United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 58

SEQ ID NO: 111071 - DNA, 2802 bp, Artificial Sequence
  Description of Artificial Sequence: Synthetic coding sequence
atggatgactccgaagtcgaaagcacggccagtattctcgcctcggtgaaggaacaggaggcccagtttgagaaactgactagagcccttgaagaggaaaggaggcacgtctccgcacagcttgaacgggtccgggtgtctccccaggatgcgaatcctctaatggccaacggcaccctgactaggagacaccagaatggcagattcgtgggcgatgctgatctggagcggcagaaatttagcgatcttaaattgaacggaccccaggatcattcccatcttctgtacagcactataccccgcatgcaagaacccggacagatcgtcgaaacctacacggaagaggacccagagggcgctatgagcgtagtgtccgtagagactagcgatgatgggaccacgcggcgcactgaaaccaccgtgaaaaaggtcgtcaagactgtcacaaccaggactgtacaaccagtggccatgggcccagacggcctcccggtcgacgcctcaagcgtctccaataactacatacagaccctggggagagattttcgcaaaaatggcaacggggggcccggcccctacgtaggccaagcaggcaccgctactctccccaggaacttccactatcctcccgacggatatagtcgacattacgaagatggatacccaggcggcagtgataactatggcagcctctctagggtgaccaggatcgaagaacggtacaggccctccatggagggctacagagctccttccaggcaagatgtctatgggccacagccccaggtaagggtcggaggctcgagcgtggacttacatcgcttccatccggagccatacggcctagaggacgaccagagatccatgggttatgatgatttggattacggtatgatgtcggactacgggacagcacggcggaccggaacaccgtcagaccctcgcagacgacttcggtcctatgaagatatgatcggagaagaggtgcccagcgaccagtactattgggcgcccctcgcacagcacgagagggggtctctggcaagcttggactctttaagaaaggggggacccccccctcccaattggagacagcctgagctgcccgaagttattgccatgctgggattccgcctcgatgccgtaaaaagcaatgccgccgcctacctgcagcacctgtgctaccgcaacgataaagtgaagacagatgtgcggaagctgaaagggattcctgtgctggtgggcctgctggaccatccaaagaaggaggttcacctgggtgcttgtggcgcccttaaaaacatcagtttcggtagagatcaagacaataagattgctatcaagaactgtgacggtgtgcctgcactggttagactgttgagaaaggccagagatatggacttgacagaggtcatcaccggaacgttgtggaatctatccagccacgactccataaaaatggagatcgttgaccacgctcttcacgctctgactgacgaggtcattatcccacattcaggctgggagcgggaacccaatgaggactgcaagccgcgccacattgagtgggagagtgtcctgactaataccgctggatgcctgcggaacgtttccagtgagcggagcgaggcccgtaggaagttgcgggagtgcgatgggctggtggacgctttaatttttatagtccaggccgagattggtcagaaagacagcgactcaaagctcgtcgaaaactgcgtgtgcctgctacgaaatctcagctatcaggtgcaccgcgagattccacaagccgaaaggtatcaggaagcagctccgaacgtcgcaaacaatacaggaccacacgcagcctcttgctttggcgctaaaaagggcaaaggaaagaaacccattgaagaccctgcgaacgatacggttgatttccccaagaggacaagccctgcccggggatacgaactgctcttccagcctgaagtggtccggatttacatatccctgctgaaggaaagtaaaactccggcgatcttagaggcaagcgccggcgctatacagaacctgtgcgccggacggtggacttacggtcggtacattagatctgctctacgacaggagaaagccctctcagcaatcgctgatctgcttactaatgaacacgagcgcgtcgttaaagcagcttccggcgcgctgagaaatctggctgtggacgcacgcaacaaggaactcataggaaagcatgcaatacccaatctagtgaagaaccttccaggcggccagcagaatagcagttggaactttagcgaagacacagtgatttctatcctgaacactatcaacgaggtgatcgctgagaatttggaagcagccaagaagttaagggagactcagggaatcgagaaactggtgttgattaacaaaagtggaaatcgaagtgagaaagaggtgcgcgcagcagccctcgtacttcagacaatctggggatacaaagagttgagaaagcccctcgagaaggaggggtggaagaagtctgacttccaggtaaacctgaacaatgccagtaggtcgcagtcctctcactcttatgatgactccacattgcccctgatcgaccgaaatcaaaagtctgataaaaaaccagatcgagaggagatccaaatgtcaaacatgggcagcaatacaaagtcacttgataacaactacagtacccccaatgaacgcggcgatcacaaccgtaccctagatcggtcgggtgacctaggggacatggagccactgaagggcactacgcccctgatgcagaaaatctag

SEQ ID NO: 111072 - DNA, 2817 bp, Artificial Sequence
  Description of Artificial Sequence: Synthetic coding sequence
atggacgacagcgaggtggaaagtaccgcttctattttagccagtgtcaaggagcaggaggcacagtttgagaagttgaccagggcacttgaagaagaaaggagacacgttagcgcacaattggaacgcgtgagagtcagcccccaagacgcaaacccactgatggccaacggaacactgacgcggcgccaccagaatggacggttcgtgggcgacgctgacctggagaggcagaagttttcagatctcaagctcaacgggccgcaggatcatagccacctgctgtacagtacaattccacggatgcaagagcctggtcaaatcgtagagacgtatacagaggaggacccagagggagccatgtccgtggtctcggtggagacttcggatgatgggaccaccaggaggaccgaaacaacggtgaagaaggttgtgaagacagtcacgaccaggaccgtccagccagtcgcgatgggacccgatgggctccccgtggacgcttctagtgtgtctaacaattacattcagacactgggcagagactttagaaagaacggtaacggcgggcctggaccatacgtagggcaagctggcacagccactttgccgcggaattttcactatccgcccgacgggtactccaggcattatgaagacgggtaccctggcggatcagataattatgggagcctctccagagttacgcggatcgaggagagataccgccccagcatggaggggtatagagccccaagtcgacaggatgtttatggcccccagccacaagttagggtgggtggatcatcggtggatctgcataggtttcacccggaaccttacggcctcgaagacgatcagcgatccatgggatacgacgatctcgactacggaatgatgagtgactatgggaccgcccggagaaccggaacaccttcagatcccagaagacggttgcggtcttacgaggacatgataggagaagaggttccaagcgaccagtactactgggcccccctggcgcagcatgagagaggcagccttgcatcactggattccttgagaaagggcgggccgccacctcctaactggcggcagcccgagctgccggaggtcatagcaatgctcggctttagactcgatgccgtgaagtcaaacgccgctgcctacctgcaacatctgtgctatcgcaacgacaaggttaaaaccgacgtgaggaagctaaaggggattcccgtactagtgggcctcctcgaccacccaaagaaggaagtgcaccttggagcctgcggagcgctgaaaaatatctcttttggccgtgatcaagacaataaaatcgctattaagaattgcgatggcgtgccagctctggtccggttgctccgcaaagcgagagatatggatcttacagaggtcatcaccggcacattgtggaatctcagctcgcacgattcaatcaagatggaaatcgtcgatcatgcattacatgctctgacagacgaggtgataatcccacacagcggttgggagagggagcccaatgaagattgtaagccgcgccatatcgaatgggaaagtgtactgacgaataccgccgggtgtctgcgtaacgtctcatctgaacgctccgaggcacgcaggaagctacgcgagtgcgacgggttagtcgatgcactcatcttcatcgtgcaggccgagatcggccagaaagactctgattcgaaactggtcgaaaattgcgtgtgcttactgcggaatctgagctaccaggtgcatcgggaaatccctcaggcggaacgctatcaggaggccgctcctaatgtcgcgaataatactgggccccatgccgcaagttgttttggggcgaaaaaagggaaggacgagtggttctcgagaggcaagaaaccgattgaggaccctgcaaacgacaccgtggactttccaaaacgtacctcacccgccagaggttatgagcttctgttccaacccgaggtggtacggatttacatcagtctcctgaaagagtctaaaacccccgctattttggaagccagcgccggggcaatccagaacctgtgtgccgggcggtggacatacggccgctatattcgatccgcattgcggcaggaaaaggccctttctgctattgccgatctactcaccaatgagcacgagcgtgtcgtcaaggctgcatctggcgccctgcgcaacctcgccgtggacgccagaaacaaagaactgatcggcaagcacgctattccaaacctcgttaagaacctcccaggtggccagcaaaacagttcttggaatttcagcgaggacacagtcatttctattctgaacacaattaatgaggtaattgcggagaacttggaggcagccaagaagttaagggaaactcaaggtattgagaaattagtgctaattaataaatccgggaacaggagcgaaaaggaagtgcgtgccgccgccttagttctgcagacaatttgggggtataaagagctgcggaagccactggagaaggaaggatggaaaaaatccgattttcaggttaacctgaataatgcgtcccgctcacagtctagccattcctacgatgactccacactgccgctcatcgatcgtaatcagaagtcagacaagaagcctgacagagaggagatccaaatgtctaatatggggagcaatacgaagtccctggataacaactatagcactccgaacgagaggggcgaccataaccggactttggatcgctctggagacctcggcgacatggaacctctgaagggaacaactcctctgatgaaaatctag

SEQ ID NO: 111073 - DNA, 2907 bp, Artificial Sequence
  Description of Artificial Sequence: Synthetic coding sequence
atggacgatagtgaggtggagagcacagcctccattctggcctccgtgaaagagcaggaggcacagttcgagaagctcacccgggccttagaagaggagagacggcatgtatctgcgcaattggagcgtgtgagagtctcaccccaagatgctaatccactgatggccaatggcaccctcacgagaaggcatcagaacggacgatttgttggagatgctgatttggaaagacagaagttcagtgacctgaagctgaatggaccccaggaccattcccatcttctctattccactattccacgcatgcaggaaccaggacagattgtagagacttatacagaggaagatccagaaggcgcaatgtcagtggtgagcgtggagacctccgatgacggtacgaccaggcggactgagacaacagttaaaaaagtggtaaaaacagtgacaactcgtactgtgcagccggttgcaatggggccagatggactgccagtggatgcctcgtcagtcagcaataactacattcaaaccctgggcagggatttcagaaagaacggcaatggcggacctggaccgtacgtgggccaggccggcacagcaaccctgccccgtaacttccattacccccccgacggctactctagacactatgaggatgggtaccctggtggttcagacaattacggtagcctgagccgggtaacaaggatagaagagagatatcggcccagtatggaaggatatagagctccaagccgtcaggacgtctatggccctcaaccacaggtgcgcgtgggaggtagcagcgtggaccttcatcgtttccaccccgagccttatggcctggaagatgaccagcgcagtatgggctacgatgatttagattacgggatgatgtctgattatgggactgcccgccgcacagggacaccttccgatcccagaaggcggctgcgcagctacgaggacatgattggtgaggaggtgcccagtgaccaatactactgggcgcccctggcccagcatgagagaggatcactagcctcattagacagtttgagaaaaggaggccccccccccccaaattggcgacaacctgaacttcctgaagtaatcgcgatgttagggttcaggctggacgcagtgaaaagcaatgcggctgcctacctacaacatctctgctatcgtaatgataaagtaaagacagatgttaggaaattgaaggggattcctgtgttggtaggcctgttggaccatcccaaaaaggaggtacacctgggagcatgtggggctctgaagaacatttcttttggcagagaccaagataacaaaatcgccatcaagaactgcgacggtgttccagcgcttgttagactattgcgaaaggcaagggacatggatttaaccgaggtaatcaccggaactctatggaatttaagcagccatgactccatcaagatggagattgtagaccatgccttacatgcgttgactgacgaagttatcatccctcattcgggatgggagcgagaaccaaacgaggactgcaaaccccggcatattgaatgggaaagtgtgctaactaacacagccggatgcctgcggaacgttagcagtgagcgatcggaagcgcgcaggaaattgcgcgagtgcgatgggctggtggacgcgttgatatttatcgtccaggcagagattggccagaaggatagcgactccaaacttgtggagaactgcgtctgcttacttcgtaatctgagctatcaagtgcacagagagatcccccaggccgaaagataccaggaggccgcacccaacgtggctaacaacacaggtccccatgccgcttcttgctttggagctaaaaagggtaaggacgaatggttctcgcgcggcaagaaaccaattgaggaccccgccaacgatacagtggatttcccaaagcgcaccagccctgcccgggggtacgagctgctctttcagccagaggttgtgcgaatctatatatccctcctgaaggaaagtaagactcccgctatactcgaggcatcagctggcgccatccagaatctgtgtgccggtagatggacctacggccgctacatccgatcagccctgcgtcaagaaaaagctctctccgccatcgccgatctgttaaccaacgagcacgaaagggtggtcaaagctgcctcgggggcactccgaaatctcgctgttgacgctagaaacaaggagcttattggaaagcacgccatccccaacctcgttaaaaatttgcctggcggacagcaaaattcctcttggaactttagcgaagacaccgtgatcagcatcctgaacacgatcaatgaagtcatcgccgagaacctagaagctgccaagaagctgcgtgaaactcaggggatagaaaaattagtattgattaataaatccggaaataggagcgaaaaagaagtgcgtgcggcagccttggtcttgcagactatttgggggtataaagaactgcggaaaccgctcgaaaaagagggatggaagaaatctgactttcaagtgaatctgaacaacgcaagccgcagccagtcctcacattcctatgacgactctacattacctctgatcgaccgaaaccagaagtctgataaaaagcccgatcgagaagagatacagatgagtaacatgggaagcaacaccaaatccttggataataactacagtacccccaacgagaggggggaccacaatcgcactctggacaggagcggtgacctgggtgacatggaaccgctcaaggggaccacaccgctcatgcaggacgagggtcaggagtccttggaagaggaactggacgtgttggtgctggacgatgaaggagggcaagttagctacccttcaatgcagaaaatttag

SEQ ID NO: 111074 - DNA, 2604 bp, Artificial Sequence
  Description of Artificial Sequence: Synthetic coding sequence
atgcaggagccgggtcaaatcgtggagacctacacagaggaggacccggagggcgcaatgtctgtcgtgtccgtggagacttccgacgacggcactacacggcgcacagaaacaactgttaagaaggtggttaagactgtgaccactcgaacagtgcagcccgtggcgatggggccagatgggctccccgtggacgcctcaagcgtgtctaacaactatattcagacgctcggacgggacttcaggaagaatggtaacggggggcctggcccatacgtggggcaagctggtaccgcgacactgccgcggaattttcactatccccccgatggctacagtcgccactatgaggacgggtaccctggcggctctgataactacggtagcctgtcccgtgtaacccgaattgaggaaagatatcgcccatccatggagggatatcgggccccatctaggcaggatgtgtatggcccccaaccccaagtgagggtggggggcagcagcgtcgacctccaccgatttcacccagaaccatacggattagaggacgaccaacgaagcatggggtacgacgatcttgactatggaatgatgtccgactacggcacagcgcgtcgtaccgggacacctagcgaccctagaaggagattgaggtcctacgaagacatgatcggcgaggaagtaccttccgaccagtactattgggcccccttggcacagcacgaaagaggctccctcgcctctctcgactctttgcggaaaggaggaccacccccccctaactggagacagcccgaattgccagaggtaatcgcaatgctgggttttcggcttgatgcagtgaagtcaaatgccgctgcctacctgcagcacctgtgttaccgcaatgacaaagtgaaaaccgacgttcgtaagttaaagggcataccagtcctggtcggccttctagatcatcctaagaaggaagtccatttaggggcctgcggggcactcaaaaatatatcctttggcagagaccaggacaacaaaatagctattaagaactgcgatggcgtgcccgcgttggttcggctgctgcgtaaggcgagggacatggatctgactgaagtgattaccgggacgctctggaatctgtcatctcatgattcgataaaaatggaaattgtggaccatgccttacacgccctgactgacgaagtcataattcctcatagtggctgggaaagagagcctaatgaggattgcaaaccgcggcatatagaatgggagagcgttcttacgaacaccgccgggtgcctgcggaatgtgtcctctgagcgctctgaggctaggcgaaagctaagagaatgcgacggcctggtcgacgctttgatctttatcgtgcaggccgaaataggacaaaaggactcagactccaagcttgtggagaactgtgtatgcctgttgcgcaatttgtcctaccaagtgcatcgggagatcccccaggccgagaggtatcaggaagcagcgccgaacgttgcaaacaatacgggtcctcacgcagcttcttgcttcggtgctaagaaaggaaaggacgaatggttctcgagggggaaaaagcccattgaggaccccgcaaacgacactgtcgactttcctaagagaactagccccgccaggggctatgagttgttgttccaacccgaggtggttagaatatacatcagcctcctgaaagaatccaagacgcctgccatattggaggcctctgcaggcgcgattcagaacttgtgcgccggccggtggacatatggtaggtatatccgcagtgcactgcgacaagaaaaagcactgtcagccattgcagacctgttaaccaacgaacatgaaagggttgtaaaggccgcaagcggggctctccgcaatctggctgtggacgcccgcaacaaagaactaatcggaaagcatgccattccaaaccttgttaaaaatttgcccggagggcagcaaaactcaagctggaattttagtgaggacacggttatcagtattctaaacacaattaatgaggttatcgcggaaaacctggaggctgccaagaagcttagggagacacagggcatcgagaaacttgtgctcatcaataagtcaggtaaccgatctgaaaaagaagtaagggccgctgcgcttgtgcttcagaccatttggggttacaaagagttaaggaagcccttggagaaagagggttggaaaaagagcgacttccaggttaatctgaacaacgcctcacgatcccagagctcgcattcttatgacgactctacattgcccctaatcgatcgcaaccaaaagtctgacaaaaagcctgatcgggaagagattcagatgagtaacatggggtccaatacaaaatcattagacaacaattacagtaccccgaacgagcgcggtgaccataaccgcacacttgataggagtggggacctgggcgatatggagcccctgaaaggcaccaccccactcatgcaagatgaggggcaagaatccctagaggaggaacttgatgtcctggtgcttgacgacgaaggaggacaggtgtcctatccgagcatgcaaaaaatttag

SEQ ID NO: 111075 - DNA, 2499 bp, Artificial Sequence
  Description of Artificial Sequence: Synthetic coding sequence
atgcaagaacctggacagattgtcgagacatacactgaagaggatcctgagggcgcaatgagtgtggtctcagtagaaacctccgacgatgggacgacgcggcggaccgagactaccgtgaaaaaagtggtcaagaccgttactacgcggactgtgcagccagtcgctatggggcctgacggtttgccggtggacgctagctccgtaagcaacaactacattcagactttaggacgcgattttaggaagaacggaaacgggggacctggaccttacgtcggccaggctggcacagctaccctgccaaggaacttccattaccctcctgacgggtactccagacactatgaggatggatatcctggaggctccgataactatggatcactttccagggtaaccagaattgaggaaagataccggcccagtatggagggctatcgggctccttctcgccaggatgtgtatgggcctcagccgcaggtgagggtggggggctcttctgtggacctgcaccggtttcaccctgagccctacggattagaagacgaccagcgatctatgggttacgacgatttggactacgggatgatgtctgattacggcacagctagacggacgggaacccctagcgacccacgccggcgccttcgtagctatgaggatatgatcggtgaggaggtgcctagcgatcagtactactgggctccgctggctcagcacgagcgaggatcattggcttccctggactcactccgtaaggggggccccccccctcccaattggaggcagccagaactgcccgaggtcatagctatgctcggctttcggctggacgcagtcaagtccaatgctgctgcctatctgcagcatctgtgttataggaatgacaaggtgaaaacagacgtcagaaagcttaagggcatccctgtgctggtgggcctgctcgatcacccaaaaaaagaggtacatttaggtgcctgcggagccttaaaaaatatatcctttggacgcgatcaagataataaaatcgcgattaagaattgtgacggtgtaccggctctggtacgtctattaaggaaagctcgcgatatggacctgacggaggtcatcactggaaccctgtggaacctgtcctcacatgattcgatcaaaatggagatcgtcgaccacgccctacacgccctgacggacgaagtgataattccacatagtggatgggaaagagagcccaatgaggactgcaagcctcgtcatattgagtgggaatccgttctgacgaacactgctggttgcttgcggaacgtgtcctccgagaggagcgaggcaagaaggaaattacgagagtgtgatgggcttgtcgacgctctgatcttcattgttcaggcagagatcggccagaaagattccgatagcaaattagttgagaactgcgtgtgtctgttgaggaacctttcgtaccaggtgcacagagaaatcccccaggctgagagataccaggaggccgcacctaatgtggcaaacaacacgggacctcacgccgccagttgcttcggcgcaaagaaaggtaagggtaagaagccaattgaagatcccgctaacgacactgtagatttccccaaacgtacctctccggcgcgaggctacgagttgctcttccagcctgaagttgttaggatatacatatcactgcttaaagagagcaagacaccagcaatactggaagcctcagcaggcgcaatccaaaatctctgtgccggcaggtggacctacggcagatatattcgttcggctctgaggcaggaaaaagcgctctcggctattgccgacctgctaacaaacgagcacgagagggtcgttaaagcggcctctggagccctccgtaatttggctgttgacgcaaggaataaggagttaattgggaagcacgccatccctaacctggtgaaaaacctcccaggaggccagcaaaatagctcttggaatttcagcgaagacactgtgatctcaatcttgaatacgataaatgaggttatcgccgaaaatctggaggctgccaaaaagctgagggagacccagggtatcgaaaagcttgtgctaatcaacaaatcagggaaccggagtgagaaggaggtgcgagcagcagctctggtcttgcagactatctggggatacaaggaactccgcaaacctctggaaaaggagggttggaaaaagagtgactttcaggtgaacctcaacaatgcttcgagatcacaatcgtcccattcatacgacgatagcacattacccttaatcgaccggaaccagaaatccgacaaaaagcccgacagggaggagattcagatgagcaacatggggagcaatacaaaaagccttgacaataactattcgactcctaacgaaagaggcgaccataaccgtaccctggatcgtagtggcgatctgggagatatggaacctctgaaagggacaacacctctgatgcagaagatatag

SEQ ID NO: 111076 - DNA, 2802 bp, Artificial Sequence
  Description of Artificial Sequence: Synthetic coding sequence
atggacgattccgaagttgaaagcaccgcaagtatcctggcctcagttaaggagcaggaggcccagttcgagaagttaacaagggctctggaagaagagcggcggcatgttagtgcacagcttgagcgcgtccgcgtgtcaccacaggacgccaatcccctgatggctaacggcaccctgactcgcagacaccaaaatggccgttttgtaggagacgcagaccttgaacgccagaaattcagcgatctgaagttgaacggaccgcaagaccacagccacctcctttactccactataccaaggatgcaggagccaggacagatcgttgagacatacacagaagaagatccggagggcgctatgtcagttgtaagtgtagagacttccgatgacgggacaacacgccgaacggagactaccgtgaagaaagtggttaagacagtgacaacaagaaccgtgcagccagtcgctatgggtccagatggtcttcctgtggacgcttcatccgttagcaacaactatatacaaacactgggaagggactttcggaagaatgggaacgggggccctggcccttacgtggggcaggctgggacggccacacttcctcgaaactttcattacccccccgatgggtactcgaggcactacgaggatggataccccggaggcagcgacaattacggaagtctgtctagggtcacacgcattgaggagagataccgaccctctatggagggttacagggccccttcgagacaagacgtgtacggaccacaaccacaggtgcgggtggggggctcttctgtggaccttcaccgttttcatcccgagccttatggtcttgaggacgaccagcgatctatgggatatgatgacctggactacggcatgatgtcggactatggaacagctagaagaaccgggactcccagcgacccgcggcgccggctccgaagctatgaggacatgataggagaggaggtcccgtcagaccaatattactgggcacccctggcccaacatgaaagaggttcactggcctctctggacagtctcaggaaggggggcccacctccacccaattggcggcagcctgaattgccagaggtcattgctatgttgggatttcgcctggacgctgtaaaatctaacgctgctgcttacctccagcacctctgttaccggaatgacaaggtaaaaactgatgtgagaaagctcaagggcattccagtcctggtgggcctgctcgaccacccaaaaaaggaagtgcaccttggcgcatgcggagccctcaagaatatcagtttcgggcgggaccaggataacaaaattgcgattaagaactgcgatggggttcccgctctggttagactgctccgaaaggccagagacatggacttaactgaggtcataacaggcacactgtggaacttgtcttcccacgactctattaagatggaaatcgttgaccacgcgctgcacgctcttaccgatgaggtgataattcctcactctggctgggagcgggagcccaatgaggattgcaaacctcgacatattgaatgggagtccgtgctgacgaataccgcgggatgtctgcgcaacgtctcctctgagaggagcgaggcccggagaaagttgagggaatgtgatggacttgttgacgcactgatctttattgtccaggctgagatcggtcagaaggattccgactctaaacttgtcgagaactgcgtgtgcctgttacgcaatctctcgtaccaggtgcaccgagagatcccccaggcagagaggtaccaagaggcagcaccaaacgtggcaaataatacaggcccccacgccgcgtcctgtttcggcgctaagaagggaaaaggaaaaaagcccattgaagatccagcaaatgatactgtggacttccctaagcgtacctctccagcaaggggctacgaactcctgtttcagcccgaagtagttcggatctacattagtttgttgaaggagtccaaaactcccgcgatcctggaagcctccgccggagccattcagaatttgtgcgccgggcgatggacttacgggaggtacattcggtccgcgctcagacaggagaaggctctgtcggctattgcagacctcctcacaaacgagcatgaacgtgttgtcaaggcagcctctggcgctcttagaaacctggccgtagatgccaggaataaggaactgattggaaagcacgcgatccccaatctggtaaagaacctgcccggtgggcagcagaatagcagctggaacttctcagaggacacggtgatcagtatcctgaatacgatcaatgaggttatcgcagagaatctggaagccgcaaaaaaactccgggaaacccagggtatcgaaaaacttgtgctgatcaacaaatcgggaaacagatctgaaaaagaagttagggccgctgccttagttctgcaaacaatctggggttataaagagctgcgaaagccacttgagaaggaaggctggaaaaaatcggattttcaggtgaatttgaacaacgcaagccggtctcaaagcagccatagctatgacgattcaacgctgccgctgatcgacaggaaccaaaaaagtgacaagaagccggaccgggaggagatccagatgtctaacatggggtcgaatacaaaaagcctggataataattactccactccaaacgagagaggcgaccataatcgaaccctggataggtccggggatcttggagatatggagcccctgaaaggaaccaccccactaatgcagaaaatctag

SEQ ID NO: 111077 - DNA, 15 bp, Artificial Sequence
  Description of Artificial Sequence: Synthetic coding sequence
atggatgactcctag

SEQ ID NO: 111078 - DNA, 2802 bp, Artificial Sequence
  Description of Artificial Sequence: Synthetic coding sequence
atggacgattcagaagttgagagtactgcgagcatcctcgcgtcagtgaaggaacaagaagcacagtttgagaagctgaccagggctctggaggaggaacgcaggcatgttagcgctcagttggagcgggttcgcgtcagtccccaggacgccaatcctctcatggccaacggcaccctcaccagacggcaccaaaatggtagattcgtcggtgatgccgacctagagcgtcagaagttttccgaccttaaactgaacggcccccaggatcactcgcacctgttgtacagcacgattcccaggatgcaggagcccggccaaatagtcgagacttataccgaggaagacccagagggcgctatgtctgtagtgagtgtggaaacatcggacgacgggaccactcgtagaacagagaccaccgtcaagaaagtcgtgaaaacagtaacaactcggaccgtccagcctgtggcaatgggccctgacgggctgcccgtggatgctagctctgtttcaaacaactacattcagaccctggggagggactttcgcaaaaatggcaacgggggtcccggcccgtatgtcggccaagccggcaccgctacactacccaggaactttcattatccccccgatggctattcacgacattatgaagacgggtatccaggcggcagcgacaattacggtagtctctctagggtgacaagaattgaggaaaggtacagaccaagtatggagggttaccgcgcccccagccggcaggacgtgtacggcccacaaccgcaagtgagagtgggcggcagtagcgttgacctgcataggttccaccccgaaccctacggtcttgaagatgaccagcgaagtatggggtatgatgatctggattacggaatgatgtcggattatggtaccgcaagacgcaccgggacccctagcgatcctaggaggaggctgcggtcatatgaggacatgatcggggaagaagtgcccagcgatcaatattattgggcccccctggcccagcatgaaagagggtccctcgcctcccttgacagcttgcggaagggcggacctcctccccccaactggcgccagcctgagctgcctgaagtcatagccatgctgggctttcgactggacgcagtgaagtcaaacgcagctgcctatctgcaacacctgtgctacaggaacgataaggttaaaactgacgtgcgaaaacttaaaggcatcccagtgttagtaggacttctggatcatcctaagaaagaggttcacctcggtgcttgcggggctctgaaaaacataagtttcggacgagatcaggacaataagattgctatcaaaaactgtgatggcgtacctgctttagtgaggctccttagaaaagcacgcgatatggatctgacagaggtcattacgggaactctttggaacctgagttcacatgactctatcaaaatggagatcgtcgatcatgcacttcatgcgttgaccgacgaagttattattcctcattcaggctgggagcgggaacccaatgaggactgtaaaccccgccatatagagtgggagagcgtgctgaccaacacagctggatgtttgcgcaatgtcagcagcgaacgctcagaggcccgccgcaaactccgtgaatgcgacggactcgtagatgcactcatcttcatcgtccaggccgaaattggccagaaagacagcgacagcaagctggtggagaactgtgtatgtctgttacggaacctgtcctaccaggtccacagggagataccgcaagccgaaagatatcaggaggctgctcccaacgtcgctaataatactggacctcatgcggcgtcctgctttggtgcgaaaaaaggtaaggggaaaaagccaatagaagacccggcgaatgataccgtggatttcccaaagcgcacatctccagctaggggttacgagctccttttccaacccgaggtggtgagaatctacatctcactgctgaaagagagcaagacaccagcaattctggaagcatccgccggggcaattcagaacctatgtgcaggccgttggacctatgggagatacatcagatccgctctgagacaggagaaagccttgtccgccatagcagatctactgaccaacgagcacgaacgcgtggtgaaggctgcatctggagctctgcgaaacctggctgtggatgcacgcaacaaagagctgattggcaagcacgccatcccaaacctagtcaaaaatctacctggtggacaacagaattcctcatggaatttctctgaggacactgtaataagcattcttaacacaattaatgaagtcatagctgagaatttggaagccgctaaaaaactcagagaaacacaggggatagagaagcttgtcctcattaacaagtccgggaaccggtccgaaaaggaagtgcgcgcagcagccctggtccttcagacaatttggggatacaaagagctgaggaagcctctggagaaagaaggctggaagaaatcggatttccaggtaaacctcaataacgccagtcggtcccagagctcgcatagttatgacgatagtaccttacctctgatcgatcgcaatcagaaaagcgataaaaagcctgatcgtgaggagatacaaatgagcaatatggggtcaaacactaagagcttggataataactactcgactcccaacgagagaggtgatcacaatcgtacgctggatcggagcggcgacttgggagacatggagcccctaaaaggcacaacgcctctcatgcagaaaatttag

SEQ ID NO: 111079 - DNA, 1851 bp, Artificial Sequence
  Description of Artificial Sequence: Synthetic coding sequence
atgatcggagaggaggtgccctccgaccagtattactgggcccccctcgcccaacatgagcgaggttctctcgcttctcttgactctctgcgaaagggtggaccacctcccccgaattggcgacagccagaattaccggaagttatcgccatgctcggttttaggcttgacgccgtgaaatccaatgccgccgcttacctacagcacttgtgttacagaaacgacaaagtgaaaaccgacgtcagaaagctgaaggggatcccagtactggtcggactcctggatcaccccaagaaggaagtacatctgggcgcctgcggagcactgaaaaacatctctttcgggcgcgaccaagataacaaaatcgcaattaagaactgtgacggagtccccgcgcttgtgagacttctgcggaaagccagagacatggatctcaccgaggtgatcaccggaactctgtggaacttgagctcccatgacagcattaaaatggaaattgtcgaccacgctctgcatgcccttacggacgaggttattatcccacattctgggtgggagcgagagcctaatgaggactgtaaaccgcggcatattgaatgggagtctgtactcactaatactgcagggtgcctgcgaaacgtatccagtgaacgttccgaagcaaggaggaaactaagggagtgcgatggcctagttgatgctcttatttttattgtgcaggccgagataggtcaaaaggactccgactcaaagctggtcgagaattgtgtgtgtctcctgcgcaaccttagttaccaagtccatagagagatcccacaggcagagagatatcaggaggccgcacccaatgtggctaataacactgggccccacgctgcctcgtgcttcggggcaaaaaagggaaaagacgagtggttctctcgcggcaagaaaccaatcgaggaccctgccaatgataccgtggatttcccaaagcggaccagccccgccagaggctacgaactcctgtttcaaccagaggtggtccggatctatatttccctgcttaaggagtcaaagacaccagctatcctagaagccagcgcaggcgccattcagaatctgtgtgccggacgctggacctacggaagatatattagatcagccttgaggcaggagaaggcgctgtcagcaatcgccgatttattgaccaacgagcacgaaagagtggtcaaagcagcatcaggagctttgcgtaatttggcagtcgatgctcggaacaaagaactgattggtaagcatgccatcccaaaccttgtgaagaatctgccaggcgggcagcagaactccagttggaatttcagcgaggatacagtgatctcaattctgaataccattaacgaggtaatcgctgagaacctagaggctgccaagaagcttcgcgagacgcagggaattgagaagctcgtgcttatcaacaagtctgggaatcgaagtgaaaaagaggtgcgtgcggctgctctcgtccttcagacaatttggggttacaaggagttacggaagccgcttgagaaggaaggttggaaaaagtcggacttccaggtgaatttgaataacgcatcccgttcgcaaagcagccactcctatgatgatagcacactgcctctgattgatcgcaatcaaaagtctgataagaaacctgatcgggaggaaatccagatgagtaatatgggatccaataccaaatcgctagataataactattccacacccaatgagagaggagatcacaaccggaccctggatcgctcgggggacttgggggacatggagcccctcaagggaactacccccctaatgcaaaaaatctag

SEQ ID NO: 111080 - DNA, 2727 bp, Artificial Sequence
  Description of Artificial Sequence: Synthetic coding sequence
atggcgaacggcactctgaccagacgccaccagaatggtcgatttgttggtgatgccgacctagagcgacagaagtttagcgatcttaaactgaatggcccacaagatcatagtcatctgctgtacagtacgatcccacggatgcaggaaccaggacaaatcgtggagacgtacacagaagaagaccccgagggtgctatgagcgtggtgtctgtcgagactagcgatgacgggacaaccagacgcactgagactaccgttaaaaaagtcgttaagacagtgaccacccggacagtgcagcccgtcgccatgggcccagatggactccccgtggatgcctccagtgtgtccaacaattatattcagacgctgggaagagattttcgtaagaatggtaatgggggcccaggcccatatgttgggcaagccggtaccgctacactgcctcgtaacttccattacccccctgacggatatagcaggcattacgaagacggttacccaggcggcagcgacaattatgggtctttgtcaagagtgacccggattgaggaacgctaccgcccatcgatggagggctatcgcgcaccatctcgccaagatgtatacggtccacagcctcaggtaagggtgggaggatccagcgtcgatttgcacaggtttcaccctgaaccatatgggctcgaagacgaccagaggtcgatgggatacgatgatctcgattacggtatgatgagcgattacgggaccgctagaaggaccggcacgcctagcgatccacggcgtagactccggtcttatgaggatatgattggtgaggaagtaccctctgaccaatactactgggctccattggcgcaacacgaacggggatctctggcatccctggatagccttcgcaaaggagggcctcctccaccaaattggcgtcagccggaattgcccgaggtgatcgccatgctaggattccgacttgatgccgttaagtcaaatgccgcagcctacttacagcacctgtgctatagaaacgataaggttaaaactgacgtgaggaaactgaaaggcattcccgtgctggtggggctcctcgaccaccctaagaaggaggtccatctcggagcctgcggagctctgaagaatataagctttggccgggatcaggacaacaaaattgccattaagaattgcgatggcgtcccggcactcgtcagacttctccggaaggctcgggatatggacctaaccgaagtgatcaccgggactctgtggaacttatccagccatgacagcatcaaaatggagatcgtggaccatgcactgcacgcccttaccgatgaggttattatcccccactcaggctgggagcgcgagcctaatgaggattgcaagccacgtcacatcgagtgggaatccgtactgacgaataccgctggatgtttgaggaacgtcagttctgagagaagtgaagcccgtcgtaaactccgtgaatgcgatggtttggtcgacgcgctgatattcatagtccaggctgaaatcggacaaaaagactctgatagcaagctggtcgaaaattgtgtttgccttctaagaaatctgagctatcaggtgcatagagaaatcccccaggccgaacgctaccaagaggccgcacctaatgtggccaacaacacagggccacacgccgctagctgctttggcgccaaaaaaggcaagggcaaaaagccaattgaagatcccgccaatgataccgtagactttcccaaacggactagtcccgcacgtggttatgaattgctgtttcagcccgaagtcgtgagaatctatatcagtctgctgaaggaaagtaaaacaccggccattctagaagccagcgccggcgccatacagaacctttgcgcggggcggtggacttacgggcgctatattagatcagctctgagacaagaaaaagccctctcagctatagctgacttgctcaccaatgagcacgagcgagtggtcaaggccgctagtggagccctcaggaacctcgcagtcgatgccagaaacaaagagctcatcgggaaacacgctatcccaaatctggtcaagaacctgccaggaggccaacagaattcctcgtggaattttagcgaagatactgtgatctccattttgaacaccataaacgaggtgatagccgaaaatttagaagccgcaaaaaagttacgcgagactcagggcatcgaaaaattggttctcattaacaagtctggaaacaggagtgagaaggaggtgagggcagcggcattggtgctgcagaccatatggggttacaaagaacttcggaaaccactcgagaaggaggggtggaaaaagagtgatttccaggtcaacctaaacaatgcttcaaggagtcaaagttcacacagctatgatgacagtaccctgccgctgatagatcgtaaccagaagtctgacaaaaaacccgatcgagaggaaatacagatgtcaaacatggggagtaataccaagtcgctcgataataactattctacgcccaacgagaggggggatcataatcgcactcttgacagatctggggacttgggggacatggaacccctgaagggcaccacccctctgatgcaggatgaaggccaggagagtctggaggaggagctggatgtgctcgtgcttgacgacgaggggggccaagtttcttaccccagtatgcaaaaaatctag

SEQ ID NO: 111081 - DNA, 1833 bp, Artificial Sequence
  Description of Artificial Sequence: Synthetic coding sequence
atgatcggtgaggaggtcccttccgaccagtattattgggcccccttggcacaacacgagcggggctcgctcgccagcctggatagtttgcgcaaaggaggacctccacctcccaattggcgtcagccagaattgccagaagttattgctatgcttggatttcggctggacgccgtcaagtctaatgccgcggcgtacttgcagcatctgtgctatagaaatgacaaggtgaagaccgatgtgcgtaaactgaaaggaattccagtcttggtaggactgctcgaccacccaaagaaggaagtgcacctgggagcatgcggtgctttaaaaaacatatcattcggaagggaccaagataacaaaattgccatcaagaactgcgacggggtccctgctttggttaggctgttacggaaggcacgggacatggacctgaccgaggtgatcacgggcactctgtggaatctatcttcccacgattccataaagatggaaatcgtggaccatgctcttcacgccttgacagacgaggtgattattccacactctggatgggagagagaacccaacgaagactgcaagccaagacacatcgagtgggagagcgtattaaccaatacagcagggtgcctaagaaacgtgtcaagcgagcggtccgaggctcgacgcaaactgcgggaatgcgacgggctggttgacgctttgatcttcattgtgcaagcagagatcggccaaaaagattccgatagtaaacttgtggagaattgtgtctgccttcttagaaatttatcatatcaggtgcacagggaaatcccacaggcggaaagatatcaggaagctgccccaaatgtggcgaataacactggtccccacgctgcatcttgttttggcgcaaagaaggggaagggcaaaaaacccatcgaggacccagctaacgataccgtggacttccctaagaggaccagccccgctcgaggatatgagctgctgttccagcccgaggttgtgcgaatttacatatcgcttctgaaagagtcaaagactcctgcaattctggaggccagcgccggagcaatccagaacctgtgcgctggtcgttggacatacggacgctatattaggtcagccctgagacaggaaaaagctctgtctgccatcgcggatttactgacgaacgaacacgaaagagttgtcaaagccgcaagcggggccctgcggaatctggccgtagacgcccggaataaagagctaattggtaaacacgccattcccaatctcgtgaagaatctccccggcggacagcaaaactcgtcatggaatttctctgaagatactgtgatcagcatacttaataccatcaacgaggtgatagccgagaatcttgaagcggcgaaaaagctgcgggaaacccaaggaatcgaaaagctagtcctgataaacaaatctggcaacagaagcgagaaagaggtgcgcgcagccgccctcgttctccagacaatttggggttacaaagagctgagaaaacccctcgaaaaagaaggctggaagaagagtgatttccaggttaatctcaacaacgcctcccgcagccaaagttcacattcatatgatgattctacactcccactaatcgaccggaatcagaaatctgataagaagcctgatagagaggagatccagatgagtaacatgggcagtaatactaaaagcctggataacaattactctacccctaacgagcgaggagaccataataggacgctcgataggagtggagacctgggcgacatggagcctctcaagggtacaacccccctcatgcagaagatatag

SEQ ID NO: 111082 - DNA, 1938 bp, Artificial Sequence
  Description of Artificial Sequence: Synthetic coding sequence
atgatcggggaagaagttccatccgatcagtactactgggcacctcttgctcagcacgagagggggtcactcgcgagtttggatagtctcagaaaagggggtccccccccgcctaactggcggcagcccgagctgccagaggtgatcgccatgctcgggttcaggctcgacgcagtgaagtcaaacgctgcagcctaccttcagcatctatgttataggaacgacaaggtgaaaaccgacgtacggaagctgaaaggcattcccgttctagtcgggctgctcgatcatccaaagaaggaggtgcacctcggagcatgcggagcactgaagaatatctctttcgggagggatcaagacaacaaaatcgccatcaagaactgcgacggagtcccagctctggtgagacttctgagaaaggcacgggatatggatttaactgaggtcattactggaacactgtggaacctgagctcccacgatagcattaaaatggaaattgtggatcatgccctgcatgctctcacggatgaagtcattataccacacagcgggtgggaacgcgagcccaatgaggactgcaagccgcgccacatcgaatgggagtccgtgctaactaacaccgcagggtgcctaagaaacgtttctagcgaacggagcgaagctcggcgcaagctgagagagtgcgatggtttggtggatgcactcattttcatcgtgcaagctgagatcggccagaaggactccgacagcaagctggtggagaactgcgtttgccttctccgcaatctgtcttaccaggtccatagggagattccacaggccgaacggtatcaggaggctgcccccaacgtggccaacaatactggaccccatgccgcatcttgctttggagccaagaaaggcaaagacgagtggtttagtagggggaaaaaacctatcgaggatccagctaacgatactgtagattttccaaagaggacatccccagccaggggctacgaacttctgttccagcctgaagtggtaagaatttatatttctcttctgaaggagagcaagacccctgccattctcgaagcaagcgccggcgccatccagaacctatgcgcgggccgatggacctatgggagatacatcaggagcgcgctgcgccaggagaaggcactgtctgccattgctgacctactaaccaacgaacatgagagagtggtaaaggcagcgtcaggcgcgctgaggaacctggctgtggatgccagaaacaaagagctcattggcaagcatgcaatcccaaatctagtcaagaaccttcccggtggacagcagaatagtagttggaatttcagtgaggacactgtaatctccatcctgaacacgatcaacgaggttatagcagaaaacctggaggccgctaaaaaactgagagagacacagggcatcgaaaaactggtcctgatcaataaatccgggaacagatctgagaaagaagtgagagccgcagctctcgtcctgcagaccatctggggctataaggagctgagaaagccgcttgagaaagaaggctggaaaaagtcagacttccaggtaaatctaaacaatgcctctcgttcccaaagctctcactcctatgatgactccacactccctttaatagatagaaatcaaaaaagcgacaagaagcccgaccgcgaagagatacagatgagcaatatgggatctaacaccaagagtctggacaacaattattctacccctaacgaaagaggcgaccataatcggacactcgaccgtagcggggatctaggggacatggagcccctcaagggtaccacgcctctgatgcaagacgagggccaagaatctctcgaggaagaattggatgtgctagtgctcgacgatgaaggcgggcaggtctcatatccaagcatgcagaagatctag

SEQ ID NO: 111083 - DNA, 2517 bp, Artificial Sequence
  Description of Artificial Sequence: Synthetic coding sequence
atgcaagagccaggacagatcgtcgaaacatataccgaagaagaccctgagggagctatgtccgtcgtgtccgtggaaacctctgatgatggtacaacgcgccgcactgagaccacagtcaagaaagttgtcaaaaccgtgacaacaaggactgttcaaccagtggccatgggaccagacggtttaccagtggatgcttcgagcgtgtctaacaactacatacagactctggggagggactttcgtaagaacgggaacgggggtccaggaccttacgtggggcaggcagggactgccactttgccacggaacttccattacccaccagatggatattccagacactatgaagacgggtaccctggcggttcagataattatggatctctaagcagagtaactaggatagaagagcgctatcggccgagtatggagggttacagggcaccatcccggcaggatgtatatggaccgcagccccaagtgcgggtcgggggatcctcggtggacttgcaccggttccaccccgaaccatacggtctggaagacgaccaacgtagtatgggttacgatgatctcgattacggcatgatgtccgactatggcacagcccgcagaactggcactccttctgatcctagacggaggctgcggtcctacgaggatatgataggcgaagaggttcctagcgaccagtactactgggctccacttgcccagcatgaacgggggtcgttagcctcactcgattccctgaggaaggggggccctccaccccctaattggagacagcctgaactaccagaagtgatagcaatgttggggttcaggttagacgcagtaaaatccaacgcagcagcatacttgcaacacttgtgttacaggaatgataaggtaaagactgatgtccggaagttgaaagggatcccagtcctggttggtctcttagaccatcccaagaaggaagtgcacctcggagcgtgtggcgccctgaagaatatatcatttggacgggatcaggacaacaagatcgccatcaaaaactgtgatggcgtaccagctctggttagactgctcaggaaggccagagacatggacctcaccgaagtcattacaggcactctttggaacctgtcaagtcatgactcaatcaagatggaaatcgttgaccacgccctccatgccctcacggacgaagttatcatcccgcacagcgggtgggaacgcgagccaaacgaagactgcaaaccaagacatatcgaatgggagtctgtactcacaaacacagcaggatgtctgaggaatgtctcgagcgaacgatcagaggctcgcagaaagcttagggaatgcgatggcctggtggatgcactcatctttatcgtacaggccgagatcggacagaaggactcggacagtaaactcgtcgaaaattgcgtctgtttgctgagaaacctgtcctaccaggttcatagggagataccacaggctgagcgttatcaggaagctgcacctaatgttgctaacaacacgggcccacacgccgcctcttgttttggtgcgaagaaaggaaaagacgaatggttttccagaggtaaaaaacctatagaggaccccgcaaatgacacagttgactttccaaaacgcaccagtccagctcgcggttacgaattgctcttccagcccgaagtagtgcgcatctacatttccctgctaaaggaatccaaaactccagcaattctcgaagcttccgcaggagccatacaaaacctctgtgcggggcgttggacatacggtaggtacatccggtccgccctgagacaagaaaaagctctgtctgcaatcgccgatctgctgacaaatgagcatgagagagtggtaaaagcagcgtccggcgcactacgcaacctcgccgtggatgcccggaataaggagctcatagggaaacatgctataccaaatttggttaaaaatttacctggtgggcagcagaattctagttggaatttcagcgaggacaccgttatttctattctcaacaccataaacgaagttatagcggaaaacctcgaggctgcaaaaaagttacgggaaacccaggggatagagaagctggtgcttatcaacaagagcggcaatcggagcgagaaagaggtaagagcagcagcgcttgtgctgcagacaatctgggggtataaagagctccgcaaacccctcgaaaaggagggttggaagaaatctgatttccaggtgaatctcaacaatgcttctaggagtcaatctagccattcttatgatgacagcacactaccgctgattgataggaatcagaaatcagataagaagcccgaccgagaggagatccagatgtctaatatgggctccaacactaagtcactagacaacaactactctacccctaatgaacgcggggaccataatagaacgctcgatcggagcggcgatcttggggacatggagccactgaaagggaccactcccctgatgcaaaaaatctag

SEQ ID NO: 111084 - DNA, 2640 bp, Artificial Sequence
  Description of Artificial Sequence: Synthetic coding sequence
atggccaatggtactctgactcgacgtcatcagaacggaagattcgtcggcgatgccgaccttgaaaggcagaagttctccgatctcaagctgaatgggcctcaggaccactcccacctgctttactctacaatccccaggatgcaggagcccggccagatagtggaaacctatactgaagaggaccccgagggggcaatgtctgtggtaagtgttgaaacttcagacgacgggacgaccaggcgcactgagaccaccgtgaaaaaggtggtcaaaaccgtcacaacccgcacagtgcagccagtggcgatgggccctgacggactgccggtggatgccagctcagttagcaacaattatatccagacactgggccgggacttcagaaaaaatggcaacgggggccctggcccatacgttgggcaggccggtaccgccaccttgcccaggaatttccactacccccccgacggctatagccggcactacgaagatggatatcctggcggtagtgataactatggcagtctgagcagagtcacccgtatcgaagaaagatatcgaccctcaatggagggctatagagcaccctcccggcaggatgtgtacgggccacagccccaggttcgcgttggtggctcctccgttgaccttcaccggttccaccctgaaccgtacggtctggaagatgaccagaggagcatgggctatgatgatttagattacggcatgatgtccgattacgggacggcacggaggacaggaaccccttccgaccctcggaggcgcttaaggtcatatgaagacatgattggtgaggaagtcccctccgaccagtattactgggccccactggctcaacatgagagggggtctttggcgtcactggattccctgaggaaggggggacctcctcctcccaactggaggcaacctgagctgcccgaggtgatcgctatgctggggttccgtctggacgctgtgaagagcaatgcagctgcgtatctccagcacttatgctataggaacgataaggttaagactgatgtacggaagttgaagggcatccccgtcttagtcggactgcttgaccaccctaagaaggaagtccatctcggagcctgtggcgcactcaaaaatataagtttcggtagagaccaggataataagattgccataaagaattgtgacggggttcccgccctggtacggctgcttaggaaagccagggacatggatctgaccgaagtcattacgggaacgctgtggaacttgagctcacatgactccataaagatggagatcgtcgatcatgcacttcatgctttaacagacgaggtgatcataccgcacagtggttgggagcgcgaaccaaacgaggactgtaagcctagacacatcgagtgggagtcagtgctgacaaacaccgctggatgcttgcgcaacgtatcctccgaaaggtctgaggccaggcggaagctgagggaatgtgacgggctggtggatgctctcatatttattgttcaggcggagattgggcaaaaagattccgatagcaaactcgttgaaaactgtgtgtgcttgctgaggaacctttcatatcaagtccaccgcgaaattccgcaggccgagcggtaccaggaggcagctccgaatgtggcgaataacaccggcccacatgctgcttcttgcttcggggcgaaaaagggtaagggcaaaaagcctattgaagacccagctaacgataccgtcgactttccaaagcgtacgtcccccgctcgaggatatgaactcttgtttcagccagaggtggtcaggatttacatttctctattgaaggaaagcaaaaccccggccatcttggaagccagtgctggcgccattcagaacttgtgcgccggaagatggacttacggaagatacattcgtagtgcactccggcaagaaaaagcactgagtgctatcgctgacctgctaaccaatgagcatgagagggtggtaaaggctgcatcgggcgctctcagaaatcttgcagttgatgccagaaataaggaacttattgggaagcatgccatacccaatctagttaagaacttgccgggtggacagcagaacagttcatggaacttctctgaagacaccgtgatttcaatccttaataccatcaatgaagttattgccgaaaatctggaggccgcgaagaagctgcgtgagactcagggcattgaaaagctggtccttataaataagtctggcaacagatccgagaaagaggtccgggccgctgccctggtgctccagaccatctggggatataaagaactgcggaagccattggagaaagaagggtggaaaaagagcgattttcaggtgaacctgaataatgcaagtaggagccagtccagccactcttatgacgactcaaccctgccactgattgataggaatcagaagagcgataaaaagcccgaccgagaggaaatccagatgtcaaatatgggcagcaacaccaaatcgttagataataattattcaacacctaatgagaggggcgatcacaaccggacacttgataggtccggagatcttggagatatggaaccactaaagggtaccacacccctgatgcagaaaatctag

SEQ ID NO: 111085 - DNA, 2640 bp, Artificial Sequence
  Description of Artificial Sequence: Synthetic coding sequence
atggcaaacggaactctaacccgacgacatcagaacggcaggttcgttggcgatgcggacctggagcgccagaagttttctgacctgaagctcaacggcccccaggaccatagtcacttgttatatagcactatcccgcgcatgcaggagcctggccaaatcgtggagacatacacagaagaagaccccgaaggggctatgtcggtcgtgtctgtggagaccagtgacgacggaaccactaggcggaccgaaactacagtgaagaaggtggttaagacggtgaccactaggaccgttcaaccggtagcaatgggtcccgacggactccctgtggacgcctctagcgtctccaacaattatatccaaactctgggcagagattttaggaagaacgggaatggtggccctggcccgtatgtcgggcaggctggcacggcgacacttccgaggaactttcactatccccccgacggctactcccgccattatgaggacgggtacccgggcgggagcgacaactatgggtcgctctctcgagtgaccagaattgaggagaggtatcgcccatccatggaagggtatagggctccttcgaggcaggacgtgtacgggccacagccccaggtgcgagtagggggttcgagtgtggatcttcatcgcttccatcctgaaccatatggtttggaggacgaccagaggtctatgggctacgatgacctcgattacgggatgatgtctgactatggcactgctcggcgcactgggaccccatctgatcctaggagacgactgcggagctatgaggacatgatcggcgaagaggtaccctccgatcaatattattgggcgcctcttgcacagcacgaaagaggctcgctcgcctcactggactcccttaggaaaggagggccacctcccccgaattggagacagcccgagttgcccgaggtgattgccatgctgggctttcgcctggacgcagtgaaatcaaacgctgcagcctacctgcaacacctgtgctaccgcaatgataaggtcaaaactgacgtccgcaagctcaaagggatcccagtgctggtgggcttactggaccaccccaagaaggaagtgcaccttggagcttgtggcgcccttaagaacatctcatttggccgagatcaggataataagattgctattaagaattgtgatggggtcccagcccttgtccgcttgctccggaaggctcgcgacatggatctcacagaggtcatcacgggaacgctgtggaacctgtcttcccacgactctattaagatggagattgtagatcatgccctccacgcactgaccgatgaagtgattatcccccactcaggatgggagagagagccaaatgaggattgcaaacccagacatattgagtgggagagtgtgcttaccaataccgcgggttgtctccggaatgtttcatctgagagatcagaagctaggcgtaagttgcgagaatgtgatggccttgtagatgcccttatcttcattgtgcaagctgaaatcggccagaaggactctgatagcaagcttgtcgaaaactgcgtgtgtctgctcagaaatttatcgtatcaggtacatcgggagataccccaagctgagagatatcaagaagccgcacctaatgtggctaacaataccggacctcacgctgctagttgtttcggggccaaaaagggcaaaggcaaaaaaccaatcgaggaccccgcaaacgataccgtggattttcctaagcggacgagcccagcaaggggatacgagctccttttccaacctgaggtcgtgaggatttatatttcactgctgaaagaatccaaaacccctgcaatactcgaagcatccgcaggagctattcaaaacctgtgtgcgggtaggtggacctatggccggtatatcaggagcgcgctcaggcaggaaaaggctctgagtgccatcgctgatctgctgactaacgaacatgaacgtgtggttaaagctgcttcaggtgcgctgagaaacctggccgttgacgctcgaaataaagagttgattggcaaacacgcaatcccaaacttggtgaaaaacctgcctggtgggcagcagaacagctcctggaacttttctgaggatacagttattagcatccttaataccattaatgaagtcattgctgagaacctggaagctgcaaagaaactgcgcgagacacaaggaatagagaaactggtgctcattaacaagtctggaaacagatctgaaaaggaggtccgggccgcagcactggttcttcagacgatctggggctataaggaactgagaaaaccgttggagaaggaaggatggaagaagtcggatttccaggttaaccttaacaatgcaagccgctcccaatcctcacacagttatgacgatagcacactgcccttgatcgaccgtaaccaaaagtcagataaaaagcctgatcgggaggagatccaaatgtctaacatggggtctaatacaaagtctctcgacaacaattacagcacacccaacgagaggggagaccacaataggaccttagataggagtggggatttgggggatatggagccactgaagggaaccacgccactgatgcaaaaaatatag

SEQ ID NO: 111086 - DNA, 2499 bp, Artificial Sequence
  Description of Artificial Sequence: Synthetic coding sequence
atgcaggaaccaggacaaattgtcgagacctacactgaggaagacccggaaggtgcgatgtcagtggtgagtgtggagacctcagacgatggcaccaccagacgcaccgaaaccaccgtcaaaaaggttgtaaaaacagtcaccaccaggacggtgcaaccggtcgcgatgggtcccgacggcctacccgtcgatgctagtagcgtgtccaacaactacatccaaaccctgggccgggacttcagaaagaacggaaacggcggtcctggcccctatgtcggccaggccggaaccgccacactgcctcggaacttccactacccgcccgatggatactctcggcattacgaggatggatacccagggggtagcgataactacggatctctgagtcgcgtaacgcgcatcgaggagcgctatcgcccgtcaatggaaggctaccgggccccctcacgccaggacgtatacggcccccagccacaggtccgagtcggcggctcatccgttgatctgcacaggttccaccctgaaccatatggtctcgaagatgatcagaggagcatgggctatgatgacttagattatggtatgatgagcgactatggcactgcaagaaggaccggcacccccagtgatccccggcgaaggctcaggtcatacgaagacatgattggggaagaagtgccctccgatcagtattactgggctcctcttgcccagcatgaacgcggcagcctcgcctcccttgactctctgagaaaaggaggcccgcccccccccaattggaggcagccagagctgccagaagttattgctatgttggggtttcgcctggacgcagttaagtcaaacgctgcggcttacctgcagcacttatgttacagaaacgacaaggtaaagacagacgtgcggaaacttaaaggtatcccagtcttggtgggactgcttgaccaccctaagaaggaagtccacctcggtgcctgcggagcattgaaaaatatcagctttggaagggatcaagataataaaatcgctatcaaaaattgcgatggcgttccagccctggtcaggcttctgcgaaaggcccgggacatggatttaaccgaggtcattactgggacattgtggaacttgtcctcgcacgactccattaagatggagattgtggatcacgctctccacgcgctcaccgacgaagtcattatcccacacagcggctgggagcgcgagcctaacgaggactgtaagcctcgacacatcgagtgggagtcggtgctgactaacacggctggatgtctccggaatgtcagcagtgagcgttcggaggcaagaaggaaattgcgggagtgtgatggattggtagacgccctgatttttatcgtacaagcagagattggccagaaggatagcgactcgaagttagtggagaactgcgtgtgcctgttgagaaacttatcctaccaggtgcatagagagatcccccaagctgagcggtaccaagaagctgctcctaatgtggcaaataacacgggcccccacgcagcatcttgtttcggggcaaagaagggcaagggtaaaaagccaatagaggatcccgcaaatgacacggttgactttccaaagcgcacatccccagcacgtggatacgaattgctttttcagcctgaggtggtgcgaatctacatctcactattgaaggagtccaagacaccagctatactcgaggctagcgcgggggcaatacagaatctgtgcgcaggtcgatggacttatggccgctacatcagatccgctttgcgtcaagaaaaagccctgtccgccatcgcggaccttcttaccaatgaacatgaaagagtggttaaagcagccagcggcgcactgaggaatctggctgtagatgctcgaaacaaggagttgattggaaaacacgctatacccaatctcgtgaagaatctgcctgggggccagcaaaatagttcttggaacttcagtgaagataccgtaattagcattctgaatactatcaatgaggtcatcgcggagaatctggaggcagccaagaagctcagagaaactcaggggatcgaaaagctggtcctgatcaacaagtcaggtaatcgcagcgagaaagaggtgagggcggctgctctggtgttgcaaacaatttggggatacaaggagctacgaaagccactggaaaaagaaggctggaagaaaagcgattttcaggtgaaccttaacaacgcaagccgtagccagagctctcacagctacgatgattccacattgccactgatagaccgtaaccaaaaatctgacaaaaagccggatagggaggagatccagatgagcaatatgggcagcaacaccaagtctctcgataacaattactccaccccaaacgagaggggagatcataaccgcacactcgatcgcagtggcgatctaggggatatggagccgctgaagggaacaacaccacttatgcagaagatctag

SEQ ID NO: 111087 - DNA, 390 bp, Artificial Sequence
  Description of Artificial Sequence: Synthetic coding sequence
atggctaacggaaccttgacccgccgacatcaaaacggtcggtttgtgggcgatgccgatctggaacgccagaagtttagtgatctgaaactgaatgggcctcaggaccactcacacttgttatacagcactattcctagaatgcaggaaccaggacaaatcgtggagacttatactgaagaagatcctgagggcgccatgagtgtggtcagtgtcgaaacttccgacgacggcaccactaggcggaccgaaactacggtaaagaaggtggtgaagacagtcaccactcggactgtgcagcctgtggcaatggggcctgatggcctcccagtggacgcaagtagcgttagcaacaattacatccagacccttggacgggatttccggtag

SEQ ID NO: 111088 - DNA, 2586 bp, Artificial Sequence
  Description of Artificial Sequence: Synthetic coding sequence
atgcaagagccaggccagatcgtcgaaacatacaccgaggaagaccccgagggggccatgagcgtggtatccgtagaaacaagcgacgacgggactaccagaagaaccgagaccaccgtgaagaaagtggttaagaccgtcacgacccggacagtccagcctgtggccatgggaccagatggactgcccgtggatgcaagtagcgtgagcaataactacattcagacactgggccgagacttccggaagaatggcaacggagggcccggtccgtacgtggggcaagctggaactgcaaccctgccacgaaatttccattatccccctgacggttacagcagacattacgaagatggctacccggggggcagcgacaactacggctccctgagcagggtgacaaggatcgaggagcgatatcgcccttccatggaaggatatcgagcccccagtcgtcaggacgtgtacggcccacagccccaggttcgcgttggtggttcctctgtggacttacatcgcttccaccccgaaccctacggactggaagatgatcagcgttctatgggctacgacgatctggactacgggatgatgagtgactacggtactgccaggcgcacagggactccctctgacccgcgaagacgcctgcgctcttatgaggacatgattggcgaggaggtccccagcgaccaatattattgggccccgttggcccaacatgagcgggggtccttggcgtctctcgattcactgcgcaaagggggtccgccacccccaaattggcgtcagccggaacttcctgaggtgattgcgatgcttgggttccggcttgacgcagtcaagagcaacgcggccgcgtacctccagcatttgtgctataggaatgataaggtgaaaacagacgttcggaaactgaagggcattcccgtgctggttggacttttagaccatccgaagaaagaggtacacctgggagcttgtggcgctttaaagaatattagttttggccgggaccaggataataagatcgctattaaaaattgtgacggcgtgcctgctctcgtacgactgctgcgcaaggctcgtgacatggacctgacggaagtgatcactgggacgctgtggaacctttcatctcatgactctatcaaaatggaaatcgtggatcacgcactgcatgcactgaccgacgaggtaataattccccattctggttgggagagggagccaaatgaagactgtaagccacggcacattgagtgggaatctgtgcttacgaatactgctggatgtcttcggaatgttagctctgaacgctctgaggcccggagaaagttgcgggaatgtgatggactggtcgacgcactgatattcattgtgcaggccgagattggacagaaggattctgattccaagctcgtggagaactgtgtgtgcctgctaagaaacctttcgtaccaggtccacagagagattccacaggctgagaggtatcaggaagcagcacctaatgtggcaaataatactgggccacacgccgcaagttgttttggggccaagaaggggaaagggaagaaaccaattgaagacccagcaaatgacaccgttgactttcctaagcggacctcacccgcccgggggtatgagctgctgtttcagccggaagtggtaaggatatatattagcctgctgaaggaaagcaaaacacccgctatactcgaagcctcagccggggcaatccagaatctgtgcgctggacgctggacctacgggcgctacattaggtcagctttgaggcaggagaaggctctatctgctatagctgatctccttaccaacgaacacgagagagtggttaaggccgctagcggtgccctacggaacctggccgtcgacgccaggaacaaggagcttattggtaagcacgccatccccaacttggtgaagaacctgccaggcggacaacaaaattcatcctggaacttttccgaagatacggtgataagcattctgaacactatcaatgaggtgatcgccgaaaatttggaagccgccaagaaactgcgggagacacaagggatagagaaactggtgttaatcaataagtcgggaaaccggtcggaaaaagaggtgcgggccgctgcgctcgtccttcagaccatctgggggtataaggagctccgtaagccgctggaaaaagaaggttggaagaagagcgattttcaggtcaatctgaacaatgcttcaaggagtcaatcatctcattcttacgacgactctaccctgccactgattgatagaaaccagaaatcagacaaaaaacccgacagggaggagattcaaatgagcaatatgggctcaaataccaagtcgctggataacaattacagcacccccaacgaacggggtgatcataaccggacattagatcgaagcggagacctcggggacatggaacctctgaaaggaacaacccctctgatgcaggatgaaggccaggagtctctggaggaggagctggatgtgttggtactggacgacgaggggggtcaggtctcctaccctagcatgcaaaagatctag

SEQ ID NO: 111089 - DNA, 2658 bp, Artificial Sequence
  Description of Artificial Sequence: Synthetic coding sequence
atggccaacgggactctgaccagaagacaccaaaacggaaggtttgtaggggacgctgaccttgagaggcaaaagtttagcgatttaaagctcaacggaccccaggaccactcacacctgttgtatagcacaattccaagaatgcaggagcccggacagatcgtggaaacctacacagaagaggacccagagggagcgatgagcgttgtgtctgtggaaacttctgacgacggcactaccagaagaactgagacaacagtgaaaaaggtggtaaagacagtcacgacaagaactgtgcagcctgttgccatgggccctgacggcctgcctgttgacgcttcctctgtaagcaataattacatacagactctgggtagggatttcagaaagaacggtaatgggggccccgggccttacgtgggccaggccggaaccgctaccctgccgagaaattttcactacccccctgatggatatagcaggcactatgaggacggctaccccggcggctcagacaattacggatctctgtcgcgtgtaaccagaattgaggaaagatacagaccctctatggaggggtaccgtgcccctagccggcaagatgtctacggcccacagcctcaggtgcgcgtgggaggtagtagcgtcgatcttcaccggttccacccagagccctacggtttagaagacgaccagcgaagtatgggatacgatgacctggactacggaatgatgagtgattacggcacggctcgtcgtacaggaactccctccgaccctaggagacgtttgcgctcttacgaagacatgatcggtgaagaagtccctagtgatcagtactattgggctcccctcgctcagcacgagcgaggaagcctcgcaagccttgatagcctgcggaaggggggcccgcctccacctaattggaggcagcccgaactgcctgaagtgattgccatgctagggttcagactcgatgctgtgaagtcaaacgcagcagcctacttgcaacatctctgctacaggaacgataaggttaaaacagacgtgaggaagttgaagggaatccccgtgctcgtggggttgctcgaccacccaaaaaaggaggtacacctgggggcctgtggagctctgaagaacatatcattcgggcgggatcaggacaacaaaattgcgataaaaaattgcgatggtgtccctgctttagtgcgcctgcttcggaaagctcgagatatggacctgaccgaagtaatcaccggaactctttggaatctgagctctcacgatagcatcaaaatggaaattgttgatcatgcattgcatgccctgaccgatgaagtaataatccctcattcgggctgggagagggaaccgaacgaggactgtaagccacgccatattgaatgggagtccgtgctcacaaacactgcagggtgtctgaggaatgtatcatcagaaaggtccgaagcccggcgtaagctgagagaatgcgacggtctcgtggacgctctgatttttattgtccaggccgagatcggtcagaaagatagcgattctaagttggtggaaaactgtgtctgcctgctccggaatctctcctatcaggtccatcgggaaattccccaggccgagaggtaccaagaggctgcacctaatgtcgccaataacacaggcccgcacgctgccagttgttttggggccaaaaaggggaaagatgagtggttctctcggggaaagaaaccaatagaagacccagcaaatgatactgtggacttccccaaaagaacgtcacctgcacgtggatacgaattattgttccagcccgaagtcgtgcgcatatacatctcactgctgaaggagagtaagacccctgcaatactggaggcgagtgcaggggctattcagaacctttgcgccgggcgctggacttatggtaggtacatccgttcggccttgcggcaggagaaagcactttcagccatcgccgatttgctgactaacgaacatgagagggttgtcaaggcagcctccggagcactaagaaacttggcggtcgacgcacggaataaggagctgattgggaaacatgctattccgaacctggtcaaaaaccttccgggaggacaacagaatagctcatggaatttttctgaagacactgttatcagtatactgaacacaatcaacgaggtcattgcagagaatctagaagctgcgaaaaaattgagggaaacacagggaatcgagaagttggtgctgattaataagtcgggaaacagatctgagaaggaggtccgcgcagctgccctggtgctgcagactatttggggctataaggaactgcgcaagcctttggaaaaagaaggatggaaaaaaagtgacttccaagttaatctgaataatgcctccaggtctcaaagcagccatagttatgatgatagcacactgccattgatcgatcgcaaccaaaaatctgacaaaaagccagatcgagaagaaatacagatgtccaatatgggctcaaacacaaaatcattagataataactacagcactccaaacgagcgaggagatcacaaccggaccctggatcgctcgggtgatctgggtgatatggaaccattaaagggaactacgccacttatgcagaaaatatag

SEQ ID NO: 111090 - DNA, 1920 bp, Artificial Sequence
  Description of Artificial Sequence: Synthetic coding sequence
atgattggagaggaagtgccatctgaccagtactactgggccccactggcccagcacgagcgtggctccttggcgagtctcgactctctgcggaagggcgggccgccgccccctaactggaggcagccggaattgccggaagtaatagccatgctcggcttccgcctcgatgcagtgaagtccaatgccgctgcttacttacagcatttatgctaccgcaacgacaaggttaagaccgacgttagaaagctcaagggaatacctgtgctcgttggacttctggaccaccccaagaaggaggttcaccttggagcttgtggagccctgaaaaacattagttttggaagagaccaggataataaaattgcaataaagaactgtgacggcgtacccgcgctggtcaggttacttcgcaaggcaagggatatggacctaacggaggtcattactggaactctgtggaatctttccagccatgatagtatcaaaatggagatagtcgaccatgccctgcacgccctgactgacgaggtgataattccacacagtggatgggagagggagcccaacgaggactgcaaacctcgtcacatcgagtgggagagcgtgctcacgaatacagccggctgcttgcgcaacgtcagctcagaaaggagtgaggctcgacggaagttgcgggagtgcgatggactcgtggacgccctgatcttcatcgtacaagccgaaattggccagaaagactctgactctaagctggttgagaactgtgtgtgccttttgaggaatctgtcttaccaggtccaccgggaaatacctcaagctgaaagataccaagaggccgcgcccaacgtggccaacaacaccgggccacatgctgcctcctgtttcggggccaaaaagggtaaaggaaagaaacctatcgaggatcccgctaatgataccgtcgatttccccaaacgaactagcccagcacggggctacgaactgctgttccagcctgaggtcgttcggatctacatctcccttttaaaagaaagcaaaacccctgcaatcctggaggcttccgcaggagcaattcagaatctgtgtgcagggagatggacatatggcaggtatatcaggtctgctcttcgtcaggagaaggcactgagtgccatagccgacttgctcactaatgagcacgagagggtggtgaaggctgccagtggagccttaagaaatctggcagtggatgcccggaataaggagttgattggcaagcacgctatccccaatctcgttaaaaacctgccaggaggccagcagaacagctcttggaacttttccgaagataccgtgataagcattctgaataccatcaatgaggtgattgccgagaacctagaggccgctaaaaagctgcgtgagacccaggggatcgaaaaattagttctaattaacaaatccggcaacagaagtgagaaggaggtgcgcgctgcagccctggtgttgcagacaatctggggatacaaggagctccgcaagccactggagaaggagggctggaagaagtccgactttcaggtcaacttgaacaatgcttccaggagccagtcctctcatagctatgatgactcaaccctgccactcatcgataggaatcagaaatcagataaaaagccagacagagaggagatccaaatgtccaatatgggtagcaacacaaaatcattggataataactacagcacgcctaatgagcgcggagaccacaaccgcaccctggaccggtctggcgacctaggggacatggagcctctgaaaggcaccacccctctgatgcaagatgaaggccaggagtctctagaagaagagttggacgtgctcgtcctcgacgatgaggggggacaagtaagttaccctagcatgcagaagatttag

SEQ ID NO: 111091 - DNA, 2499 bp, Artificial Sequence
  Description of Artificial Sequence: Synthetic coding sequence
atgcaggaaccaggccagattgtcgaaacctatactgaggaggatcccgaaggcgccatgtctgtagtgtccgtagaaaccagcgatgacggcacaacccgcaggactgagaccaccgtaaaaaaagtcgtcaagacagtaaccacccgtacagtgcagcctgtggctatggggccagatgggctccccgtggacgccagcagcgttagtaataactacatacagactctcggacgagattttcgcaagaacggcaacggcggtccgggaccttatgtgggacaagctggcactgccaccctgcccaggaacttccattatccacctgatggatatagcagacattacgaagacggctaccctggcggcagcgacaattatggctcccttagccgggttacgcgaatcgaggaaaggtatcgcccatctatggagggatatcgggccccatctagacaggatgtgtacggcccccaaccgcaggttcgggtgggcggaagtagtgtagacctccacaggttccatcccgagccctatgggctggaggatgatcagcggtccatgggttatgatgatctcgattatggaatgatgtccgattacggcacggcgagacgaacaggaaccccctcagacccccggcggcgccttcggagttatgaagacatgatcggcgaagaagtcccatccgaccagtactactgggcccctcttgcccagcacgaaagagggtctctggcctcactcgattctctgcggaaaggtggtcctcctccacccaattggcgtcagccagagcttccagaggtcatagcaatgcttggcttcagactggatgccgttaaatccaacgccgccgcttacctacaacacctgtgctaccgaaatgacaaggttaagactgacgtaaggaaacttaagggcatccccgtgctcgtgggactcctagatcatccaaaaaaagaagtccatttaggcgcatgcggggcccttaagaacatatcttttggaagggaccaggacaataagatcgccatcaagaattgcgacggggtccccgcccttgttagactcctgaggaaggcgagggacatggacttgacggaagtgatcaccggaactttatggaacctctctagtcatgatagcattaagatggaaatcgttgaccatgccctccacgcactgacagacgaggttatcatcccacattccggttgggaacgcgagcctaacgaggattgtaagcctcggcatatcgaatgggaatccgtgttgacgaataccgccggctgtttgcggaatgtttcatctgagcgctctgaggcgagacgaaaattgagggaatgtgatgggctggtcgacgcattgatctttattgttcaggcggagatcggtcagaaggattccgacagtaaactggtggagaactgcgtttgcctgctgcggaacctgtcataccaagtgcacagagagattccccaggccgaaaggtaccaagaagccgccccaaacgttgccaataacacaggaccgcacgctgcctcatgtttcggcgcaaagaaggggaaaggcaagaagcccatagaggaccctgccaatgacaccgtcgattttcccaaacggacaagtccagcaagaggttacgaactactgtttcaacctgaagtggtgagaatctatatcagtctccttaaggaaagcaagacccctgccattttggaagcgtctgccggagctatccagaatttgtgtgccgggcggtggacctatggtagatatatcaggagtgcattgagacaagagaaggcattgagcgctatagccgatctgctgactaacgaacacgaaagagtcgtcaaagccgcctccggagccctccgaaacttggctgtggatgctcggaataaagagttgataggcaaacacgcaatccctaatctggtaaaaaaccttcccgggggccagcagaacagttcatggaacttttcggaagatacagtgatcagcattctgaataccattaatgaagtgattgctgaaaaccttgaggctgcaaagaagcttcgggaaacacagggcatcgaaaagttggtcctcattaataaatcgggcaaccggtcagagaaagaagtcagggccgccgccctcgtgctccagacaatctggggctacaaagagctccgtaaacctttggagaaggaaggttggaaaaagagcgatttccaggttaatttaaataatgcatccagatcacaaagttctcactcctacgacgactccaccctgcctctgattgataggaaccaaaagagcgataagaagcccgaccgagaggaaatccagatgagcaacatggggtcaaatacgaaaagtctggataataactactcaacacccaacgagagaggtgatcacaacagaaccctggacagatccggcgacctgggagacatggaacccttaaagggaactaccccactgatgcagaagatatag

SEQ ID NO: 111092 - DNA, 2499 bp, Artificial Sequence
  Description of Artificial Sequence: Synthetic coding sequence
atgcaggaaccagggcaaatcgtagagacctacaccgaggaggaccctgaaggggcaatgagcgttgtgagcgttgagacgagcgatgatggtaccacccgcagaaccgaaacaacagtcaagaaagtcgttaagactgtgacaacaagaacggtacagcccgtcgccatggggcccgacggccttccggtggacgcaagttccgtgagtaacaactacatccagactctgggaagagacttccgcaagaatggaaatggtgggcccggaccatatgtcggccaggctggcaccgcaaccctacctcgcaacttccactatccacctgacggctactctagacactatgaggacggttacccagggggtagtgacaattatgggtccctgtccagggtcacacgaattgaagagcgctatcggccttcaatggagggatatcgcgctccttctagacaggacgtctacgggccacaaccccaggtaagggtgggcgggtctagtgtggacctacacagattccacccggagccctatggtttggaggacgatcagcggagtatggggtacgatgacctcgattacggtatgatgtccgattacggaacagcacggcgcacgggaactccaagcgaccccagaaggcggttgagaagctacgaggacatgataggagaagaggtacccagtgatcagtactactgggcaccattagcccagcacgagcggggatccctagcgtctctggactccctgcgaaagggcgggcccccaccacctaactggcgccagccggaactgccagaagtaatcgcgatgttggggtttaggctggatgccgtgaaaagtaatgctgcagcctacttacagcacctctgttacagaaacgacaaagtcaaaacagatgtgaggaagctcaagggcattcctgttcttgttgggctacttgatcaccccaagaaagaggttcatctgggagcttgcggtgctctgaagaacataagcttcggccgggatcaggacaacaagatagctattaagaactgtgatggggtcccggctctggtgagactgttgcgaaaagccagagacatggatctgactgaggtcatcacaggtaccctttggaatctgtcctcacatgactctatcaaaatggaaattgtggaccacgcacttcatgctctcacggacgaggtgataatccctcatagcggatgggaacgggagcccaatgaagattgcaaacctaggcatatcgaatgggaatcagtccttacaaatacagccggctgtttgaggaatgtctcatctgaacgatcagaggcaagacgcaagctgcgggagtgtgatggactggtcgatgccctaattttcattgttcaggcagagatcggacagaaagattctgacagcaaactagtcgagaactgcgtctgccttctgagaaatttatcttaccaggtccacagggagataccacaggctgagagataccaagaggctgctccaaacgtggctaacaatacgggcccacacgcagcgagctgttttggtgctaagaaagggaagggcaagaagccaatcgaagatcccgctaatgacaccgtcgacttccccaagcgaaccagccccgccaggggatatgagctgctctttcaaccagaggtggttaggatttatatcagcctgctgaaggagtctaagactcccgcaatcttagaagcatctgcgggagccattcagaatttgtgtgcaggtagatggacatatgggagatacatcagaagcgccttacgtcaggagaaggcactgtctgctatcgcagacttgctcacaaatgagcacgaacgcgtggtgaaggctgcaagcggtgcacttagaaacctggccgttgatgccagaaacaaagaattgattggcaagcacgccatacccaatcttgtgaaaaacttacctgggggccagcagaactcttcttggaacttttctgaggacactgtgatcagtatcctcaacaccataaacgaggtaatcgcggagaatctggaggcagcgaaaaagttacgggagactcaggggattgaaaaattagtgctgatcaataagagcgggaaccgaagcgagaaggaagtaagagcagcagccctcgtcctgcagacgatctgggggtataaagagttgcggaaaccgttagaaaaagaaggctggaagaagagcgactttcaggttaatctgaacaacgcttcacgcagccagtcctcccactcatatgatgactcgacactgccattgatcgaccgcaaccagaagagtgataaaaagcccgaccgggaggaaattcagatgtcaaacatgggtagcaacactaagtcgctcgataacaattattccactcctaacgaacgaggagaccacaaccgcacgctggaccggtcaggagacctaggcgacatggagcccctgaagggtaccaccccactcatgcagaagatctag

SEQ ID NO: 111093 - DNA, 2640 bp, Artificial Sequence
  Description of Artificial Sequence: Synthetic coding sequence
atggccaatgggaccctcacccgccggcaccagaacggtagattcgtaggagacgccgacttagaacgccagaaattcagtgatctgaaattgaacggtccacaagaccactcccacctcctttattcaacaatcccacgtatgcaggaacccggccagattgtagaaacctatacagaggaggatcccgaaggcgccatgtctgtagtctctgtggagacctcagatgacggcacaacaaggaggacagagacaacagtaaaaaaggtggtcaaaactgttacaacgcggactgtccagcccgtcgccatggggcctgatggactgcccgtggacgcgtcctccgtgtcgaataactacatacagacgcttggacgcgattttaggaagaatggtaacggtggtccaggcccatacgtgggccaggccggaacggccaccctgccgcgaaactttcattatccacccgacggctattcccggcattatgaggacgggtacccgggaggatcagacaattatggctctttatcccgggtaactcgaattgaagagagatatcggccttcaatggaggggtaccgtgctcccagcaggcaggacgtgtacggtccccagccacaagtgagggttgggggatcgtcggtcgacctccacagattccacccggagccatatgggttggaggatgatcaaagaagtatgggctacgacgatctggattatggcatgatgtctgattatggcacagcaagacgaaccggcaccccatctgatccacgccgacggctcagaagctacgaggacatgataggcgaggaagtacctagcgaccagtactactgggcgcccctggctcagcacgaaagaggtagcctcgcttcgcttgattctctgcgcaaaggggggcctccaccgccaaattggcggcaacccgaactccctgaggtgattgctatgctggggtttagacttgacgccgtgaagtccaatgctgcagcctacctacagcacctatgctacaggaacgacaaggtcaaaacggacgtcagaaaactcaagggaatccccgtacttgtcggattgctggatcacccgaaaaaagaggtgcatctgggagcctgcggcgcgctcaagaacatcagcttcggaagggaccaggacaacaagattgccattaaaaactgcgatggggtccctgcgttagtgagattgctgcggaaagccagggacatggacttgacagaagtcattacaggaacgctctggaatctgtcctctcatgatagcatcaagatggagatcgtcgaccatgcactgcacgcccttactgatgaggtgattatccctcacagcgggtgggaacgagaacctaatgaggattgcaagccccgccacatagagtgggaatccgtgctgacaaacacggcagggtgcctaagaaacgtatcgagcgaacgctcagaggctaggcggaaattgcgagaatgcgatggccttgtggatgctctgatctttatagttcaagctgaaattggtcaaaaagactcggactccaagctggttgagaattgtgtgtgtctccttcgtaatctgagctaccaagtccaccgcgaaattccacaggcagagagatatcaggaagcggcccccaacgtggctaacaatacagggcctcatgccgcttcatgttttggcgctaagaagggcaaggggaaaaaacccattgaggaccctgctaatgatacagtcgatttcccaaagcgcaccagtccagcccgcggatacgagctgcttttccagccagaggtggtccgaatttacatcagcctattaaaggagagtaagacgcctgcaattcttgaagccagcgccggagccatccagaacctgtgtgctgggcgctggacctacggcaggtacataaggagtgcgttgagacaggagaaagccctctcagccatcgctgacttactgacaaatgaacacgagagagtggtgaaagctgcaagtggggcactgcgtaacctggcggtcgacgcccggaataaagagctaatcgggaagcacgcgatacctaatctagtgaaaaatttaccaggcggacagcagaattcatcctggaactttagcgaggacacagtgatcagtatcctgaataccatcaatgaagttatcgcagagaatctcgaggcagcgaaaaagcttcgggaaacgcagggaatcgagaaattggtacttataaataagagcggtaaccgctccgagaaagaggtgcgcgccgccgcccttgtactgcagacaatctgggggtacaaagagctccggaaacccctggaaaaagaaggctggaagaagtcagatttccaggttaacctcaacaacgcctcaaggagtcaaagcagtcattcatatgacgattccacccttcctcttatcgatagaaaccaaaaaagtgataagaagcccgatcgggaggagattcagatgagcaacatgggctccaacaccaaaagcttggacaataactacagtacgccaaacgaacgtggggaccacaaccggactttagaccggtccggagacctgggagacatggagccgctgaagggaacaacccccttgatgcagaaaatatag

SEQ ID NO: 111094 - DNA, 2523 bp, Artificial Sequence
  Description of Artificial Sequence: Synthetic coding sequence
atgcaggaacccggccaaatcgtggagacctacactgaggaggatcccgagggggccatgtcagtggttagcgtggagacttctgatgatggaacaacaagacgaaccgagactaccgtgaagaaggtggtgaagactgttaccacccggactgtacagccagtcgccatgggtccagacggactgccagtggatgccagcagcgtgtcaaataactatattcagacgctggggagggattttcggaagaacgggaatggaggaccaggtccttatgtcggccaggccggcactgccaccctcccacggaattttcactacccacccgacggatacagccggcactatgaagacggctaccccggcggctcggacaactatggatccctgtcccgcgtcacacgcattgaggaaaggtaccggccgtccatggagggctaccgggccccttcaaggcaggatgtatacgggccacagccacaggtccgggtgggaggatcatctgtagaccttcaccgctttcacccagaaccttacgggctcgaagacgaccaaaggagtatgggctacgacgacttagattacggcatgatgtctgactacggcacagcaagacggacaggaacccctagtgatcctagacgaaggctgcgatcttacgaggatatgataggcgaagaggtgcccagtgatcaatattattgggccccgctcgcccagcacgagagaggaagcctggcaagcttagatagtttgagaaagggcgggcctcctccacctaattggaggcagcctgagctgccagaggtgatcgccatgttaggcttccgccttgatgctgtcaagtctaacgccgccgcctaccttcagcacttgtgttaccgaaatgacaaggtgaaaaccgacgtaagaaaattgaaaggtatcccggttttggtggggctgttggaccacccgaaaaaggaggtgcaccttggcgcgtgcggtgctttgaaaaatattagttttggacgggaccaagacaataaaatcgcaattaagaactgtgatggcgtgcctgccttggtccggttgcttcgtaaagccagggatatggatctaaccgaggtcataacaggcactctctggaatctgagtagccatgactctattaagatggaaattgtcgaccacgccctccatgccctgacagacgaggtgatcatccctcacagcggatgggaacgcgaacctaacgaggattgtaagccacgtcacattgagtgggagagcgtacttaccaatacagcaggttgtctgagaaacgtcagctctgaaaggtcagaggccaggagaaaactaagggaatgcgacgggctcgtagatgcattgatctttatcgtacaggccgaaattggacagaaagatagcgacagcaaattggtggagaactgtgtgtgtctgctgagaaacctctcctaccaagtgcacagagagatcccccaggcagagagatatcaggaggcggctcccaatgtggcaaacaacacagggccccatgccgcctcttgctttggagctaagaagggtaaaggaaaaaaacccatcgaagatccagctaatgatacagtggacttcccaaaacggacctcacctgcacgaggctacgagctgctattccagcctgaggtggtgcgcatatatatctccctgttgaaggagtcgaagactccagcaatccttgaggcatccgcgggagctattcagaatctgtgcgccgggcggtggacctatggccgatatattcgaagtgcactgagacaggagaaagcattatcagccattgcagacctgttgaccaacgaacacgaacgtgtggttaaagcagcatcgggagctcttaggaatttagccgtagacgcacgcaacaaggagttgatcggtaagcacgctatccctaatttagtgaagaacctcccagggggccaacagaattcatcttggaacttcagcgaggacactgtgatctccattctgaacacaatcaatgaggtgatagctgagaatctcgaggccgctaagaaattaagggagacacagggcattgaaaagctggtcctcatcaataagtccggaaacagaagcgagaaagaggtccgcgcagcagccctggtgctgcagacaatctggggttataaagaattacgcaagcctttagagaaggaaggctggaagaaaagtgattttcaggttaacttaaataacgcctctagatctcagagttctcattcttacgacgattcgacactgccgcttatcgatcgcaaccaaaagtcagataacaattactccacaccgaacgagaggggcgaccataatcggacgttagacaggagtggagacctgggggatatggagcctctaaagggaacaacccccctaatgcaggacgaaggtcaggaaagcttggaagaggagctagatgtgctcgtgctggacgatgaaggcggccaggttagctacccatcaatgcaaaaaatatag

SEQ ID NO: 111095 - DNA, 2745 bp, Artificial Sequence
  Description of Artificial Sequence: Synthetic coding sequence
atggcaaatgggactttaactcgtcggcaccagaacgggcgtttcgttggggatgccgatctggagcggcagaagttcagtgaccttaaactgaacggcccacaggatcatagtcatttattgtacagcacaatcccccggatgcaagaaccgggacagatcgtcgagacctataccgaggaagatccagagggtgctatgtcagtcgtgtccgtggagactagtgatgatggtacaaccagacggaccgaaacaactgtcaagaaagttgtgaagacggtgacaactcgcactgtgcagccagtggctatgggccccgatggcctgccggtggacgcctctagcgtaagcaacaattacattcaaaccctcgggcgcgactttcgaaaaaacggcaacgggggcccgggaccttacgttggtcaggccggcaccgctacactaccccggaactttcattacccccctgacggctattcacgccactacgaagatggctatcctggagggtcggataattacgggagtttgtctcgagttacacgcatagaggagaggtacaggccctctatggagggatatcgggcaccctctaggcaggacgtgtacggaccgcaaccccaggtccgggtcggagggagctccgtggacctgcaccgatttcacccagagccatacgggctggaagatgatcagaggtcgatgggatatgatgacttagactacgggatgatgtccgattatggtacagccagaagaactggcacacccagtgacccaaggcgccggctcaggagttatgaggatatgattggagaggaggtcccctcagaccaatattattgggctcctctagcccagcatgagcgcggtagcctggcatcactggattccctgcgcaagggcggccccccaccaccgaactggcgacagcctgaattgccagaggttatcgccatgttaggatttagactggacgcagtgaagtcaaacgccgcggcatacctgcagcacctttgttaccgaaacgataaggttaagacagacgtgcgcaagctgaaagggattccggtcctcgtgggcctgctggatcatcctaaaaaagaagtgcacttgggtgcttgcggcgccctaaagaacatctctttcggacgggatcaggataataaaatcgccatcaaaaattgtgatggcgtccctgccctggtgcggctcctcagaaaagcacgcgacatggacctgactgaagtaatcacagggactctgtggaacctgagttctcacgactcaatcaaaatggaaatcgtagatcacgccttacacgcactgaccgacgaggttataattcctcacagcgggtgggaacgcgagcccaatgaagattgtaaaccccggcatattgaatgggagagtgttctcacgaacaccgccgggtgcttgcggaacgtcagctctgaaaggagtgaggcacgcaggaaactgcgtgaatgcgatggtctggtggacgctctgatcttcatagtgcaggccgaaatcggccaaaaggacagcgactcaaagttggtggaaaattgcgtttgcctgctgcgcaacctgtcttaccaggtgcaccgtgaaattccgcaggctgagcgctatcaggaggccgcacctaatgttgctaacaacaccgggccccatgcagcctcttgttttggggccaaaaagggaaaagacgagtggtttagccgtggtaaaaagccaatcgaagaccccgccaatgacactgtggacttccctaaacgtactagtcctgccaggggatatgagctactgttccagcccgaagtcgtgcgaatctatatcagcctgcttaaggaaagcaaaacacccgccattctggaagccagtgccggcgccatacagaacctgtgcgcagggcgatggacctatggacggtatataagatccgccctgaggcaggaaaaagccctgtccgctatcgccgaccttctgactaacgaacacgaacgagtcgtcaaggccgccagtggcgccttgaggaaccttgcggtagatgctcggaataaggaattgatcgggaagcacgcaattcccaatcttgtgaagaatttgccaggaggccagcagaactctagctggaatttctccgaagataccgtgatctccatactaaacacaatcaacgaggtgattgcagagaatctggaagccgccaagaaactccgggagacccaggggatagaaaaattggtcctgattaacaaatctggcaatagaagtgagaaagaggtcagagccgcagcccttgttctgcagacaatctggggctataaggaactgcggaaaccccttgagaaggaggggtggaagaagagcgactttcaggttaacctgaacaacgcatcgcgatcccagagttctcacagctacgacgatagtaccttgcccctgattgaccgaaaccagaagtcagacaaaaaaccagaccgggaagaaatccagatgagcaacatgggctcaaacactaaaagcctggacaacaactacagtacgccgaatgagagaggggaccataatagaaccctcgaccgctcaggcgatctgggggacatggaacccctgaaaggaacaactcccctcatgcaggatgaaggtcaggaaagtctcgaagaggagctcgacgtgctggtgctggacgatgaaggaggccaggtgtcctaccccagcatgcagaagatctag

SEQ ID NO: 111096 - DNA, 381 bp, Artificial Sequence
  Description of Artificial Sequence: Synthetic coding sequence
atgatcggagaagaggtccctagcgatcaatactattgggctccgctagcacagcacgagcgcggaagcttggcctctctggatagcctgcggaagggaggcccgccgccgccaaattggagacagccggaactacctgaagtcattgcaatgttgggcttccgtctggatgctgtcaaaagtaatgctgctgcctatctacagcacctgtgttaccgcaatgacaaagtcaaaactgacgtgcgaaagctaaagggcatacccgtgctagtggggctacttgaccatcctaagaaggaagtgcatctgggagcttgtggagctcttaaaaatattagttttggacgggaccaagataataagatcgcgataaagaattag

SEQ ID NO: 111097 - DNA, 2640 bp, Artificial Sequence
  Description of Artificial Sequence: Synthetic coding sequence
atggctaacggcacgctcacacgacgtcatcaaaacggacgcttcgtcggggatgctgaccttgagagacagaaattttcagacctcaaactgaatggcccacaggatcactcacatctgttatactctaccattccaaggatgcaggaacctggacagatcgtggaaacctatacagaagaggatcccgaaggcgcaatgtctgttgtttccgtcgagacttccgacgacgggacaacgcgcagaaccgaaacaacagtcaagaaagtagtgaaaactgtaacaacccggacagtgcagcctgtcgccatgggtcctgacggtttaccggtggacgcctcatccgtatcgaataactatatccaaacactgggccgcgatttccgtaaaaacggaaacggcggacctggcccctatgtgggccaggctggcacagccaccctccctcgcaactttcactaccccccagatggttattcccggcactatgaagatggctatcccggaggaagcgacaactatggcagtctgagtagagtgactcgcatcgaggaacgctacagaccttctatggaaggataccgagctccctcaagacaggatgtatatgggccacagcctcaggtccgcgtaggtggtagttccgtcgaccttcaccgattccacccagagccctatggcctcgaagatgatcagaggtctatgggctacgacgacttagattatggtatgatgagtgactatggcaccgcacggcgaaccggtacaccaagcgaccctcggaggcgattacgctcttatgaggatatgatcggagaggaagtgccgtctgatcaatattattgggctccactagcccagcacgagcgcggcagcctggcctccctcgactccttgaggaagggcggcccccctccacccaactggcgccagcccgagcttcctgaagttattgccatgctgggcttcagactggacgccgtgaagagcaacgcagcagcttacttacagcacctgtgttatcgtaatgacaaggtgaagaccgatgtacggaagttaaagggaatccctgttctcgttgggctgctcgatcatcctaagaaagaagtgcacctaggcgcttgtggcgctcttaaaaacattagcttcggtagggatcaagataataagatagcaatcaagaactgtgatggggttcctgcgcttgtgaggctgttaaggaaggcgcgcgacatggatttaacagaggttattaccggaactttgtggaatctttctagtcatgattcaataaagatggagatcgtagaccacgcccttcacgccctgactgacgaggtgatcattcctcatagtggttgggagcgggagccgaacgaggactgcaagcccaggcatatagagtgggagtccgttctgactaacacggccggctgcctgcgcaatgtgagtagcgagcgctcagaggccagaaggaaattgcgtgagtgtgatgggttggtggatgccctgatcttcatcgtgcaggctgaaattggacagaaagatagtgacagcaagcttgtcgagaattgcgtgtgccttctgcgaaatctgagctaccaggtacaccgcgagattcctcaggctgagcgatatcaagaggcggctccaaatgtggcgaataatacgggcccgcatgctgcatcttgctttggcgcgaagaaggggaaaggaaagaagccaatcgaagatcccgccaacgatacagtggatttcccgaaacgaacatcgcctgcgcgaggttatgaactgctgtttcaacctgaagtcgttaggatttatattagtctattaaaagagtccaagaccccagccatcttagaagcttccgcgggagcgattcagaatctgtgcgccgggcgatggacatatggtcgctacatacgcagtgcactgcgacaggagaaagccctgtctgctatcgccgatctactcactaatgagcacgaacgtgttgtgaaggcagcatctggggcgctcaggaacctcgctgtggacgccaggaacaaagagttgatcgggaaacatgctatccccaacctcgtgaaaaacttgcccggcgggcaacagaactcttcttggaacttctctgaagacactgtgattagcatcttgaacacgattaacgaagtcatagcagagaacctcgaggccgctaagaaattgagagagacacagggcatcgagaaactggtgttgattaataagtcaggcaaccgtagcgagaaggaagttagagccgccgccctagtattgcagaccatatggggctataaagagctgcgcaagcctctcgaaaaagaagggtggaagaagtcggatttccaggtaaacttgaataacgccagccgatcccagtcgtcccactcctatgacgactccactctgccactgatcgatagaaaccagaaaagtgataaaaaacccgatcgcgaggagatccaaatgtcaaacatgggctccaacaccaaatctttggataacaattatagcacacccaacgagcgaggcgatcacaatcggactctggatagatccggagatctcggggatatggaacccctgaaaggaactacccccctgatgcagaaaatctag

SEQ ID NO: 111098 - DNA, 3678 bp, Artificial Sequence
  Description of Artificial Sequence: Synthetic coding sequence
atgttcgcccgcaagcccccaggcgccgcccccctcggcgcaatgcccgtgccagaccaacctagcagtgcttctgaaaaaacatcttcacttagtcctggtcttaatactagcaatggcgacggaagtgaaacagagacgacctcagcaattttggcttcagtcaaggagcaggaattacagttcgaaaggctaactcgcgaactggaggcggaaagacagatagtagcaagccagcttgagcgatgcaagctgggttccgagaccgggagtatgagcagcatgtctagtgctgaggagcagttccaatggcagagtcaggatggacagaaggacattgaagatgaactgaccactggcttggagttagttgatagctgcatccgaagtcttcaggaaagtggaatcctggaccctcaggattacagtacaggagagcggccctcacttctgtcccagtctgccctacaactgaactcaaaacccgagggaagctttcagtaccccgcatcataccactctaaccaaactttggcattaggggaaaccaccccctctcagctgcccgctcggggaacccaggcgagggcaaccgggcagagctttagccagggcacaacctccagagcagggcacctggccggccccgagccagctcctccccccccaccgcctcctcgagagcccttcgcgccctccctaggtagcgcctttcacctgccggatgcgcctccagccgctgccgccgcagccctgtactattcatcaagcaccctgcctgcaccacccaggggaggaagcccacttgcagccccccagggtgggagccctactaaacttcagcgtggcggttccgccccggagggcgctacctacgcagcacctcgcggaagcagccctaaacagagtcctagccggctggccaaaagttattctacgtcctctcctattaacattgtagtctcctcagctggcctctctccaatccgcgtgacgtcaccccctactgtccagtccactatatcctcgagccccattcaccagctttcatctacaattggaacctacgcgacactttctcctactaaaagactggtgcacgcttctgagcagtactcgaagcactctcaggaattatacgctaccgccacccttcagagaccaggctccctagccgccggatccagagcgtcctactccagccaacacggccacctgggtccagaactgagggctctccagagtcccgaacatcatatcgatccgatctatgaagacagggtatatcagaagccacctatgaggtccctgtctcagtctcagggggaccctctgccgcccgcgcatacaggcacctacagaaccagcaccgcacctagtagtccgggcgtcgattccgtgccattacagaggactggttcccagcacggaccacaaaatgctgccgccgccacctttcaacgggcatcgtacgccgcaggaccagcctcaaactacgcggacccgtatagacagctgcagtactgtccatccgttgagagtccctattctaagagcggtcccgcactgcctcctgagggcactttggccagatctccctcaatagatagtatccagaaagacccccgggagttcgggtggcgagatccagagttacctgaagtgattcagatgctgcagcatcaattccctagcgtgcagtcaaacgctgcggcctacctgcaacatttgtgttttggagacaataagattaaagccgagataaggcggcaggggggtatccagctcctagtcgatctcttagaccaccggatgaccgaggttcatcggagcgcttgcggcgctctccgcaacctggtgtatggtaaagccaatgacgataacaagatagctctgaagaattgcggaggcatcccagccctggttaggctgttgcggaaaacgacagacctggaaattagggagctcgtcacaggcgtgttatggaatcttagctcatgcgacgccctgaaaatgccaattattcaggatgctttggctgttctaaccaacgccgtgatcataccccacagcgggtgggaaaactctcctctgcaggacgacagaaagattcagctccacagctcacaggtactgcgtaatgccactggatgccttaggaatgtctccagtgccggggaggaggcacgaagacggatgagagaatgtgatggactcaccgatgccctcctttacgtcattcagtcagccctcggcagcagtgaaatcgattctaagaccgtggaaaactgtgtgtgtatcctgcgaaacctgagttaccggctggcagctgaaacatcacagggacagcatatggggactgatgagctagacggacttctgtgtggggaggccaatgggaaggacgcagagtcttctgggtgctggggcaaaaagaaaaaaaagaagaaatctcaagatcaatgggatggcgtgggacccctccccgactgtgccgagcctccgaagggtatccaaatgctctggcaccccagcatcgtcaagccttatttaacattattgtccgaatgctccaatcctgatactttggaaggggcagccggtgctctgcaaaacctcgcagctggctcctggaagtggtctgtgtatatccgcgcagctgtgcggaaggaaaaaggcctccccatcctagtcgaactgctcagaattgacaatgaccgcgtggtgtgtgctgtcgccacagccctccgcaacatggcactcgacgtgcgcaacaaggaactcataggaaagtatgccatgcgggatctggtgcacagactgcccgggggcaataattccaacaacaccgctagtaaggccatgagcgatgatactgtgactgcagtttgctgcacccttcatgaagtgatcacgaaaaatatggagaacgctaaagctctacgagacgcaggaggtatcgagaaacttgtcggtatcagtaaatcaaaaggtgacaagcactcccccaaagtcgtcaaggccgctagccaggtgctcaactccatgtggcagtacagagacctgagatccctgtataagaaagacggttggtctcaatatcacttcgtggcttcctcgagcactattgagcgcgaccggcaaagaccatactcctctagtcggactcctagcatctcccctgtgcgggtctctcccaacaatcgaagcgcctctgcaccggcatcgccgagggaaatgatcagcctcaaagaaagaaagacagattacgagtgcaccggaagtaatgccacctaccatggagccaaaggagaacatacatccaggaaggacgccatgaccgcccagaatactgggatctcgaccctgtataggaactcctatggcgccccagcagaagatataaagcacaatcaggtgtcagctcagcccgtccctcaagagccttcacgaaaggactacgagacatatcagccgtttcagaacagtacgaggaattatgacgaatctttctttgaagatcaggtccaccacagaccccccgcctccgagtatacaatgcatctgggtctgaagtccactggcaattacgttgatttttactcagcagctcgtccctattctgagttgaattacgagacctctcattatcctgcctcgcctgacagttgggtgtag

SEQ ID NO: 111099 - DNA, 3504 bp, Artificial Sequence
  Description of Artificial Sequence: Synthetic coding sequence
atgtttgccaggaagcccccaggagccgcccccttaggagcaatgcccgtgccagaccagccttcctccgccagcgagaaaaccagctccctgagccccggcttgaatacaagcaatggagacggatccgaaacagaaaccacatccgcgattctggccagcgtcaaggagcaggaacttcagtttgaaaggttgacgagagagctcgaagcagaaagacagattgtggcgtcccagcttgagaggtgcaaactaggatctgagaccggaagtatgtcatcaatgtcctctgccgaggagcagttccagtggcagtcccaagatggccagaaagacattgaggacgagctcactacaggtttagaactagtggactcttgcattagaagcctgcaggaaagcggcatactggatccccaagactactcaacaggtgagagacctagcctgctgagtcaatctgcactgcagttaaacagtaaacccgagggatcatttcagtatccagcatcataccactccaaccagaccctggccttgggcgaaactaccccaagccagctgcctgccaggggcacccaggctagagctaccggacagtcattttcgcaaggcaccacaagtcgagcaggacaccttgcaggcccagagcccgccccaccgcctcctcctcctccacgggaaccattcgcacccagcttgggcagtgcctttcacctgcctgatgcccctcctgctgctgcagcagcagctctgtattacagctctagtacattaccagctcctccgagaggaggctctccactcgccgctccgcagggggggtcccccaccaagctgcagcgaggaggatcagcgcctgagggcgctacatatgccgctccaagggggtcttcaccaaaacaaagcccctccagattggcaaaatcctacagtacctccagtccaattaacatagtggtcagcagcgcaggcttaagccccataagggtcactagcccaccgactgtgcagagcactattagctcaagccctattcaccaactctcgtctaccatcgggacctacgctacactgtccccaaccaagcgactggttcatgcatcagagcagtattccaagcattctcaagagctgtacgcaactgccactctccagagaccaggatccctcgcagccgggagccgcgcaagctactccagtcagcatgggcatctaggcccagaactgcgcgcattgcagtctccagaacaccatatagacccaatctatgaggacagggtgtaccagaagccccccatgcgtagtctgtctcagtctcagggagaccccctaccacctgcgcacacgggaacctatcgcacttccacagcccccagcagccccggggtcgactcagtgcctctccagcggacaggtagtcagcatggaccccaaaacgcagccgctgcaacctttcagagggccagctatgccgccgggcctgcctctaactatgctgatccttatcgacagctgcagtattgtcccagcgtggaaagcccgtactccaagtctggaccagccctgccccctgaaggaaccctggcgcgctctccctccatcgatagcattcaaaaggaccctagggagttcggttggcgcgaccctgaacttccagaggtgatccaaatgctgcagcaccagtttccaagcgtacagtccaatgccgcagcctacctgcagcacctgtgtttcggcgataacaaaatcaaagccgaaatccggcggcaaggaggaatccaattgctggtagatctgctggatcacaggatgactgaagttcataggtctgcgtgtggggctctgcggaatcttgtttacggtaaggccaatgacgataacaagatcgcactcaaaaattgtggcgggataccagcacttgtcaggctgctgcgcaagacgacagaccttgaaattagagagcttgtgacgggtgtgctctggaacttgagctcttgcgatgccttgaaaatgccaataattcaggacgctctggctgtcctcactaacgcagttattatcccacattcagggtgggagaactccccccttcaggacgacagaaagatccagctccactctagccaggtgctgaggaacgcaacggggtgtctccgcaatgtttctagcgctggtgaggaagcaagacggcggatgagagagtgtgacggactgacggatgccctgctatacgtcatccagagtgctttaggctcctcagagatcgacagtaaaacagtggaaaactgcgtctgcatcctgcggaacctgtcgtatcggttggcagccgagaccagccagggacagcatatgggaacagatgaactcgacgggttgctttgtggggaggcaaatggcaaggatgccgagagctcaggctgctggggcaagaaaaagaagaagaagaagtcccaggatcagtggtcagtgtacattcgcgcagccgtgcgcaaagaaaaagggcttcctatccttgtggaacttctgcgaatcgacaatgatcgggtggtctgtgctgtcgctaccgctctgaggaacatggctcttgacgtccggaacaaggaactgatcgggaaatacgccatgagggacctggtccaccgactgcccggcggaaataactccaacaacactgcctcaaaagcaatgtcagatgacaccgtgaccgctgtgtgctgtacacttcacgaggtgatcactaagaacatggagaacgctaaggctttgcgcgacgcaggaggcattgagaagctggtaggaataagtaagtccaaaggtgataagcacagcccaaaggtcgttaaagccgcctcccaggttctgaactctatgtggcaataccgagatctcaggtctctgtataagaaggacggatggagtcagtaccacttcgtggcttccagctctactattgagcgggatcgccagcgtccctacagcagctcacggactcctagcatatctcccgtccgtgtgagtcccaataatcggagcgccagcgccccggcttcacctcgggagatgataagcttgaaagagagaaagactgactacgaatgcacgggctccaatgcaacataccacggtgccaagggggaacatacaagccgaaaagacgctatgacagcacagaataccggaatctctaccctttacaggaattcgtatggggctcctgcagaagacataaaacacaatcaagtaagcgctcagcccgtacctcaggaaccgtcccgcaaagattacgagacatatcaaccctttcaaaacagtactcggaattatgacgagtctttctttgaggatcaagtgcatcacaggcccccagcttccgagtatacaatgcacctggggctgaaaagcacgggaaactacgttgacttctacagtgccgcaagaccttattcagaactgaattatgagaccagtcattacccagctagcccagactcatgggtctag

SEQ ID NO: 111100 - DNA, 2379 bp, Artificial Sequence
  Description of Artificial Sequence: Synthetic coding sequence
atgaggtctttgagccagtcccagggggatcctctgccaccagctcacactggtacctacaggacttccactgccccatcgtccccaggcgtggattcagttccattacagcggaccggatcacaacatggacctcagaacgctgcagccgccacctttcagagggcctcatatgccgcgggtccagcgtctaattatgccgatccgtaccgccagcttcagtattgccccagcgtggaatcaccctactccaagtcaggtcccgcgcttccccctgagggcaccctcgcacgcagtccatccatcgatagcatccagaaggatccacgcgaattcggctggagagacccagaattacctgaggtgatacaaatgctccagcaccagtttccatccgtgcaaagcaatgccgctgcttatctgcagcacctgtgcttcggcgacaacaagattaaggctgagatccggagacaaggcggcattcagctcctggtcgaccttttggatcatcggatgaccgaggtacaccgatctgcgtgtggcgcccttagaaatctggtgtacgggaaggccaacgatgataacaagattgctctgaagaattgcggaggcattcccgccctcgtacggctgctgaggaagaccaccgatctggaaattagggaattggtgaccggtgtactgtggaacctgagcagctgcgatgcattgaagatgcccatcatccaagacgctcttgcagtgctcactaacgcagttattattcctcattctggatgggagaatagtccactgcaggatgatcggaagatccaacttcactcaagccaggtcttacggaacgccaccggatgtcttcgcaacgtaagtagcgctggagaagaggctagaaggagaatgagagaatgtgacggcctcaccgatgctctgctctatgtgatccagagtgcactcggcagctcggaaatagattctaaaaccgttgaaaattgtgtgtgtatcctgcggaacctgagttaccgacttgcggccgaaacatcacaaggtcagcacatgggcacagacgagctggatggcctcctgtgcggcgaagctaatggcaaagacgctgaaagctccggctgttggggcaaaaagaaaaaaaaaaaaaaatcacaggatcaatgggatggggttggacccttaccagactgcgccgagcctccgaaagggatccagatgttatggcatccttcgatcgtcaaaccctatctcaccctcctttccgaatgctccaacccggatacccttgagggcgcggcgggcgcacttcagaatcttgcggccggaagctggaagtggagcgtttacatcagagctgcagtgcggaaggagaaaggcctgcctatcttagtagagctgttacggatcgacaacgacagagtcgtgtgcgccgttgctactgctctgagaaatatggccctggacgtgaggaataaggagcttatcggcaagtacgccatgcgcgatctggtgcaccggcttccagggggtaataattccaataacacggccagtaaggcaatgtcagacgataccgttactgccgtgtgctgcacactgcacgaggtgatcaccaagaacatggagaacgcgaaagcccttcgtgatgccggagggatagagaagctcgtcgggatttctaaaagcaagggggataagcattccccaaaagtagtcaaggccgcaagtcaggtgttgaattccatgtggcagtaccgtgatctccgctctctctataagaaagacggctggagccagtatcatttcgttgcttcttctagcacaattgaacgcgatcgtcaacgcccctattcatcttctcgcaccccgtctatatcccccgtgagggtctctcccaataatagaagcgcatctgctcccgcctcgccgcgggaaatgatctccctgaaagaacggaagacagactatgagtgtaccggctcaaacgccacctaccatggcgccaaaggggagcatacatccagaaaggacgcgatgactgctcagaataccggcataagcactctctacagaaactcctacggtgcgcccgctgaagatattaagcacaaccaggtgagtgcccagcccgttccccaggagcctagtcgtaaggactatgagacctaccagcctttccagaacagcacacgcaattatgacgagagtttcttcgaagaccaggtccatcacaggccgccagcgagtgagtacacgatgcaccttggcctgaagagcaccggaaattatgtcgacttttattctgctgcaagaccgtattccgaacttaactacgaaacttctcattaccctgccagtccagattcttgggtttag

SEQ ID NO: 111101 - DNA, 2667 bp, Artificial Sequence
  Description of Artificial Sequence: Synthetic coding sequence
atgagcagtatgtcatccgctgaggagcagtttcagtggcagagtcaggatggtcagaaggacattgaggacgaactgaccacgggactggagctggttgatagttgtatcaggagtttgcaggaatccggcattctggacccccaagactattccacaggcgaaaccggatccagggcatcatattcctcacaacacggtcatctgggacctgaactgcgcgccctccagagcccagagcaccacatcgatcccatctacgaagacagggtgtaccaaaagccgccaatgaggtccttgagccagagccaaggagatcccctgcctccagctcatacaggcacttataggacgtctactgctccttcctcacccggcgttgattcagtacccctgcagaggaccggatcccaacacggtccacagaatgccgccgctgcaacgttccagagggctagctacgcggccggtccggcttcgaattatgccgatccctacaggcagttgcaatattgcccttctgtcgaatccccttattccaagagcggcccagctctccccccagaaggaacgctggctcgatcaccttcaatcgattccattcagaaagacccacgggagttcggttggcgggacccagagttgcctgaagtgattcagatgttgcagcaccagttcccatcagtccagagcaatgcggccgcctatctccagcacctgtgtttcggcgataacaaaattaaggccgaaataagaaggcaagggggaattcaactgttagtcgatctgttggaccacagaatgactgaggtacacagatctgcctgtggcgcgttacggaatctggtttacggcaaagctaatgacgacaacaaaatcgctctgaagaattgcggtggaattccagccctggtccggcttctgaggaaaacaaccgatctggaaatccgagaactcgtaaccggcgttttgtggaatctgagctcctgcgacgctcttaagatgcccattatccaggacgctctggctgtcctgaccaacgcggttattattccccatagtgggtgggagaattcgcctctgcaagacgatcgaaagatccagctgcatagcagtcaggtgttgaggaatgctacaggctgtctccgcaatgtgtcctccgccggcgaagaagctaggaggaggatgcgggagtgcgacgggctgacagacgccctcctgtacgtgattcagagcgccttggggagcagcgaaattgatagtaaaaccgtggagaactgtgtgtgcatcctccggaacctttcctacaggctggcagccgaaaccagtcagggacagcacatgggtacggatgagttggacggtctcctgtgtggcgaggctaatggtaaagatgcggagtcatcaggctgttggggcaagaaaaagaaaaaaaagaagagccaggaccagtgggacggggtgggacctttgccagactgcgccgaacctccaaaagggatccagatgctgtggcacccctccatcgtgaaaccatatctgacactgctttccgagtgtagtaatcctgacaccctcgagggggcagctggtgctctccagaacctggctgcaggttcatggaagtggtctgtgtatataagggctgccgttcggaaagagaaaggcctcccgatccttgtggagctgctacggattgataatgacagagtagtctgcgccgttgccaccgctttgcggaacatggctctcgacgtacggaataaggaactgataggcaaatatgccatgagagatctcgtgcacagactcccaggaggaaataatagcaataatactgcctcaaaagcaatgagcgatgacaccgtaacagccgtctgttgcactcttcacgaggtaataacaaaaaacatggagaatgcaaaggccctgcgagatgcagggggcattgagaaactggttgggatctcaaagtccaaaggagataaacactctcctaaggtcgtgaaggccgccagccaggtgctgaattccatgtggcagtaccgagaccttagatccctgtataagaaggatggatggagtcagtatcatttcgttgcgtccagctccacgatcgagcgggatcgtcagcgcccttactcatcctcccgaacacctagtatttctcccgtacgcgtctccccaaacaaccggtccgcttccgcgccagcttcgccaagggagatgatcagcctgaaggaacggaagactgattacgagtgcactgggagcaacgccacctaccacggtgcaaaaggcgagcatacatcccgaaaggatgctatgaccgcccagaacacgggtatcagcacactgtataggaatagctatggtgctccagccgaggacatcaagcacaatcaagtcagtgcccagcccgtcccccaggagcccagtaggaaagactacgaaacctaccaacccttccagaattcaacccggaattacgacgagtccttcttcgaggaccaggtacatcatcggcctccagcctccgaatatacaatgcacctgggactcaaaagcactggaaattatgtggatttctactctgctgcaaggccttattccgagttaaactatgaaacctcccactatccggcgagtcctgactcctgggtgtag

SEQ ID NO: 111102 - DNA, 546 bp, Artificial Sequence
  Description of Artificial Sequence: Synthetic coding sequence
atgagtagcatgtcgtctgccgaggaacaatttcaatggcagagccaagatggacagaaggatattgaagatgaattgaccaccgggcttgaactggtcgactcctgtatccgctccttgcaggagagcgggatcttggatccccaggactattcgaccggtgaaaggccaagtctgctgtctcaatcagccctccagctcaatagtaaaccagaaggttctttccagtatccagcatcctatcactctaaccagaccctggctctaggtgagactaccccctcgcaacttcctgctcgcgggacccaggctagagctaccggccagtctttctcccaagggacgacctcacgggccggccatttagctggacccgagcccgcacccccacctcccccacccccccgtgaaccgtttgcaccaagcttagggagtgcatttcatcttcctgacgcaccccctgcagccgcagccgcagcactatactatagttcttccacacttccagcacctccacgcggcgggtctccactcgctgcgccctag

SEQ ID NO: 111103 - DNA, 963 bp, Artificial Sequence
  Description of Artificial Sequence: Synthetic coding sequence
atgacagtatggtgtgccgtggcgacagccctccggaacatggcactcgacgtcagaaataaggagttaattggaaagtacgcgatgagggacctggtgcaccgactacctggggggaataattccaacaatactgcatctaaggctatgtcagacgacacagttactgcggtgtgttgtacactgcacgaggtgattaccaagaacatggaaaacgcgaaagcgctgagggacgctggcggaattgagaaactagtcggcatcagtaaatccaagggggacaagcactcacctaaggtcgtgaaggccgctagccaggttctaaatagtatgtggcagtaccgggatctgcgtagtctctataagaaggatggttggagccagtatcacttcgttgcttccagcagcaccattgaaagagatcgtcagcgcccgtactcttcttctcgcactccttcgataagccctgtacgcgtgagccccaataatcggagcgcctctgctccggcctctccacgcgagatgatttctctgaaggagcgtaaaactgactacgaatgtactggctctaatgccacgtaccatggcgccaagggtgagcacactagccgcaaggatgcaatgacggctcagaataccggcattagtacgctatacagaaattcatacggggcaccggccgaggacatcaaacataatcaggtttctgctcagcctgtaccacaagagccgtcgagaaaagactatgagacatatcagcccttccagaactccactcgcaactacgatgagtccttcttcgaagatcaggtgcaccacagaccaccagcgagcgagtacacgatgcacttaggcctgaaatccactggaaattacgttgacttctattctgccgcacgaccatactctgaacttaattacgagacaagccactatcctgcctcccccgactcgtgggtctag

SEQ ID NO: 111104 - DNA, 246 bp, Artificial Sequence
  Description of Artificial Sequence: Synthetic coding sequence
atgaaccgagagggtgctcccgggaagtccccagaagagatgtatatccagcaaaaggttcgtgtgctgttaatgcttagaaaaatggggagcaacttgaccgcttctgaggaggagttcctgaggacatatgcaggcgttgtcaattctcaattaagccagcttccgccccatagtattgatcagggtgctgaggacgtggtcatggcctttagtagatccgagacggaggacaggagacagtag

SEQ ID NO: 111105 - DNA, 246 bp, Artificial Sequence
  Description of Artificial Sequence: Synthetic coding sequence
atgaacagggaaggcgcccctgggaagagtccagaagagatgtatatacaacagaaagtgagagtactccttatgctccgcaaaatggggtcaaacttaactgctagcgaggaagagtttctccggacgtatgcaggcgtcgttaactctcagttatcccagctccccccacattccattgaccagggcgccgaggacgtggtcatggcatttagccgctccgagacagaggataggcgacagtag

SEQ ID NO: 111106 - DNA, 246 bp, Artificial Sequence
  Description of Artificial Sequence: Synthetic coding sequence
atgaatcgagaaggcgcacccgggaaaagccctgaagagatgtatattcagcagaaagtaagagtacttcttatgctgcgcaagatgggatccaacctgacagcatctgaggaagagttcctgcgaacctatgcaggcgtcgtgaattctcagctgtcgcagctgcccccacactctatcgaccagggcgcggaagatgtggtaatggcgttcagtcggtcagaaaccgaggacagacgacaatag

SEQ ID NO: 111107 - DNA, 246 bp, Artificial Sequence
  Description of Artificial Sequence: Synthetic coding sequence
atgaaccgggagggggctccaggaaagagccccgaagaaatgtacatccaacagaaggtccgtgtcctactgatgctcaggaaaatgggttctaacttgacagcttcagaagaggaatttctgagaacctacgccggcgtcgtcaattctcagttaagtcagctccccccccatagcatcgaccagggcgcagaggatgtggttatggcattttcccggtcagagactgaggaccgtagacagtag

SEQ ID NO: 111108 - DNA, 246 bp, Artificial Sequence
  Description of Artificial Sequence: Synthetic coding sequence
atgaatcgagaaggtgctccggggaagtccccggaggaaatgtacattcagcagaaggtgagagtattactcatgctacggaagatggggagcaacctcactgcttccgaagaggagttcctgcgcacttatgccggagtcgtgaactctcagctatcccagctgccgcctcactcaatcgaccagggggcggaggatgtggttatggcgtttagccggagcgagaccgaggaccggcggcaatag

SEQ ID NO: 111109 - DNA, 1692 bp, Artificial Sequence
  Description of Artificial Sequence: Synthetic coding sequence
atggatgttggagaactgctctcttatcagcctaaccgcggaaccaagagacctcgggatgacgaggaagaggaacagaagatgcgtcggaaacagacaggcaccagagaaagaggtaggtatcgtgaggaagaaatgaccgtcgtggaggaagccgatgacgataaaaaaaggctgctgcagattatagatcgtgacggcgaggaggaggaggaggaagaggagccgctggacgagtctagtgttaaaaagatgatcctgacgtttgagaagaggagctataaaaatcaggagctgaggatcaagttcccggacaatccagagaagtttatggagtcagagctggacctcaatgacattatccaggagatgcacgtggtggccactatgcctgacttgtatcacctcctggtagaactcaatgcagtgcaatctcttctgggactgctagggcatgacaatacggatgtgtcgatcgcagtagtcgacctgctacaagaactcaccgatattgatacgctgcacgagagtgaggagggtgcagaggtgctgatcgatgcactggtggatgggcaggtcgtggcactccttgtgcagaacctggaaaggttagatgagagtgtcaaagaagaggccgacggagtgcacaataccttagccattgtcgagaatatggcagagttccggcccgaaatgtgtacagaaggggctcagcagggattgctccagtggctattgaaacgtctgaaagccaagatgccattcgatgcaaacaagctgtattgcagcgaagtcctggccatcctgctgcaggataatgacgaaaatcgggaactgctcggagaattagacggtattgatgtgcttttgcagcagctgtcagtttttaaacgccataacccctctaccgccgaggagcaggaaatgatggaaaacctcttcgactctttatgctcttgtctgatgctgtcatccaatagagaaagattcctgaaaggcgagggcttgcaactgatgaatctcatgttacgggaaaaaaagattagccggagcagtgccctgaaggtgctagatcacgcaatgataggacccgaggggacagataactgtcacaagtttgtggatattttgggcctgaggaccatctttcctctgtttatgaagagcccccgaaagattaagaaggtcggcacaacagagaaagagcacgaggaacatgtgtgttctatcttggcaagcctcctgcggaatctccgcggacagcagaggaccaggttactgaacaaatttacagaaaatgactctgagaaggtggatcgacttatggaactgcactttaagtatttgggagccatgcaggtcgccgataagaagatcgagggcgagaaacacgacatggtcagacgtggggaaattatcgacaacgacacagaagaggagttttatctccggcggctggatgcggggctctttgtccttcaacatatctgctatattatggccgagatctgcaacgccaatgtgccccagattcgtcagcgcgttcaccagattcttaatatgcgcgggtcatctatcaagatcgtccgccacattattaaagaatacgccgaaaacatcggagacgggaggtcccccgagttccgcgagaatgagcagaagagaattctgggactgctggagaatttctag

SEQ ID NO: 111110 - DNA, 1611 bp, Artificial Sequence
  Description of Artificial Sequence: Synthetic coding sequence
atgcggcggaaacaaactggcaccagagagcgtggacgctatagggaggaagaaatgacagttgtcgaggaagcggacgacgataaaaaacgccttctgcaaattatcgacagggatggagaagaggaagaggaggaggaggagccactggacgagtccagcgtgaagaaaatgatacttacgttcgaaaagcgtagctataaaaaccaggagctacgcattaaatttcccgacaacccggagaaatttatggaatccgagttggatttaaatgatataatccaggaaatgcacgtcgtagcgacaatgcctgatctgtaccacttgttagtcgaactcaacgcagtgcagagcctgcttggactgctgggccacgacaacactgacgtttctatcgccgtggtcgatttgctgcaggagctgaccgacatcgatacactccatgagtctgaagaaggtgcagaggtactgattgacgctctggtggacgggcaggtcgtggcactgctggtgcagaacttggagaggcttgatgagagtgtgaaggaggaggcggatggcgtccataatacactcgccatcgtcgagaacatggccgaattccggcctgagatgtgtacggagggcgcccagcagggattactgcagtggttgctgaagcggctcaaagcaaagatgccttttgacgccaataagctgtattgttccgaggtgctcgctatcctgctgcaggacaacgatgagaacagggaattgcttggagagctggacggcatagacgtgctgctgcagcagctcagcgtcttcaagcgtcataatccttccactgcagaagagcaggaaatgatggagaatctgtttgacagtctctgctcttgcctcatgctgtcctctaatagagagcggtttctgaagggcgaaggccttcagcttatgaaccttatgcttagagaaaagaaaattagtcgatcatccgcactgaaggtgctagatcacgctatgatcggcccagaagggacagacaattgtcacaaattcgtcgatatcttagggctccgcaccatcttcccccttttcatgaagtccccgcggaagattaagaaggttggaacaaccgagaaagaacacgaggaacacgtttgttcgattcttgcttcactccttcgcaacctgcgcggccagcagcgcaccagactgttaaacaagtttaccgagaatgattctgaaaaggtggaccggctgatggaactacacttcaagtacctgggcgctatgcaagtagcagataaaaagatagagggggaaaagcacgatatggtgcgacggggcgaaatcatagacaacgacactgaggaggaattctatcttcgccggttggatgccgggctgtttgtcctgcaacacatttgttatattatggctgagatctgcaacgctaatgtgccccaaatcaggcaacgggtccatcaaattctgaacatgcggggcagttccatcaagatcgttagacacataatcaaggaatacgccgaaaacataggggacggaaggagccctgagtttcgggagaatgagcagaagcggattctagggctgctcgaaaatttttag

SEQ ID NO: 111111 - DNA, 501 bp, Artificial Sequence
  Description of Artificial Sequence: Synthetic coding sequence
atgcgccgtaagcaaaccgggacacgcgaacggggtagataccgcgaagaggaaatgactgtggtcgaagaggccgacgatgacaaaaagaggctcctgcagattatcgatcgcgacggggaagaggaggaagaagaagaggagcccctggacgagtcctccgtgaaaaagatgatcctgacattcgagaaaaggtcgtacaagaaccaggaactgaggattaagtttcccgacaaccctgagaagttcatggagtccgaactcgacctcaacgacattatccaggagatgcacgtcgtggctacgatgcccgacttgtatcacctgctggtggaacttaatgctgtgcaatctctcctgggactgctgggccatgataacacagatgtgtccatcgccgtggtggatctcctgcaagagctgactgacatagacactttgcacgagtctgaagaaggcgccgaggtgttaatcgatgccttagtggacggacaagtatag

SEQ ID NO: 111112 - DNA, 1443 bp, Artificial Sequence
  Description of Artificial Sequence: Synthetic coding sequence
atgatccgggccgccccacctccgctgtttttactgctgttacttctgctgctgctggtgtcctgggcctctcggggtgaagctgcccctgatcaggatgaaattcagagactcccaggccttgccaagcagccatccttccgtcagtatagcggctatctcaaaggctctgggtctaaacatctccactattggtttgtagaaagccaaaaggatccagaaaactctcccgtggtgctgtggctgaacggcggcccaggctgcagcagcctcgatggattattgacggaacacggacctttcctggtgcagcccgacggagttaccttggagtacaatccgtactcttggaatcttatcgccaacgtgctgtatttagagagtcccgcaggagtgggattttcctatagtgacgacaagttctacgcaacaaacgatacggaagtcgcccagtctaattttgaggccttgcaggactttttccggttatttcctgagtacaaaaacaacaagctatttttaacaggggagtcatatgcaggaatatatatccccactctggctgtccttgtaatgcaggacccatcaatgaacctgcagggtctagccgtagggaatgggttatccagttacgagcagaacgacaattctctggtgtactttgcatattaccacgggctcctagggaatcggctatggtccagcctccagacccactgttgctcccagaataagtgcaatttctacgataataaagacctggagtgcgtcacaaatctgcaggaagttgctagaatcgtaggtaatagcggcctcaatatctataacctgtatgcaccatgtgcaggaggagtgccgtctcacttcaggtacgagaaagatacggtggtggtgcaggatctgggcaatatcttcacccgcctgccactcaaacgcatgtggcaccaagccttactgcgcagcggcgacaaagtgcgaatggatcccccatgcacgaacacaacagcagccagtacatatttaaacaatccatacgtaagaaaggctctgaatatacctgaacagctgccacaatgggatatgtgcaatttcctggttaaccttcaatacagacggttatatcggagcatgaacagtcagtatctgaagcttttgtctagtcagaaataccagatcctcctctataacggagacgttgatatggcctgtaattttatgggtgatgagtggtttgtcgactccctgaaccaaaaaatggaagttcagaggaggccctggcttgtaaagtacggtgactccggagaacagatcgcagggttcgtcaaggagttttcgcatatcgcgttcctgacaatcaagggagctgggcacatggtacctaccgataagcctctcgccgcctttactatgttttccagattcctgaataagcagccttactag

SEQ ID NO: 111113 - DNA, 1446 bp, Artificial Sequence
  Description of Artificial Sequence: Synthetic coding sequence
atgacgagcagtccgagagctccccccggcgagcaggggcgaggcggtgcagaaatgattcgtgctgcccctcctcctctctttttgctgttactgctgctcctcctgctcgtgtcatgggcctcacggggcgaggcagcacccgatcaggatgagatacagagacttcccggacttgccaagcaaccgagctttcggcaatactcagggtatcttaagggatctgggtctaagcacctgcactactggtttgtcgagtcacagaaagacccagagaacagcccagtggtcttgtggctgaacggtggacctggttgctcctctcttgacggcctgctcaccgaacacggtccctttctgatcgcaaacgtcctgtatctggagtcacccgccggcgtcggcttttcgtattcagatgataagttttacgccaccaatgatacagaggtggcccagtccaatttcgaagccctgcaggattttttccggctgtttcctgaatataaaaacaataagctattcctcacaggggagtcctacgccgggatctacatccccacactagccgtcctggtgatgcaggatccttccatgaaccttcaggggttagctgttgggaatgggttgagcagctacgagcaaaacgacaatagcctggtgtatttcgcttactaccacggccttctgggaaatcgcttgtggagcagtttgcagacacattgctgcagccagaataagtgtaacttttacgataacaaagatttggagtgcgttactaatctccaggaggttgctagaatagtcggaaactcaggactcaacatttataatctgtacgctccatgcgctgggggtgttccgtcccatttccgatacgagaaggacactgtggtggtgcaggacttggggaacatctttacccggctgcctctgaagcggatgtggcatcaggccctactacgcagtggggacaaggttaggatggatccaccctgcacaaacactacggcagcaagcacgtatctgaataacccatacgtgcgtaaggccctcaatatacccgagcaattgccacaatgggatatgtgtaattttcttgtgaatctgcagtatagacggctctatcgcagcatgaattcccagtatctgaagctgcttagctcccagaaataccaaatcctgctctataatggcgatgtcgatatggcctgtaacttcatgggggacgaatggtttgtagacagcttaaatcagaaaatggaggtgcagcgcaggccttggctcgtgaagtatggagattccggagagcagatcgcaggttttgtgaaggagtttagccatatagccttcctgaccatcaaaggagccggccacatggtgcctacagataaaccattagctgcttttacgatgttctcaagattcttgaataaacagccgtattag

SEQ ID NO: 111114 - DNA, 870 bp, Artificial Sequence
  Description of Artificial Sequence: Synthetic coding sequence
atgattagggcagcgccacctccacttttcctcctacttcttttacttctactactggtttcatgggcaagcaggggcgaggccgcccctgaccaagacgaaatccagcgtctgccgggcctcgcaaagcagccatcttttaggcaatattccggctatctcaaaggctcaggatcaaagcacctgcattattggtttgtggagtctcagaaggatcctgaaaattccccagtcgtcctgtggcttaatggaggccccggttgttcatctctggatggcctgttgacggagcacggccccttcctggtgcagcctgacggggttactctggagtacaatccctacagctggaatctgattgcaaatgtgctgtacttggagagccctgctggagttggcttctcttattccgacgataagttttatgccacaaacgacaccgaagtcgctcaaagcaacttcgaagccttgcaggattttttcagacttttcccagagtataaaaataacaaattgttcctgactggcgagagttacgccgggatttacattcccacgctggccgttttagtcatgcaggatccctccatgaatcttcagggccttgccgtagggaatggtctatcaagttacgagcagaatgataattccctggtgtactttgcttactatcatgggctactgggcaatcgcctttggtcttccctccagactcattgttgcagccaaaataaatgtaatttttatgataataaggacttggagtgcgtgactaatcttcaagaggttgctcgaattgtgggcaattccggattgaacatctacaacttgtatgcaccatgtgccgggggcgtccctagccacttttag

SEQ ID NO: 111115 - DNA, 1497 bp, Artificial Sequence
  Description of Artificial Sequence: Synthetic coding sequence
atgaccagctcaccacgtgccccacccggcgagcagggacgcggaggcgccgaaatgatacgcgccgcacccccacctctgttcctgctactgctcctgttgctgctgcttgtgtcttgggcttctaggggcgaggctgcacctgatcaggatgagatacaaaggttaccaggtctggcaaagcagcccagctttcgacagtacagtggctacctgaaaggaagcggcagcaagcacctgcactattggtttgtcgagtctcagaaggatcccgagaatagcccggtcgtactttggctcaatggcgggcctggatgttcgtccctcgatggcttgttgactgagcacggcccctttctggtgcagccagacggtgtcactctcgaatacaatccatacagctggaacctgattgctaacgtgctttatctggaaagtcctgccggagtaggttttagctactctgacgataagttctatgcgacgaacgacacagaggtggctcagagcaacttcgaggccttgcaagactttttccgcctgttccctgaatataaaaataataagctgttcttgaccggggagtcttatgccgggatttacatccctaccctggccgtcctagtgatgcaggatccctcaatgaacttacaaggcttagccgtgggcaatggattgtcctcatacgaacaaaatgacaattcactagtgtactttgcttactatcatgggctcctggggaatcgtctctggtcctctcttcaaacgcactgctgttcgcagaacaaatgtaatttctacgacaacaaggacttggaatgcgtcaccaacctgcaggaggtggcccgaattgtgggcaactccgggctcaacatttacaacctgtacgctccatgtgccgggggtgtccccagccattttaggtacgagaaagatactgtggttgtgcaggacctagggaacatattcacaagattgcccctcaagcgcatgtggcatcaggccctcttgcgatccggagacaaggtacggatggatcccccctgcaccaatacaactgcagcctcaacctatctaaacaatccatacgtgaggaaagctctaaacattccggagcagttgccccaatgggacatgtgcaactttctggtgaaccttcaatatcgcaggctctaccgctccatgaattcacagtacctaaagcttctgtcaagtcaaaaatatcagattctactgtacaacggcgacgttgatatggcctgcaacttcatgggcgacgagtggtttgtcgattcgctcaaccagaaaatggaggtgcaacgtcgtccatggctcgtgaagtatggcgacagcggtgaacagattgctggcttcgtgaaggaatttagtcacattgcatttttgacaattaagggggccggccacatggttcctaccgacaaacccttagccgccttcacaatgttctcacgctttctgaacaaacagccatattag

SEQ ID NO: 111116 - DNA, 1038 bp, Artificial Sequence
  Description of Artificial Sequence: Synthetic coding sequence
atgataagggccgccccaccacccctattcctgcttctgttgctcctgttgctgctggtgagctgggcgtctaggggggaggccgcccctgatcaggacgagatccagcgtttgcccggcttggccaaacagccatcatttcgccagtacagcggatacctgaagggatcaggtagcaagcacttgcactactggttcgtggagagccagaaagatcctgagaacagtcctgttgtcttatggcttaatgggggccccggatgttcttctctggacggtctgctcaccgaacacgggcctttcctgatcgcaaacgttttgtatcttgagtctccagccggtgtgggcttctcctactctgacgacaaattttatgccactaatgatacagaggtggcacagtccaattttgaagcccttcaggatttcttccgactgttcccagagtacaagaacaacaagttgtttctgacaggcgagtcatacgctggcatatatatccctacactcgccgtcctggtaatgcaggacccatccatgaacctacagggtctggcagtgggaaacggcctaagcagctatgagcaaaatgacaactctcttgtgtatttcgcttactaccacgggctgctgggcaaccgattatggagctccttgcagacccactgctgttcccagaacaagtgcaacttttacgataataaagacctagaatgcgtgaccaacttgcaggaggtggctagaatcgtcggcaattcaggtctcaacatctacaacttgtacgctccttgcgccgggggggttccttcccattttcgatacgaaaaagatactgtcgtggttcaggatctaggcaatattttcactagacttcccttgaagaggatgtggcatcaggccttattgagatcaggtgacaaggttcggatggatcctccttgtacgaataccactgcagcaagcacctacctgaacaacccctacgtacgcaaagccctcaacattcccgagcagctgcctcagtgggacatgtgttag

SEQ ID NO: 111117 - DNA, 1149 bp, Artificial Sequence
  Description of Artificial Sequence: Synthetic coding sequence
atgatgtttccaggcttgctggctccaccagcaggatatccatccctcctgcgtcccacgcctacattgacattacctcagagcttgcaaagcgccttctctgggcactccagcttcctggtcgaagatttgattagaatttcaagaccgccggcctatcttcccagatcggtgcctacagcctcgatgagtcctcccaggcagggagcacctaccgctctcaccgacacaggcgctagtgatctgggctcgcctggcccgggcagtaggcggggtggctctcctccgaccgccttttctcccgcctccgaaactacttttctgaagtttggagtgaatgccattctgagctcaggccctaggacggaaacatcccctgctcttttgcagtctgtccctccgaagacttttgcgttcccgtacttcgaggggtcattccagcccttcattcggagttcttattttcctgcttctagttctgtggtgcctatccctggaactttcagttggcctctcgccgcccgcggcaaacctaggagaggcatgctgcgacgtgcagtgttctctgacgtacaacggaaagctctggagaaaatgtttcaaaaacagaaatacattagcaagccagataggaaaaaattggcagcgaagctgggcctcaaagactcgcaagatactgcaagaaggacggaaccagcccccgattcaactccccgcccacgggcctctccaggggcacctgatctgaccagcgcttcaccctttttctctcccgccgggacatttcaggttaagatctggtttcaaaatcgcaggatgaagtggaggaattcaaaggagagggagctattatccagcggtgggtgtagggaacagactcttcctaccaagctaaacccccaccctgacctgagtgatgtgggtcagaagggccccggaaatgaagaagaagaagaaggtccaggctcaccctctcatcggctggcctatcacgccagctcggatccgcagcacctgcgggacccacgtttgcccggcccgctgcccccaagccccgcccatagctcaagtccaggcaagcctagcgacttcagcgatagcgaggaggaggaagaaggggaggaacaggaggagattactgtgagctag

SEQ ID NO: 111118 - DNA, 1341 bp, Artificial Sequence
  Description of Artificial Sequence: Synthetic coding sequence
atgggcgccggaccaagttgtgatacccccgccaactgcacctacctggatctcctgggcacctgggtgttccaagtgggcagcagtggctcgcaacgggacgtgaattgctctgtgatgggaccacaggagaagaaagtggttgtttacctgcaaaagctcgataccgcctacgacgatctggggaactcagggcatttcactataatctataatcaaggatttgagatagtcctgaacgactacaagtggtttgcatttttcaagtacaaggaggagggctccaaagttacaacatactgtaacgaaacaatgaccggatgggttcacgacgtactggggcggaactgggcctgctttacaggcaagaaagtaggaacagcctccgagaacgtctacgtgaacatcgcccacctgaaaaatagccaggaaaagtattccaatcgcctatataaatatgatcacaactttgtcaaagcaattaatgcaattcaaaagtcctggacagccactacgtacatggagtacgaaacgcttaccctgggagatatgatcagacgatctggaggacactcacgcaagatccctcgtccaaaacccgccccacttacagccgaaatccagcaaaaaatcctccatttgcctacctcttgggactggaggaatgtacacggcattaacttcgtatctcccgtgagaaaccaggccagctgcggatcctgctacagctttgcaagtatgggaatgctagaggcccgaattcggatacttacgaataactcgcagactccaatcctgtcccctcaggaagttgtgagctgctctcagtatgcccagggttgtgagggcggctttccctatctcatcgctgggaaatatgcccaggattttggtctcgtggaggaagcttgcttcccttacactggaacggatagcccctgtaaaatgaaggaggactgcttccgttattactctagcgaatatcattacgtgggcggattctacggaggttgcaacgaggctctgatgaaactggagctggtccatcatggacctatggctgtggcttttgaagtctatgacgatttcttgcactataagaaaggcatctaccatcacacgggactcagagacccctttaatccctttgagcttacgaaccatgccgtgctgcttgtaggctacgggacggacagtgcatccggaatggattattggatcgttaagaattcttggggcactgggtggggagagaacgggtacttccgcatacggagaggtacagatgagtgcgcaattgaaagtatcgctgtcgccgcaactcctattccaaagttgtag

SEQ ID NO: 111119 - DNA, 414 bp, Artificial Sequence
  Description of Artificial Sequence: Synthetic coding sequence
atgggcgcaggtccctctttgctgctcgccgccctgctgctcctcttgtcaggggacggcgctgtacgatgtgacacgcccgcgaattgcacatacctggatcttctgggaacgtgggtgttccaggttggcagcagcggctcccagcgtgacgtcaactgcagcgtaatgggtcctcaggagaaaaaagtggtcgtgtatttacagaagctggatacagcgtacgatgatttggggaactctggacactttacgataatctacaaccagggcttcgagatcgttctcaacgactacaagtggttcgcgttttttaaggatgtaaccgattttatcagccaccttttcatgcaattggggacagtcgggatctacgacctcccccacctgcgcaacaagctggttattaagtag

SEQ ID NO: 111120 - DNA, 426 bp, Artificial Sequence
  Description of Artificial Sequence: Synthetic coding sequence
atgggcgcggggccctcactcctgctggccgccctgcttttgctgctgtcaggggacggcgcggtccggtgcgatacacccgctaattgcacctacttggatcttttgggtacttgggtgtttcaggtgggatcatctggcagccaaagagatgtgaactgctcggtcatgggcccccaggagaagaaagtggttgtttatctgcaaaagcttgacaccgcatatgatgatctgggtaactcaggacacttcaccataatctacaatcaaggattcgaaatcgttttgaacgattacaagtggttcgctttcttcaaagatgtgacagacttcatcagccacctgtttatgcagcttggcacagtgggcatctacgatctgccgcacctgagaaataagctggcaatgaaccgacgatgggggtag

SEQ ID NO: 111121 - DNA, 1191 bp, Artificial Sequence
  Description of Artificial Sequence: Synthetic coding sequence
atgaaaacgctgctcctactgcttttagtactgctggaactcggcgaggcacagggaagcctgcatcgagtcccattacggcgtcacccaagcctcaaaaaaaaacttagggcacgttcacagctgtcagagttttggaaaagtcataacctggacatgatccaatttacggagtcttgctccatggaccagagtgcaaaggaacctctgatcaactacctggacatggaatacttcggaacaatttctattggctcgcctccccaaaacttcaccgtgatctttgacaccgggagctcgaatctttgggtaccaagcgtgtattgtacatctccagcttgcaaaacacacagtagatttcagccgagtcagtcttctacatactctcagcctggacagtccttcagtatccagtacggcactggatctctgtcagggatcatcggcgccgatcaggtctccgttgaaggactgaccgtggttggccagcaattcggcgaaagtgtgactgagccgggtcagaccttcgtggatgccgagtttgatggaattcttggccttggctaccccagcctagcggtggggggcgtaacaccagtttttgataatatgatggcccaaaacctcgttgacctccccatgttctcagtgtatatgagttctaacccagagggaggggccgggtccgagctcatatttggaggatatgatcatagccacttctccggctcattaaattgggtccctgtgacaaaacaagcttactggcaaatcgccctggataacatccaggtcggtggaactgtgatgttctgcagtgagggatgccaggccatagttgatacggggacctctttaatcaccgggccctcagataagataaagcagctgcagaacgcaattggagctgctcccgttgacggagaatatgccgtggaatgcgcaaatcttaatgtgatgccagatgtcaccttcaccataaacggcgtcccttacacactgagccctaccgcttacacactgctcgactttgtggacggaatgcagttctgctccagcgggtttcaagggctagacattcatccccccgcaggccctttatggatactgggcgacgtcttcatcaggcagttttattcggtcttcgacagaggaaataaccgggtcggtcttgcccctgctgtgccctag

SEQ ID NO: 111122 - DNA, 1092 bp, Artificial Sequence
  Description of Artificial Sequence: Synthetic coding sequence
atgaagactctgctactgctcctcttggtgctgcttgaattgggagaggcacagggatctctgcaccgggtgccactgagaaggcacccttctttgaaaaaaaagctgagagctcggagccaactgtccgagttctggaaaagccataacctggatatgatccaattcacagaatcatgtagcatggaccaatctgcaaaggaacctctgataaactacctcgatatggaatactttggcacaatctctataggatcccccccccaaaatttcacagtcattttcgacaccggtagtagcaatttgtgggtgcctagcgtctattgcaccagtcccgcatgtaaaacccactctagatttcaaccgtcacagtcttctacgtatagtcagcccggtcaaagcttttccattcaatatggcacagggtccctgagcggaatcatcggtgcagaccaagtgagtgtggagggcctgaccgtggtcggacaacagtttggtgagtccgtgacagagcccggacagacctttgttgacgcggagtttgacgggatcctcggacttggctatccttctttggccgtcgggggggtgaccccagtgtttgacaacatgatggcacagaacctggtggacctccccatgttttcagtttatatgtccagcaatccggagggaggagccggcagcgagttaatcttcgggggctatgatcactctcacttctctggaagcctgaattgggtgcctgttacaaaacaggcctattggcagattgccctagataacatgctgtggtccgtgccaaccctcacaagctgtcgtatgtcaccttcacccttgaccgagtcccctattcctagcgcacagctgcctactccatattggacatcctggatggagtgtagttcagctgccgtcgcttttaaggacctgacatccactctgcagttaggccccagcggatcttgggggatgagctcctttgactctttcactcagagcctcacggttggcattacagtgtgggactggcctcagcagagcccaaaagagggtccctgtgtttgcgcttgtctgtcagatcgtccctag

SEQ ID NO: 111123 - DNA, 1206 bp, Artificial Sequence
  Description of Artificial Sequence: Synthetic coding sequence
atgaaaacactcctgctgctgttgctggtactgctggaattgggagaggctcaaggatctttgcacagagtcccgcttcggcgacatcccagtttgaagaaaaagctgcgcgcacggagccaattatcggagttctggaagagccataatctggacatgattcagtttaccgaatcctgctccatggaccagagcgctaaagagccactcatcaactacctggatatggaatattttggaacaatctcaatcggaagtccaccccagaattttactgtgatctttgatacgggatcatccaacctttgggtacctagcgtgtactgtacgagtcctgcctgcaaaacccattcgcgcttccagccctctcagtcaagtacctactcgcagccagggcagtccttctctattcaatacggcactggatctctaagcggaatcattggggctgaccaagttagcgcgtttagctatcaggttgaagggttaaccgtcgtcgggcagcagttcggtgagagcgttacggagcctgggcagacatttgtggatgctgagttcgacggaatcttaggacttgggtacccgtccttagccgtgggcggcgtgactcctgtgttcgataatatgatggcccagaatctcgtggatttgcccatgttctctgtctacatgtcatccaatcccgagggtggagccggatctgaactgatcttcggcgggtacgaccacagccacttctctggatctctgaactgggtgcccgtgaccaagcaggcatactggcagatagcacttgataacattcaggtcggggggactgttatgttctgtagcgaaggttgtcaggcaattgtggatacgggcacctcactcattacagggcctagcgacaaaatcaagcaactgcagaatgcgattggggcagctcctgttgatggagagtacgcagtggaatgcgctaacctgaatgttatgcctgatgttacgttcaccatcaatggtgtgccgtatactctctcccccacagcatatactttgctcgatttcgttgatggtatgcagttttgctcctccggcttccagggtctggacattcatcctcctgctgggccgctgtggatcttgggagacgtgtttatacggcagttttacagcgtgtttgacagagggaacaatcgagtcggcttagcgcccgccgtaccctag

SEQ ID NO: 111124 - DNA, 867 bp, Artificial Sequence
  Description of Artificial Sequence: Synthetic coding sequence
atggaatatttcggtaccatatccattggtagccccccacagaattttacggttattttcgataccggttctagtaacctttgggtgccttctgtgtactgtaccagccctgcatgcaaaactcactcccgtttccagccttctcagagctccacctatagtcagccaggacagtccttcagcattcaatatggcaccggctctttgagcggaatcattggagcagaccaggtgtccgtcgagggtttgacggtggtcggacagcagtttggtgagagtgttacagaacctgggcagacattcgtggacgcagagttcgacgggatcctgggactcggatatcctagcttggccgtcggaggtgtgacacccgtgttcgacaatatgatggcacaaaacctggtagatcttcccatgttcagtgtgtacatgagttcgaacccagagggaggcgctggctcggaactgatctttggagggtacgaccactcccacttcagcggatccctgaattgggtgccagtaaccaagcaggcgtattggcagatcgccctggacaatatgctctggtctgtgcccacactgacaagctgccggatgagccccagtcctctgacggaatctccaatcccctctgcacaactccccacgccatattggacttcctggatggaatgttcctctgcggctgtcgccttcaaggacctgacatccactctccagctggggccgagtgggtcatggggaatgtcatcatttgacagcttcacacagtccttgacagtgggtattactgtgtgggactggcctcagcagtccccaaaagaaggaccctgcgtctgcgcatgtctcagcgatcgcccttag

SEQ ID NO: 111125 - DNA, 1455 bp, Artificial Sequence
  Description of Artificial Sequence: Synthetic coding sequence
atggctccctggctgcagctcctgtctctcctgggtctgttgccaggcgccgtcgcagcgccggcccaacctcgggccgccagcttccaggcatggggacctccttccccagaactgctggctcccacccgctttgccttggaaatgtttaatcgtgggcgggcggccgggacaagagcggtgttagggcttgtcaggggacgggttcgcagagctggacaaggcagcctgtactccctggaggctacattagaagagcctccctgtaacgaccctatggtgtgccggttgcctgtgagcaagaaaacattactgtgttcctttcaagtgctcgatgagctcgggcgccacgtgcttcttcgcaaggactgcggaccggtcgacacgaaggtccccggggccggtgaacctaaatcagcctttacccagggctcagccatgatttcttcattgagccagaaccatccagacaatcgaaacgaaacctttagctcagttattagtctgctcaacgaagatcctctcagtcaggatctaccggtaaagatggcatccatttttaagaactttgtgataacctacaaccgcacttacgaatccaaggaggaggctcggtggagactgtccgtctttgtaaataacatggtgagagcccagaagattcaggctctcgatcgcgggacggctcagtacggagtgaccaaattctccgacctcactgaggaggaatttcggaccatctatcttaacaccctgctgcgaaaggaacccggcaataaaatgaagcaagctaaaagcgtcggcgacctcgcccccccagagtgggattggcgtagtaaaggcgcagtgaccaaggtgaaagatcagggaatgtgcggctcatgctgggcattcagcgtcacggggaatgtcgagggtcagtggttcttaaaccagggaacactgctgtccttgagtgagcaggaactcttggattgcgataagatggataaagcgtgcatggggggactcccgtcaaatgcttatagcgccatcaagaatctaggaggtctggagaccgaggacgattactcataccaagggcatatgcaatcctgcaactttagcgctgaaaaagcaaaggtatatattaacgacagtgtggagttatcccagaacgaacagaagctcgcagcatggctcgcaaaaaggggccctatttctgtggctatcaatgcatttggaatgcagttttatagacatggcatctcccggccccttcgacccttatgcagcccatggctcattgaccacgccgttctgctggttggttatggaaacagatccgacgtgcccttttgggctattaaaaattcctggggcaccgattggggggagaaggggtattactacttgcacaggggaagtggggcatgtggcgtcaacaccatggcatcgtcagcagttgtagactag

SEQ ID NO: 111126 - DNA, 675 bp, Artificial Sequence
  Description of Artificial Sequence: Synthetic coding sequence
atggcagctgccgtgccacagagagcctggactgttgaacagttgcggagtgagcaactccctaaaaaagacatcattaaatttttgcaggagcacggttccgacagctttctggcagagcataagctgctaggaaacatcaaaaacgtcgcaaagacagcaaataaagaccacctggtgacggcctacaatcacttattcgaaaccaaacgtttcaagggaaccgagtccatctccaaagtttccgagcaggtaaagaatgttaaattaaacgaggataagcccaaggagaccaagtccgaagagaccctcgacgaaggtcccccaaagtacaccaaatccgtcctgaagaagggcgacaagacaaactttcccaaaaagggtgacgtggtgcactgttggtacacagggacattacaggacggcacggtatttgacaccaacattcagacttctgctaaaaaaaagaaaaatgctaaacccctctcctttaaggttggcgtcgggaaggtaatacgcgggtgggacgaagccctcttgacaatgtcaaagggggagaaggcgagactggaaatcgaaccggaatgggcctacggaaaaaaaggtcaaccggacgctaagatccctcccaacgccaagctgacgttcgaagtcgaactggtcgacatcgactag

SEQ ID NO: 111127 - DNA, 801 bp, Artificial Sequence
  Description of Artificial Sequence: Synthetic coding sequence
atgagctctgtctttggcaaacctcgtgccgggagtgggccccagtctgcaccattagaagtcaacctggccatactggggcgccgaggtgccggcaagtccgccttgacggtaaaatttctcaccaaaaggtttatctcagagtatgatccaaatcttgaagacacatacagtagcgaggagacagtcgaccaccagcccgtccatcttagagtgatggacacagccgatctggacacaccacggaactgcgagagatatctcaactgggcccacgctttcctggtggtgtacagcgtggattcaaggcaatccttcgacagcagctctagctacctcgagcttctggccctgcatgcaaaggagacccaacggagcattcccgcactgctgctaggaaacaagttggatatggcccaataccggcaggttaccaaagcagaaggggtcgcactggccgggagatttgggtgcttgttcttcgaggtgtcagcttgcctggactttgaacacgtccagcatgtgtttcacgaggccgtgcgggaggcccgtcgcgagcttgaaaaatccccactcacccgccccctgttcattagtgaggagagagctctcccacaccaggcaccgttaactgctaggcatggccttgcgagttgcacttttaacacccttagcacaatcaacctaaaggaaatgcctaccgtggcacaagctaaactggtgactgtcaaatccagtcgcgcccagtctaagaggaaagcccccacactcactttgctgaaagggttcaagatattctag

SEQ ID NO: 111128 - DNA, 972 bp, Artificial Sequence
  Description of Artificial Sequence: Synthetic coding sequence
atgtgggccacacttccacttctctgcgcagcggagctgtgtgtgaactccctcgaaaagttccatttcaaaagctggatgagcaaacatcgtaaaacatactccacggaagaataccaccatagactccaaacttttgccagtaattggagaaaaatcaacgcccacaataatggtaatcatacttttaagatggctctcaatcaattctccgatatgagcttcgcggagatcaaacataagtatctgtggtctgaaccacaaaattgtagcgccaccaagagtaactatcttcggggaacaggcccctaccccccttccgtcgattggcggaagaaagggaatttcgtgagccccgtcaagaaccaaggggcttgcggaagctgttggaccttttcaactaccggcgcattagaaagcgctatcgccatcgccacaggcaaaatgctgtccctcgctgagcaacagcttgtcgactgtgctcaagactttaataaccacggttgtcaggggggtctgccatcacaggccttcgagtacatactgtataacaaagggataatgggtgaggatacgtatccctaccagggcaaggacgggtattgtaaattccagcctggaaaggctattggcttcgtgaaagatgttgccaatatcacaatctacgatgaggaggccatggtggaggccgttgcactttacaacccagtaagtttcgcgttcgaagtaacccaagatttcatgatgtaccgaacaggcatttattcttcgacctcatgccataaaacaccagacaaggtgaaccacgccgtactcgctgtcggttacggggagaagaacggtatcccgtattggatcgtgaagaactcttggggtcctcagtggggcatgaatgggtattttctgatagagagaggtaagaatatgtgtggattggcggcatgcgcatcctatcctatccccctggtatag

SEQ ID NO: 111129 - DNA, 621 bp, Artificial Sequence
  Description of Artificial Sequence: Synthetic coding sequence
atgtgggccacactccctctgttatgcgccggcgcctggcttctgggcgtgccggtgtgtggtgcagcagagttgtgtgtgaattcccttgagaaattccacttcaaatcgtggatgagcaagcacagaaaaacctattcaactgaggagtatcaccatagacttcaaacctttgcctcaaactggcgaaagatcaatgcccataacaacgggaatcacacattcaaaatggcccttaatcaattttccgacatgtcttttgccgagatcaagcataaatacctatggtccgagccacagaactgttctgccaccaagtctaactacctgagaggcacgggaccctacccacccagtgttgactggaggaaaaagggcaactttgtcagccccgtcaagaatcaagtgtgcctcgctatctctattctgagtctacagaacggccacacacctcgccagtatactagaaaaaataattcaaagggcccacaaaaccaccacaagcatataccagcttcagtttctagtcgtcacctcagtccagggcgtccgtctttaccccagttacgcgagatttgtgagggtaaacgactaggggaggctagtgttaatctgggttag

SEQ ID NO: 111130 - DNA, 990 bp, Artificial Sequence
  Description of Artificial Sequence: Synthetic coding sequence
atgtggggattaaaggtattgctgttacccgttgtgtcatttgccctgtatccggaagagattctagacacccattgggaactgtggaaaaaaacgcatcggaagcagtataataataaagtcgacgaaatctctagacgtctcatatgggagaaaaacctgaagtacatttctattcataatctcgaagcctctttgggcgtacatacttacgaattggctatgaatcacctgggagacatgacctccgaggaggttgtccagaagatgaccggactgaaggttcctctttcccattcccgttcaaacgatacactatatattccagaatgggaaggtagagcaccagattcagtggattatcggaagaagggttatgtgactcccgtaaagaatcagggccaatgcggcagctgttgggccttcagcagcgtgggggcacttgagggacagttaaagaagaagaccggcaaattgcttaacctgagcccccagaacctcgtcgattgtgtgtccgagaatgatgggtgcggagggggctacatgactaatgctttccagtacgttcagaaaaatcgaggaatcgactcagaagatgcatatccgtatgtcggtcaggaggaatcttgcatgtacaaccctactggaaaagcagcaaaatgtagaggctacagggagattcccgaggggaacgaaaaagcactgaagcgtgcagtggctcgggttgggccggtttccgtggccatagatgcttccttgacaagtttccagttttactctaagggagtatactacgatgaaagttgcaattcagacaatcttaaccatgctgtcctggcagtgggttacgggatccagaagggaaacaaacattggatcattaaaaacagttggggcgagaattggggcaataagggctacatcctgatggctcgcaacaagaataatgcatgtggaatagccaacctcgccagttttcccaaaatgtag

SEQ ID NO: 111131 - DNA, 777 bp, Artificial Sequence
  Description of Artificial Sequence: Synthetic coding sequence
atgcataaggagaatgaggagatatacaacgttagcgagaatcggaaacattgtccaatctttccttgcccgctgttgacacggtctggaaaagtgcctgagttccggcatgagcgtgaagagcgccttgaagaaatgattcggcggcaaaatctggacggcaacctgtctttcgtcatgtgggggctgaaggtattactgctcccagttgtgagtttcgctctatatccggaagaaatcttggacactcactgggaactgtggaaaaaaactcacagaaagcagtataacaacaaagttgacgagatcagcaggcggctgatttgggaaaaaaatctaaaatatattagcatacataacttggaggcatcccttggcgtgcacacttacgaactcgccatgaaccacctgggcgatatgacttcggaggaagtagtccaaaagatgacaggattgaaggtccccctgtctcacagccggagcaacgatactttgtacattccggagtgggaaggccgggctcctgacagcgtggattaccggaaaaagggttatgtaacacctgtgaagaatcagggccagtgtggaagttgctgggccttttcatccgtgggagcactagaaggccagcttaaaaagaaaacaggcaagctgcttaacttgagtcctcagaacctggtcgattgcgtgtcagagaatgacgggtgcgggggaggctacatgactaatgcttttcagtacgtgcaaaagaatcgtgggatcgattccgaggactag

SEQ ID NO: 111132 - DNA, 1005 bp, Artificial Sequence
  Description of Artificial Sequence: Synthetic coding sequence
atgaacctctctcttgttctggccgccttctgcctgggaatagcgagtgcagtcccaaagtttgaccagaacttagacactaagtggtatcaatggaaggccacccatagaaggctgtacggagccaacgaggaggggtggaggcgagcggtctgggaaaaaaatatgaaaatgatcgagctacacaacggagagtactctcagggaaaacacggttttactatggctatgaatgcttttggagacatgacaaatgaggagttccggcaaatgatgggctgctttagaaaccaaaaattccgcaaaggtaaggttttcagggagccgctgtttctagacctgcccaaaagcgtggactggcgcaagaaggggtacgtgacccctgtgaaaaaccaaaagcagtgcggaagttgttgggccttcagcgctacgggtgcattggaggggcagatgtttcgcaagactggcaagctagtttccctgtctgaacagaacttggtggactgttcccgaccacagggcaaccaggggtgcaacggtggattcatggcccgggcattccaatatgtgaaggagaatgggggcttagactcggaggagtcttacccttacgtggccgttgacgaaatttgtaagtacagacccgaaaactcggtcgccaacgacacaggtttcacagttgtggcccccggcaaggaaaaggcgctgatgaaggctgtcgcgacggttggtcccatttccgtggcgatggacgccggtcatagctcttttcagttttataagtccggcatctattttgagcccgactgctcatctaaaaacctggatcacggcgtacttgtggtgggctacgggtttgaaggcgcgaattctaacaattcgaagtactggctggtgaaaaactcttggggcccagagtggggctctaatggttatgttaagatcgccaaagacaagaataaccactgcgggatcgccacggccgcaagctatcccaatgtttag

SEQ ID NO: 111133 - DNA, 1005 bp, Artificial Sequence
  Description of Artificial Sequence: Synthetic coding sequence
atgaatctctctcttgtgctcgccgctttctgtctggggatagcctccgcagtacctaaattcgatcagaatcttgatactaagtggtaccagtggaaagctacccaccgccgcttgtacggcgcgaacgaggaaggttggcggagggctgtatgggaaaagaacatgaagatgatcgagttgcataacggagagtactctcagggcaagcacgggtttaccatggctatgaacgctttcggcgatatgaccaacgaggaattccgccaaatgatgggttgtttcaggaatcaaaagtttcgtaaggggaaagtatttagagaacccctgttcctcgatcttccgaagtctgtggactggagaaaaaaaggatacgtcacacctgtcaagaatcagaagcagtgtggttcttgctgggcgttttctgcgactggagccctggagggtcaaatgtttagaaaaaccggcaagctcgtttctctgtccgagcagaaccttgtggattgcagccggccacagggcaaccagggctgtaacgggggtttcatggcccgggccttccagtacgtgaaagaaaacgggggcctagattccgaggaatcttatccatatgtagcagtggatgagatctgtaagtatcgacccgagaattccgtggccaatgataccggctttacagtggtggcaccaggcaaagagaaggctctcatgaaggctgttgcaactgttgggcccatcagcgtggcgatggacgccgggcactcaagctttcaattctataaatcaggcatttattttgagcctgattgctcttcaaaaaacctcgatcatggggtcttagtggtcggatacggattcgagggcgccaactcgaataactccaagtactggctggtgaagaactcctgggggcctgagtggggatctaacggctacgtgaagattgcaaaggacaagaacaatcattgcgggattgcgacagccgcttcctacccaaatgtgtag

SEQ ID NO: 111134 - DNA, 996 bp, Artificial Sequence
  Description of Artificial Sequence: Synthetic coding sequence
atgaagaggctggtgtgtgtgctgctggtgtgctcttctgccgtggcacagctccataaagaccctacgctggatcaccactggcacctctggaagaagacctacggcaaacaatacaaagagaaaaatgaagaggcagtgaggcgactcatctgggaaaaaaatctgaagttcgttatgctgcacaacctggaacacagcatgggaatgcattcctatgacctgggaatgaatcacctgggcgacatgacgagcgaggaagtgatgagtctaatgtcgagcctgcgagtcccatctcagtggcaaaggaacataacctacaaaagcaacccaaatagaatcctgccggactcggtggattggcgggaaaaagggtgtgtgaccgaggtgaaataccaaggctcttgcggcgcttgctgggccttcagtgcggtaggagctctggaggcccagttgaagcttaaaaccggaaaacttgtgagcctgtctgcccagaatctggttgattgcagcaccgaaaagtacggcaataagggttgcaatggggggttcatgacgactgccttccaatacatcatcgataataaaggcatcgatagtgatgcctcttacccttataaggccatggaccagaagtgtcagtacgactccaaataccgggctgctacttgttccaaatacaccgaactgccatatggacgagaagacgtcctgaaagaagccgtcgcgaacaagggtccggtgtccgttggagtggatgctcgacaccctagcttcttcctctaccggagcggcgtgtattatgagccttcttgcacccagaatgtgaatcatggtgtgctggtggtgggctatggagaccttaacggtaaggagtattggctcgtcaaaaactcttggggccacaattttggcgaggaaggctacatcagaatggccagaaataagggaaaccattgcggtattgcatccttcccctcctatcccgaaatttag

SEQ ID NO: 111135 - DNA, 846 bp, Artificial Sequence
  Description of Artificial Sequence: Synthetic coding sequence
atgaagcgtctcgtttgtgtgctgctagtgtgcagttcggctgtggcccagcttcataaagaccccacactggatcaccattggcacctgtggaaaaagacttatggcaaacagtataaggagaaaaacgaggaggcggtgcgccggctgatctgggaaaaaaacttgaaatttgtaatgttgcataatctcgaacactcaatgggaatgcattcctacgatctggggatgaaccacctcggcgatatgggtagctgtggggcctgttgggctttttcagctgtgggagccctagaagcacagctgaagctgaaaacgggtaaactggtttctctaagtgctcagaacttggtcgactgttccactgaaaaatacgggaataagggatgcaacggaggctttatgaccaccgcattccagtatatcatcgataacaagggcatcgacagcgatgctagctacccttacaaagccatggaccagaaatgccagtatgactccaagtatagggcggctacctgctctaagtacacagagctgccctatggaagggaagacgtcctgaaggaggcggttgctaacaaaggccccgtgagtgttggcgtggatgcgcgacacccttcattcttcctttacaggtctggggtctattatgagcccagctgtacccagaacgttaaccatggagtcttggtcgttggatacggcgatctgaatggcaaggagtactggttggtcaaaaattcatggggccataacttcggcgaagaggggtacattcgtatggccagaaacaaggggaatcattgtggtattgcctcgtttccatcctatcctgaaatatag

SEQ ID NO: 111136 - DNA, 1131 bp, Artificial Sequence
  Description of Artificial Sequence: Synthetic coding sequence
atggccctgactgctcatccttcttgtctcctcgcactcctagtggccggcctcgcccagggcatccgcggacctctgagggcgcaagatctgggtcctcagcctttggagttgaaagaagcgttcaaactctttcagatccagtttaacaggagctacctgagtcccgaggagcatgcacaccggcttgatattttcgcacacaacctggcccaggctcaaagactccaagaggaagacctgggcacagcagagtttggggtcacgcctttcagcgatctgaccgaagaagaattcggtcagttatatggctatcgacgagctgccgggggcgtgccaagcatggggcgtgagatccgctcagaagaacctgaggaatcagtgccatttagctgcgattggcgaaaggttgcttccgctatatctccgatcaaggaccaaaagaattgtaattgctgctgggctatggcggctgccggaaacatcgaaactttatggagaatatccttttgggattttgtagatgtgtctgtccaagagctgctggactgtggcaggtgcggggacggatgtcacggtggtttcgtctgggatgcgtttatcacagtactgaataatagcggcttggcgtcagaaaaagactatcctttccagggtaaggttagggctcatcgatgtcaccccaagaaataccagaaagtggcatggatccaagatttcatcatgctgcagaacaacgagcaccgaatagcccagtatctcgcaacttacggccccattactgtaacgattaacatgaagccactgcagctctaccggaagggagttattaaagccactccaactacttgtgacccacagctggtggatcactctgtcttgctggtggggttcggcagcgttaagtcagaagagggaatttgggctgagaccgttagtagtcagagccaaccgcagcccccgcaccctaccccatactggattttaaagaattcttggggcgcccagtggggagagaagggttattttcggttgcatcgcggctccaatacttgcggcattaccaagtttccccttacagcgcgggttcagaagcctgacatgaagccacgggtctcttgcccgccttag

SEQ ID NO: 111137 - DNA, 2679 bp, Artificial Sequence
  Description of Artificial Sequence: Synthetic coding sequence
atgacagatcctttttgtgttggagggcggcgactgccaggcagtagcaagagcggccccggcaaggacggtagtaggaaagaagttaggcttcccatgctgcacgaccctccgaaaatgggtatgcccgtcgtgcggggaggacagaccgtgcccggccaggcacccctgtgttttgatcctggatcgcccgcatctgataaaactgaaggtaaaaagaagggaagaccgaaagctgagaaccaagctctgagagacatcccgttgtcgctgatgaacgattggaaggacgagtttaaagcacacagtagggtgaaatgtccaaactctggatgttggcttgaatttccaagcatttacgggctcaaataccattaccagagatgtcagggtggtgctattagcgacagactagcattcccctgccccttttgcgaagctgcatttacctctaagacccaactcgagaagcaccgtatatggaatcatatggacagacctctcccagctagcaagcccggtccaatatcacgcccagttaccatctccagaccagtgggtgtgagtaaaccaatcggggtgtcgaagcccgtgacaattgggaaacctgtcggcgtgtcgaagcccattggtatctctaagcccgtgtctgtgggaaggcctatgccggttacaaaggccattcctgtgacaaggcccgtgccggttactaagccggtaacggtatcaagacccatgcccgttacaaaggcaatgcctgtgaccaaaccaatcacagtgactaaaagcgttcccgtgacaaaaccagttcccgtgactaaacctatcaccgtgaccaagctcgtgactgtgacaaagcccgtgcccgtcactaagcctgtgacggtatctcggcctatagtcgtgtccaagcctgtgacagtgagccggccgatagccatcagtagacatactcctccttgtaaaatggtgttgttgaccaggtctgaaaacaaggcccctcgcgcaacaggaagaaattcgggaaagaagcgcgcagccgattctttggacacgtgtcccatcccccccaagcaggcacggcctgagaacggcgaatacggtcccagctccatgggtcagtcttccgcctttcagctcagtgctgacacctcatccggcagtttgtccccaggctcaagacccagtggtggcatggaagctctcaaggcagcaggacccgccagtcctccagaggaggatccagaacggaccaagcatagaagaaaacagaagaccccgaagaaattcactggcgagcagccaagtatcagcgggacgttcggcctcaagggactggtaaaggccgaagataaggcacgagtgcaccggtctaaaaagcaggagggccctgggccagaggacgctcgaaagaaggtgcctgcagcccccataacggtgagcaaagaggcacctgcccctgtggcccatcccgctccaggtggtcctgaagaacagtggcaacgcgcgatccacgaacggggggaggctgtgtgtcccacctgtaacgtggtcactaggaaaaccctggtggggcttaagaagcatatggaagtgtgtcagaaattgcaggacgcccttaagtgtcagcactgcagaaagcagtttaaaagtaaggcaggactgaattatcacactatggccgagcactctgcaaaaccatccgacgccgaggcctccgagggaggggagcaggaggaaagggagaggctgcggaaggttctgaaacagatgggccggctacggtgtccccaggagggctgcggtgccgcattcagcagtctcatggggtaccagtaccatcaaaggcgttgcggaaagccgccatgtgaagttgactcaccctccttcccttgcacccattgtgggaaaacctataggagcaaggccggacacgactaccacgtgcggtcagagcacaccgctccacctccagaagagcccaccgacaagagcccggaggcagaagatccactaggggtggaacggaccccctctggcagggtgaggagaacaagtgctcaggtggccgtgttccacctccaggagatcgctgaggacgaactggcccgcgattggacaaaacgtagaatgaaggacgatttagtccctgaaacggcccggctgaattataccaggcctgggctccctacactcaatccgcaattgctggaggcatggaagaatgaagtgaaagagaaggggcatgtcaattgccctaatgattgctgcgaagctatttactctagcgtgtcaggtctgaaggcacacctggcctcttgttctaagggggcccacctggccggcaaataccggtgcctcctttgtcctaaggagttcagcagtgaaagcggggtgaaataccatattctgaagacgcacgctgaaaactggttccgcacatctgctgaccccccccccaaacaccggtcacaggacagcctcgtgccaaagaaggaaaaaaagaaaaatttggccggcgggaagaaacggggcaggaagcccaaggagagaacgcctgaggagccagtcgccaaactgccaccgcgccgtgacgattggccaccagggtgtcgtgataagggcgcacggggctccactggccgcaaggtgggagtgagcaaggcgccagaaaagtag

SEQ ID NO: 111138 - DNA, 2343 bp, Artificial Sequence
  Description of Artificial Sequence: Synthetic coding sequence
atggatcagaactccgtccccgagaaggcacaaaacgaggctgacactaacaatgccgaccgcttcttccggagtcattcttcacctccacatcaccgaccgggccactcaagagcccttcatcactatgagctgcatcaccacggggtcccacaccagcgcggcgagagtcaccatcctcctgagttccaagacttccacgaccaggctctttccagtcatgtgcatcagtctcaccatcattcagaggcccggaatcacgggagagcccacgggcctacaggttttggcctggcgccttcacagggcgcggtcccatcacatagatcttatggggaggattatcatgatgagctccaaagagacgggcgcagacaccacgacggttctcaatacggcgggttccaccagcagagcgactcacactaccaccggggatctcaccacggacggccacagtatctgggcgaaaatctgagtcattactccagcggcgtgccccaccatggagaagcctcccaccacggaggaagttatcttccccacgggccgaacccatatagcgaaagcttccaccattcagaagccagtcatctaagtggtctgcagcacgatgagtctcagcatcatcaggtgccacatcgcggatggcctcatcatcaccaggtgcaccaccacggccggtctcgtcaccacgaagctcatcagcatgggaaatcgcctcatcacggagaaacaatctctccacattctagtgttggctcataccagcgaggcatctcagactaccactcagagtaccaccagggcgaccaccatcccagcgaataccatcacggagatcaccctcaccacacccaacatcactaccaccagacccaccggcatagagattaccatcagcaccaggaccaccacggtgcttatcacagttcgtatcttcacggagattatgtacagtccacttcccagctctccattccgcacacgagtaggtcactcattcatgacgctccaggccccgctgcctccagaactggcgtatttccctaccacgtcgcccacccccgtgggagtgcccattccatgactcgaagcagctcaactatccgatcccgcgtcactcaaatgagtaagaaggtgcatacccaagacatcagcacgaaacactctgaggactggggcaaggaggaaggacagtttcagaagagaaaaaccggccgcctccaaagaacgcgcaagaagggccatagtactaacctctttcaatggctgtgggaaaagctgacctttctgatacaggggttccgggaaatgatcagaaatcttacacagtcgcttgccttcgagacctttatcttcttcgtcgtctgcctaaacacagtcatgctggtggcgcaaaccttcgcggaagtcgaaattagaggggagtggtattttatggcacttgactctattttcttttgcatctacgttgtggaagctctgctgaaaattattgctctgggtttatcctacttttttgacttttggaataatctggatttcttcatcatggccatggccgtactggactttctactgatgcagacacattcattcgccatctatcatcagtctttgtttaggattctaaaagtgtttaagtctctgagagccctgcgcgcgatccgggtgctaagacggcttagcttcctgacatctgtgcaagaggtgaccggcactctgggtcagtctctgccctctatagccgcaatcctgatactcatgtttacttgcctattcctgtttagcgcggtactaagagccctctttcgcaagtctgaccccaagcggtttcagaacatatttaccacaatctttactctgtttacacttttaactctggatgactggagcctgatctacatggattcgagggcgcagggcgcgtggtacatcatccctatcctcgtgatatacatcataatccagtactttatcttcctgaacctagtgatcacggttttggtcgactcattccaaactgcgttattcaagggccttgagaaggccaaacaggagcgagccgcccgcattcaagagaagttactggaggattccctgacagagctcagagccgccgagcccaaagaagttgcgtcggaaggcactatgttaaagagacttatcgaaaagaagtttggcacaatgaccgaaaagcagcaggaacttttgttccactatttgcagctggtggcgtctgtggagcaagaacagcagaagtttaggtcccaggctgccgtgattgatgagatcgtcgatacgaccttcgaagccggtgaggaggacttccgtaattag

SEQ ID NO: 111139 - DNA, 1197 bp, Artificial Sequence
  Description of Artificial Sequence: Synthetic coding sequence
atgagccagcatagacaccagcgccatagccgtgtcatctcatcatctcccgtggacaccacatctgtcgggttctgcccgacttttaaaaaattcaaacggaatgatgatgagtgccgggcctttgttaagagagtcataatgtccagattcttcaagatcataatgatatcaacagttacatccaacgcattttttatggccctgtggacatcttatgatatacggtatcgcctctttcgcctgttggagttttctgaaatcttttttgtttctatatgtacctcagaacttagtatgaaagtctacgttgacccaatcaattattggaagaatggctataacctgcttgatgttattatcatcattgtgatgtttcttccctatgccctgcgtcagcttatggggaagcagtttacctacctttacatagcggatggtatgcagtctttacggatcctgaagctgattggctattcacaggggatcagaactctgatcactgctgtgggtcagactgtttacaccgtcgccagcgtgctcctgttattatttctgttgatgtatatttttgctattttgggattctgtttgttcggatctcctgacaatggcgaccacgataactggggtaacctggcggcagcctttttcactctgttctcactggctaccgtcgacgggtggacagatcttcagaaacaactggacaatagggaatttgctctcagtagagcttttactatcattttcattctgctcgcttccttcatttttctaaacatgtttgttggagtgatgattatgcataccgaggactctatccgcaagtttgagcgagaactgatgctggaacagcaagagatgctcatgggcgaaaagcaagtgatcctccagaggcagcaggaggaaatttcccgactgatgcatattcaaaagaatgctgactgtacttccttttccgaactcgtggaaaatttcaaaaaaaccttgtcccacaccgacccaatggtattggatgattttggaactagcctgcccttcatcgacatctatttcagcacactggattatcaggatacaaccgtgcacaaacttcaggagctttactacgaaattgtacacgtactcagcttgatgcttgaagatctcccccaagaaaagccccagtcactcgagaaggtcgatgagaagtag

SEQ ID NO: 111140 - DNA, 1419 bp, Artificial Sequence
  Description of Artificial Sequence: Synthetic coding sequence
atgcgcgataatgaaaaagcctggtggcagcagtggacaagccataccggccttgaaggttggggtggcacacaggaagatcgcatgggttttggaggcgctgtggccgccctgaggggccggccctcaccgctgcagtcgaccattcacgagagctacgggaggccagaagagcaagtgcttataaataggcaggaaataacaaataaggctgacgcctgggatatgcaagagttcattacccacatgtatataaagcaacttttacggcacccagccttccagcttcttttagccttgctcctggtcatcaacgcaatcacaatagctttacgcacaaacagctacctcgaccagaagcactacgagctattttcgacgatcgacgatattgtgttaacaatcctcttgtgtgaggttctgttgggctggctgaatggcttttggatcttttggaaggatgggtggaacatcttaaactttattatcgtttttatcctcttgctccggtttttcatcaacgagatcaacatccccagtatcaattataccctgagggcccttagactggtccatgtatgtatggccgtggagccattagcccggattatcagagtcatcctacaatctgtccccgatatggctaacattatggtgctgatcctgttcttcatgcttgtcttctcagtctttggcgtgacacttttcggcgcctttgtccccaagcacttccaaaacattcaggttgcattgtacacactatttatctgcattactcaggacggctgggtcgatatctactcggattttcagactgaaaaaagagagtatgccatggagatcgggggtgcaatctattttactatctttatcaccatcggtgccttcatcgggattaacctatttgtgattgtcgtaaccacaaacctcgagcaaatgatgaaggcaggcgaacaaggccagcaacaacggataacttttagcgaaacaggtgcagaggaggaggaagaaaacgatcagctgccacttgttcactgtgtggtggctagaagtgaaaaaagcggcctgctccaggagcctctagctggtgggcctcttagcaacctctctgaaaacacatgtgacaacttctgtttagtgctggaagccatacaggagaatctgcggcaatataaagagatccgcgatgagctgaatatgatagtggaagaggtgagggctattagattcaaccaggaacaggagagcgaggtcttgaataggagatcctctacatcaggctcccttgagactacatctagcaaagatattagacagatgagtcagcagcaagaccttttgtccgcgctggtctccatggagaaggtgcacgacagcagctcacagattttactcaagaaacacaagagttcccattag

SEQ ID NO: 111141 - DNA, 3351 bp, Artificial Sequence
  Description of Artificial Sequence: Synthetic coding sequence
atggaatctcctctgatctacgtgtcggtgctcctacttaatatctttgagttttcttcgggcatcgtgtacaacaaggacgatactgagaagcggtttgcctgttctaacaagggattcccgcaggaaaacgagataattaaactctatctgttcctggaaaatttgaaaattcagtgctttttccagactgagaatgagatcgccagcaaggcaatgctctccgtgttcacaagcgggggtcttgcccctagtctagggattatgaatagcacttataatgggatctttcactttaatcttactctgtttagtgacagaattctgtggcttgtagatatcccaagggagaacataacacagtccacagacattgctgctgtcgaggagtggctggtgaggattaccttgcaccacggcttaaatatttatgctaccgagggaaccctcctcgacgtcatccgggagccaatccttcaatggaccccaggcgacgtaatcccagagtctgaaatcagcaagctgtatcctcacgttgttgatctgaaagttacaaaatgcccatgtgcaaacgatgtagccttgctcggcttcatcgtagataccattgtcgacggcgtgtatattggcataacctttggggggttctggcacgactacgataccacttggttcaatatgacacagaccatttactcccagttgcaagaagaatatgaagacttgtcattggtcgacatggtcctcactaaccactttttggtgatcttgaccagccttggcctctttgtatccgaagatttacgctacccttcccgtcattccctgagtttctcgcgagcagatttttgtgggttcgagcgcgttgattacgtaaaggggaagctctggtataacgagcggtgcttcgcaaaccgcgaacacttcgaagttgattatgtgactgtaacctttgaacgaaatcgcaccctctccgagtcatcctcgtgcttttatagccaggagccatttctagaatgggtcccctgtctgccacacatatttaaaggaatcaaaatctttcccaccgttcttaccttccttgtggaccaggagaggggaacaggagtttaccttttctacaacaaggtacgtaagacagccattgcgagcgtgtcaaccctacgtaacaatgagccaaattcccagagtaagtttcccatctttaggtttccatcctccttttctagccccgtagggatggtgtttcacccacgtagtcacttcctatacgcctacgggaaccagatctggctgtctgtggacggcggaaatacgtttcagctcatagccaacttccatgacgacattattaagaagaccttccactctttctacacctcggccatcacttttgtgagtcagcgcggcaaggtctattctactaaagcaggcatgggaagatacagtgcggtgggatctgtaacagagcggatctttaccctttactacgaccacctgggttttttacacaaactgacactgggtcgcttcgaggccagcggcccaccaaccgcatttggcaacagccggaacctgtttggacaaccccccgatatgggttttgagactgccttagctcctcaacatacctctttagatgaaatcatattcttcgcctatgtgcccgaaaatgaaccacaggagaccatttactctaagaaatttgggaacatacactatggcaaggtaatccactcaggaaaaacaggacgtgcctacatacggaaagtgctgcagcatacaactcccaaaggatttctgagcagtgttatagccgagatgaaggaaccgttcggtcttgaagaggtgaatgaatcctcatgcctgtcttccagtctgttgataaataaggcgggcaacgtgtataagctgacgctcgactcacaagtggtccaggcactcttcgaagatactgacatcgagaagactgtcgttctgccagggtatagctccttcttgatcaccagcatactcgacaacaagaatgcactggctatcgcgaccatgccggagagcgcaccgaacaacatgacctttctgaaaagtacttggttcctgtacaactttggccaaagaaatggacggacctggaagatctattcaaaaccctgcaattattggtttcagcatgacgattcgccctcactgaatatcgtgaagtacatcgacctcggaaacagttacgttctgaaagcgaaagtcatacggaacgccaagggtttcagaatgctggagatacctctccttacagtttttgtgggtaatccaaatctgcttgaagttactgctgaggttaccttcgatgacaccgactcctacgtgatcaccatctccgctgctagcaaggtgctgcaccaaggctccacttcactggccttcattatgtggtctgcttcaacagagtgctttgttaccaccatggtgccaaccctgaaatcttcctgttcatatttgaggagtatgcaccacataccctctaaattcatcccctttgaagattggatttcaggcgtgcataaggacagccagggcttcaacctgattaagactttgcctatcaattatcgacctccttccaacatggggattgccattcctctcacagacaatttttatcacgcggatcctagtaaacctatcccccggaatatgtttcatatgagtaagaaaacgggcaagttcaagcagtgtgcaaacgtgagcacccgggaggaatgcaattgcaccaaggatcagaaattttcccatgccgtggcctttagtgattgcagagaaaaggtgccaaggttcaagttccctattactcagtaccccgtctcacttgagatcattaatgaggacggtagggtaccactccagtccccctatctagtgacggtgactgaagtaaatatgcgtcacaactggaaacttaagcataccgttcccgagaacatcaaacgcatgaagcagcttgtggaacccatactgggcgcagcagtttacaacccttcaggactgaacctgagtataaagggcagtgaactgttccacttccgtgtcaccgtaattagcggagtgaccttttgcaatctgattgaggaattccaaatctacgtggacgaggcccctttaccattccccggtcatacacttattgcagttgctacggcggtagtcctcggtgggttgatcttcatcgcgttcatgttccagctacagggaattcatccctggaggaccttccagcgttggatccggcgaaaccaggaaaagtttagcagcatatcgttgagcgagttaattcatcgctccaagtcagaagagtag

SEQ ID NO: 111142 - DNA, 225 bp, Artificial Sequence
  Description of Artificial Sequence: Synthetic coding sequence
atggagagcccactgatatatgtgtccgtgctgttgctgaacatctttgaattttcctccggtatcgtctataataaggatgacacggaaaagcgctttgcctgttctaacaaaggattccctcaggagaacgagattatcaagctttacctttttctagaaaatctgaaaatccagtgcttttttcagacggagaacgaaattgctagcaaagccatgctatag

SEQ ID NO: 111143 - DNA, 303 bp, Artificial Sequence
  Description of Artificial Sequence: Synthetic coding sequence
atggaatcaccactcatttacgtctccgtattacttctgaacatcttcgagttttcaagtggcatagtctacaacaaggacgatacagagaagcgtttcgcctgctcaaataaggggttcccacaggagaacgagatcattaagctttacctctttctggagaacttgaaaatccagtgttttttccagactgaaaatgaaatagcctccaaagccatgttaagcgtgttcacaagcggaggcctcgcccctagcctgggcatcatgaacagcacctacaatgggatcttccacttcaattag

SEQ ID NO: 111144 - DNA, 225 bp, Artificial Sequence
  Description of Artificial Sequence: Synthetic coding sequence
atggaatcacccctgatctatgtgagtgttctgctgctgaacatttttgaattctcgtccggcatcgtgtacaataaagatgacaccgagaagcgtttcgcttgcagcaataagggcttcccccaggaaaacgaaatcattaagctttacctttttctcgagaacttaaagattcagtgtttctttcagacagaaaatgagatcgcatcgaaggcaatgctttag

SEQ ID NO: 111145 - DNA, 795 bp, Artificial Sequence
  Description of Artificial Sequence: Synthetic coding sequence
atgcacaatcctgacgggagtgcctctcctactgccgatccaggctcggagcttcagacactgggacaggcagcgagacggcctcccccgccccgagccggacacgatgcccctagacgaaccagaccttccgctcgaaaaccgctatcctgtttctcaaggaggccaatgcctacgagagaacctcctaagacacgcggttcgcgggggcatctccacacccatccaccaggccctggacctccattgcagggcttggccccccggggcctgaagacatcagcacctcgccctccatgccagccccagccaggaccccacaaggctaaaacgaaaaaaatagtgtttgaggatgaactattgagtcaggcgttactcggcgccaagaaacccatcggtgctattccaaaagggcataaacctaggccgcaccccgtgcctgactatgagctgaaataccctcctgtctcttctgaacgggagcggtcccgctacgtggctgtgtttcaggaccagtatggagaattcctcgagctgcaacatgaagtgggctgtgcgcaggcgaagctcagacaactggaagcactgctgtcgagcctgcctccaccccaaagccaaaaagaggcccaggtcgccgcaagggtgtggcgcgagtttgagatgaagcggatggacccaggatttttggataagcaggcccggtgtcattacctgaagggtaagctccggcaccttaagacacaaatccagaaatttgacgatcagggggattccgaggggagcgtctatttctag

SEQ ID NO: 111146 - DNA, 3480 bp, Artificial Sequence
  Description of Artificial Sequence: Synthetic coding sequence
atgtgtggaccggccatgtttccagctggccctccgtggccacgggtccgagtggtgcaagttctgtgggcactcctcgccgtgctgctggctagctggcgcctgtgggcaatcaaggattttcaggagtgtacctggcaggtagtcctcaacgagttcaagagagtcggtgaatctggagtgtctgactctttcttcgaacaagaaccagtggatactgtgtctagtctatttcacatgctggtcgatagcccaattgacccctccgagaaatatctgggctttccctattaccttaaaataaattattcttgcgaagaaaaaccctctgaagatctggtgaggatgggccatctgaccggtttgaaacccctggtgctagtgaccttccagtccccagtcaacttttatcggtggaaaatcgaacagctccagatccagatggaggccgcccctttcaggagcaaagaaccttgtatggccgaggaagtttgctctatgtcctggtacactccaatgcccatcaagaaaggctccgtcgtaatgcgcgtcgacataagttcaaacgggttaggcacctttatcccggacaagcgcttccagatgaatatcaacggttttcttaaacgggatagggacaacaatattcaattcaccgtgggcgaggagcttttcaacctgatgccccagtacttcgtcggcgtgtctagcagacccctctggcacactgttgaccagtctccggtcctcatcctgggaggcattcctaacgaaaaatatgtccttatgacagatacaagcttcaaagacttctcattagttgagctatctatcgactcatgttgggtcggcagtttctattgccctcattcaggcttcacagccaccatctacgacacgattgcgaccgaaagcacgctgtttattagacagaatcagctggtgtactatttcactggcacatacactacactgtacgagaggaaccggggctccggaagctggatacgggtcctcgctagcgagtgtataaagaagctttgtccagtctactttcactccaatgggtctgagtatatcatggcactgaccaccggaaagcatgagggttacgtgcactttgggaccatccgcgatgggcaggtgtcctttgaaatgctacctcggcaatggtccgtgtgtgaacagatcggggtcaccacctgttccattatctggtccgaatacatagcaggagagtataccctgcttctgctggtggagagcggatacggaaacgcgtccaaacgctttcaggttgttagttacaatacagcttctgatgacctagagctcttgtaccacataccagaatttatcccggaggcacgggggctggagttcttgatgattcttggaaccgagagctacacgagcaccgccatggcaccaaagggcatcttctgcaacccatataacaatcttatatttatctggggtaacttcctgctgcagtcatctaataaagagaattttatatatctggccgacttcccgaaagaactttcaataaagtatatggcccggtcatttcgcggcgccgtggctattgtgacagaaaccgaggaaatctggtaccttctggagggctcttatcgggtgtatcagttgttcccctctaagggttggcaggtgcacatttctttgaagctcatgcagcagagctctctgtatgcttctaacgagaccatgctcacactcttctacgaggactccaaactctaccagttagtgtacctgatgaataatcagaaaggacaactggtgaaaaggttagtgcccgttgaacagctgcttatgtatcagcaacacacgagccactatgacctggaacgtaagggtgggtatttgatgctttctttcatagatttctgcccattctccgtgatgcgactacgttctctgcctagtcctcagcgatacaccaggcaggagagatacagggcccgaccaccacgagtcctcgaacggtccggattccataacgaaaattcactggcaatttaccagggattggtgtactacttgctgtggctgcacagtgtctacgataagccatacgctgacccagtccacgatcccacctggaggtggtgggccaataacaaacaggatcaagattactacttctttttagcatcgaactggagatccgctggtggtgtatctattgagatggactcctacgaaaaaatctacaatcttgagtctgcgtacgagctgcctgagagaatatttcttgataagggcactgagtacagctttgctatatttttgtcggctcagggacactcattccgcactcaaagtgagttggggaccgcctttcagctccacagtcaggtcgacgtcggcgtagtgctggccgatccagggtgtatcgaggccagcgtgaagcaggaggtgctgataaaccgcaatagcgtgttgtttagcatcaccctgaaggataagaagttatgctacgaccaggggatctcaggtcatcatctgatggagacatccatgacggtcaacgtggtgggctcaagtggactgtgttttcaggagacacatctgggaccacacatgcaaggtaatcttatggttccggtgttcattggatgccctcccgggaaacgacttgcatttgatatcacctacactctggagtacagccgtctgaaaaacaagcactatttcgactgcgttaatgtcaaccccgaaatgccatgctttctgtttagagacatattctacccgttctttctcatccaggacctggttaccggagacagcggctcctttcaggggagttacgtgctcctggttgtgggtggaggtcctactctggactccttgaaggattatagtgaggacgaaatttatcgctttaacagcccactagataaaacaaattctctgatttggacgacgagaactacacgtacaactaaagattctgctttccacatcatgtcacacgagtccccgggtatagagtggttgtgcctggaaaatgcaccctgctatgacaatgttccgcagggtattttcgcaccagagttcttctttaaggtcctcgttagcaataggggagtggacacaagtacctactgtaattatcagctcacatttttgctccacattcacggcctgcctctgagtcccaagcgagcgctgtttattatcatggtgtcagcttccgtttttgttggcctggtaatcttctatatcgctttctgtcttttgtggcctctggtcgtgaaaggatgcaccatgatcagatggaagattaacaatcttatcgctagcgagagctactacacttatgcaagcatctctggcatttctagtatgcctagcctgcggcactcccggatgggaagcatgttcagttctcgcatgactgaggatcgcgcggagccaaaggaagctgttgaaaggcagctgatgacttag

SEQ ID NO: 111147 - DNA, 3480 bp, Artificial Sequence
  Description of Artificial Sequence: Synthetic coding sequence
atgtgtggcccggctatgtttcctgcagggcctccctggccccgagtccgcgttgtgcaagtcttgtgggccctgctcgcggtactcctggcctcttggaggctgtgggcaatcaaagattttcaagaatgtacatggcaggtcgtccttaacgaatttaagagagtaggtgaaagcggtgtgtctgactcatttttcgagcaggaaccagtcgacaccgttagctcattatttcacatgctggttgattcccctattgatccgtcggagaaatacctggggtttccatattatttaaagataaattacagctgtgaggagaaaccaagcgaagatcttgtccggatgggtcatctgaccggactcaagccactcgttctggtgacattccagtcaccagtcaacttttaccgttggaagattgagcagctgcaaatccagatggaggcagcccctttccgaagcaaagagccctgcatggctgaagaagtatgcagtatgtcatggtatactccaatgccaattaagaagggctccgtggtgatgcgtgtggacatctcatccaatggtttgggaacctttattccggacaagcgtttccagatgaatattaacggtttccttaagcgggacagagataataatatacagtttacagtgggggaagagctgtttaatctgatgccccagtacttcgttggagtttcttccagacctctgtggcacactgtagaccagtcgccagtgctgatactgggcggaatcccaaatgagaagtatgttcttatgacagatacgagcttcaaggacttcagcctggtggaactttcaattgattcgtgttgggttgggagtttttactgtccacacagcggattcaccgccacaatttacgacactatagcgacagaatccacgcttttcattcgccagaaccagctggtctattattttactgggacatataccaccttgtacgaacggaaccgggggagcgggtcctggatcagagtattggccagcgagtgcatcaagaagttatgcccagtgtacttccattcaaacggaagcgagtacattatggccctgaccaccgggaaacatgaaggatacgtgcactttggcacgatcagggatggtcaagtgagtttcgagatgctgccacggcaatggtcggtatgcgagcagatcggcgtgacaacgtgttctattatttggagtgaatacatagccggcgagtacacgttattgctcctggtagaatcaggctatggcaacgctagcaaacgatttcaggtggtgtcctataacaccgcctccgacgatctggagctgctctatcacattcctgaattcatccctgaggcacgtgggttggaattccttatgatattgggcaccgaatcctatacctccactgctatggcacccaaaggtatattttgtaacccctataacaatctgatctttatatgggggaactttctgctacagtcttctaacaaagagaattttatctacctggctgatttcccaaaagaactgtcaatcaaatatatggcaaggagctttcggggggctgtggctatagtcacggagaccgaggagatctggtatcttttagaaggctcctatcgggtttaccagctcttcccatctaagggatggcaggtgcacatctccttaaagctgatgcagcagagctccctctacgcctctaatgaaacaatgttgacactattttacgaagatagcaagctgtaccaactggtctacctgatgaacaatcagaaaggacagctggtgaaaagacttgttccggtagaacagctgctgatgtaccagcaacacacctcccactacgaccttgagaggaagggaggctacctgatgctctccttcattgatttctgccccttctcggtcatgcggctgcgtagcctcccgtccccgcagaggtatacacgacaggagaggtacagggccaggccccctcgcgtcttggaaagatccggatttcataacgagaacagcctggccatctatcagggcctcgtgtattatcttctttggcttcattcagtatacgacaagccatatgctgacccagtacatgatccaacctggagatggtgggccaacaacaaacaggaccaggactattatttctttctggcatctaactggaggtctgccgggggcgttagtatagagatggacagctacgaaaagatctacaaccttgagagtgcctatgagctccccgaacgcatcttcctggacaaaggaaccgaatacagtttcgccatcttccttagtgctcagggccattcctttcgcacccaatctgaacttggtacggcgttccagctgcactcccaagttgatgtcggggtggtgctggccgatccagggtgcatcgaggcaagcgttaagcaagaggttctcatcaatcgcaactctgtcctgtttagtattacactcaaagacaagaaactgtgctacgatcagggaataagcgggcatcacttgatggaaacaagcatgaccgttaatgttgtaggctcaagcggactctgtttccaagagactcacctgggcccgcatatgcagggtaatctgatggtgcccgtctttatcggctgtcctccggggaagagattggcatttgacatcacttacactctagaatatagtcggctcaaaaacaaacattatttcgactgtgtcaacgtaaatcctgagatgccgtgcttcctgttccgggatatcttttatccttttttcctgatccaggatctggtgacaggtgattcgggcagcttccagggcagctacgtgctgctcgtggttgggggtgggccaacattggacagtctgaaggactattcggaggacgaaatctatcgctttaactcacccttggataagaccaacagtctgatctggaccacaaggaccacccgcaccactaaggatagcgcttttcacattatgtcccatgaatcaccaggaatcgagtggctgtgcctggaaaacgcaccatgctatgacaacgtgccccagggcatctttgctcccgaattcttcttcaaggtcctggtgagcaaccgaggtgtcgacacctcaacatattgcaactaccagctcacgttcctgttgcatattcacggcctgccactttcaccaaaacgcgcgctgttcatcataatggtgtccgcctccgtcttcgtcggtctggtgatattctacatagcattctgtctgctctggcctctggtagtgaaggggtgcacgatgatacgctggaagatcaataatctcatcgccagcgagtcttactacacgtatgcttctatctctgggatttccagtatgccatctctgaggcactctcgaatgggcagcatgttctccagtcgtatgacggaggacagagctgaacctaaggaagctgttgagagacaactcatgacttag

SEQ ID NO: 111148 - DNA, 1983 bp, Artificial Sequence
  Description of Artificial Sequence: Synthetic coding sequence
atggatgtgctggtgtcagaatgcagtgcccggctgcttcagcaggaggaagaaataaagtcgctaactgccgaaattgatcgccttaagaactgtggatgcctgggggccagcccaaatctggagcagctgcaggaggagaatctgaaattaaagtatagactgaatattttgcggaagagcctgcaggctgagcgcaacaagccgactaaaaatatgataaatatcatcagtcgtctccaggaggtatttggccacgcaatcaaggctgcatatcccgacttggaaaaccctccactgctagtgacaccttctcaacaggcaaaattcggcgactaccagtgtaactccgccatggggatatcccagatgctcaagaccaaagaacagaaggtgaacccccgggagatcgccgagaacatcacaaaacacctcccggataacgaatgcatcgaaaaagtggagatcgcaggtccaggctttattaacgtgcacctgcggaaggatttcgtgagcgagcaactgactagcctgctggtcaatggtgttcagctgccagccctgggtgaaaacaaaaaagtgatcgtagacttttcaagccccaacatcgctaaggagatgcacgttggccatctgaggagcacaataattggagagtcgatttcccggctgttcgagttcgctggctatgacgtgttaagattaaatcacgtgggggattgggggacacaatttgggatgctgattgcccacctacaggacaaatttccggattatctgacggtaagccctccgattggtgatcttcaagtattttacaaagagagcaaaaagaggttcgacactgaagaagagttcaagaaaagggcatatcagtgtgttgtgctgctgcagggcaagaaccccgatatcacaaaagcctggaagttaatatgcgatgtctcgaggcaggagctcaacaagatctatgatgcactggacgtctctctaatcgaacgaggggagtctttctatcaggatcgtatgaacgatattgtcaaagaatttgaggatagggggttcgtccaggtggatgatgggagaaaaatagtgttcgtgccgggctgctctataccattgactattgtcaagagcgatgggggatatacatacgatacgtcagacctcgccgcaataaaacagagactgtttgaagaaaaagcggacatgattatatatgtcgtagacaatggtcagtctgttcatttccagaccatcttcgccgccgcacagatgatcgggtggtatgatcctaaagtcacacgtgtcttccatgcaggtttcggagtagtgctgggcgaggataagaaaaaatttaaaacacggtcaggtgagactgttcggcttatggacttattgggtgagggtttaaagaggtctatggataagctcaaggaaaaagagcgggataaggtgctaaccgcagaagaacttaacgcagcacaaactagcgtcgcttatggatgcataaagtatgcagatctctcccacaataggttgaacgactacatattttcgttcgataaaatgcttgacgaccgcggcaataccgctgcttatcttctctatgcctttacacgtattcgaagcattgcgcgcttggcaaatatcgacgaagagatgcttcagaaagccgcgcgagagactaagatcctgcttgaccacgagaaggaatggaagctgggacgatgcatcctgcgattcccagagatactccagaagattttggacgacttgttcctgcatactctctgcgactatatctatgagctggccaccgccttcacggagttttacgactcctgttactgtgttgagaaagaccggcagactggtaagatccttaaagttaatatgtggagaatgctactgtgcgaggcggttgcagccgtcatggcaaagggatttgacatccttggaataaaacctgtgcaacgcatgtag

SEQ ID NO: 111149 - DNA, 465 bp, Artificial Sequence
  Description of Artificial Sequence: Synthetic coding sequence
atgtgttggacaaggattagacccgggactcccagcagtccaggcgcacagagacctacaccatacgagtggatgaggcgcagtgtcgcggctggcggtgggggaggctccggtaagactagaaccaaagataaatatagggtggtctacactgatcaccagcggcttgaactcgagaaggagttccactatagcaggtatattactatccgacgcaaaagcgagctggcagcgaacctcggacttactgagcggcaagtgaaaatttggtttcagaataggagagcaaaagaaagaaaagtcaataagaaaaagcagcagcaacaacagcctccacagccacctatggcccatgatatcaccgcgacccccgccggcccctctctgggaggcctttgtcctagcaatacgtccttgttagctacttccagtcctatgcctgtcaaggaggaatttctcccttag

SEQ ID NO: 111150 - DNA, 183 bp, Artificial Sequence
  Description of Artificial Sequence: Synthetic coding sequence
atgagaggcggacctaggggtcatcacgtttgtggactgtgcgccgggcaaggcttcgccagggtgccccggccctctcaggcctcccagccgcgtcctggtccggcttcgctctgcccctcaaatacaagtctgttagccacctcttctcctatgcccgtaaaagaggagtttttgccttag

SEQ ID NO: 111151 - DNA, 942 bp, Artificial Sequence
  Description of Artificial Sequence: Synthetic coding sequence
atgtacgtgtcctacctgttggacaaggacgtgagtatgtatccaagctccgtaagacattcagggggcctgaatctggcccctcagaatttcgtctctcctccacagtaccctgattatgggggctatcacgtggcggccgccgccgctgcggctgctaacttggactctgcccagtcaccaggcccaagctggcccgcggcctatggggcacccttgcgggaggattggaatggatatgcaccaggcggcgctgctgccgcagccaacgccgtcgcacacggactgaatggagggagtcccgccgccgctatggggtacagctcgcctgccgactatcatccccatcaccacccacatcatcaccctcaccatcccgcagcagctccaagctgtgcatccggactgctgcagacgctgaatcctggtcctccaggcccagctgcaactgcggcagcagagcagctgtcccccggaggacagaggagaaatctgtgtgagtggatgaggaagccagcccaacagtctctcggcagtcaggtaaaaacacgtacaaaggacaagtatcgcgtagtttacacagaccaccagcgcctcgagctggaaaaagagttccactatagccgctatatcaccattcggcgcaaggcagaactggccgctactctgggcttgagcgaacggcaggtcaaaatctggttccagaacaggagagccaaagagcgcaaaataaacaagaagaagctgcagcaacagcaacaacagcagcctccccaaccccctccgcctcccccacaacccccccaacctcagcccggtcctctgagatcagtgcccgagcctctcagcccagttagcagcttgcaagctagtgtgccaggcagcgtcccaggcgtcctcggtcctaccggcggagtgctgaaccctactgttacacagtag

SEQ ID NO: 111152 - DNA, 855 bp, Artificial Sequence
  Description of Artificial Sequence: Synthetic coding sequence
atgtacgggagctgtctcctggagaaggaggcaggcatgtatccgggaaccttaatgtctccaggcggcgacggaacggctggaaccgggggaactggtgggggtggctcaccaatgcctgccagtaacttcgcggccgcccctgccttttcccattacatggggtacccgcacatgccaagtatggacccacactggccctcactgggggtgtggggctcaccttattcgcccccacgcgaagattggtctgtgtaccctggcccatccagtaccatgggcaccgtacctgtgaatgatgtcacctcatctccagcggctttctgctccaccgattatagcaacctgggcccagtgggcgggggcacttctggatctagtctacctggccaggccgggggttccctggtgccgaccgacgccggggctgccaaggccagcagtccctcacgctccaggcattctccttatgcctggatgcggaagaccgttcaggtgacaggcaagactagaaccaaagaaaaatatcgcgtggtctacacagaccatcagaggcttgagctggagaaggagtttcattgcaaccgctatataactatacagaggaagtcagagcttgccgttaacctcggactctccgagcgccaggtcaagatctggtttcagaatcgtagggcaaaggagagaaagatgataaagaagaaaatcagtcagtttgagaattccggaggtagcgttcagtccgatagcgactctatctcacccggcgagctccccaatactttttttactaccccatcagccgttcgcgggttccagcctatagagattcagcaagtcattgtgagcgagtag

SEQ ID NO: 111153 - DNA, 456 bp, Artificial Sequence
  Description of Artificial Sequence: Synthetic coding sequence
atgatggctgaagaacatacagacctcgaggcacagattgtcaaagatattcactgcaaagaaattgatctggtgaacagggacccgaagaatataaatgaagacattgttaaagtggacttcgaggatgtcattgccgagcccgtcggcacctacagttttgatggcgtctggaaggtgagctacaccaccttcaccgtgtcgaaatactggtgttatcggcttctgagcacgctcctcggcgttccactagctcttctgtggggattcctgttcgcctgcatctctttctgccacatatgggcggttgtgccttgtatcaagtcctacctgatcgaaattcagtgtatcagccatatttattctctctgcatccgaactttttgtaacccactattcgcagcgctgggccaggtgtgctccagtatcaaggttgtgttacgcaaagaagtgtag

SEQ ID NO: 111154 - DNA, 456 bp, Artificial Sequence
  Description of Artificial Sequence: Synthetic coding sequence
atgatggccgaggaacataccgatctggaggcccagatcgttaaagacattcactgcaaggaaattgatttggtcaaccgggatcccaaaaatattaacgaggacattgtgaaagtggactttgaagatgtaatcgcagagccagtgggtacttacagcttcgacggtgtctggaaggtgtcgtataccacattcaccgtcagtaagtactggtgctatcgcttgttatccactctcctgggtgtgcccctggctctgctgtgggggtttctgttcgcctgcatcagtttttgtcacatctgggccgtggtgccctgtataaagtcttatctcattgagatacaatgtatttcacacatctattccctgtgtatacggacattctgtaacccactgttcgccgcactcggtcaagtgtgtagctccattaaggttgttctgcgtaaagaagtctag

SEQ ID NO: 111155 - DNA, 813 bp, Artificial Sequence
  Description of Artificial Sequence: Synthetic coding sequence
atggcggaccatatgatggcaatgaatcacggtcgattccccgatggcacgaatgggctgcaccaccatcctgcccataggatgggcatgggccagtttccttccccacatcaccaccagcagcagcaacctcaacacgctttcaatgcgctcatgggagaacacatacattacggggctggaaacatgaacgcaacatctgggatacggcatgctatgggcccaggcaccgtcaatggggggcatcccccatcagcattggctcccgccgctaggttcaacaatagccagttcatgggccccccggttgcaagtcaaggagggtccctcccggcttcgatgcagctgcagaagctcaacaatcaatattttaatcaccacccatatcctcacaatcactatatgccagatctgcatccagccgctggtcaccaaatgaatggaacaaaccagcatttcagagattgcaatccaaagcactcaggaggaagctccacaccaggcggctctggtggatcttctactccaggcggctccggcagttcgagcggaggcggcgccggctcctcgaacagcgggggaggtagcggatcgggcaatatgccagcttcagttgcacatgtgcccgccgcgatgttaccccctaatgttatcgacacggatttcattgatgaagaggtccttatgagcctcgtaatagaaatgggtttggatagaataaaggagttgcccgaattgtggctgggccagaatgagttcgactttatgactgacttcgtttgtaaacagcagccaagtcgtgtgagttgctag

SEQ ID NO: 111156 - DNA, 645 bp, Artificial Sequence
  Description of Artificial Sequence: Synthetic coding sequence
atggccgatcatatgatggctatgaatcacggccgtttccctgatggcactaatgggctccatcaccacccggcacacagaatggggatggggcagttcccgagcccccaccatcaccagcaacagcagcctcaacatgcattcaatgcactcatgggcgaacacatccattacggcgccgggaacatgaacgccacctccggtatcagacacgctatgggtcccgggactgtgaacgggggccatcctccttctgctttggcccccgctgcgcgtttcaataatagtcagtttatgggccctcccgtggcctcccagggagggtctctgcctgcttcaatgcagctgcaaaaattgaataatcagtattttaaccatcacccctaccctcacaaccactatatgcctgacttacaccccgccgccgggcaccagatgaacggcaccaatcaacattttagagattgcaacccaccaaatgtaatcgacactgacttcattgatgaagaggtgcttatgagtttggttatcgagatgggactggataggatcaaggaattgcccgagttgtggctcggacagaacgagtttgacttcatgaccgacttcgtttgtaagcagcagccaagtcgagtttcttgctag

SEQ ID NO: 111157 - DNA, 813 bp, Artificial Sequence
  Description of Artificial Sequence: Synthetic coding sequence
atggccgaccatatgatggccatgaatcacggccgatttcccgacggaaccaatgggctgcatcatcatcccgcccatcggatgggaatggggcagttcccatcccctcaccaccaccaacagcagcagccacagcatgcctttaacgccctgatgggggaacatattcattacggtgctggtaatatgaacgctacaagtggcatccgccatgccatgggccctggcaccgtgaatggaggacatccgccctctgccctggctcctgcagcccggttcaacaattcacagtttatggggccacccgttgccagccaagggggcagcctcccagcctcaatgcaattgcagaaacttaataatcagtacttcaatcatcacccataccctcacaaccattacatgcctgatttacaccccgcagctggacatcaaatgaatggaactaaccaacatttccgcgattgcaacccaaaacacagcggagggtcaagtacaccgggggggtccgggggatcttcaactcctgggggcagcggaagttccagcggaggaggggctggatcttctaatagcggaggcggatccgggtcaggtaacatgccagcatcagtggcccacgttcccgcagccatgctcccgcccaatgtgattgacaccgattttatcgacgaggaagtgctgatgagtctcgttatcgagatgggcctggataggataaaggagttgcctgagctgtggttggggcagaacgagtttgattttatgaccgacttcgtgtgcaagcagcaaccgtctcgagtcagttgttag

SEQ ID NO: 111158 - DNA, 813 bp, Artificial Sequence
  Description of Artificial Sequence: Synthetic coding sequence
atggcagatcacatgatggcaatgaaccacggcaggttccccgacggaacgaacggactacatcatcatccggctcaccgtatgggcatgggacagttcccaagcccccatcatcaccagcaacagcagccccagcacgcgtttaacgccctcatgggggaacacattcactatggagcaggcaacatgaacgctacttctgggatccgccatgctatgggtccgggtaccgtgaatggcggacacccacctagcgccctggccccggctgctcggttcaacaattctcagtttatggggcccccggtggccagtcaggggggatctttgcccgctagcatgcagctgcagaagctgaataaccagtatttcaaccaccatccctacccacacaaccattatatgcctgatctgcaccccgcagctggacaccagatgaacggtaccaaccagcactttagggattgcaatcctaagcactctgggggctcaagtaccccaggcggatcgggcggcagtagtacccctggcggctccgggtcgagctctggaggcggagccggtagctccaactctggcggaggctcaggctctgggaatatgcccgcaagcgtggcccacgtgcctgctgccatgttacctccgaatgttatagacacagactttatagacgaagaggtactgatgtccctcgtgattgagatgggactcgaccgcatcaaggagttacccgagctttggctgggccagaatgagtttgattttatgacagactttgtttgcaaacagcaaccttctagagtgtcttgctag

SEQ ID NO: 111159 - DNA, 1797 bp, Artificial Sequence
  Description of Artificial Sequence: Synthetic coding sequence
atggaaaattcgagtgctgcttctgcctctagcgaggcgggctcatccaggtctcaggaaatcgaagaactggagagatttatcgacagttatgtgctcgagtaccaggttcaagggctgcttgcggacaaaactgaaggggatggcgaatccgagaggactcagtctcacatctctcaatggactgctgactgcagtgagcccctcgactcctcttgcagctttagccgtggccgtgcacctccgcaacagaatggcagtaaagacaattcccttgatatgcttggaaccgacatctgggctgctaatactttcgatagtttctctggagcaacctgggatcttcagcctgagaaactggacttcacacaattccacaggaaagtgcggcatactcccaagcaaccattgccccacatcgatagggaggggtgcgggaagggcaagctggaggatggcgatggaataaacctgaatgatatcgaaaaagtcctccccgcatggcaggggtaccaccctatgccccatgaggttgagatcgcgcacaccaaaaaactttttcggcgccggaggaacgatagacggagacagcagagaccaccgggtggcaataaaccccagcagcacggcgaccaccaacctgggtctgccaagcacaaccgcgatcaccagaagagttatcaaggaggttcagcgccacatccgtccggtcggcccacacatcacggatactctcaaaaccggagatggcatcatggaaatatgaagcatcctcccggcgataaaggggaggccggcgctcatcggaacgccaaagagaccatgacaattgagaatcccaaactcgaggacactgccggcgacacaggccattcctctctcgaggccccgcggagtcccgacactctggcaccagtggcctctgagcgattgccgccccagcaaagcggcggacccgaagtcgagacgaaaaggaaagatagcatcttacccgagagaataggcgagcgtccaaagatcactctcctgcagtcttctaaggaccgcttaagaagaaggctgaaggaaaaggatgaagtagccgtcgaaacgacaacgccacagcagaacaagatggataaactgatcgagatactcaatagcatgaggaacaatagctctgatgtggataccaaactgacgacattcatggaagaagcccagaacagtaccaactcagaggagatgcttggcgagatcgtaaggaccatttaccaaaaggccgtatcagataggagctttgctttcaccgcggccaaactctgtgacaagatggctctgtttatggttgaggggactaagtttcggtcactgctgctgaatatgttgcaaaaggatttcacagtgcgggaagagctacagcagcaggacgtggagcggtggctgggcttcattacttttctatgcgaagtgttcgggaccatgagatcttccactggagagccattccgcgttttggtgtgtccaatatatacatgtctccgggaacttttgcagagtcaagatgtcaaagaagatgcagttctgtgctgctcaatggaactccaatcgacagggcgattacttgaagaacaattgcctgagatgatgactgaactgcttgcgagtgccagggataagatgctatgtccctcggaatccatgctgacacgtagcttgttactcgaggtgattgagctgcatgcgaactcgtggaatcccctaaccccacccatcacgcagtactacaacaggaccatccagaaattgactgcatag

SEQ ID NO: 111160 - DNA, 1803 bp, Artificial Sequence
  Description of Artificial Sequence: Synthetic coding sequence
atggagaattcaagcgcagcctctgcgtcctccgaagccggcagtagcaggagtcaagaaattgaggaactcgagcgcttcatcgattcttatgttctcgagtaccaggtgcaggggctcttagcggataaaacagagggagacggcgaatcggagcgcacacagtcccacatctcgcagtggacagccgattgttctgaacctctggactcttcatgctccttttcaagaggtagagcaccccctcagcagaatggcagtaaggacaactctctcgacatgctggggacagatatttgggccgcaaatacttttgactccttttcgggagctacttgggatctgcagcctgaaaaactggactttactcagtttcaccggaaggtccgccacacaccgaaacaacccctgcctcatattgacagagaaggctgcggcaaaggcaaactcgaggacggagatggcattaacttaaatgacattgaaaaggtgctgcctgcttggcagggctaccatcccatgccccatgaggtcgaaatcgcacacaccaaaaagctgttcagacgccgcagaaatgatagacgccggcaacagaggccacccgggggtaacaagccgcaacagcatggcgaccaccaacctggaagcgctaagcacaaccgggaccatcagaaatcttaccaaggtggttctgcaccacatccttctggtcggcctactcatcacggatacagtcagaaccgtcggtggcaccatggcaatatgaagcacccgcccggagacaagggcgaggcaggggcacaccgaaacgctaaggagactatgactatagagaaccctaagctagaagacacagcgggcgacacaggccactcatccctggaggctccgagatctcccgatacgctcgcccctgtagcctcagagaggctgccaccacagcaatcgggagggcctgaggtcgagaccaaacggaaggattctattctgccagagcgaattggtgagagaccaaagatcacattgctgcagtcctctaaggacagactgaggcggagacttaaagaaaaagtgcccgatgaggttgccgtcgagacaactacaccacagcagaataagatggataagcttatcgagatattaaacagtatgcgcaacaattctagtgatgttgacactaaactgaccacctttatggaagaagctcagaactcgaccaactctgaggaaatgctgggagagatcgtgcgcacgatctatcaaaaagctgtaagcgatagatcttttgcgttcacagcggcgaaattatgcgacaaaatggcccttttcatggtagagggtaccaagtttagatctttactcttgaacatgctgcagaaagattttactgtgagggaggagttgcagcagcaggatgttgaacggtggctgggcttcattacctttctctgtgaggtgttcggcaccatgcgtagctccaccggagagccctttagggtgctggtttgtccaatttatacttgtctgagagaattgctgcaatctcaggatgtcaaagaagacgcagtgctgtgctgctccatggagctgcagagcacggggcgtctcctggaggaacagctgcccgagatgatgactgaactgctggcctcagcccgcgacaaaatgttgtgtccttcagagagcatgctgacaagatccttattactcgaagtaatcgagctgcacgctaattcttggaacccgctcaccccgcccattactcaatattataatcgcacgatacaaaagttaactgcctag

SEQ ID NO: 111161 - DNA, 1947 bp, Artificial Sequence
  Description of Artificial Sequence: Synthetic coding sequence
atgggtcggctgccctgtgggccattgcctggccaatggactgctgattgcagcgagcccttggactcgtcctgctccttttctcgcggaagggctccgccccagcaaaacgggtccaaggacaactctcttgatatgcttggtaccgatatctgggccgcaaatacgtttgatagtttttccggggcaacctgggacttgcaacccgaaaaattggattttacccagtttcatcgcaaggttcgccatacccctaaacagcctctcccgcatattgatagagagggctgcggtaaggggaaactggaagacggcgacgggattaacctgaacgacatagaaaaggtccttcctgcttggcagggctatcatccaatgccccatgaggttgagatagcgcacacaaaaaaactgtttagaaggagaagaaatgacaggaggcggcagcagcgaccccctggcggaaacaaaccccagcagcacggcgatcatcagcctgggagcgccaaacataatcgtgatcaccaaaaaagttaccagggcggatcggcaccccatcccagcggtagaccaacacaccatggatattctcagaataggagatggcatcacggcaacatgaagcatccgccaggcgataagggtgaagcaggagcgcatagaaacgccaaagagaccatgaccattgaaaaccccaagctcgaggacacagccggtgatactgggcattcctcccttgaagcaccccgtagccccgacactttggcccccgtggcctccgagcgtttaccccctcagcagagcggggggccagaggttgagaccaaacggaaagactccatattgccggaacggataggcgagagacccaagattactttgttgcagagttctaaagatcgactgagacgaagattgaaagaaaaggacgaagttgccgtggaaaccaccaccccccagcaaaacaagatggacaaattgatagaaattctgaacagtatgcgtaacaacagttcagacgtcgataccaagctgacaacttttatggaggaggctcagaattctacgaactctgaagagatgttgggggagatcgttagaacaatttaccagaaggccgtgtccgacagaagcttcgcattcactgcagccaaactgtgtgataagatggctctctttatggttgagggaaccaagttcaggtcactcctgcttaatatgctgcagaaggactttactgtgcgggaagaactgcagcaacaagatgtagaaagatggctcggcttcatcacttttctgtgcgaggtgttcgggacaatgcggtctagcaccggcgagccattcagggtactggtttgtcccatctacacctgtctgagggagctgctccaaagccaggacgttaaagaagacgccgtactgtgttgctcaatggaattgcaatccacaggccggctgctggaggaacaactgcccgaaatgatgaccgaactcttggcctctgcccgcgataaaatgctctgcccgagtgagagcatgttgactaggtctctgctcctcgaagtcattgaacttcacgccaacagctggaaccagggggcatggcaggcagctcacggccagctggggccctggtgcaccggccccgacggacaggccggcggccagggatggccctggagagagaaggagatgggccgtcgtgcagggcgggtgggaggccagtctggagctcgggcctgcaaactgacgcccattcgggaagcttgcttttttttcctggtcgccctggccctgcctttccttaccccagcaagtcctttgcccatccggccaataccccacggagcgctttgtgaggggtctcataggtgtgacagttccgagaccctcgcagcatctcacgcgggcgcacctctcggatcagagaggacctccgaaggatag

SEQ ID NO: 111162 - DNA, 1077 bp, Artificial Sequence
  Description of Artificial Sequence: Synthetic coding sequence
atggagagcgccgacttctacgaggcagagccccggccgccaatgagctcccatcttcagtctccgccgcacgcccctagcagcgcagccttcgggttcccccgcggagccggaccggcacaacccccagccccccccgcagccccggagccactgggcggaatttgcgaacatgagacctccatcgacatctctgcttatatcgatccggctgcattcaacgacgaattcctggctgatttgttccagcactcccgacagcaggaaaaggccaaggcagcggtcgggccaactggcgggggaggtggtggcgactttgattacccgggggccccagccgggccaggtggtgccgtcatgcctggtggggcgcatgggcccccacctggctatgggtgcgctgccgctgggtacctggacgggcggctggaacccctgtacgagcgggtgggagcgcccgccctgcggcccttagtgattaagcaggagccccgtgaagaggacgaagctaaacaattggctctggcaggcctgttcccataccagccaccgccaccaccaccaccctctcacccccacccccacccgccacccgcacatctcgcagcccctcacttgcagttccagatcgcacattgtgggcagactacaatgcacctccagcctggtcatccaaccccaccccccacacctgttccgtccccccaccccgccccggccctcggcgctgcggggctgcccgggccaggctctgcgctgaagggtctgggcgcagcccatcccgatctgcgtgcatctggtggctccggcgcgggcaaagcaaagaagtcagtggacaagaactccaacgagtatcgagtccggcgcgaaaggaataacattgctgtgcgaaagtcaagggataaggccaaacagaggaatgttgagacccagcagaaagttctcgaacttacctcggacaatgatcggctgcgcaaacgggtcgaacagctctcacgggagctggacacactgcgcggtatctttagacaactgccagagtcatctctggtgaaggctatgggcaactgtgcgtag

SEQ ID NO: 111163 - DNA, 810 bp, Artificial Sequence
  Description of Artificial Sequence: Synthetic coding sequence
atgagcgcagccctgttctccctggatggccccgccagaggagccccttggcccgctgagccagcccccttctacgagccaggacgggctggtaaaccaggccggggagccgagcctggggcactcggggagcccggtgccgcagctcccgcgatgtacgacgacgaatcagccattgacttcagtgcttatattgactccatggctgccgtccccactctggagttatgccatgatgagctgttcgcagatctctttaattcaaaccataaggcgggtggggccggcccattagagctgctgcccgggggccctgctaggcctctggggcctggacccgccgctcccagactgctgaagcgcgagcccgattggggcgacggtgatgcacccggctccctgctgccggctcaggtggcggcttgtgcccagactgtagtgagcctggcggccgccgggcagccaacgccccctactagcccggagcccccccgctcctctcctcgacagactcccgcaccgggacccgcgagagaaaagtcagctggaaagcgcgggcctgatagaggttcacctgagtacagacagcggcgtgaaagaaataacatcgccgtgcgaaaaagcagagacaaggccaaaagaagaaaccaggaaatgcagcagaagctcgttgagcttagcgccgaaaacgaaaagttgcaccagagagtggaacagctgacccgtgatctggccgggctccggcagttctttaaacaattgccctccccaccctttctcccggccgcaggaaccgcagactgtcgatag

SEQ ID NO: 111164 - DNA, 402 bp, Artificial Sequence
  Description of Artificial Sequence: Synthetic coding sequence
atgagtgcggctctttttagtctggacgggccggccaggggagccccatggcctgcagagcctgcccccttttatgaacctggccgggctggcaaaccagggcggggcgccgaacctggagccctgggcgaacccggggcagcagcacccgccatgtatgatgacgaaagcgcaattgatttctcagcgtacatagattccatggctgccgttcctactctcgaactgtgtcacgatgagctgtttgccgaccttttcaattccaaccacaaggcgcgcgccccgtgggccagggcactaccattgcctgcctgttcaagtgcttctcccaccggggccacagctactcgcccagcccgctgctgcccccgccgctggccccgagcacaccggccctggtag

SEQ ID NO: 111165 - DNA, 1092 bp, Artificial Sequence
  Description of Artificial Sequence: Synthetic coding sequence
atggcctctggagacttctgctcacctggtgaaggcatggagattcttcagcaagtttgtagtaaacagttacccccatgcaacctgagcaaggaagatttgctacagaacccatattttagtaaactgctcctcaatttgagtcaacatgtggatgagagcggtttgagtctcaccctcgcgaaggagcaagcccaggcctggaaggaagttagactccacaaaacaacctggttgaggagcgaaatcctacatcgcgtcattcaagagttattagttgattactacgtgaaaattcaggacacaaatgttacttccgaggacaagaagtttcatgaaactctggagcagcgccttcttgtgactgagctgatgcgcctcctgggcccgagccaggagagagaaatccctcctttactcggccttgagaaggcagacctcctggaactcatgcctctttctgaggatttcgtatggatgagggctcggctccaacaggaagtagaagagcagctgaaaaaaaagtgcttcacacttctgtgttactacgatccaaactcagatgcagactcagagaccgtgaaggccgcaaaagtgtggaagctggctgaggtgctggtgggagagcagcagcagtgccaggacgctaaatcacagcagaaagagcaaatgctgctgctagagaaaaaatccgcagcttattcccaagtgctccttcgttgtttgacattactccaaaggcttttgcaagaacatcgtcttaaaacacagtccgaattagaccgcatcaacgcccaataccttgaggtcaagtgcggggccatgatcttgaagctaaggatggaagagctcaagatcttgtccgatacgtacaccgttgagaaggtagaagtccaccggctgatcagggatcggcttgaaggagcaatacacctgcaggaacaggatatggagaattcccgccaggtgctgaactcttatgaggtgttgggagaggagtttgacaggctggtgaaggagtacactgtccttaaacaggcaacggaaaacaaacgctgggctcttcaggagttctccaaggtttacagatag

SEQ ID NO: 111166 - DNA, 1359 bp, Artificial Sequence
  Description of Artificial Sequence: Synthetic coding sequence
atggggagctcccaatcagtcgaaatccccggtggtggaacagaaggctaccatgtcctgagggttcaggaaaacagtcccggacacagggcaggactcgagcccttctttgacttcatcgtgtccatcaatgggagtcggcttaataaggacaatgacacactgaaggacctgttaaaagcaaacgtggaaaagcccgtgaaaatgttgatttatagttctaaaaccctggagctcagggagactagtgtaaccccttcgaatctgtggggggggcaaggacttttgggtgtctccattcgattttgtagcttcgacggagccaatgaaaatgtttggcacgtgttagaggtggagagcaattctccggctgccctggctggcctccgcccccacagcgattatatcataggggccgacacagtgatgaacgagagcgaagaccttttcagccttatcgagacacacgaggcaaaacccctgaagttatatgtctataatactgacacggataattgccgtgaggttatcataacacccaattccgcttggggtggagagggctcactcggatgcgggattgggtatggttatcttcaccggatccctacacgcccttttgaggaaggtaagaagatttctctgccaggccagatggcaggcacaccaatcaccccactcaaagacggtttcaccgaggtgcagctctcttccgtaaaccccccttctctctctcctccggggacaaccggaattgagcagagtctcaccggactaagtatatccagcacgcctcccgcagtcagctcagtcttaagtactggcgttcctacagtccctttgctcccaccacaggttaaccagtctttaacgtcagtccctccaatgaaccctgcaacaactttacccggcctaatgcctctgcccgccggcctccctaatctgcctaatctcaatctgaatttgccagctcctcacataatgcctggtgtgggactccctgagctggtgaatcctggattgcctccgctgccctccatgcctccgcggaacctccctggaatcgcccctttaccccttccatcagagtttctcccatcgttcccgttagttcctgagagtagctctgcagcaagtagtggcgagctcctgtcttctttgcctcctacatccaatgcaccatcagatcccgccacaacgaccgcaaaggccgatgccgcatcttcccttacagtggacgtgacacctcccaccgcaaaggcccctactacagtcgaagaccgagtgggagattccacacctgtgagtgagaagcctgtgtcagcagcagtagatgcaaatgccagcgagtcgccctag

SEQ ID NO: 111167 - DNA, 2997 bp, Artificial Sequence
  Description of Artificial Sequence: Synthetic coding sequence
atggccgccgtgaaggagcctttggagttccacgccaaaagaccgtggagaccagaggaggccgtggaggaccccgacgaggaagacgaggataatacctccgaagcggagaatggcttcagtttggaagaggtcctacgtctcggcggtacaaaacaagactacctcatgttagctaccttggacgaaaacgaggaagtgatagacggagggaagaaaggtgccatcgatgacttgcaacagggcgaactggaggcgtttatacaaaacctaaacctggccaagtacaccaaagcttctttagttgaggaagatgagcctgccgagaaagaaaactcatcaaagaaggaggtgaaaataccaaaaatcaacaacaaaaatactgccgaatcccagagaacttccgttaacaaggtgaagaacaaaaacagaccggagccacactctgacgagaatggtagcactacacccaaagtaaaaaaagacaagcagaacatctttgaattcttcgagcgacagactctgctcctccgcccgggggggaaatggtatgacctggagtacagtaatgaatattctctgaagccccagccacaggatgtggtatctaagtacaagacgctcgcccagaagctctatcagcacgaaattaacctcttcaaatcaaaaactaacagccagaagggcgcctcttcaacttggatgaaagcaattgtcagtagcggaacacttggcgaccggatggctgccatgatcttgctgattcaggacgacgcagtgcacacactacaattcgtggagacgctggtcaatttggtgaagaagaaagggtccaagcagcagtgcctcatggcactagatacattcaaggagctcctgattacggacctgttacccgacaaccgcaaactgcggatattctctcagagacctttcgacaaactcgaacagttatcttctggcaataaggactccagggacagaaggctgattctgtggtactttgaacaccagctgaaacatcttgtcgcagaatttgtgcaggtgctcgagaccctgtcccatgatacgctggttacaacaaagacccgcgcactgactgttgcccacgagctgttgtgcaataagcccgaagaagagaaagccctgcttgtgcaggttgtcaataagctcggggatccgcagaaccgtattgcaaccaaagcgagccatctgctggagacactgctctgtaaacaccctaacatgaagggtgtagtcagtggggaagtggaaaggttgctattcaggagtaacatttcctcgaaagcgcaatactatgccatctgttttctgaatcagatggccctgtcacatgaggagtctgagttggcaaacaagctgatcacggtgtacttttgtttctttcgcacctgtgtgaaaaagaaggacgtggaatccaagatgctgtctgctcttctgactggggtaaacagggcatatccttacagccaaacaggtgatgacaaggtcagagaacagatcgatactctcttcaaagtgctgcacattgtcaacttcaatacctcagtacaggctctcatgctgctcttccaggtgatgaacagtcagcaaactatcagtgacaggtactacacagctctgtatcgaaagatgctcgatcctggattgatgacctgctctaaacaagccatgtttctgaacctagtatacaaatcccttaaggcagacatcgtacttcggcgggtgaaagcttttgtgaaaaggttgttacaggtcacctgtcagcaaatgccaccgtttatctgcggcgcactatacctggtttcagaaattttgaaggccaagcctggactgagatcccagctcgacgaccaccccgagagtgacgatgaggagaactttatcgacgccaatgacgatgaggacatggagaagttcacagatgccgacaaggagaccgagatagttaagaagctggagactgaggagacggtgccagagacagatgttgaaacaaagaagccagaggtcgctagttgggtacatttcgacaatctgaagggcggaaaacaactgaacaaatatgatccgtttagcagaaaccctctgttttgtggggcggagaacacaagcctctgggagttgaagaagctgagcgtgcacttccacccgagtgtggccctattcgctaaaacaatactccagggcaattacatccaatactccggtgaccctcttcaggattttacgcttatgcggtttctggataggtttgtgtatcggaatcccaagccacataagggaaaagagaacaccgacagcgtggtcatgcagccgaaaaggaaacactttataaaggacatccggcatttacctgtcaactctaaagagtttctggcgaaagaggaaagtcaaatcccagtcgatgaagtgttcttccatcgctactataaaaaagtggcagtcaaggaaaagcaaaaacgggacgctgacgaggaatctatcgaggatgtggatgatgaggagttcgaggagcttatagacactttcgaagacgataactgcttcagcagcggaaaagatgacatggactttgctgggaacgtgaaaaagagaactaagggagctaaggacaataccctcgacgaagacagcgagggtagtgatgacgaattggggaacctggacgatgacgaggtttctctgggctcgatggatgacgaggagtttgccgaggttgacgaagatggagggacattcatggacgtgctagatgacgagtccgagtcagtaccggagttagaagtccattccaaagtgagcactaagaaaagtaagagaaagggaaccgatgacttcgacttcgcaggatccttccagggtccaaggaaaaaaaaaaggaatctcaatgactcaagtctcttcgtatctgcagaagagttcggccatctgctggatgaaaacatgggttccaagttcgacaatattgcttag

SEQ ID NO: 111168 - DNA, 1992 bp, Artificial Sequence
  Description of Artificial Sequence: Synthetic coding sequence
atggctgctaccgagatctcagtgctgtccgaacagtttactaagatcaaagaactcgagcttatgccagagaaggggctcaaggaggaagaaaaggacggggtctgcagggaaaaggatcaccggtcacccagtgaactggaagcagaacggacgtcaggcgctttccaggattctgtgcttgaggaggaggttgaactggtgctggctcctagcgaggagtccgaaaaatatatcctgactcttcagacagtgcatttcaccagtgaagcagtggaactccaggacatgagcttactcagcatacagcagcaggaaggggtgcaggttgtcgtgcaacaacctggccctggcctgctgtggctcgaggaaggccccaggcagagcctgcaacagtgtgttgcgatctcaatccagcaagaattgtatagcccgcaagaaatggaagtcctccagttccacgcgctggaggaaaacgttatggtagcaagtgaagattcgaagctggctgtgagccttgccgagacaacgggtctaatcaagcttgaggaggaacaggagaagaatcagctactggctgagagaaccaaggagcagttgttttttgtcgaaacgatgtctggagatgagcgatccgatgaaattgtcctaacagttagcaattcgaatgtcgaagagcaagaggaccagcctactgctggtcaggctgatgccgaaaaagctaaatccacgaaaaatcagcgaaagacaaaaggagcaaaaggcacatttcattgcgatgtctgcatgtttacctcttccagaatgagcagcttcaaccggcatatgaagacccatacctctgaaaaaccacacctttgtcacctgtgtctgaagactttcaggaccgtcacattgctaagaaaccatgtgaatactcacaccggaacgaggccatacaaatgcaacgattgcaatatggcttttgtgacatccggggagctggtccggcaccggagatacaagcatacccacgaaaaacccttcaagtgttccatgtgtaagtacgccagcgtggaagccagcaagctgaagcgccatgtgagaagtcacaccggagaaagaccattccaatgctgtcagtgctcctatgcatctcgggacacgtataaactgaaacggcacatgaggacacatagcggagaaaaaccttatgaatgccacatctgtcacactagatttacacaaagcggaactatgaaaattcacatcctgcagaaacatggggaaaatgtgccgaaatatcagtgtcctcactgcgccacaatcattgccaggaagtctgatcttagggtgcacatgcgtaacttacacgcttacagtgctgcagaacttaagtgtcgctattgcagcgcagtgttccacgagcgctatgccttgatccagcatcaaaaaacacataagaacgaaaaacgatttaaatgcaagcactgcagctacgcgtgtaaacaggagaggcatatgactgcccacattcgaactcatacaggggagaagccattcacatgtctcagttgtaataaatgtttcaggcaaaaacagttgttgaacgcccactttcggaaatatcacgatgccaatttcatcccgaccgtctacaaatgctcaaagtgtggcaaaggattctccaggtggataaacctacatcgccattctgaaaaatgcggctcaggtgaggccaagagcgccgcatctgggaagggtcgaaggacgaggaaacgcaaacagaccattttgaaggaggccactaaggggcaaaaagaagccgcgaagggatggaaggaagcggcaaacggcgacgaggcggcggccgaggaggctagcacaacgaagggggaacagttccccggcgagatgttccccgtggcctgcagagagactactgcgcgagtgaaagaggaggttgatgaaggcgtgacatgtgaaatgttgcttaacacaatggacaagtag

SEQ ID NO: 111169 - DNA, 1992 bp, Artificial Sequence
  Description of Artificial Sequence: Synthetic coding sequence
atggccgccacagagatctcggtgttgtcagaacaatttacaaagataaaagagttggagcttatgccggagaaggggctaaaggaggaggaaaaggatggcgtatgcagggaaaaggaccataggagtcctagcgagctcgaggccgagaggactagcggggcatttcaggactccgtgcttgaagaagaagtggaactggtgctcgccccctccgaggagagtgagaaatatattctgacactgcagactgtccactttacctccgaagcagtcgagttgcaggatatgtcattgctgagtatccagcagcaggagggcgtacaggtggttgtgcagcaaccaggtcctgggctgctctggcttgaggaaggtcctcgccaatcactgcaacaatgcgtggccataagcatccagcaagagctatactcccctcaggaaatggaagtcctccagttccatgctctggaagagaatgttatggtggcaagcgaggattcaaaactcgctgtttcgctggccgagactaccggcctaatcaagttagaggaggagcaggagaagaaccaacttctagcagaacgaacaaaagagcagcttttcttcgtggaaacaatgagtggtgacgagcgttccgatgaaatcgtgttgaccgtgtccaacagtaacgtggaggagcaggaggaccagcccaccgcagggcaggcagacgctgaaaaggcgaaaagcacaaagaatcagagaaagactaagggggcaaaggggacgttccattgcgatgtctgcatgtttacaagcagtcggatgagctcattcaatcgacacatgaaaacccatacgtctgagaagccgcacctgtgccatctgtgcctgaaaaccttccggaccgtgaccctgctccggaaccatgtcaatacacatactgggacaagaccatataagtgcaatgattgtaacatggcatttgtgacgtccggcgagctggtgcggcatcgcaggtataaacacacacacgaaaaaccattcaaatgtagtatgtgtaaatatgccagtgtagaggcatcgaagttgaaaagacacgtccggtctcataccggcgaaaggcctttccagtgttgccagtgtagctacgcctcccgggacacatacaagctgaaaaggcacatgcgaacgcacagtggggagaagccctatgaatgtcacatctgtcacacaaggttcactcaatcagggaccatgaaaatccacattctgcagaaacatggcgaaaatgtgccgaaatatcagtgccctcactgtgccactattatcgcaagaaagtccgatctgcgcgtgcatatgcggaatctccacgcatactccgcagccgagctcaagtgtagatactgctccgccgtgttccatgagcgctatgcacttatccaacaccagaagacacacaaaaacgagaagagattcaaatgcaagcactgttcttacgcctgtaagcaggagcgccatatgactgcacatatacgaacccacacaggcgaaaaacctttcacgtgcctgagctgtaacaagtgtttccgtcagaaacagctgctgaacgcccacttccggaaataccacgatgccaatttcattccaaccgtgtataaatgttctaagtgcgggaaggggtttagtcgatggattaacctccatcgacacagcgaaaaatgtggttctggcgaagctaaatcagccgcatccgggaaggggcgtcgcaccaggaagaggaaacagaccattctgaaagaggctaccaaagggcagaaagaagccgctaagggatggaaggaggcggccaacggagatgaggctgcagctgaggaagcctccaccacaaaaggcgaacagttcccaggcgaaatgttccccgtagcttgtcgggagaccacagctagagtgaaagaggaggtggatgagggcgtcacttgcgaaatgctgctgaacacaatggacaagtag

SEQ ID NO: 111170 - DNA, 1284 bp, Artificial Sequence
  Description of Artificial Sequence: Synthetic coding sequence
atggctgccaccgaaataagtgtgctcagcgaacagttcacaaagatcaaggagctggagctcatgcccgaaaagggcttgaaagaggaggagaaggacggagtgtgcagagaaaaggatcacagatctccatctgagctggaggccgagcgcacatctggagcattccaggacagcgtgctggaagaggaggtggagctggtgctggccccttcagaagagagcgagaagtacatcctgacactccaaaccgtccattttacttccgaggctgtggagttgcaggatatgtcacttctcagtatacagcagcaagagggggtacaggtcgtggtacagcaaccaggtcccggtttattgtggcttgaagagggaccccggcaaagtctgcagcagtgcgtggcaatctcaattcagcaggagttgtattctccacaagagatggaggtgttgcagtttcacgctctcgaagaaaatgtcatggtggctagcgaggacagcaagctagccgtatcactggcagagacaacaggactgattaagctggaggaggagcaggagaaaaaccagctgctcgcagagcgaactaaagagcagctattctttgtggagaccatgagcggcgacgaacggagcgacgaaattgtgctgacagtgtcaaattctaacgtggaagaacaggaagaccagccgacggccggccaggcggacgctgagaaggctaaatcaactaaaaaccaaaggaaaacaaagggagctaagggcaccttccattgcgacgtttgtatgttcaccagttcccgcatgtcctctttcaacaggcatatgaaaacacacaccagcgagaagccgcacctgtgtcacttatgtttaaaaaccttcagaactgtgacacttctacgaaatcacgttaacacacatacagggacccggccttacaagtgcaatgattgtaatatggcattcgtgacaagcggcgagctggttcggcacagacggtacaagcatactcacgagaagccttttaaatgcagcatgtgtaaatacgccagcgttgaagccagcaagctgaaacgccacgtccgaagtcatacaggtgaaagacctttccagtgctgtcagtgcagttatgccagccgggatacatataaactgaaacgccatatgcgcacccactcagaggctacttccaagcgtagcctgcaggaaattccccgctgcaagttccatcccgactgtctccagatgctccaagtgtggcagcgcctatttcctctggattag

SEQ ID NO: 111171 - DNA, 1722 bp, Artificial Sequence
  Description of Artificial Sequence: Synthetic coding sequence
atggcagctactgagatttctgttttatctgagcagtttacgaagatcaaggaactggaattgatgcctgagaaagggctaaaagaggaagaaaaagacggcgtgtgtagggagaaagaccatcgtagcccttccgagctcgaagcggagaggactagcggcgccttccaggattctgtgctggaggaggaggttgagctcgtactagctccatctgaagagtctgagaagtacatcctcactcttcagacagtccacttcacctcggaggccgtagagttgcaggatatgagcttgctgagcattcagcaacaggaaggggtgcaggtggtcgtgcagcagcctgggccaggcctgctctggttggaggaagggcccagacagtcactccagcagtgtgtcgccatcagtatccaacaagaactgtactcccctcaggagatggaagtcctgcaattccatgctctcgaggagaatgtgatggtcgcctccgaggactccaagctggccgtgtcattggccgaaacgaccggcctgatcaaactggaagaggagcaggagaaaaatcagctgctggccgagcggactaaggagcaactgttcttcgtcgagactatgtcgggcgatgagaggagcgatgaaatagtgctgacagtttccaacagcaatgttgaggagcaggaagatcagcctacagccggacaggccgatgccgagaaagctaaaagtactaaaaaccaacgaaagactaaaggagctaagggcaccttccactgtgatgtgtgtatgttcacctcatcaaggatgagcagcttcaacagacacatgaagacacacacttcggaaaaacctcacctgtgccacttgtgtctcaaaacatttaggacagttacactgcttcgaaaccatgtgaatactcacacaggtactcgtccgtataaatgtaacgattgtaatatggcatttgtgacatccggcgagctcgtccgacaccgccgctacaaacacacccacgagaagccttttaagtgtagtatgtgcaagtacgcttctgtcgaggctagcaaactgaagcgccatgtaagatctcacaccggggagcgacccttccagtgttgtcagtgctcttatgcttcccgcgacacatataagctgaaacggcatatgcggacccatagtggcgaaaagccctacgagtgtcatatctgccatacccggtttacacaatctgggacaatgaaaattcacatcttacagaagcatggcgagaacgtgcctaaataccagtgcccacactgcgcaactataatcgcccgcaagagtgatcttagagtgcacatgcgcaatctgcacgcctacagcgctgcagagctcaaatgccgctactgttccgctgtgttccacgagcgctacgccctgatccagcaccagaagacacacaagaatgaaaagcgctttaagtgtaaacactgcagctacgcatgcaagcaggaaaggcatatgacagcccatatcaggacacacacgggcgagaaaccattcacttgtctctcttgcaacaaatgctttcggcaaaaacaacttttgaatgcgcattttagaaaatatcacgacgcaaatttcattccaaccgtgtataagtgctcgaaatgcggaaagggattttcaaggtggatcacttctaaatggagcgggctgaagcctcagacttttatcacatag

SEQ ID NO: 111172 - DNA, 2103 bp, Artificial Sequence
  Description of Artificial Sequence: Synthetic coding sequence
atggccgctacggaaatctcagtgttgagcgaacaattcaccaagatcaaggaactcgaattaatgccagaaaagggactcaaagaagaagaaaaggatggcgtgtgtcgcgaaaaggaccatagatctccgtccgagctggaagcggagcgaactagcggcgcattccaggattcagtactggaagaagaagtggagctcgtcctcgccccaagcgaggaatcagagaagtacattctgacactccagacagtccacttcacaagtgaggccgtggagctccaggacatgagtctgttgagcattcagcagcaggaaggagttcaagttgtagtccagcaacccggcccagggttgctgtggcttgaggaagggccaaggcaatctctgcagcaatgcgttgcaataagcattcagcaggagctgtacagtccgcaggagatggaagtgctgcagtttcacgccctggaagaaaacgtcatggtggcatccgaggactctaaattggctgtatctctcgcggaaacaacgggtctgatcaagctggaagaggagcaggagaagaaccaacttctggctgagcgtacgaaagagcagctgttctttgtggaaaccatgtcaggtgatgagagaagtgatgaaatcgttctcaccgttagtaattctaacgtcgaggagcaagaggaccagccgacagcaggacaggcggacgctgagaaggcgaaatccacaaaaaatcagagaaagacgaagggcgctaagggcacattccattgtgatgtgtgcatgtttaccagtagcagaatgtcctctttcaaccgccacatgaagacccacacatcagaaaaaccacacctctgccatctgtgtctaaagacatttagaacggtgactcttttgcgaaatcacgtgaatactcacacgggaactcgtccatacaagtgtaacgattgcaatatggcttttgtgacttctggtgagctggtgcgccaccgccggtacaaacacactcacgagaagcccttcaaatgctctatgtgtaagtatgcctccgtggaggcctccaaactaaagagacacgtgcgctctcataccggagaaagacccttccagtgttgccaatgttcctatgcctctcgggacacctacaagctcaagaggcacatgcgaactcattctggggagaaaccgtacgagtgccatatctgccacacccgtttcacacagtccggaaccatgaaaattcatattttacagaagcatggagaaaacgttccaaagtatcagtgcccccattgcgcaactatcattgctcgaaaaagcgatctgcgtgtgcacatgcggaatcttcatgcatattctgcagccgaactgaagtgtaggtattgttctgctgtcttccatgaaaggtacgcccttattcagcatcaaaagacacacaaaaatgagaaacggtttaaatgtaagcattgcagctatgcctgcaaacaggaaagacacatgactgcccacatacgaacacatacgggggagaagccttttacgtgtttatcttgtaacaaatgtttcagacaaaaacagttgctaaacgcccatttcaggaagtaccatgatgctaacttcatacccacagtatacaaatgttctaaatgcggcaagggcttctcgagatggataaacctgcatcggcactcagaaaaatgcggtagtggtgaagcgaagagcgcagcctccggcaagggaagacggacacgtaagaggaagcagactatccttaaagaggctacgaaagggcagaaggaagccgccaagggctggaaggaagccgccaatggcgacgaagccgcagccgaagaagcttcaaccactaagggagagcagtttcccggagagatgtttccagtggcttgccgtgaaactacagctagagtgaaagaagaggttgacgagggagttacttgcgaaatgctccttaacactatggacaactctgctgggtgtaccggacggatgatgctggtctctgcgtggctcctgggcagaccacaggagacctataaccagggcaggagaagacggggcagcagaagggtgacctggtag

SEQ ID NO: 111173 - DNA, 1356 bp, Artificial Sequence
  Description of Artificial Sequence: Synthetic coding sequence
atggcagccaccgaaatctccgtgctcagcgagcagttcaccaaaatcaaggagttggaactcatgcctgagaaagggttaaaagaagaggaaaaggatggtgtgtgtcgcgaaaaggatcataggtctccatccgagctcgaggccgagcgtacgtctggcgcttttcaggacagcgtactagaagaggaggtggaactggtgcttgccccgtccgaagagagtgagaaatatattctgacactgcagaccgtgcatttcacgtctgaagccgttgagctgcaggacatgtctctgctgagtatacagcagcaagagggcgtgcaagtcgtggtgcagcagccagggcctggcctgctctggcttgaagagggcccccggcagtcgctgcagcagtgtgtggctattagcatacaacaggagttgtatagtccccaagaaatggaggtcctgcaattccacgctctggaagaaaatgtgatggttgctagcgaggatagtaagctggccgtctccctggccgaaaccacagggctgattaaactggaggaggagcaggaaaaaaatcagcttctggccgaacgcaccaaagagcaactcttctttgtggagactatgagcggggatgaacggtctgatgagattgttctgactgtcagtaactctaatgttgaggagcaagaggatcagcctactgcaggccaggctgacgcagaaaaggccaagtccaccaaaaaccagcggaaaactaagggcgccaaaggcacttttcattgcgacgtttgtatgttcacttcctcccggatgagctcctttaatcggcatatgaagacacatactagcgagaaaccacacctgtgccatttgtgtctgaaaacatttcgcactgtcaccctgcttcgcaaccatgtgaacactcacaccgggacacgcccatataaatgcaatgattgtaacatggctttcgtgacatccggcgaacttgttagacaccgccgttataagcacacacacgagaagcccttcaagtgcagcatgtgtaaatacgcctccgttgaggccagcaagctaaaaagacatgtgcggtctcatactggggaacgccccttccagtgctgccagtgctcatatgcctcccgggatacatacaagctcaagaggcatatgcgcacccactctggcgagaagccatacgagtgtcacatttgccacacccggtttacccagtcaggaaccatgaagatacacattttacaaaaacacggggaaaatgtgccgaagtaccagtgccctcactgcgccactattatagcacgaaaaagcgatctgcgattcttgggattgccatttccctag

SEQ ID NO: 111174 - DNA, 1842 bp, Artificial Sequence
  Description of Artificial Sequence: Synthetic coding sequence
atggctgccacagagatctcagtgttgtctgaacagtttaccaaaattaaagagctggagcttatgccagagaaaggtctgaaggaggaggaaaaagacggggtgtgtcgagaaaaggaccacaggtccccttccgagttggaggccgaacggactagcggcgccttccaagactcagtgcttgaggaagaggtggaactcgtgctggcacctagcgaagagtcggagaagtatatccttaccctccaaacagtgcattttacatccgaggctgtggaacttcaagacatgtctctcctcagcattcaacagcaggaaggcgtacaggtggttgtgcagcagcctgggccggggctcctgtggctggaggaggggcctagacagagcctgcagcagtgtgttgcaatatctatccagcaggagttatatagcccacaggagatggaggtactgcagtttcacgccctggaggaaaatgtgatggtggcatccgaggactctaaactggccgtaagtctcgctgagaccactggcctgatcaaattggaggaggaacaggaaaaaaaccagctcctggcagagaggactaaggaacaacttttttttgtagaaacaatgtccggcgatgagcgcagcgatgaaatcgtgcttacagttagcaattcaaatgtcgaagagcaggaggaccaacctaccgctggccaggctgacgccgagaaggcgaagtccaccaagaatcagagaaagactaagggcgccaagggcaccttccactgcgatgtgtgcatgttcacatcaagcaggatgagtagctttaatcggcatatgaagacacatacctctgaaaagcctcacctctgtcacctgtgtctaaagacgttcagaaccgtgacactgttacgcaaccacgttaatacacataccggtaccagaccctataagtgtaatgactgtaatatggccttcgttacgtctggagagctcgtacggcacaggagatataaacatactcacgagaagcccttcaaatgcagcatgtgcaagtatgcttctgtggaagcaagcaagctgaagaggcacgttcgctcccacacaggggaacgtccttttcagtgttgtcagtgcagttacgcctcccgcgacacttacaagctaaaacggcacatgcggacacacagtggagtccatatgaggaatctgcacgcctacagtgcagctgagttgaagtgcagatattgctccgccgtttttcacgaacggtatgcccttatccagcatcagaagacccacaaaaatgagaagcggttcaaatgtaagcactgcagctacgcctgcaaacaggagcggcacatgacagcccacatccgcacgcataccggcgagaaaccatttacctgtctcagctgtaacaaatgctttaggcaaaaacagcttttaaacgctcactttcgcaagtatcacgatgccaacttcatccccacagtgtacaagtgttcaaaatgcgggaaagggtttagccgatggataaacctgcacaggcatagcgaaaaatgtggatctggagaagcaaaaagtgcagccagcggtaaagggcgcagaacacggaaaagaaaacagacaattctcaaggaagccacaaaggggcagaaagaggccgccaagggatggaaagaggccgccaatggcgacgaggctgccgcggaagaggccagcacaacaaaaggcgagcagtttcccggagaaatgtttcccgtcgcgtgtcgcgagacgacggccagggttaaggaagaagtagatgagggcgttacctgtgagatgctgctgaacacaatggataaatag

SEQ ID NO: 111175 - DNA, 1452 bp, Artificial Sequence
  Description of Artificial Sequence: Synthetic coding sequence
atggccgctactgaaatctctgttcttagcgaacaatttaccaaaattaaggaacttgagcttatgccagagaagggactgaaagaggaagaaaaagatggcgtgtgtcgggaaaaggaccataggagtccttcagagttggaagcggaacgcacgtctggtgcatttcaagatagcgtcttagaagaagaggttgaactcgttctggccccctcggaggagtccgagaagtacattctgacactccagacagtgcatttcacaagcgaggccgtggagctgcaagatatgtccctcttgtccatccagcaacaggaaggggtccaagtagtggtacaacagcccggacctggactgctctggctagaggaggggcccaggcagtctctccagcagtgcgtggctatcagcatacaacaggaactgtattcccctcaggaaatggaagtcctacagttccacgccttagaagagaacgttatggtcgcatccgaggattcgaagttggccgtatccctggcagagaccactgggcttattaaattggaagaagagcaggagaagaatcagctgttagccgaaaggaccaaggaacagttgttcttcgtggagacgatgagtggggatgagaggtccgacgagatcgtcttgaccgtgtccaatagtaatgttgaggagcaggaagaccaacctacagccgggcaggccgacgcagaaaaggccaaatccaccaaaaatcagaggaagaccaagggtgcgaaggggacattccattgtgatgtttgcatgtttacatcctcccgtatgagttcctttaacagacatatgaagacacacacgtcggaaaaaccacatctatgccatctttgtttgaaaacgtttaggactgtaaccctgctgaggaatcatgtgaacactcacacggggacccgaccctataaatgcaacgactgtaacatggcttttgtcaccagtggcgagctcgtgagacaccggcgctataagcacactcatgagaagccttttaaatgttccatgtgcaaatacgcaagtgttgaagagagacacatgactgctcatattcggacacacaccggagagaaacccttcacatgtctctcatgtaataagtgcttcaggcaaaaacagcttctaaacgctcatttccggaagtaccacgatgccaatttcatccccactgtgtataaatgtagcaaatgcggcaaaggattcagtaggtggattctatgggttggaaattctgaagtggcagagctgggcggacctgggagtggtcccctgctcagactgcagtcagggtgtcccccagggctgcaccatcctaaggccggactcgggcctgaggatcctctacccggccagttgcggcatacaactgcaggcacaggcctcagtagcctgctgcagggcccactttgccgcgcagcctag

SEQ ID NO: 111176 - DNA, 1998 bp, Artificial Sequence
  Description of Artificial Sequence: Synthetic coding sequence
atggccgccacagagattagtgtgctgtcagagcagtttaccaaaataaaagaactcgagcttatgcccgaaaaaggacttaaagaggaagagaaggatggcgtgtgccgggagaaggatcatagaagcccttcagagctggaggcagagcggaccagtggggcatttcaggatagcgtgctcgaagaggaggtagagcttgtgcttgccccgagtgaagaatcggaaaagtacatcctgactctgcagacagtgcatttcacatccgaagctgtggagctccaggatatgtccctgctctctatccagcagcaggagggtgtgcaggtggtggtacaacagccgggccctggcctcctatggctggaggaggggcctcggcaatcacttcagcagtgtgtggcgatcagtatccagcaggagttgtattccccacaagaaatggaggtcttacagtttcatgccctcgaagagaatgtgatggtcgcttcagaagatagtaagctagccgtcagcctcgccgaaacaacaggccttattaagcttgaagaggaacaggagaagaatcagcttctggccgagcggaccaaggaacagctttttttcgtggagaccatgagtggagatgagaggtcagatgagattgtgctgacagtgtccaatagcaacgtagaggagcaggaagaccagcctaccgctggccaagcagatgccgaaaaggctaagtccacgaagaaccaacgcaagaccaagggtgccaagggaaccttccactgtgatgtttgcatgtttacttccagtcgaatgagctcattcaatcggcacatgaagactcatacttccgagaaaccgcacttgtgccatctgtgtttgaagacattcaggacagttaccttattgcggaatcacgtgaatacccacacaggcacacgcccttataaatgcaacgactgtaacatggcttttgtgacgtctggggagctggtgagacaccgcaggtataagcacacacacgagaaaccctttaaatgttccatgtgcaagtatgctagcgtcgaggcctccaagctaaagcgtcatgtgcggtcacacacgggggaacgaccctttcagtgctgccaatgttcatacgcgtcaagggacacctataagctgaagagacatatgcgtacccattctggcgaaaaaccctacgaatgccacatctgccatacccgctttacccagagcgggaccatgaaaatacacatcttgcagaaacatggcgagaatgtaccaaagtatcagtgcccacattgtgcaacgattatcgctcggaaatcggatttaagggtccacatgaggaacctgcacgcgtattcagctgcagaactgaagtgccgctactgttcagccgttttccacgagagatacgccctgatccaacatcagaaaacacataaaaatgaaaagcggttcaaatgtaagcattgcagttatgcctgtaagcaggaacgacatatgaccgcccatatcaggacccatactggggagaaaccgtttacgtgtctctcctgtaacaaatgtttccggcagaagcagttgctgaatgctcatttcaggaagtaccacgatgccaatttcattccaacagtctacaagtgctccaagtgtggaaagggtttctccaggtggatcaacctgcatagacattcagaaaaatgcggctctggtgaagccaaatccgctgcttccggcaagggaagacggaccagaaaaaggaaacaaacaatcctgaaggaagccacaaagggccagaaagaagccgccaaggggtggaaggaggccgccaacggtgatggggtgatcagtgctcatcgtaacctgtgcctcctggggagttctgactcccacgcatccgtgagtggggcaggtattacagatgctagacatcatgcatggctgatagtcctgcttttcctggttgagatgggcttttatcatgtttcacattcttag

SEQ ID NO: 111177 - DNA, 1212 bp, Artificial Sequence
  Description of Artificial Sequence: Synthetic coding sequence
atgtttaccagcagtcggatgtcttccttcaatcggcatatgaagactcacactagtgaaaagccccatctgtgccatctctgccttaagacgttccgtaccgttacactcttgagaaatcacgtgaacacccatactggcaccagaccatataagtgtaacgactgtaacatggcttttgtcacatccggcgagctagtccggcacaggcggtataagcacacccacgagaaaccttttaagtgctctatgtgcaaatatgcctcagtggaagcctcaaaactcaagcggcatgtgaggtcccatacaggggaaaggcctttccagtgctgccagtgtagttacgctagccgggatacatacaagctcaaaagacatatgcgcacccattctggtgaaaagccttatgagtgtcacatttgccatactagatttacgcagagcggcactatgaaaatccacatcctgcagaagcacggcgaaaacgtgcctaagtatcagtgtcctcattgcgccaccatcatcgctagaaaatccgacctccgcgtgcacatgcgtaacctgcatgcttatagcgctgcggaactgaagtgccgatattgcagtgccgttttccacgagaggtacgcgctgattcagcatcaaaaaacccataagaacgaaaaacgcttcaaatgcaagcattgtagctacgcgtgtaaacaggaacggcacatgaccgctcacatacggacgcacaccggagaaaagccttttacttgcctgtcctgcaataagtgtttccgtcaaaagcagttactgaatgcccattttaggaagtatcacgatgccaacttcataccaaccgtgtacaagtgttcaaagtgcgggaaggggttctcacgttggattaacctgcaccgtcacagcgagaaatgcggtagtggggaggcaaagtccgcagcctcaggcaagggcagacggactagaaagcgcaagcagactatcttgaaagaggctaccaaggggcagaaggaagccgccaaggggtggaaagaggctgccaatggggacggcgtaatttccgcccataggaatctgtgtttgcttggtagttccgatagtcacgcgtccgtgagcggcgccggcattacagacgctagacatcacgcctggctaatagtcttactcttcctggtcgaaatgggattttatcatgtgagccatagctag

SEQ ID NO: 111178 - DNA, 1269 bp, Artificial Sequence
  Description of Artificial Sequence: Synthetic coding sequence
atgtccggggacgagcgatcagacgagatagtcctcaccgtctctaattccaatgttgaggaacaggaagatcagccgaccgccggccaggcggacgctgagaaggcgaagagcacaaaaaaccaacgcaagacaaaaggtgccaagggcacgtttcactgcgatgtgtgcatgttcacctcttcacggatgtcatcttttaatcgccatatgaaaacccacacctcagagaaaccacatctgtgtcacttatgcctgaaaacatttcgaacggtcaccttactacggaaccatgtgaatactcataccgggacccgaccttacaagtgcaacgattgtaatatggccttcgtcactagtggagagctggtgaggcacagacgatacaagcacacgcatgagaaaccttttaagtgtagcatgtgtaaatacgctagtgttgaagccagtaagctgaagaggcacgtgaggtcccacaccggcgagcgaccatttcagtgttgccaatgctcttacgcatctcgggatacgtacaaattaaagcgacacatgcggacacattctggggaaaagccttatgaatgccacatctgtcacacccgtttcactcagtctggcactatgaaaattcacatcctgcaaaagcacggcgagaacgtgccaaagtaccaatgtccccactgcgcgaccattatcgcccgcaaatcagaccttcgcgtgcacatgagaaacctccacgcttactcagctgcagagctcaagtgtagatattgcagcgccgtcttccacgagcgctacgcgctcatccaacatcagaaaacccataaaaatgagaaaaggttcaagtgcaagcactgcagttatgcttgtaagcaggaaagacatatgactgcacatattcgcacacatacgggtgagaaaccttttacctgcctcagctgtaacaaatgtttccgtcagaagcaactcctgaatgcacattttcggaaatatcatgatgcaaactttatccccacagtgtataaatgtagcaagtgtggaaagggatttagtcgttggattctctgggtgggcaatagtgaggtcgccgagcttggagggcccgggtcaggccccttgcttcggcttcagtcaggctgtccgcctgggttacatcatcccaaagccggactaggtccagaggacccattgcccggacagttacgccacaccacagccggtacaggattgtctagcttgctacagggaccgctgtgccgggcagcttag

SEQ ID NO: 111179 - DNA, 1296 bp, Artificial Sequence
  Description of Artificial Sequence: Synthetic coding sequence
atgtttcattccccgcgaaggctgtgttctgccctcttgcagcgggacgctcctggactgaggcgcctgcccgcacccgggcttcgccgtcctctttcccctccagccgccgtgcctcgccccgcctcacctagactcctggctgcagccagcgctgcctctggcgctgccagatcatgttcaagaaccgtgtgctctatgggcactggcaccagccgcctgtacagcgcgctcgccaagactctgaacagcagcgctgcctcacaacatcccgagtacctcgtgtcccccgaccctgagcatttggagccaattgaccccaaggagcttctcgaagagtgtcgcgccgtgctgcacacccgccctcccaggttccaacgcgacttcgtggacctgcgcactgactgcccatcaactcacccccctatccgggtcatgcagtggaacatccttgctcaggccctcggcgagggaaaagacaactttgtccaatgccccgtagaggccctgaagtgggaggagcggaagtgcctgatactggaggagatcctggcctaccagcctgatatcctctgcttacaggaggtagaccattactttgatacattccaaccgctactcagtcgcctcgggtaccaagggacctttttccccaaaccatggagcccttgccttgatgttgaacataacaatggccccgatgggtgtgccttgttcttcctccagaataggttcaaactggtcaacagcgctaatatcaggctcaccgcaatgaccctgaagaccaatcaggtcgccattgcccaaacactggagtgtaaagaatcgggtagacaattttgcatcgcggtcacccatttgaaggccaggactggctgggagcggttccgttcggcccagggttgcgatctgctacagaatctccagaacattacacagggtgctaagattcccctgattgtatgtggcgactttaacgcggagccgaccgaggaagtgtacaagcattttgcctcctcgagtctgaacctgaactccgcatacaaactgctctctgccgacggccagagcgagcctccgtacactacttggaaaatccgaactagcggggagtgtcgccacactctggattacatatggtatagcaagcatgcattaaacgtgagatcggcccttgacttgttgacagaggaacaaatcggtcccaatcgactgccatcctttaattatccgtccgaccacctctcgcttgtatgtgacttttccttcacagaggagagtgatggactatcctag

SEQ ID NO: 111180 - DNA, 2133 bp, Artificial Sequence
  Description of Artificial Sequence: Synthetic coding sequence
atgtctaggtcccctgacgcgaaagaagatccagtggagtgtcctctttgcatggagccactcgagatagatgatataaattttttcccgtgtacttgtgggtaccagatttgcagattctgttggcaccgcatccggacagacgagaacggtctatgccctgcctgtcgtaaaccctatcctgaggatcctgccgtttataaaccgctgagtcaggaagaactccagcgcattaagaacgagaagaaacagaagcagaacgagaggaagcaaaagatcagcgagaataggaaacaccttgcaagcgtgagggtagtgcaaaaaaacttagtatttgtggttggactatcccaacgtttagccgatcccgaagtcttaaagaggccagaatatttcgggaagtttggcaagatccataaggtcgtgattaacaacagcacgtcctacgcaggctcccaggggccaagcgccagcgcatacgtgacctacattcgctcggaggatgcactgagagccatccagtgtgtcaataatgtcgtggtggatgggagaacgctcaaagcctccctgggcactacaaagtactgctcctacttcttaaaaaacatgcagtgtccaaagccagattgtatgtacttgcacgagctgggcgacgaagctgcatcatttaccaaggaggagatgcaagccgggaaacaccaggagtacgaacagaagttgcttcaggaactttacaagctgaatcccaatttcctgcagttgtccaccggtagcgtagataagaataaaaataaggtaaccccactacagagcccgatcgataagccctccgacagcctttcgatagggaatggcgacaactcccaacagatctcaaatagtgatactccttcaccacctcctggcctgtctaaatctaatcctgttattcccatctctagctccaaccacagtgctaggagtccctttgagggcgccgtcaccgagtcgcagtctctgttttcagacaattttcgacacccaaatcccatcccaagtgggttacctcccttcccaagctcaccgcagacgagcagcgattggccaaccgcccctgagccacagtccctgtttactagtgaaactatacccgtcagctctagtacagactggcaggccgcgttcggcttcggcagcagcaagcaaccagaggatgatctaggcttcgatccatttgacgttacaaggaaggcactggccgatctgatcgaaaaggaattgagcgtacaggatcagccctccctgtcacccactagtctccagaattctagcagccacaccacaaccgcgaaaggccccggcagtggatttcttcatcctgccgcagccactaatgcaaattccctgaacagcacattctcagtcctgccacagaggttcccccaatttcagcagcatagagcagtgtataactcgttttctttcccaggccaggctgcacgatacccgtggatggcgtttcctaggaattccatcatgcacctaaaccatactgcaaatccgacgtccaacagtaatttcttggacctcaacctgccaccgcagcacaatactggattagggggaatccctgtggcagataatagcagcagtgtggaatcgcttaatatgaaagagtggcaggatggccttagggccctactgcccaatatcaacatcaatttcggcgggctgcccaattcttcctccccttctaatgcaaaccatagcgctccgacctcaaacaccgccaccacagacagtctgagctgggactcacccgggagttggacagatcccgctatcatcacagggattcctgcctcgtcggggaactccctagacagcctgcaagatgataacccgccccattggcttaaatctttgcaggccctgactgagatggacggcccttcggccgccccaagccagacccatcactcagcccctttttctacccaaatccctctccaccgggcgtcctggaacccgtatccgcccccttctaacccgtcatcattccattcaccgccacccggcttccaaactgccttccgacctccaagtaaaactcccacagatctgctgcaatccagcacactagacagacactag

SEQ ID NO: 111181 - DNA, 3684 bp, Artificial Sequence
  Description of Artificial Sequence: Synthetic coding sequence
atgacgcagaaagtggaggagttaaaggaaacagtgaaagaggagtttatgccgtgggtatcccaatatctcgttatgaagcgagtatcaattgagccaaacttccactccctgtattccaacttcctcgatactctaaagaatccagagttcaacaaaatggtactcaatgagacctataggaatatcaaagatctcgatgtgaaatctctcttattggaagcctacgttaagggtcaacaggaactgctatatgtcgtgcctttcgtcgccaaggttttagaatcatccatacggtccgtggtgtttcggccccccaatccttggaccatggccataatgaacgtcctagccgagttacatcaggagcatgatttgaaactgaatctgaagtttgagattgaggtgctctgcaagaacttggctctggatatcaacgagctgaagcccggaaacctgctcaaggataaggacagactgaagaacctggatgagcagctgtcagcgccaaaaaaggatgtgaaacagcccgaggaactcccaccaattaccacaacaactaccagcaccacaccagcaacgaataccacttgcactgcgacagtgccaccacagccacagtatagctatcacgatatcaatgtgtacagcttggctggattggccccacacataactctcaatcccacaattcctctgtttcaggcccacccccagcttaagcagtgtgttcgccaagctattgaaagagccgtccaagagctggtgcatcccgtggtagatcgttctattaaaattgccatgacgacctgtgagcagatcgtgagaaaggatttcgccttagacagcgaggagtctaggatgaggatcgctgcccatcatatgatgcgaaacctcacggcaggcatggcaatgattacttgccgagagccattgctcatgtccatctctaccaatcttaagaattcctttgcttccgctctccggacagcctccccccagcagcgcgagatgatggaccaggccgctgcacagctggctcaggataactgtgagctggcatgctgtttcatccagaaaacagccgttgagaaggccggtcccgagatggacaagagactggcgacggaattcgagctgcggaagcatgctcgccaggagggtcgaaggtattgcgatcccgtggttctaacatatcaggccgagaggatgccagagcaaattagactgaaggtaggaggggtagacccaaagcaactcgctgtttatgaggagtttgccagaaatgtgcccgggttcctgccaaccaacgatttgagccagcccacagggtttctcgcccagccaatgaagcaggcatgggcaactgacgacgtggcgcagatctatgacaagtgcatcaccgagctggaacagcatctgcatgctataccgcctactctggcaatgaatcctcaggcacaggcattgcgttctcttctggaagtggtggttctgtctagaaactccagagatgccatagccgccctggggctgctgcagaaagccgtggagggcctgcttgatgcgacttccggggcagatgccgacttgcttcttaggtaccgtgagtgccatctgctggttctgaaggctctccaggacgggagggcatacgggtcaccatggtgcaacaagcagattacacgttgtcttattgagtgtagagacgagtataagtataatgtggaggccgttgagctgctgattcggaatcacctggtgaatatgcagcagtacgatctgcatttggcccagagcatggagaacggcctgaattacatggcggtcgccttcgcaatgcagctggtcaaaatcctgttggttgatgaacggtccgttgcccacgtgacagaagccgatcttttccacacgatcgaaaccctgatgaggataaatgcccattcccgcggaaatgcccccgagggcctgccacaactgatggaagtagtgagatcaaattacgaagctatgatcgatcgcgcacacggaggtcctaacttcatgatgcatagcggaatcagtcaggcaagtgagtatgacgatccaccagggctgagggagaaggccgaatacctgctcagagaatgggtcaatctgtaccactcggccgcggctggccgagactcgacgaaagcattttccgcatttgtaggacagatgcatcagcaggggattctgaagaccgatgacctgatcacgagattcttccgactgtgcactgagatgtgcgtggagatctcctatcgagcccaggcagaacagcagcacaaccccgctgccaacccaaccatgattcgggcaaaatgctaccacaacctggacgccttcgtcagactaatcgctttactcgttaagcattctggtgaggctaccaatacagtgacaaagattaatctgctgaacaaggtcctaggcattgttgtgggcgtgctgttgcaggaccacgacgtcagacagagcgagtttcagcaattgccataccacaggatttttatcatgctgctgctcgagctgaacgcccctgagcacgtgctggagactattaactttcaaaccctaaccgcattttgcaatacgttccatatcctgcggcctactaaagctcccggatttgtctatgcatggctggagctcatctcccatagaatctttatcgcgcgtatgctggcacacaccccccagcagaaaggctggcccatgtacgcacaactgttgattgatctttttaagtacttagcacctttcctcaggaacgtggagctgacaaaaccaatgcagattctgtataaggggactctgcgggtgcttctggtgctcctccatgattttccagagttcttgtgtgactaccactacggcttctgtgatgtaatcccccctaattgtatccagctgagaaatctcattttgtccgctttccctcggaacatgagacttccggatcctttcacaccgaatctaaaggtggatatgctgagtgagatcaacatcgccccgaggattctcaccaattttacaggcgttatgccaccccagtttaagaaggacctggattcttacctcaaaacccgctcacccgtgacctttcttagtgatctgagatccaatctccaggtgtccaatgaacccgggaataggtataatctgcagcttatcaacgctctggtgctctatgtgggcacacaggcaatcgctcacatccataacaaaggctccacaccgtcaatgagcaccattacacattccgcacacatggacattttccagaacctggcagtggatctcgataccgaaggccgctatctttttttaaatgccatcgccaatcagctcaggtatcccaattctcacacccactacttctcttgcaccatgctgtatctattcgctgaagcgaacactgaagccatccaagaacaaattaccagagtcttgttggagaggctcatcgtcaatcggccccacccctggggtctgttaataacttttattgaactcataaagaaccctgccttcaagttctggaaccatgaatttgtccattgcgcgcctgaaatcgagaaactattccagtcagtagcccaatgctgtatggggcagaagcaggctcaacaagtgatggagggcacaggagccagttag

SEQ ID NO: 111182 - DNA, 7131 bp, Artificial Sequence
  Description of Artificial Sequence: Synthetic coding sequence
atgaacttggatagtctaagtctggcccttagtcagatatcttatctagtggacaacctgaccaaaaagaattatcgcgcctcccagcaggagatccagcatatagtaaacaggcacggtcctgaggcagaccgccacctactgaggtgcctgttcagccatgtcgacttcagcggagatggtaagtccagcggaaaggactttcatcagacccagtttcttatccaggagtgcgccctccttattaccaagccaaatttcatctccacactctcatatgcaatcgataaccctctgcattatcaaaagtcactgaagcccgctcctcacctattcgctcagctgagcaaggtacttaagctgagtaaggttcaggaagtgattttcggcctcgcactgcttaattccagtagcagcgatttgagggggtttgctgcccagtttataaagcaaaaacttcccgacttgttgcgcagctatatcgacgctgatgtctcgggaaatcaggagggcggattccaggacatcgcgatcgaggtgttacatctcctgctaagccacttgctgtttgggcagaagggggcgttcggagtgggacaagagcagatcgacgcctttctcaagacccttagaagagattttcctcaggagaggtgcccagtggtgctggctcctttactctacccagagaaaagagacatactcatggacaggattctgccagattccggtggggttgcgaagactatgatggagagctcacttgccgatttcatgcaagaggtgggatatggcttctgcgcctctattgaagaatgcagaaatatcattgtgcagttcggagtgagagaggtcactgcagcgcaggtcgcacgagtgctcggcatgatggcacggacacattcaggactcacagatggaatccccctgcagtccataagtgctccaggctcaggcatttggtcagacgggaaggataagtctgatggcgctcaggcccatacatggaacgtcgaggtgctcatcgacgtgttaaaagaactgaacccaagcctcaatttcaaagaagtgacttatgagctcgaccatcccggctttcaaataagggatagtaaaggtttgcacaatgtcgtgtatggaattcagcgtgggctagggatggaagtcttcccagtggacctgatctaccgaccctggaagcacgcagagggccaactgtctttcatccagcactcacttatcaatccagagattttctgtttcgccgactacccttgccacaccgtggcaacagatattctaaaggctcctcctgaggacgacaatcgtgaaattgctacttggaagtcattggatttaattgaatcactcctgcgtctagccgaggtgggccaatatgagcaggtcaaacagcttttttcattccctatcaaacattgccccgatatgttagtcctggccttattgcaaatcaatactagttggcataccctacggcacgaactcattagcacactaatgcccatttttctcgggaatcacccaaatagcgcgatcattctccattatgcttggcacggccagggtcagtcaccatctatccggcagctgataatgcacgccatggctgagtggtatatgcgtggtgagcagtacgaccaggctaaactgtctcggatacttgatgtagctcaagacctgaaggctctgagcatgctcctgaatgggactcctttcgcgttcgttatcgatctcgccgcactcgcctctagaagagagtacttaaagcttgacaagtggctaaccgataagatcagagaacacggcgaaccattcattcaggcctgtatgacctttttaaagcggagatgtccaagcattttaggcggcctggcacccgaaaaggatcagcccaagtccgcacagctgcctccggagaccctcgcaacaatgttagcctgtttacaggcctgcgcagggagcgtgtcacaggagctatccgagacaattctgactatggttgctaactgtagcaatgtcatgaacaaggctcggcagccaccgccaggtgtgatgccgaagggaagaccccctagtgcctcctccctggacgctatctctccagtccagattgatcctttggctggtatgacttccctatcgatcggcgggtctgcagctcctcatactcagtccatgcaaggctttcctccaaacctgggctccgccttttctactccgcagagtccggccaaggctttcccgcctttatcaaccccgaatcagaccaccgccttctctggaattggtgggctctcaagccagctacccgtcggaggcctgggaactggatccctcacgggcatcggcactggggctctcgggttgcctgctgttaataatgacccctttgttcagagaaaactcggcacctcagggctaaaccagccgacgttccagcagagcaaaatgaaaccgagcgatctctcccaggtgtggcctgaggccaaccaacattttagcaaggaaatcgacgacgaggccaattcatacttccaaaggatttacaaccaccctccccaccccaccatgtccgtcgatgaagtgttagaaatgctccagcgattcaaagacagcaccatcaaaagggaaagggaggtctttaattgcatgctcagaaacttgttcgaagaatacagatttttccctcagtacccggataaagagctgcacatcaccgcctgtctattcgggggaatcattgaaaagggtttagtgacttacatggccctgggcctggcccttaggtatgttctcgaggctctccgtaagccattcggcagtaaaatgtactactttggtatcgcagcccttgatcgcttcaaaaacaggctcaaggattacccacagtactgccagcacctcgccagtatctcacatttcatgcagtttcctcaccatttgcaggagtatattgaatatgggcagcagagtcgagatcccccagtcaagatgcagggaagtattacgacccctgggtcaatcgcactggcacaggcccaagcacaagctcaagtgccggcaaaggcgcctctggcaggccaagtaagcaccatggtgaccacaagcaccacaaccacagttgctaagactgtcacagtgactcggcctaccggcgtctcatttaaaaaagacgtcccaccctccattaatacgaccaacatcgataccctgctcgtggctacagaccaaactgagcggatcgtcgaaccacctgaaaacattcaggaaaaaatagcatttattttcaacaatctcagccagtctaatatgactcaaaaagtcgaggagcttaaagagactgttaaggaagagtttatgccttgggtgtctcagtacttggttatgaaaagggtatctatcgagcccaactttcactcactgtactcaaacttcttggatacactcaaaaatccagagttcaacaaaatggtgttaaatgagacttataggaacatcaaggtgttgttgacctccgataaggctgccgctaacttctccgaccgtagcctccttaagaacctcggacactggctgggaatgattactctcgctaaaaataaaccaattctgcatactgacttggacgtaaagagcctgttgttggaggcctacgttaaagggcaacaagaactgttatatgtggtgcctttcgtggccaaggtactggaatctagtattcggtctgtagtgttccggcctcctaatccttggaccatggcgataatgaacgtattagctgagttacatcaggagcatgacctgaaacttaacttgaagttcgaaatcgaggttctgtgcaaaaatctggctttggacataaatgaactcaaaccgggcaaccttctgaaggacaaggacaggctgaaaaacctggacgagcaactctccgccccaaaaaaggacgtgaagcaaccggaagaactccccccaattacaaccaccacaaccagcacgactccagccactaatacaacctgcaccgcgaccgtgccgccacagcctcagtatagttatcacgacatcaacgtgtactctctagccggcctggctccgcacataacattaaacccaactatccccttgtttcaggctcacccacaactgaaacaatgcgttcgccaagcaatcgaaagggcggtccaggaactggtccaccccgtagtagaccggagtataaaaatcgccatgactacgtgcgaacaaattgtccgcaaagatttcgcactcgacagcgaggagtccagaatgcgcattgcagcccaccacatgatgcgtaatctgacagccggcatggccatgatcacatgccgggaacctttactaatgagcatctccacgaatttaaagaatagctttgcttctgccttaaggacagcgagcccacaacaacgtgaaatgatggatcaggccgcggctcagctggcccaagacaattgcgaattggcctgctgcttcatccagaaaacggcagtggaaaaggctgggcctgagatggataagcgcctggcaaccgagttcgaactaagaaaacacgctcggcaagagggaagacggtactgcgacccggtggtactgacgtatcaggcagagcgtatgcctgaacagatcagactgaaggtggggggtgtggatccaaaacagctggctgtgtatgaggaatttgccaggaatgttccaggatttctacccacgaatgatctgtctcagcctactgggttcctggctcagcccatgaaacaagcttgggccaccgatgatgtcgcacaaatctatgataagtgcatcactgagcttgagcagcacctgcacgccataccccccactctcgccatgaatccccaagctcaggctctgcgttcgcttctcgaagttgtagtgctgtcccggaactccagagacgcaatcgctgcgctgggattgttgcagaaagctgtcgagggactgcttgacgcaaccagcggggccgatgctgacctcctgctccgatacagagagtgccacctactggtgttaaaggccttgcaggatggacgagcttacggctccccttggtgtaataagcagattaccagatgtctcatagagtgccgggatgaatacaagtataatgtggaggctgtggaactcttaatccgcaatcacttggtcaacatgcagcaatatgacttgcatctggcacagtctatggagaatgggcttaattatatggccgtggccttcgcaatgcagctcgttaagatcctactggtagatgagagatcagttgcacatgtgaccgaagcagacctcttccacacaatcgagactctgatgcgaataaatgctcattcacggggaaatgctcccgaaggactcccgcaattgatggaggttgtgagatctaactacgaagctatgatagatcgtgcccacggtgggcctaattttatgatgcatagcgggataagccaggcctccgaatatgacgaccctcctggactgcgcgagaaagcagagtacctgctgagggaatgggtaaatttataccattctgcggctgcaggacgggatagcaccaaggctttctcagcctttgttggccaaatgcaccagcagggcatcctgaaaaccgatgacttgatcaccagattcttcagactgtgcactgagatgtgcgtggaaatatcctaccgagcgcaagctgagcaacaacacaatcctgccgcgaatcctacaatgattcgtgcaaagtgttaccacaacctcgatgccttcgtccgattaatcgcactgctggtgaagcactccggcgaggccactaacaccgtcacaaaaattaaccttctgaacaaggtgttgggaattgtggtgggagtcctgctccaggaccacgatgtcaggcagtctgaatttcagcagttgccttatcacaggatttttatcatgttactgttggagttaaacgctcccgaacatgtgctggaaacgatcaacttccagacgttgaccgccttttgcaacactttccatattctcagacctacaaaagcgcccggctttgtttacgcatggctcgagctgataagtcaccgcatttttatagcgcgaatgctggcacatacccctcagcagaagggttggccaatgtatgctcagttgctgattgatttgttcaaatacttagctccttttctgaggaacgtcgagctgacaaagcccatgcaaatcctctacaaagggacgttgagagttctacttgtgttgctccacgacttcccggagttcctgtgcgactaccactatggcttttgcgatgtcatacctccaaactgtatccagctccgaaacctaattttgagcgcatttcctcgaaatatgcgcctgcccgacccatttactcccaacttaaaggttgacatgctctccgagataaatatcgcaccacgcatcttaactaacttcaccggcgtcatgcccccacagtttaaaaaagacctggatagttacttaaaaactcggagccccgtgacgttcttatctgaccttaggagcaatctacaggtttcaaatgaaccggggaatcgctataatctccagctaataaatgcccttgtgctttatgtgggcactcaagcaattgcacacatccataataaaggatcgacaccctctatgtccacaattactcattctgctcacatggatattttccagaatctggcggttgaccttgacacagaaggccgctatttgttcctgaacgccattgcgaaccagttaagatacccaaattcacacactcactacttcagttgcacaatgctgtatctatttgctgaggccaatacagaggcaatccaggaacaaatcactcgcgtgctgttagagcgcctcattgtcaacaggccccatccgtggggtctgctgataacctttatcgaactgatcaagaatccagcttttaagttctggaaccacgaattcgtccactgcgccccagaaattgagaagctgtttcagagcgtggcgcagtgttgtatgggccagaagcaggcccagcaggtgatggaaggtaccggtgctagctag

SEQ ID NO: 111183 - DNA, 6453 bp, Artificial Sequence
  Description of Artificial Sequence: Synthetic coding sequence
atgaacctcgatagcctttccttggccttatcacagatcagctacctggttgataacctcaccaagaaaaactatagagcctcacagcaggaaatccagcacattgtcaatcgacacggccctgaagctgacaggcacctgttaaggtgcctatttagccacgttgatttcagcggtgacgggaagtcctccgggaaggactttcaccaaactcagttcctgatccaggaatgcgctctgctcatcacgaagcctaacttcatctccactctgtcttatgccatagataacccactgcattatcaaaaatctctgaaaccagcccctcatctttttgcacagttgtctaaggtgctgaaactgagtaaggtgcaggaagtcatctttggactcgcgttgctgaacagctcctctagtgatcttcgaggctttgctgcacagttcattaaacagaagctgcctgatttgctccgctcctatatcgacgcagacgtctccggtaaccaagaagggggattccaggatatcgccatagaggtcctccatctgctcttgagccacctactgtttggccagaaaggagctttcggggtgggccaagagcagattgatgcgttcctgaaaacccttcgccgcgacttccctcaggaacgctgtcctgtagtgcttgcgccactgttgtatcctgaaaaacgggatattctgatggaccgcatcctgccagatagcggtggggtcgctaagacaatgatggagagctctcttgccgactttatgcaggaggtcggctacggtttctgtgcctcgattgaggagtgccggaatatcatagttcagttcggggtcagagaagtgacagctgcgcaggtagcccgagtactgggcatgatggcacgcacccactcgggccttaccgatggaataccattgcagagtataagtgcacccggctcaggtatttggtcagacgggaaggataaatccgacggtgcccaggcccatacctggaatgtggaggtgcttatagatgtcctgaaagaattgaacccgtcactcaacttcaaggaggtgacatacgagctcgaccacccaggtttccaaatcagagacagtaaggggttacataacgtggtatatgggattcagaggggcctgggtatggaggtatttcccgtggatctaatctatagaccttggaaacacgctgaaggccagttgtccttcatacaacattcactgatcaatccagagattttttgctttgccgattatccatgtcacaccgtcgccacagacattctcaaagccccccccgaagatgacaacagggagatcgctacctggaaatcactggatctcatcgaaagtcttctgcgactggctgaggtaggccagtatgaacaggtgaagcagctgttttcattcccaataaagcattgcccggatatgttagtgcttgcacttctgcagatcaatacctcctggcacaccttacgccacgaactgatcagcacactcatgccaatctttcttggaaatcaccccaatagcgctataatcttacactatgcatggcacggacagggccagtcaccaagcatccgacaactcatcatgcatgccatggcagaatggtacatgcggggcgagcagtatgaccaggcgaagctgagccggatcctcgatgtggcccaagaccttaaagcactatccatgcttctgaacggcactccttttgccttcgttattgatttagctgcacttgcatcaaggcgggagtacctgaagctggataaatggcttaccgacaagatccgtgagcacggtgagcccttcattcaggcttgcatgaccttcctgaaaaggagatgtccaagcatcctaggaggattggcgccagagaaggaccagcccaagagcgctcaactacctccagaaacactcgccacaatgctcgcctgtctgcaggcatgcgccgggagcgttagccaggagctctccgagacaatcctaacaatggtcgccaactgttctaatgttatgaacaaagcccgtcagccccctccgggcgtgatgcctaagggacgacctccatcagcttcctcactagatgctatatcaccagtacagatcgatccactagctggcatgactagcctgtctattggggggagcgcggcccctcacacacagtctatgcagggttttcctcccaatctgggaagtgcctttagtaccccgcagtctccagccaaggccttccccccactgagcactcccaatcaaaccactgctttctcaggcatagggggattatccagtcaattgcccgtagggggtctcggtactggcagtctgaccggcataggaaccggagctttaggactgccggcagttaataacgatccttttgtgcagagaaagttggggacaagtggtctgaaccagccaacattccaacagaccgacctttcacaggtgtggccagaagctaatcagcatttctccaaggaaatcgatgatgaggcaaattcctacttccagcgtatctataaccacccgccgcaccctacgatgtcagtcgacgaagttctcgagatgttgcagcggttcaaggacagcactatcaaaagagaaagagaggtgttcaactgtatgttacggaacctgttcgaggagtatagattttttccgcagtacccggataaggagctgcatatcacagcctgcctgtttggaggaattattgaaaaaggattggtgacctatatggcgctggggctagcattgcgctatgtcctggaggcgctccggaaacccttcggtagcaagatgtactattttggcattgccgccctggaccgctttaaaaaccgcctgaaggactacccacagtactgccagcacttggccagtatatcccacttcatgcagttcccacaccatctacaggaatacatagaatacggccagcagtcaagggatccccccgttaaaatgcaggggtctatcactacccccggcagtattgctctcgcccaggcccaggcacaggcccaggtgccggccaaagcgcctctcgctggccaagtgtctactatggtgaccacctcaacaacgaccactgtcgctaaaacagtgaccgtcacccgccccacaggcgtatcctttaaaaaagatgttccacccagcatcaacaccaccaatattgatacactgctggtggctacggaccagaccgaacgaattgtcgagccaccagagaatattcaggagaagattgccttcattttcaataatttgagccagagtaatatgacacagaaggtagaggaactcaaggagaccgtgaaggaggagttcatgccctgggtgagtcagtacctagttatgaaacgtgtgtctattgagcctaatttccattcactgtattctaattttcttgacactcttaagaaccccgagtttaacaaaatggtgctgaatgagacatataggaacattaaggtattactcacgtccgataaggcagctgcgaatttttcggaccgaagccttcttaagaacctgggccactggctgggaatgataactctggcaaaaaataaaccaatcttgcacactgacctcgatgttaagagtctgttactcgaagcttatgtcaagggacaacaagaattactgtatgtggttccgttcgtcgcaaaggtcttagaaagttctataaggagtgtcgtctttagaccgcccaacccttggactatggcgatcatgaacgtccttgccgagctccatcaggagcacgacctgaagttaaacctaaagttcgagatcgaagtcctatgtaaaaacctggccctggacatcaacgagcttaaaccaggcaatttgttaaaagacaaagaccgactcaaaaatctggatgaacagctatccgctccaaagaaggacgttaagcagccagaggagctaccccccatcacaacgacgaccacatcaacaacgccagctacgaatacgacgtgtaccgccactgtcccccctcagccccaatattcttatcacgacatcaacgtttattccctggctggccttgctcctcatatcaccctgaacccaacaatccccttgttccaggcccacccgcagctcaaacagtgcgtgagacaagccattgagagagccgttcaggagctggtacatccagtcgtggatcgttctatcaaaatcgccatgaccacttgcgagcagatagtgcgtaaggacttcgctttggactctgaagaatctcgcatgcggattgccgctcaccatatgatgcgtaatcttaccgctggcatggctatgataacctgccgggagcctctgctgatgagcatctcaacaaacctgaaaaacagctttgcctccgcgttgcgcaccgcatccccccagcagcgcgaaatgatggaccaagccgccgcacagctcgctcaggacaactgtgagctcgcctgttgctttatccagaaaacggctgtcgagaaggccggccctgagatggacaagaggctcgctactgagttcgaattgagaaaacatgccagacaggaaggtaggaggtattgtgatccagtcgtacttacctatcaggcggagcgaatgcctgaacagattcggcttaaggtaggtggagtggatcctaagcagctcgctgtgtacgaggagtttgctcggaacgtaccaggttttcttcctacgaacgatctctcccaacccacaggatttcttgctcagcccatgaagcaagcctgggccaccgatgacgtggcacagatctacgacaagtgcatcaccgagttggagcaacatctgcatgcgattcctcctaccctggcgatgaatccacaagcgcaagctttacgatccctcttggaagtggtggtcctgtcacgcaacagccgcgatgcaatagcggcccttggcctgttgcaaaaggcagtcgaaggcctgcttgatgcaaccagcggtgccgacgctgacttgctactgcggtatagagagtgccatcttctggtgctaaaagcattacaggacggccgggcctatgggtccccctggtgcaacaagcaaatcacaagatgtctcattgagtgtagagacgaatacaaatataacgtggaagccgtggaactactgatcaggaaccacctcgttaatatgcagcagtacgatctgcacttggcgcagagtatggagaacggcctgaattacatggccgtggcattcgcaatgcagctagttaaaatcctgttagtggatgaaaggtctgtcgcacatgtgaccgaggcagatctgttccatacaatagaaactctcatgaggatcaacgctcattcaagagggaacgcccccgaagggttgcctcagctcatggaggtggtcagaagtaactatgaggccatgatcgaccgagcccatgggggtccaaacttcatgatgcatagcggcataagtcaggctagcgagtatgacgatccacctggattgcgcgagaaagcggagtacctccttcgcgagtgggtcaacctgtaccactctgccgcagcaggtcgcgacagtactaaagcgttctccgcatttgtgggacagatgcaccagcagggtatcctgaagacagacgacctcattacccggtttttcaggctctgcacggagatgtgtgtggaaattagttatcgcgcccaggccgagcaacaacacaatcccgcagcgaaccccaccatgattagagcaaagtgctaccataaccttgatgcttttgtcagactcattgctctgctagtgaaacattcaggcgaagctaccaatactgtgaccaaaattaacctactgaacaaagtgttaggcatcgtcgtgggcgttctgctgcaggatcacgatgtacgccaatccgaattccagcagttaccatatcaccgaatattcatcatgctcctcttggagttgaacgcacctgagcatgtgcttgagacaatcaacttccagactttgacggctttctgtaacacatttcacatccttcggcctaccaaagcgccggggttcgtctacgcatggctggagctgattagccacaggatcttcatcgcaagaatgcttgcacacacaccgcagcaaaaagggtggccgatgtacgcccagctgctgattgatttgtttaagtacttggctccatttcttagaaacgtggagttaactaaacccatgcagatcttgtacaaaggtacattacgggtcttgttagtcctgctccatgatttcccagagtttctttgcgattatcattatggcttttgcgacgtgattcccccgaactgtatacagttaaggaatctcatactgtcagctttcccaagaaacatgcgcctgcccgaccccttcactccaaatctgaaggaaatcatgttgtag

SEQ ID NO: 111184 - DNA, 3213 bp, Artificial Sequence
  Description of Artificial Sequence: Synthetic coding sequence
atgctcctgaatgggactcctttcgcttttgtgattgaccttgcagccctcgctagtcggagagaatatctaaagctggataagtggttgaccgacaaaattcgggaacatggcgagccatttatccaggcgtgtatgacgttcttaaaacgtcgctgcccgtcgatcctgggtggcctcgcacccgagaaagatcagcccaaatctgctcagctgccacccgagacactggccacaatgctggcttgcctgcaggcatgtgcaggatccgtgtctcaagagctgtctgaaaccattttgaccatggtagcaaattgcagtaatgtgatgaataaagctcgacaaccaccccccggcgtcatgccaaaaggtcgacctcctagtgcatcaagcctggacgcaatttccccagtgcaaattgacccactcgcagggatgacttccctttcaattggcggctcagccgctccccacacccagagcatgcagggcttcccccctaatctggggtctgcgttcagcactccacagtcccctgccaaggcgttcccacctttaagcacaccaaaccaaacaaccgctttctcaggaataggtgggctctctagccagctgcccgtgggggggctgggcactggatctctgacgggcatcgggactggggcattggggttacccgcagtcaacaacgacccttttgtacagaggaagctgggaaccagtggcttaaaccagcctactttccagcaatctaagatgaagcccagcgatcttagccaggtttggccagaggcgaaccaacacttctcgaaagagatcgacgacgaggcaaacagttacttccagcgcatttacaatcaccccccccaccccacaatgtctgtggacgaagtactggagatgctgcagcgcttcaaagattccactattaaacgcgagcgagaggtttttaattgtatgctgagaaacctgttcgaagagtatcgcttctttccccagtacccagataaggagctacatattaccgcatgcctcttcggggggattattgagaaggggctcgttacatatatggccctgggactcgccctgcggtacgtgttggaggcattaagaaaacccttcgggtcaaaaatgtattacttcggcattgccgccctggatcggttcaagaacaggctgaaagattatccccaatactgccaacacctcgcctccatttcccacttcatgcagtttcctcatcacctgcaggagtacatcgagtatggacaacagtcacgggacccgccggtcaagatgcaaggatctatcactacaccaggctctattgccctggcacaggcccaagcacaggcacaggtgccagctaaggccccgcttgcaggtcaggtctctactatggttacaacgtcgaccactacaacagtggcaaaaaccgtgacagtgacacggccaacaggagtctccttcaagaaagacgtcccgccctctataaacaccactaatattgacacccttctggtggcgacagaccagaccgaaagaatagtggaacctccagagaacatccaggaaaagatcgcattcattttcaataacctgtctcagtccaatatgactcagaaggtcgaagaactaaaagaaacagttaaggaagagtttatgccttgggtttctcaatacctggttatgaagagggtcagtatcgagcctaacttccactctctgtattctaatttcctcgatacgctaaaaaaccttattacacgtttctttaggctatgcacagagatgtgtgtagagatttcctatagggctcaagcagaacaacagcataatcccgcagcaaatccgaccatgattagagctaagtgctaccacaacctggatgccttcgtgagactgattgctctgctggtcaagcatagcggcgaagcgaccaacaccgttacaaagattaacttactgaacaaggtattgggtatcgtcgtcggggtgctcttgcaggatcacgacgtgcggcagtcagaatttcaacaactcccataccaccgaattttcatcatgttattgctcgagctgaacgcgccagagcacgtcctggaaacaatcaattttcaaacactgactgcattttgcaataccttccatattctccggcccaccaaagccccaggatttgtctacgcatggctggagctcatatcgcatagaatctttatagcaaggatgttggcacataccccccaacagaaaggttggcccatgtacgcgcagttactgattgatttgtttaagtatttagccccattcctgagaaatgtcgaactgaccaaaccaatgcagattctatacaaaggcaccctgcgggttctgctggtgctgctccacgactttccggagtttctgtgtgactatcactacggtttttgtgacgtcatcccaccaaactgcattcagctgcggaacctgatacttagtgcgttccctcgcaacatgaggcttccagaccccttcaccccaaacttgaaagttgatatgctgtcagaaatcaatatagccccccgcatcctcacaaatttcaccggagtcatgccgcctcagtttaaaaaagatctggacagttacctcaagacccggagcccggtgaccttccttagcgatttacgtagcaatctccaggtctcaaacgagcctggtaatcgttacaatcttcagctgattaatgcccttgttctctatgtcggcacacaggccatagcccacattcataacaagggctcgaccccatctatgtccaccattacccattctgcccacatggacatcttccaaaatttggccgtcgatctggataccgaggggagatacttgttccttaacgccatcgcaaatcagctccggtaccccaattcccacactcattacttcagctgcactatgctctatttatttgccgaagcaaacacagaggccattcaagaacagattacacgcgtccttctggaacggctgatcgttaacagacctcatccctggggcctgctcataacatttattgaactgattaagaatcccgcctttaagttctggaaccacgaattcgttcattgcgcccctgagatcgaaaaactctttcagtcggtagcccaatgttgtatgggacagaagcaagcccaacaagtgatggaagggactggagcctcttag

SEQ ID NO: 111185 - DNA, 4656 bp, Artificial Sequence
  Description of Artificial Sequence: Synthetic coding sequence
atgaatctcgatagcctctctctcgcactatcccagatcagctatctcgtcgacaacctgactaagaaaaattaccgcgcttcccagcaggagattcagcacatcgttaaccgacacggccccgaagctgatcgccatctactgcggtgtctgttctcacatgtggacttctccggggatgggaagagctctggtaaagatttccatcagactcaattcctgatacaggagtgcgctctgttgatcaccaagcctaattttatcagcacactctcatacgcaattgacaatcctttgcattatcagaagtcacttaaaccggctccacatctgtttgcgcagctcagcaaggtccttaaactgtccaaagtgcaagaggtgatttttggactagccctcctcaatagtagttcatctgacctacggggttttgctgcccaattcattaaacaaaaacttcccgatttattaaggtcctacatcgacgctgatgtctcaggtaaccaggaaggaggctttcaagatatcgccatcgaagtgctccatttactcttgagccacttgctgttcggtcagaagggagccttcggagtgggacaggagcaaatcgacgcctttctgaaaacgctgcgccgggacttcccccaggagcgctgtcccgtggtgctcgcccccctgctgtaccccgaaaaaagagacatcctgatggatcgtatcttgccagattcgggcggggtagccaaaaccatgatggaatcatcacttgctgatttcatgcaggaggtggggtacggtttttgtgctagtatagaggaatgtaggaatattatcgtacagtttggcgttagagaggtaaccgcagcgcaagtggcccgagtgctgggcatgatggcccgcacccattctgggctgactgatggcattcccctgcagtccatatccgctccgggttccggcatttggagcgatggcaaggacaaatctgatggagcgcaggcccatacctggaacgtggaagtgttgattgacgtgttgaaagagttgaacccaagtcttaattttaaagaggtcacatatgaattagatcatccaggttttcagatccgggatagtaaggggcttcataatgttgtgtacggcatacagcgcggtttaggaatggaagtttttcctgtggatttaatatacagaccatggaaacatgctgagggccaactaagctttattcagcattcgctgatcaatcccgaaatattctgtttcgccgactacccttgccacacagtagcaacagatatcctcaaagccccccctgaggacgacaaccgggagatcgctacctggaagtccctcgaccttattgagtctctgctcaggctcgccgaagtagggcagtatgagcaagtcaagcaactgttctcatttcccatcaagcattgtcctgacatgctggtcttggcattgctgcagatcaatacttcctggcacactctgcggcatgaactcatttccacattaatgcctatctttttgggcaaccaccctaattcagccattatcctccactatgcatggcacgggcaaggtcagagtccctccattaggcagctcatcatgcacgccatggccgagtggtatatgcggggtgaacagtacgaccaagcaaagcttagccgcatactcgatgtcgctcaggatctgaaggctttgagcatgctgctaaacggaacgccttttgccttcgtcatcgatcttgcggccttggccagcaggcgggagtatctgaaattggacaagtggctgacagacaagatacgggagcacggggagcccttcatccaggcgtgcatgacctttctcaagcgacggtgtccgtcaatccttggcggcctcgccccagaaaaggaccagcctaaaagtgctcaactgccgcctgaaaccctggctacaatgctggcgtgcctgcaagcctgcgcagggagtgtgtctcaggagctctccgagacaatcctcactatggttgccaactgctctaacgttatgaacaaggcccgacagccaccccctggggtgatgcccaaagggcgacctcccagtgcctcttccctggatgctatttctcccgtccagatagatccccttgctggaatgacttctctgagcattggagggagtgccgcccctcatactcagtctatgcaaggttttcctccaaatttgggatcagcgtttagtaccccacagtcaccagctaaggcctttcctccattatccacccctaatcagactacagcatttagcggcattggaggattgtcttcccagttgcctgtcggcgggttggggacagggagtctgacagggatcggcactggggctctgggtctgcccgctgtgaacaacgatccgttcgtccagcgcaaacttggtacctccgggctcaaccaaccaacatttcaacagtccaagatgaagccttccgacctttctcaggtctggccggaggccaaccagcacttttctaaggagattgatgatgaggccaatagctatttccagcggatttacaaccatccaccgcatcccaccatgtctgtagacgaggttcttgagatgctacagcgcttcaaggatagcaccatcaaacgcgaacgagaggtctttaattgtatgctgaggaatctgttcgaggaatataggtttttcccacagtatccggacaaggagctgcatattaccgcgtgcttattcggcggaatcattgagaaagggctcgtgacctacatggccttgggtttggctcttcggtatgttctagaggccctgagaaagccatttggcagtaaaatgtattacttcgggatcgcagctctggaccggttcaaaaacagattgaaggactacccacagtattgtcagcatttggcatcaatttcccattttatgcagtttccgcatcatctgcaggagtacatcgaatacggccaacaatccagggatcctcccgttaaaatgcaaggcagcattaccacccccgggtccattgccttggcgcaggcccaggctcaagctcaagtgcctgccaaagctcccctggctggtcaggtctcaaccatggtcaccacctctacaacaactactgtcgcaaagaccgtgaccgtgacaaggcccacaggggtgagttttaaaaaggacgtgcccccgtcaatcaatacaaccaacattgacactcttctcgttgcaactgaccagactgaaaggatcgttgagccccccgaaaatatccaggagaaaattgcatttatatttaataatctctcacagagtaacatgacccagaaggtagaggagcttaaggagacagtgaaggaagagttcatgccatgggtctcccagtaccttgtgatgaaaagagttagcatcgagcccaattttcatagcctctattcaaactttctcgatacactgaaaaatcctgaattcaacaaaatggtactgaacgaaacatacaggaatatcaaggttctgctgacaagtgataaggccgcagctaactttagcgatagatctctgcttaagaatttgggtcattggctcggcatgataactctcgctaaaaacaagccaattcttcacacagatctggatgtcaaaagcttactgctggaggcttacgtgaaaggccagcaagaactgctgtacgttgtgccgtttgtcgcgaaagtcctggagagcagtatcaggtccgtagtgttccgcccccctaatccctggacaatggccataatgaatgtgctggccgagctgcatcaagaacacgaccttaaactgaacctgaagtttgagatcgaggttctctgtaagaatctggcactcgacatcaatgaattgaaacctggcaatttgctcaaagacaaggacagactgaagaatttggatgagcagctctctgcccctaagaaggacgtgaaacagcccgaggagttgcctccaattacgaccacgactacttcaactactccagccaccaacacaacttgcaccgcaacggttccaccccagcctcaatattcataccacgatattaacgtatattccctcgccggattagctccccatattacgcttaatccgactatcccgctctttcaggcccatccccagttgaagcagtgtgtgaggcaggccattgagagagctgtgcaggaattggtccatcccgttgtagatcggagcatcaagattgccatgacaacctgcgagcaaatcgtaaggaaggactttgctctggattctgaagagtcgcggatgaggatcgcagctcaccatatgatgaggaatctaactgccggcatggcgatgatcacatgcagggagccacttctgatgtctatatctactaacctgaaaaattcctttgcctccgctcttagggtcagttggctcttcccatggtaccgctacaaaacttattactgtctctcagtgattatcttcttcttcgtatacatctggcattgggcccttccattgatcctcaataatcaccacatctgcctgatgtctagcataatcctcgactgcaattcagtccgccagtcaattatgagcgtctgcttcttcttcttcttgctctattcacagcacgatgtctag

SEQ ID NO: 111186 - DNA, 951 bp, Artificial Sequence
  Description of Artificial Sequence: Synthetic coding sequence
atgctgctgttggagttgaacgcaccagaacacgtcctggagacgataaactttcagactttgacagccttttgtaacacattccatattctgagacccacaaaggcacctggattcgtgtacgcctggctggagctgatcagccaccggatctttattgcaagaatgttagcacatacaccgcagcaaaagggctggccaatgtacgctcagctgctcatcgatctgttcaagtacttggccccctttctgaggaacgtggagctcaccaagcctatgcagatcctctacaagggtacactccgagtgctgttggtgctgctgcacgactttcccgagttcctgtgcgattaccactacggtttctgtgacgtcatcccacctaattgtatacagctgcgcaatctcatccttagcgcattccctaggaacatgcggcttcccgatccctttacccccaatctgaaggttgacatgctgtcagagattaatatcgccccccggattctgaccaacttcactggcgtgatgccacctcaatttaaaaaggaccttgatagttacctgaagacgcggtcaccagtgacatttcttagtgacttgcgctccaacctgcaggtttccaatgagcccggcaataggtacaatttgcagttgatcaatgctctcgttctctacgtcgggacccaggccattgcacacatccacaacaaggggtcaacacccagtatgagtacgatcacacattccgcccacatggacatatttcagaatctggctgtagacctagataccgaaggaaggtacctgttcctgaatgccattgccaatcaatcaggcacacagatcgccacactgactacatcagtggcaccctgttgtacattcttgcaacgccctatccgcaaaccttcaaagaatcgctcacaggagttcagctggaatggatag

SEQ ID NO: 111187 - DNA, 2778 bp, Artificial Sequence
  Description of Artificial Sequence: Synthetic coding sequence
atggatcgtagcggctttggagaaatctcctctccggtgataagggaagccgaggtgacgcgcaccgctaggaagcagtccgctcagaaaagagtgttactccaggcctcccaggatgagaatttcggaaatacgacccccaggaatcaggttatcccgagaacaccgtcctcttttcggcaacctttcacccccaccagtaggagcctgctgaggcagcccgacatcagctgcatccttggcaccgggggaaagtctcccaggctgacccagtcatcaggcttctttgggaatttaagcatggttacaaatctggacgactccaattgggcggccgcattcagttctcagcggagcggacttttcacgaacacagagccacatagtatcacagaagatgtgaccatttcggctgttatgctgcgagaggacgaccccggggaggccgctagcatgtccatgttttctgattttctgcagagtttcctcaaacactccagttcaaccgtgttcgatctagtggaagagtatgagaacatctgtggttctcaagtaaacatcctctccaagatcgtgtcaagagccacacccggcttgcagaaattttcaaaaaccgcgtccatgctgtggctgctgcagcaagaaatggtcacttggagattgttagcctctctgtatcgggatagaatccagtcggccttggaggaggagtcagtgttcgccgtcacagctgttaacgctagtgaaaagaccgtggtggaagcgttgtttcaacgtgattcactggtgcggcagagccagctggtggtggactggctcgagagtatcgcgaaagacgaaattggagaattctccgataatatagagttttatgccaaatcagtgtattgggaaaatactctgcacacccttaaacagcgccagctgacctcgtacgtgggttccgttcggcctctggttactgaactcgatcctgatgctcctattagacagaagatgcccctggacgacttagaccgagaggatgaagtgaggctgctgaagtatctctttactcttataagagcaggaatgaccgaagaagcacagaggctgtgtaagcgatgtggacaggcctggcgagcagccacgcttgaaggttggaaactctatcatgacccgaacgtgaacggaggcacagagctcgaaccagtcgagggaaatccatataggcgtatatggaaaataagctgctggcgcatggcggaggacgaactgttcaacaggtacgagcgtgccatctatgctgcactgtccggtaacctcaaacagctgctcccggtgtgtgacacttgggaagacaccgtctgggcctatttccgagtgatggtggacagcctggtggaacaagagatccagacaagcgtggctactctcgatgaaaccgaagagttgcctagggaatatctcggcgccaactggactcttgagaaggtgttcgaagaactgcaggcaaccgataagaaacgtgtgttagaagagaaccaagagcactatcacattgtccaaaaattcctaatcctgggcgacatcgacgggctcatggacgaattttcaaagtggctttcgaagagccggaataaccttccagggcacttgctgaggtttatgacccacctcatcttgttttttcgaactttggggctgcaaactaaggaggaagttagtatcgaggttctcaaaacttacattcagctactgatacgagaaaaacacacgaacctgatagccttctacacatgtcacctgccccaggacctggcagtggcccagtatgccctgttcctggagagcgtcacagaatttgagcaacgtcatcactgccttgagctcgctaaggaagctgatctagacgtcgccaccattactaagacagtggttgaaaacatacgtaagaaggataatggcgagttttctcaccatgacctggcccctgctcttgataccggaactactgaagaggaccggctcaaaatagatgtgatcgactggcttgtctttgaccccgctcagcgcgctgaggcactgaaacagggcaatgcgatcatgagaaagtttctggcttctaaaaagcatgaagctgcaaaagaagttttcgtaaaaattccacaggattccattgccgaaatatacaatcaatgtgaggagcaggggatggaatcacctcttcccgctgaggatgataatgcaatccgagagcatctttgtatccgtgcttatctggaggctcacgaaactttcaatgagtggtttaagcacatgaattcggtgccacaaaaaccggcccttatcccccagcccaccttcacggaaaaggttgctcacgaacacaaagaaaagaagtatgaaatggacttcggaatctggaaaggtcacctagacgcccttaccgccgacgtcaaggagaagatgtacaacgtgctgttattcgttgatggcggatggatggtcgatgtccgcgaggatgcaaaggaggatcacgagcggactcatcaaatggttctgctcagaaaactgtgccttcccatgctttgcttcctactgcacaccatccttcacagcaccggccagtatcaggagtgtctgcagcttgctgatatggtgtccagcgaaaggcataagctctatcttgtattttcaaaagaagaattgcgcaaattgttgcaaaaactaagggagagctcactgatgctcctggatcagggcctggatcctctgggatatgaaatccaactgtag

SEQ ID NO: 111188 - DNA, 1623 bp, Artificial Sequence
  Description of Artificial Sequence: Synthetic coding sequence
atggtccggaccgacggccatactctgtccgaaaaaagaaactaccaagtaactaattctatgtttggcgcctcacgtaagaaattcgtagaaggggtggactccgattatcacgatgagaatatgtattacagccaaagcagtatgttcccccacagaagtgaaaaggacatgctggcttctcctagcactagcggtcaactgagccaattcggagcgtctctgtacgggcagcaaagtgccctgggactgcccatgcgtggcatgtctaataacacaccacaactcaacagatctctgagccaaggcacacagcttccatcccacgtgacacctaccaccggagttcctaccatgtccttgcatactccaccatcccccagtcggggtatcctacctatgaaccctagaaacatgatgaaccactcccaggtaggtcagggaataggaatcccatccaggactaacagtatgtcctcatcaggactgggcagccctaataggtcatccccgtctattatttgtatgcctaagcaacagccctctcgccagcccttcaccgttaactccatgtctggctttggcatgaaccgaaatcaggcctttggtatgaacaactcactcagctctaatatcttcaatggaactgatggatctgagaacgtcactggacttgacctcagtgatttcccggccctggcggaccggaatcgccgagagggatctggaaaccctactcctctcattaaccctttagccgggagggccccttacgtgggcatggtgaccaaacccgcaaacgagcaatctcaggacttctctatccataatgaagactttccggcccttcctggctcaagttacaaagaccccacctcaagcaacgatgattctaaatccaacctcaacaccagcggaaagaccacctcatcgaccgatggaccaaaatttccgggagacaagtcatccactactcaaaataacaatcagcaaaaaaagggcattcaggtgttgccagatggccgggtgactaatataccccaaggtatggtgaccgaccagttcggcatgattggactactcaccttcattcgggcagccgagactgaccccggtatggttcacttagccctgggatctgatctgacaacattgggcctcaacctgaattctccggaaaacctctatccaaagtttgcaagtccctgggcctcctcaccctgtcgcccacaggatattgacttccatgtcccatccgaatacctgaccaatatccacatccgcgacaaactcgccgctatcaaactggggaggtatggggaggacctgctcttttacctatactatatgaatggtggtgatgtgctccaactgcttgccgccgtagagctctttaatcgggactggcgttatcacaaggaagagcgggtgtggatcaccagagctcctgggatggagccaacgatgaagaccaatacctacgagcgggggacctattatttcttcgactgcttgaactggcgtaaggtggctaaggaatttcacctggaatacgataaactggaggagagaccccaccttccctccacgtttaattacaatccagcacagcaggctttttag

SEQ ID NO: 111189 - DNA, 78 bp, Artificial Sequence
  Description of Artificial Sequence: Synthetic coding sequence
atggtaagaaccgatggacatactctctcagagaagcgcaattaccaggtgacaaactcaatgtttggggcgtcgtag

SEQ ID NO: 111190 - DNA, 552 bp, Artificial Sequence
  Description of Artificial Sequence: Synthetic coding sequence
atggtcagaaccgacgggcataccttaagtgagaagagaaactatcaggtgactaatagcatgtttggagcctccaggaaaaagtttgtggagggcgtggattctgactaccacgacgaaaatatgtattactcacagtccagcatgttccctcaccgatcagaaaaggacatgctggcctccccatctaccagcggccagctgtcccagttcggggcctcactctatgggcagcagtccgccctgggacttcccatgcggggtatgtctaataacactcctcagcttaacaggtctctgagtcaggggacacaactgcccagccacgtgacccctactacaggggttccaactatgagcctgcacacaccgccttcacctagcagggggatccttccaatgaaccctcgcaatatgatgaaccatagccaggttggccagggtattggtatccccagccggaccaattctatgagttcatccggactaggtagccctaatcgatcctccccatctatcatttgtatgcctaagcagcagccaagtcgctag

SEQ ID NO: 111191 - DNA, 1623 bp, Artificial Sequence
  Description of Artificial Sequence: Synthetic coding sequence
atggtgcgcaccgacgggcacaccctcagcgagaagcgaaactatcaggtgacaaacagtatgtttggcgcatcccgaaaaaaattcgtggaaggtgtggacagcgactaccacgacgagaacatgtattacagccaatcatccatgtttccccacagaagcgaaaaggatatgctagccagcccctccacaagtgggcaactctctcaatttggagccagtctctacggacaacagtcggcattggggctgccaatgcgtggcatgtccaacaacacccctcagctcaaccggtcactcagtcagggcacgcagcttccaagtcatgttacccctaccactggggtccctactatgtctctccacaccccaccgtcaccttcaaggggaattctgcccatgaacccgaggaacatgatgaaccattcacaagtgggccaaggaatcgggattcctagcagaacaaactctatgagcagcagcgggctaggaagccctaaccggtcaagcccctcgatcatatgcatgccgaagcagcagcctagtcgccagccatttacagtaaactccatgtctggttttgggatgaacagaaatcaggcgtttggaatgaacaactctttgtcgtctaacatattcaacgggacggacggaagcgaaaatgtcacagggctcgacctgtcagactttcctgctttggcggatagaaaccgtagagaggggtctggcaatccaacccccctgattaaccctctcgcaggtagagctccgtatgttggtatggttaccaaacctgctaacgaacagagtcaggactttagcatacataacgaggattttcctgccctgccgggctcatcttataaagatcctacctcatcaaatgatgactccaagtctaatctaaataccagcggtaaaaccacatccagtaccgacggccctaagttccctggcgacaaatccagcacaactcaaaataataatcagcaaaaaaaggggatacaagtgttgccagacggtagggtcacgaacatcccacagggtatggtgacagaccaattcggcatgatcgggcttctcacatttattagggctgctgagacagatcccggaatggtccacctagcgctcggttctgacctgactacactgggcttgaacctgaattcccctgaaaacctatatccaaagttcgcgagtccttgggcctcctccccctgtcgaccacaggacattgatttccatgttccttctgaatatttgaccaatatacatattagagacaaactagccgccattaagctgggaaggtatggggaggatttgctcttctacctctattacatgaacggtggagacgtgctgcagctgctggctgccgtggagctgttcaatcgcgactggcgctaccacaaggaagaacgagtctggattactcgagcgccaggaatggagccaacgatgaagacaaatacatacgagaggggcacgtactacttctttgactgtctgaactggaggaaggtggccaaagagttccaccttgagtacgataagctcgaagagaggccccacctgccctccaccttcaattacaatcccgctcagcaggctttttag

SEQ ID NO: 111192 - DNA, 576 bp, Artificial Sequence
  Description of Artificial Sequence: Synthetic coding sequence
atggtgaccgatcagtttggtatgatcggacttcttacattcattagggcagctgaaactgaccccggaatggtccatctggctctgggatccgatctaactactttgggactgaatctgaacagccccgaaaacctttacccaaaattcgcctcaccgtgggccagctccccttgtagaccacaagatattgatttccacgtcccaagcgaatatttgactaacatccatatccgtgataaactcgcagctataaaattagggcgatatggtgaggatctcctgttctatttatactatatgaacgggggcgatgtgctgcagctccttgccgccgttgagcttttcaaccgggattggcgctaccataaggaggagcgggtgtggataacaagggcgcctggaatggagccgacgatgaaaaccaacacgtatgagagaggaacatactacttctttgattgtctcaactggagaaaggtcgccaaggaattccacctagaatatgataaattagaggaacggccgcatttgccgtccaccttcaactacaatcccgcacaacaggctttttag

SEQ ID NO: 111193 - DNA, 966 bp, Artificial Sequence
  Description of Artificial Sequence: Synthetic coding sequence
atggtccgcacggacgggcataccctgtctgagaaaaggaattaccaggtgacaaactctatgtttggcgctagcaggaagaagtttgttgaaggtgttgactcggattaccacgacgaaaacatgtattattctcagagctccatgtttccccaccgatccgagaaggacatgctggcgagcccatccacttcaggacaactctctcagttcggggcatctctctatggtcagcagagtgccctgggtcttcctatgcgtggcatgtcgaataatacaccccagcttaaccggtccttgagccagggcacgcagctaccgtcccacgttacgcctactacaggggtgcctacaatgtccctccatacaccaccctccccatccagaggcatactcccgatgaaccctcgaaatatgatgaaccattctcaagtgggccaaggcattggcatcccaagtagaactaatagcatgtcgtcaagcggcctcggtagccctaaccgcagtagcccgtcaataatttgtatgcctaaacagcagccgagccgtcaacctttcacggtgaatagtatgtctgggtttgggatgaacagaaatcaagcttttggcatgaacaattctctctcctcaaacatttttaatggcactgatggttcagagaatgtcacagggctggacctgtctgatttcccggccttggcagaccggaacagacgagaaggctcaggcaatccgacacccctgatcaatcccctggctgggagagctccatacgtgggaatggtgactaagcccgctaacgagcagtcccaggatttcagtattcataacgaggactttcccgccctgccaggaagctcatacaaagatcctacttcgagcaacgatgattccaagagcaacctgaatacctcgggtaagacgacctcctcaaccgatggccctaagttcccaggagataaatag

SEQ ID NO: 111194 - DNA, 978 bp, Artificial Sequence
  Description of Artificial Sequence: Synthetic coding sequence
atgtccaccgcccgagaacagcctattttctctacaagggcacatgtgtttcagattgaccccgcaactaaacgcaattggattccggccgggaaacatgccctcaccgtgagttacttctatgatgctaccaggaatgtctacagaatcatcagtatcggcggtgcaaaagctatcattaatagtactgtcacgcctaacatgaccttcactaagaccagtcagaagttcggccagtgggccgattcccgagcgaacacagtttatggattgggatttgcctctgaacagcatctgacacaggtccccccctcacctctggtgtcagcaaacggacccggggaggaaaaactgtttaggtcccagagcgctgatgctcccggacccacagaaagagagcggttaaaaaagatgctaagtgagggcagtgtcggcgaggtacagtgggaggccgaatttttcgctcttcaagactccaataacaaactggctggagctctacgtgaagcaaatgccgctgcggcgcagtggcgccagcagctggaagcccagagggcagaagccgagagactccgccagcgagtggcagagctggaagcacaggccgcatctgaagtgacccctactggcgagaaggaagggctgggtcaagggcagtcactggagcagctggaagctctggttcagacgaaggatcaggagattcaaactttgaaatcccagacaggcggcccccgggaggcccttgaagcagcggaacgagaggaaacgcagcagaaggttcaagatctggaaacaaggaatgctgagctggagcatcagctgcgggccatggagagaagcttggaggaagctcgggcagagagagagagggcacgggctgaggttggccgagcggcacaacttctggatgtatctctgttcgagctgtctgagctgcgagaaggactggctaggctcgccgaagccgccccttag

SEQ ID NO: 111195 - DNA, 1716 bp, Artificial Sequence
  Description of Artificial Sequence: Synthetic coding sequence
atgctcgaaactattctccggatgctcgacaacgattctatcctggtggacgctattcggaagattaaggacgatgtggaatactacgtggacagctcccaggatcccgactttgaagagaacgagttcctgtacgacgatttggatctcgaagatattccccaggccttagtcgcaaccagccccccttctcacagccatatggaagatgaaatctttaatcaatccagctcaactcccactagtaccacctcgtctagcccgatacccccctccccagctaactgcaccactgaaaacagtgaagacgataaaaaacggggcaggtcgacagatagcgaagtgtctcagagccctgctaagaacgggagcaagccagttcattctaatcagcacccacaaagtcccgcagttccacccacatatccctctggccccccacctgctgcctccgccctctcaacaacccctggaaacaatggcgttccagcaccggcggcccctccatctgcactaggtccaaaggcttcccccgcccccagccacaacagcggcacgcccgcaccttacgcacaggccgtggccccacccgccccatccgggccttctactactcaaccccgcccccccagtgtgcagccgtcgggcggaggaggcggcggttctggcggaggcggaagtagttcaagtagcaattcttcagccggcggaggggcaggcaaacagaatggagcaacatcttatagtagcgttgtcgctgatagccccgctgaggtcgctctgtcatcctcaggaggtaacaacgcctcctcccaggccttgggtccaccttccggcccacacaacccgccaccctccacgagtaaggagccttcagccgctgcacctactggcgccggaggcgtggctcccggaagcggtaacaatagcggtggaccctccctcctcgttcccctccctgtgaaccctcccagtagtcctactccatcgttctctgatgccaaggcagccggtgccctgttgaacgggccgccccaattctctacagctccggaaatcaaagccccagagccactcagttccttgaagagcatggctgaaagagcagctatctcctccggcattgaggatccagtccctacactacacttgaccgagcgtgatattatattgtcttccacatctgccccccccgccagtgcacagccgccactgcagctctccgaggtgaatatccccctttccttaggcgtatgtccactaggacccgtgccgttgactaaggagcagttataccagcaggccatggaggaagccgcatggcatcatatgccacacccttccgatagtgaacgcatccggcaatatttgccccgcaacccatgtccgacccccccataccaccatcagatgccgcccccacatagcgatacagtggagttctaccaaagactgagtactgagactctcttctttattttctattatttagagccacgcgacgttaggacggcctgggttgattccgaggccgggcctttgcgccatacctccgcgccgcttcccgtggctcactggttaactaggggccctagccctgcactgcttcagcagcctcaatcccgacctacaccactgtgtagctccgctcactcacaggcatccctggaaaccactggagaactgtcttctcccctgccaacgcctctactgtag

SEQ ID NO: 111196 - DNA, 2262 bp, Artificial Sequence
  Description of Artificial Sequence: Synthetic coding sequence
atggccgacaaacgtaagttgcagggagagattgaccgctgtctgaagaaagtgagtgaaggagtggaacagtttgaggacatctggcaaaagctacataacgcagctaacgcaaaccagaaggaaaagtacgaggccgatctgaagaaagaaatcaaaaaattacagcgcttgcgtgaccagataaagacctgggtagcttctaatgagatcaaggataagagacaattgatagataatcgtaagctgatcgagacccagatggagcgattcaaagtggtggaacgggaaacaaagacaaaggcctatagcaaggagggactggggctggctcaaaaggtggaccccgctcagaaggaaaaagaggaagtgggacagtggcttacaaacaccattgataccctgaatatgcaggtcgaccaatttgaaagcgaggtcgaatcactatcggtgcaaactaggaagaagaaaggcgataaagacaaacaggaccgcatcgaggggttgaaaaggcacatcgaaaaacatcgatatcacgtcaggatgctggaaacaatcctgcggatgctcgacaatgacagcatcctggtggacgctatcaggaaaatcaaggatgacgtcgagtattacgtggattctagccaggatccagatttcgaagagaacgaattcctctacgatgacctcgacctggaggacattccccaggcgctggttgccacctcgccacctagccacagccatatggaagacgaaatttttaaccagagtagttctacacctaccagcacaacctctagtagccctattcccccatcccccgcaaattgtacaaccgagaactcagaggatgataagaagagagggcgcagtaccgatagtgaggtgagccaatcacccgcgaagaatggatccaaacctgtccacagcaaccagcacccccaatctccagccgtccctcccacgtatccctcagggcctccgcccgcagcctccgcccttagtacaacacctggaaataacggagtgcccgctcccgccgcacctccttccgctttaggcccaaaagcatcccccgcgcctagccacaatagcggaacaccggctccttatgcccaagccgtggcccctccagcccccagcggaccttccactacacaacctcggcccccaagcgtgcagccatcgggagggggaggagggggctctggaggcggcgggtccagcagttccagcaatagctccgccggcggcggggccgggaaacaaaacggagctactagctatagcagcgttgtggccgattcacccgccgaagtagctctcagttcatcaggggggaacaacgcgagttcgcaggctctgggtccaccgtctgggccccataaccctcctccgagcacctcaaaggagcccagcgccgctgccccaaccggggcaggcggcgtagccccgggttccggtaacaactccggcgggccctccctgctggtacctctgcccgtgaatcctccctccagcccaacaccctccttcagtgatgccaaagcagccggggcactgctcaatggccccccccagttcagtacagctcctgaaattaaggccccagaacctttgtctagtttaaagtcaatggctgagcgtgcggctatctcgtccgggatcgaggacccagtgccaactctgcatctcactgaaagagacatcatcctaagcagcacttccgctccaccagctagtgctcagccaccccttcagctgagtgaagtgaacattcccctcagtttgggtgtttgtccactgggtcccgtgcctctgaccaaggaacagctctaccagcaggccatggaagaagccgcttggcaccatatgccgcatccttcagacagcgagcgcatccgtcagtatctccctcgcaacccatgtcccacacctccttatcatcaccagatgcccccaccccacagcgacacagtcgagttttaccagcgtctgtctaccgagacactattcttcattttttactatctggagggcacgaaggcacagtaccttgcagcaaaagcgctcaagaagcaatcttggcgcttccacacaaagtatatgatgtggtttcagaggcacgaggaacccaaaaccataacagacgagttcgaacaggggacatacatctattttgattacgagaagtggggacaaagaaagaaagagggtttcaccttcgaatatcgatacctggaagatagagatctgcagtag

SEQ ID NO: 111197 - DNA, 867 bp, Artificial Sequence
  Description of Artificial Sequence: Synthetic coding sequence
tgaaaagaaccctcagctgctgccccaacaggagctgggggcgtcgcccctggctccgggaacaatagcggaggccctagcctgctggtcccgctccccgtgaatccaccgtcttcgccaaccccaagcttcagtgacgctaaagctgcaggcgcccttctgaatggtcctccgcagttctccaccgcccccgagatcaaggcacccgaaccactgagtagcctgaaatctatggccgagcgggccgctatctcctcaggtattgaggatcccgtgccgacccttcatctgaccgaaagagatattattctttcaagcacgagcgcgccgccggcaagtgcccagcctccactgcagctgagcgaagtaaacatccctttgagcttaggagtctgtcccctcggacccgtacccctcactaaggaacagctttaccagcaggctatggaagaggcagcctggcatcacatgccgcatccgagtgattccgagaggattcggcagtatctgcctagaaacccttgtcccactccaccataccaccaccagatgccccccccacactccgacaccgtggaattctatcagaggctgtcgacggagaccctatttttcatcttttactaccttgagggcaccaaagctcagtacctcgcagctaaggcactgaaaaaacaatcttggagatttcataccaagtacatgatgtggttccagcggcatgaggagcccaaaacaataaccgacgagttcgagcaactggctcaaagtttgagcctgactaagtactcaagcctgtggctctcagctcagccagggactcccccctcacaccccccgctcggccagctgctgggtttgctatag

SEQ ID NO: 111198 - DNA, 2304 bp, Artificial Sequence
  Description of Artificial Sequence: Synthetic coding sequence
atgagcaggtcccccgacgccaaggaggatcctgtggagtgccctttatgtatggagccactggaaattgacgacattaatttttttccttgtacctgcggctaccagatttgccggttttgttggcacaggattcgtacagacgagaacggactgtgtcctgcctgtaggaaaccatatccagaagacccggcagtatacaaaccactgagccaggaagagttgcagcgcataaagaacgagaagaaacagaaacagaatgaaagaaagcagaagatttccgaaaatagaaagcatctggcgtcggtgcgggtcgtgcagaaaaacctagtctttgtcgtgggcctgagccagagattggctgacccggaagtgcttaaaaggccagaatacttcggaaagttcggcaagattcataaagtcgtcattaacaactccacgagttatgcaggctcccaaggtccaagtgccagcgcgtatgtgacgtatattagatctgaagacgctttgcgtgccatacagtgcgtgaacaacgtggtggttgatgggcgaacactcaaggcgtccctgggcaccaccaaatattgcagctacttcctgaaaaatatgcagtgtccaaagccagactgcatgtacctgcacgagctgggagatgaggccgcgtcttttacaaaggaagaaatgcaggcaggcaaacaccaggagtatgaacagaaattgctacaggaattatacaagctgaacccgaatttcctgcaactatccactggtagcgttgacaagaataagaataaggtaactcccctgcagcgatacgatactccgatcgacaagccatccgacagcttatcaattggaaacggggacaatagccaacagatctctaattctgatactccctcacctccccctgggctgtccaagtcgaacccggtgattcctataagttcatccaatcactcagcccggagcccatttgaaggtgctgttaccgagtctcaaagcctgttctctgacaacttcaggcaccccaaccccatcccctccgggctgcccccattcccctctagcccacagactagcagcgattggccgacagcacccgagcctcaaagcctgttcacttcagaaaccattcccgtgtcttccagcactgactggcaggccgctttcggcttcggctcctcaaagcagccagaagacgacctgggttttgacccattcgacgtgacacggaaggcacttgccgacttgatagaaaaggaactgagtgtgcaagaccagccatccttgtctccgactagcctgcagaacagcagcagtcacacaaccactgcgaagggtcccggtagtggctttctccaccctgccgccgcaacaaatgctaactccctcaactccaccttctctgtgctgccccagcggtttccccagttccagcagcaccgcgccgtctataatagtttctccttcccaggacaggcagcccgatacccctggatggcctttcctcggaactctatcatgcacctcaaccatacagctaaccccaccagcaactccaactttctggacttgaacctgccccctcaacataacacgggactgggaggaatcccagtcgcagataattcctcttcggttgagtccttaaacatgaaagaatggcaggacggtttgcgagcattattgcccaatataaacatcaactttggcggactgcctaactcttcatctccctccaacgccaaccattctgctcccacttccaacacagctaccacggactccttgtcgtgggatagcccaggttcatggacagaccctgctattattacaggcataccagccagcagtggcaacagcttggattctctgcaggatgataaccccccccactggctgaaatcattgcaagcgctgacagagatggacggaccgtctgccgcaccctcgcagacccatcatagtgcacccttcagtacacagattcctctgcaccgtgcatcctggaatccctacccacctccctctaatccatcctcattccattcaccaccgcctgggatctactatcgcgttcaacactggaccgccatccggcagcggggcgcaacaatccggaagtgtaggatttgcccaactctgttcagcccctcacagcccacaacacacagctccctgctcatttcttatgtgcttaaaaatccagtgccggaccagttcttcttctccctgacaccagatgcaatgcgctcccagggacactaccatctcttcatcaactgtaaaaacttctgttag

SEQ ID NO: 111199 - DNA, 1728 bp, Artificial Sequence
  Description of Artificial Sequence: Synthetic coding sequence
atgagccgtagtcccgacgccaaggaggaccctgtcgagtgccccctctgtatggagccattagagattgatgacatcaatttctttccttgtacttgcggataccagatttgcagattctgttggcaccggattcgcactgatgagaacggcctttgtcctgcttgccgcaaaccatatcccgaggaccccgccgtctataagcctctgagccaggaggagctccaaagaatcaagaacgagaagaagcagaaacagaatgaaagaaaacaaaagatcagcgaaaaccgcaaacatttggcgtccgtaagggtcgttcagaagaatttagttttcgttgtgggcctgtcccaacgcctggccgaccccgaagtgctgaagaggcccgagtacttcggcaagttcggtaaaatccataaagttgtgataaacaattccacttcatacgcgggatctcagggtccatctgcctcagcgtatgtgacttacataagatccgaagatgctctccgtgctatacagtgtgttaacaatgtggtggtcgacgggcgtacactcaaagctagcctgggtacaacgaaatattgctcctacttcctgaagaacatgcagtgccccaagcccgactgtatgtatctccacgaactcggcgacgaagccgcaagctttacaaaggaagagatgcaggccggaaagcaccaggaatacgagcagaaactgctgcaggaactgtataaattgaaccccaattttctacagctcagcacaggcagcgtggataaaaacaaaaataaagttacacccctacagaggtacgacacccccatcgacaagccgtctgattccctatccatcggcaacggtgacaactcgcaacaaatcagcaactccgacactccgtctcctccgcccggccttagcaagagtaatccagtcattccaatttcctcctcaaaccattcggctcgcagcccttttgaaggggccgtgaccgagtcacaatctctgttctcagacaactttcggcatccaaatcctattccttctgggctccctccatttccatcttcccctcagacctccagcgattggccaacagctcccgagccccagagcctgttcacatccgaaactatcccagtttcctcgtccactgactggcaggcggcatttggattcggcagtagcaaacagcccgaagacgaccttggctttgatccttttgacgtaaccagaaaagctctcgccgacttaatagagaaggagttgtcagtccaagatcaacccagcctctcgcctactagcctacagaacagttcttctcatactaccaccgccaagggtcccggatctggctttcttcacccagcggccgcgactaacgccaatagcctaaactctacattttcagtgctgcctcagcggttccctcagtttcagcagcatagagccgtatacaatagtttctcgttccctgggcaagcagcgagatatccttggatggctttccctcgcaacagcatcatgcatctcaatcacactgccaaccctacctccaatagtaacttccttgacctgaaccttccaccccaacataatactggcctcggagggattcctgtcgccggggaggaggaggtgaaggtgtccaccatgcccctgagtacatcttctcactcactgcagcaggggcagcagccaacgtctcttcacacgacagtggcatag

SEQ ID NO: 111200 - DNA, 1302 bp, Artificial Sequence
  Description of Artificial Sequence: Synthetic coding sequence
atgagtagatccccagacgctaaggaggatcctgtggagtgtccactgtgcatggagcctctcgaaattgacgacattaacttcttcccatgcacttgcggttaccagatttgtcgattctgctggcaccgaatccgcacggacgaaaacggtctgtgtcctgcctgccgcaaaccttatccagaagatccagctgtttacaaacctctaagccaggaagagttgcagcgaatcaagaacgagaagaagcagaaacaaaacgagaggaaacaaaagatatcagagaatcgtaaacatctagctagcgtgcgcgtggtacaaaagaatctggtcttcgttgtcgggctctcccaaaggctagcagatccggaggtccttaaaaggcctgagtatttcggcaagtttggcaaaatccataaagtggtaattaataactctacttcatatgccggatctcagggtccgtccgcttctgcatacgtgacctacataagaagcgaagacgcactgagggcaatccagtgcgtgaacaacgtggtggttgatggcaggacactgaaggccagccttggcactactaagtattgctcctattttttgaaaaacatgcagtgccccaaacctgattgcatgtacctccacgagctgggggacgaagccgcgtcgttcaccaaagaggaaatgcaagccgggaaacatcaggaatatgagcagaaactcctccaagagctatataaattaaacccgaattttctacagcttagcactggctcggtcgataaaaataagaacaaggttacccctttgcaaagatacgatacacccatagacaaacccagcgatagccttagcatagggaacggtgacaattctcagcagatttcaaactccgacacaccatcgcccccacctggcttgagtaaatcaaatccagtcatcccaattagtagcagcaaccattcagcccgatctccattcgagggagcagtgactgaatcacagtcattattctccgataattttcggcatcctaacccgatccctagcgggctgccgccatttcctagttcaccacaaacaagttctgattggccgactgcgccagagccccagtccctgttcacctccgagaccatccctgtgtcatcctctactgactggcaggccgcattcgggtttggaagctcaaagcagcccgaagacgacctgggctttgaccctttcgacgtaaccaggaaagcattggcagatctcactgagccaattgagcgaaagcggctggctgtcctgaagcgacgatag

SEQ ID NO: 111201 - DNA, 1920 bp, Artificial Sequence
  Description of Artificial Sequence: Synthetic coding sequence
atgtctcgcagtcccgacgccaaggaggaccctgtggaatgtcccttatgcatggagcccctcgagatcgacgacatcaatttcttcccttgtacatgtggctaccagatctgcagattttgttggcacaggatcaggaccgacgaaaacggcctctgtcctgcatgccggaagccatacccggaggaccccgccgtgtacaagccactgtcacaggaagaactgcaacgcatcaaaaatgagaagaagcagaagcaaaatgaaaggaagcagaagatctctgagaatcggaaacatcttgcgtccgttcgagtcgtgcagaagaacctcgtctttgtggtgggattgtcacagaggttagccgatcctgaagtgttgaagcggcccgagtactttggaaagtttggaaaaatacataaggtcgtcattaacaacagtacatcctacgctgggagccagggccccagcgcctccgcgtatgtgacgtacattcggtcagaagacgcattgcgcgccatccaatgcgttaataacgtcgtggtggacggccgcaccctgaaggcatctctcggcaccactaaatactgctcatacttcctgaagaacatgcagtgccccaagcccgactgtatgtacctgcacgaacttggagacgaagcagcatcattcactaaagaagagatgcaggccgggaaacaccaggaatacgaacagaagctgttgcaggaactatataagttaaatccgaacttccttcagttgtcgacgggttccgttgataaaaacaaaaacaaagtgactcccttgcagagccctattgataaacccagtgactccttgagcattggtaatggggacaacagccaacagatcagtaattcagacactccctcgcctcctccaggactgtccaaatcgaatcctgtgatacctatctctagctcaaaccattcagccagatcaccctttgagggtgctgtcacagagtcccagagtctcttcagcgacaatttccggcatccgaatcctatccccagcggcctgccacctttccccagctccccccaaacctccagtgattggcccaccgcacctgaaccacaaagtttattcaccagcgagaccataccagttagctcatctaccgactggcaggccgcgtttgggtttggaagcagcaagcagccagaagacgacttgggcttcgatccatttgatgtcaccaggaaagctctggccgacctgattgaaaaggagctgtcagtccaggatcaaccttctctctccccaacatccctgcaaaattcgagcagccatacaacaactgcgaaaggtccgggatccggctttttgcaccctgccgccgccaccaatgcaaattctctaaattccaccttttctgtcttgcctcagcggtttccacaattccagcagcaccgcgccgtttataacagcttttcttttcctgggcaggcggcccggtacccatggatggcattccccagaaattccataatgcacctgaatcacacagcgaaccctaccagtaactcgaacttcctcgatctcaatctgcccccgcagcataacacaggactgggcggcattcctgtggccgggattcccgcctctagcggtaacagcttagattcactccaagacgacaatcctccacactggctgaagtccctacaggcgctgacagagatggatggccccagcgccgctccatctcagactcaccatagcgcccctttctctacccagattccactgcaccgagcttcatggaacccatatcctcccccaagcaatccatctagtttccattccccaccaccaggctttcagaccgctttcaggcctccatctaaaacacccacagatttgctgcagagcagtacattggataggcactag

SEQ ID NO: 111202 - DNA, 1302 bp, Artificial Sequence
  Description of Artificial Sequence: Synthetic coding sequence
atgtctcgctctccggacgctaaggaggaccctgttgaatgcccgctgtgcatggaacctttagagattgacgatatcaacttttttccgtgtacctgcggataccagatctgcaggttctgctggcacaggattcgcaccgatgaaaatggtctgtgccccgcgtgtcgaaaaccatatccagaggatcctgcagtgtacaagcccctgagccaggaggaactccagaggataaagaacgagaagaaacaaaagcagaacgagcgtaagcagaaaatctccgaaaacaggaagcacctcgcttcagtgcgcgttgtgcaaaagaaccttgtgttcgtggttggactgagccagaggctcgccgatcccgaggtcctgaagcgaccggagtatttcggaaagtttggtaagatccacaaggtggtaatcaataactctacctcctatgccggatcacaaggcccatccgcaagcgcgtacgtgacatacatacggagcgaagacgccctcagagcaatccagtgcgtgaacaacgttgttgtggacggccggacactgaaggctagcttggggacgacaaaatactgctcatacttccttaagaacatgcagtgtccaaaacccgactgtatgtacctgcatgagctgggcgatgaggctgcttcattcaccaaagaagagatgcaggctgggaagcaccaggagtacgagcaaaaactcttgcaggagctgtataagttgaaccccaatttcttgcagctctccacaggctctgtggacaagaacaagaacaaggttacgcctttacagcgctacgatacgcccatcgacaaaccttccgattcactgtcaattggtaacggagataattcccagcagatttccaatagtgatactcccagccccccaccgggtttaagtaagagcaaccctgtgattccgatcagcagctccaatcattccgcgaggtccccctttgaaggagccgtgaccgagagtcagagcctgttctcagacaactttcgacacccaaacccaattccatccgggttgcccccctttcccagcagcccacagactagtagtgactggcccaccgcgccggagcctcagtcactctttacctctgagactatccctgtgtcatcctctaccgactggcaggcggcctttgggtttggttctagtaagcagcctgaggacgacctgggcttcgacccttttgacgtgacccgtaaggcacttgcagacctcacggagcccatagagcgaaagcgtctagctgtattaaagaggcggtag

SEQ ID NO: 111203 - DNA, 1929 bp, Artificial Sequence
  Description of Artificial Sequence: Synthetic coding sequence
atgtcgcgaagtcccgacgccaaggaggacccggttgaatgtccactgtgtatggaaccattagaaatcgacgatatcaacttctttccctgcacttgtggataccagatctgtagattctgctggcaccgcattaggacagacgagaacgggttgtgccctgcgtgtcgaaaaccttatcctgaagaccctgccgtatataaaccgctgtcacaagaggaactgcagagaattaagaatgagaaaaaacagaagcagaatgagagaaagcaaaaaatcagcgagaaccgcaagcaccttgccagcgtccgtgtcgttcagaaaaatctggtcttcgttgttggactctcccaacggctggctgacccagaggtccttaagagaccagagtactttgggaagtttggtaaaatacacaaagtggttattaacaactctactagttacgctggtagccaggggcctagtgcctcagcctacgttacctacatcagatccgaagacgccctaagagcaattcaatgtgttaataacgttgtggtcgacggtcgcaccctgaaagccagcttgggcactacgaagtactgcagttactttctgaagaatatgcagtgtcccaagccggactgtatgtacctccacgagctgggagatgaagcggcctcattcaccaaagaagagatgcaagccggcaagcatcaggaatatgaacagaagctattgcaggagctctacaaactgaatcctaatttcctgcagctcagcacgggctcagtggacaagaacaaaaataaggtgactcctctccaacggtatgacacaccaatcgacaaacccagtgacagtctaagtataggaaatggggacaactcgcagcagatctcaaactctgatacacccagtcccccacctggtctctccaaaagcaaccccgtcatacccatttcttccagtaaccacagtgcaaggtcgccgttcgagggggcggttacagagtcccaatcccttttcagtgataactttcggcatccaaaccctatcccctccggactgccaccttttccatcgtccccacaaacaagctccgattggcctacggcccctgaaccacaaagcttgtttacctcggagacaattcccgtatcttccagtaccgattggcaagcagctttcggcttcggatccagcaaacagcccgaggatgatctcggtttcgatccattcgatgtcactcgaaaggccctggccgatctgattgaaaaggagctgtctgtgcaagaccaaccgagtttatcacccacatccctgcaaaatagctccagccacactaccacagcaaagggtcccggtagtgggtttctgcaccccgccgccgctaccaacgccaatagtctgaacagcaccttttctgtgctgccccagaggttccctcaatttcagcagcacagagcagtctacaacagtttctctttccccggccaggctgcacgctacccatggatggcctttccaaggaatagcatcatgcatctgaaccacactgctaatcctacttcaaattctaattttcttgatctaaatttgcccccccagcataatactgggctggggggtattccagtcgccggaattcccgcttcctcaggaaacagcctagacagcctccaggatgataatcccccccactggctaaagagcctccaggccctcacggagatggacggtccttcggccgcaccttctcaaacccaccacagtgccccctttagtacacaaattccattacaccgtgcctcctggaacccttatcctccaccaagcaacccatcgtccttccatagccctccacccgggtttcagactgcattcaggcccccctccaagacccccacagaccttcttcagagttccactctggacagacattag

SEQ ID NO: 111204 - DNA, 1719 bp, Artificial Sequence
  Description of Artificial Sequence: Synthetic coding sequence
atgagcagaagccccgacgccaaagaggatcctgtggagtgccctctctgcatggaaccattggagatcgacgacattaatttctttccatgcacttgtggctatcagatatgtcgcttctgctggcatcgtatccgcaccgatgagaacggcctctgtccagcctgccgtaagccataccccgaagatcctgcggtctataaacccctttcacaggaggaattgcaacgcattaaaaacgaaaagaagcaaaagcagaatgagcggaagcaaaaaattagcgagaaccgcaagcacctcgcatcagtgcgcgtggtgcaaaagaatctggtattcgtcgtcggtctgagtcagcggctcgccgatcccgaggtcctcaaacgaccggaatattttggaaagtttgggaaaattcacaaggtggtaataaacaactccaccagctatgccgggtctcagggcccctctgctagtgcctacgttacgtacattaggtcagaagatgctttgcgtgcaattcaatgcgtcaataacgtggtggtcgatgggcgaactctgaaagcatccttaggcactacaaaatactgctcctactttctgaaaaatatgcagtgcccgaaaccggattgtatgtacctccacgaactcggagatgaggctgccagctttactaaagaggagatgcaggctggaaaacaccaggaatatgagcagaaactcctgcaagagctatataagttgaaccctaattttttacagctgtctactggctctgtggacaagaataagaacaaggtaacaccgctccagtcccccattgacaaaccttccgactcactaagtatcggaaatggcgataactcccagcagatcagcaatagtgataccccgtctcccccccccggcctgtctaagagcaacccagtcatccctattagctccagtaaccattcggccagatcaccttttgagggtgctgtcaccgagtcccagtccctcttctcagacaactttcgccatcctaaccctatacctagtggcctacctcccttcccgtcatccccccagacatcttctgattggcccaccgctccagaaccccagtccctgttcacgtcagagaccattccagttagctctagtactgattggcaggcagctttcggctttggcagttcaaaacaacccgaagatgacctggggttcgacccatttgatgttacccggaaggcacttgccgatctgatcgagaaagagctttcagtacaggatcagccatcgctgagtcctacatccctacagaattctagctctcacacgacgactgccaagggacctggcagtggttttctgcacccagccgcggctaccaatgctaactcgctcaactctacattcagtgtcttaccccaacggttcccacagtttcagcagcaccgggctgtttataactcttttagttttccggggcaagcagcccgctatccctggatggccttcccccgaaattccattatgcacctaaatcacacagccaatccaacctccaactcaaactttttggacttgaaccttcctccccaacataacacaggcctcggtggcattccagtggctggtgaggaagaagtgaaggtgtcgaccatgcctctgtcaaccagcagtcactcactgcaacagggccaacagcccacttctctccataccacagtggcttag

SEQ ID NO: 111205 - DNA, 2142 bp, Artificial Sequence
  Description of Artificial Sequence: Synthetic coding sequence
atgagccggtcccctgatgccaaggaggacccagtggaatgtcccctgtgtatggagcctctcgaaatcgacgacatcaatttttttccatgcacttgtggttatcaaatctgccggttttgctggcaccggatcagaaccgacgagaacggcctttgcccggcctgtaggaaaccctaccccgaggaccctgcagtctataagcctctgagtcaagaggagcttcaacgtatcaagaatgaaaaaaagcagaaacagaacgaacgtaaacagaagatctcggaaaaccgaaagcacctggcctctgtccgtgtcgtgcagaaaaacctggtgttcgtggttggactcagccagcgcctggcagaccctgaggtgctaaagcggccggaatatttcggcaaattcgggaaaatccacaaggtggtgattaacaactctacctcctatgctggctctcagggcccttcggcaagtgcttacgtcacctatatcagatctgaagacgctctacgcgcgattcaatgcgtgaacaatgtcgtggtagacggccgaactcttaaagcttccctgggcacgacaaaatactgctcgtacttcctgaagaacatgcagtgtcccaagccagattgtatgtatctgcacgaattgggggacgaagccgcttcatttactaaggaggagatgcaggctgggaagcaccaggaatacgagcagaagctactgcaggagctgtacaagcttaatcccaattttctgcagctcagtacgggatctgtggacaaaaataagaataaagtcacccccctccaacgttacgacacacccatcgataagccctcagacagcctctcgatcggcaacggagacaattcgcagcaaatttcaaattcagataccccttcgcccccacctggcttgagtaagagcaaccctgtgatccccatatcatcctctaaccattcagcccgcagcccattcgaaggagccgtaacagagtctcagagtcttttttctgacaatttccgccaccctaatccgattccctcaggtctgccgcctttcccatctagtccacaaacttcatccgactggcccactgcccctgagcctcagtcacttttcacatctgagacgatcccggttagcagctccactgattggcaggcggccttcggattcggttcatccaagcaacctgaagacgacctcggatttgatccattcgacgtgacacgcaaggctcttgccgacctgatcgagaaggagctgagcgtccaggaccagccatctctttcgcccacctcattgcagaattcgtcctcacatacaacaaccgccaagggcccgggttcaggcttcctgcaccctgccgcggcaacaaatgccaacagtctgaactcaacgttcagcgtcctgcctcaacgttttcctcagttccaacagcacagggcagtttacaactccttctcatttccggggcaggcagccaggtacccctggatggcctttcctagaaattcaataatgcacctcaaccataccgctaatcccacgtctaactcgaacttcctggaccttaatctgcctccacaacacaacacaggcctgggtggtattcctgttgcagataatagcagttctgtcgagtcgcttaacatgaaggaatggcaggacggcctgcgtgcactgctcccaaatatcaatataaactttggggggctgcctaactcgagttcccccagcaatgcaaatcactctgcacccactagcaacacagcgacaaccgattccctgtcttgggactctcccggctcttggaccgacccagccatcatcacaggcatcccagcctcatccgggaactcactggactcccttcaagacgacaatccgccgcactggctcaagagtctgcaagcactgacagaaatggacggaccatccgccgctcccagccagacacaccacagcgcaccttttagtactcagattcctttgcacagagcttcctggaatccgtatcccccgccgagcaacccgtctagttttcactcccccccgccagggtttcagactgcttttagacctccatccaagacacctactgacctgctccagtcatcaactcttgatcggcattag

SEQ ID NO: 111206 - DNA, 1674 bp, Artificial Sequence
  Description of Artificial Sequence: Synthetic coding sequence
atgccaaaagagaagtatgagcccccggacccgagacgtatgtatacaattatgagttccgaagaggccgccaatgggaagaaatctcattgggccgagctcgaaattagtgggaaagtgcgatccctctccgccagcttgtggtcactaacacacttaacggctttgcacttatccgacaattccttgagccgaatcccctctgatatcgcaaagctgcacaatctggtctatctggatttgtcttccaataagatacgatcacttccggccgagttagggaatatggtgtcactccgggagctccacctgaacaacaacctgctgcgggtgcttccctttgagctgggcaagctctttcagcttcagacactggggttaaaaggtaacccgctgacacaggatatccttaacctgtaccaggagcctgatgggacgagacggttgctcaattatctcctcgacaatcttagtggaaccgccaaacgcattactactgagcagcctcctccgcgctcctggattatgttgcaagagccagacagaacacgacccacagctctattttccgtcatgtgctataacgtactgtgtgataagtacgcaacccgacagctgtacggctattgtccctcatgggccctaaactgggactacaggaagaaggcgattatccaggaaattcttagttgcaatgcggatatcgtgtccctgcaggaagtcgagaccgaacaatactactcattttttctggtggagctgaaggagagaggctacaatggctttttcagtcctaaatcacgggcacgcactatgtcagaacaagagagaaagcacgtggatggatgcgcaatcttcttcaagacagagaaatttacacttgttcagaagcacactgtggagttcaatcagctggccatggctaatagcgaagggtctgaggctatgctgaacagggtcatgaccaaggacaatataggcgtggcggtgctccttgagctcaggaaggaatcaatcgagatgccttcaggaaagccccatctgggcacggagaagcaactgattctggtggccaatgctcacatgcactgggaccctgagtattcggacgtgaagctggtacagacaatgatgttcctcagtgaggttaaaaatattattgacaaggcgagccggaatttaaagtcaagtgttctcggagaatttggaacaatccctctagtgctgtgcgcagacttgaactccctccccgattctggagtcgttgaatatttgagtacagggggagtcgagacaaaccataaagattttaaggagttacggtacaacgaatctctgacgaatttctcttgtcacggcaaaaatggcaccacgaatgggcgaattacccatggctttaaactgcaatccgcctatgaaagcggattaatgccatacactaactatacattcgattttaaggggatcatcgactatatattctactcgaaaccacaactgaacacgctgggcattctggggccgctcgatcaccactggttggtggagaacaacataagtggttgcccgcacccactcatcccctctgaccatttttcactgtttgcccaattagaactgcttctgccatttttgcctcaggtgaatggcatccatctgccaggccgcagatag

SEQ ID NO: 111207 - DNA, 1674 bp, Artificial Sequence
  Description of Artificial Sequence: Synthetic coding sequence
atgcctaaggaaaagtacgaacctcccgaccctcgtcggatgtataccatcatgtcgagtgaagaggccgccaacggtaagaagtcacattgggctgaactggaaatatccgggaaggtgaggtcattgagcgcttccttgtggagcctgacccacttgactgctctgcacctcagcgacaactccttatcaaggatccctagcgatatcgccaagttgcataatctggtttatcttgacctatccagcaacaagatacgctcccttccagccgaactgggaaacatggtctccctccgcgaactgcacctgaataataatttacttagggtcttgccttttgagttaggcaaactatttcagctccaaactctgggcctcaagggcaacccccttacccaggatatcctgaatctgtatcaggagcctgacgggaccagaaggctcttaaactatttattagacaacctcagcgggactgcgaaaaggataaccaccgagcagccgcctcctaggtcctggataatgctccaggagccagatcgtacacgccccacagccctctttagcgttatgtgttataatgtcctctgcgacaaatatgccacaagacagttatatggttattgtccatcttgggccttgaactgggactaccgaaaaaaagcaattatccaggagatcctgtcctgtaacgccgatatcgtgtccctgcaggaagtggagactgaacagtattatagtttttttctggtagagttgaaggaaaggggctataacggattttttagccccaagtcccgagcaagaaccatgagtgagcaggaacgcaagcatgtcgatgggtgcgccatcttcttcaagaccgagaagtttaccctggtccagaagcatacggtggagttcaatcagctagctatggccaacagcgaggggtcagaggccatgctgaatagagtgatgacaaaggacaatattggtgtggccgtccttctcgagttgcgcaaggagagcatcgagatgcccagcggcaaacctcaccttggaacagaaaaacagctgatactagtggcaaacgcacatatgcactgggatcctgaatattcagatgtgaagctggtccaaacaatgatgttcctgtccgaagtcaagaacatcattgataaagcgtcacgtaacctgaaatcctccgtgctaggggagttcggtacaatcccactggttctgtgcgccgatctcaactccctgccagactctggcgtcgtggaatatctgtcgaccggaggagtggaaacaaaccacaaagattttaaagagttgcgttacaacgagtccctgacaaacttctcatgccatgggaagaatggcacgaccaacggccggattactcacggcttcaagctccagtctgcttacgagtcgggcctgatgccttataccaactacacttttgactttaagggtataattgactatatattctactccaagccccagctgaatacgttaggaatcctcggtcccttagaccaccactggctcgttgagaataatatctcaggttgccctcacccactgattccgagcgaccacttctcactgtttgcccagcttgagctcttgctgcccttcctgcctcaggtcaacggcatccacctgcccgggcggcgctag

SEQ ID NO: 111208 - DNA, 858 bp, Artificial Sequence
  Description of Artificial Sequence: Synthetic coding sequence
atgccagccgcaacggtggatcactctcaacggatttgtgaagtgtgggcctgtaaccttgacgaggagatgaagaagattagacaggttatcaggaaatataactacgtcgccatggataccgaattccccggggtggtcgcacggccaatcggagaattcaggtctaatgcagactatcagtaccaactccttcggtgcaatgtggacctgctgaaaatcatccaactcggcttaacattcatgaatgaacaaggcgaatatcctcccgggacaagcacctggcagttcaattttaagttcaacctaacagaagacatgtacgcacaggattcaatcgaactgttaactacctccggaatccagttcaaaaaacacgaggaggagggcatcgaaactcagtattttgcagaactcctgatgacctcaggagtcgtgttatgtgagggagtcaaatggctgtctttccactcggggtacgacttcggatacttgatcaagatactaaccaattctaatttgcctgaagaagaattagattttttcgaaattctccggctcttttttcctgtgatttacgatgtcaagtatttaatgaagagctgtaaaaatctgaaggggggattgcaagaagtcgccgagcagctcgagctggagcggattggcccacagcatcaggccggcagcgacagcctgctgactggtatggctttcttcaaaatgcgggagatgttttttgaggatcatattgacgatgctaaatattgcggacatctgtatggtctcgggtcaggctcaagctacgtgcagaacggaacaggcaatgcatacgaggaggaggccaacaaacagtcctag

SEQ ID NO: 111209 - DNA, 126 bp, Artificial Sequence
  Description of Artificial Sequence: Synthetic coding sequence
atgcccgctgcaactgtggaccactcgcagcgtatctgtgaagtctgggcatgcaatcttgatgaggagatgaaaaaaatccggcaggtaatccgcaagtacaactatgtggcgatggacacttag

SEQ ID NO: 111210 - DNA, 735 bp, Artificial Sequence
  Description of Artificial Sequence: Synthetic coding sequence
atgcccgcggcaacagttgaccattcccaacggatatgtgaggtttgggcctgcaacctggacgaggagatgaaaaaaattagacaagtgataaggaaatacaactacgtggccatggacaccgaattccccggggtcgtggcccgccctatcggcgagtttcggtccaacgctgattaccagtatcaattactccgctgcaatgtggatctccttaagattatccagctgggattgacatttatgaatgaacagggagagtatccgcccggcactagcacctggcagtttaacttcaaattcaatctgaccgaggatatgtatgcccaagattcaattgagttactgaccacctcagggattcagttcaaaaagcacgaagaggaaggcatcgagacgcaatatttcgccgagctgctcatgacctctggtgttgtgctgtgtgagggcgtaaagtggttatcattccattccgggtatgacttcggatacttgatcaaaatcctaacaaatagtaatctgcctgaagaagagctggacttctttgaaatcctgaggctgttcttccccgtgatctacgacgtcaagtacctgatgaaaagttgcaaaaatctaaagggcggacttcaggaggtggccgagcaactagaactcgagcggatcggaccccagcaccaggcaggctctgattccctgctgaccgggatggccttcttcaaaatgagagaggtgtag

SEQ ID NO: 111211 - DNA, 444 bp, Artificial Sequence
  Description of Artificial Sequence: Synthetic coding sequence
atgcccgccgctaccgttgatcacagccagcggatttgtgaagtctgggcctgcaacctggatgaggagatgaagaaaattcgccaagtcattcgtaaatacaattatgtagcaatggacaccgagtttcccggagtggttgcaagacctattggggaattcagatccaatgcggactaccagtaccagctcttacgttgcaacgtcgatctgttgaagatcatacaacttgggctgaccttcatgaatgaacagggcgaatatcccccaggaacaagcacatggcagtttaatttcaagttcaatttgactgaggacatgtatgcacaggactccatcgagttgttgaccaccagtggcattcaattcaaaaaacacgaagaggaaggaattgaaacccagtactttgccgaattgctgatgactagcggcgtcgtgctctag

SEQ ID NO: 111212 - DNA, 879 bp, Artificial Sequence
  Description of Artificial Sequence: Synthetic coding sequence
atgcctgctgccttggtcgagaacagccaggtaatttgtgaagtgtgggcgtccaacctagaagaggagatgcggaagatccgcgaaatcgttctctcttattcatatatcgccatggacacggagtttcccggtgtggtggtgaggcccatcggagagttcaggtcttcaatcgattatcagtaccagctgctgcgatgtaatgttgatctgctcaagatcattcagttgggcctgacatttaccaatgaaaaaggggagtatccttccgggattaatacttggcaattcaactttaagttcaacctgactgaggacatgtattctcaggactcaatcgacctgttagctaacagtggtctgcagttccagaagcatgaagaggagggaatcgacaccctgcattttgcagaacttttgatgacctcaggggtggtgctatgtgataacgtaaagtggctgtccttccatagtgggtacgacttcggctatatggttaaactacttacagatagcaggttgccggaagaggagcacgaatttttccacattctgaatctcttttttccttccatctacgacgtgaagtatctgatgaagtcgtgtaagaacctaaagggaggcctgcaagaagtcgctgaccaactggacctacagcgaattggtaggcagcaccaggccgggtcagattcattactgaccgggatggcatttttccgtatgaaggaactgttcttcgaagactccatcgacgacgctaagtattgcggaagactgtacggcttgggcacaggggtggctcagaagcaaaatgaagacgttgactccgcccaggagaagatgagcattttggccattatcaacaacatgcagcagtag

SEQ ID NO: 111213 - DNA, 879 bp, Artificial Sequence
  Description of Artificial Sequence: Synthetic coding sequence
atgcctgctgcactggtggagaactcacaagtgatatgcgaggtgtgggcatctaacctggaggaggagatgaggaagatacgcgagatcgtgctatcctactcatacatcgctatggacactgaattcccgggggtggtggtgaggcccattggggaattccggtcctcaattgactaccagtaccagctgttaagatgtaacgtggatctgctcaagataatccagctggggttgacatttaccaacgagaagggagagtatcccagcggcatcaatacttggcaatttaacttcaaattcaatctgactgaggacatgtactctcaagacagcattgacctcctggccaatagcggcctgcagtttcagaagcacgaagaagaagggatcgatactctgcacttcgccgagctactcatgacatccggcgttgtgttgtgcgataacgtcaagtggctgtccttccacagcgggtacgatttcggctacatggtcaaattgctgaccgactcccgactgccagaagaagagcatgagttcttccacattcttaacttattcttcccctctatttatgatgtcaaatacctgatgaagagctgtaagaatctaaaagggggactccaggaggtggcagaccagctcgatctccagagaattggtcggcagcaccaggctgggtcggacagcctactgaccggcatggcattttttagaatgaaagagcttttctttgaggactcaatcgacgacgctaagtactgcggaaggttatacggtctcggtaccggagtggcgcagaagcagaacgaggacgtagatagtgcgcaggaaaaaatgtcgatcctagccatcatcaataatatgcaacagtag

SEQ ID NO: 111214 - DNA, 357 bp, Artificial Sequence
  Description of Artificial Sequence: Synthetic coding sequence
atgcccgccgctctggtggagaactctcaggtcatttgcgaggtgtgggcaagcaacctcgaggaggagatgcggaagatcagggagatagtgctatcgtacagctatattgccatggacactgagtttcctggggtggtggtgcgacccatcggagagttccgttcctctatcgactaccaatatcagcttcttaggtgcaacgttgacctgctgaagatcattcaactcgggctgacatttaccaatgaaaagggagagtacccgtcaggcatcaacacttggcagttcaattttaaattcaacctcaccgaggacatgtatagccaggacagcattgacttgctggcaaattag

SEQ ID NO: 111215 - DNA, 879 bp, Artificial Sequence
  Description of Artificial Sequence: Synthetic coding sequence
atgcctgcagcactcgtcgaaaattctcaagttatttgtgaagtgtgggcctccaatcttgaggaagaaatgcgcaagatccgcgagatagtgctgtcctattcttatatcgcaatggacacagagttcccgggcgtggtcgtgcgccccataggagagtttagaagttcgatagattatcagtaccagcttctgagatgcaacgtggatctgctgaaaattatccagttgggtctcactttcacaaacgagaagggcgagtatccttccggaataaacacttggcagttcaatttcaagtttaacctgactgaagacatgtattcacaggacagcattgacctgctcgccaactcaggcctccagttccaaaagcatgaggaagagggcatcgacaccctccactttgccgaactcctgatgacaagcggagttgtcctttgtgataatgtgaagtggcttagctttcacagcggctacgactttggatatatggtcaagctcctgaccgattccagactgcccgaagaggagcatgagttctttcatatccttaacctgttcttcccttctatatatgacgttaagtacttaatgaaatcatgtaaaaacctcaaggggggcttacaggaggtggccgatcagctcgatttacagcgtataggcaggcagcatcaggctgggtcagattcactgctcactggcatggctttcttccggatgaaggaattgtttttcgaagattctattgacgacgcaaaatattgtggccggctctatggcctcgggactggcgtagctcagaaacagaacgaagacgtggactctgcccaggaaaaaatgtcaatcctcgctataatcaataatatgcagcaatag

SEQ ID NO: 111216 - DNA, 168 bp, Artificial Sequence
  Description of Artificial Sequence: Synthetic coding sequence
atgccagcggctctggtcgagaatagtcaggtgatttgtgaggtctgggccagtaacctggaggaggagatgaggaaaataagagagatcgtgctgagctatagttatatagccatggatactgaattccccggggtcgtggttagaccaattggggagtttcggtag

SEQ ID NO: 111217 - DNA, 678 bp, Artificial Sequence
  Description of Artificial Sequence: Synthetic coding sequence
atgcccgccgctttggtggagaatagccaggtgatctgtgaggtgtgggccagcaacctggaggaagagatgagaaagatccgggaaatagtcctctcctattcgtacattgcaatggatactgaatttcctggggtagtggttcggcccattggagagttcagatcttcaatcgattaccagtaccagctgctccgctgtaacgtcgaccttttaaaaatcatacagctcgggttgacctttaccaatgaaaaaggagaatatccatctggaataaatacatggcaatttaactttaaattcaaccttactggctacgatttcgggtacatggtaaagttactcacagattcacgcttgccggaagaagaacacgagttctttcacatcctgaatttgttcttcccctctatttatgacgtgaagtatcttatgaagtcctgtaagaacctgaagggcggcctgcaggaggtagcggatcagttagacctccagaggattggcaggcagcaccaagcgggaagtgattctcttttgacagggatggcctttttccgaatgaaggaactcttttttgaggattcaatcgatgatgccaaatactgtggacggctgtatggattaggaactggcgtggctcagaagcagaacgaagatgttgactcagcccaggagtag

SEQ ID NO: 111218 - DNA, 360 bp, Artificial Sequence
  Description of Artificial Sequence: Synthetic coding sequence
atgcccgctgccctcgtggagaactctcaggtgatttgcgaggtctgggccagcaatctcgaggaggagatgaggaaaatccgcgaaattgtcctctcatactcatacatcgcgatggacacagaattccctggggtagtggtacgcccaataggtgaatttcgaagttcaatagattatcagtaccaactgctgaggtgcaacgtagacctattgaagatcatccaactgggactcactttcactaatgagaagggcgaatacccatcaggcatcaacacctggcagttcaattttaaatttaacctgacggaggatatgtatagtcaggattctatagatctacttgccaactcctag

SEQ ID NO: 111219 - DNA, 717 bp, Artificial Sequence
  Description of Artificial Sequence: Synthetic coding sequence
atgcccgccgcccttgtcgaaaattcccaggtcatttgcgaagtgtgggcatccaatctggaggaggagatgcgaaaaatcagggaaatcgtgctctcctactcgtatattgccatggataccgaattcccaggagtggtggtcaggcctatcggggagttcagatcgagtatagactaccaatatcagctattacggtgtaacgtggaccttctgaaaattattcaactgggcctcacattcacaaacgagaagggtgaatatccaagcggtattaacacatggcagttcaacttcaagttcaacctgaccggctacgatttcggctatatggttaaattactgacagattcaagactccccgaggaggaacacgaattcttccatatattgaacctttttttcccctcaatttatgacgtgaaatatctaatgaagagctgcaaaaatctaaagggaggtctgcaagaagtagctgaccagctcgacctgcaaagaattggaagacagcaccaggcaggctccgattctctcctcacaggcatggccttttttagaatgaaggagctcttctttgaggatagcatcgacgacgcaaagtactgtgggcgcctttacgggctcgggaccggggtggcccagaaacagaacgaggatgtggattctgcccaagagaagatgtcgatattggctatcattaacaacatgcagcagtag

SEQ ID NO: 111220 - DNA, 168 bp, Artificial Sequence
  Description of Artificial Sequence: Synthetic coding sequence
atgcctgctgccctggtcgaaaactcccaagtgatctgtgaagtatgggcatccaacttggaagaggagatgcgtaaaattagggaaatagtcctgtcatactcttacattgctatggataccgagtttcccggagtggtggtaagacccattggcgagtttagatag

SEQ ID NO: 111221 - DNA, 258 bp, Artificial Sequence
  Description of Artificial Sequence: Synthetic coding sequence
atgtatagtcaggacagcatagacctgttggccaattccgggttgcaattccagaagcacgaggaagagggaattgacaccttgcacttcgctgaactgctcatgactagcggagtcgtgctctgcgacaatgttaagtggctcagcttccattccggatacgacttcggctacatggtcaaattgctgaccgactccagattgccagaggaagagcatgaattcttccatatcctcaacctgtttttcccttcgtag

SEQ ID NO: 111222 - DNA, 402 bp, Artificial Sequence
  Description of Artificial Sequence: Synthetic coding sequence
atgcctgctgccctcgtggagaactcccaggtgatctgcgaggtttgggcctcaaaccttgaagaagagatgcgcaaaatccgggagatcgtcctgagctactcctacatcgccatggataccgagttccccggagtagttgtgcggcccataggcgaattcagaagcagcatcgactaccagtaccaactactaaggtgcaatgtggatctactcaagataattcagctgggtcttaccttcacgaatgaaaagggcgagtaccctagtggtattaacacttggcagtttaacttcaaatttaatctgacggaggacatgtactctcaggacagtattgatctgcttgcaaattccgggcttcagttccaaaaacacgaggaagaaggcatagacacatag

SEQ ID NO: 111223 - DNA, 561 bp, Artificial Sequence
  Description of Artificial Sequence: Synthetic coding sequence
atgtattcacaggattcaatcgacctgctcgccaacagcgggctgcagtttcagaagcacgaagaggagggtattgacactctccacttcgccgagctcttgatgacttctggagtagtattgtgcgacaatgtgaagtggctttcttttcacagtggatatgatttcggctacatggtaaagcttctcaccgatagtcggctccctgaggaggagcatgagttctttcatattttgaatctatttttcccttcaatctatgacgttaagtacctaatgaagagttgtaagaacttgaagggcggactgcaagaagtggcggaccagctcgatcttcagagaatcggacgtcaacatcaggccggatcagattccctgctgaccgggatggcatttttccgcatgaaggagttgttctttgaagactccattgatgacgccaaatactgcgggaggttatatgggctcggcactggcgttgcccagaagcaaaatgaggatgtagactccgctcaggaaaaaatgagtatcctggccattataaacaacatgcaacagtag

SEQ ID NO: 111224 - DNA, 561 bp, Artificial Sequence
  Description of Artificial Sequence: Synthetic coding sequence
atgtattcccaggattcaatagatctgctagctaattctggcctacagtttcagaaacacgaagaggaaggaatagataccctgcactttgctgaactcctgatgactagcggggtggtgttgtgcgacaatgttaaatggctgagtttccattccggatatgatttcggttacatggtaaagctacttactgactcgcgactgccagaggaggagcacgaattttttcatatactcaatcttttcttcccaagcatctatgatgttaaatacctcatgaagtcctgcaagaatttgaaaggggggctccaggaagtggccgatcaactcgatctgcagcggatcgggagacagcaccaggcaggaagtgacagccttctgaccggcatggctttcttccggatgaaggaactattctttgaggacagcatcgacgatgccaaatactgcggaagactgtacggcctgggcaccggcgtagcgcaaaagcagaacgaggacgtcgactccgcccaggagaaaatgtctattctggctattattaacaatatgcagcagtag

SEQ ID NO: 111225 - DNA, 561 bp, Artificial Sequence
  Description of Artificial Sequence: Synthetic coding sequence
atgtatagccaagattctattgacctgcttgctaatagtggcttgcagtttcagaagcacgaagaggaaggcatcgacacactgcactttgcagagctcttgatgacgtctggggtcgtgttgtgcgataacgtcaagtggctgtcctttcactcggggtatgattttggatatatggtgaagctgctcaccgatagccgactgcccgaagaagagcacgaattcttccatatcctgaacttattttttcctagcatctatgatgtaaagtatttaatgaaatcctgtaagaacctcaagggagggctgcaggaagttgctgatcagttagacctgcagcgtattggacgacaacaccaggccggctccgactcattattgacgggaatggcgtttttcagaatgaaagagctattctttgaggacagcatcgatgacgccaagtattgcggtagactttacggcctcggaactggggttgctcagaagcagaacgaagatgtggatagtgcgcaggagaagatgagtattttggcgattattaacaacatgcagcagtag

SEQ ID NO: 111226 - DNA, 366 bp, Artificial Sequence
  Description of Artificial Sequence: Synthetic coding sequence
atgccagccgcactggttgagaattctcaggttatatgcgaggtctgggcgagcaatttagaggaggagatgaggaaaattagggaaatcgtgctgtcttattcttatatcgccatggatactgaatttcctggggtggtagttcggcccataggcgaattccggagctccattgactaccagtaccaactcctgagatgcaatgttgacctgctgaaaatcatccagctggggttgaccttcaccaacgaaaaaggcgagtatccatctggtattaacacatggcagtttaacttcaagttcaatctcacagggtatgacttcggttatatggtgaagctgctgactgactctaggctgccttag

SEQ ID NO: 111227 - DNA, 561 bp, Artificial Sequence
  Description of Artificial Sequence: Synthetic coding sequence
atgtactcccaggactcgatcgacctactggctaatagtggcctacagtttcagaagcacgaggaggagggaatcgacactcttcacttcgccgaactgctgatgacatccggcgtggtgctgtgcgataatgttaagtggctgagctttcatagcgggtacgactttggctacatggttaagctgctaacggatagcagacttcccgaagaggaacacgagtttttccatatcctcaacttgtttttcccatccatttatgatgttaagtacctgatgaagtcgtgtaagaacctgaaaggtggtctgcaggaagtggccgatcagctggatttacaaaggataggccgccagcatcaggcaggttcagattcactcctgacgggcatggcgtttttcagaatgaaggagctcttcttcgaggacagtattgatgacgcaaaatactgcggccgcttgtatgggctgggtacgggggttgcacagaagcaaaatgaggacgtggactccgcacaggagaagatgtccatcctggccataatcaataacatgcagcagtag

SEQ ID NO: 111228 - DNA, 387 bp, Artificial Sequence
  Description of Artificial Sequence: Synthetic coding sequence
atggttaaacttttgacagactccaggctgcccgaggaggagcacgagtttttccatatactgaacctgtttttcccgagtatttacgacgtgaagtacctgatgaagagttgtaaaaatttgaaggggggattgcaggaggttgccgatcagctcgatctacagcgcattggacgccaacaccaagccggttctgattcactactgactggtatggcattttttcggatgaaggaattgtttttcgaggattcaatcgatgacgctaagtactgtggccggctttatggactgggaacaggcgtcgcccagaaacagaacgaagacgttgacagtgctcaagagaaaatgagcattttggcaattattaataatatgcagcagtag

SEQ ID NO: 111229 - DNA, 810 bp, Artificial Sequence
  Description of Artificial Sequence: Synthetic coding sequence
atgaggaaaatccgggaaatcgtgctcagctattcatatattgccatggacactgagtttcctggcgtggtagtcagaccaataggcgagtttcggagctcgatcgactaccaatatcaactgcttaggtgtaacgtagatctgctgaagatcatccagctcggactcactttcaccaacgagaagggggagtacccatctggaattaacacctggcaatttaacttcaagtttaacctcaccgaggacatgtactctcaggattcaattgacctgctggccaattctgggctgcagttccagaagcatgaagaggagggaatagacaccctgcatttcgccgaactgctcatgacgtctggcgtggttctatgtgataacgtcaagtggctgtcattccatagcgggtacgacttcggatatatggtgaaattgcttaccgactctcggctgcctgaagaagagcacgaattcttccacattctaaacctcttcttcccaagcatttacgacgtgaagtacctgatgaaatcttgtaaaaatctcaaaggcggattgcaggaggtggctgaccagctggatcttcagagaatcggacggcagcaccaggcaggctccgatagcctgcttacaggcatggctttctttcgaatgaaggaattattcttcgaagactctattgacgacgctaagtattgcggccgtttatacgggctcggcaccggtgtggcacaaaaacagaacgaagatgtcgatagtgcccaggagaaaatgtctatcctggcaatcatcaacaacatgcagcagtag

SEQ ID NO: 111230 - DNA, 4338 bp, Artificial Sequence
  Description of Artificial Sequence: Synthetic coding sequence
atgcagggccctcccctcttgactgctgcccatctgttatgcgtgtgcacggccgctttagctgtcgctcctgggccgaggtttctcgttactgcaccaggaattattagaccggggggcaatgtgacgatcggggtggagctgctggaacattgcccatctcaggttaccgttaaggcagagttactcaagacagcatctaacttgactgtctctgttctggaagctgagggtgtttttgagaaaggctcatttaaaacactgaccttgccaagcttgcctctgaacagcgcggacgagatctacgagctgagagtcacaggaagaacccaggacgagattctcttctccaacagcacacgtctgtcatttgaaaccaagcgcatctcggttttcatccagacagataaagctctgtacaagcccaaacaggaagtaaagttcaggatcgtcactctgttcagcgacttcaagccttataaaacatcacttaatatacttattaaagatccaaaatccaatttgatacagcagtggctgagtcagcagtcagacctaggggtcattagcaagaccttccaactgtcctcacatccgatcctcggtgactggagcattcaggtgcaagtgaacgatcagacctactatcagagcttccaggtctctgagtatgtcttaccaaaatttgaggttacgctgcagacgccactttactgttccatgaattcaaagcatctgaatgggaccatcaccgcaaagtatacgtatggcaaaccagtgaagggagacgttactcttacctttctgccactcagcttttggggcaaaaagaaaaatattacaaaaaccttcaaaatcaatgggtctgctaacttttccttcaacgacgaagaaatgaaaaacgtcatggacagttccaacggcctgagcgagtacttggatttatcaagtccaggaccagtagaaatactgaccacggttaccgaatcagtaacaggaataagccggaatgttagtaccaacgtttttttcaaacagcacgattatatcatcgaattcttcgactacaccaccgtgttgaaaccaagtcttaattttacagcgactgtgaaagtcaccagagcagatggcaatcaattaacactggaggagcgaaggaacaacgtcgttattacagttacacagagaaactacaccgagtactggagcggctctaactccggaaaccagaagatggaggccgtccagaagatcaattataccgtcccccaatctgggacctttaagatagagttccctattctggaagactcgtcagagctgcagttgaaggcctacttcttgggatctaaaagctctatggccgtgcactccctgttcaaaagtccatctaaaacatacattcagctcaagactagagacgaaaatataaaggtcggaagtccgttcgagcttgttgtctcgggcaataagcgattgaaagaactcagctatatggtcgtcagccgaggccagctggttgctgtggggaagcagaacagcaccatgttcagtctgacaccagagaattcatggacaccgaaagcgtgtgtgattgtgtactatatcgaagacgacggagagatcatcagcgatgtgttgaagattccggtgcagttggtgtttaaaaacaagatcaagctttactggagcaaagtgaaagcggagcccagcgaaaaagtgagtcttcggatctcggtcacacagcccgattcaatcgtagggatcgttgcagtcgataaatctgtgaacttgatgaacgcgtccaatgatattacaatggagaatgtagtccatgaattagaattgtataatacaggatactacctcgggatgttcatgaactcattcgctgtgttccaagagtgcgggctttgggttctcaccgacgcaaacctgacgaaagactacatcgacggggtttacgacaatgctgaatatgcagaaaggttcatggaggagaatgaagggcacattgttgatattcatgacttttccctcggctctagtccacacgtccgtaagcattttcccgagacgtggatctggctcgataccaatatgggttacagaatctaccaggaatttgaggtcaccgttcccgactcaattacaagctgggtggccacgggctttgtcatcagcgaagacctcggtctggggctgacaaccactccagtcgaactccaggcctttcagccattttttattttcttgaatctgccgtactcggtcattcggggggaagagttcgctctggagatcactatcttcaattacttgaaggatgccacggaagtgaaggtgattatcgaaaaatctgataaattcgacatccttatgacttcaaatgaaattaatgccacggggcaccagcaaacgctgcttgtgccgtccgaggatggagcaaccgtgctctttcccatacggcccacacaccttggcgaaatcccgatcactgtgaccgccctaagtccgacagcaagcgatgctgtgactcaaatgatcctggttaaggctgaggggattgagaagtcctatagccagtcaatcctcctcgacctcacagataatagactgcagagcactctcaaaaccctcagcttcagcttcccacccaacaccgtgacaggctccgaacgcgtgcagattaccgccattggcgatgttctcggaccgagtattaatgggctggctagtttgatacgcatgccatatggatgcggagaacaaaatatgatcaattttgcccccaatatctacatcctggactatctaaccaagaagaaacaattgacagacaacctcaaggagaaagcattaagcttcatgcgacaggggtatcaaagagagctcttgtatcagcgtgaagacggctcattcagtgcctttggtaattacgatcctagcggatccacttggttgtccgctttcgtattacggtgtttcctggaggcggacccatatatcgacattgaccagaacgtacttcaccggacttacacctggttgaagggccatcagaagagtaacggagagttctgggaccctggccgggtaatccactctgaactgcaagggggcaacaaaagtcctgtgaccctgactgcttacattgtgacctcgctgctgggctacagaaagtaccagcctaacatagatgtacaggagtcgatccatttcctcgaatccgaattcagccgtggcattagcgacaactataccctggcactgatcacttatgctctctcttccgttgggtcccccaaggcaaaggaggctctcaacatgctcacctggcgggcagagcaggaaggcgggatgcagttctgggtcagttctgaatccaagctctctgactcttggcagccaagatcgctggatatcgaagtggcagcatacgctttattgagtcatttcctgcaatttcagacctctgagggcattccaatcatgaggtggctgagccggcaacgcaattctctgggcgggttcgcttccacgcaggacacaaccgtagccctgaaagccctgtcggaatttgctgcactcatgaatactgaaaggacaaacattcaagtcacagtgactggcccaagtagccctagcccagttaaattccttatcgatacccacaataggttgctgctgcaaaccgcagaactcgccgtcgtgcagcccacagcagtcaatatcagtgccaacggatttggattcgctatttgccagctgaacgttgtatataatgtaaaggcgagtggttcatctcggcgacggaggtctattcagaaccaagaggcttttgatctggatgtagcagtgaaagaaaacaaagacgatctgaatcatgtcgatctgaatgtttgcacatcattttcaggccccggcaggtccgggatggctctcatggaagttaatctcttgtccggtttcatggttccctccgaggcgatctcactctccgaaaccgtgaaaaaggtcgaatatgatcacgggaaattaaacctgtacctcgattctgtgaacgaaactcagttttgcgtgaatatccctgcggtacgcaacttcaaagtgagcaacacacaggatgctagcgtgagcatcgtggattattatgaacccagaaggcaggccgttaggagctacaatagtgaggtgaaattgagctcatgcgacctttgctccgacgttcagggatgtcgcccttgtgaagatggcgccagcggcagtcaccaccattcctcggtgatatttatattttgtttcaaactgctgtattttatggaactgtggctgtag

SEQ ID NO: 111231 - DNA, 4107 bp, Artificial Sequence
  Description of Artificial Sequence: Synthetic coding sequence
atgcagggccctcctttactaacagctgctcacttgctatgtgtgtgcactgccgcactggcggtggcgcccggcccacgtttcctggtgacagccccaggaatcattaggcctggaggcaacgtgaccatcggcgtcgaactgctggagcattgcccttcacaggtcaccgtgaaagcagagttgctcaagactgcatctaatttgactgtctccgttctggaagccgagggggtgtttgagaaggggagctttaaaacactaacactgccatccgatccaaaaagcaacctgatacagcagtggctctcacagcaatccgatctgggggtgatttccaaaacgttccaactgtccagccaccctattcttggtgattggagtatccaggtgcaggtcaatgaccaaacgtactaccagtcgttccaggtaagtgagtatgtcctccctaagtttgaagtgactctccagacccctttgtactgtagtatgaactctaagcatctgaatggcacaatcacagccaaatacacatacgggaaacctgtgaagggcgacgtcacactaacctttctccctctgtccttctggggtaagaagaagaatatcactaagacctttaaaataaacggctctgccaatttctcattcaacgacgaagagatgaaaaatgtcatggattcctccaacgggcttagcgaatacttggatttgtcatctcctggccctgtcgaaatcttaaccaccgtgaccgagtccgttactgggatttccagaaacgtttctactaatgttttcttcaagcaacacgattacattattgagttcttcgactacactacggtgttgaaaccttcgctgaatttcactgctacagtcaaggttacgcgagccgacgggaaccaactgactctcgaagaacggcgcaataatgtcgtaattactgtgactcaacggaattataccgaatattggagcggttcaaactctgggaatcagaagatggaagcagtccaaaagatcaattatacggtgccgcagtcgggaacctttaagattgagttccccattctggaggacagctcggagctgcagctgaaggcatattttcttggctcaaagtctagtatggcggtgcacagtcttttcaagtccccatctaagacatatatccaactcaaaacccgcgatgaaaatattaaagtgggctcccctttcgaattggtcgtgtcaggcaacaagcgcctgaaggagttaagttacatggtcgtctccaggggccagcttgtggcagtgggtaagcagaacagtaccatgttctccctgacccccgaaaattcgtggacccctaaggcctgtgtgattgtgtactatatcgaggacgacggggaaatcattagcgacgtactgaagattcctgtccagttggtgttcaagaataagattaagctgtactggagcaaagtaaaggcagagccctcggagaaggtgtccctgaggatctcagtgacccaaccagactcaatcgtcgggatagtcgccgtggacaagtccgtgaacctcatgaacgcaagcaacgacattactatggagaatgtggtccacgagcttgagctgtataacacaggctactatcttggcatgtttatgaactcattcgcggtctttcaagaatgtggattgtgggtgctgaccgacgctaacctgactaaagactatatcgacggcgtttacgacaacgctgagtatgccgagcggtttatggaagagaacgagggacatatcgttgatatccacgacttttctctcgggtcaagcccccatgtgaggaaacattttcccgaaacctggatttggttggacaccaatatgggataccgaatctaccaggagtttgaagtgactgtgcccgactccattacaagctgggtcgctaccggctttgtcatatctgaagatttgggcctcggccttactaccacgcccgtggagcttcaggcgtttcagccctttttcatctttctcaatctaccttacagcgttatcagaggcgaagagtttgccctagaaatcaccatcttcaattacctcaaggatgctacagaagtgaaggtgattatagaaaagtcagataagtttgacattcttatgaccagcaacgaaatcaacgcaactggacatcaacagacattactggtaccaagtgaagatggagcgaccgttctcttcccgatccgcccgactcacctcggcgagatccccattactgtgaccgctctgtcgcctaccgcctccgatgcagttacccaaatgattttagtgaaagccgaaggaattgaaaaatcctacagtcagtcaatactcctcgacctgacagacaacaggctgcaatctacactgaaaaccctctcattcagcttcccacctaacaccgtgacgggcagcgagagagtccaaatcacagcgatcggtgacgtcttaggcccctccatcaatggtctggcgtctttgattcggatgccatatggatgcggcgaacagaacatgattaactttgccccaaatatctatatcctggactacttgacaaagaaaaagcagctcaccgacaacttaaaagaaaaggccttgtctttcatgaggcagggttaccagagagagctactctaccaaagagaggacggtagcttctctgcctttggaaattacgaccccagcggaagcacctggctgtccgcgtttgtcctgaggtgctttctcgaggcagacccgtatatcgacatcgaccagaatgtacttcaccggacatacacatggttaaaaggccaccagaagagtaatggtgaattctgggatcccgggcgtgtgattcacagcgagctccagggaggcaataaatcaccagtaacactgacagcctacatcgtaacttccctgctaggttatcgcaagtatcagcccaacatcgacgttcaagaaagtatccattttctggaatcagaattcagccgggggatctcagataattataccctcgcattgataacctacgccctaagctctgtaggtagtccaaaggccaaagaagcccttaacatgttgacttggcgggctgagcaagaaggaggcatgcagttttgggtctctagcgaatccaaattaagcgattcatggcagccacgatccctagacatcgaagttgccgcctatgccttattgagccattttctccagtttcagacctcggaagggatccccatcatgcgctggctgtcccgacagcggaactctttaggcgggtttgcctccactcaagatactacagtagcgctgaaggcgctatcagagttcgcagctctcatgaatactgagaggacgaatatacaggtgaccgtgaccggccctagcagcccctctccagtcaaattcctcatcgatacccataacagactgctcctgcagacagctgagctggctgtggtgcaacccactgcagtgaatattagtgctaatgggtttggctttgcaatctgccaactcaatgtcgtatacaacgtgaaagcgtcagggtcttcacgcaggaggagaagtatccaaaatcaggaagcgtttgatcttgacgtcgctgtcaaggagaacaaggatgacttgaatcatgtggatttgaatgtctgcacttccttcagtggccccggccgatctggtatggccttaatggaagtgaatttactgtccggtttcatggtcccctcagaggctatttccctgagtgagaccgtgaagaaggtggagtacgatcacgggaaactaaatctttatctggattctgttaatgaaactcagttttgtgtaaatatcccagctgtcagaaacttcaaagtgtccaatacacaggacgcgtctgtctctatagtcgattattacgaaccacgacgacaagcagtccgaagctacaacagcgaggtgaagctcagcagttgtgacttgtgtagcgacgtgcagggatgccggccctgcgaagatggcgcatcaggctcccatcaccatagctccgttatcttcatcttttgctttaagcttctctattttatggagctgtggctctag

SEQ ID NO: 111232 - DNA, 4287 bp, Artificial Sequence
  Description of Artificial Sequence: Synthetic coding sequence
atgcagggacctccacttctgactgcagcacaccttctgtgcgtctgtaccgcagctctcgctgtagcccccggaccccgtttccttgtgacagccccagggataattcgacctggagggaacgtgaccatcggagtagagctacttgagcactgcccttcccaggtgacagttaaggccgaactactaaagactgccagtaatctcactgtctccgtgttggaggccgaaggagtgttcgagaagggtagctttaaaaccctgaccctgccctccctcccactgaatagtgccgacgagatctacgagctacgtgtgactggaagaacccaggacgagattctgttcagcaattccaccaggctaagcttcgaaactaagcgcattagcgtgtttattcagacggacaaggccttatataaacctaagcaggaagtgaaatttcgtattgtgacgttgtttagtgattttaaaccctataaaacaagcctcaatatccttatcaaggaccccaagagcaacctgatccagcaatggctgagccagcagagcgatctcggagtcatttccaagacctttcagctgtcaagtcatccaattctcggtgattggtccatccaggtccaagtcaatgatcagacctattatcaaagcttccaggttagtgaatatgtgttacctaagtttgaggtgacactacagacccccctctactgcagtatgaactcaaaacatctaaacgggacaatcaccgcgaaatacacttacggcaaaccggttaagggggacgtcaccctaacattcctgccgcttagcttttgggggaagaaaaagaacatcaccaaaaccttcaagataaatgggagcgcaaatttttctttcaacgatgaagagatgaaaaacgtgatggacagttctaatggcctgagtgaatacctcgacttatcctcaccgggtcctgtggagatcctgaccacagtcacagagtctgtaacaggtatttctcggaatgtgtctacgaatgtattcttcaaacagcacgactacatcatcgagttctttgattacacgacagtcctgaagccctcactgaattttacagccaccgttaaggtcacccgggcagacggcaatcagcttacgttggaagagcggcgcaataatgtagtcattacagttactcagagaaattacaccgagtattggtccgggtctaattccggcaatcagaagatggaagcagtccagaaaattaactacaccgtgccgcagtcgggtacgttcaagatcgagtttccaatactggaagatagcagcgagttacaactcaaagcctattttctcggcagtaaatcctcaatggctgttcacagtctttttaaaagcccatccaaaacatatatccagttaaagaccagagacgagaacattaaagtgggctcaccttttgagcttgtggtctctggcaataaacgcctgaaagaactctcctacatggtggtttcccgcgggcagctggtggctgtcgggaagcaaaatagcaccatgttcagcctcactccagagaactcctggacccccaaagcgtgtgtgatagtatattacattgaagacgacggcgaaataatctccgacgtgttaaaaatccccgtgcagctcgtgtttaagaacaagatcaaactgtattggagcaaagtgaaggccgagccgtcagaaaaggtttcactgaggatatcagtcacacagcccgacagtatcgtcggtatagtggctgtcgacaaatcagtaaatctgatgaatgcctcaaatgatattaccatggagaacgttgtccacgaactggagctgtacaataccgggtattacctcggcatgttcatgaattcatttgcagtcttccaagaatgtgggctgtgggttttgacagatgccaatttgacaaaagattatattgacggcgtttacgataacgcggagtacgctgagaggtttatggaggaaaacgagggtcatatagttgacattcatgacttctcacttggctcttctcctcatgtcaggaagcatttccctgaaacttggatctggctggacaccaatatgggataccggatttaccaggaattcgaggtgaccgtgcctgatagcatcacatcctgggtggcaaccggcttcgtgatctcagaggatctgggtttgggcctcacaacaacacctgtcgaactacaggcttttcaacctttcttcatttttctgaacctcccttacagtgtaatacggggagaggaattcgccctggagatcacaatttttaactacttaaaggatgccacagaggtcaaagtgatcattgaaaagtcggacaaatttgacattctcatgactagcaacgaaatcaacgcgacgggacatcaacagaccctacttgttcctagtgaggacggcgctactgtgctgtttccaatccggccaactcaccttggcgagattcctattactgttactgcgctctcaccaacagccagtgatgccgttacgcagatgatattagtcaaggccgaggggattgagaagtcatactcacagtccattcttctcgatctcacggataatcgcctgcagagtacacttaaaacactcagtttcagttttccccccaatacagtgactggctctgagagggtgcagataacggcaatcggagacgtacttggccccagtatcaatggtctggcaagccttatccgcatgccctatggctgcggcgaacaaaatatgatcaacttcgcccctaatatctatattcttgattacctgaccaaaaagaagcagttgaccgacaatttgaaggagaaagccttgtcctttatgcgccagggctaccagcgggagctcctgtatcaacgagaggacggtagcttcagcgctttcggcaactatgatccatccgggagcacctggttgtcagcctttgttttgagatgctttctggaagccgatccgtacatcgatatagaccagaacgtgctacacagaacatatacgtggctgaaggggcatcaaaaaagtaacggcgagttctgggatcccggcagggtcattcacagcgaactccaagggggaaacaagagccccgtcacactgaccgcctacatcgtaaccagcctattaggttataggaagtaccaaccaaatattgatgtgcaggagtcaattcattttctggagagcgaatttagtagaggtatttccgataactacaccctggccctcattacttacgccctctcatccgtgggatcccccaaagcgaaagaggccctgaacatgcttacctggagggctgaacaagaaggcggaatgcagttttgggtatcatctgaaagcaaactgtctgatagctggcagccaaggagtctggatatcgaagttgctgcctacgcgttgttatcccacttcttgcagttccaaactagtgagggcattccaatcatgcgctggctgtcccgacaaaggaacagcctgggtggtttcgccagcactcaggacaccacagtcgctttgaaggccctgagcgaatttgcagcattgatgaataccgagcgcacaaatattcaagtaaccgtgactggaccatcctcgccgtctcctctggcggtcgttcaaccaaccgccgtgaatattagcgctaacggttttggctttgcaatttgtcagctgaatgtcgtttacaacgttaaggcctcgggaagcagtcggcggcggaggagtatccaaaaccaggaagcattcgaccttgacgtggccgtaaaagaaaacaaggacgatctgaaccacgtagatttgaacgtgtgcacaagcttctccggccctgggaggagtgggatggcactgatggaggtaaacctgctgtctgggttcatggtgccatcagaggctattagtctcagcgaaacagttaagaaggttgagtatgatcatggcaaactgaatctctatctggacagcgtaaatgaaacacaattttgcgtcaatatccccgccgtacggaattttaaagtgtctaatacacaggatgcctcggtttctattgttgattactatgaaccgaggaggcaagcagttagatcatataattctgaagtgaaactctcttcatgtgatctatgttccgatgtgcagggttgtagaccctgtgaggacggcgcctccgggtctcaccaccattctagcgtaatattcatattttgtttcaagctcctatattttatggagctctggttgtag

SEQ ID NO: 111233 - DNA, 762 bp, Artificial Sequence
  Description of Artificial Sequence: Synthetic coding sequence
atgggagagtttaacgaaaaaaagaccacatgcggtacggtgtgtttgaaatatctgctgtttacgtacaactgctgcttctggctggccggactcgctgttatggctgtgggaatctggaccctcgccctgaagtctgattacatcagcctcctggcaagcggtacttatctcgccacagcttatatcctggtcgtagctggaactgtcgtgatggttacaggcgtcctggggtgctgtgcgaccttcaaagagcgccggaacctactccgactgtatttcatcctcctgttaattatcttcttacttgagatcattgctgggattttagcttacgcttattatcagcaactaaacacggaattgaaagaaaacctgaaggacaccatgactaagagatatcatcagccaggtcacgaagccgtgacttccgccgtggatcagttgcaacaagagtttcattgctgtggaagcaacaactctcaagattggcgggacagcgagtggatccgttcacaggaggcgggtgggagggtggttcctgattcatgttgtaagactgttgtcgcactttgcgggcagcgggatcacgcgtcaaatatctataaggtggaaggaggttgcattactaagcttgagactttcatccaggaacacctgcgtgtgatcggcgcagtcggcatcggaattgcttgcgttcaggtattcggaatgatattcacctgttgtctatatcgatctctgaagcttgaacactactag

SEQ ID NO: 111234 - DNA, 762 bp, Artificial Sequence
  Description of Artificial Sequence: Synthetic coding sequence
atgggagaattcaatgagaagaagacgacctgcggaacagtatgtctcaagtatctgttatttacctacaactgttgtttctggcttgccgggctcgctgtaatggcagtgggtatatggactctggcgctcaaatctgattatatttccctgctggccagtggaacctatctcgcaaccgcgtatattcttgtggtggctggtactgttgtcatggtgacaggagttctcgggtgttgcgccacattcaaagaaagacggaatctgctgcgcctgtatttcattctgctgcttataatctttctcttagaaattattgcaggtattctcgcctacgcgtactaccaacaacttaacacagagctgaaagaaaacctgaaagatacgatgaccaaaagataccaccagcctggtcatgaagcagttactagtgccgtcgatcagctccagcaggaattccactgttgtggctcgaataacagccaggactggcgtgattcagaatggatcagatctcaagaggctggcggacgagtggtgccagactcctgttgcaagaccgtggtggctctctgtggccagcgggatcacgcttctaacatttataaagttgagggcgggtgcatcacaaagctagagacgttcatccaggagcatctgcgcgtaattggtgctgtgggaataggcatcgcttgtgtacaggtgttcgggatgatttttacctgttgcttgtatagatctttgaagcttgagcactattag

SEQ ID NO: 111235 - DNA, 762 bp, Artificial Sequence
  Description of Artificial Sequence: Synthetic coding sequence
atgggggagttcaacgagaaaaagaccacttgtggcacagtgtgtctgaagtaccttctattcacgtacaattgttgtttctggctggctggactggccgttatggctgtggggatatggactttggcattaaaaagcgactatatatcgctgctcgcctccggtacctacctcgctacggcatacatcctggtggttgcaggcacagttgttatggtgaccggggttctcgggtgttgtgctacttttaaagagcggagaaatcttctccgcctgtactttattttgctgctaatcatctttctgctcgagatcattgctggaatactggcatacgcttactaccagcaactgaacacagagctcaaagaaaatctaaaggataccatgacaaagaggtatcaccagcctgggcatgaagcagtgacctccgcagtcgaccagctccaacaagaatttcactgctgtggtagtaataattcacaggattggcgcgactcggagtggatccggtcccaggaggcaggtggccgggtggtgccagattcttgttgtaaaacagtggtcgctctatgcgggcagcgagatcacgcatcaaacatctataaagttgagggcggatgcatcacaaaattagagacatttattcaggagcatctgcgggtgataggagcagttggcataggaattgcttgtgtgcaggtgtttggcatgatttttacatgctgtctgtatcgctcactgaagttggagcactactag

SEQ ID NO: 111236 - DNA, 543 bp, Artificial Sequence
  Description of Artificial Sequence: Synthetic coding sequence
atgggtgagttcaatgagaaaaagactacttgtggcaccgtgtgcttgaagtatctcctgtttacttacaattgttgcttttggttagcaggcctcgctgtgatggctgtgggtatctggacccttgccctgaagagcgattatataagccttctcgctagcgggacgtatttagcaaccgcttacatactggtggtggcagggacagtcgtgatggtaaccggagtgttgggctgctgcgccaccttcaaagagagacggaaccttttgcgactatactttatactgttactcattatcttccttctcgagattatcgccgggattctagcctatgcttactaccagcagcttaacacggagctcaaggaaaacctgaaagataccatgactaagcgttatcatcagcccggccacgaggccgtcacaagtgcggttgatcagctccagcaggaattccattgctgcggatctaataatagccaggactggagggatagcgagtggattaggagccaagaggctggggggagggtggtgtag

SEQ ID NO: 111237 - DNA, 240 bp, Artificial Sequence
  Description of Artificial Sequence: Synthetic coding sequence
atgggtgaattcaacgagaagaagaccacttgcggcacagtatgtcttaaataccttctgtttacatacaactgctgtttctggctggccgggctggccgtgatggccgtggggatatggaccctggcactcaagagcgactacattagcttgttggcctcagggacctatctagccacagcgtacatactggtcgttgcgggaactgtggtaatggtgaccggtgtactgggctgttag

SEQ ID NO: 111238 - DNA, 279 bp, Artificial Sequence
  Description of Artificial Sequence: Synthetic coding sequence
atgggagagtttaacgagaaaaaaacaacatgtggaactgtgtgtctgaaatatctgctgttcacctacaattgctgcttctggctcgcaggactcgctgtcatggcagtggggatctggactctcgcacttaagtcagactacatctccctgctagccagcggtacatacctggccactgcttatatccttgtggtagcaggtaccgtcgtaatggtgactggggtcttggggtgctgcgcgacattcaaagaaagaaggaacctcctgcgcctgtag

SEQ ID NO: 111239 - DNA, 198 bp, Artificial Sequence
  Description of Artificial Sequence: Synthetic coding sequence
atgggtgaatttaacgaaaaaaagaccacctgtggcacagtgtgtcttaagtatcttttattcacatataattgttgcttttggctggctggactggcagtcatggctgtcgggatctggacgcttgcactcaaatccgattatatctctctactggcttccggcacttatttagcaaccgcctacattctggtttag

SEQ ID NO: 111240 - DNA, 531 bp, Artificial Sequence
  Description of Artificial Sequence: Synthetic coding sequence
atgggcgaattcaacgagaagaagacgacttgcggcactgtttgtctcaaatatctgttgtttacatacaactgctgtttttggttggcgggcctggcagtgatggccgtgggtatctggacgctggccctcaaaagcgactacatatccctgcttgcgtcgggtacataccttgctactgcttatatactggtggttgcaggaactgtggtgatggtgacgggtgttctcggctgctgcgccaccttcaaagagcgcaggaacctcttgaggctctattttatcctattgctgataatcttcctcctggagatcatagccgggatcttggcctatgcatactaccagcaactcaatactgaactgaaggagaacttaaaggataccatgaccaagcggtatcaccagcccggtcatgaggccgtaacatcagcagtggaccagctccagcaagaatttcactgctgtggctccaacaattcccaggattggcgggatagtgagtggattcgctcacaggaagctggctag

SEQ ID NO: 111241 - DNA, 543 bp, Artificial Sequence
  Description of Artificial Sequence: Synthetic coding sequence
atgggagaatttaacgagaaaaagaccacctgcgggaccgtgtgcctgaaatacctcctttttacgtacaattgttgtttttggctcgctggactggctgttatggctgtggggatttggacactagctctgaaaagcgactatatctccctgctcgcttcaggcacctatcttgcaactgcttatatactggtcgtggctggcaccgtggttatggtcactggagtactcggctgttgtgccacatttaaagagcgtaggaacttattacgtttgtattttatcctcctgctgataattttcctcctggaaatcattgcaggcatcctggcttacgcatattatcagcagctgaacacagagttgaaggaaaacctgaaggatactatgacgaagcgctaccatcagcctggacatgaggcagttacctccgctgtggaccaactccagcaggaatttcactgttgtggctcaaacaattcgcaggactggcgggattccgagtggattaggtctcaagaggccgggggcagagttgtgtag

SEQ ID NO: 111242 - DNA, 273 bp, Artificial Sequence
  Description of Artificial Sequence: Synthetic coding sequence
atgggggaattcaatgaaaaaaagacgacatgcggaaccgtgtgtttgaaatatttgctgttcacttacaattgctgcttttggctggccggcctggccgtcatggctgtgggcatctggacgttggctcttaagtctgattacatcagcctgctggcatcaggaacctacctggccacagcttacattctagtggttgctgggaccgtggtgatggttaccggggtcctagggtgctgcgccaccttcaaagaacgcaggaacctactatag

SEQ ID NO: 111243 - DNA, 513 bp, Artificial Sequence
  Description of Artificial Sequence: Synthetic coding sequence
atgggagaattcaacgaaaaaaagaccacctgtggtacggtatgcctcaagtatctcttgttcacttataactgctgcttttggctggccgggctggcggtaatggctgtgggtatctggaccctggcactcaaatctgattatatatctctcctggccagcggcacatatctggctaccgcatacatcctggtggtggctggtacggtggtgatggtgactggggtgctgggctgttgcgccacttttaaggagagacggaatctgctgagactgtactttattctgcttctcatcatttttctactggagatcatcgccggcatcctggcttatgcttattatcagcagcttaatacagaacttaaggagaacctgaaggacacaatgacaaaacgctaccatcagcccgggcacgaggcagtcacaagtgcagtagaccagctgcaacaggagttccactgctgcggcagcaacaattctcaggattggcgggatagtgagtggatttag

SEQ ID NO: 111244 - DNA, 762 bp, Artificial Sequence
  Description of Artificial Sequence: Synthetic coding sequence
atgggcgaatttaacgaaaaaaagacgacctgcggaacagtttgcctgaagtatttattgttcacatataactgttgtttctggctggcaggactggccgtgatggccgtagggatctggaccctggccctcaaatcagattacattagcttgttggcatcaggaacctacctggcaacagcatacatcctggtggttgcagggaccgtggtgatggtcacgggagtactcggatgttgtgccacattcaaggagaggaggaacctgctgagactctactttatcctcttgctcataatattcctccttgagataatagccggaatcctcgcctatgcatattatcagcaactgaataccgaactgaaagagaacttgaaggacacgatgacaaagcggtaccaccagcctggtcatgaagctgtcaccagtgccgtcgatcagttgcagcaggagtttcattgttgcggcagcaacaattctcaggactggagagattcagagtggatcaggtcccaggaagccgggggtcgcgttgtgccagactcctgttgtaagactgtggtggccctgtgtggacagcgcgaccatgccagcaatatttacaaggtggagggaggatgtatcactaaattggagacgttcatccaggagcaccttagagtgatcggagctgtgggaatcgggatcgcttgcgtccaagtcttcggtatgatttttacgtgttgcttgtaccgcagcctgaagctcgagcattactag

SEQ ID NO: 111245 - DNA, 3471 bp, Artificial Sequence
  Description of Artificial Sequence: Synthetic coding sequence
atgtcgaaattgaggatggtgctactggaggactctggatccgcagactttcgacgccatttcgtaaacctgagcccgtttacgatcaccgtggttctgctgctctccgcctgctttgtgacgtcctctttggggggtactgataaagaactgagactagtggatggcgagaacaagtgctccggccgggtggaagtgaaagtgcaggaagaatgggggacagtgtgtaacaacgggtggagcatggaagcagtttctgttatctgcaaccagctgggatgtcccacagcaataaaggctcccggctgggctaattcaagcgctggttctggcaggatatggatggaccacgtgagttgcagaggcaatgaatccgccctttgggactgcaaacacgatggatggggtaagcactctaactgtacccaccaacaggacgcaggagttacttgtagcgacggctcgaacctggaaatgcggcttacacgtggtgggaatatgtgcagcggccgcattgaaataaaatttcaagggcgctggggtacagtgtgcgatgacaacttcaacatcgaccatgcttccgtcatctgcagacaactcgaatgcggctccgcagtctccttcagcggaagcagtaattttggtgaagggagcggccctatctggtttgacgatctgatctgcaatgggaacgagtccgccctctggaattgcaaacatcagggatgggggaagcataactgcgatcacgcggaggacgccggcgtcatttgctctaagggcgcggatctctccctgcggctcgtcgacggggtgaccgaatgcagtggaagactggaggtccgatttcagggcgagtggggtacaatctgtgacgacggttgggatagctacgacgctgcagttgcttgcaaacagctggggtgtcctaccgctgtgaccgccattggacgggttaatgcaagcaagggtttcggccacatttggctggactccgtctcctgccagggacacgagcctgcaatctggcagtgcaagcaccatgaatggggaaaacactattgtaaccacaacgaagatgctggtgtaacctgctctgacggttccgacctcgaactgcgtctgagaggagggggaagccgctgcgccggaacagtggaagtggagattcagaggctgcttgggaaagtgtgtgatcgaggctggggcctgaaagaggctgacgtggtctgccggcagctgggctgcggcagtgccttgaagaccagttaccaggtgtactccaagatccaagctactaatacctggctgttcctcagctcttgtaatggcaatgagaccagcctctgggactgtaagaattggcagtggggaggccttacctgcgaccattatgaagaagcgaagattacctgtagcgcgcaccgagagcctcggcttgttggtggagacatcccttgttctggacgagtggaggtaaagcacggtgatacttggggctcaatctgcgacagcgacttttcattggaggccgcatctgtcctgtgcagggaactccagtgtgggactgtggtgagcatcttgggcggtgctcactttggcgagggcaacggacagatctgggccgaggaattccagtgtgaaggccatgaatcccacctgtccctttgcccagtagccccacgccctgagggtacatgctcccacagcagggatgtcggtgtagtgtgcagccggtacacagagattagactcgtgaacggcaagaccccctgtgagggacgtgtcgagctcaagacattaggggcttggggatcactctgtaacagccactgggacatcgaggacgctcacgtgctgtgccaacaacttaaatgcggggtcgccttgagcactccaggaggcgccaggttcgggaaaggcaacgggcagatttggcggcacatgtttcattgcaccggtaccgagcagcatatgggcgattgtcctgtcacagctttgggagcctctctgtgccctagcgagcaagtcgcctctgtaatttgttctggtaatcaatctcagactttgagttcatgtaacagctcctccctcggtcccacacgcccaaccataccagaggagtccgcagtcgcctgcattgagtctgggcagctgcgcctagtgaacggcgggggccgatgcgccgggcgggtcgaaatctaccacgaaggcagctggggaacgatctgtgatgactcatgggacttatccgacgcccacgtggtctgccgtcagcttgggtgcggtgaggccataaacgccacaggatccgcgcacttcggggagggtaccgggcccatttggctggacgaaatgaagtgtaacggtaaggagtctagaatctggcagtgccacagccacggatggggccagcaaaactgtaggcacaaagaggacgcgggcgttatctgttctgagttcatgagtcttcggctgaccagcgaagcgagccgagaagcctgtgctggtcggctggaggtgttttacaatggagcttggggaactgtcggcaaatcctccatgtccgagaccaccgtgggtgtggtgtgtcgccagcttggttgcgcagataaggggaaaattaacccagcctcactcgataaggccatgagtatacccatgtgggttgataatgttcaatgtcccaagggacccgacactttgtggcagtgtccgtcctcgccatgggagaagcgtcttgcctccccgtccgaagagacatggataacttgcgataacaaaatacggcttcaagagggcccaactagttgttccggtcgtgtggagatttggcacggcggcagctggggaacagtctgcgacgactcctgggatttggacgatgcccaggtggtctgccaacaactgggttgcggacctgccttaaaagctttcaaggaagctgagttcggacaaggaactggccctatatggctgaacgaggtcaagtgcaagggcaacgaaagctctttgtgggattgtcctgctcgccgatggggccactctgagtgtggccataaagaggacgctgccgtgaactgtactgacatcagtgtgcagaagacgcctcagaaagctacgacaggtaggagcagcaggcaatcctcttttattgctgtcggcatcctaggagtcgtgcttctggcgatcttcgtcgcactttttttccttacaaaaaaacgcagacaacgtcaacgcttggctgtgtccagccgaggcgaaaatctcgtccaccaaattcaatatagagagatgaatagctgcctcaacgcggacgaccttgacctgatgaatagctccgaaaactcacatgagagtgctgattttagtgcagccgagcttatctcagtgagtaaatttctcccaatcagtggcatggagaaggaggcaattttatctcatacagagaaagagaatgggaacttgtag

SEQ ID NO: 111246 - DNA, 3465 bp, Artificial Sequence
  Description of Artificial Sequence: Synthetic coding sequence
atgtcaaagctgcggatggtgctgcttgaggatagcgggagtgctgattttcgtagacactttgtcaacctatccccctttactattacggtggtactgctgctctcagcctgttttgttacaagctcacttggcgggacagacaaggagctgcgcttggtggatggcgagaacaaatgcagcggacgagtcgaagtaaaggtacaagaggaatggggaactgtctgtaacaatggctggagcatggaggccgtgagcgtgatatgcaaccaattaggctgccctaccgcaattaaagccccaggatgggccaatagctccgcgggatccggccgaatttggatggaccatgtctcctgcagggggaatgaatctgccctctgggactgcaagcatgatggttgggggaagcacagcaactgtacacatcagcaggacgccggagtgacgtgcagcgacgggtcaaatctcgaaatgcgcctgacgagaggagggaacatgtgctctggtcgcattgagataaagtttcaaggccggtggggcacggtttgcgatgacaactttaacatagatcacgcctctgttatctgtcggcaactcgagtgcggctctgcggtctctttctctggttccagcaacttcggggagggatccgggccgatttggttcgatgatctgatatgtaatgggaacgaatccgcgctttggaactgcaaacatcaaggatgggggaagcacaattgcgaccatgctgaggacgcaggcgtaatctgtagtaaaggggccgacctttcgttaagactcgtcgatggagtaactgaatgctccggaaggctggaggtcaggtttcaaggagagtggggcaccatttgtgatgatggttgggatagttacgatgctgctgttgcctgcaagcagcttggctgtcctacagctgtcactgcaatcggccgcgttaacgccagtaagggcttcggacatatttggctggattccgtttcctgtcaagggcacgaaccagcaatctggcagtgcaaacaccacgaatggggcaaacattattgcaatcataatgaggatgctggtgtgacttgtagtgatgggtcagacctggaactaagattgaggggagggggatcccgatgcgcgggtacggtggaggtcgaaatacagagactattgggtaaagtttgcgacagaggatggggccttaaggaggcggacgtcgtatgccgacaactcgggtgtggctctgcactgaagacatcatatcaggtgtacagtaagatccaggcaactaatacctggttgtttctgtccagctgtaatggcaacgaaacctccctgtgggactgcaagaattggcagtggggaggactgacatgtgaccattacgaggaggccaagataacatgcagcgctcatcgggagcccaggctcgtgggcggagacatcccatgctccggccgtgtggaggtcaagcacggcgatacttgggggtccatatgtgattccgattttagcctcgaggcagccagtgtcctatgtcgagagctgcagtgtggcaccgtggtctcaatcttgggaggcgcacactttggggaggggaacggccaaatttgggcagaagaattccaatgcgaaggccatgaatctcacctgtccctgtgtcccgtggctccccgcccagaaggaacttgttcacatagccgcgacgttggggtagtatgtagtagcaaaactcagaagacatctctgatcggtagccacactgtcaagggcacgggattgggatcccacagctgcctcttccttaagccatgcctgttgcccggctataccgaaatcagattggttaatggcaaaacaccttgtgagggccgggtggagcttaagactctaggagcttggggctctctatgcaacagtcactgggacatcgaggatgcccacgtgctgtgtcagcaactgaaatgcggggtggctctgagcacacctggcggtgctcggtttggcaagggaaacggtcagatctggcggcatatgttccattgcactgggactgaacagcacatgggcgactgccccgtcactgctctgggcgcctccctatgcccatctgagcaggttgccagcgtcatatgtagcggaaaccaaagccaaacgctgtcaagctgcaacagcagttctctgggccctacaaggccaaccatcccagaggagtcagccgtggcctgcatagagtccggccaactgcgactggtcaatggcggcggaaggtgtgccggaagagtggagatttaccacgaaggatcatggggaactatctgcgatgactcatgggacctgtctgacgctcacgttgtgtgccggcagctgggctgcggggaagctatcaacgcaacgggttcagcgcattttggagagggaaccgggccaatttggctagacgaaatgaaatgcaacggaaaggagagtcggatttggcagtgtcactcacatggttggggtcagcaaaattgccgacacaaggaagatgcaggggtgatttgcagtgaatttatgtcactcaggctgacaagcgaggcgagccgcgaagcatgcgccggaagacttgaggtgttctacaatggggcatgggggaccgttgggaaaagctccatgagtgagaccactgtgggagtggtctgccgacaactcggctgtgccgacaaggggaagataaatcccgcgtccctggataaggcaatgagtattcctatgtgggtggataacgtgcagtgccctaaaggtcctgatactttatggcagtgtcccagcagtccctgggaaaagcggctggcgagtccaagtgaagaaacatggataacgtgcgataacaagattcggctccaggaggggcccacaagctgcagtggtcgcgtagaaatctggcatggaggttcttggggcaccgtgtgcgacgactcctgggacctggacgacgctcaggtcgtctgccagcaactaggatgcggacccgcactaaaggcttttaaggaggcggagtttgggcagggtactggcccaatctggctcaacgaggtgaagtgcaagggaaatgagtcgtcactctgggactgccctgcccggcggtggggccactcagaatgcggccacaaggaagacgctgctgtgaactgtactgacatctccgtccagaagacacctcagaaagctactactggccggagcagtcggcagtctagcttcattgctgtgggcatactaggggtggtgcttctggcaatctttgtggcgctgttcttcctcaccaagaaacgccgtcaacggcaacgcctcgccgtttcttctaggggagaaaatctagtgcatcagatacagtacagagaaatgaatagttgtctgaatgctgacgacctggacctgatgaattcatcaggcggccatagcgagccacattag

SEQ ID NO: 111247 - DNA, 3366 bp, Artificial Sequence
  Description of Artificial Sequence: Synthetic coding sequence
atgtctaaactcaggatggttctactggaggactctggttccgccgactttagacgccacttcgtgaatctgtcccctttcacaataacggtcgttttgttgcttagtgcgtgtttcgtcactagctctctgggcggcacagataaagaactgcgactggtggatggtgaaaacaagtgttctggtcgcgtggaagtcaaagtgcaagaggaatgggggactgtgtgcaataatggctggagtatggaagcagtctccgttatctgtaaccagttgggttgccccacggctatcaaagcccccgggtgggccaactcaagcgccgggagcggcagaatctggatggatcatgtgagttgccgagggaatgaatcagccctgtgggattgtaaacacgatggttggggtaagcactccaattgcactcaccagcaggacgcaggagtcacctgcagcgacgggtccaatctggagatgcgccttaccaggggtggaaacatgtgttcaggacggatcgaaattaagttccagggccgctggggtaccgtatgcgatgataacttcaacattgatcacgcctcagtaatctgtaggcaacttgagtgtggctctgctgtgagcttctcaggtagctcaaatttcggagagggaagtggtccaatatggttcgatgacctcatttgcaatgggaatgagagcgcactgtggaactgtaaacatcagggctgggggaaacacaactgcgaccacgctgaagacgcaggtgtgatctgtagtaagggagccgatctgtccctccggctggtggatggtgtgacagagtgttcgggcagattagaggtgagatttcagggcgagtggggtaccatctgtgatgatggctgggacagctacgatgccgctgtcgcctgcaaacagttgggctgcccaactgccgttactgcaataggacgggttaatgcaagcaagggattcgggcatatttggctggacagcgtcagctgtcagggtcatgaacccgctatctggcaatgtaagcatcatgaatgggggaaacactattgcaaccataatgaggatgccggagtaacgtgctcagatgggtctgatctcgagctgcgactccggggggggggttctcggtgtgcgggaacagtcgaggtggagattcaaaggctgttgggaaaggtctgcgacagaggatggggcctgaaagaggcagacgtagtctgcaggcagctgggttgcggcagtgctctcaagacatcctatcaagtatacagtaagatccaagccaccaacacttggctgtttttgagctcctgcaatggaaatgagacctcactgtgggactgcaagaattggcagtggggtggactcacctgtgatcattatgaggaggcaaaaattacatgctcagcccatagggagccaaggctggttggtggagacatcccttgttccgggagagttgaggtgaagcacggtgacacctggggttccatttgcgattcagacttcagcctggaggctgcaagcgtgttatgccgcgaattacaatgtggaactgttgtttctatcctaggaggagcgcacttcggagaaggaaatggccagatatgggcggaagagttccaatgcgaggggcacgaaagccacctttccctctgtcctgtggcgcccaggccagaagggacatgttcccactctagagacgtgggcgtggtatgtagtaggtacacggagatcagactagtcaatggtaagaccccttgcgagggcagagttgagctgaagactcttggagcatggggcagtctgtgcaactcacattgggacattgaggacgcacacgtcctctgccagcagttaaaatgtggagttgccctgtccactcccggcggtgcacggtttgggaaagggaacgggcagatatggcgccacatgttccactgtacaggaactgagcagcacatgggggactgcccagtaaccgccttaggagccagtctttgccccagcgaacaggttgccagcgtaatttgttcaggaaaccagtcacagacactgtcttcatgtaattcttcatccctgggcccaacgcgacccacgatacctgaggaaagcgctgtcgcctgtattgagtccggacagctgagactagttaatggcggcgggcgctgcgctggcagggtggagatttatcacgagggcagttggggtaccatttgtgacgattcatgggatctcagtgacgcccatgttgtgtgtcggcagttaggctgtggggaggcaatcaacgctactggctcagcccactttggtgagggcactggcccgatttggctggatgaaatgaaatgcaatggtaaagagtctcgcatctggcagtgccactcccatggctgggggcagcagaattgtcgacacaaggaggatgctggggttatttgtagtgaatttatgagtctgagactcacaagcgaggcctccagagaagcctgtgccgggagacttgaggtgttctacaatggggcctggggcaccgtggggaaatcttctatgagcgagactacagtgggagtggtttgccggcaactcgggtgcgctgacaaaggaaaaattaatccagcctcactggataaggctatgtcaatcccaatgtgggtggacaacgtacagtgcccaaagggacctgacacgctctggcaatgcccctcctccccttgggaaaaaaggctggcctcaccctctgaggaaacctggatcacatgtgataataagatccggctgcaggaaggacccactagctgttctggacgcgtcgagatctggcacggtgggtcatgggggacagtgtgcgatgactcttgggaccttgacgacgctcaggtggtttgtcagcagttgggctgtgggccagccctcaaggctttcaaggaggccgagttcggccagggcaccggacctatttggctcaacgaagtcaagtgtaagggaaatgagtcctcactgtgggattgccccgctaggagatggggccatagtgagtgcggtcacaaagaagatgccgccgttaattgcacagatatttccgtgcagaaaactccccagaaagcaactactggtcgcagcagtagacagtcgtcatttattgcagtcggtattcttggggttgtcctactggctatatttgtggccctttttttcctcacaaagaagcgcaggcagcgccagcgcctggccgtgtcttccagaggcgagaacttggtccatcagatccagtatcgggagatgaactcctgcttaaatgccgatgacctggacctgatgaattcaagtggaggtcactccgagccgcactag

SEQ ID NO: 111248 - DNA, 555 bp, Artificial Sequence
  Description of Artificial Sequence: Synthetic coding sequence
atgtccaggttatcaaggtcactgctgtgggctgccacctgtttgggagtgctgtgcgtacttagtgcggataaaaacacaacccaacatccaaatgtgaccactctcgcccccatttctaatgtcacatccgccccggtgactagcctgcccttggttaccaccccagcccccgagacatgtgagggacgaaactcttgtgtctcttgtttcaacgtgtccgtcgtcaacactacctgcttctggatcgagtgtaaggatgagagctactgcagccataattctaccgtctctgattgtcaagtcgggaatactacagatttttgttcggccaagcccacagtgcagcctagccccagcaccaccagcaagacagtcacgacatcagggactactaacaatactgtaaccccaacgagtcagcccgttcgcaagagcacttttgatgccgcatccttcatcggcggaatcgtcctggtgctgggtgtgcaggctgttatcttcttcctgtataagttctgcaagtctaaggagaggaattaccacactttgtag

SEQ ID NO: 111249 - DNA, 594 bp, Artificial Sequence
  Description of Artificial Sequence: Synthetic coding sequence
atgtcccgcctgtctcggtctctgttatgggcggccacttgcctgggggttttgtgtgttctttctgcagacaaaaatactactcaacacccgaatgtcactacgttagccccgatctcaaatgtgacgtcagcccccgtgacttctctgcctcttgtgaccactcccgctcccgagacctgtgaagggcgcaactcctgcgtgtcttgctttaatgtttccgttgtgaataccacatgcttctggatcgagtgcaaggacgagtcttactgcagccataatagcaccgtgtcggattgtcaggttgggaatacaaccgatttctgttcggtgtccaccgcgacccccgtgcccactgcaaattcaaccgcgaagccgaccgtgcaaccgagccctagcacaacttccaaaaccgtcacgaccagcggtaccactaataatacagtcacccccacttctcagcccgtgcggaaatctacttttgacgccgcgtccttcatcggtggaattgtgctggtgttaggcgtccaagccgtcatcttctttctgtataagttctgcaagagcaaggagcgcaattaccacacactatag

SEQ ID NO: 111250 - DNA, 537 bp, Artificial Sequence
  Description of Artificial Sequence: Synthetic coding sequence
atgagtcgcctctcacgatctctgctctgggccgctacatgcctgggggtcctatgtgtcctcagcgctgataagaacaccactcagcatcccaatgtcaccacacttgcccctatcagcaacgttacctccgccccagtgacatccttacctctggtgactacaccagctccagagacatgcgaaggtaggaacagttgcgtaagctgcttcaacgtcagcgtggttaacacaacttgtttttggatcgaatgtaaagatgagtcctactgcagccataactcgaccgtgagcgactgccaagtggggaacaccacagatttctgtagtgtcagcacggcgacccccgtccccacggccaactccacagggacaacaaacaacacagtgactccaacctctcagccagttagaaaatccacatttgacgccgcctcgtttattggcggtatcgttttggtcctgggggtgcaggcagtcatcttcttcttgtacaaattttgcaagagcaaggaacgtaattaccatacgttatag

SEQ ID NO: 111251 - DNA, 498 bp, Artificial Sequence
  Description of Artificial Sequence: Synthetic coding sequence
atgtccagactgtcacgctccttgctgtgggccgcaacttgcctcggggtgctgtgcgttctctcggccgacaagaacactactcagcacccgaacgtgactaccctggcccccatatccaatgtgacatcagcgcccgtgacttctctgcccctggttaccaccccagcccccgaaacttgcgaaggaaggaactcttgcgtgagctgtttcaacgtgagcgtggttaatactacgtgcttctggatcgagtgcaaggacgagtcttattgctctcacaatagtacagtgtctgactgtcaagtgggcaacacgactgatttctgctcaggcaccaccaataatacagtcacacctacttcacagccagtgagaaagtcaacatttgatgccgccagtttcatcggtggcattgtcctcgttctaggtgtgcaggccgtgatcttcttcctgtataagttttgcaagtccaaagaacgcaactaccacacactttag

SEQ ID NO: 111252 - DNA, 570 bp, Artificial Sequence
  Description of Artificial Sequence: Synthetic coding sequence
atgagtaggctctctcgctcgttgctgtgggctgccacatgcctgggtgttctctgcgtattgagcgctgacaaaaacacaactcagcaccccaacgttaccacactagcccccatctcgaatgtcacatcagcgccagtgacaagtcttccgctggttacaactccagcacccgagacatgtgagggcagaaactcttgcgtgtcttgctttaatgtcagcgtggtgaacaccacttgtttctggatcgaatgtaaggacgaaagctattgctcccacaacagcaccgtctctgattgtcaggtcggcaatacgactgacttctgtagtgtgtcgacagcaacgcccgtaccgactgctaattccacagcaaagccgaccgtacagccttcccccagcactacctcaaagacggtcacaacgtcaggtaccactaataacactgtgacgccaacaagccagcccgttcgtaaatccacctttgatgcggctagttttattggcggaattgtcctagttctggagatacgctgtcatacccggaattatatacccgatctgaaaaagtag

SEQ ID NO: 111253 - DNA, 474 bp, Artificial Sequence
  Description of Artificial Sequence: Synthetic coding sequence
atgtctaggttatcccgctcattgttgtgggccgcaacttgtttaggggtcctgtgtgtgctctcagccgataagaataccacacagcatcccaatgtgactacattggccccaatcagcaatgtgacttctgcccccgtcacttccttgcctctagttactacaccagcaccagaaacctgtgagggacgaaatagctgcgtgagctgcttcaatgtgtcagtcgtgaacactacgtgcttttggattgaatgtaaggacgaatcttactgctcccataactctaccgtctctgattgccaagtgggcaataccaccgatttctgctccgtttcaaccgccactccggttcccaccgccaattctactgcaaagcctacagtgcagccatcaccttcgacgacaagcaagaccgttacaacaagtgaaatcagatgtcatacccggaactacattcccgatctcaagaagtag

SEQ ID NO: 111254 - DNA, 747 bp, Artificial Sequence
  Description of Artificial Sequence: Synthetic coding sequence
atgtccgcggtgctgcttctcgctttgctcggctttatcctgccgcttccaggagtgcaagcactactgtgtcagttcggaactgtgcagcacgtgtggaaagtgtctgacctgccaaggcagtggactcctaagaacaccagctgcgattctggactcgggtgtcaggacaccctgatgttaattgagagtgggcctcaggtcagcctggtgctatcaaaaggatgcactgaggctaaggaccaggagccaagagtcacagagcacaggatgggtcctggtttgtcgctgattagttacacatttgtgtgccgccaggaagatttctgtaacaacctcgtgaacagcctcccattatgggcgcctcagccaccagctgacccgggctccctgaggtgtcccgtgtgtctttcaatggagggttgcctggagggaaccacagaggagatctgcccgaagggcactacacactgttacgacggcctgctccgactccgggggggtgggattttttccaaccttagagtccagggttgcatgccacagcccgtgtgcaatctgttgaacggcacccaggaaataggtcccgtgggtatgactgagaattgtgacatgaaggacttcctccagctcaaacccgtgggacttctagaagagcacaacgttggagagaaggagagaggacaaggacagcatcaatgcgtacagctcgattggcagaaaagggctgccactggtattttctag

SEQ ID NO: 111255 - DNA, 438 bp, Artificial Sequence
  Description of Artificial Sequence: Synthetic coding sequence
atgtctgctgtccttctattggcactgctcggttttatcctcccactgcccggcgtccaggcgctgctctgccaattcggaaccgttcaacacgtctggaaggtttctgatcttccgcggcaatggacgccaaagaacactagttgcgattctggactggggtgccaagatactctgatgctgatcgagagtgggcctcaggtgtccttagtgctgtctaagggttgcacggaggccaaggaccaggaacctcgtgtgactgaacaccggatgggcccgggcctgtcattgatcagctacacgtttgtatgtagacaggaagatttttgcaacaacttggtgaatagtcttccactatgggccccccagccacctgccgatccgatgatgggtgccgctgagggccctttcgggaaagcggaacaagttgactcctag

SEQ ID NO: 111256 - DNA, 438 bp, Artificial Sequence
  Description of Artificial Sequence: Synthetic coding sequence
atgagcgcagtgttactgctcgcgttgttgggatttatcctgcccctgcctggagtacaagctcttctctgccagtttgggactgtgcagcacgtttggaaagtgtcggatctgcctcggcagtggacgccaaaaaatacttcatgcgactctggactcgggtgccaggacaccctgatgcttattgaatccgggccacaggtgtctctcgtcctgagcaaaggttgtacagaggccaaggatcaggagccacgagtgacagaacacagaatgggtccaggactaagcctgatatcctatacatttgtgtgcagacaagaagacttctgtaacaacctggttaattcactccctctgtgggccccacagccaccggctgatcccatgatgggggcagccgaaggcccattcgggaaagctgaacaagtggatagttag

SEQ ID NO: 111257 - DNA, 1671 bp, Artificial Sequence
  Description of Artificial Sequence: Synthetic coding sequence
atgcctccaccacgccttttgttcttcctgctgtttctgacccccatggaggtgagacccgaagaaccactcgtggtgaaggtcgaagaaggggacaacgccgtcctgcagtgcctgaaggggactagtgacggccctactcagcagttaacttggtcccgtgaatcaccccttaagcccttcctgaagctgtcacttgggctgcccggactgggcatccacatgcggccgcttgccatatggcttttcatctttaatgtgagccagcaaatggggggtttctacctgtgccagccaggaccaccctccgaaaaagcatggcagccgggttggacagtgaatgtagagggcagcggagagctgtttcgttggaatgtgtccgacttaggcggactggggtgcggcctgaagaataggtcctctgagggtccttcttcccctagtggaaaattaatgagtccaaaattatacgtgtgggccaaggacaggcctgaaatctgggagggggagccaccctgtctgcccccccgggactctcttaatcagtccctgagtcaggacctgaccatggcaccgggatcaaccctgtggctgtcttgcggcgtgcctcccgacagtgtcagccgcggtcctctaagctggactcatgtgcacccaaagggcccaaagtccctgctgtcactagagctcaaggatgatcgccccgctcgagacatgtgggtgatggaaacgggactgctgctgcccagagctacagcacaggacgccggaaaatactattgccacaggggtaacctgacaatgagcttccacttggagatcaccgcacggccggtcctgtggcactggcttctgaggactgggggctggaaggtatccgccgtgactctcgcttacctcatcttctgcctgtgctccctggttggaattctacacctacagcgcgccctggtgctccggcgtaagcgcaagcggatgactgaccctactcgaagatttttcaaagtgacccccccccccgggtctggccctcaaaatcaatatggcaatgtgctgagcctgcccacaccaaccagtggcctcggccgggcgcaaagatgggctgcaggcttgggcggcaccgccccatcctacgggaacccgtcctcagatgtgcaggccgatggcgccctgggttctcgcagcccgcccggcgtgggccctgaagaagaagagggtgaggggtacgaggagcccgacagtgaagaggactccgaattttacgaaaacgattcaaatcttggacaggatcagctcagccaggatggaagtggatatgagaacccagaagatgaacctttaggaccagaggacgaggattcgttttcaaatgctgaatcttatgagaacgaggatgaagagctgactcagcccgtggcccgtacgatggattttctgagccctcatggctcagcttgggacccatctcgcgaggcgacctctttaggcagtcagtcgtacgaagatatgcgggggatcctgtacgcagcacctcaactgcggagcattcgaggacagccaggacccaaccatgaagaagatgctgactcatatgagaatatggataaccctgatgggcctgatcccgcatggggaggtggtgggcgcatgggtacctggtctaccagatag

SEQ ID NO: 111258 - DNA, 1092 bp, Artificial Sequence
  Description of Artificial Sequence: Synthetic coding sequence
atggaagtcagacccgaggaacctctagttgtaaaggtggaagagggggataacgccgtgctccagtgcctcaagggaacatctgatggacctacccagcagctgacatggtcccgggaatctcccctgaaacccttcctgaaactttcactcggcctgcccggactgggaatccatatgcgacccctgggcaagtattattgtcatagaggcaatttaaccatgtctttccatttagagattaccgcaagacctgttctctggcattggctactgcgaaccgggggctggaaagtgagcgcggttaccctagcctacctgatattctgtttgtgcagtctggtcggaatattacacctgcagcgtgcgctggtcttacgtaggaaacggaagcgaatgacagacccaacaagaagattttttaaagtaacccctccccctggaagtggtccccagaatcagtacggtaatgtactttcactcccaacgcctactagcggacttgggcgggctcagcgctgggccgccggtctcggcggaaccgccccatcttatggaaatccttcatcggatgtccaggctgatggtgccctcggatcccggagccctccaggagtgggtcctgaggaggaggagggcgagggctacgaggagcccgacagcgaagaagactctgagttctacgaaaatgacagcaatctgggccaggaccagttatcacaggatggcagcgggtacgaaaatcctgaggacgagcccctggggccggaggacgaagatagctttagcaacgccgagagttatgaaaacgaagacgaggagctgactcaacccgtggcccgcaccatggacttcttgagcccacacgggtccgcttgggacccaagccgcgaggccacctcattagggtcccagagctatgaagacatgcgggggattctatacgccgcaccccagctgagatccatcagggggcaacccggtccaaaccatgaggaagatgcggactcctacgagaatatggacaaccccgacggacccgacccagcctggggcggcggcggccgcatggggacttggagcactaggtag

SEQ ID NO: 111259 - DNA, 1218 bp, Artificial Sequence
  Description of Artificial Sequence: Synthetic coding sequence
atgagcccaaagctttacgtttgggctaaggatcgaccagagatatgggagggagagccgccatgcctcccaccaagggactccctgaatcagagcttaagtcaagacctgactatggcccctggatccaccctgtggctctcctgtggggtgccccctgactcagtttctagaggcccactgtcttggacccacgtacatcccaaggggccaaaatcactgctgtccctggagctgaaagatgataggcccgcccgggacatgtgggtcatggaaactgggcttcttctacccagggccaccgcccaggacgccgggaaatattattgccatcgaggcaatttgaccatgtctttccacttggaaatcacagccaggcccgttctgtggcattggctcctgagaaccggcgggtggaaggtgtcagccgtaactctggcatacctgattttctgcctttgctctctcgtaggaatcctccatttacagagggcactcgttctgaggcgcaagaggaaacgaatgaccgatcccaccagaagatttttcaaggtgacccccccccccgggtctggaccccaaaaccaatacggcaatgttttaagtttgcccacacctacctctgggctgggccgcgcccagagatgggcggctggcctaggaggaacggccccatcttatggcaacccaagttctgatgttcaagccgatggggctctgggttcccgcagccctccaggggtgggcccagaggaggaagaaggagagggctacgaggagcccgactctgaggaagactctgaattttatgaaaatgatagcaacctaggtcaggaccagctcagtcaggatggctctgggtacgagaatccagaagatgaaccgctgggtcccgaggatgaggacagcttctcgaatgctgagagctatgagaatgaagatgaggaacttacacagcccgtagcacgaaccatggatttcctaagccctcatggatcagcctgggatcctagtagagaggctacttcactggggtcccagtcatatgaggacatgcgtggtattttatatgcagctccacagcttcggagcattcggggccaacctggacccaatcacgaggaggacgctgacagctacgagaacatggataacccagatggtccggatccggcttggggaggaggtgggcgcatgggcacctggagtacccgttag

SEQ ID NO: 111260 - DNA, 1674 bp, Artificial Sequence
  Description of Artificial Sequence: Synthetic coding sequence
atgcctcctcctcggctgctttttttcctcctgtttttgacacctatggaggtgagacctgaggagcctctcgtcgttaaggtagaagagggagacaacgcagtgctccagtgtttaaaggggacctccgacggcccaacacagcagctcacttggtctagggaaagccccctgaaaccattcctgaagctcagcctgggtttgcccggtctgggcatccatatgaggccattggcaatctggctttttatcttcaatgttagccagcagatggggggcttctacctgtgccaaccggggcctccaagcgagaaggcctggcagcccggatggactgtgaacgttgaaggttccggcgaactcttccggtggaacgtttccgatctgggagggttaggctgcgggctcaaaaaccgttcttcagagggccctagttcaccatcggggaagttgatgtctccgaagctgtacgtttgggctaaagatcgccccgagatctgggagggagaaccaccttgcctccccccccgggacagccttaatcagtcactgagccaggatctgacaatggctcctgggtccaccttgtggttgagctgtggagtaccccccgacagtgtgagtagaggcccgctcagctggacccacgtgcatcccaagggtcccaagtcactcctgtcgctggagttaaaagatgaccgcccggcacgcgacatgtgggttatggaaacgggcctacttctgccacgggccacagctcaggacgcgggcaaatattactgtcaccgtggaaacctcacaatgtcctttcacctggagattacagcgcgcccagtgctctggcactggcttttgcgaacgggcggatggaaagtgtcagctgtgactcttgcgtacttgatattctgcctttgttccctcgttggcattctgcacctgcagcgcgctctcgttctgagacggaaaagaaagaggatgaccgatccaacccggcggttctttaaggtcactccaccgccaggatcgggcccacaaaaccagtacggtaacgtgctcagcctacccacacccacctctggtctcggtcgcgcccagaggtgggcggccggactcggaggaactgccccttcttatggtaaccccagcagtgatgtccaggccgatggcgccttgggctcaagaagccctcctggggtgggtccggaggaagaagagggtgagggctatgaggaacctgactcagaagaagattctgaattttacgaaaatgacagcaatctgggacaggatcagctttcccaggatggatcaggatacgagaacccggaggatgaaccgctgggcccagaagacgaagactccttcagtaatgcagagtcttacgaaaacgaggacgaagaactgacacagcctgtggcccgtactatggatttcctgagtccccatggctccgcttgggatccatcccgggaggcaactagtctggctggtagtcagtcgtacgaagatatgagaggtatcctgtatgccgccccccaattaagatccatccgcgggcagccgggccccaaccacgaggaggacgccgatagttacgagaacatggataacccggatggtcctgacccggcgtggggcggcggcggacgtatgggaacttggtctacccgctag

SEQ ID NO: 111261 - DNA, 984 bp, Artificial Sequence
  Description of Artificial Sequence: Synthetic coding sequence
atgctgttcttgctgctgcctcttctggccgtgctcccaggagacggcaatgcagacggactgaaagaaccactctccttccatgtgacctggatcgcatccttttataatcattcatggaagcagaacttggtgagcggctggttgagcgacctgcagacgcacacgtgggactcaaattcctctacaattgtctttctgtgcccttggtctcgaggaaacttttctaacgaggaatggaaggagctggaaacgttattccgaatacgcacaatccggtcctttgaggggattaggcggtacgcccacgaactgcagttcgagtacccttttgaaattcaagtcaccggtggctgcgagctccattccggcaaggtgagtggatcatttctccagctggcttatcaggggtctgactttgtgtccttccagaataatagctggctcccctatccagtggctggcaatatggccaaacatttctgtaaagttctaaatcagaaccagcacgaaaatgacatcacacacaacctgctgtccgacacgtgtcctcgttttatcttgggtctcctggatgcgggcaaagcccacctccagcgtcaggtgaaaccggaagcatggctttcacacggtccatcacctggccccgggcatctgcagttggtgtgtcacgtgagcggcttctacccaaaacctgtgtgggtgatgtggatgaggggagaacaggaacaacagggcacccaacgcggggatatattgccgagtgccgacggcacctggtacctacgagctacacttgaggtggccgccggcgaggccgctgacctatcctgcagggttaaacactcttcactggagggccaggatatagtcctttattgggagcaccattcttccgtaggcttcattatcctagctgttatagttcctctgctcctgctgattgggctggccctctggttccgtaaaagatgcttttgctag

SEQ ID NO: 111262 - DNA, 1002 bp, Artificial Sequence
  Description of Artificial Sequence: Synthetic coding sequence
atgttactcctgccattccagctgctcgctgttttattccccggcggcaattccgagcatgcattccagggccctactagcttccacgtgatccagacatcttcctttactaatagtacatgggcgcagactcagggttctggttggttggacgacctacagatacatggatgggatagtgatagtggaacggcgatattcctgaaaccctggtctaagggaaatttctctgataaggaggtagcggaactcgaagaaatcttccgggtttacatctttggcttcgcccgcgaggtgcaggacttcgctggggatttccaaatgaaataccccttcgaaattcagggcattgcaggctgcgagctccactctggcggggctattgtgagcttcctgaggggagcccttggtggcctcgattttttatctgtcaaaaacgcctcatgcgttccaagtcctgaaggaggaagtagagcacagaagttttgcgcattgataatccagtaccaaggaatcatggagacggttaggattctcctctatgaaacctgtcctaggtatctactcggtgtgttaaacgccggtaaggccgacctccaaaggcaggtaaagccagaggcttggcttagcagcggaccctctccagggcccgggcgcctgcagctggtctgtcatgtcagtggtttttaccccaagcctgtgtgggtgatgtggatgagaggggagcaggagcaacaggggactcagttgggggacatactccctaatgctaattggacgtggtacctaagggctactctcgacgtggcagatggggaagccgctggtcttagctgtagggtcaagcattcctctctggaagggcaggacatcatactgtattggaggaaccccacatcaattggatctatcgtcctagcgatcatcgtgcctagtctgcttctgctgctttgccttgccttgtggtacatgagaagaaggtcctatcagaatataccatag

SEQ ID NO: 111263 - DNA, 741 bp, Artificial Sequence
  Description of Artificial Sequence: Synthetic coding sequence
tgatcctctttcacgaacagcacttgggctcagacacaggggagtggttggctggatgacctacagatccacggttgggactcggattccgggacagcaatcttcctcaaaccgtggtcgaaaggcaacttcagcgacaaagaggtagcggaattggaagaaatttttcgagtatacatttttggcttcgctcgtgaggtgcaggactttgcaggcgattttcagatgaagtaccccttcgagatccagggaatcgccggctgtgagcttcactcagggggagccatcgtctccttccttaggggcgcccttggcggcctcgattttttatctgtgaagaacgcctcctgcgtgccttccccggagggaggcagccgggctcagaagttctgtgccctgatcatccaatatcagggcattatggagaccgtgaggattctgttatatgagacatgccctcgttaccttctgggcgtgctcaatgccggcaaagcagacctgcagcgacaggtgaagcctgaggcttggctgtcctccgggccttcccccggcccaggcaggctccagcttgtttgtcatgtgagcggattctaccccaaacccgtttgggttatgtggatgagggggaaccccacaagcattggttccattgtgctcgccatcatagttccatcccttctgctgctgctgtgtttggcactctggtacatgcgcagaaggtcctatcagaatataccttag

SEQ ID NO: 111264 - DNA, 1041 bp, Artificial Sequence
  Description of Artificial Sequence: Synthetic coding sequence
atgctatttctgcaatttcttctcttagccctgctgctgccaggcggggacaatgcggacgcctctcaggaacatgtgtccttccacgtgattcagattttcagtttcgtgaatcagtcttgggctcggggacagggatcgggctggctcgacgagctgcagacacatggctgggattctgaatccggcacaattattttcctccataattggagcaagggcaactttagcaatgaggagctgtcagatttggagctcctcttccgcttttacctgttcggattgacaagagaaatccaggatcacgcctcccaggattactcgaagtacccttttgaggttcaggtgaaagccgggtgcgagttgcacagtggcaagtctccggagggttttttccaggtagcattcaatgggctggacctgctgtcattccaaaataccacgtgggttccatcccccgggtgcggcagtctggctcagtccgtatgccatctcctgaatcaccagtatgaaggcgtaaccgaaacagtttataatctgatcaggtcaacgtgcccacgctttctgcttggactgctggatgcaggaaagatgtacgtccaccgtcaggtacggcctgaggcttggctgtcatcaagaccatcactgggttcaggccagctcctcctcgtgtgccatgcgtcggggttctaccccaagcctgtctgggttacctggatgcggaatgagcaggaacagctaggaactaagcacggcgacatactgccaaatgctgatggtacctggtatctgcaggttatcctggaagtggccagcgaggagcccgctgggctgagctgtcgagtcagacattcatcactgggagggcaggacatcatactgtattgggcccacatacgcacctcatgtgagaccctccctcctgattctccaatagtgctgcgtacccaacagccaaggtccttggtgcaatatagcgacgctattccatccacgctccacctcaattgcttctccttctgtatcatcaatatctgctag

SEQ ID NO: 111265 - DNA, 1002 bp, Artificial Sequence
  Description of Artificial Sequence: Synthetic coding sequence
atgttgtttctgcaatttctgctcctggccctgctgctgcccggtggcgacaacgctgacgcttctcaggaacacgttagtttccatgtgattcaaatcttttcttttgtaaatcagagttgggcaaggggacagggaagtgggtggctcgatgagctgcagacacatggctgggactccgaatccggtaccatcatcttcctccacaattggtcaaagggtaattttagcaacgaagaactcagtgatctggagcttttattccggttctatttattcggactgactagggaaatccaggaccacgcttcccaggattatagcaagtatccatttgaggtgcaggtcaaagcgggatgcgaactacacagtgggaaatcacccgagggcttcttccaggtggccttcaacggcttggatctactcagtttccagaacaccacttgggttccgtcccccgggtgcggaagcttggctcagtctgtttgccacctgttaaaccaccagtatgagggcgtgaccgaaaccgtctataatttaatccgttctacatgtcctcggttccttctgggactgctggacgctgggaaaatgtatgtccacaggcaagtcaggccagaggcatggctttcaagccggccttcgcttgggtctggtcagctattattggtgtgtcacgccagtggattttatccaaaacccgtatgggtgacctggatgcggaatgagcaggaacaactcgggaccaaacacggcgacattttaccaaacgctgatggaacctggtacctgcaggtcatcctggaggtcgcgtctgaggagccggcgggcctgtcatgcagggtgcggcactcgagtctgggagggcaagacattattctatactggggccaccactttagtatgaactggattgcgctcgtcgttatcgtgccccttgttatcctgattgtcctcgttctctggtttaagaagcactgttcctatcaggacatactgtag

SEQ ID NO: 111266 - DNA, 846 bp, Artificial Sequence
  Description of Artificial Sequence: Synthetic coding sequence
tgatttctccataattggagtaaaggtaacttctctaatgaggagttatcagacttagaactgctgttccgtttctacttgttcggtctaacacgggagatccaagatcatgcctctcaggattactctaaatatccatttgaggtgcaggtgaaggcaggctgcgagctgcatagcgggaaatcacccgaggggttctttcaggttgctttcaacggtctggacctgttatcttttcagaacacgacctgggtgcctagccccggctgcgggagcctagcccagtcagtttgccatctgttaaatcaccagtatgagggagtaaccgagacagtatacaacctcatacgctccacgtgtccacggttcctgttgggcctgctggacgctggtaaaatgtacgtgcaccgacaggtaagaccagaggcttggctgtcctccaggccaagccttgggagtggacagctactgctggtgtgtcatgcatctggcttttatccaaaacccgtgtgggtaacctggatgcggaatgaacaagaacaactgggtaccaagcacggggatatccttcccaatgccgatgggacctggtacctgcaggtaatactcgaggtagcatccgaggagcccgccgggctaagttgccgggtccggcacagctctttggggggccaggacatcatcctgtattgggcacatatccggactagctgcgaaactctgccgcccgactccccgatcgttctgcggacccagcaacctcgttctcttgtccagtatagtgacgcgattccatccacgctgcatttgaattgcttctccttttgcattatcaatatttgttag

SEQ ID NO: 111267 - DNA, 411 bp, Artificial Sequence
  Description of Artificial Sequence: Synthetic coding sequence
atgtatgtgcatcggcaagtgaggccggaggcctggcttagctctaggcccagcctcggttcgggtcagttgttgctagtgtgccacgctagcggattttatcctaaacccgtctgggtcacatggatgcgtaacgagcaggagcaactgggcacgaagcacggagacatcctgccaaacgccgatggcacatggtacttgcaagtgatcctggaggttgccagcgaggaacccgcaggcctgagctgtagagtcagacacagttctctgggcggacaggacattattctctactgggggcatcacttctctatgaactggatcgcgctggtggtcattgttcctctcgtgatactaatcgtcttggttctatggttcaagaaacactgctcttatcaggatatcctgtag

SEQ ID NO: 111268 - DNA, 1008 bp, Artificial Sequence
  Description of Artificial Sequence: Synthetic coding sequence
atggggtgcctgctgttcctgctgttatgggccttacttcaagcctggggcagtgcagaggttcctcagcgtctttttcccctgagatgtctgcagataagtagcttcgcgaactccagctggaccaggacggatgggctggcgtggctgggtgaactgcagacccactcttggagcaacgatagtgataccgttagatcattgaaaccctggtctcaagggaccttctctgaccagcagtgggagactctacagcatatttttcgcgtctaccgatcatcctttaccagagacgtcaaggagttcgcgaaaatgctccggctgtcttatccattggagctccaggtatccgctggctgcgaggttcatccgggtaatgcatccaataatttctttcatgttgccttccaaggcaaggacattctgagtttccaggggacatcctgggagcccacccaggaggccccactgtgggtcaacttggcaatccaagttctgaaccaggataaatggacgagggaaaccgtccagtggctcctgaacggaacgtgccctcaattcgttagcgggctacttgagagcgggaaatcagagctgaagaaacaggtgaagccaaaggcatggcttagtcgtggtccgagccctggacccggcagactccttttagtgtgccacgtgagtggtttctacccaaagcccgtctgggtaaagtggatgaggggcgagcaggaacagcaaggcacacagcccggtgacattttgcccaatgcagatgaaacatggtacttgcgcgccacgctggatgtggtggccggggaggcggccggcctttcatgccgggtcaaacacagctccttggaaggtcaggacattgtattatattggggcggttcttacacctcaatgggcttaattgccctggcggttctggcttgtctgctgtttctcttgatcgtcggtttcaccagtaggttcaaacggcaaaccagttatcagggtgtgctttag

SEQ ID NO: 111269 - DNA, 435 bp, Artificial Sequence
  Description of Artificial Sequence: Synthetic coding sequence
atgctgttgctctttctccttttcgagggcttatgttgtcccggcgagaacaccgccgtaaaaccggaagcgtggctctcatgtggccccagtcccggtcctggccgacttcagttggtctgccacgtgagcggcttttatccaaaacctgtttgggtaatgtggatgcggggcggctattcaatcttcctcatcctgatatgcctcacagtcatcgtcacattggtgatcctggtagtagtggactcacgcctcaagaagcagtccagcaacaagaacattctgagccctcacaccccaagcccagtgttcttgatgggggccaatacacaggataccaaaaactccaggcaccagttttgtctggctcaggtgagctggataaagaatcgcgtattgaaaaaatggaagaccagactcaaccagctctggtag

SEQ ID NO: 111270 - DNA, 696 bp, Artificial Sequence
  Description of Artificial Sequence: Synthetic coding sequence
atgttattgctttttctgttgttcgaaggactgtgctgtcccggggagaacaccgccgcccctcaagccttgcagagctaccatcttgccgctgaggaacaactatcttttagaatgttgcagacatcctctttcgctaaccattcctgggcccacagtgaggggtccggctggctaggggatcttcagacccacgggtgggataccgttttgggaaccattcgattcctaaaaccttggtcccatggaaatttctcaaagcaagagctgaaaaatctgcagagcctgtttcaactttactttcatagctttatacaaattgtgcaggcgtctgctggccaatttcaactggagctgaagccagaggcttggctgagctgtgggccttccccaggacctggaaggcttcagctggtgtgtcacgtgagcgggttctacccaaaaccagtctgggtcatgtggatgcgggggggatactcaatctttctgatactcatctgtttgacagtcatcgttacattagtgatcttggtcgtggttgactctcggcttaaaaaacagtctcccgtcttccttatgggggccaatactcaggacactaaaaactcccgccatcagttctgtctggcccaggtttcttggatcaagaatagggtcttaaaaaaatggaagaccagactaaaccagttgtggtag

SEQ ID NO: 111271 - DNA, 861 bp, Artificial Sequence
  Description of Artificial Sequence: Synthetic coding sequence
atgttgcttttgttcctcctgttcgagggactttgttgtcccggggaaaatactgctgctccccaagctttgcagtcttatcaccttgcagccgaggagcaattgtccttcagaatgttgcaaacttcgtctttcgccaaccactcctgggcccactctgaggggtcgggatggctcggagacctgcaaacacacggatgggacactgtacttggaacaattcggtttcttaaaccctggagccatggcaacttttcaaaacaagagttgaagaacctccagtccctctttcagttatattttcattcattcatacagatcgtccaagcgtcagccggacaatttcagctggaactgaagcccgaagcttggttgtcttgtggaccttctcccgggcccggtcggcttcaattggtttgccacgtgtctgggttttatcctaaacccgtgtgggtcatgtggatgagaggagaacaggagcaaagagggacacaacggggagatgtactcccaaatgcagatgagacatggtacttgcgagctactcttgacgtggcagcgggcgaggccgcgggcctaagttgccgcgtcaagcatagcagtctggggggtcatgatctgattatccattggggcggctactccattttcttgatcttaatatgcttgactgtgatcgtgactctggttattctcgtggtggttgattccagactgaaaaagcagtcccccgtgttcctaatgggcgcaaatacgcaagacaccaagaatagccgccatcagttctgtcttgcccaagtgagctggatcaaaaaccgggttcttaagaaatggaagacccggctgaatcagctgtggtag

SEQ ID NO: 111272 - DNA, 399 bp, Artificial Sequence
  Description of Artificial Sequence: Synthetic coding sequence
atgcttttactgtttttgctttttgagggactgtgctgtccaggtgagaataccgctgtgaagccagaggcgtggctgagttgtggacccagccccgggcccggtaggcttcaactggtctgccatgtgtccggcttctatcctaaaccagtctgggtgatgtggatgcgaggaggctacagcatttttctcatactaatttgccttaccgttatcgtgactctggtgattttagtcgtggtggactcacgtctcaagaaacagtcccctgtgttcctgatgggcgccaatacgcaggatactaagaattccaggcatcaattctgtctggcacaggtctcctggataaagaatcgggtgcttaaaaaatggaaaacacgcctgaaccagctgtggtag

SEQ ID NO: 111273 - DNA, 1131 bp, Artificial Sequence
  Description of Artificial Sequence: Synthetic coding sequence
atgttactcctttttttgctctttgaaggactgtgttgtccgggcgagaacacagccgcaccacaggcgttacaatcataccacctggcggccgaggaacagctctcttttcggatgctgcagacgagctcattcgctaaccactcgtgggcccacagcgaggggtccggctggctgggagacctgcaaacgcacgggtgggacacagtcttgggcacgattcggtttctgaagccgtggtcacacggcaacttctccaagcaagagctgaaaaacctgcagtccctgttccagctgtacttccacagtttcatccagatagttcaggcgtccgccggccagttccagctcgagtaccccttcgagattcaaatcctcgccggatgccggatgaacgccccccagatctttctgaacatggcataccagggctccgatttcctcagtttccagggcatttcatgggagccctcaccaggagcgggaatcagggcacagaacatctgtaaagtgctcaatcgctacttggacataaaagaaattctgcagtcactgctaggccacacctgcccacgtttcttggctggcctcatggaggccggcgagtcggaactgaagagaaaagtgaagcccgaagcctggctgagttgtggaccctctccaggccctggacgactgcagctggtttgtcacgtaagtggcttttaccccaagccagtgtgggtcatgtggatgaggggagagcaggaacagcgggggacacagcggggagatgtgctacccaacgcagacgaaacatggtacttacgcgccacattggatgtagctgcgggggaagcagccgggctgagctgtcgcgtgaagcacagcagcctggggggccacgatctcatcatacactggggcggatattctatatttctcattctgatctgcctgactgttatcgtgaccctggttatcttggtcgtggtcgacagccgcctaaaaaaacagtcccccgtcttcctgatgggggcaaatactcaggatactaaaaattctcggcaccaattttgtttggcccaggttagctggataaaaaatcgggtgttgaagaagtggaaaacaagactgaaccaactctggtag

SEQ ID NO: 111274 - DNA, 873 bp, Artificial Sequence
  Description of Artificial Sequence: Synthetic coding sequence
atgttgcttctttttctgctgttcgaggggctgtgctgccccggggaaaacacagcggctccccaggctctccagagctatcacttggctgctgaggagcaactgagtttccggatgctgcagacaagttcgttcgccaatcactcttgggcccactccgaaggaagtggctggctgggcgacttacagacccacggctgggacaccgtgctaggcaccatacgatttctcaagccttggtctcatggtaatttcagtaagcaggaacttaagaacctccaatctttattccagctatatttccactccttcattcaaatcgtccaggcatctgcgggacagtttcagctcgagtacccatttgagatccagatcttggcagggtgccggatgaacgcgccacaaatttttctgaacatggcttaccaggggtcagacttcctctccttccagggtatctcctgggaacctagcccaggcgccggaatccgagcccagaacatctgcaaggtcctcaatcgttatctcgacataaaagaaatcctgcaatcgctcctgggacatacgtgccctcgattccttgcggggctcatggaagctggggagagcgaactcaaaaggaaagtgaaaccagaggcctggttaagttgtggacccagcccaggacccggcaggctgcagctagtgtgtcatgtgtccggtttttatcctaagccagtctgggttatgtggatgcggggtgaacaggaacagcgaggaacacagcgcggcgatgttctacccaacgccgacgaaacctggtggattttccacctcagccatccggatctgttcgattgtgacagttatcctggccacatcggttgctcatag

SEQ ID NO: 111275 - DNA, 183 bp, Artificial Sequence
  Description of Artificial Sequence: Synthetic coding sequence
taagtctccgggttctatcccaaaccagtgtgggtgatgtggatgcggggtgaacaggagcagagagggacccaaaggggcgacgtgttgcccaacgcagatgaaacgtggtggatcttccatttgtcgcatccagacctattcgactgtgatagctaccctggacacatcggctgtagctag

SEQ ID NO: 111276 - DNA, 966 bp, Artificial Sequence
  Description of Artificial Sequence: Synthetic coding sequence
atgcttttgctttttctgctttttgaagggctatgctgtcccggggagaacacagccgcgcctcaagctctccagagttaccatctggccgctgaggaacaactttctttcagaatgcttcagacctcatcattcgcgaaccatagttgggctcatagcgagggttcaggctggctaggggacctgcagacacacggttgggataccgtcctggggaccatcaggtttctgaaaccttggagccatggcaatttcagcaagcaggagctgaagaacctgcagtccttgttccagctgtacttccacagctttattcagatcgtccaggctagcgctggacagttccaactcgagtacccctttgaaattcagattctggcggggtgcaggatgaatgctccgcagatttttttaaatatggcctatcaggggtccgatttcctcagttttcaaggaatatcatgggagccgagtcccggggccggaatccgagcccagaatatctgcaaagtgctgaatcggtatctcgacataaaggagatcctgcaatctctattaggtcatacatgtcctcggttcttggcagggctgatggaggcaggagaaagcgaactgaagagaaaagtaaaaccagaagcctggttgagttgcggtccatcccctgggcccggtcgcctacaattggtgtgtcacgtcagtggcttctatccaaagcccgtatgggtaatgtggatgcggggcggttacagtatcttcctcatacttatctgcttgaccgtcatcgtcacactcgttatccttgtagtcgttgactccaggttgaagaagcagagtccagtattcctgatgggcgccaacacgcaggacaccaaaaacagccggcaccagttctgtttagcacaggtctcctggatcaaaaatagggttttgaaaaagtggaaaactcggctgaatcaattatggtag

SEQ ID NO: 111277 - DNA, 306 bp, Artificial Sequence
  Description of Artificial Sequence: Synthetic coding sequence
atgcttctcttgttcctactctttgaaggcctgtgctgccctggtgaaaatacagccgtgaagccagaggcttggctgagctgcggcccgtcacctgggcccggccgtttacagttggtctgccacgttagtggattctatcctaagcctgtgtgggtcatgtggatgagaggagagcaggagcaacgggggactcagcggggagacgtcctgcctaacgcagacgagacatggtggatatttcacctctcccaccccgatttgttcgattgtgactcctatccaggccacattgggtgctcgtag

SEQ ID NO: 111278 - DNA, 897 bp, Artificial Sequence
  Description of Artificial Sequence: Synthetic coding sequence
atgctcctcctgttcctcctctttgaagggctctgctgccctggcgaaaacactgcggcaccacaggcgctccaaagctaccacctggctgccgaggaacagctgtcttttcgcatgctacagacttcaagtttcgcaaatcactcctgggcacacagcgagggatcaggatggttgggcgatctacaaacacatgggtgggacaccgtcctggggacgattcggttcttgaagccgtggagccacggcaacttctcaaagcaagagctcaaaaaccttcagagcctgttccagctgtatttccactccttcatacagatcgtgcaggcttccgccggacagtttcaactggaactaaaacctgaagcctggctgtcctgtggaccttcacccggcccaggcagacttcagttagtctgccacgtctctgggttctaccctaaaccggtgtgggtgatgtggatgaggggcgagcaggagcagcgaggaactcagaggggagatgttcttccaaacgccgacgaaacctggtatctgagagcgaccttagatgtcgccgctggtgaggcagctgggctttcatgccgcgtgaagcattcttcactcggaggacatgacctcatcattcattgggggggatattccatcttcctcattctgatctgtctgacagtgatcgttaccctcgtgatcctggtggttgtcgattctcggctgaaaaagcagtctagcaacaagaatatcctgagtcctcacacgccctcccctgtgttcttaatgggagccaacacccaggatacgaagaactcacggcaccagttctgtttagctcaagtgtcatggataaaaaaccgagtgcttaagaagtggaagactcggctcaatcaactgtggtag

SEQ ID NO: 111279 - DNA, 564 bp, Artificial Sequence
  Description of Artificial Sequence: Synthetic coding sequence
atgctgctcttatttctcctattcgaagggctctgttgccctggtgagaacacggcagtcaaacccgaagcgtggctgagctgcggacccagtccgggccccgggaggctgcagctagtctgccacgtgtctgggttttaccccaaacctgtctgggtgatgtggatgcgtggggaacaggaacaacgagggactcaacgtggagatgtgctgcctaatgccgacgaaacctggtacctccgtgccacactcgatgtggcagcaggtgaggctgccggactgtcttgccgcgtgaagcattcttctcttggcggccatgacctgataatacactggggcggctactcaattttcttgatcctcatctgcttgacagtaattgtgaccctggtcatacttgttgttgttgactctcgtcttaaaaagcagagtcccgtgtttctcatgggcgcaaacacccaggacactaagaacagccgccaccagttctgtctggcccaagtcagttggatcaagaaccgggttttgaagaagtggaagaccagattaaaccaattgtggtag

SEQ ID NO: 111280 - DNA, 1167 bp, Artificial Sequence
  Description of Artificial Sequence: Synthetic coding sequence
atgctactcctgttccttctgtttgaagggctctgttgcccaggtgaaaacacagcagctccccaggccctacagtcttaccatctggctgctgaagagcaattaagttttagaatgctccagacaagttcatttgcaaatcacagctgggctcactccgaggggtctggttggctaggcgacctccagacccacgggtgggacaccgttttaggcaccatccgctttctcaaaccatggagccatggaaacttcagtaaacaggagctgaaaaacttgcagagtctgttccagttatacttccactcctttatacagatcgtacaggccagtgccggtcaatttcagctcgagtaccctttcgagatccagatcttggcaggatgtcggatgaacgcgcctcaaatctttctgaacatggcatatcagggctccgattttctctctttccagggcataagctgggagccttcccccggcgccgggatcagggcacagaacatctgcaaagtgctcaaccgctacctggacatcaaagagattctccagtctcttctgggtcacacctgtcctaggttcttggccggtctgatggaggctggagaaagtgaactgaagagaaaagtgaagcccgaagcatggttgtcgtgtggaccgtccccaggcccgggcaggctgcagctcgtttgtcacgtcagcggtttttatcctaaaccagtttgggtgatgtggatgagaggtgaacaggagcagcggggaacacagagaggagacgtcttgcccaatgctgatgagacttggtatctcagagccacactagacgttgccgccggtgaagcagcagggttgtcatgcagagtgaagcattctagccttggaggccacgacctcatcatccactggggaggctacagcatttttctgattctgatctgcctgactgtcatcgtaaccctagttatccttgtcgtggtggactcaaggctcaaaaagcagtcatctaacaagaacattctttccccacacaccccatcaccggtgtttctcatgggcgccaacacgcaggatacaaaaaactctcggcaccagttttgcctggcccaggtaagctggattaaaaacagagtgctgaagaagtggaagaccaggctgaaccaactatggtag

SEQ ID NO: 111281 - DNA, 1023 bp, Artificial Sequence
  Description of Artificial Sequence: Synthetic coding sequence
atgattaaaagcagggtaaaacgctatcgaagaaggcgtggctctcagagagcccctcaagccctgcagagctatcatcttgccgctgaggaacagttaagcttccggatgctccagacttcatcctttgctaaccacagctgggctcatagtgagggaagtggctggttgggcgatctgcagacccatggttgggatacagttctcgggactataaggtttcttaaaccatggtctcacggaaacttctccaagcaggaactcaagaacctccagagtctgtttcaactctatttccactctttcatccagatcgtgcaagccagtgccggccagtttcagctggagtacccgtttgaaattcagatcctcgcaggctgccgtatgaacgcaccccagatttttctcaatatggcttaccaggggtccgactttctttcctttcaaggtatatcatgggagcctagtccgggtgcagggatccgggcccagaacatctgtaaagtcctgaataggtaccttgatatcaaggagatactccagtccctgctgggacatacctgtccccggttcctggctgggcttatggaggcaggcgagtctgagctgaagcgaaaggtcaagccagaggcttggctgtcctgcggaccctccccaggccccggccggctgcagctcgtgtgccatgtttctggcttctatcccaagccggtgtgggtgatgtggatgcgtggggaacaggagcagaggggcacccagaggggggacgttcttccaaatgctgatgagacttggtacctgcgcgcaactctggatgttgccgcaggtgaggcagcagggttgtcttgcagggtgaagcattcatccctcggcggtcacgaccttattattcactggggcgagaagcagctgcgcctgtgttgggaaattatgaaaattgccttggggctcctgagtgtagggctccgtaaatgggttgggatgctgggcacccgacgggtcaagctaggacaaagtaagtag

SEQ ID NO: 111282 - DNA, 870 bp, Artificial Sequence
  Description of Artificial Sequence: Synthetic coding sequence
atgctcctactgttcttgttattcgagggcctctgctgtcccggggaaaacacagcagacccattcgagatccagatactggcagggtgccggatgaatgccccccaaatattcctgaacatggcctaccagggctccgactttcttagctttcagggaatctcctgggaaccttcacctggagccggtattcgagctcagaacatctgtaaagtactgaacaggtatctggatatcaaagagattcttcaaagtttgttgggtcatacttgtccacgatttcttgcaggcctgatggaggccggagagtcggaattgaagcggaaggtgaagcctgaggcctggctgtcatgcggacccagccctggccctggccgactgcagctcgtgtgccatgtgagtggcttttatccaaagcccgtatgggtgatgtggatgcgtggcgaacaggagcagcgagggactcagcgtggagacgtgctgccgaatgccgatgagacgtggtacctgagagcaactctggacgtagcggctggtgaggctgccgggctatcctgccgagtgaagcactcgtctctgggcggacacgatctgattattcactgggggggatattccatatttttgatcctgatctgccttacggtaatcgtgaccctggtaatcttagttgtggtggattctaggctcaagaaacaatcctccaataaaaatattctctctccacacaccccttctccagtatttctcatgggtgcgaacacccaggataccaagaacagccgacaccagttttgtctggcccaggtgtcttggatcaaaaaccgagtgctgaagaagtggaaaaccaggcttaaccagctgtggtag

SEQ ID NO: 111283 - DNA, 600 bp, Artificial Sequence
  Description of Artificial Sequence: Synthetic coding sequence
atgctcttgctgttcctgctttttgaggggctttgttgccctggtgagaatacagctgttaagccagaagcctggctgagctgcgggcctagccctggaccgggtagactccagctcgtgtgccacgtatcaggcttttatccaaaacctgtctgggtaatgtggatgcggggggagcaggagcagcgtgggacccaacgaggcgatgtcctgcctaacgcggacgagacatggtatctgagggccacccttgacgttgctgctggcgaggctgctggactgtcatgcagagttaagcactctagcttggggggtcacgatctgattatccactggggcggttattctatctttttaattctcatttgccttaccgttattgtgaccttagttatcctggtggtggttgactcaaggctcaagaagcagtcttccaacaagaacatactgtccccccacacaccatcaccagtgttcttgatgggagccaatactcaggataccaagaacagtagacatcaattttgcctggcccaggtgagttggataaagaatcgcgtcttgaagaagtggaaaaccaggctcaaccaactgtggtag

SEQ ID NO: 111284 - DNA, 1047 bp, Artificial Sequence
  Description of Artificial Sequence: Synthetic coding sequence
atgctttgtccgtggagaacagctaacttaggcctgttactgatcctgaccatatttctggtagctgaagccgagggtgccgctcaacctaataactcactgatgcttcaaacaagcaaagagaaccatgccctcgcatctagctcactttgtatggatgagaaacaaatcacacagaattatagcaaagttctggccgaggtcaatacttcatggccagtgaaaatggccaccaacgctgtactgtgctgcccccccatcgccttacgtaacttgatcatcatcacctgggagatcattttgcgagggcagccttcatgcactaaagcttataaaaaggaaaccaatgagacaaaggaaaccaattgtactgacgagcggattacctgggtatctaggccagaccagaactcagatctacagattaggacagtcgccattactcacgacggttactatcgttgcattatggtgacccccgacggtaatttccacagagggtatcatttgcaagtcctggtaaccccagaagttacactgtttcagaacagaaatcgtaccgcagtgtgcaaggcagtggccggcaaaccagctgcccatatctcttggatccccgaaggggattgtgcaacaaaacaagaatactggagcaacggcacagtcaccgtcaaaagcacctgccactgggaggtccacaatgtctccacagtgacttgccacgtttcacacctcaccggtaataagtctttatatatcgaactactgccagtacctggcgccaagaaatctgccaaactgtacataccctatatcatcctaacaatcatcatactcaccatcgtgggatttatctggcttttgaaggttaatggatgcaggaaatataagctaaataaaactgagagcactccagttgtggaggaagacgaaatgcagccgtatgcttcatataccgaaaaaaacaatccgctctacgatacaacgaataaagtcaaggcatcagaggcccttcagtctgaggtagatactgatctccacaccctgtag

SEQ ID NO: 111285 - DNA, 567 bp, Artificial Sequence
  Description of Artificial Sequence: Synthetic coding sequence
atgctttgcccctggaggaccgccaacctgggcctactgcttatattaacaatcttcctggtggctgaagccgagggcgctgctcaacctaataatagcctcatgcttcagacgtctaaggagaaccatgctttagctagctcaagcttgtgcatggacgagaaacaaatcacacagaattactcaaaagtcctcgctgaagtgaatacgagttggccagtaaaaatggccactaacgcagttctgtgttgtccccccattgccttaaggaatctgattattatcacgtgggaaattattctccgcgggcagcctagctgtaccaaggcctataaaaaggagacgaatgagacaaaggaaactaattgtaccgatgagcgcattacctgggtcagcagacccgatcagaactccgaccttcaaattcgcacagtggcaattacgcacgacgggtattacagatgtattatggtcacaccagatgggaattttcaccgaggctaccacctgcaggtcctcggaaaggagcaccacatcctgcggtacttcacctcacccgatctgtag

SEQ ID NO: 111286 - DNA, 978 bp, Artificial Sequence
  Description of Artificial Sequence: Synthetic coding sequence
atgctgtgtccctggcgcactgctaacttaggtctgcttctcattctgactatcttcctggttgcagcgagctctagtctctgcatggacgagaagcagatcactcagaattacagcaaggtattggctgaggtaaatacatcctggccagtgaagatggccactaacgcagtactgtgctgcccaccaattgctctgaggaatctgatcattataacgtgggaaatcatattgagaggtcagccatcatgtactaaagcctataagaaggaaactaacgagacgaaggaaaccaactgtacagatgagcgtatcacttgggtgtcacggcctgaccagaactctgatcttcagattagaaccgtggctatcacacacgacggatattatagatgcataatggttacccccgatgggaactttcataggggctaccatcttcaggtcttggtgacacccgaagtgacgctctttcagaaccgtaatagaactgccgtatgcaaggctgtggcaggcaagcctgctgcccacattagctggatacctgaaggcgattgtgcaacaaaacaggagtactggtccaacggtactgttacagtaaagagcacctgtcactgggaggtgcacaatgtctctacagttacatgtcacgtatcccatctgacgggaaacaaatcactgtacattgaacttctgccagtgcctggtgccaagaagtcagccaaactatatattccctatatcattctcaccattattatccttaccatcgtagggttcatctggttgttaaaggtgaatggatgccgtaagtataaactaaataaaaccgagtctacccccgttgtggaagaggacgagatgcaaccctacgcatcatacactgagaaaaacaatcccctgtatgacactaccaataaagtaaaggcgtccgaggctctgcaatccgaagttgacaccgatctccacactctgtag

SEQ ID NO: 111287 - DNA, 498 bp, Artificial Sequence
  Description of Artificial Sequence: Synthetic coding sequence
atgctttgcccttggcggactgccaacttgggcctgctacttatactgacaatattcttagtagccgcctcatcttctttgtgtatggatgagaaacagattacgcaaaattactcaaaggtgctggccgaggtcaacacaagctggcctgtgaaaatggcaaccaacgccgtactttgctgccctcccattgctctaaggaacctgataataatcacctgggagatcattttacgagggcagccctcatgcacaaaggcttacaagaaggagacaaacgagacgaaggaaaccaactgtacagacgaacggatcacttgggttagccgccccgatcagaacagcgacttacaaattagaactgtcgcaattacccatgatggctattaccggtgtatcatggtcactccagacgggaacttccaccgggggtaccacttgcaagtgttggggaaggaacaccacattcttcggtactttacgagcccagatctctag

SEQ ID NO: 111288 - DNA, 987 bp, Artificial Sequence
  Description of Artificial Sequence: Synthetic coding sequence
atgacagtggagaaagaggcgcccgacgcccacttcaccgtggataaacagaatatcagtctctggcctagggagcctccacctaaaagcggcccttcgctggtgcccggcaaaacgcctacagtcagggccgccctgatctgcctgaccttagttttagtggccagtgtgctgcttcaggcggttttatatcctcgtttcatgggcaccataagtgacgtgaaaaccaacgtacaactgctgaagggcagagtggataacatctccacgctggactctgagataaaaaagaattcagacggaatggaagctgcaggcgtgcaaatccagatggtcaacgagtctctgggctatgtgcgctcccagtttttaaaattgaaaacctctgtggagaaggcgaacgctcaaatacagatcttaaccagatcctgggaagaggttagtaccctgaatgcccagattcctgaactcaaatccgatctagagaaagcctcagccctgaatacgaagatacgagcattgcaaggcagcctggaaaacatgagtaagctgttgaaacgacagaacgacattctacaggttgtttcccaaggatggaagtattttaagggtaatttctattacttttcacttattcctaaaacatggtatagcgccgaacagttttgcgtgagccggaactcacatctgacaagcgtgacaagtgagtctgagcaggagtttctttacaaaactgcagggggtctgatttattggatagggttgactaaggccggtatggagggcgattggagctgggtggacgataccccattcaataaagtgcagtctgtccgattttggatcccaggagaacctaataacgcaggcaacaatgaacattgcgggaacatcaaggctccctccctccaagcctggaacgatgctccctgtgacaagacctttctgtttatttgcaagaggccctacgttccttctgagccttag

SEQ ID NO: 111289 - DNA, 4497 bp, Artificial Sequence
  Description of Artificial Sequence: Synthetic coding sequence
atggatggtgccagcgccgagcaggacggacttcaggaggacagatcccactccggcccttcttctctcccagaggctccactgaaaccccctggcccactagtcccaccagatcagcaggacaaggtgcagtgtgctgaagttaacagggccagtaccgaaggcgagtctcccgatgggcccggtcagggaggtctctgtcagaacggacccactcctccattcccagatcctccatcttccctggatcctacgacctcccctgtgggaccggacgcctctccaggagttgctggcttccacgacaacttgagaaagagccagggcaccagcgcggaggggtccgtgcggaaggaggccttacaatcccttaggctgtctcttccaatgcaagagacgcagctctgtagcactgattcccctcttcccctggagaaggaggaacaggtgaggcttcaggctagaaaatggcttgaagagcagctgaaacagtaccgcgtaaagcgccagcaggagcgcagttcacagccagccacaaagacgcggctctttagcactctggaccccgaacttatgctcaatccagagaatctgccaagggcctccacgctggcaatgaccaaagagtattctttcttgcggacatctgtacccaggggcccgaaggtgggctcactgggactccccgctcatcccagggaaaaaaagaccagcaagtcttccaagatccgttccctggcggactatcgaacagaggattcaaatgcgggaaatagtggggggaacgtgccagcgcctgatagcacgaagggcagcctgaaacagaatcgcagttcggcagcctccgtggtcagcgagatcagcctgagtcccgacacagacgataggctggagaacaccagcttagctggtgacagcgtgtctgaggtagacgggaatgattccgatagttctagctactctagcgcttctacaagggggacttatgggatcctgtcaaagaccgtaggaactcaagacactccgtacatggttaatggacaggagatccccgcagataccctcggacaatttccttccataaaagacgtacttcaggcagctgccgccgaacatcaggaccaagggcaagaagtcaacggggaagtgcgatcccgccgtgatagcatctgtagcagtgtttcgctggaatcaagcgccgccgaaactcaagaagaaatgctccaggtcctgaaagagaaaatgcgcttagagggacagcttgaggccctttccttggaagcctctcaggcactgaaagagaaggccgagctccaggctcagctggctgcgctaagtacaaagctgcaggctcaagtcgaatgctctcactccagccaacagagacaggactcactgagttcggaagtggacactttaaagcagtcatgctgggacctggagcgtgcgatgaccgaccttcaaaacatgctcgaggccaaaaacgctagcctcgctagttccaacaatgacctgcaggtggccgaggagcaatatcagcgcttgatggctaaggttgaagatatgcagaggtctatgctgtctaaggacaatactgtgcacgacctgaggcagcaaatgaccgctctgcagtctcaactgcagcaggtgcagctggagaggacaactctgacaagcaagcttaaagcctcccaggctgaaatctcaagtctacagagtgtacggcagtggtaccaacagcagttagcccttgcgcaagaagcgcgggtgagactgcagggagaaatggcacatatccaagtggggcagatgacccaagcgggtctgctggaacatcttaagttggagaatgtctcactctctcagcagctcaccgagactcagcatcgcagtatgaaggagaagggcaggatagccgcccaattgcagggaattgaagccgacatgctggatcaggaagccgccttcatgcagatccaggaagccaaaaccatggtggaggaggacctgcaaagacgcttggaggagtttgagggcgagcgcgaacgcctccagaggatggcagacagtgcagcctcactcgagcagcagcttgagcaggttaaactcactctgctgcagcgggaccagcagctcgaagccctccagcaggaacacctggatttgatgaagcagctcacactgacccaggaggccctgcaaagccgggaacagtctctggatgccctccagacacattatgacgaacttcaggctcgtttgggggagctacagggcgaggccgcatctcgcgaggatacaatctgcttgctacaaaacgagaaaatcatcttggaagccgccctccaggctgcaaagtctggtaaggaggagttggatcggggggcccggcgcttagaggaggggacagaggagacctccgaaactctggaaaagctgagagaagagctggccattaagtcgggacaggtggaacaccttcagcaggagaccgccgctctaaagaaacagatgcagaagattaaggaacaatttttacaacagaaagtgatggtggaggcttacagaagagacgccacttccaaggaccagcttatctctgaactgaaggccaccaggaagcggctggactcggaactgaaagagctccgacaggaattaatgcaggtccatggggagaaacgtaccgctgaagctgagctctcccggctccatagagaagttgcgcaggtgcggcagcatatggccgacctggagggtcacctccagagcgcccaaaaagagcgggatgagatggagacacatctgcaaagtctccaattcgacaaagaacagatggtggctgtgactgaagccaatgaggccttaaaaaagcagatcgaggagctccagcaggaagctagaaaggccattaccgaacagaagcagaagatgcgaagacttggctcagatttgacctccgcccagaaagaaatgaaaactaagcacaaggcctacgagaatgccgtcggaatactgtcacggcgcctccaggaggctctggctgctaaagaggctgcggatgccgagcttggccaacttcgagctcaaggaggcagctccgactcctcattagccctccacgaacggatccaggcactggaggctgagctccaggcagtttctcactctaaaacacttctggaaaaagagctgcaagaagtgattgctctcacctcacaagaactcgaagagtcacgtgagaaggtgctagaacttgaggacgagctccaggagagtcgtggttttagaaagaaaattaagagactagaagagagcaataagaagctcgctctggagctggagcatgaaaagggcaagctgactggtttgggccaaagcaatgcagctctccgtgagcataattccatcctcgaaacggctttggccaagagagaggccgacctggttcagctgaacttacaggtccaagcagtgctccagaggaaagaagaagaggatcggcagatgaaacatttggtacaggctctccaggcttccctggaaaaagagaaggagaaggttaattctctgaaggagcaggtcgctgctgcaaaggtggaggccggtcacaataggcgccatttcaaggccgcaagtctggaactctctgaagttaagaaagaacttcaggcaaaggagcacctggtgcagaaactgcaagccgaagcggacgacttacagattcgcgagggtaagcactcacaggagatagcccagtttcaggctgagttggccgaagcacgagcccagttacagctgcttcaaaagcagctggatgagcagttgtcaaaacagccggtgggcaatcaagagatggagaaccttaagtgggaagtagaccagaaggaaagggagatccagagcctgaaacaacaactggaccttaccgagcagcaggggcgcaaagagcttgaggggctgcagcagctgttgcagaacgtcaagagcgagttagagatggcacaggaggatttgagtatgacccagaaagataagttcatgctgcaagctaaggttagtgaactcaaaaacaatatgaagacattgttgcagcaaaaccagcagctcaagctggacttaaggagaggtgctgccaaaacgcgcaaagaaccaaagggagaagctagcagctctaaccccgccacaccaattaagattccagactgcccagtaccggcatcccttctcgaggagctgctccgtcctccgccggcagtatcaaaagagccgctgaagaatctcaactcatgcctccagcaattgaaacaggaaatggacagcctgcagagacagatggaagagcacgcactgacagtgcacgagtccctgagtagttggacacccctggagcccgccaccgcatcaccagtgcccccgggtggccacgcgggcccgcggggggaccctcagcggcattcccagtcaagagcttctaaggagggacctggagagtag

SEQ ID NO: 111290 - DNA, 807 bp, Artificial Sequence
  Description of Artificial Sequence: Synthetic coding sequence
atgtccgatagcaaagagccgcggctacaacagttgggcctgcttgtctctaaagtgccctctagcattagtcaagaacaaagcaggcaggacgccatctaccaaaacttaacccagttgaaggccgccgtaggggaactgagtgagaagtcaaaactacaagagatctatcaagagctaactcaactgaaagccgccgttggcgagctgccagaaaagtcaaaactgcaggagatctaccaggagcttacaaggctgaaggccgccgtcggagaattgcccgaaaaatccaaacagcaggaaatctatcaggaacttacccagctgaaagccgccgtggaaagactctgccatccatgtccttgggagtggaccttttttcaaggcaactgttacttcatgtccaactcccagaggaactggcatgacagtataaccgcatgcaaagaagtgggagcccagctggtggttattaaatctgcggaggagcagaatttcctacagctccagagctcgagatctaaccggttcacctggatgggcttatctgacctgaatcaggaagggacctggcagtgggttgatggcagccctctgctcccatccttcaaacaatattggaacaggggcgaacccaataatgtaggtgaggaggattgtgcagagttttctggaaatggctggaatgacgataagtgcaacctcgccaagttctggatttgcaagaagtccgcggcttcatgcagcagggacgaggagcagtttctgtcccccgcacccgccactccaaaccccccaccggcctag

SEQ ID NO: 111291 - DNA, 1143 bp, Artificial Sequence
  Description of Artificial Sequence: Synthetic coding sequence
atgagcgactcaaaggaaccccggctgcaacaattggggttactcgaggaggaacagctgcgaggcctgggattccgtcagacccgcggctataagtcattggcagtatctaaggtgccttcatcaatctctcaggagcaaagtcgtcaggacgcgatatatcagaatctcacccagcttaaggccgcagttggggagctgtcggagaaaagcaagcttcaagaaatctaccaggagctaactcagctcaaagctgccgttggagagctccctgagaaaagcaagttacaggaaatttaccaggaactgactcgtctcaaagccgcagttggggagttaccagagaaatctaaattacaagagatataccaggaattgacctggctgaaggctgccgtcggggagctccctgagaagtctaagatgcaagaaatataccaggagctgactcgattgaaagccgccgttggggagttgcctgaaaagagtaaacagcaggagatatatcaagagctgacccggttaaaagcagccgtcggcgagcttcctgaaaagtccaagcagcaagagatctatcaggaactgacacggttaaaagccgccgtgggggagctccctgagaaaagtaaacagcaggaaatatatcaggaattgacacagttgaaggcggccgtcgagaggttatgtcacccttgcccttgggaatggacctttttccagggcaactgttatttcatgtcaaactcacagagaaattggcacgactcaatcacagcttgcaaggaggtgggcgcacagcttgtggtgatcaagtctgcagaagaacagaattttctgcaactgcagtcatctagaagcaatagattcacttggatgggactgagcgatctaaatcaggaagggacctggcagtgggtggatggaagtccactgttgccgagctttaagcagtactggaatcggggtgaaccaaataacgttggagaagaagattgcgctgagttcagtggcaacgggtggaacgacgataaatgtaatttggctaaattttggatctgcaagaagtctgccgcctcttgtagcagggatgaggaacaattcctgagcccagctcctgctacacccaaccctccccctgcttag

SEQ ID NO: 111292 - DNA, 1215 bp, Artificial Sequence
  Description of Artificial Sequence: Synthetic coding sequence
atgtctgacagtaaagaacctcggctccaacaattgggtcttctggaggaggagcaattgagaggccttggcttccgtcagaccagggggtacaaaagtctggctggatgccttggacacggccccctggtgttacaattgctaagttttacgctccttgccggcttgctggtccaagtgagtaaagtgccctcttcaatatcacaagaacagtctcggcaggatgcaatataccagaatttaactcagttgaaagctgccgtgggtgagctctctgagaaatcaaagctacaggaaatctaccaggagcttacacaacttaaagctgccgtgggagaactgccggaaaaatctaaactgcaggagatatatcaggaactgacccggctcaaggcggctgtgggcgagcttcctgagaagtctaaactgcaggaaatataccaggagctgacatggctgaaggcggctgtgggtgagctgccagaaaagagcaaaatgcaagaaatctatcaggaactaacaagattaaaggctgccgtcggcgagctgcctgagaaatcaaagcagcaggagatctatcaggagctgactcgactcaaggccgccgttggtgaattgcccgaaaagtccaagcagcaggagatctatcaagagttgacacgactgaaagcagcagtgggagagttgccagagaaatccaagcagcaggagatctatcaagaactcactcaactgaaagccgctgtcgaaagactgtgccatccgtgtccatgggagtggactttctttcagggcaactgttactttatgtccaactcacagcggaattggcacgactcaattaccgcgtgcaaagaggttggtgcccagcttgtggttattaaatctgccgaagagcaaaattttcttcaactgcagagcagcaggagcaatcgttttacctggatggggctcagcgatctgaaccaggaaggaacatggcaatgggtggatggcagcccactgctgcccagcttcaagcagtactggaatagaggcgagccgaataacgtcggagaggaggactgcgccgagttctcgggcaatggatggaatgacgacaaatgtaatctggccaagttttggatttgcaagaaatctgcagcttcctgctctagggatgaagaacaattcttgtctccagcacctgccacccccaacccccctcccgcttag

SEQ ID NO: 111293 - DNA, 1197 bp, Artificial Sequence
  Description of Artificial Sequence: Synthetic coding sequence
atgtcggactctaaagagcctcgtctgcaacaattgggactgctggaggaagagcagctgcgaggccttggatttcggcagaccagaggctataagagtctggctggctgtctaggtcacggccctctggtattgcagctgttgtcttttacgctcctggctggcctgctcgtccaggtaagcaaggtgccctcttctatctcccaggagcagagccgccaggacgctatttatcagaatctgacgcaacttaaggctgctgtaggggaactgtctgagaaatcaaagttgcaagagatttaccaggagctgactcagttgaaggccgccgtcggggagctccccgagaagtcaaagctgcaggagatttatcaggaacttacccggctcaaagctgccgttggcgaactgcccgaaaaaagtaagctgcaggaaatatatcaggaactgacttggctcaaggcagccgtcggcgaattacctgaaaagtctaagatgcaagaaatctatcaggagctgacccgtttgaaagccgccgtgggtgaactgccagaaaagtcaaaacaacaggagatttatcaggaactcaccaggctcaaagctgccgtcggggagttgcccgaaaagtctaagcaacaggaaatttaccaggagctgacgcgcctgaaggcagctgtcggcgaactgcccgagaagagcaaacagcaggaaatctatcaggaactaacacagctcaaggctgcggtggagcgcttgtgccatccttgcccctgggagtggacattcttccagggcaattgctactttatgtccaatagccagcgtaactggcacgactccattactgcctgtaaagaagttggcgcgcagctggtggtgattaaatctgctgaggaacagagctcacgaagcaacaggttcacctggatgggactgagcgacttgaatcaagaaggaacctggcagtgggtcgatggaagccctctgctcccatccttcaagcagtattggaatagaggtgaacccaacaacgtcggggaagaagattgtgccgaattttccggaaacggctggaacgatgataagtgtaacttagccaagttctggatttgtaagaagtctgccgcctcctgctcacgcgatgaggaacaatttctctcccctgccccagccaccccgaaccctccccccgcttag

SEQ ID NO: 111294 - DNA, 507 bp, Artificial Sequence
  Description of Artificial Sequence: Synthetic coding sequence
atgtctgatagcaaggagccgcgcctgcaacagttaggtctgcttgaagaggaacagctgcgagggctaggcttccggcagacccggggatataagtctctcgctggatgcctaggacatggtccgttggtcttgcagttgctatcatttactctccttgctggattgctggtgcaagtctcaaaagtgccctctagcattagccaggaacaatctcgatcaaatcggtttacctggatgggcctctcagatctgaatcaggagggaacttggcagtgggtcgacggctcccccttactcccctcattcaagcaatactggaataggggcgagccaaacaatgtcggtgaggaagactgcgcagagttctccggtaatggatggaacgatgataaatgcaatcttgctaaattctggatatgtaaaaagagcgcagccagttgttctagagatgaagagcagttcctctcccctgccccagcaactccaaaccccccgcccgcttag

SEQ ID NO: 111295 - DNA, 939 bp, Artificial Sequence
  Description of Artificial Sequence: Synthetic coding sequence
atgtctgattctaaggaaccgcgccttcagcagctgggcctcttagaagaggagcagcttcgaggtctcggattccgccagacaagaggttacaagtcattggcaggatgccttggacacgggccactggttttacaactgctgagctttactcttctggctgggcttctcgtccaggtttcgaaagttccctcctccatttcacaagagcagtctcgccaggatgccatatatcagaatctgacccagctaaaggccgcagtgggagagctgagtgaaaaatccaaactgcaggaaatataccaagaactgactcaactcaaggccgcagtcggggaattgcccgaaaagtcaaagctacaagagatttatcaggagctgacacggctcaaagcagctgtgggggaactcccggagaagagcaagctgcaggagatttaccaggaactcacatggttgaaagccgcagtggagcgtctttgccacccttgtccgtgggaatggactttcttccagggcaactgttacttcatgtccaactctcagcggaactggcatgactctatcaccgcctgtaaggaagtgggagctcagctcgtcgtgattaagagcgccgaagagcagaactttctccagctccaaagcagccggagcaataggttcacctggatggggttgtctgacctgaaccaagaaggtacctggcagtgggtggatgggtcaccactccttccttctttcaaacagtactggaatagaggagaaccaaacaacgtaggagaggaagattgcgcggagttcagcgggaacggatggaatgatgataagtgcaatctggcgaaattctggatctgtaaaaagtcggccgcttcgtgctcacgagacgaagaacagttcctgagtccagcccccgctactcctaacccgccgcccgcctag

SEQ ID NO: 111296 - DNA, 105 bp, Artificial Sequence
  Description of Artificial Sequence: Synthetic coding sequence
atgtcagactctaaggagccgaggctgcaacagttaggtttgttggaggaggaacagctgagggggctcggctttcgtcagacccggcggaatcagaagtgttag

SEQ ID NO: 111297 - DNA, 855 bp, Artificial Sequence
  Description of Artificial Sequence: Synthetic coding sequence
atgagtgattccaaagagccacggctgcagcagttggggttactggggtgcctaggccatggccccctggtgctccaactcctgtccttcacgctgttagcgggcctgttagtgcaggtcctgggccccgtaagtaaggtcccatcatcgatcagccaggaacagagtagacaggacgcaatctaccagaacctgacacagctcaaggctgcagttggggaactgtccgagaagtccaaattgcaggagatctatcaggagctcactcagctcaaggctgccgtcggcgagctgccagaaaaatctaagcttcaggagatttatcaggaactgactcgtctaaaagccgcggttggcgaactgcccgaaaaaagcaagctgcaggagatataccaggaactgacgtggctgaaggcggccgtcggcgagctgcctgagaaaagtaaaatgcaggagatttaccaggagctgaccagactgaaggccgctgtcggggaattaccagaaaaaagcaagcagcaggagatttaccaggaacttacgcgactgaaggcagccgtgggcgagctcccagaaaagagcaagcagcaggaaatataccaggagctgactcggctaaaggccgctgtgggcgaacttcctgagaaatcaaaacagcaggagatctatcaggagctgactcaactcaaggccgccgtagaaaggctgtgtcacccatgtccctgggaatggacattttttcagggtaactgttattttatgagtaactcccagcgcaattggcacgattccatcactgcttgtaaggaggtgggggcacagctagtggttattaaatctgcagaggagcagtag

SEQ ID NO: 111298 - DNA, 939 bp, Artificial Sequence
  Description of Artificial Sequence: Synthetic coding sequence
atgtccgactctaaggagccccgcctgcagcagctggggctgttagaggaagaacagcttagagggctgggttttagacagacccgggggtacaaaagccttgctggctgtctcggacatgggccattggtgttgcaattgctgagttttacacttctggccggcctgctggtgcaggtgtctaaggtgcctagttccatttcacaggagcaatctaggcaggatgccatttaccagaacctgacgcagctcaaggccgccgtaggcgagctaagcgagaaatccaagcttcaggagatttatcaggagctgacccagctaaaggccgccgtgggtgagctgcctgaaaagagtaagttacaagaaatctaccaggagttgaccaggctgaaagccgccgttggagagcttccggagaagtcgaaacttcaggagatttatcaggagttaacctggctcaaggcagcagtggaacggctttgtcatccatgtccctgggaatggaccttttttcagggcaattgttattttatgagtaactcccagcggaattggcatgatagtattaccgcttgcaaagaagtcggagcacaattagtggtgatcaaatcagctgaggagcagaattttttgcagcttcagtcttcgcggagcaataggttcacttggatgggcctgagcgatctaaaccaggagggaacatggcagtgggtcgacgggtctccattgctgccttcctttaaacaatactggaaccgcggggagcctaacaatgttggcgaggaggactgtgctgaattttctggaaacgggtggaacgacgataagtgtaacttagccaaattttggatatgtaagaaaagcgcagccagctgcagtcgagatgaggagcagtttctgtcacctgcgcctgctactccaaatcccccacctgcatag

SEQ ID NO: 111299 - DNA, 1011 bp, Artificial Sequence
  Description of Artificial Sequence: Synthetic coding sequence
atggattaccccaccctgctgctggccctgttacatgtttaccgggctctgtgcgaggaggttttgtggcatacctcggtgccttttgccgagaacatgtctttggaatgtgtttacccaagcatgggtatcttgacccaggtagagtggtttaagattggaacacaacaggacagcattgccattttctccccaacgcacgggatggtgatccgcaaaccctacgccgaaagagtgtactttctcaactctactatggcctctaacaacatgaccctgttttttaggaatgcttcagaagatgacgttggctattactcttgcagcctttatacatacccacaggggacttggcaaaaggtgatccaggtggtacagtcagactcattcgaagcggcagtgcccagtaacagccacattgtctctgagccgggtaaaaatgtgacgctgacctgtcagccccagatgacctggccagtacaggccgtgagatgggagaagattcagccccggcagattgatctcctgacatactgtaacctggtccacggaagaaacttcactagcaaattcccacgccagattgttagcaactgttcacacggcagatggagtgtgatcgttatcccggacgtgaccgtctcagacagtggcctatatcggtgttatctccaagcatctgcgggagaaaatgagacctttgtaatgcgcctgactgtggctgagggcaagaccgataaccagtataccctttttgttgctgggggaacagtgctgttactgctgttcgtcatctctatcaccacaataattgtcatatttctgaataggcggagaaggagggagagaagggatcttttcactgagtcctgggacacccagaaggcgcctaacaactataggtctcccatttccacatcgcagccaactaatcagtctatggacgataccagagaggacatctacgtgaactaccctacatttagccggcgccccaagaccagggtttag

SEQ ID NO: 111300 - DNA, 822 bp, Artificial Sequence
  Description of Artificial Sequence: Synthetic coding sequence
atgctggggcaggtggtaaccctgattctcctgcttctcttaaaagtgtatcagggaaaagggtgtcaaggttcagcggaccatgtggtctctatctctggagtgcctttgcaattgcaaccgaatagtattcaaaccaaagttgatagcatagcatggaaaaagctcctgccatctcagaacggatttcaccacatcctgaagtgggagaatgggtcactcccctccaatacatctaatgaccggtttagctttattgtgaaaaacctgtctttgctaatcaaggccgctcagcagcaggatagtggtctctattgtctggaggtgacgagtatatcgggcaaagtgcagactgccacctttcaagtgtttgtatttgaattccgtttttggccgttcctcgtgataattgtcattttgtcagctctgtttctcggaactcttgcctgcttttgtgtgtggcgccggaagagaaaggaaaagcagagcgaaacaagtccaaaggagtttcttactatttatgaggatgtgaaggacctgaagacacggcgaaaccacgaacaagagcagacatttccaggtggcggttctaccatctacagcatgatacagtctcaatcctctgctcccacttctcaggagccagcctacaccctatattctctgattcagccttccaggaagtccggcagccgcaagcggaatcactccccttcattcaactcaaccatttacgaggtgataggtaagtctcaacctaaagctcaaaatccggctcggctgagcaggaaggagcttgagaattttgatgtctatagctag

SEQ ID NO: 111301 - DNA, 990 bp, Artificial Sequence
  Description of Artificial Sequence: Synthetic coding sequence
atgctgggacaggtggtgaccctaatcttgctgttattactcaaggtgtaccaaggtaaaggctgccaggggagcgcggaccacgtcgtgagtattagtggagttcctttgcaactgcaacccaattccatacaaaccaaggtggactcaatcgcctggaaaaaactgctcccatctcagaatgggtttcaccatatcctgaagtgggaaaacggctctctcccgagcaatacatccaatgatagattctcatttattgtgaagaaccttagtcttcttataaaggctgctcagcagcaggattctggtttgtactgtctagaggtcacctccatttcgggtaaggtgcagactgcaaccttccaggtgtttgtcttcgacaaagtggagaagccaagactgcaaggccagggaaagatcctggaccgtgggcggtgtcaggtcgccctgagttgcctagtcagccgggatggtaacgtttcctatgcttggtaccgcggttctaaactcattcagacagctggaaatttgacctacctagacgaagaggtggacattaatggaacacacacttatacttgcaacgtgtccaaccctgtgagctgggaaagccacactctgaacctgacccaagattgccaaaatgcgcaccaggagttccggttctggccgttcctggtaattatcgtcattttgagcgccctgtttctcggcactttggcctgcttttgcgtgtggcggcgtaaaagaaaggagaagcagagtgaaacctccccaaaggagttcctgaccatttatgaagatgttaaggacttgaagacaagacggaatcacgagcaggagcagacctttcctggggggggctcaacaatctatagtatgatccaaagtcagagttcagctccgaccagccaggaaccagcctacacattgtatagccttattcagccctcacggaagggagacagattttattcatttagcggatag

SEQ ID NO: 111302 - DNA, 1113 bp, Artificial Sequence
  Description of Artificial Sequence: Synthetic coding sequence
atgctcggtcaggtggtgactcttattcttctcctcctgttaaaggtctatcaaggcaaagggtgccagggctcggcggatcatgtggtctcaataagcggagtcccattacagctgcaaccaaactccatccagaccaaggtggattccatcgcttggaaaaaactgctaccttcccaaaatgggtttcaccacattctcaagtgggaaaatggctccctccctagtaacacctcaaatgatagattcagcttcattgtcaaaaacctatctctgctcattaaggccgcccagcagcaggatagtgggctgtattgcctggaggtcacgtccatctctggcaaagtgcagaccgcaacattccaggtcttcgtgtttgagtccttgctaccggataaggtggagaagcctcgtcttcaggggcaggggaaaattttagaccgaggacgctgtcaggtcgctctcagctgcttggtctcgcgcgacggtaacgtgagctacgcttggtacagagggagcaaattgattcagactgctggcaatttgacttacctcgacgaagaggtcgatattaacggcacccacacatatacctgcaacgtctctaaccctgtgtcgtgggagagtcatacattgaatctaacgcaggattgccaaaacgctcatcaagagttcagattttggccttttctggtgatcatcgtgattctgtccgctctgttcctggggaccctggcctgtttctgcgtgtggcggcggaagcggaaagaaaagcaatcagaaacctcgccaaaggagttcctgacaatctacgaggatgtgaaagaccttaagaccaggcggaaccatgagcaggaacaaaccttccctggtggcggtagcaccatttattcaatgatccagtctcaaagttccgctccaacctcacaggagccagcttacacattatactcgctcattcagccaagccgcaagagcggcagtcggaaacggaaccattctcccagcttcaactccaccatttacgaggtgattggtaagagccagccgaaggcccagaaccctgcgcggctatctcggaaggagcttgagaacttcgacgtctatagctag

SEQ ID NO: 111303 - DNA, 1098 bp, Artificial Sequence
  Description of Artificial Sequence: Synthetic coding sequence
atgctggggcaggtggtcaccttgatcctgcttctactcttgaaagtgtaccagggcaagggatgtcagggatctgcggaccacgtggtgagtatatctggcgtgcccctgcaactccagcctaattcaattcagaccaaggtcgattcaattgcctggaagaagttgctgcccagtcagaacggctttcaccacattctgaagtgggagaacggctcgctgccatcaaacacctcaaacgatagattctcttttattgttaaaaacctgtcccttctgattaaggcggcccagcagcaggattccggcctgtattgcctggaggttacaagcatatcaggaaaggtgcagaccgccacttttcaagtgttcgtgttcgacaaagtggaaaagcccagacttcaagggcaaggtaaaatcctggacaggggccgctgtcaggtcgctctgagctgtctcgtttcacgtgacggaaacgtcagctatgcatggtacaggggttcgaaactgatccagaccgcgggaaaccttacctatttggacgaagaggttgatatcaacggaacacacacttacacttgtaacgtaagtaaccctgttagttgggaaagtcacacacttaatctcacgcaagattgccagaacgcacaccaggaatttcgattttggccctttctggtcataattgtaatcctgtctgcattattcctgggaactctggcgtgcttttgtgtatggcgccggaaaagaaaggaaaagcaaagcgaaacctcaccaaaggaattcctgaccatctatgaagacgtcaaggatcttaaaactcgacgtaaccatgagcaggagcagacgttccctggaggcggctctacaatctatagcatgatccaatctcagtcctcagctcctacctcccaagagccagcttataccctgtattccctgattcagccttctaggaagtccggcagccggaagaggaatcattcccccagctttaatagcacaatttatgaggtcatcggtaaaagtcagcccaaagcacagaacccagcaagactctcccgtaaggagctcgagaatttcgacgtctacagttag

SEQ ID NO: 111304 - DNA, 495 bp, Artificial Sequence
  Description of Artificial Sequence: Synthetic coding sequence
atgaagtggaaggctttatttaccgccgcgatcctgcaggcccagctgcccatcactgaggcacagtcttttggcctccttgacccaaaactgtgctatctgttggacggaatcctttttatctatggcgtcatccttacagcgctgttcctcagggtcaagttcagtagatctgcagatgctccagcctaccaacagggacagaaccagctttataacgagctcaacctgggtagacgggaagaatacgatgtgttagataaacgaaggggacgagacccggaaatgggcggaaagccccagcgccggaagaacccccaggaggggttatacaacgagctgcagaaggacaaaatggctgaggcgtactctgagattggaatgaagggggagcgacggcgggggaaaggtcacgacggtctttatcaaggccttagcaccgccacgaaggatacctacgatgctcttcacatgcaagccttgcctccaagatag

SEQ ID NO: 111305 - DNA, 492 bp, Artificial Sequence
  Description of Artificial Sequence: Synthetic coding sequence
atgaagtggaaggctctctttacagctgccatactccaggcacagctaccaattacagaagcacagtcctttggcttactcgatccgaaactctgctacctgctcgatggaatcttattcatctatggagtaattttgacggccctctttctacgggtgaaattcagtcgttccgcagatgcacccgcatatcagcaggggcagaatcagctctacaacgaactaaatctggggcgtcgggaggagtatgacgtgctggataagcggcgtggcagagacccagagatgggaggcaagcctcgtcggaaaaacccccaagagggtctctataacgaactgcagaaggacaagatggcggaagcatactctgagattggaatgaagggcgagcgaagaagggggaaggggcacgatggcttgtaccaagggctgagcacggcgactaaggacacgtatgacgccctccacatgcaggctttacctccgcgttag

SEQ ID NO: 111306 - DNA, 2274 bp, Artificial Sequence
  Description of Artificial Sequence: Synthetic coding sequence
atgcttcttcgtctcctgctggcatgggccgcagccggtccaacgctgggccaggatccctgggccgcggagccccgagcggcctgcggaccttctagctgctatgcgttgttcccaaggcgtcgaacatttctggaagcttggcgggcctgccgagaactggggggggaccttgcaaccccccgaactccagaagaggctcagagagtcgactcactggttggagccggaccagcatcccgcctcctctggatcggattgcaaagacaggctaggcagtgccaactgcagcggccactgcgaggattcacttggacaaccggtgatcaggacaccgcttttactaattgggcgcaacccgcctcaggtggaccctgcccggctcagcgatgtgttgcattggaggcctctggtgaacataggtggctcgaggggtcctgcacactcgctgtggacgggtacttgtgccagttcggttttgagggcgcttgcccagcattgcaggatgaggccggtcaggcgggcccagctgtttacaccactccatttcacctcgtctctacagagttcgagtggctgccctttggcagcgttgctgcggtccagtgccaggccggtcgcggcgcgagtcttttatgcgtcaagcagccagaaggcggtgtggggtggtcaagagccggccccctttgccttggcacaggatgcagccccgataacggcggctgcgaacacgagtgcgtggaagaggtggacggacacgtgagttgcagatgcacagagggcttccgtctcgctgcagatgggaggtcgtgtgaggatccgtgcgcacaggcgccctgtgaacagcagtgcgagcccgggggtcctcaaggatattcctgccactgcaggctgggttttcgtcccgcagaggatgacccacacaggtgtgttgatacagatgagtgtcaaattgccggagtttgccagcagatgtgcgtcaattatgtaggagggtttgagtgctactgctcagaaggacacgaattggaagctgacggaatctcgtgctctcccgccggggcaatgggtgcgcaagcttcccaggaccttggcgatgagctgctggacgatggggaagacgaagaagatgaggacgaggcatggaaggccttcaatggcggctggaccgaaatgcccggcatactgtggatggagccaacccagccccctgattttgctctggcataccgcccttcgttccccgaggaccgggaacctcagatcccctatcccgaacccacctggcccccacccctgtcagctccccgcgttccgtaccactcttccgttctctctgtgacccgacccgttgtggtctccgctacccacccaacattgccttcagcacaccagccacctgtcatccccgctactcatccagcactttctcgggatcaccaaatccctgtgatcgctgcaaactacccagatcttccctccgcatatcaaccaggtatcctctcagttagtcacagcgcccagccaccagcccaccagcctccaatgattagtacaaagtatccagagctgttccctgctcaccagagtccgatgtttcctgacacccgggtggcagggacacagacgacaactcatttgcctggtattccaccaaatcatgcccccttggtgaccacccttggagcacaattaccaccccaggcaccagacgcactggtgctgaggactcaggccacgcagttgccaatcatacctactgcacagccgagcctgactaccacgtctcggagccccgtgagtcccgctcatcaaattagtgtcccagctgcgactcagcccgccgcccttcccaccttactgccgtcccaatccccaacgaaccagaccagccccatcagccccactcaccctcatagcaaagcccctcagattccgcgagaagacggcccatcccctaaactcgcgctctggctgcccagtccagcaccaaccgcggccccgaccgccctgggcgaggccggattggctgagcactcccagcgtgatgatcgctggctcctggtggcacttctggtccctacatgcgttttcttggtggtgctgctggctctcggaatcgtgtactgtacaaggtgtgggccccatgcccccaacaagcgcattacagactgttacaggtgggttatacacgcaggtagtaagagtccaacagaacccatgccccccaggggctccctgacgggcgtacaaacttgccgcaccagcgtgtag

SEQ ID NO: 111307 - DNA, 951 bp, Artificial Sequence
  Description of Artificial Sequence: Synthetic coding sequence
atgctgagacggagagggtcccctggcatgggcgttcacgtgggcgccgccctcggtgccctgtggttttgtctgaccggcgccctcgaggtccaggttcctgaagatcctgtggtggcactggtgggaacagatgcaaccttgtgctgcagtttcagccccgaaccaggatttagtctggcacaactcaatcttatttggcagctgaccgacacgaagcagttagtgcactccttcgccgaagggcaggatcaggggagtgcctatgccaacaggacagctctgtttcccgatctcttggctcagggcaacgctagcctgaggctccagcgagtgagagtagcagacgaaggaagcttcacatgtttcgtgtcgattagagattttggcagcgccgcggtctctctacaggtcgcagcaccgtactcaaagccctcgatgactctggagcccaacaaggatctgaggccaggcgatactgtaactataacctgtagctcttaccgaggctaccccgaggccgaagtgttttggcaggatgggcagggcgttcccctcacaggcaatgtgactacctcgcagatggccaatgagcagggtctgtttgatgttcactctgtgctgcgcgttgttctgggagccaacggaacatactcatgcctggtgaggaatccggtcctgcaacaggacgctcatggctctgtgactattacaggccagccaatgacatttcctcccgaggccctgtgggtcacagtgggactcagtgtttgtctgatcgctctgctggtggcgctggcctttgtctgctggagaaaaatcaaacagtcatgcgaggaggagaacgcaggggctgaggaccaggacggggaaggcgaaggtagcaagaccgcactccagcctctcaaacacagtgattcaaaggaagacgacggccaggagatcgcgtag

SEQ ID NO: 111308 - DNA, 1605 bp, Artificial Sequence
  Description of Artificial Sequence: Synthetic coding sequence
atgctcagacgccgagggtcacctggaatgggcgtgcacgttggcgccgccctcggcgccctctggttttgtctgaccggggccctggaggttcaggtccctgaagatccagttgtggcactagtcggcaccgatgctaccctatgttgctccttcagtccagaaccaggtttctctctggcccagcttaacctcatttggcagctgactgataccaaacagctggtgcactctttcgcagaggggcaggatcagggctcagcttatgccaacagaaccgccttattcccggatctgctggcacaggggaacgcatcccttaggctgcaaagagtgcgagtggctgacgaagggagtttcacttgtttcgtgagcatccgcgacttcgggtctgccgctgtaagtctgcaagtggcagccccctatagcaaacccagtatgaccttggaacctaacaaggatctgagacccggtgataccgttacaataacgtgtagctcttaccaagggtacccagaggccgaagtcttttggcaggatgggcagggagtccctctgacagggaatgtcactacctcccagatggccaacgaacagggcctctttgatgttcacagtatcttacgcgtggtattgggagccaacggtacctattcctgtttggtgcgcaacccggtcctccagcaggacgcacactccagcgtgaccataactccgcagaggtctcccactggcgctgtggaggtgcaggtgccagaggatccagtcgtggccctggttgggaccgacgcaacactacggtgcagcttctcccccgaacctggtttcagcctcgcacagctgaatctcatctggcagctgacagacaccaaacagctggtgcattcatttacagagggacgggatcagggttcagcatatgcaaataggaccgcgctgtttcccgacttactggcacagggcaatgcctcgctgaggttgcaaagagtcagggttgccgatgagggctcttttacctgcttcgtctcaattcgtgattttgggagcgcggccgtcagcttacaggtggctgccccttattccaaaccgtctatgacactggagcccaataaggaccttcgcccgggcgacactgtgactatcacatgcagttcatacagggggtaccccgaggccgaagtgttctggcaggatggccagggggtaccattgacaggcaatgtgaccacttcccagatggccaacgagcagggtttgtttgacgtgcattctgttctgcgtgtggtgcttggggccaacgggacctactcatgcctggtccggaatcccgttctccagcaggatgcccacggcagcgttactatcactggtcagcccatgacctttccccccgaagcactgtgggtaactgttggcctgtcggtctgcctgatcgctcttttggttgcacttgccttcgtttgctggagaaaaatcaagcagagctgtgaagaggagaatgccggggccgaggaccaggacggagagggggagggttcaaagaccgctttgcagcccctgaaacacagcgatagcaaagaagacgatggacaggaaattgcctag

SEQ ID NO: 111309 - DNA, 1482 bp, Artificial Sequence
  Description of Artificial Sequence: Synthetic coding sequence
atgttgaggaggcgggggtccccaggcatgggagtccacgtcggcgctgcgttgggagccctatggttctgcctgacaggggcgctcgaggtccaggtgccagaagacccagtagtggccttggtcggaaccgatgccactctctgctgtagctttagcccagaacctggcttttccctggcccagttaaacctcatctggcagctgactgacactaagcagctcgtgcacagcttcgcagaggggcaagaccagggatccgcctatgcaaaccggacggctctgttccctgatttgttggctcagggaaacgcctccctgcgccttcaaagagtgcgcgtagctgatgaaggaagttttacttgcttcgtcagcatccgagacttcggaagcgcagcggtgtccctgcaggtggctgcgccttactcaaaacctagcatgactctagaaccaaataaggatctgaggccaggagacacagtcacaataacctgctccagctatcagggttatccagaggctgaagtgttttggcaggatgggcagggagtacccctgacaggtaacgtgaccacatcacaaatggcaaacgaacagggactgtttgatgtgcactctatcctccgcgtggtcctaggggctaacggtacatacagctgccttgtcaggaatcccgtgctgcagcaggatgcgcactctagcgttaccattaccccgcagaggtctcctaccggcgcggtggaggtgcaggtgcccgaggatcccgtcgtggccttagtcggcactgacgctacccttcgctgcagtttctcacccgagcccgggtttagtctcgcacagttgaacctgatttggcagctcacggatacaaaacagctggttcactctttcacagaaggacgggatcagggaagcgcttacgcaaatagaacagccctctttcccgatctgttggcccaggggaatgcctctctgcggctgcaaagggttcgcgttgccgatgagggcagcttcacttgcttcgtttctattagggactttggatccgcagccgtgagcctccaagtcgcagcaccatattccaagccatcgatgaccctggaaccaaacaaggatttgcgtcctggggatacggtgaccatcacgtgctcatcttatcgggggtatcccgaagcagaggttttctggcaggacggccagggcgttcccttgacggggaacgtgacgactagccagatggctaatgagcagggccttttcgatgtacatagtgtgctccgggtcgtgttaggagcgaatggtacttactcctgcttggtgcgtaaccctgtcctacaacaggatgcgcatgggagcgtgaccatcacaggacaacccatgaccttcccacctggccctgcctccagcgcagtccctcttagtcctgcccaccccccacacggcagtatgtgttggtcccactggttctcccggggactttag

SEQ ID NO: 111310 - DNA, 423 bp, Artificial Sequence
  Description of Artificial Sequence: Synthetic coding sequence
atgcttcggcggcgggggtctcctggaatgggggtccatgtaggggccgcactgggtgctctctggttttgccttactggagccctggaggtacaagtaccagaggatcctgtagtggcactcgtcggaaccgatgccacactttgttgtagcttcagccccgagcccgggttttccctggcccaactgaatctgatctggcaattgacagacacgaaacagctggtccactccttcgccgaaggccaggatcagggtagcgcctacgcaaatagaaccgccttgtttccagatctgcaccgggccgcatacgacattccgccacgggggcctgtgggtgaccgaggagccgtgtgtctgtcgcactgtacagccggagggccgggcttccgggtactggaaaaggatcagactgagctctag

SEQ ID NO: 111311 - DNA, 411 bp, Artificial Sequence
  Description of Artificial Sequence: Synthetic coding sequence
atgcttaggcgcagaggctcacctggaatgggcgtgcatgtcggggcggccctgggcgccctgtggttctgtttgacaggggcccttgaggtgcaggtgcccgaagaccccgtggtggccttagtaggaaccgatgctactctgtgttgctccttttcacctgagcccggcttcagtctggcacagctgaaccttatttggcagttgacagacacaaagcagctggtgcatagcttcgctgagggtcaagatcaggggtcagcatacgctaaccgtactgcattattcccagaccttttggcccagggcaatgcctctctcagactacaacgagtgagggtcgcggacgaaggctcgttcacgtgcttcgtgtcgatcagggactttgggtccgctgccgtgagtctatag

SEQ ID NO: 111312 - DNA, 402 bp, Artificial Sequence
  Description of Artificial Sequence: Synthetic coding sequence
atgctccgccgccgcggcagtcccggaatgggcgtgcacgtcggagccgccctcggcgccctgtggttttgcttaacaggtgcgcttgaggtccaggttccggaggaccccgtcgtcgcactcgtgggaacagacgccacgctctgctgtagtttcagtcctgaaccggggttctcattagcacagctgaatctcatctggcagctgactgacactaagcagttggtgcattccttcgccgaagggcaagaccaggggtctgcctacgcgaatcggaccgctctgtttcccgacttgttggcccagggcaacgcgagtctgaggcttcagcgagtgagagtagcagatgagggttcttttacctgtttcgtgtccattagggatttcggaagtgctgcctag

SEQ ID NO: 111313 - DNA, 1602 bp, Artificial Sequence
  Description of Artificial Sequence: Synthetic coding sequence
atgctgcgccggcggggtagccctggaatgggcgtgcacgtaggcgctgctctcggcgctctgtggttttgtttaacgggggccctcgaggtacaggtcccagaagacccagttgtcgctctggttggcactgacgcaacactttgctgtagcttttctcccgagcctggattcagcttggcacagctcaaccttatctggcagctaactgataccaagcagttagttcactcctttgctgaaggacaggatcaaggctccgcgtatgccaatcgcaccgccttgtttcccgacttactggcccaagggaatgccagcctgcgcctgcagcgtgtccgcgttgctgacgaggggtccttcacctgcttcgtatctatacgagacttcgggtccgctgccgtctctctgcaagtggccgctccatacagcaagccttccatgaccctggagcccaacaaagatctgagacccggcgacaccgtgacaattacctgctcttcatatcaggggtacccggaagcggaagtgttttggcaggacggacaaggagtgcccttgacagggaacgttacaacctctcaaatggcaaacgaacagggccttttcgacgtgcattcgatcctgagagtagtgctgggggccaacgggacatactcgtgcttggtgcgtaaccccgtgctccagcaggacgcccatagcagcgtcactatcacgcctcaacgctcacctacaggtgccgtggaggtccaggtccccgaggatccggtcgtagcgttagttggtacagacgccacgctgagatgctctttttcaccagagcccgggttctcgctcgctcaattaaatctgatctggcaactgacagacacgaaacagctcgttcactccttcactgagggccgggatcaggggtcagcatatgctaaccggactgcgctctttccagacctgctggcccagggaaacgcatcgctgcgcttgcagcgtgttagggtggctgatgagggttccttcacttgttttgtgtccatcagagactttggcagtgcagcagtaagtctccaggttgcagctccatactctaagccaagcatgacgcttgagccaaataaggaccttcgacccggcgatactgtcaccatcacatgctcatcctaccggggatacccagaggcagaagtgttttggcaggatgggcagggtgttccccttactggtaacgttactacctcacagatggcaaatgaacaaggtttatttgatgtgcacagcgtgctgagggtggtgcttggtgcaaatgggacttactcatgtctagtgagaaatccggtgcttcagcaggacgcacacggcagtgttacgatcactggacagcccatgacctttccacccgaagcattgtgggttaccgtagggctatccgtgtgtctgatagcactactagtagccctggcttttgtctgctggcgcaaaataaaacaatcatgcgaggaggaaaacgccggtgctgaagaccaggatggggaaggggagggttccaaaactgcacttcaacctctcaagcattctgactctaaagaggggaaagatacctgggcctag

SEQ ID NO: 111314 - DNA, 498 bp, Artificial Sequence
  Description of Artificial Sequence: Synthetic coding sequence
atgctgcgccgtcgaggatctccaggaatgggggtccacgtgggagccgccctaggcgctttatggttctgtctcaccggcgcattagaggtccaagtgcccgaggaccccgtggtggccctggttggcactgacgccacattgtgctgttctttttcacctgagcctggtttctcgcttgctcagttgaacctgatctggcagttaacagacacaaagcagctcgtccactcctttgccgagggacaggaccagggatccgcctatgccaataggacagcattgttcccagacctgttggctcagggcaatgcgagcttaaggcttcagagagtgagggtcgccgacgaagggtctttcacgtgctttgtctccatccgcgacttcgggtcggctgcggtgtccctgcaggtcgctgccccgtattccaagccaagtatgacacttgaacctaacaaggacctacgacctggcgacacagttacaataacctgctag

SEQ ID NO: 111315 - DNA, 156 bp, Artificial Sequence
  Description of Artificial Sequence: Synthetic coding sequence
atgcttcggcgtaggggctcccccgggatgggggtgcacgtgggggccgccctaggtgccctttggttttgcttgaccggcgcactcgaggtgcaagtaccagaggaccctgtggttgcactggtcggcactgatgctaccctgtgttgctcttag

SEQ ID NO: 111316 - DNA, 663 bp, Artificial Sequence
  Description of Artificial Sequence: Synthetic coding sequence
atgttgcggctgttgcttgccctcaacctgttcccttcaattcaggtgaccggaaacaagattttagtgaaacagtccccaatgttggtcgcttatgataatgctgtgaacctgtcttgtaagtatagctacaatctgttctcacgagagtttagggcgagcctgcataagggactcgactcagctgtggaagtatgtgtagtgtacggaaactatagtcagcagttacaagtgtactcgaaaacaggctttaactgcgacggtaagctgggcaacgaatctgtgacgttctatctccagaacctgtacgttaaccagacagatatttacttttgtaagatcgaggttatgtaccccccgccctatctggataatgaaaaatccaatggcaccatcatccatgtcaagggaaagcacctctgccctagccctctttttcctggccccagcaagcctttctgggttctggtcgtagtgggcggagtgctggcttgttactccctcctagtgactgtggcattcatcatcttttgggtcaggtcaaaaaggagccgtctgctgcatagcgactatatgaatatgactccaaggcgccccgggcctaccagaaaacactaccagccttatgctcctccgcgtgactttgccgcctatcggagctag

SEQ ID NO: 111317 - DNA, 306 bp, Artificial Sequence
  Description of Artificial Sequence: Synthetic coding sequence
atgctgcggctcctccttgcgctcaatttgttccctagtattcaggttaccggtaagcacctatgcccgagtcccctgttccccggaccgtctaagccattctgggtcctggtcgtggtcggtggagtgctggcctgttatagcctgttggtcactgtagcctttattattttttgggtcagatctaaaagatcccgtcttctccacagtgattatatgaacatgaccccaaggaggcccgggcctacccgcaagcactaccagccttacgccccacctagggattttgccgcttacaggtcctag

SEQ ID NO: 111318 - DNA, 411 bp, Artificial Sequence
  Description of Artificial Sequence: Synthetic coding sequence
atgctgagactgcttctggccctaaatctcttccccagtatacaggtgacagggaacaaaattcttgtgaaacagtcgcctatgctcgttgcatacgataatgccgtaaacctgtcgtacaatgaaaaatccaatgggaccatcatccacgtaaagggaaagcatctttgcccttctccactgtttccaggcccctccaaaccattctgggtgctcgtggtggtcggtggggttttggcctgctacagcttgctggttacagtggcattcatcatcttctgggttaggagcaagagaagccggctgctccactcagactacatgaacatgacacctagaaggccaggcccaaccagaaaacactatcaaccgtacgccccgccccgcgattttgcagcttaccgctcttag

SEQ ID NO: 111319 - DNA, 705 bp, Artificial Sequence
  Description of Artificial Sequence: Synthetic coding sequence
atgccttgtggcctgtccgcactcataatgtgtccaaagggtatggtggcagttgtggtggcagttgacgatggtgatagccaggcattagccgggaataagatactcgtgaagcaatctcctatgcttgtggcatacgataatgccgttaatctcagctgcaagtacagctacaatctgttttctagagagtttcgtgcaagcctgcacaagggcttggactcggccgtagaggtgtgcgtcgtttatgggaactatagtcaacagttacaggtttacagcaaaacagggtttaattgcgacggcaagttgggaaacgaatctgttactttttatctgcagaacctgtacgtaaaccagacggatatctacttctgcaaaatcgaagttatgtacccccccccatatttggataacgagaaatccaacggtacaatcattcatgtgaagggcaaacacctctgtcctagccctttgtttcccggaccatctaaaccgttttgggtactggtggtggtcggcggcgtgctggcctgttatagtttgctggtcactgtggcctttatcatcttttgggtcagatctaagaggagcaggcttctgcatagcgattacatgaatatgactccgcgaaggcctggacccacacggaagcactaccagccatatgctcccccccgagatttcgccgcgtatcgtagctag

SEQ ID NO: 111320 - DNA, 1920 bp, Artificial Sequence
  Description of Artificial Sequence: Synthetic coding sequence
atggtcgactacattgtggagtatgattatgacgccgtccacgacgatgaactgacaataagagtgggcgagatcattaggaacgtaaagaagcttcaggaagagggctggctcgagggggagctgaatggccgtcggggaatgttccctgacaactttgtcaaggaaattaagcgggaaacagagttcaaggacgacagcctacctatcaaacgcgagcggcacgggaatgtggcaagcctagtccagcgtatctccacatatggtctgcccgccggcgggatccaaccgcacccgcagacaaagaacatcaagaaaaagacgaaaaaaaggcagtgtaaggtactattcgaatacattcctcaaaatgaggacgagctcgagctgaaggtgggcgacattatcgatattaatgaggaggtagaagagggttggtggagcggtacgctcaataacaaacttgggctgtttccttctaacttcgtcaaggagctggaggtcactgacgatggcgaaacccatgaagcccaggatgacagtgaaacagtgctcgccggaccaacctcgcccattccatcactgggcaatgtgagcgagactgcatcaggttctgtgacgcaacccaagaagatccgtggaattggatttggcgatattttcaaggagggtagcgtgaaacttcggacccggaccagcagtagcgagaccgaagagaagaagcctgagaagccactcattttgcagtccctcggtcccaagacccagtctgttgaaatcacaaaaacagataccgaggggaaaattaaggcgaaggagtactgccgcaccttgttcgcctatgaggggaccaacgaggacgagttaactttcaaagagggcgaaatcattcacttgatatccaaagagactggtgaagcaggctggtggaggggtgagttgaacggcaaggagggcgtttttcctgataactttgcagtgcagataaacgaactggataaggacttccccaaaccaaagaaaccgccccccccagccaaggcccccgctcctaagcccgagctgatcgctgccgagaagaagtatttcagccttaaacccgaagaaaaggacgagaaatccacactggagcagaagccttcgaagccggccgccccgcaggtgcctcctaagaaacctactcctccgactaaggcttctaatctgcttcgtagttccggcacagtgtaccccaagaggcccgaaaagccagtacctcctccgccccctattgcaaaaattaacggggaggtgtcttctatatcttccaaattcgaaaccgagcccgtttctaaattaaaactcgactcagaacagctgccgctgaggcccaaatccgttgacttcgatagcctgaccgtgagaacctcaaaagagaccgacgtggttaattttgacgacatagctagtagtgaaaatctgctccatctgactgcgaaccgacccaagatgcctggcagacgactgcccggccgatttaacggcggtcattcacctacacacagccccgaaaagatcctcaaattaccaaaggaagaggattccgcaaaccttaaaccgagtgaactcaaaaaagacacttgctacagtcccaagccatccgtgtatttgtcaaccccgtcttcagctagtaaggccaacaccaccgcctttctgacacctctggagatcaaagcaaaagttgaaactgacgacgtgaagaagaacagcctcgatgaactgcgtgctcagatcattgagctcctttgcatagtggaagctctgaaaaaggaccacggaaaagagttggagaaactgcggaaggatttggaagaggagaagactatgcggagcaatctcgagatggaaattgagaaactgaaaaaggcggtcctgagttcatag

SEQ ID NO: 111321 - DNA, 717 bp, Artificial Sequence
  Description of Artificial Sequence: Synthetic coding sequence
atgtgccggaggtgtaaaccagagctcaggcagaattttcagagcgcctctggaatctgtatctgtcactggctgcagatacggagaactaggagccgcgaaggcagggcaatgtggttaccgccggcgctgctacttctgagcctgtctggctgcttttcaattcagggacccgagagcgtaagagctcccgagcagggatccctgactgtacagtgccactataagcaaggctgggaaacctacattaaatggtggtgccgcggcgtgagatgggacacctgtaagatactgatcgaaaccaggggctctgagcagggagaaaaaagcgatcgggtctccatcaaggacaatcagaaagataggacttttaccgtcactatggaaggcctgaggcgggacgatgcggatgtctattggtgtggcatcgagagaaggggcccagacctgggtacacaggttaaagttattgtggatcccgagggtgccgccagcaccaccgcttctagtcctactaactcaaatatggctgtgtttattggttctcacaagcgtaatcattacatgctgctcgtcttcgttaaagtccctattctgctgattctggtaaccgcgatcctctggctcaagggcagtcaacgcgtgccagaggagcctggcgaacagcctatctatatgaacttctccgaacctttgaccaaggacatggcaacctag

SEQ ID NO: 111322 - DNA, 606 bp, Artificial Sequence
  Description of Artificial Sequence: Synthetic coding sequence
atgtggctgccccccgccctgctgctgctgtctctgtcaggatgcttttcaattcagggccctgaatccgtgcgagcaccggaacagggctctctgacagtccaatgtcactacaagcaaggatgggaaacctacattaagtggtggtgcaggggagtgaggtgggacacgtgtaaaatcttgattgaaacacgggggtctgaacaaggcgagaagagtgatagagtcagcataaaagacaaccaaaaagacaggacctttacagtgacgatggaaggcctgcgcagggacgacgcagatgtgtattggtgtgggatcgagaggagagggcccgacctgggtacccaggtcaaggtaattgttgatccagagggcgcagcttccaccacagcatcatcacctactaactccaacatggcagtattcattggaagccataaacgcaaccattacatgctgctggtctttgtgaaggtccccattctgttgatcctggtgaccgccattttgtggcttaagggctcccagagagtgccagaagaaccaggggaacagccaatctacatgaatttcagtgaacccctcaccaaggatatggccacctag

SEQ ID NO: 111323 - DNA, 735 bp, Artificial Sequence
  Description of Artificial Sequence: Synthetic coding sequence
atgccccttctgacattgtacctgcttctcttttggctaagtggctattctatagtcactcagatcacgggcccaaccacagtcaatggcttagaacgcggctcactaacggtgcagtgcgtgtacaggtcgggttgggaaacctacttgaaatggtggtgccgaggagcaatatggagggattgcaagattctggttaagacctctggctctgaacaggaagtgaagagggacagggtctcaatcaaggacaatcaaaaaaatagaacctttacagttactatggaagaccttatgaaaacagacgcagatacatactggtgtggcatcgagaaaaccggtaacgacctcggtgtgactgtgcaggtgaccattgatcccgcccctgttacacaggaggagactagctcctcacctactctcacaggccatcacctagataatcgaagcgagggatcccaggctgccaattacagacctgccgcgcaccaggcacaggcacctgaggcacaatgcccacccgcccctcatctccaccatattgccgccgctttcggcggtaggctgaccctgggactggaggatgacgaagttccagccgagtccagtcgggatgtgcctagggccgggaccgcagcgcctggagggcgtcccctgctttgccggccagatccggccgctggaagaaatctgcccgcaaaaggctaccacgaggccttcctgtgtcctggttag

SEQ ID NO: 111324 - DNA, 873 bp, Artificial Sequence
  Description of Artificial Sequence: Synthetic coding sequence
atgcctctgttaacgctctacctgctgctgttctggctcagtgggtactctatcgtgacccagatcaccgggcccaccacagtcaacggcctagaacggggcagtttgacagtccagtgtgtttataggtctggatgggagacttatctgaagtggtggtgtagaggcgcaatctggcgcgattgcaagattctggttaagacaagcggctctgagcaggaagtaaaaagagacagagttagtatcaaggataatcagaagaaccggaccttcaccgtgaccatggaggaccttatgaagactgacgctgatacctactggtgcggaatcgaaaagactgggaacgacctgggtgtgaccgttcaggttacaatcgaccctgcacccgtaacccaggaggagacgtcgtccagtccgactttgacaggccatcacctggataacagacacaagctcctaaagctttcagttctgctgccattaattttcacaattctcctgctgcttctggtggccgcatccctcctggcttggcgcatgatgaaatatcagcagaaagcagccggtatgagccccgagcaagtcctgcagccacttgagggcgacctgtgttacgcagacttgaccctacaactcgccggcacaagcccgcagaaagccacaacaaaactgtcttctgcccaagttgaccaggtggaggttgagtacgtgaccatggcaagtctgccgaaggaagacattagctatgcttcattgaccttgggggctgaagaccaagagcccacatactgcaacatgggccatttatcttcccatcttccaggaagaggaccagaggagcctacagagtactcaaccatctccagaccttag

SEQ ID NO: 111325 - DNA, 585 bp, Artificial Sequence
  Description of Artificial Sequence: Synthetic coding sequence
atgtggctgcctcaacttgatctcatgagagttattagtgccaaaagccagggttattcaatagtgacccagattacaggacctaccactgtgaacggcctggaaagggggtcactgacagtgcaatgcgtttatagaagcgggtgggagacatatctgaagtggtggtgtcgcggtgccatctggcgggattgcaaaatcctggtgaaaacctcaggcagcgaacaggaggtcaagcgtgacagagtgtccattaaagataaccagaaaaatcgcactttcacagtgacaatggaggacctgatgaaaactgatgctgacacatattggtgcggcattgaaaagacagggaacgacctgggggtaacagtgcaagtgaccatcgatccagcccccgtaacccaagaggaaacctccagttcccccacacttactggacatcaccttgacaatagtagcagagatgtgccccgtgcgggcaccgccgcccccggtggcaggcctctgctgtgccggcctgaccctgccgccggcaggaatctcccagccaaagggtatcacgaagctttcctgtgtcctggctag

SEQ ID NO: 111326 - DNA, 720 bp, Artificial Sequence
  Description of Artificial Sequence: Synthetic coding sequence
atgtggctccctcagttggacctgatgagagtgatatcggctaaaagccaggggtactctatcgtgactcagattacagggccgacaacggttaacggacttgaacggggatctctaaccgttcagtgcgtttatcggtctggatgggagacctacttaaagtggtggtgtaggggagcaatttggcgtgattgcaagattctcgtgaagacttccgggagtgagcaggaggtgaaacgggatagggtgagcatcaaagataatcaaaagaacagaacatttaccgtgaccatggaagatctcatgaagactgatgctgacacttactggtgtgggatcgaaaagactggaaatgatctcggagtgaccgttcaggtcactatcgaccccgcctccactcccgcccccactacccccacatccacaacctttacggctccagtaactcaggaggagacttcttcttcccctaccctcacgggccatcacctcgacaatagacataagcttctgaaacttagtgtcctcttgcccctgattttcaccatactgctgttgctgcttgtggctgcctccttactggcgtggcggatgatgaaataccagcagaagggaactgcggccccaggtgggaggccattgttatgtagaccggacccagccgcaggccggaacctgcctgcaaaggggtaccatgaggcatttctgtgcccaggatag

SEQ ID NO: 111327 - DNA, 699 bp, Artificial Sequence
  Description of Artificial Sequence: Synthetic coding sequence
atgttacgggcggccctgcctgcgcttcttctgccactattgggattagcggccgccgctgtagccgattgtcctagttcaacctggatacagttccaagacagttgctacatcttcttgcaagaagcgatcaaagtcgagagcatagaagacgttcgcaatcagtgcacggaccatggtgccgacatgattagcattcataatgaggaggagaacgcttttatactcgataccctgaagaagcagtggaagggccctgatgatattctgctcggcatgttttatgatacagacgacgcttcgttcaagtggttcgacaactccaacatgacattcgacaagtggacggatcaagacgatgatgaagaccttgtagatacctgtgcgttcctacacatcaagaccggagaatggaagaaaggcaattgcgaagtttcaagcgttgaaggaacgctgtgcaaaacagcgattccatacaagaggaaatacctgtctgataatcatatcctgatttctgctctggtgattgcctcaacagtgatccttactgtcctcggagctattatttggttcctgtacaaaaaacattccgactcacgcttcactaccgtattttctacggctccacagtcaccttacaatgaggattgcgtgctcgtggtaggcgaggagaatgagtatccagtccagttcgactag

SEQ ID NO: 111328 - DNA, 525 bp, Artificial Sequence
  Description of Artificial Sequence: Synthetic coding sequence
atgctgcgggccgctctgccggcgctgctgctgccactgcttggcttggccgccgccgctgtcgcggattgccctagcagtacctggatccagttccaggactcctgttatatttttctccaagaagccataaaggttgaatctattgaagatgtgcggaatcagtgtactgaccatggcgctgacatgatcagcatccacaatgaggaggagaatgcattcatcctggataccttaaagaaacagtggaagggccccgatgacattcttctgggaatgttttacgatactgatgtgccctacaaaagaaaatacctgtccgataatcacatcctgatctccgccctggtgattgctagcactgtaattctcacggtgctcggagccataatctggtttttatacaagaagcatagcgatagtagattcactactgtcttctccactgcaccacagtcgccctacaatgaagactgtgtgcttgtggtgggtgaggaaaacgaatacccagtgcaattcgactag

SEQ ID NO: 111329 - DNA, 849 bp, Artificial Sequence
  Description of Artificial Sequence: Synthetic coding sequence
atgagcgggggctggatggcccaggtcggcgcgtggagaacaggcgccttagggttagcacttctgttactcttagggcttggcctcggtctggaagccgcagcaagccctctgtccacccccacttcagcccaagcggctggtccttctagtggttcgtgtccacctaccaagttccagtgtaggaccagcggcctttgtgtgcctctgacctggcgatgcgaccgtgacctagattgcagcgacggtagtgacgaagaagagtgcagaatcgagccttgtacacagaaaggacagtgtcctccccccccaggcttgccctgtccctgcacgggagtctcagactgtagcgggggcaccgataagaagctgcgaaactgtagtagacttgcctgtctggcgggcgaactgaggtgtaccctctctgatgattgcattccactgacttggagatgcgatggacaccctgactgccccgatagcagcgatgaacttggctgtggtaccaacgagatactgcccgagggagatgctacgacgatggggccacctgttaccctggaatctgtcacctccttaaggaacgctaccacaatggggccccctgttacgcttgagtctgtcccctcggttggaaatgcaacttcatcctctgctggcgatcagtccggtagcccgaccgcatacggagtgattgccgccgccgcagtgctctctgcatctctggtaacggccaccttgctgcttctgagctggctgcgggcccaagagagattgcgccctttaggcttgctcgtcgcaatgaaagaatcccttctgctgtctgaacagaaaacctctctgccctag

SEQ ID NO: 111330 - DNA, 606 bp, Artificial Sequence
  Description of Artificial Sequence: Synthetic coding sequence
aatgaaatcctgccagaaggcgatgctacaacaatggggccccccgtgacccttgagtcagtaacctctctgaggaacgccaccacaatgggaccgccggtgactcttgagagcgttcccagcgtcgggaatgctatactgctatgcaggcgtccggtgtggaagcccaactgcctgtgggggtactgttcctgctgtggtgcacaatgcaaacccggccaccggcaccctccacccttcgtactcgcaccttcccctggtgctccaccccccactggggtaaccggagggcatgagggagtccctgctgccgtgcgcacagaggacttggcggcattgcgcacgtcaacctgccatcatagacacagcgctcttggtgtggcaggacaggaagagagcagcgacgccgatggctaccccggaacgccggccttacgggacctctctagctctgggcacgtagagccgcgcactagggcacctgctgaggtcgccctggagattgagggtccctggaccctgccaatggaaatcagaggggccagaatgggcaaccttccccaacctgaactgcgtggttggccacaggccgcacctcgcggctag

SEQ ID NO: 111331 - DNA, 723 bp, Artificial Sequence
  Description of Artificial Sequence: Synthetic coding sequence
atgtcaggtgggtggatggcccaggttggcgcatggcggacaggtgcactgggccttgcacttctactgctactgggcctaggactggggttggaggctgctgctagcccgctgtcaacaccaacatctgcccaagcagcaggaattgagccttgtactcagaaaggacagtgccctcctccaccggggctgccctgtccctgcacaggagtgagcgactgctctggtggcaccgacaaaaaattgaggaactgttctagactcgcctgcttggctggcgaacttcgatgcaccctgagcgacgactgtattccactcacttggcggtgtgacggtcaccccgactgccctgattccagcgatgaactcggctgcggcaccaacgaaattttgcccgagggggatgctactactatggggcctccggtcactcttgaatctgtcacctctctaaggaatgctaccaccatgggcccacctgtgaccttagagtccgtgcctagcgtcggaaatgccacctcgtctagcgccggggatcagtcgggttcccccacagcttatggcgtaatcgccgcagccgcggtactttctgccagcttggtcaccgcgaccctattgctcctcagctggctcagggcccaggaacgtctgcgcccactcggacttttagtggccatgaaagagagcctgctgctgtccgagcaaaagacgtctcttccttag

SEQ ID NO: 111332 - DNA, 1095 bp, Artificial Sequence
  Description of Artificial Sequence: Synthetic coding sequence
atgcctcttcttcttttactgccacttttgtgggccggagccctggccatggaccctaatttctggctccaggtacaggaatctgtgaccgtccaagaagggctgtgcgtgctcgtcccatgtacattcttccaccccattccgtattacgacaagaatagcccggtgcacggctactggtttagagagggcgccatcatttctcgcgattcccctgtggcaacaaataagctggaccaggaggtccaggaagagacccagggcaggtttagactactgggggaccctagtcgcaataactgtagtctgtctattgtggacgcccgccgacgggataacggttcatacttctttcggatggaaaggggcagtacgaagtattcttacaagagtccccaactaagtgtacacgtgacggatctgacacaccggcccaagatcctgatccctggaacactggagccaggacacagcaagaacctcacttgcagcgtctcctgggcctgcgagcaagggaccccaccaattttttcctggctcagcgctgcgcctacttccctcgggccgcgcaccacccacagctccgttctgattattactcctcgcccccaggaccacggtacaaatttgacatgccaggtcaagttcgctggagctggagtcactaccgagagaactatccagctgaacgtgacatacgtcccacaaaacccaacgacaggtatcttccccggcgacggatcagggaagcaggagacccgcgccggtgttgtgcacggcgccatcgggggcgccggtgtgaccgcgctgctggctctctgtctttgtctgattttttttattgtcaaaacccatcgacgcaaggcagccaggacggccgttggaaggaatgatacacacccgacgactggttcggcttcacctaaacatcagaagaagtcaaagctccatggcccaacagagacctcaagctgctctggtgccgctcctaccgtagagatggacgaagagctccactacgctagtttgaattttcacgggatgaatccctccaaggatacaagcactgagtatagcgaggtcaggacgcaatag

SEQ ID NO: 111333 - DNA, 933 bp, Artificial Sequence
  Description of Artificial Sequence: Synthetic coding sequence
atgcctttgcttctgttgctcccgctgctgtgggcaggcgcactggctatggaccccaatttttggctgcaagtgcaggaatcagttactgtgcaggaggggctgtgcgttctggtcccctgcacgttttttcaccccatcccgtactacgacaagaattccccagttcatggatactggttccgcgaaggagctatcataagcagagacagccctgtggccactaataaattggatcaggaagttcaggaggagacccaggggagatttaggctcctcggggacccctctcggaacaactgtagtctttcaattgtggatgcccggaggcgagacaacggctcatactttttccgcatggagcgggggagcactaagtattcttacaaatcccctcagctcagtgtccacgttacagatcttacacacaggcccaagatattaattccggggactttggaacccggccactctaagaacctgacctgctctgtgtcatgggcctgcgaacagggcacacctccaatatttagttggctttcggctgctcctacttctctcggcccgaggacaacccactcatccgttctgatcatcacccctcggccacaagatcacgggactaacttaacatgtcaggtcaaatttgctggcgcaggggttacaaccgagcggacaatacaacttaacgtgacctatgtaccgcagaatcctacgactgggattttccctggtgacggtagcggcaagcaggagactcgcgctggggtggtgcatggcgccatcggcggtgccggagtcactgccctcctggccctgtgtctgtgcctaatcttctttatcgtcaaaacccataggcgtaaagcagccaggaccgctgtcggtaggaatgacacccacccaacaaccggctctgcctcaccagtgagatag

SEQ ID NO: 111334 - DNA, 714 bp, Artificial Sequence
  Description of Artificial Sequence: Synthetic coding sequence
atgccactgctgctgcttctacctctgctctgggcagatctcacccatcggcctaaaatactgatccccggtaccctggaacccggacactccaaaaacctgacctgctctgtcagctgggcctgcgaacaggggacccctccaatcttttcatggctaagcgcagcacccacaagtctgggtccaaggacgactcattcttccgtcttaattattaccccccgcccccaggaccatggtactaatctcacttgtcaggtcaagttcgcgggagccggagtgaccaccgagagaactatccagttaaatgtgacatacgtgcctcagaaccccacaacaggcatctttcctggtgatggcagtgggaagcaggaaacgcgcgccggtgttgtccatggggccataggtggcgccggcgtcacagcactgctcgcgctatgtctttgtttaatcttcttcatcgtgaagactcatagacggaaggctgcccgtacagccgtagggcggaatgatacccaccccaccactggaagcgccagccccaagcaccaaaagaagtccaagctgcacggacctaccgagacttcctcctgctccggtgcggctcctactgttgaaatggatgaggagcttcattacgcaagtctaaactttcatggaatgaacccaagcaaggatacctcaacagagtatagcgaagttaggacacaatag

SEQ ID NO: 111335 - DNA, 639 bp, Artificial Sequence
  Description of Artificial Sequence: Synthetic coding sequence
atgcctttgctactgcttcttcccctgctctgggccgacttaactcaccggcccaagattctgatacccgggaccctcgagccaggacattccaagaacctcacatgttccgtctcttgggcttgcgaacagggcacaccgccaatctttagttggttgtctgccgcacctacaagtctgggcccccgcactacacacagctcagtgctgatcattacacctcgaccccaggaccacgggactaatctgacatgccaggtgaagttcgccggcgcgggcgttacaactgaaagaactatccagttgaacgtgacctacgtccctcagaacccgacgaccggaatctttccgggtgacgggagcggtaaacaggagacaagagccggtgtcgtccacggagctataggcggcgcgggcgtgactgctcttctggccttatgtttgtgtttgatattcttcatcgtgaagactcatagaaggaaagcagcgcgaactgctgtcggacggaacgacacccacccaaccactggatctgccagccccgtgagtgatggcgcaagctggcaccccgtatgtcctgcagacactagttcccagtgcgggcccccaagttgcccaattcaacacttccagaactag

SEQ ID NO: 111336 - DNA, 1419 bp, Artificial Sequence
  Description of Artificial Sequence: Synthetic coding sequence
atgggctgcgataggaactgtgggctcatcgcaggtgctgttattggggcagtactagccgttttcggaggcattctaatgcccgttggcgatcttctgattcagaagacaattaaaaaacaagtcgtgctggaggagggcactatcgcctttaaaaattgggttaagactgggaccgaggtttatagacagttttggatcttcgatgttcagaacccgcaggaagtgatgatgaactctagcaacatccaagtcaagcagcggggaccatatacttatcgggtgaggtttctggctaaagaaaacgttacgcaggatgccgaagataacaccgtcagctttttgcaaccaaacggagctatatttgagccatctttaagcgtgggaaccgaagctgacaattttacagtgctgaatcttgccgtagccgcagcttctcatatctaccagaaccagtttgttcaaatgatcctgaactcacttataaataaaagcaaatccagtatgttccaggtgcgaactctgagggagctattgtgggggtaccgagatcctttcctcagtctggtgccctatcccgtcacaaccactgtgggactattctacccatacaataacaccgctgacggcgtgtacaaagttttcaatgggaaggacaacatttccaaggtcgctataatcgatacttataaggggaagagaaatcttagttactgggaatcacattgcgacatgatcaacggcacagatgccgcctcctttccgccatttgtggagaaatcacaagtgctgcagtttttcagctccgacatatgccgctctatatatgcggtgtttgagtccgacgtgaacttgaaaggcattcctgtctaccgatttgtgctgccctctaaagcgtttgctagtcctgtcgagaaccccgataactactgtttttgcacggaaaaaattatctcaaaaaactgtacaagttatggggtcctggacatttcaaaatgtaaagagggaagaccagtctacatcagtcttccacacttcctatacgcatcacctgacgttagcgagccgatcgacgggctgaatccaaacgaagaggagcatagaacctatttggatattgagcctattaccgggttcacgctgcaattcgctaaacggctgcaggtgaatctgctggtgaaacctagcgagaaaatccaggtgctgaaaaatctgaaacgtaattacatagtgcccatcctttggcttaatgaaaccgggaccatcggagatgagaaggccaatatgttcagaagtcaggtgacagggaagataaatcttctaggcctcatagagatgattcttctctctgtgggcgtggtgatgtttgttgctttcatgataagctattgtgcctgtcgcagtaaaacgatcaagtag

SEQ ID NO: 111337 - DNA, 1419 bp, Artificial Sequence
  Description of Artificial Sequence: Synthetic coding sequence
atgggatgcgacagaaattgcgggttgatcgcaggcgccgttattggcgccgtgctggctgtgtttggaggcattctgatgcctgttggggacctgctgatacagaaaaccatcaagaagcaggtggtcttagaagaggggaccatagcatttaagaactgggtgaaaaccggaactgaagtgtataggcagttttggatttttgacgtgcagaatccccaggaggtgatgatgaatagttccaatatccaagtcaagcagagaggcccatacacttaccgggtccggttcttagccaaagaaaacgtgacacaggacgcagaggacaatactgttagctttctgcaacccaacggcgctatctttgagccctctctgagtgtgggaacggaagccgataacttcactgtactcaatctcgctgtggctgctgcatctcacatttaccagaaccagttcgtgcagatgatcctaaacagcctgattaataagagcaaatcatctatgttccaggtgcgaacactgagggagctgttatggggatatagggatcctttcctgagcttagttccgtatcctgtcactactactgtggggctcttctacccatacaataataccgctgacggcgtttataaggtctttaacggaaaggacaatattagcaaggtggctatcatcgacacctacaaagggaaacgaaatttgtcctactgggaatcacactgtgacatgatcaatgggacggatgccgcctcttttcccccattcgtcgaaaagagtcaggtacttcagttcttctcatcagatatttgccgatcaatttacgcagtgttcgagagtgacgtgaacttgaaaggcattccagtgtaccgattcgtgctcccttcaaaggccttcgccagtcccgtggaaaacccggacaactattgcttttgcactgagaagattataagtaaaaactgcacgtcatatggagtcttagatatttccaaatgcaaggagggacggcctgtctatatcagcttgccacattttctctatgcgtctcccgacgtttccgagccgatcgacgggctgaatccaaatgaagaggagcatcgaacctacctcgacatcgaaccgatcactggatttactttgcaatttgctaaacggttgcaggtcaacctgttagtcaaaccaagtgagaagatccaggtgctaaagaatctgaaacggaattacatcgttccaatactatggcttaatgagactggcaccatcggcgacgaaaaggcaaatatgttcagatcgcaggtgacaggcaaaataaatttgctgggccttatcgaaatgattcttctgagcgtgggagttgtcatgtttgtggccttcatgatttcatattgcgcttgccgctcaaagaccatcaagtag

SEQ ID NO: 111338 - DNA, 612 bp, Artificial Sequence
  Description of Artificial Sequence: Synthetic coding sequence
atgggatgtgacaggaattgtggactgattgcaggagcagtgattggggcggtcttagccgtatttgggggaatcctgatgcctgtgggggatctgctgatccaaaaaactatcaaaaagcaggtggtgttggaggaaggcactatcgcattcaagaactgggtgaagacaggcaccgaagtgtaccgtcagttttggatcttcgacgtgcagaaccctcaggaggtcatgatgaacagctctaacatccaggttaaacaacggggaccctatacgtatcgcgtgcggttcttggccaaagagaacgttacacaggacgccgaggacaacacagtttcatttctacagcctaatggcgcaatcttcgagccatcgctttccgtgggaaccgaagctgacaactttacagttttaaacctggcggttgccgccgcctcccacatttatcagaaccagttcgttcagatgatactgaattcgttgattaacaagtccaagagctcgatgtttcaggtgcgcacactccgtgaattgttatggggatatagggaccccttcctgagtctggtcccgtatccagtgactaccactgtcgggctgttctacccatag

SEQ ID NO: 111339 - DNA, 1392 bp, Artificial Sequence
  Description of Artificial Sequence: Synthetic coding sequence
atggggtgtgaccgaaactgcggtctgattgcaggggccgtcatcggagctgttttagcagtgtttgggggaattctaatgcccgtgggtgacctgctgatccagaagacaataaagaagcaagtagtgctggaagaggggactattgcctttaagaactgggtaaagacgggcaccgaagtatacaggcaattctggatcttcgatgttcagaatcctcaggaagtcatgatgaacagctccaacatccaggtgaagcagcgcggcccctacacctaccgagtgaggttcctagccaaagagaatgtgacacaggatgccgaggacaatactgtttcgtttctgcagcctaacggagctatattcgagcccagcctatctgtcgggaccgaggccgataacttcacggtcttaaaccttgcagtggctgcagcaagtcatatctatcagaaccagtttgtacagatgattcttaatagcctgattaacaaatctaagagctcaatgttccaggtgcgtaccctaagggaactgctctggggttacagagacccattcttaagcttggtgccctaccccgtcactactactgtggggctcttctatccttacaacaataccgccgacggggtgtacaaggtgtttaatggcaaggataatataagcaaagtggctatcattgatacatacaagggtaagcgaaacttgagctactgggagtcacactgcgacatgatcaacggaactgatgctgcgtccttcccccccttcgtagagaagagccaggtcttgcaattttttagttccgatatctgtcgctccatctatgccgtgttcgaaagtgacgtgaacctcaaggggatcccagtgtaccggttcgttttaccatcaaaggcctttgcttcacctgtagagaatcctgataactactgcttttgtacggagaaaatcatcagcaagaactgcacctcctacggcgtgctggatatcagtaaatgcaaagagggccgacccgtgtacataagcctgccccatttcttgtacgctagtcccgacgtcagcgagcccatagacgggctgaatccaaacgaagaagaacataggacatacctcgatatcgagcctataactggtttcactcttcagttcgctaaacgcctccaggtgaatctcctggtgaagccctcggagaagatccaggtcctgaagaatttgaagcgaaactacatcgtacctattctgtggctaaatgagacgggaactattggcgatgagaaagccaacatgttcaggtcacaggtgaccggaaagattaacctgttaggcctgatagagatgatcctcctgtccgtgggcgtcgttatgtttgtcgcctttatgataagctattag

SEQ ID NO: 111340 - DNA, 447 bp, Artificial Sequence
  Description of Artificial Sequence: Synthetic coding sequence
atgggttgcgaccgaaactgcggtttaattgccggtgcagtaataggcgctgtcttggctgtgttcggtggtatcctgatgcctgtgggggatctcctcattcagaagactattaaaaagcaggttgtgttagaggagggaaccatcgctttcaagaactgggttaaaaccggcactgaggtttaccgacagttctggatctttgacgtgcagaatcctcaggaggtgatgatgaattccagcaacatccaggtgaaacagcggggcccatacacttaccgagtccgttttttggctaaggaaaacgtgacccaggacgcggaagataacacagtttcctttctacagcctaacggggctattttcgaacccagcttatccgtcggaaccgaggccgacaacttcactgtcctaaatttggccgttgctgccgcctcccacatctag

SEQ ID NO: 111341 - DNA, 282 bp, Artificial Sequence
  Description of Artificial Sequence: Synthetic coding sequence
atgggttgcgaccgtaattgcgggctgatcgcgggagcagttatcggagctgtgttggcggtttttggtgggatcctaatgccagtgggcgatctgctcatccagaagacaatcaaaaaacaagtggtgctcgaggaggggaccatcgcctttaagaattgggtgaaaactggcacagaggtttaccgacagttctggatctttgacgttcagaaccctcaggaagtcatgatgaactcatctaatatacaggtcaagcagaggggcccctatacctactag

SEQ ID NO: 111342 - DNA, 1419 bp, Artificial Sequence
  Description of Artificial Sequence: Synthetic coding sequence
atgggatgcgaccggaactgtgggctaattgccggcgctgtgataggagctgtccttgcggtgttcgggggaattttaatgcctgtcggtgacctactgattcaaaagacaatcaaaaaacaggtcgttcttgaggaaggtactattgcttttaaaaattgggttaagaccggcacggaagtgtatagacagttttggatcttcgacgttcagaaccctcaagaggtcatgatgaacagctcaaacatacaggtcaagcagcgtggtccatacacctacagagtccgctttctggccaaggaaaacgtgacacaagacgctgaggataacacggtctcctttcttcagcccaatggagcaatttttgagccatccctgagcgtcggaaccgaggcagacaattttacggtgctgaacctggccgtggctgccgctagccatatttatcagaatcagtttgtgcagatgatcctaaattcactgattaacaagtccaagtcgagcatgttccaagtgcgaaccctccgagagctcctgtggggctacagagatcctttcctcagccttgtaccatacccggtgacaactaccgttggtctgttttacccctacaataacacagctgacggggtctacaaagtcttcaatgggaaagacaacatttccaaggttgctattattgatacttacaaaggaaagagaaatctgtcctactgggagagccactgtgatatgatcaacggaaccgatgccgcatcatttcccccatttgtcgagaaaagtcaggtgttacagtttttttcgtcagacatttgcaggtccatctacgccgtgttcgagtcggatgttaacctgaaaggaattcctgtgtataggttcgttttgccctctaaggcattcgccagcccagttgagaatcctgacaactactgcttttgtactgagaaaattatctctaaaaattgcacatcctacggcgtattagacatcagtaagtgtaaggaaggccgacccgtgtatatctccttaccgcacttcttatacgcttcccctgacgtgagcgaaccaatcgacggcctcaatccaaatgaggaagagcatagaacatacctggacattgaaccgattacaggttttaccctgcagtttgcgaagcgactccaggtcaatcttttggtgaaaccaagcgagaagatacaggtgctgaaaaatcttaaacggaactacatagtgcccattctctggctgaacgagaccgggacaataggagacgagaaggccaacatgtttcggtcccaggtgactggcaagattaacttattgggattaattgagatgattctgcttagtgttggtgtggttatgtttgttgccttcatgatcagctattgcgcctgtcgcagcaagacaataaagtag

SEQ ID NO: 111343 - DNA, 1302 bp, Artificial Sequence
  Description of Artificial Sequence: Synthetic coding sequence
atgggatgcgataggaactgtggtttgattgctggcgctgtgataggcgcagtgctcgccgtgtttggcggcattctcatgcccgttggcgacttgctgattcagaaaaccattaagaaacaggtggtgttagaggagggcacaattgctttcaaaaactgggtgaaaaccggtaccgaagtatacaggcagttttggattttcgatgtccagaaccctcaggaggtgatgatgaattcctccaatatccaagtcaaacagcgaggtccctatacctatcgcgtgaggtttctggcaaaggagaatgtgactcaggacgccgaagacaacacggtgagtttcctccagccaaatggtgccatcttcgaaccttcccttagcgtgggcactgaggctgataattttacagtgctgaacctggcagttgccgctgcaagtcacatatatcagaaccagtttgtccagatgattctcaactccctaatcaacaaatccaaatcctctatgttccaggttcgcacactgcgcgagctcctttggggctatagagacccctttcttagcttggtgccgtatcccgtcaccacgactgtcggattgttctacccctataataatacagccgatggggtctataaagtcttcaacgggaaggataacatcagcaaggtggccatcattgatacctataaaggaaaaagatcgatctacgccgtgttcgagagcgacgtcaatcttaaaggtattccagtttacaggtttgtactcccctcgaaggcgttcgcttcaccagtcgaaaatcccgacaattattgcttctgcacagaaaaaattatcagtaagaattgcacttcatatggggttctcgatatatccaagtgtaaggaggggagaccagtctacatttccctcccccattttctctacgctagtccagatgtaagcgaacctatcgacgggttgaacccgaacgaggaggagcacaggacataccttgacatcgaaccaattaccggatttacgcttcaattcgccaagcggctgcaggtgaacctgttggtgaagccgtctgagaaaatccaggtgttaaaaaatctgaagcgcaactatattgttccaatactttggcttaatgaaactggaaccattggagacgagaaagccaacatgttcagatcacaggttaccggcaaaatcaatttactgggcttaatcgaaatgattttactcagcgtaggtgtcgtcatgttcgtagcgttcatgatttcctattgtgcatgtcggtcgaagactatcaagtag

SEQ ID NO: 111344 - DNA, 1419 bp, Artificial Sequence
  Description of Artificial Sequence: Synthetic coding sequence
atgggatgcgatcggaattgcggtttaatcgctggcgccgtaatcggagcagttctggccgtcttcggaggcatactgatgccagtaggcgatctcctcatccagaaaacaattaaaaaacaggtagtcctggaagaaggtacgatcgctttcaagaactgggtgaagacaggcaccgaggtgtatcgacaattttggatttttgatgtacaaaatccacaagaggtcatgatgaatagttctaacattcaggtgaagcagaggggcccttacacataccgcgtgagatttctggcaaaggagaacgtgacccaagacgcagaagacaataccgtcagcttcctccagccaaatggagcaatctttgagccttctttgagtgtgggaacagaggccgataacttcaccgtgctcaacttagctgttgctgcagcaagccacatctaccagaaccagttcgttcagatgatcttgaatagcctgatcaacaaaagcaagtccagcatgttccaagtgagaacattgagagagttactgtggggatacagagacccatttctgtccctggtgccataccccgtgacgacgacagtgggactcttttacccatataataatacagccgatggcgtttacaaggtcttcaacggcaaggataacatcagtaaagtagcgattattgacacttataagggcaagagaaatttaagctattgggagtcccattgcgacatgataaatggtaccgacgcggcctcttttcctcccttcgttgagaagtcacaggtgttgcagtttttctctagtgatatatgtaggagcatttacgctgtgttcgaatctgatgttaaccttaagggcattccagtgtatcgcttcgtgttacctagtaaagcgttcgccagcccagttgagaatccagataattactgtttctgtacggagaaaatcatatccaagaactgcacttcatatggggtcctggatatttctaagtgtaaagagggccgaccagtgtacatcagcctcccacacttcttatatgcctctccggacgtgtcagagcctatcgacggactcaacccaaacgaagaggagcaccggacttatctggatatcgagcccattacaggctttactctgcagttcgccaaaaggctgcaggtgaatctcctcgtaaaacccagcgagaaaatccaggtgctgaaaaatctgaagagaaactatatcgttcctattctgtggctgaatgaaacaggaacaatcggggatgaaaaggccaatatgttcagatcccaggtgacagggaagattaatctcctcggactcatcgagatgattctgctgagcgttggggtggtcatgtttgtggccttcatgataagttactgtgcctgccggagcaagactatcaagtag

SEQ ID NO: 111345 - DNA, 282 bp, Artificial Sequence
  Description of Artificial Sequence: Synthetic coding sequence
atggggtgtgaccgcaactgtggactgatcgctggggctgtgatcggagccgtgcttgccgtgttcggcggcattctcatgcccgtgggtgacctgcttattcagaaaacgattaagaagcaggttgtcctcgaggagggaacgatcgccttcaagaactgggtgaagactggcacagaggtttaccgacagttctggatcttcgatgtccagaatccccaggaagtgatgatgaattcttccaatattcaggtaaaacagcgaggcccatatacttattag

SEQ ID NO: 111346 - DNA, 432 bp, Artificial Sequence
  Description of Artificial Sequence: Synthetic coding sequence
atgggttgtgaccggaactgcggactcatcgctggggctgtgattggagccgttctggcagtgtttggaggcattctcatgcctgttggagatctgctcattcagaagaccattaagaaacaggtggtactcgaggaagggacaattgcttttaaaaactgggtgaaaactggcacagaagtgtatagacaattctggatcttcgatgtccagaatccccaagaggttatgatgaattctagcaatattcaggttaaacagcgcggtccctatacgtatcgggttagattcctggctaaagagaacgtgacacaggatgcagaggacaatactgtgtcatttttgcaaccgaacggagctattttcgaaccgagtctgagtgtgggtacggaggcagacaattttaccgtgcttaatcttgctgtagcctag

SEQ ID NO: 111347 - DNA, 1419 bp, Artificial Sequence
  Description of Artificial Sequence: Synthetic coding sequence
atgggatgtgaccgtaactgcggcctcatcgcaggcgcagtgattggagccgtgctcgcagtgttcggtgggattctgatgcctgtgggagatctattgatccaaaaaacaataaagaaacaggtcgtactcgaggaaggaactatcgcctttaagaactgggttaaaaccggcaccgaggtatatagacaattttggatcttcgacgttcagaatcctcaagaagtcatgatgaattcatccaatatacaggtcaaacagagaggaccatatacatatcgggttagattcctggcaaaggaaaatgtcactcaggatgccgaggacaatactgtatcatttctgcagcccaatggggctattttcgagcccagcctctccgtgggaacagaagccgataattttactgtgcttaacctggccgttgccgctgctagccacatctatcagaaccagtttgtccagatgatcctcaattccctgatcaataagtctaagtccagcatgttccaggttcgcactttgcgggaattgctgtggggctacagggatcctttcctgtcattggtgccatacccagtgacgactacagttggcctattctacccatacaataataccgcagatggcgtttataaagtcttcaacggaaaagataatatctccaaagtggccataatcgatacttacaagggtaagcggaacctgtcctactgggagtctcactgtgacatgattaatgggacggacgccgcttcattcccaccattcgttgagaaatcccaggtgctacagttctttagttcggatatatgtagaagtatttacgccgtgtttgagtccgatgtcaacctgaaaggaattcccgtttaccgcttcgtactgccttccaaggcttttgcaagtccggtcgagaaccccgataattattgtttttgtactgagaagattatctcaaagaactgcactagttacggtgttctcgacatttctaagtgtaaggagggacggcccgtgtatataagccttcctcactttctttatgcctctccagatgtcagcgaacccattgatggattgaacccaaacgaggaggaacaccgcacatacctggacattgagcccatcacaggcttcaccctgcagttcgctaaacgtctccaggttaatctcctcgttaaaccttccgagaaaatccaagtgttgaaaaaccttaagcgcaattacattgtccccatactttggctgaatgagactggaacaataggggacgaaaaggccaatatgttcaggtctcaggtgacaggcaagattaacctcctgggcctcatcgagatgatcctactctctgtgggtgtggtgatgtttgtggcctttatgatatcttattgtgcatgccggagtaaaactattaaatag

SEQ ID NO: 111348 - DNA, 198 bp, Artificial Sequence
  Description of Artificial Sequence: Synthetic coding sequence
atggggtgcgaccggaattgcggcctcattgccggcgccgtgatcggcgcggttcttgcggttttcggcgggattctgatgcctgtgggcgacctgcttatccagaaaaccatcaagaagcaggtcgtgcttgaggaagggaccatcgcttttaaaaactgggtgaaaactgggacagaggtgtaccgccagttttag

SEQ ID NO: 111349 - DNA, 1191 bp, Artificial Sequence
  Description of Artificial Sequence: Synthetic coding sequence
atgatgaattcttcaaatattcaagtgaagcagcgagggccctatacttatagagtgcggttccttgccaaggagaacgtgactcaagacgcagaggataacacagtgtctttcctacaacccaatggggctatattcgaacctagcttgtctgtcggcactgaggccgacaacttcacagttctaaatctagcggtagccgccgcgtctcacatataccagaatcagtttgtgcagatgatacttaatagtctgatcaataagtcaaaatcttcaatgttccaggtgaggactttgagggaactgctgtggggttaccgtgatccttttctgagccttgtgccttacccagtgacgacaaccgttgggctcttttacccttacaacaatactgctgatggcgtttataaggtatttaacgggaaagacaatatttcaaaagtggctataattgacacctacaagggaaaacgcaatctaagctactgggagtcccactgcgatatgatcaatggcacggacgccgccagcttccctcctttcgtggaaaaatcccaagtgttacagtttttctccagcgacatttgtcgtagtatctacgctgtatttgagtccgatgttaaccttaaaggcatcccagtgtacaggttcgtattgccttctaaagcatttgcatcaccggttgagaacccagacaattactgcttctgtacggagaagatcatttccaaaaactgcacctcttatggtgtgctcgacatttccaagtgcaaggaaggacgccctgtctacatttcgctgccacatttcttgtacgcttcacctgatgtgtctgagcctattgacgggttgaatcccaatgaggaagaacatagaacttatctcgatattgaacccataacggggtttaccctgcagtttgcaaaacggttacaggtcaaccttctggtaaagccttctgaaaagatccaggtgctgaaaaatctaaagaggaattacattgtccctatcttgtggctcaacgagaccggcaccatcggagacgagaaagctaatatgtttaggagccaggtgactggaaagattaacctgttgggcctgatcgagatgattctactatctgttggagtggttatgtttgttgctttcatgatctcttactgcgcctgcagaagtaagactatcaaatag

SEQ ID NO: 111350 - DNA, 1239 bp, Artificial Sequence
  Description of Artificial Sequence: Synthetic coding sequence
atgggatgcgatcggaattgtggccttattgcgggcgctgtcatcggggcagttctggctgtctttggcggcattcttatgcctgttggtgatttgctgatccagaagacaatcaagaagcaggtggttcttgaggaggggacaattgctttcaaaaattgggttaagaccggtacagaggtgtaccggcaattttggatcttcgacgtccaaaatccgcaagaggtgatgatgaatagcagtaatattcaagtaaagcagcgtggcccctacacataccgcgtgcggttcttggccaaggagaacgtgacacaggacgcggaggataacacggtgtcctttctgcaacccaatggcgccatattcgaaccgtccctaagcgtcggcacagaggctgacaatttcactgtattgaatctcgccgtggcatataacaacactgctgacggggtttataaagttttcaatggaaaagacaatatctctaaggtggccatcatagatacttataaaggcaagcggaatctgtcctactgggagagccactgcgatatgattaacggtacagacgcagcgtcatttcctcctttcgtagagaaaagccaggtgttgcaattctttagcagcgacatttgtcgttctatatatgccgtgtttgagtctgatgtgaatctgaaagggattcctgtgtatagattcgtgctgccaagcaaggcctttgcgtcccctgtggagaatcccgataactattgtttctgcactgagaaaataatctccaaaaactgcaccagttacggcgtgctggatattagtaaatgcaaagaggggagacctgtttacatcagcttaccacacttcctttacgcctcacccgacgtttcagaaccaatcgacggccttaacccgaacgaggaggagcatagaacatacctggacattgagcctatcactggattcacgttacaatttgcaaaacgtctccaggtcaacctgctcgtgaagccttcggagaaaattcaggtgctcaagaatctgaagaggaattacatagtgcctattctgtggctcaatgaaactggaacaatcggggatgagaaggccaacatgttcagatcccaggtgacgggtaaaataaatctgctaggactcatagaaatgatcctcttatcagtgggcgtcgtgatgtttgtcgctttcatgatctcttactgtgcctgtcgaagcaagacaatcaagtag

SEQ ID NO: 111351 - DNA, 867 bp, Artificial Sequence
  Description of Artificial Sequence: Synthetic coding sequence
atgggatgcgaccgcaactgcggcctcatagccggtgctgtcatcggtgctgtgctcgcagtttttggcgggatcctgatgccagtgggtgatctgctgatccagaaaaccattaaaaagcaagttgtgctggaggagggtacaattgcctttaaaaactgggttaagactggaacggaggtttaccgccaattttggattttcgacgtgcagaatccccaggaggtaatgatgaactcttccaatatccaggtaaaacagcgcggcccctacacctaccgggtaagatttctggccaaggaaaacgtcacacaggatgccgaggacaacaccgtctcctttctccagccgaatggagctatattcgagcccagtttgtcagtaggcacggaggcagacaatttcacagtactgaatttagctgtcgccgcggcttcacatatataccagaatcagtttgtgcagatgatactgaatagcctgataaacaagtcaaagtccagcatgtttcaggtccggaccctacgtgaactactgtggggatatagagacccctttctttcactggtgccctatcctgttacaacgacggtggggcttttctacccctacaacaacaccgccgacggggtgtataaggttttcaatgggaaagacaacattagtaaagtggccattatcgatacatataaaggcaaaagaaacctcagttattgggagagtcactgcgacatgatcaatggcacggacgcggctagctttccaccattcgtcgagaagagtcaggtcctccagttcttctcaagtgacatttgccgcgaaacctgtgtccacttcacctctagcttttccgtgtgtaagagctag

SEQ ID NO: 111352 - DNA, 846 bp, Artificial Sequence
  Description of Artificial Sequence: Synthetic coding sequence
atgagcgctcaagaatcctgcttatctctcataaagtatttcctgttcgttttcaatctgttctttttcgtgctggggtccctgatattttgttttggtatctggattcttatagataagactagcttcgtgagctttgttggcctcgctttcgtccccctgcagatctggagtaaggtgcttgctatcagcggcatctttacaatgggcatcgctctcctcggatgcgtcggagccctcaaggagctgaggtgtttactgggactctacttcggtatgctgctcttgttgttcgctacacagatcaccttggggatactgatcagtactcaaagggcccaattggagcgcagcttgagggacgttgtagaaaaaacaatccaaaagtatggtaccaaccccgaagagaccgcagccgaggaatcttgggattatgtgcagttccagctccgatgttgtggatggcactacccgcaggattggtttcaagttctgattctgcgcggaaatgggagcgaagcccaccgagtcccttgctcctgttataacctaagcgctacaaacgacagcacaatcttagataaggtgatactcccacagctcagccggcttggccatctagcaaggtctagacacagcgcagatatctgcgctgttccagccgagtcacacatttatcgcgagggctgcgcccagggccttcagaaatggctgcataacaacctcatctccattgtgggtatctgcctgggggtcgggctacttgagctcggctttatgacactcagcatctttctgtgtagaaatctggaccacgtttacaatcgactagcaaggtatagatag

SEQ ID NO: 111353 - DNA, 471 bp, Artificial Sequence
  Description of Artificial Sequence: Synthetic coding sequence
atgagcgcgcaggaatcttgtttgagcctcatcaaatactttctgttcgttttcaacctgttctttttcgtgctggggagtctgatcttttgcttcggcatttggatcctgatagacaaaacaagctttgtatcttttgtcggactagccttcgtgccgctccagatctggagcaaagtgcttgccatctccggcatctttacaatggggatagcactactcggctgtgttggagccctcaaggagctgaggtgtttgctgggcctgtacttcggtatgctgcttcttttgtttgcgacccaaattaccctcggaattctgatctcaacccagcgcgcacagaaagatactcccacgtggaccaaaggcgacagacataagcaactgcagagagagacccatgggaagaaacgcgaacaggaaaaggaaatcgacgcactgaaggaggagacggagacttacgaaccctag

SEQ ID NO: 111354 - DNA, 642 bp, Artificial Sequence
  Description of Artificial Sequence: Synthetic coding sequence
atggggattgcgctgctgggatgcgttggcgctctcaaggagctgcgatgcttactgggcctgtactttggtatgctcttgttgctgttcgccacacagattacgcttgggattctgatttccacacagcgtgcccagctggaacggtcccttagggacgttgtggaaaaaactattcaaaagtacggaacaaatcctgaggaaacagctgctgaggaaagctgggactacgtgcagtttcaactccgttgctgtggatggcattaccctcaggactggtttcaggttctgattctgcgaggcaacggctccgaggcccacagggttccctgtagctgctacaatctgtcggctaccaacgactcaactatactggacaaagtgatactgcctcaacttagtagacttgggcatttggcacgtagcagacattctgctgatatctgcgcggttcccgccgagtcgcatatctatagagaagggtgcgcacagggtctgcaaaaatggctgcacaataatttaatcagcatcgtaggaatctgtctaggcgtcgggctactggaactcggtttcatgaccctctccattttcctgtgtcgaaatttggaccacgtgtacaatagactggcccgatacagatag

SEQ ID NO: 111355 - DNA, 813 bp, Artificial Sequence
  Description of Artificial Sequence: Synthetic coding sequence
atgtccgcccaggaatcatgtctgagcctaatcaagtattttctcttcgtatttaaccttttcttcttcgtactggggagcttgattttttgttttggcatatggatattgatagacaagaccagttttgtttcatttgttggactcgctttcgttccgctacaaatctggtctaaggtgttggccattagtgggatctttacaatgggtatcgcactgttgggttgcgtgggagccctcaaggaactgaggtgtttgctgggtctgtacttcgggatgcttttgttgttgttcgctactcagattactctgggcatacttatttcaacgcaaagggcccaactcgaaaggtctctgcgagacgtcgtggaaaaaacgatacagaagtacgggacgaaccctgaggagaccgccgctgaagagtcatgggactacgtgcagttccaactccggtgctgtggctggcattacccccaggactggttccaggttctgatactccgcggcaacggtagcgaagcacatagggtgccctgcagttgttacaatctcagtgcgacaaacgactccaccatcctggacaaggttattctcccacagttgtctcggctcgggcacctggcacgctcgaggcactccgccgatatctgtgcagtccccgctgagtcccatatttatagggagggctgtgcccagggactccaaaagtggctgcataataacctcatctccatagtcgggatttgtctcggcgtgggactgctggaggtgatatggccacggccccacccacggtcagccctgaacccctag

SEQ ID NO: 111356 - DNA, 1095 bp, Artificial Sequence
  Description of Artificial Sequence: Synthetic coding sequence
atgcctcattcttacccagctctgagcgcagagcagaagaaggaactctcagatattgcactccgaatagtggcaccagggaaggggattcttgccgcggatgaaagtgtcggctccatggccaagcggttatcccagataggggtggagaacaccgaggagaatagaagactctatagacaggttctctttagcgcggacgaccgtgtgaagaagtgtatcggcggcgtgatattcttccacgaaactttatatcagaaagatgacaacggggtccctttcgttagaacaatccaggataaggggattgttgtgggcattaaggttgacaagggtgtggtgccactggctggcacagacggcgagactacaacgcagggtttagatggattaagtgaaaggtgtgcccagtataagaaggacggggctgacttcgccaagtggagatgcgtgctcaaaatctcagaacggactccctccgcgctcgcgatcctcgagaatgccaacgtcctggcgcgttacgcctctatctgccaacaaaatggtatcgttccgatcgtagaaccagaaatattgcccgacggtgaccatgatctcaagaggtgccagtatgtaactgaaaaagtgctggcggccgtgtataaagccctctcagaccaccacgtctaccttgagggaactttactgaagcctaacatggttactcctggccacgcttgtcccatcaagtacacgccagaggagatcgctatggctaccgtgacagctctcagacggaccgttcccccagcggtcccaggagtgacattcctttccggcgggcagagcgaggaagaagcatccttcaacctgaatgccatcaacaggtgtcccctgccccgcccttgggcacttaccttcagctacgggcgggcactgcaggccagcgccctgaacgcctggcgtggccaaagagataatgctggcgcagcgaccgaggagttcatcaagcgggctgaagtcaacggccttgctgcacaggggaagtatgaaggatccggcgaagatggtggtgcggccgcgcaatccctgtacatcgccaatcacgcctattag

SEQ ID NO: 111357 - DNA, 483 bp, Artificial Sequence
  Description of Artificial Sequence: Synthetic coding sequence
atggcaaattgcgaattttcacccgtcagtggcgataagccttgctgccggctaagtcggagggcacagctgtgtctcggggtgtcaatcctagtgctgattctggtggttgttttggctgtagtcgtgccaagatggaggcagcagtggtcaggcccagggactaccaagagattccccgagaccgttctcgctcggtgcgttaaatacaccgaaattcatccagaaatgcgccatgtcgactgtcagagcgtctgggatgcattcaagggggcctttatctccaagcacccctgcaatattactgaggaggactaccagcccctgatgaaattgggcactcaaaccgtgccctgtaacaagaacgaaaccattaacttggcccagaccggcgagaggaccgctgctactacactgttccagtattccggcaagcgatttcccgctggtctgcagaaactccctgtgatgtggtccatgtag

SEQ ID NO: 111358 - DNA, 624 bp, Artificial Sequence
  Description of Artificial Sequence: Synthetic coding sequence
atgcagtcagggacgcactggcgtgttctgggcctttgtctactttctgtcggagtgtgggggcaagatgggaatgaggaaatgggcggaatcacacaaaccccgtataaagtgtctatcagcgggactactgtgatcctgacatgtccccagtatcccggatcagagattctgtggcagcataacgataagaacataggtggagacgaagatgacaaaaatatcggttccgacgaggaccatctgtcccttaaggagtttagtgaactggagcaatctggctactacgtatgttaccctcgaggttccaaacccgaagatgctaacttttatttgtacctgcgggcccgcgtctgcgaaaactgtatggaaatggatgtgatgtcagtcgccaccatcgtgatagtcgacatttgcatcaccgggggcctcttgctacttgtttactattggtcgaaaaacaggaaagccaaggcaaagcctgttacgcgcggcgcaggagccggcgggcgacaacgcggtcaaaacaaggagcgcccacctcccgtgcccaaccccgactatgagccaatccggaaggggcagagggacctttatagtggcttgaatcaacgccgaatttag

SEQ ID NO: 111359 - DNA, 606 bp, Artificial Sequence
  Description of Artificial Sequence: Synthetic coding sequence
atgcagagtggtactcattggagagtgttgggcctttgcctcctgtcggttggggtgtggggtcaggacgggaatgaagaaatggcctacaaggtgagtattagtggtaccaccgtcattcttacttgtccccagtatccggggtctgaaatcctgtggcagcacaatgacaaaaacattggcggtgatgaagacgataagaatatcggctcggatgaagaccacctctctcttaaagagttttcggagttagaacagtccggctattatgtgtgctatcccagagggtccaagcccgaggatgccaatttctacctgtacctccgcgcccgggtttgtgagaattgcatggagatggacgttatgagcgttgcaaccatcgtaatcgtggacatctgtatcacgggaggcctgctgttgctcgtctactactggagcaagaatcgaaaagccaaggccaagcccgtgacccgcggcgcgggggctgggggtaggcagagaggtcaaaacaaagaaaggcctcctccagtgccaaatcctgattacgaacccatcaggaaaggccagcgcgatctttactccggtctgaaccagcgacggatttag

SEQ ID NO: 111360 - DNA, 237 bp, Artificial Sequence
  Description of Artificial Sequence: Synthetic coding sequence
atgatcggttttcttacagaggataagaagaagtggaacttggggagtaacgcaaaagatccccgtgggatgtaccaatgcaagggcagtcagaataaatctaagccccttcaagtctactataggacctctgacaaacaaacactgctgcccaatgatcagctctatcagcccctaaaggaccgggaggatgatcaatactctcacctgcagggcaaccagctcaggaggaattag

SEQ ID NO: 111361 - DNA, 549 bp, Artificial Sequence
  Description of Artificial Sequence: Synthetic coding sequence
atggagcagggaaagggacttgctgtgctgattctggcaatcatcctgctccaaggaaccttggctcagagcattaaaggaaaccacttagtgaaggtgtatgactatcaagaggacgggtccgtcctattgacgtgtgatgccgaggcaaagaacataacatggtttaaggacggtaaaatgattgggttccttacagaagacaaaaaaaaatggaatcttggtagtaacgcaaaagatcctaggggtatgtaccagtgcaaaggctcacagaataaatctaagcccctgcaagtgtattatcgaatgtgccagaactgtatcgaattgaatgctgcgacaattagtgggtttctctttgctgagatcgtctccattttcgtgctcgccgtcggtgtgtattttattgcaggacaggacggggtgagacagtctagggccagcgacaaacagacactattgcctaatgatcaactttatcagcccttgaaagatcgcgaagacgatcagtattcacatttgcaggggaatcaactcagacgcaattag

SEQ ID NO: 111362 - DNA, 1200 bp, Artificial Sequence
  Description of Artificial Sequence: Synthetic coding sequence
atggaaccacccggtcgtagagagtgcccattcccaagctggaggttcccaggactgttactcgctgccatggtcctgctcctgtacagcttcagcgacgcctgcgaggaacctcccacttttgaggcgatggagctcatcggcaagcccaaaccatattatgagattggcgaacgagtcgactataagtgtaaaaaaggatacttctacattcctccactggccacacacacaatttgcgaccggaaccatacctggctgccagtgtctgatgacgcctgctaccgcgagacctgcccttacattcgagacccactcaatgggcaggctgtccccgctaatgggacctatgagtttggttaccagatgcacttcatctgtaacgaggggtactatctcataggcgaagaaatcctttattgcgagctgaaaggctccgttgcaatttggtctggtaagccaccaatttgtgaaaaggttttatgcacgcctccgcccaaaataaaaaatgggaagcatacattctcagaagttgaggtcttcgagtatttggacgctgtgacgtattcatgtgaccctgcacccgggccagacccatttagcctgattggagagagtacaatctactgcggcgacaacagcgtgtggagtagagccgctccggagtgcaaagtcgtgaaatgtagattccccgtagtggagaatggcaaacaaatcagcgggttcggtaaaaagttttactataaagcaactgttatgtttgagtgtgacaaagggttttatctggacggcagtgacactatcgtgtgtgacagtaattctacatgggaccccccggtacctaagtgccttaaagtcctccccccctcatctaccaagccccccgccctaagtcactccgtctcaacatcctcaaccaccaaatcacctgccagtagcgcatctggccctagaccgacttacaagccgccagttagcaattaccctggataccctaagcctgaggagggaattttagactccctcgatgtatgggtgattgctgtgatcgttatcgcgatcgtagtgggtgtggccgttatctgcgtggtgccgtaccgctacctacagagacgaaagaagaagggcaaggcggatggaggggcggaatacgccacttaccagacaaagtcgacaactcccgccgaacaacgcggttag

SEQ ID NO: 111363 - DNA, 1050 bp, Artificial Sequence
  Description of Artificial Sequence: Synthetic coding sequence
atggagccccccggacggagagagtgtccattccctagctggcgattcccaggcctcctccttgcagcgatggtgctgttgctgtactccttttccgatgcatgcgaagagcccccaacatttgaggcgatggaattgatcgggaagcccaaaccatactacgaaatcggagaaagagtggattacaagtgtaaaaaggggtatttctatatcccccctctcgcgacccacaccatttgtgaccgtaaccatacttggcttcccgtaagcgatgacgcatgttaccgcgagacctgcccctacatccgcgaccccctcaacgggcaagcggtcccagctaacggcacgtatgaatttggataccaaatgcatttcatttgtaatgagggctactacctaatcggggaagagatactctactgcgaactgaaggggagcgtagcaatttggtcagggaaaccgcccatatgtgagaaagtgttatgcactccgcctcccaaaatcaagaacggcaagcatactttctccgaggtcgaggtttttgagtacctcgatgccgtgacatacagttgcgaccccgctccgggccctgaccccttctctctgatcggggagagcaccatttattgtggcgacaattccgtctggtcccgggccgctcccgagtgtaaggttgtcaaatgccggttcccggtagtagagaatggaaagcaaatcagtggtttcgggaagaaattttactacaaggccaccgtcatgttcgagtgtgacaaaggcttttatctggatggatctgatacaatagtatgcgactcaaactctacgtgggatccaccagtgcctaagtgtttgaaggggcctagaccaacatataagcctcctgtgtctaactatcctggatatcccaagcccgaggaggggatcctggactccctagacgtgtgggtgatcgctgtgattgtcatcgctatcggcaaacaaatggtggagcttaacatgcccttgacacgcttaaaccagcccttgcagcaaagcagagaagcagaatag

SEQ ID NO: 111364 - DNA, 1155 bp, Artificial Sequence
  Description of Artificial Sequence: Synthetic coding sequence
atggagcccccaggccgacgcgaatgcccatttcccagctggagatttcccggcttactcctcgccgctatggtgctactgctatattcattttcggacgcgtgcgaagaacccccaacattcgaggcgatggaattgatcggcaagccaaagccttactatgagattggggagcgggtcgattacaagtgcaagaagggatacttttacatcccccccctggccacacataccatttgcgatcggaaccacacctggttgcctgtgagtgatgatgcttgttatagagagacttgcccttatattcgcgatccccttaacggacaggccgttcccgcaaacggcacctatgaattcggttaccagatgcacttcatctgtaacgaaggttattacctaattggagaggaaatcctgtattgcgaactgaagggcagcgtggccatttggtccggtaagccaccgatctgtgaaaaggtgctgtgcacaccacctcctaaaataaaaaatggaaagcacacattcagcgaggtggaggtttttgagtatttagatgcagttacatactcctgtgacccagcaccgggccctgaccctttcagtttgatcggagagtcgaccatctactgcggcgacaattcggtttggagtcgtgccgcccctgaatgcaaggttgttaagtgtcgattcccagtggttgagaacgggaagcagatctcagggtttggaaagaaattctactataaagccacggtcatgtttgagtgcgacaagggattctacctcgacgggtctgataccatcgtctgtgacagcaattctacctgggacccccctgtgcctaagtgtttgaaggtctctacatcttcaaccaccaagtcgcccgcctctagtgcctctggccctcgaccaacatacaaacctcccgtgagtaattacccaggttaccccaaacccgaggagggaatccttgatagtcttgatgtatgggtcatcgccgtcattgtgattgctatcgtggtgggcgtggccgtgatttgcgttgtcccgtacaggtacctgcagcgtcgaaagaagaaagggaaagccgatggcggcgctgagtatgctacctaccaaacaaagtccacgactccggccgaacagcgaggttag

SEQ ID NO: 111365 - DNA, 1110 bp, Artificial Sequence
  Description of Artificial Sequence: Synthetic coding sequence
atggagcctccaggaaggagagaatgtcctttcccttcttggcgctttccgggcttgctgttggccgcaatggttctgctcttgtattctttttctgacgcttgcgaggaaccaccaacgttcgaagccatggagcttattgggaaacccaagccatattatgagatcggcgaacgtgtagactacaagtgcaaaaaggggtacttttacatcccaccgctcgctactcacacaatctgtgatcgcaaccacacttggctgcctgtcagcgacgatgcttgttacagggagacatgcccatatattagagatccactgaatggtcaagccgttccagcaaacggtacttatgagttcggatatcaaatgcatttcatctgtaacgaggggtactacctcatcggcgaggagattctctactgcgagcttaagggctctgtggcaatatggtcaggcaaacctcccatttgcgagaaggtactgtgtactccaccacctaagattaagaatggcaaacacaccttttccgaggtcgaggtgtttgaatacctggatgccgtcacctactcctgcgatcccgcaccaggcccagaccccttttctctgatcggagagtcaactatctattgtggcgataactctgtttggtcccgtgccgcgccggagtgtaaggttgttaagtgtagatttcctgtcgtcgaaaatggcaagcagatcagcggctttggaaaaaagttctattataaagcgaccgttatgtttgagtgcgataaaggcttctacttagacggcagcgacaccatcgtgtgcgactcaaactctacctgggatccgcccgtacccaaatgtctgaaaggcccccgccccacctacaagccccctgtgtccaattatcctggctaccccaagccagaggaaggaatactcgacagccttgatgtatgggtaatcgctgttatcgttattgccatcgtcgtaggcgtggctgttatctgcgtcgtgccttatagatatctgcaaagacgtaaaaagaagggcaaagcggatggcggtgccgaatacgcgacatatcagacaaagtccactacacccgccgaacaacggggatag

SEQ ID NO: 111366 - DNA, 1179 bp, Artificial Sequence
  Description of Artificial Sequence: Synthetic coding sequence
atggagccgcccggacggcgagaatgcccctttcccagctggcggttccctggtttactgctggccgctatggtactcttgctatacagtttcagcgacgcatgtgaggagcccccaactttcgaggccatggaacttatcggcaagccaaagccctactatgagataggggagcgggtagactacaagtgcaaaaagggctacttttatattcccccattagccacgcatacaatctgcgatcgtaaccacacttggttacccgtgagtgacgatgcctgttaccgtgaaacatgcccctacattagagaccccctgaacgggcaagccgttcccgccaacggcacatacgaattcgggtaccagatgcacttcatctgcaatgaaggttattacttgataggcgaggaaatcctgtattgtgagctcaaaggctcggttgccatttggtctgggaagcccccaatctgtgagaaagtgctgtgtacccctccccccaagattaagaatggcaaacacacctttagcgaggtggaagttttcgaatacctggacgccgttacatactcctgtgatcctgccccaggaccagaccccttttctctgattggagaaagcaccatctattgcggcgataatagcgtgtggtcaagagccgctcccgaatgtaaagtggtaaaatgtcgctttccagtggtcgaaaacggaaaacaaatatcgggctttggcaaaaagttctactataaagctaccgtgatgttcgagtgtgacaaaggtttttatctcgatgggtctgacacaatcgtctgtgatagcaactccacttgggatccaccagtgcccaagtgcctgaaggttctgcccccgtcatcaacaaaaccccctgctctatctcatagcgtcagcacctctagcaccactaaatctccggctagctcggcatcagggccgaggccaacatacaagcccccagtgtcaaactaccccggatatcctaaacccgaagaaggtatactggacagcctggatgtgtgggtgatcgctgttattgtgatcgctatcgtagtgggggtagcagtgatctgtgtggtcccctataggtatctacagcgccgtaaaaaaaaggggacctatctcacagatgagactcatcgcgaggtcaagttcacaagcctgtag

SEQ ID NO: 111367 - DNA, 1068 bp, Artificial Sequence
  Description of Artificial Sequence: Synthetic coding sequence
atggaacctcctgggcgccgtgaatgtccattcccatcctggcgctttcccggcctccttctggccgccatggtgttactgctgtactctttcagcgacgcctgcgaagaacctcctacctttgaagcaatggaacttattggaaagcccaaaccgtattacgagatcggtgagagagtcgattataagtgcaagaagggttatttttacatcccccctctggcaacccacaccatctgtgatcgtaaccacacctggttacccgtgtcagacgatgcctgttatagggaaacgtgcccatatattcgggatccactcaatggacaagctgttcctgccaatggaacctatgagttcggctaccagatgcactttatctgcaatgaaggctactatctgataggtgaagaaatcttgtattgcgagcttaagggcagcgtcgcaatttggtccggcaagcctcctatctgtgagaaagtgctgtgcacaccaccccccaagataaaaaacggcaagcacaccttttctgaggtggaggtgttcgagtacctagatgccgttacttacagctgtgatccagcacccggtccagatcccttctcactcatcggagagtccaccatttattgtggagataacagcgtgtggagtcgggctgcacctgaatgtaaggtggtgaaatgcaggtttccagtcgtagagaatggcaagcagatatctggatttggaaaaaagttttattataaagcaaccgtaatgttcgaatgcgacaaaggtttttatctcgatggcagcgataccatagtgtgtgatagcaattcaacctgggatccccctgttccaaaatgcctgaaggggtaccctaaacccgaagaaggcatcctggactcccttgacgtgtgggttatcgctgtgattgtcatcgcaatagtggtaggagtggcggtcatttgtgtggtcccctatcggtacctacaacgtcgaaaaaaaaaaggcaaggccgatggaggcgccgagtatgcaacctaccagacaaagagtaccacccccgcggagcaaaggggatag

SEQ ID NO: 111368 - DNA, 1158 bp, Artificial Sequence
  Description of Artificial Sequence: Synthetic coding sequence
atggagccccctggaagaagagaatgtccattccctagctggcgtttccccggtttactcctggctgctatggtgctactgttgtattctttctctgacgcctgtgaggaaccacctactttcgaagccatggagctgatcggtaaaccgaagccgtactatgagatcggggagagggtggactacaagtgcaaaaaggggtatttctatatcccaccccttgccacccacacaatttgcgatcggaatcatacctggcttcccgtgagtgatgatgcatgctatagagagacttgtccctacatacgagatccactgaacggccaggccgtgcctgcgaatgggacatacgaatttggctaccagatgcactttatttgcaacgagggctattatctgatcggcgaggagatactttactgcgagctgaaaggctccgttgccatttggtctggcaagccgccgatttgtgagaaggtgctgtgcacccccccacctaagatcaagaacgggaagcacaccttctccgaagtggaagtgttcgagtacctagatgccgtgacgtactcctgtgatcctgcgccggggcctgacccattctcactcatcggagaatcgacaatttactgcggcgacaacagcgtctggagccgggctgcacccgagtgtaaggtggtgaagtgcaggtttcctgtggtggagaatgggaagcagatcagtggctttggtaaaaaattttactacaaggctacagtgatgttcgaatgtgacaagggcttctatcttgatggtagcgataccattgtgtgcgactctaactcaacctgggatccacccgttcctaaatgtttgaaggttctccccccctctagcacaaaaccccccgctctttcccatagtgtcagcacatcttccactacaaaatctccggcatcctctgcaagtggataccccaagccggaggaaggaatactggattcactcgatgtatgggtcatcgctgtcatcgttatcgcaatcgtagtcggggtggcagttatttgcgtcgtgccttatagatatctccagagaagaaaaaagaaggggaaggctgatggaggggccgagtacgctacataccaaacaaaatctactaccccagcggaacaaagggggtag

SEQ ID NO: 111369 - DNA, 1089 bp, Artificial Sequence
  Description of Artificial Sequence: Synthetic coding sequence
atggagcctcccgggcggcgcgagtgccctttcccaagctggcggttcccaggattgcttctggcggccatggtgctcttactgtatagttttagtgatgcctgcgaggaaccccccacattcgaggccatggaattgatcgggaaacccaagccttactatgaaattggcgagcgggttgactataagtgtaagaaaggatacttttacattcctcctctggctacacacacgatctgcgacagaaaccacacgtggctgccagtctccgatgatgcatgttaccgtgaaacctgcccctacattcgggatccattgaatggacaggctgttccggctaacggcacttacgagttcgggtaccagatgcacttcatttgcaatgagggctactaccttattggggaggaaattctgtactgcgagctgaaaggaagcgtggccatctggagcggtaaaccaccgatttgcgaaaaggttttatgtaccccaccgcctaaaataaagaacgggaaacatactttctccgaagttgaagttttcgaatacctggacgcagtcacatacagctgcgatccggcaccaggccccgatccattttctctgattggggaatcaacgatctattgcggcgataacagcgtctggtcccgggctgctcctgagtgcaaagtcgtaaaatgccgattccctgtggtggagaacggcaaacagattagtggctttgggaaaaaattctattacaaggcgactgtgatgttcgagtgtgataaaggattctacttggacgggagcgacactatcgtgtgcgattccaacagcacctgggacccaccagtgcctaagtgcctcaagggacctagaccgacttacaagccccctgtcagcaattaccccgggtacccaaaacctgaggaaggcatcctcgacagcctggatgtctgggtaatcgccgtgattgtgattgcaatcgtggtgggtgttgctgttatttgcgtggtcccttaccgctatttacagcgcagaaagaaaaagggtacatatcttacggatgagacacaccgagaggtcaagtttaccagtctttag

SEQ ID NO: 111370 - DNA, 1134 bp, Artificial Sequence
  Description of Artificial Sequence: Synthetic coding sequence
atggagccccctggccgcagagagtgtccgtttccctcgtggagatttcctggccttctcttggcagcaatggtcttgctgttatatagcttcagcgatgcgtgcgaggagccaccaacatttgaggctatggaactgataggaaagcccaaaccatactatgagatcggtgaacgcgtggactacaagtgtaagaaagggtatttttacatacctcccctcgcaacccatacaatttgcgacagaaaccatacctggctgccggtcagcgacgacgcgtgctaccgagaaacctgtccctacatccgagacccgctcaacggccaggcggtacctgccaatggaacgtatgaattcggttaccagatgcacttcatttgcaacgaggggtattatttgataggggaagagattctgtactgtgagctgaagggtagtgtcgcgatttggtccgggaagcctcccatctgtgaaaaagtcctatgcacccctccccctaagatcaagaacggaaagcataccttcagtgaggtcgaggtgtttgaatatctggatgctgtgacttattcctgcgatcctgcccctggacccgaccccttcagtcttatcggagaatcaacaatttattgtggtgacaacagtgtgtggagcagagccgctccagaatgcaaagtcgtaaagtgccgatttccggtagtggagaatggcaagcagatctcgggatttgggaagaagttctattacaaggctactgtcatgttcgagtgcgacaagggattctatctcgatggctccgacactatcgtttgtgattcaaactctacctgggacccgcccgtgcctaaatgcctaaaagtgtcaaccagctctaccaccaagtcccccgccagctcagccagcggccctagaccgacctacaaaccgcccgtctctaattacccagggtacccaaagcccgaggaagggatactcgatagcttggacgtctgggttattgccgtgattgtgattgcaattgtagttggcgtggccgtgatttgcgtggtcccttataggtacctgcaaagacggaaaaaaaaggggacatatctcaccgatgagactcacagggaagtgaagttcacaagtttatag

SEQ ID NO: 111371 - DNA, 1011 bp, Artificial Sequence
  Description of Artificial Sequence: Synthetic coding sequence
atggagccacctggacggagggaatgtccctttccgagctggaggtttcctggcttattgcttgcagccatggtcctgctcttgtactcatttagcggagagacatgcccctatatccgtgatccactgaacggccaggccgttcctgcgaacggcacttacgagtttggatatcaaatgcacttcatctgtaatgagggatactacttaattggagaggaaatcctctactgcgagttgaagggctcggtggcaatctggtccggcaagccacctatctgtgaaaaagtgctgtgcacaccccccccaaagatcaagaacgggaagcacactttctcggaggttgaggtatttgagtacttagacgcagtgacctactcgtgcgaccccgcccctggacccgaccccttttctctcatcggcgagtctactatctactgcggtgacaactctgtatggagcagagccgccccggaatgcaaagtcgttaaatgtaggttccctgtggtggagaacggaaaacagatttctggattcgggaaaaaattttattataaggcaacggtgatgttcgagtgtgataaaggattttatttagacggatcggatactattgtatgcgacagcaattcaacttgggatcctccggtcccgaaatgcctgaaggtgttgccgcctagctcgaccaaaccacccgctctgagtcactctgtgagcacaagcagcactaccaaaagcccagccagctccgctagcgggcctaggccaacttataagccccctgtgtccaattatcccgggtaccctaaacccgaagagggtattctcgactcgctggatgtgtgggtgatcgctgttatcgtcatagccatcgtggtgggagtggcggtgatttgcgtggtcccctaccgctacttgcagaggagaaagaaaaagggaaaagctgatggcggcgcggaatacgcgacgtatcaaaccaaaagtacaacaccagctgagcagcgggggtag

SEQ ID NO: 111372 - DNA, 1095 bp, Artificial Sequence
  Description of Artificial Sequence: Synthetic coding sequence
atggagccgccaggcaggagggaatgcccctttccttcttggcgctttccaggtctcctgttggcagctatggttctgctgctctacagcttctcggatgcatgcgaagaacctcctacatttgaggctatggagctgattggcaaaccaaaaccctattatgaaataggcgaaagagtggactataagtgtaagaagggatacttctacatcccacctctagccacccacacaatttgcgatcggaaccacacctggctgcctgtctctgatgacgcctgttacagagaaacatgcccatacatccgggacccgttgaacgggcaggctgtccccgctaacggaacgtacgaattcggctaccagatgcacttcatttgtaatgagggctactatctgatcggcgaagagatcctctactgtgagcttaagggttctgtggccatctggtcaggcaagcctccaatctgcgaaaaagtcttgtgtacacctcctccaaagatcaagaatggtaagcatacattcagtgaggttgaggtttttgagtatctagacgcggtaacctactcctgcgaccccgcacccgggccggatcccttcagcctgatcggcgagagcacaatctactgcggagataactccgtatggtcaagagccgctcctgaatgcaaggttgttaagtgccgttttccagttgtggagaacggtaaacaaatttcagggttcgggaagaagttctattataaagctactgtcatgtttgaatgcgacaaggggttctatctcgacggatccgataccatcgtctgtgatagcaattccacatgggacccaccagtgcccaaatgtctgaaggtcagcacatcctcaaccaccaaaagtcccgcctcttcggcctccggccccagaccaacctacaaaccccccgtctcaaactaccctggctatcctaagcccgaagagggcatactcgactcactggatgtctgggtcatcgcagtcattgtaatagctatcggaaaacaaatggtcgagcttaatatgccactgacacgtttaaaccagcccctgcagcagtccagggaggcggaatag

SEQ ID NO: 111373 - DNA, 1113 bp, Artificial Sequence
  Description of Artificial Sequence: Synthetic coding sequence
atggaacctcctgggagaagagagtgtccattcccaagttggaggtttcccgggctgttgcttgcggccatggtactgcttttatatagctttagcgacgcctgtgaagaaccccccactttcgaggcgatggaactcataggaaagccaaagccctactatgagatcggcgagcgagtggactataagtgtaagaagggatatttttacatccctcccctcgcgactcacactatatgcgatcggaatcacacatggttgcctgtaagtgacgatgcatgctacagggagacttgcccctacatcagagacccccttaacggtcaagccgtgccagccaacgggacttacgagtttggctatcagatgcattttatatgtaacgaagggtactacttgattggagaggagattctgtactgtgagctcaagggctcagtggccatctggagcggtaaacctccaatttgtgagaaagtgctctgtactccccctcccaagatcaagaatggtaaacataccttttctgaggtggaagtcttcgagtaccttgatgctgtcacttactcctgtgaccccgcgccagggcccgatcctttttccttgattggggagtcaacaatttactgtggtgacaattctgtgtggtctcgggcggcaccagaatgcaaggtagtgaagtgtagattcccagtagtggaaaatggcaagcaaatttctggcttcggcaagaagttttactataaggctaccgtgatgtttgagtgcgataaaggcttttacctggacgggtccgatacaatcgtttgcgactcaaatagtacttgggatcctccggtgccaaagtgtctgaaggtgagcacaagcagtaccactaagtctcctgcctcgtcggcctcagggtacccaaagcccgaggagggcatcctagatagtcttgatgtctgggtcatcgcagtcatagtaattgccatcgtcgtgggtgtggccgtcatctgcgtagtcccctaccgctacctgcagaggcgcaagaagaagggcaaagctgatggcggcgccgagtatgccacctatcagaccaagtctacaactcctgctgaacagcgcggttag

SEQ ID NO: 111374 - DNA, 510 bp, Artificial Sequence
  Description of Artificial Sequence: Synthetic coding sequence
atgtgtagcaggggatgggattcctgcctggctctggagctccttctgttacctctgtcgctgctggtcaccagtattcaaggacacttagtgcatatgacagtggtgtcaggaagtaacgtgacgctgaacatttcagaatctcttccagaaaattacaagcaactgacctggttctatacctttgatcaaaaaattgtcgagtgggactcgcgcaaaagtaaatacttcgagagcaagttcaaagggcgggtcaggctcgacccacagagcggagctctgtatatatctaaggtacagaaggaagataatagtacttacatcatgagggtgctcaaaaaaacaggcaatgaacaggagtggaagatcaagctgcaggtgttgggagagagtggcgagcctaagtccaagtcgccgctacagtggcctcagatggatcactgtcgcgcttcctgggaggcatggggcacgctgggagaggaggagcgtaagacatccgggcaggtatag

SEQ ID NO: 111375 - DNA, 732 bp, Artificial Sequence
  Description of Artificial Sequence: Synthetic coding sequence
atgtgctcgagaggatgggacagctgcctagccttggaactcctgttgctaccactaagcctgcttgttactagcatacagggccacctggttcatatgaccgtggtgtcgggcagtaatgtcaccctaaacatctctgaaagcctacctgaaaattacaagcagctcacctggttttacacttttgatcagaaaatagtggagtgggactctcgcaagagtaagtatttcgagtctaagtttaagggccgcgtgcgcctggacccacagtctggggcgctgtacataagcaaagtgcaaaaagaagataactccacatacatcatgcgtgtgctgaaaaaaacggggaatgaacaggaatggaagatcaagctgcaagtgctggacccggttccaaaacccgtgattaagatcgagaagatcgaggacatggatgacaactgttacctcaagctgtcttgtgtgattccgggcgagtccgtgaactatacatggtatggagacaagcgccccttcccaaaggagctgcaaaattccgtgctggaaacaacgctgatgccgcataattattctcggtgctatacctgtcaagtatccaattccgtgtcgtccaagaatggcactgtgtgcctctcaccaccttgtactctggcccggtcgtttggggtagagtggatcgcgtcttggttagtggtgactgttccaactatcctaggactgctattgacctag

SEQ ID NO: 111376 - DNA, 1044 bp, Artificial Sequence
  Description of Artificial Sequence: Synthetic coding sequence
atggcactgctgttttcactcatcctggccatctgtactaggcctggcttcctggctagtccctctggggtgaggttggtgggcggtcttcataggtgtgaaggtcgggtcgaggtggaacagaagggccaatggggcaccgtgtgcgatgacgggtgggacattaaggatgtggcggtcttatgccgcgaacttggttgcggggctgcttctggcacaccatccggcatactgtatgagccccccgcagaaaaggaacagaaggtcttgatccagagcgtgagttgcactggcactgaggacacactggcccagtgcgaacaggaggaggtttatgattgctcccacgatgaggacgctggggccagctgtgaaaacccagagtctagcttcagccctgtccctgagggagtgagattggccgacgggccaggacactgtaaaggccgcgtggaggtgaagcaccagaatcagtggtataccgtctgtcagacgggctggagcctgcgagctgcaaaagtagtgtgcagacaactcggctgcggccgcgccgttctgactcaaaaacgttgtaataagcatgcatacggtaggaaacctatctggctgagtcagatgtcttgctccggacgggaagccacgctgcaggactgtccaagcggcccttggggcaaaaacacctgtaatcacgatgaagacacctgggtagagtgtgaagatcccttcgacctgaggctggtagggggagataacctgtgttctggaagactggaggtactacacaaaggcgtgtgggggtctgtgtgcgacgacaattggggggagaaagaggatcaggtggtgtgcaagcagctgggatgtgggaagtccctatcccccagctttcgagaccggaaatgctacggcccaggagtgggacgcatttggctggataatgtgcgatgctccggtgaagaacagtctctcgagcagtgccagcacagattttgggggttccacgactgcactcatcaagaagatgtcgctgtgatttgctcaggttag

SEQ ID NO: 111377 - DNA, 660 bp, Artificial Sequence
  Description of Artificial Sequence: Synthetic coding sequence
atgggaatgtcttcgctcaaacttctgaagtacgttctattttttttcaatctactgttttggatatgcgggtgctgtatcttggggttcgggatttacctgctaattcataacaactttggtgtgttgttccacaatctgccctccctcacactaggcaacgtgtttgtcattgtgggttctattataatggtggtagcatttttagggtgcatggggagtattaaggagaacaagtgcctcctcatgtccttcttcattttgctgctgatcatcctgctagctgaggtgaccctggctatccttttgttcgtatatgagcagaagcttaacgaatacgttgctaagggccttacagactctatccaccgttatcattctgacaattccactaaagcggcctgggactcaatccagagtttcttacagtgctgcggcatcaatggcacttctgactggacctccggccctccggcgtcctgcccttctgacagaaaagtggaaggttgttacgctaaggcgcgactgtggttccactctaacttcctttatattggcataatcacgatatgcgtctgtgtcattgaggtcctgggaatgtcctttgctttaaccctgaattgccaaatcgataaaacaagtcaaacaatcggcctatag

SEQ ID NO: 111378 - DNA, 483 bp, Artificial Sequence
  Description of Artificial Sequence: Synthetic coding sequence
atgggaatgagttcactgaaactgctgaaatacgtgctgttcttcttcaacctcttgttctggatctgtggctgctgtatcttagggtttggcatttacctcttaatacataataatttcggcgtgctgtttcacaatctgccctctctgacactggggaacgtgttcgtgatcgtcggttccatcataatggtagttgcctttctgggatgcatgggcagtattaaagaaaataaatgcctgctgatgtcatttttcatcctcctgctaattattttgctagcagaagtcaccctggcgattcttctctttgtgtacgagcaaaaaggatgttacgccaaggctagattgtggtttcacagcaactttctgtacattgggataatcacaatttgcgtgtgcgtcattgaagtcctggggatgtcgttcgctctgacgcttaactgccaaattgacaagacctctcaaacgataggcctgtag

SEQ ID NO: 111379 - DNA, 1323 bp, Artificial Sequence
  Description of Artificial Sequence: Synthetic coding sequence
atgaccgttgccagaccatccgtcccagccgctcttcctcttcttggggagctgccaaggcttctcctgctcgtgctgttgtgcttgcccgctgtctggggagactgcggtctcccaccagacgttccaaatgcccagcccgcgctcgagggtcggacatccttcccagaggacacagtgatcacctataagtgcgaggagagcttcgtgaagatccctggcgagaaagatagtgtaatttgcctgaaagggtcccagtggagcgatatcgaggagttctgcaacagatcttgcgaggtgccaaccaggctaaattcggcctctctgaagcagccctacataacacagaactacttcccggttggaaccgtggtggagtacgagtgccgtcccggctataggagagagccatccctctccccaaagcttacctgtttacagaacctgaagtggtctaccgccgttgagttctgcaaaaagaaatcttgtcctaaccctggcgagataaggaacggacagatcgatgtgcctggtggtattcttttcggcgccacaatcagtttcagttgcaataccggctataagctgttcgggtccacctcctcgttctgcctcatttctggcagctctgtgcagtggtcggatcctttgccagaatgccgtgaaatctactgccctgctccaccacaaatcgacaatgggattatacaaggggaaagagatcattacggttaccgccagagtgtgacctacgcctgtaataaaggtttcactatgattggggagcacagtatctactgtaccgtgaataacgacgaaggggagtggtctggtcccccccctgaatgtcgcggaaagagtctcacctccaaggtgccccctacagtccaaaagcccaccacagttaacgtacctactacggaggtgtcacctacgagccagaagacaaccaccaagaccacaactccgaacgctcaagctacacgatcaacacctgtgtcacgcaccacaaagcattttcacgagacaacgccaaacaagggatccggaacgaccagcggaactactagactgttgtcaggctctaggcctgtgacacaggctgggatgcgctggtgtgacaggtcaagcctacagagccgaacgcccggattcaagagaagcttccacttctcactgccatcctcctggtattatcgggcccacgtgtttcatgttgatcgcttcgcctgggatgcgtcaaaccatgggttggccgatttggctaaggaggaactacgacgaaaatatacccaggtctaccggttattcctggtatcctag

SEQ ID NO: 111380 - DNA, 1095 bp, Artificial Sequence
  Description of Artificial Sequence: Synthetic coding sequence
atgacggtggcgcggccttccgtcccagcagccttgcctcttctgggcgaattaccaagattgctgctgctagttctgctgtgcctccctgctgtgtggggggactgcggcctgcctccagacgtgccaaacgctcagcccgccttggaggggagaacctcatttcctgaggacacagtgatcacctacaaatgcgaggagagtttcgtcaaaattccaggggagaaagactctgtgatttgtctcaagggtagtcaatggagcgatatcgaggagttttgcaaccgctcctgcgaagttcccacaagattaaacagcgctagcctgaaacaaccttacatcacgcagaactacttccctgttggtacggtggtggagtacgagtgccgccccgggtataggagagagccctcactctcccccaaactcacttgtttacaaaatctcaaatggagcacagctgtggaattttgcaaaaaaaaatcttgtcctaaccccggtgaaattcgcaacggccagatcgatgttccgggaggcattctcttcggcgccaccatcagcttttcttgtaacacagggtataagctgtttggctcgactagtagcttttgcttgatttccggctcttcagtgcagtggagcgatcctttacctgaatgcagggagatttattgcccggctcctccccagatcgacaatgggatcattcagggtgaaagagaccattacgggtaccgtcaaagtgtgacctacgcctgcaacaaaggtttcactatgattggagagcacagcatctactgcacagtgaataatgatgaaggcgagtggagcggacctcctcctgagtgccggggtaaatctctcaccagcaaagttccaccgacagtacagaaacccacaaccgtcaatgtgcctaccactgaggtgagcccaacaagccagaagactactaccaagacaactacgcctaatgctcaggctacgagatccacgcctgtctcacgaacaacgaagcacttccacgaaacaacaccaaacaagggatcaggcactacttccggaacaacaagactgctttctgttctttttatgtag

SEQ ID NO: 111381 - DNA, 1146 bp, Artificial Sequence
  Description of Artificial Sequence: Synthetic coding sequence
atgaccgtggctcggcctagcgtgcccgcagccctgccgctgctcggcgagttgcctcgccttctgcttctggtgctgttgtgtctaccagctgtctggggtgactgtgggcttccacctgacgtgccaaacgcccaaccagctttggaaggacggacatcctttcccgaggacacagtaattacttataagtgcgaggagagcttcgtgaagatccctggcgaaaaagactctgtgatctgtctcaaaggaagccagtggagtgacatcgaggaattctgcaataggagttgtgaagtgccaacaaggctgaacagcgcttctctcaagcaaccatacatcacccagaactattttcccgtgggaaccgttgtggagtacgaatgccgacccggatacaggcgcgaacccagcttgtcacccaagcttacatgccttcagaatctgaaatggagcaccgccgtggaattctgtaaaaagaagtcatgccctaaccctggcgaaattcgtaacgggcagatcgatgtccccggaggcatactgtttggtgccacgattagttttagctgtaataccggatacaagctgtttggatctacaagctccttctgcctaatctcaggcagttcagtgcagtggagtgacccactccccgaatgccgtgagatctattgccccgcgccccctcagatcgataatggcattatccagggcgagcgagaccactatggctatagacaaagtgttacttacgcctgtaataagggctttaccatgattggcgaacattcaatttattgtactgtcaacaacgatgagggcgaatggtcgggcccacccccggaatgtagggggaaaagcctgacttcgaaagtgcccccgacggtgcaaaagccaacgactgtgaacgtacctacaacagaagtctcgcccacctcacaaaaaaccaccaccaaaacaaccacacccaacgctcaggctacgagatccaccccagtgtcaaggacaacaaaacactttcacgagactacaccaaacaagggctctggcaccacatcaggcaccactcgtctcctctccggacatacctgcttcacactgaccggtctgttaggtaccctggtgaccatgggcctgctgacttag

SEQ ID NO: 111382 - DNA, 1320 bp, Artificial Sequence
  Description of Artificial Sequence: Synthetic coding sequence
atgaccgttgctcgcccaagtgtacccgcagccttgccactcctcggagagttgccaagactcctgttgctagtacttctgtgtctgcccgcggtttggggggattgtggtttgccacccgacgtgcccaacgctcaaccagcgctcgaaggccgcaccagctttccagaggataccgttatcacttacaaatgtgaagagtcttttgtcaagattcccggagaaaaggattccgtaatctgcctcaagggatcgcagtggtctgatattgaggaattctgtaaccgcagttgcgaggtgcccactcggctgaactccgcctctctgaaacagccctacattacacagaattatttccccgtgggtaccgtggtcgagtacgagtgtcggcccggctaccgccgagagccgagcctctcaccaaagttgacttgcctacaaaacctcaagtggagtaccgccgtggaattctgcaagaagaaatcctgcccaaacccaggggaaatcagaaacggacagatagacgttccaggcggaatcttgtttggtgctaccataagcttctcctgcaacaccggctacaagttgtttgggagcacttcatcgttctgtctgatttcaggaagctccgtgcaatggtccgatcctttgccagagtgtcgcgaaatatattgtcccgcaccgccccagatcgataatggaattattcagggcgaacgcgaccactacgggtatagacagtctgtgacgtacgcgtgcaacaagggcttcacaatgatcggggaacactcgatatactgtacagtgaacaacgacgaaggggagtggtccgggccacctccggaatgtcgtggtaagtctctcacaagtaaggttccaccaacagtccaaaaacctactacggtgaatgtcccaaccactgaggtgagtcccacctcccagaagacgaccaccaaaaccacgacgcccaatgcccaggcaactagaagcacaccggtgtctcgcacaaccaagcattttcatgaaacaacaccgaacaaaggcagcggcacaacttcggggacaactcggctgcttagtgaaactgtctttcatcgcgtaattcaggacggcctcgacctgctcgcgagccgcagcgcctgtctcggcttgcctaaatgctgggactataggcgcgagccccctcatcttgcacgcgcgcacgtattccatgtggacagattcgcttgggatgcatcaaatcatggactcgcggatcttgccaaggaggaactgcggcgaaagtacactcaagtgtatcggctgtttctggtgtcatag

SEQ ID NO: 111383 - DNA, 390 bp, Artificial Sequence
  Description of Artificial Sequence: Synthetic coding sequence
atgacggtagcacgaccgtctgtgcctgccgctcttcctctgctaggagagttgccccgactacttcttttggtgctgctctgcctgcctgcggtctggggtgattgcggtctacctcctgacgtcccaaacgcacagcctgcactcgagggccggacttcctttcccgaagacacggtgataacttacaagtgcgaggaatcattcgtcaagattcctggcgagaaagatagcgttatctgtctgaaggggtctcagtggagcgatatcgaggaattttgtaacagaagttgcgaggtgcccacacggctgcagaagaggactttctccatcaccaaaacgaatctcccctcagagtttaaaatggtacactctagcagaatcttgtag

SEQ ID NO: 111384 - DNA, 1155 bp, Artificial Sequence
  Description of Artificial Sequence: Synthetic coding sequence
atgacagtcgcacgccctagtgttccagcggctttgccgctcctcggcgagctgccccgtttgctgctactggtactgctgtgcctaccagccgtgtggggggattgcgggctaccacctgacgtccctaatgcccagcccgccttagaaggcaggacatcttttccagaggatacagtgattacctataagtgtgaagaaagtttcgtgaagataccaggcgagaaggactccgtaatatgcctaaaaggctctcagtggtctgatattgaggaattttgcaatagatcttgcgaagtgccaactcgcctcaactccgccagcttgaaacagccttatataactcagaactacttcccagtgggaacagtggtggagtacgaatgcagacctggctataggcgggagccttccctctcccccaagctaacctgcttacaaaaccttaaatggtccactgctgtagaattctgtaagaaaaagagctgtccgaatccaggcgagatccggaatgggcagattgatgttcctgggggtattttgtttggggcaacaatttccttttcttgcaacacaggatataaactgttcgggagcacctcctccttttgcttgattagcggaagcagcgtccagtggagcgatcccctgcccgagtgtcgcgaaatatactgtccagccccgcctcagattgacaatgggattattcagggtgaaagggatcattatgggtataggcagtctgtgacatacgcgtgtaataagggattcaccatgatcggggaacattctatttattgtaccgtcaacaacgatgagggcgagtggagcggtccgccacctgaatgccgcggcaagtcattgacgagtaaggtgcctccaacagttcagaaacctaccaccgtgaacgtcccaaccactgaggtctcccccacatcccagaaaactacaacgaaaaccacaacacccaacgcccaggcaaccaggtccactccagtgagcaggacaacgaaacacttccatgaaaccacaccaaataagggttcagggacaacatccggcaccacccggctgttgtccgcactacaggtccgcccgtttgaagttagcggaagttctcacatcagtagtaaaaagatgatgtgcatcctttag

SEQ ID NO: 111385 - DNA, 954 bp, Artificial Sequence
  Description of Artificial Sequence: Synthetic coding sequence
atgaccgtggcaagacctagcgttccagccgccctgcctctgctgggagagctcccgcgcctgctcctgctagtcctgctgtgtttacctgccgtatggggagattgcgggctgcctccagatgtgcccaatgcccaaccagccctggagggccgaaccagtttccctgaggacaccgttatcacgtataagtgtgaagagagttttgtgaagattcccggggagaaagatagcgtcatttgtttaaaggggtcacagtggagcgacattgaggaattctgcaaccagaaaagctgtccgaacccaggagagatcagaaatggccagatcgatgttccaggtggcattctctttggcgccactattagcttctcctgtaacactgggtacaaattgttcggaagtacgagctcattttgtctgatttccggcagctctgtgcaatggagcgatccactgccagagtgccgcgagatctattgtccggccccaccccagatcgacaacggaataatccagggcgaaagggaccactatgggtaccggcaaagcgtgacttatgcctgtaacaaagggtttaccatgatcggagagcactctatatattgtaccgtcaataatgacgagggcgagtggtccgggccaccgccagaatgcaggggtaagtccctgaccagcaaggttcctcccaccgtgcagaagccaaccactgtgaatgtgcccacgacagaggtaagccctacgtcacagaaaactaccacgaagaccacaacaccaaatgcccaggccacacgctctacgccggtctcaaggacaaccaagcatttccacgaaaccacgcccaacaaagggagcggcactacctctggccagttgaccctattcagcggtcacacttgctttaccctcacaggactcctcgggacgctggtgacaatgggactgctgacatag

SEQ ID NO: 111386 - DNA, 753 bp, Artificial Sequence
  Description of Artificial Sequence: Synthetic coding sequence
atggttgctggttccgatgccggtagggcacttggggttttgagcgtcgtttgtctgttacactgtttcggcttcatctcttgtttctctcagcagatttacggagtagtctacggaaatgttactttccacgtcccgagcaatgtgcctctgaaagaggtattatggaagaagcaaaaggacaaggttgcggagctggaaaactcggagtttcgcgcattttccagctttaagaaccgggtataccttgacactgtctccggctcgttaaccatctacaatctcacttctagcgacgaagatgagtatgagatggaatccccgaacattacggacaccatgaagttttttttatacgtactggagagtttgccatccccaacgctgacatgcgcactgactaacgggtccatagaagtccagtgtatgatcccagagcactataatagtcaccgcgggttgataatgtatagctgggattgccctatggaacagtgtaaaaggaattcgactagtatctacttcaaaatggaaaacgacctgccccagaaaattcagtgtacattgagtaacccattgttcaataccacatcgagcattatcctgactacatgcattccgtccagcggtcattcgaggcaccggtacgccctgatccctatccccctggcagtcattaccacctgcatcgtattgtacatgaatggtatactgaaatgcgaccggaagcctgaccggacaaattctaattag

SEQ ID NO: 111387 - DNA, 747 bp, Artificial Sequence
  Description of Artificial Sequence: Synthetic coding sequence
atggtagctggctccgatgccggcagagcattgggtgtgttgagcgtggtgtgcctgttgcattgtttcggattcattagctgcttctcccagcagatatatggtgtggtatacggcaatgtgaccttccacgtgccttcaaatgtaccactgaaggaagttctgtggaagaagcagaaagacaaagtagctgagctcgaaaatagcgaattcagggcgttcagttcattcaaaaacagggtgtacttagataccgtctctggctcattaacgatctacaatttgacttccagcgatgaggacgagtacgagatggagagtccaaatatcacagatactatgaaattttttttatatgtgttggaatcactcccttctcctacactcacttgtgccctaaccaatggttctattgaagtgcagtgcatgatccctgagcactataattcacatagaggactgatcatgtactcatgggattgtcctatggaacagtgtaagagaaactcaacctctatttatttcaaaatggaaaacgacctcccacaaaagattcagtgcacactgtccaatccgttgtttaatacaaccagcagcatcatcctaaccacttgtattccttcttctgggcacagtcgacaccgttatgctctgattccaattccgctagctgtaatcacaacttgcatagtgttatatatgaacggaattcttaagtgcgacaggaaacccgatcgcacaaagtag

SEQ ID NO: 111388 - DNA, 387 bp, Artificial Sequence
  Description of Artificial Sequence: Synthetic coding sequence
atgggtattcaaggtgggtcagtcctgtttggactgcttctagtgttggcggtgttctgtcacagcggccacagcctgcaatgttataattgtcccaaccctacagccgattgtaaaacagcggtcaattgctcctccgactttgatgcttgcctgatcaccaaggcagggctccaagtatacaacaaatgctggaaatttgaacactgtaattttaacgacgttactacgaggctgcgagaaaacgaactgacttattattgttgcaagaaagacctctgcaatttcaacgaacaacttgagaacggtggtacctccttaagcgagaaaaccgtgctgctgcttgtgacgcctttcctcgccgccgcctggtccttacacccctag

SEQ ID NO: 111389 - DNA, 387 bp, Artificial Sequence
  Description of Artificial Sequence: Synthetic coding sequence
atggggattcaaggagggtcggtcctttttggtctgcttctggtgctggccgtgttttgccacagtgggcactctctgcagtgctacaactgcccgaaccccacagctgactgcaaaacagccgtgaactgtagctccgatttcgatgcatgcctgattactaaggcaggcctccaggtttacaataaatgttggaaattcgagcactgtaatttcaacgatgtcacaacacgacttcgggagaacgaactgacatactattgctgcaaaaaagacttgtgtaattttaacgaacagctcgaaaatggcggaacctccctgtcagagaagacggtcctacttctggtcactcctttcttggccgccgcatggagtctgcatccctag

SEQ ID NO: 111390 - DNA, 387 bp, Artificial Sequence
  Description of Artificial Sequence: Synthetic coding sequence
atgggcattcagggcggaagtgtgctgttcggtctgctgctggttctggctgtcttctgccactcagggcactctctccagtgttacaactgtcctaacccaacagctgattgcaagacagctgtgaactgcagttctgatttcgacgcttgcctcataactaaagccggactccaggtgtataataagtgctggaagttcgagcactgtaactttaacgacgtgaccactcgcctccgagaaaatgagctgacttactactgttgtaaaaaggatctgtgtaatttcaatgagcagctggagaatggtgggacctccctctcggagaaaaccgtgctgctcttggtgacacctttcctggctgccgcctggagtctgcatccgtag

SEQ ID NO: 111391 - DNA, 387 bp, Artificial Sequence
  Description of Artificial Sequence: Synthetic coding sequence
atggggattcagggaggctccgtgttgttcggccttctgctggtcctggccgtattttgccattcagggcatagcctgcaatgctataattgtccaaaccccaccgccgattgtaaaaccgcagttaactgctcatccgactttgatgcctgcttgataactaaggctgggctccaggtctataacaaatgttggaagttcgaacattgtaatttcaatgatgtgacaaccagactccgtgagaatgagctcacctactactgctgtaaaaaggacctctgtaactttaacgagcagttggagaatggggggacttctctatctgagaagactgtgctcctcctggtgacacctttcttggctgccgcgtggagtctccacccctag

SEQ ID NO: 111392 - DNA, 387 bp, Artificial Sequence
  Description of Artificial Sequence: Synthetic coding sequence
atgggtattcagggcggatcggtgctctttgggctgctgctcgtattggcggttttctgtcattcggggcactctctgcagtgttacaattgtcctaacccaactgctgattgcaagaccgctgtgaattgctctagcgattttgacgcttgcctcatcaccaaagcaggcctgcaggtttacaataaatgttggaagttcgaacattgcaactttaacgacgttactactagattgagagagaacgaattaacatattattgctgcaagaaggacctttgtaactttaatgaacagctagagaacgggggaactagcctttctgagaagactgttctgctactagtaaccccattcctggcggcggcctggtctctacacccttag

SEQ ID NO: 111393 - DNA, 387 bp, Artificial Sequence
  Description of Artificial Sequence: Synthetic coding sequence
atggggattcagggcgggtcagtgctgttcggcctgctgctggttctcgcagtgttctgtcactccgggcattcactccagtgctacaattgccctaaccccactgcagattgtaaaacggcagtgaattgctctagcgatttcgatgcctgcctgatcaccaaagccggactgcaggtttataataaatgttggaagtttgagcattgcaatttcaacgacgtgacaaccaggctgagggagaatgagttaacgtactattgctgcaagaaggatctgtgcaactttaacgagcagctcgagaacggcggtacttctctatccgaaaaaacagtccttctgttagtaacacctttcctagccgctgcgtggagtctacatccctag

SEQ ID NO: 111394 - DNA, 387 bp, Artificial Sequence
  Description of Artificial Sequence: Synthetic coding sequence
atgggcattcaaggcggttccgtgctgtttggcctgttattggtcctggcagtgttctgtcactcaggccacagtctgcagtgttacaattgtccaaacccaaccgcagactgcaagaccgcagtgaactgttctagcgactttgacgcctgccttataactaaagccggccttcaggtttacaacaaatgctggaaattcgaacactgtaactttaatgatgtgactacacggctgagggagaatgagctgacttattattgctgcaagaaggacctgtgcaactttaacgagcaactagagaacggaggaacatccctgtctgaaaaaaccgtgctactgctggtgactccttttctcgcggcagcttggtcactgcatccatag

SEQ ID NO: 111395 - DNA, 387 bp, Artificial Sequence
  Description of Artificial Sequence: Synthetic coding sequence
atggggattcaaggcggttcagtcctatttggactgctgctggtgctggccgtgttttgtcattctggccattcattacagtgttataattgcccaaatcctacggcagattgtaagacagccgtgaactgctcgagtgactttgacgcatgcctgatcactaaggccggtctgcaggtatataataagtgttggaaatttgagcattgcaactttaacgatgtcactacaaggctgcgtgaaaatgagctcacttattattgctgcaaaaaagatctgtgtaattttaacgagcagcttgaaaacggcggtacctccctgagcgagaaaaccgtccttcttctcgtgaccccattcttggctgccgcatggagcctgcacccttag

SEQ ID NO: 111396 - DNA, 387 bp, Artificial Sequence
  Description of Artificial Sequence: Synthetic coding sequence
atggggatccaaggcggcagcgtcctattcggtttgctcctcgttctggccgtgttctgccattccggccattccctccaatgttataactgtccaaacccaaccgcagattgtaagaccgccgtaaattgttcctcagatttcgatgcatgtctcattactaaggccggcctgcaagtatacaacaaatgttggaaattcgaacactgtaattttaatgacgtcaccacacgattacgtgaaaatgagctgacctactattgctgcaaaaaggacctctgcaatttcaatgaacagctggagaacgggggaacctctctatcagagaagactgttctgcttctcgtgacgccctttttggccgccgcatggtcactgcacccctag

SEQ ID NO: 111397 - DNA, 2007 bp, Artificial Sequence
  Description of Artificial Sequence: Synthetic coding sequence
atgtggctgttctttggtattactggcctactcactgccgctctatccggccatccttcacccgctcctcccgaccagctcaacacatcctcagcagaatcagagctctgggagcccggcgagcgcttgcctgtcaggctgacgaacggctcttcctcttgtagtggaactgtggaagttaggttggaagcatcttgggagccggcctgcggagccctgtgggatagccgtgctgccgaagccgtgtgtagagctcttggctgcggaggagccgaggctgcgagccagttggccccccccacccccgaactgcccccaccacccgccgcagggaatacgtctgtggccgcaaacgccacgttggccggcgctccagcgctgctttgctctggggccgagtggcggctatgtgaggtcgtggaacatgcctgcaggtcagacggccgccgggcaagagtgacttgcgctgaaaatagagccctgcgtctagtggatgggggaggggcttgcgccggacgagtggaaatgttggagcatggcgaatggggctcggtttgcgatgatacatgggatttagaggacgctcacgttgtttgtcgacagctgggatgtggctgggccgtgcaggcattgccgggccttcatttcactcccggaagagggccaatccatagagaccaggtcaactgtagcggagctgaggcgtacctctgggactgccctggtctgcctggacagcactactgtggtcataaagaagacgcaggcgctgtgtgttctgaacaccagagttggcgccttaccggaggcgctgaccgctgcgaaggacaagtcgaggtacattttagaggagtgtggaataccgtctgtgacagtgaatggtatccttccgaggccaaagtactgtgtcaatcccttgggtgtggcacagccgttgaacgaccaaaggggctgcctcactccctgagtggacggatgtattattcctgtaatggtgaagagctgaccctcagcaattgtagctggaggttcaacaatagtaacctgtgtagtcaatcgctggctgcaagagtactgtgctctgcaagccgatcgctgcataacttgagtacaccagaagtgccggcatccgtgcagacggttacaatcgagagtagcgttacggtcaagatcgagaataaggagagcagggaactgatgctactgattccaagcattgtcttgggaattcttctcctgggttccctgatattcatagcattcatccttctccgaatcaaaggaaaatacgccctccccgtgatggtcaaccaccagcacctccctacgaccatcccagctgggagtaatagttaccaaccggttccgattacgatccccaaggaagtgttcatgctccccatccaggtgcaagcacctccccctgaggatagcgactcaggatccgactccgattatgagcattatgacttctccgcgcagccccccgttgctctgacaacgttttataattctcagaggcaccgggtgactgacgaagaggtgcagcagtcccgattccagatgcctcccctggaggaaggcttagaggaactacatgcttctcacatccctactgctaatcccggacactgcattaccgaccctccgtccctgggcccacaatatcacccgcgatcaaactcagagagcagcacttctagtggggaagattattgtaactcacccaagtctaaactgccaccctggaatcctcaagtatttagcagcgagagaagctctttcttggagcaaccccccaatttggagttggctggaactcagccggctttctccgctggaccacccgcagatgacagttcctcgaccagctccggtgagtggtatcaaaatttccaacctcctcctcaaccgccttccgaggaacagtttggctgtcctgggtctccttccccgcagcccgactctacagacaacgatgactacgatgacatctccgccgcctag

SEQ ID NO: 111398 - DNA, 1911 bp, Artificial Sequence
  Description of Artificial Sequence: Synthetic coding sequence
atgtggctcttctttggtatcacgggcttgcttacggccgctctctctggtcatccttccccagcaccacctgaccagcttaatacatcctctgccgagtctgagctgtgggaaccaggagagcgcttaccagttaggctgacaaatggcagtagttcttgcagcggtacggttgaagtgagactagaagcctcttgggaaccagcttgtggagccctgtgggactcccgggccgccgaagcagtctgccgcgccctggggtgtggcggcgccgaggccgcttcgcaactcgcgcccccgaccccagaactcccgcctccccccgccgcagggaatacttcagtcgctgctaatgcaacgctggccggcgctcccgccttgttatgtagcggggctgaatggcgactgtgtgaggtggtcgaacacgcttgcagatctgacgggcggagggcacgtgtgacgtgtgcagaaaatcgcgccttgcgcctggtagacgggggaggcgcatgtgctggtagggtcgaaatgctcgagcatggcgagtggggctctgtctgtgatgatacttgggacctcgaagatgcccatgtggtgtgcagacaactcggctgtggctgggccgtccaggccctgccgggactgcacttcaccccaggcagaggacccatccacagagatcaggtcaactgcagcggggccgaagcttacctctgggactgccctgggctaccgggccaacactactgtggccacaaggaagacgcaggggctgtctgtagcgaacaccagtcttggcgacttactgggggcgctgacagatgcgagggccaggtggaggtgcactttagaggtgtgtggaatacagtctgtgattcagaatggtatccctcagaggcgaaggtgttgtgccagagcctcgggtgcggcaccgcggtggagcgcccaaagggccttccccactctctgtccggccggatgtattatagctgtaacggcgaggaactgactctgtcgaactgcagctggaggtttaacaacagcaacttgtgctctcagtcattggcagcaagggtgctgtgttcagcctctcggtcgctgcacaatctgtctaccccagaggtgccggcaagcgtgcagacggtgacgattgagagcagcgtgactgtgaagatcgagaacaaagagtctcgagagttgatgctgcttatacccagcatagtcctaggtattctcctgcttggttctcttatcttcattgcattcatcctcctgagaatcaagggcaaatacgtgtttatgctgccaattcaggtccaggccccacctcccgaggactccgatagcggctccgacagcgactacgagcattacgattttagcgcacagccccctgtcgctctgaccaccttctacaattcccagcgacaccgggttaccgatgaggaggtacagcagagcaggttccaaatgcctcccttggaagagggtctggaagagctgcatgcttcccacatcccaactgcgaaccccggacactgcataactgatccaccttcactgggacctcagtatcaccctaggagcaatagtgagtcttcaaccagctcgggtgaggactattgcaactctccgaaatcaaagcttcccccttggaatccccaggtgttttcctctgagagatcgagctttcttgaacagccccccaacctggagctggccggcacccagcccgctttctcggcaggcccaccggctgacgattcatcgtcgacgtcaagtggcgagtggtatcaaaatttccaacctcccccccagcctccatcggaggagcaatttggctgccctggcagcccttccccccaaccagactctacagataatgatgactacgacgacatttcagccgcgtag

SEQ ID NO: 111399 - DNA, 1788 bp, Artificial Sequence
  Description of Artificial Sequence: Synthetic coding sequence
atgtggctatttttcggcattactggattgttgactgcagctctgagcggccatccaagcccagcaccgcccgaccagttgaatacctcatccgcagagagcgaactctgggaacctggtgagagactccccgttaggctgacaaacggcagctcgtcctgctctggaaccgtggaggtgcgcctcgaagcgtcttgggagcctgcttgcggcgctctgtgggattctcgggcagctgaagcagtgtgtcgagccctaggctgtggcggtgcagaggccgccagtcagctggctccacccacccctgagctgccacctcctcccgctgcaggcaacaccagtgtggctgcaaacgccacacttgcaggcgcacctgccttgctgtgcagtggggccgagtggcggctgtgcgaggtagtggaacacgcgtgtagatccgatgggcgtagggcccgcgttacctgtgctgaaaatcgagcccttcgcctggtcgacggtggaggtgcctgtgccgggcgggtggagatgttagagcatggagaatggggttctgtctgtgatgatacttgggatcttgaggacgcacacgtagtctgtaggcaactagggtgcggctgggcggtgcaggccttgcccggactgcacttcaccccaggccgcgggccaattcatagggatcaggttaactgttccggggctgaggcttatctatgggattgcccgggcctgcctggacagcactattgtggacataaggaagacgctggggccgtttgttcagaacaccagagttggcgcctcaccggaggcgccgaccggtgtgagggtcaggtggaggtccatttccggggcgtctggaataccgtctgtgattctgagtggtaccctagcgaggccaaagttctctgtcagtcacttggctgtggaacagccgttgaaaggccaaaaggattgcctcattccctgagcgggcggatgtattactcgtgcaatggcgaagagcttacgctgtctaattgcagttggaggttcaacaactccaatctctgctcacaatctcttgccgcaagggtcctgtgcagcgcctcccgtagcctgcacaacctctctactccagaagtgcctgcaagcgtccaaactgtcacgattgagtcctccgtgacggtgaagatcgaaaacaaggagtctcgtgaactcatgctcctgatccctagcattgttctcggcattctcttattagggagcttgatttttatcgcctttatcctgttgagaatcaagggtaagtacgattcccaacgccaccgcgtgacagatgaggaggtacagcagtccaggtttcagatgcctccacttgaggaagggcttgaggagctgcatgccagccatatccctactgccaatcccggacattgcattacagaccctccgtctctcggaccccaatatcacccacgctccaatagcgaaagttctacgtcgagcggcgaggattattgtaacagcccaaaaagcaagttacccccctggaaccctcaggtgttcagcagcgaacggtcaagcttcctcgagcagccgccaaatctggagttggccggaactcagcccgccttctcagcggggcctcccgcagacgatagctcctccacttcctcaggggagtggtatcagaactttcagcccccaccccagcccccgtccgaggagcagtttggctgtccaggctcgccgagtccacagcctgacagcactgataacgacgattacgacgatatcagcgcagcctag

SEQ ID NO: 111400 - DNA, 1806 bp, Artificial Sequence
  Description of Artificial Sequence: Synthetic coding sequence
atgtggctgtttttcggcataaccggtctcctgaccgccgcacttagcggacatccttcgcctgccccacccgaccaattgaacacttctagtgccgaatcagaactctgggagccgggagagaggctcccagtgcgcctgaccaatggtagttcaagttgcagtggaaccgtcgaggtgagattggaagctagttgggagcccgcgtgtggcgccctgtgggactctcgagccgcagaggctgtgtgtcgcgcgctgggctgtggtggcgctgaagctgcctcccagcttgcccctcccacacccgagctgcccccgccccccgctgctggtaacacttcggtggcagctaacgcaacactcgcaggggcgcccgcactcctttgctccggcgctgaatggaggctgtgtgaagttgtggaacacgcctgccgctcagacggtcgaagggcgcgcgtcacctgcgccgaaaacagagccttacggttggtggatggtgggggggcctgtgcaggtagggtggagatgctggaacacggcgagtgggggtctgtgtgtgacgacacctgggatctggaagacgcacacgttgtatgtcgccagctcgggtgtggctgggcagttcaggccctcccaggtctccatttcacaccaggtcgtggtccaattcatagggatcaggttaactgcagcggggccgaggcttacctttgggactgtcctggcctgcccggacaacactattgtggccataaggaggatgctggcgcggtatgctcagagcaccaatcatggcgtctgacaggtggcgcagataggtgcgagggacaagtcgaggtccatttcagaggtgtctggaacaccgtttgcgacagcgaatggtacccgtccgaagcgaaagttctctgtcagagcctgggatgcggcacagcagttgagagacccaagggccttccccacagtctgtctggaagaatgtattacagctgcaacggcgaagagcttactttgtccaattgctcctggcgcttcaataatagtaatctctgttcccagtccttagcagctagagttctgtgctcagccagcagatcattgcataatctgagtactccggaggttcccgcaagtgtgcaaaccgtgactattgaaagtagcgtaaccgttaagatcgaaaataaggaatccagagagctgatgctcctaatccctagcattgtgctgggtatcctccttctaggtagcctgatattcattgccttcattctccttcgaattaaaggcaagtacgtgttcatgctccctattcaagttcaggccccacctcctgaagactcggatagtggcagtgattcggattatgaacattacgactttagcgcacagcccccggtcgccctgacaacattctacaattcccaacggcacagggtgaccgatgaggaagtgcaacaatctaggttccagatgccaccattggaagaggggctggaagagttgcatgcctcccacatcccgaccgcaaatcccggccactgcatcacagaccccccctctctggggccacaataccatcccagaagtaattctgaaagttctacatcatctggcgaggactattgcaattctcctaaatctaaactgccaccttggaacccccaagtcttttcatcagagcgcagctcattccttgaacagccaccaaacctggagctggccggcacgcagcccgccttcagcggctccccctcaccacagcccgattccacggataatgatgattacgacgatatttctgcggcctag

SEQ ID NO: 111401 - DNA, 1779 bp, Artificial Sequence
  Description of Artificial Sequence: Synthetic coding sequence
atgtggctgttcttcggcatcacagggctcctcaccgccgctctttccggtcatcctagcccagcaccacccgaccagctaaatacttcctcggctgagagcgagctttgggaaccaggagaaagattgccggtccgccttaccaatgggagcagtagctgcagtggtacggtggaagtgcgccttgaagcctcctgggagccagcctgtggagcgctgtgggattcaagggcagcagaggccgtgtgtagagccctgggatgcggtggcgccgaggcggcgtcgcaactggcccccccgaccccagagcttcccccccctccagctgctggcaatacttccgtcgctgccaatgcgaccctggcgggcgcacctgcccttctgtgctccggggctgagtggaggctctgtgaagtcgtggagcacgcctgcaggtcagatggacgaagagccagagtgacttgtgctgagaacagggccctgaggttggtggatggggggggggcctgcgccggaagagtcgagatgctcgagcatggcgaatgggggtccgtctgcgacgacacttgggacctagaggacgctcatgtggtgtgcagacagctcggctgtggctgggctgtgcaggctttgcctggattgcacttcactcctggcaggggccccattcaccgcgaccaagtaaactgtagtggagccgaggcctatctatgggattgtccagggcttcccgggcagcactactgcggtcacaaggaagacgcaggcgcagtgtgcagtgaacaccaatcttggcggctcacgggcggtgctgatcgatgtgagggacaggtcgaggtgcatttccgcggtgtatggaacaccgtctgtgatagcgaatggtacccctctgaggccaaggtgttgtgccagtctctgggctgcggcaccgcggtcgagagaccaaaaggccttcctcattccctcagtggaagaatgtactacagctgcaacggggaagagttaaccctgagtaattgttcttggaggttcaacaactctaacttgtgttcccaaagtcttgccgccagagtattatgttccgcctcacgaagtcttcacaatctttccaccccagaggttccggccagtgtccagaccgtcaccattgaatcctccgtgaccgtaaaaattgagaataaagagtcgagggaacttatgttgctcatccccagcatcgtgctgggcattctcctgctcgggagcttgatcttcatcgcctttatccttctgcgaattaaggggaagtatgcactgcccgtgatggtaaatcaccagcatctacctactactattccggccggaagtaattcttaccagcctgtgcctattacaatacctaaagaggattcccagcgccacagggtgaccgacgaagaggtgcagcagtcccgatttcaaatgccaccactcgaggagggtctggaggagctgcatgcctcccacattccaacagcaaaccccggtcattgcattacagacccgccatcacttggcccccagtaccaccctcggagcaatagtgagagcagcacttcttccggggaagattattgcaacagcccaaaaagtaagttgccaccttggaatccacaggtgtttagctctgagcgttcatcatttctcgagcagccaccaaatctggaactggcgggaacccagcccgccttctccgggagtccatctccccagcccgacagcaccgataacgatgactatgacgacatttcagcagcctag

SEQ ID NO: 111402 - DNA, 717 bp, Artificial Sequence
  Description of Artificial Sequence: Synthetic coding sequence
atggcggtggagggagggatgaaatgtgtgaagtttttgctgtatgtcctgctccttgcgttttgcgcctgtgccgtgggattgatcgcggtgggggtgggagctcagcttgtgctgtctcagaccattattcaaggagctacaccaggctcgctcttgcctgttgtcatcatcgcagtgggagtgtttctgttcctcgtggcatttgtcggttgttgtggagcctgtaaagagaattactgtctaatgatcacctttgctatatttctgagcctcatcatgctggtggaggtggccgcagccatcgccggttatgtgtttcgggataaggtcatgtccgagtttaataataatttcaggcagcaaatggaaaattatcctaagaacaaccacaccgctagcattctggacagaatgcaggccgatttcaagtgctgtggcgccgcaaactatactgactgggagaagataccctcaatgagcaagaatcgggttccagattcctgctgcattaatgtgactgttggatgtggtatcaatttcaatgaaaaggccatccacaaggaaggctgcgttgagaaaatcgggggttggctcaggaaaaatgtgttagttgttgccgccgcagctctgggcattgctttcgtggaggtgctgggtatcgtgtttgcctgctgtctggttaagtccatcagatccgggtatgaggtaatgtag

SEQ ID NO: 111403 - DNA, 711 bp, Artificial Sequence
  Description of Artificial Sequence: Synthetic coding sequence
atggccgtggaaggcggtatgaagtgcgtcaagtttttgttgtatgttctgctactggcgttctgcgcatgcgccgtcggacttatcgcagtaggggtaggtgctcagctcgtgctgtcccagacaattattcagggggccacccctggaagcctgctgcctgtggtgatcattgcagtcggagtgttcctgtttcttgtggcctttgttgggtgctgtggagcttgtaaagagaattattgcctgatgatcacatttgccatttttttaagcctgatcatgctagtagaagtggcggcagccattgctggctatgtctttcgcgataaggtcatgtcagagtttaataacaatttccggcagcaaatggagaactaccccaaaaacaaccacaccgctagcattctcgaccgaatgcaagcagatttcaagtgctgtggcgccgccaactatactgactgggagaaaataccctcaatgtctaagaatcgggtccctgactcatgttgcatcaacgtgacagtcggctgtggcattaattttaatgaaaaagctatacataaagagggatgcgtagagaagattgggggttggctccgtaaaaacgtcctggtcgtggcagctgcggctctgggaatagcatttgtgctcggcatcgtttttgcatgttgcctggtgaagagtatccggagcggctacgaagtgatgtag

SEQ ID NO: 111404 - DNA, 402 bp, Artificial Sequence
  Description of Artificial Sequence: Synthetic coding sequence
atggccgttgagggagggatgaagtgcgtgaaatttctactgtatgtgctgctgctcgccttttgtgcctgtgcagttggcctcatcgcagtcggtgtcggcgcccagctggttctctcccagacaatcatacagggtgccactcccggctctcttcttcctgtagtcattatagctgtgggagtctttctgtttctggttgccttcgtaggctgctgtggcgcttgcaaagagaactactgccttatgattaccttcgccatttttctgagtttgatcatgctcgtggaagtcgcagccgccatagcgggttatgtatttagagataaggtgatgtccgaattcaataataacttcagacaacagatggagaactatcccaaaaacaaccacacagcctag

SEQ ID NO: 111405 - DNA, 717 bp, Artificial Sequence
  Description of Artificial Sequence: Synthetic coding sequence
atggccgtcgaaggtggcatgaaatgcgttaaattcctcctttacgtcctgctcctagccttttgtgcctgcgccgttggcctcatcgccgttggggtgggagctcagcttgttctgtcccagaccatcattcagggggcgactccaggctctttactgcctgtagtgattattgccgtgggtgtatttctatttttagtggcattcgtcggctgttgcggcgcctgcaaagagaattactgtctgatgatcacttttgccatatttttgagcctcatcatgctggtcgaggtggcggcagcaatagccggctacgtgttcagagacaaggtcatgtctgaattcaacaataatttccgccagcagatggaaaattaccctaagaataatcacactgcttcgatcctggatagaatgcaggccgacttcaagtgttgcggggccgcaaattataccgactgggagaaaatcccctcaatgtctaaaaacagggttcccgatagctgttgcatcaacgtcactgtgggctgtggaattaatttcaacgagaaggccatacacaaagagggatgcgtggaaaagataggcgggtggcttaggaaaaacgtgcttgtggtggcagccgccgcgttggggatagcattcgttgaggtcctgggcattgtgttcgcttgttgtctcgtgaaaagcatcagatccggttatgaagttatgtag

SEQ ID NO: 111406 - DNA, 648 bp, Artificial Sequence
  Description of Artificial Sequence: Synthetic coding sequence
atggcagtcgaagggggcatgaagtgcgtgaaattcctgctgtatgtactgcttctcgcattctgtgcatgtgccgtgggccttatcgccgtgggcgttggtgcacagctcgtcctgtctcagaccataattcagggggcaacccccggaagtctgttgccagtggttataattgcagtcggcgtcttcctcttcctcgtggcttttgtcgggtgctgcggcgcttgtaaagagaattattgtttgatgattacctttgccatatttctgtcactgatcatgttggtcgaggtggcagctgctatcgctggctacgtttttagggacaaggtgatgtctgagtttaataataactttagacagcagatggaaaattatcctaagaacaaccacactgccagcatcctcgaccgaatgcaggcggattttaagtgctgtggagccgccaattacacagactgggagaaaattccatccatgagcaagaacagagttcccgattcatgctgtattaacgtaaccgtagggtgtggcatcaatttcaatgaaaaggccatccacaaagaaggatgcgtggaaaagatcggcggctggctccgtaaaaacgttctggtcgtggctgccgcagccttgggaatcgcattctag

SEQ ID NO: 111407 - DNA, 654 bp, Artificial Sequence
  Description of Artificial Sequence: Synthetic coding sequence
atggcagtggagggaggcatgaaatgtgtgaaatttctgttgtatgtgctgctgctcgccttttgtgcatgtgctgtgggccttatagccgtgggagtgggggctcagctggttctgtcccagacaatcattcagggggctacaccagggagcctcctcccagtcgttattatagcagttggagtcttcctttttctcgtagccttcgtgggctgttgcggagcttgtaaagaaaattactgcttaatgattactttcgcaatttttctttctctaattatgcttgtagaagttgctgccgctatcgccggctacgtgtttcgggataaggtaatgagtgagtttaacaataactttcgacagcaaatggaaaactaccccaaaaataatcatacagcatccattcttgatcgcatgcaggccgatttcaagtgttgtggtgccgccaactacaccgattgggagaagatcccaagcatgtcaaagaaccgagttcccgattcctgttgtatcaacgtgaccgtcgggtgtgggatcaatttcaacgagaaggccatccacaaggagggatgtgtcgaaaagatcggcggatggctgagaaagaacgtgctagtggtggcggcagcggcccttgggatcgcctttgtcgaatag

SEQ ID NO: 111408 - DNA, 717 bp, Artificial Sequence
  Description of Artificial Sequence: Synthetic coding sequence
atggctgtcgaaggcggcatgaagtgtgtgaagttcctcttatatgtgctgctactcgctttttgtgcctgtgcagtgggattgatcgccgttggcgtgggtgctcaactcgttctcagtcaaacgattatccagggggcaactccaggttctctcttgccagtggttattattgccgtcggcgtgtttctttttctggttgccttcgtaggatgctgtggcgcgtgcaaggagaactattgcctgatgatcacgttcgccatcttcctttctctgatcatgctcgttgaagttgccgcagccattgcggggtatgtttttcgggacaaggtgatgagcgagtttaataacaatttcagacagcagatggagaactaccctaagaacaaccacactgcgagcatcctggaccgtatgcaagctgacttcaaatgttgcggcgcagctaattacacagattgggaaaagattccctcaatgagtaaaaaccgggtgccagactcatgttgcatcaatgtgacggtgggatgcggcataaatttcaacgagaaagcgatccataaagaggggtgtgtcgagaaaataggaggctggctacggaagaatgtgttggtagtggctgcagccgcgcttggcatcgcctttgtggaggttctcggcattgttttcgcatgctgcctcgtgaaaagcattaggtccggctatgaggtaatgtag

SEQ ID NO: 111409 - DNA, 648 bp, Artificial Sequence
  Description of Artificial Sequence: Synthetic coding sequence
atggccgtggagggcgggatgaaatgtgtcaagttcctgctctatgtcctcttgctggcattttgtggagctacacccggatctctcttgccagttgtgataattgctgtaggagtgtttcttttcctggtggcttttgttggctgttgtggcgcatgcaaggagaactactgccttatgattaccttcgcgatattcctctcactgatcatgttagtggaagttgcagcggctattgccgggtatgtgttccgggacaaggtgatgagcgagttcaataacaattttaggcagcaaatggagaattatccaaagaataaccatacagcgtcgatcctcgaccgcatgcaggccgactttaaatgctgcggggcggcgaactatacagactgggaaaagattccatcaatgagcaagaatcgcgtgccagatagctgctgcatcaacgttaccgtgggctgtggcattaatttcaacgagaaagcaatccataaagagggctgtgtggaaaaaatcgggggctggctacgtaaaaacgtactcgtggtagctgccgctgccctaggcattgcattcgtcgaggtgttagggatagtcttcgcatgttgcttggtgaaatcaattcgctctggctacgaggtcatgtag

SEQ ID NO: 111410 - DNA, 471 bp, Artificial Sequence
  Description of Artificial Sequence: Synthetic coding sequence
atgatcacgtttgccatatttctttcattgataatgctggtggaggtggcagccgctattgcaggttatgttttcagggataaagtaatgtcagagttcaataacaattttcggcagcaaatggagaactatcccaagaataaccatacagcttccattctcgatagaatgcaggcggacttcaagtgctgtggcgctgcaaattacacagattgggagaagatcccttcaatgtctaagaacagggtcccagatagctgttgcattaatgttacagtgggttgcggcataaacttcaatgaaaaagccatacataaggagggatgcgtggagaagatcggcggatggctgaggaaaaacgtcttggtcgtcgcagcagccgccctgggtatagccttcgtggaggtcctcgggattgtgtttgcatgttgcctcgtaaagagcatcagaagcggctacgaggtaatgtag

SEQ ID NO: 111411 - DNA, 471 bp, Artificial Sequence
  Description of Artificial Sequence: Synthetic coding sequence
atgatcacatttgcaattttcctttctctgatcatgctggtcgaagtcgccgcggccattgccggctacgtgtttagggacaaggttatgtctgagttcaataacaattttcggcaacagatggagaattatccaaaaaacaaccacacagccagcattcttgatcggatgcaggcagactttaagtgctgcggagcagctaattacactgattgggaaaaaataccatccatgtccaagaaccgcgtgcctgactcttgttgtataaacgttacagtgggttgtggcatcaatttcaacgaaaaggccatccacaaagagggctgcgtcgagaaaataggggggtggctccgtaagaatgtgctcgtcgtggctgctgcagccttgggtattgctttcgtggaagtattaggaattgtcttcgcctgctgcttggtgaaaagcattcggtcaggctacgaggtaatgtag

SEQ ID NO: 111412 - DNA, 1065 bp, Artificial Sequence
  Description of Artificial Sequence: Synthetic coding sequence
atgagactggctgtactcttctctggggccctcctgggcctgcttgccgctcagggaaccggtaacgattgtccgcacaagaagagcgccacattgcttcccagctttaccgtcactccgacagtgacggagtccaccgggaccacgagtcacagaacaacaaagtcacacaaaaccacaacccatcgaacaactactactgggacaacctcccacggtcctactactgcaacacataaccctaccaccacctctcacggcaatgttactgtccatccaactagcaatagtaccgcgactagtcaggggccaagtaccgccacccattccccagcgaccacaagtcacgggaatgctaccgtccacccaacctccaactcaacggccaccagccccggcttcacctcttctgcccaccctgagccaccccctccctccccctccccatctcctacctctaaggagaccattggcgactacacatggactaatggcagtcagccctgtgtgcacctacaggcacaaatacagattcgggtcatgtacactactcagggtggtggagaagcttggggcatatccgtactcaaccctaacaagaccaaggtgcagggaagttgcgaaggcgcccatccacatttgctgctctccttcccctatggacaccttagcttcgggtttatgcaggacctgcaacaaaaagtagtttacctaagctacatggcagtggagtataatgtgtccttcccacacgctgcacaatggaccttttcggcccagaacgcatccctgagggacctgcaggctccactcggacagtccttttcatgtagcaatagttctattattctctctcctgcagttcatctagatttgctgtcgctccggctacaggccgctcagttgccacacaccggagtgtttggacagtctttttcttgtccctcagatcgcagcattttgctcccactcatcataggtctcattctgctgggcctactggcgttggtcttgatcgccttttgcatcattaggaggcgaccgagcgcctaccaggcattgtag

SEQ ID NO: 111413 - DNA, 894 bp, Artificial Sequence
  Description of Artificial Sequence: Synthetic coding sequence
atgcggctggcggtgctgttttcgggggcgttgttgggcctgctagctgaaagcacagggacaacctcccacaggaccaccaaatcgcataagaccaccactcacaggacaacaacaactgggactaccagccacggacccacaacagcaacacataatcctacaaccacttcccatggaaacgccactgttcaccctacttccaacagcactgccacatcccctggatttacttcctcagcccaccccgagcctccccctcctagtccaagcccaagtccgacgtctaaggaaaccatcggcgactatacctggacaaatggttctcagccctgcgtgcacctgcaagcacagattcaaatacgcgtcatgtatactactcagggtgggggcgaagcatggggcatttccgtgcttaatcctaataaaaccaaggtgcagggcagttgtgaaggcgcccacccacatcttctcctgtccttcccttatgggcatctgtcattcgggtttatgcaggatcttcaacaaaaagtggtatatttgtcctacatggcggtagaatacaacgtctcattcccgcacgctgctcagtggaccttctctgcccagaatgcatctcttcgcgaccttcaagcaccactgggccagagtttctcttgttcgaattcctctattatcctcagtccagcggtgcatcttgatctgctaagcctgcgccttcaggccgcccagctgcctcataccggagtcttcggccaatccttctcgtgccctagtgaccgctctatcctgctgccactgatcattggactgatccttctgggactgctcgctctggtgttgatagccttctgtatcatcaggaggcgcccatcggcctaccaggcactctag

SEQ ID NO: 111414 - DNA, 3018 bp, Artificial Sequence
  Description of Artificial Sequence: Synthetic coding sequence
atgatgtcagatgccagcgacatgcttgcggccgcattggaacagatggacggaatcatcgctggctccaaggctttggagtactccaacggcatttttgattgccaaagcccaactagcccttttatgggtagtcttcgggctctgcacctcgtggaggacctcagaggcctgctcgagatgatggagactgatgaaaaggaggggctgcggtgccagattcccgactccaccgcagagactttggtggaatggctgcagtcccagatgaccaatggtcacctgcctggaaacggtgacgtgtaccaggagagacttgctaggttggaaaatgataaagaatcactggttctccaggtaagcgttctgacagatcaggttgaagcacagggtgaaaaaatcagggacctagagttttgcctcgaagagcacagagagaaagtgaatgcaaccgaagagatgctgcagcaagagcttctatctaggacatcactcgagactcagaagctcgaccttatggctgagatctccaatctgaaactcaaactaacagccgttgagaaagaccggctggactacgaggacaagttcagggatacggagggcctcatccaggaaataaacgatctccgcttgaaggtgagcgagatggacagtgaaaggctccagtatgaaaagaagctgaaatcaacaaaagacgaactggccagccttaaggagcagctggaagagaaagagagcgaagtcaagcggctgcaggaaaagctggtatgcaaaatgaagggtgagggggtcgagatagtcgaccgggacgagaattttaagaagaagctcaaagagaagaatatagaggttcagaagatgaaaaaggccgtagaaagcctaatggccgcaaacgaggagaaagatcggaaaattgaagatctacgccagtgcctcaataggtacaaaaaaatgcaggatactgtcgtcttagcccagggcaagaagggaaaggacggagaatacgaggaattactcaattcctcatcaataagttctctcctagacgctcagggtttctccgatcttgaaaagtccccttctccaaccccagtgatgggctccccttcttgtgacccctttaatacatccgtccccgaggagttccacacaacaatcctccaggtcagcattccatcactgctgcctgccaccgtgtccatggagacctcggagaagtctaaactgacgcccaaaccagagacctcattcgaggaaaacgatgggaacattattctgggcgctaccgtcgatacacaactatgcgataaactgctcacatcttcattacagaaatcatcttccctgggaaacctgaaaaaggagacaagcgatggtgaaaaggaaacaattcagaagacgagcgaagaccgagctccagccgagagccgtcccttcggcacgctccccccccgcccgcctggtcaggatactagtatggacgacaatcctttcggtacaaggaaggtgaggagctcctttggtcgtggctttttcaagattaagtccaacaaaagaaccgcctccgcccctaacctggatagaaaaagaagtgcctccgcccccactctcgctgagaccgaaaaggagaccgccgaacatttggatttagctggcgctagctctcgcccaaaggattctcaacgaaattctccgtttcagatcccgcctccatcaccagacagcaagaagaagtcacggggcattatgaaattgtttgggaagttaaggagaagccagtccactacctttaatccggatgacatgagtgagcctgagttcaaaaggggcgggacgcgggctacagctggaccgcgcttggggtggtccagggaccttggacagtcaaactcagacttggatatgccatttgccaagtggacaaaggaacaagtctgcaactggctcatggagcagggtctggggtcctatctgaattctgggaaacactggatcgcttctggccagacgttattgcaagctagccagcaggatttggagaaggagcttgggattaaacactcgctgcaccggaaaaagctccaactggccctgcaggctctgggaagtgaagaagagacaaaccatgggaagcttgacttcaattgggtgacgcgttggttagatgacataggcttgccacaatataagacccagttcgacgaggggagggtcgacggaaggatgttgcattatatgaccgttgacgacttactgagcctgaaagtcgtgtcagttctgcaccacctgtcaatcaaaagagctatccaggtgctcaggatcaataacttcgaaccaaattgcctaagaaggcggccttcggacgaaaacacaattgcaccttcagaagtccaaaagtggaccaaccaccgtgtgatggagtggctccgttctgtggatctcgctgagtacgcccctaacctgagaggatcaggcgtgcacggtggtctaatggtcttagaaccacgttttaatgtcgagacaatggcccagttattgaatatccctccaaacaaaacactattgagaaggcacttggctacacactttaaccttttgatcggcgctgaggctcagcaccagaagcgggatgccatggagctccccgattacgtgttgctgactgcaaccgcaaaggtcaagccaaaaaaactggcctttagtaatttcggcaatctcagaaaaaaaaaacaagaggacggtgaggagtacgtttgccctatggaactgggccaggcctccggttccgcctccaaaaaggggttcaaaccaggtctggatatgcggctttatgaagaggacgatctggatcgactggagcagatggaggactccgaagggacagtcaggcagattggcgctttcagcgagggaatcaataacctgacacacatgttaaaggaagatgatatgtttaaagatttcgccgccaggtcacctagtgcaagcattacagacgaggatagtaatgtgtag

SEQ ID NO: 111415 - DNA, 495 bp, Artificial Sequence
  Description of Artificial Sequence: Synthetic coding sequence
atgtcgagtgagaactgcttcgtagccgagaatagctcactgcacccggaaagcggacaggagaacgatgctacctcccctcacttctccactagacacgaaggctcttttcaggtgcccgtcctttgtgccgttatgaacgttgttttcataacaattttaattatcgcccttatcgcgctgtctgtggggcaatacaattgccccgggcagtacacattctctatgccgagtgattctcacgtttccagttgcagtgaggactgggtcggttatcagcgaaagtgctatttcattagtacagtcaaacgttcatggacgtcggcgcaaaatgcttgtagcgaacacggcgctacactggcagtcattgatagcgaaaaagatatgaactttctgaagagatacgccggcagggaagaacattgggttggcctaaaaaaggaacctgggcatccttggaaatggtcaaacggaaaggaatttaataattggtag

SEQ ID NO: 111416 - DNA, 723 bp, Artificial Sequence
  Description of Artificial Sequence: Synthetic coding sequence
atggccgggcctcctcggctgctcctgttacctctccttctggccctcgctagaggtttaccaggcgccctggcggcccaggaagtccagcagtcaccacattgtaccaccgttccagttggagcctctgtcaacatcacgtgcagtaccagcggtgggctacgcgggatttatctaagacagcttggacctcagccgcaagacatcatctattatgaggatggagtggtccctacaaccgatcgtaggttcagagggcggatcgatttttccggtagtcaggataacctcaccatcactatgcacaggttacaattatcagataccggtacttacacatgccaggccattacagaagtgaacgtgtacggcagtggaacactcgtgctggtcacggaagaacagtcgcagggctggcatcggtgctccgacgctcctccccgcgcctccgcattacctgccccgcctacgggctctgcactccccgacccacagactgcctccgccctgccagaccctccagccgccagcgcactccctgccgctctggccgtcatctcttttctcctggggttaggcctgggtgtggcttgcgttttagccaggacccagatcaagaagctctgtagctggagggacaagaactccgctgcttgcgtcgtctacgaggatatgagtcattcccggtgcaatacattatcatcgcctaaccagtatcagtag

SEQ ID NO: 111417 - DNA, 1080 bp, Artificial Sequence
  Description of Artificial Sequence: Synthetic coding sequence
atggctgaggcaattacatacgcggatttgcggttcgtgaaggcacctttaaagaagagcatatcctcaaggctcgggcaggaccccggggccgatgatgacggcgaaattacctatgaaaacgtacaggtccctgcagtcctaggtgtgccgtcatctctcgcgtcttctgttctgggtgacaaagcggcggttaaatcagagcagccaaccgcgtcatggcgagcagttacgagcccggctgtaggccgcatcctgccttgcagaaccacttgcctgcgctacctgctcctggggctcctgttgacatgcctgttgctgggggtgaccgctatttgtcttggcgtgcgatacctgcaggtctcccaacagctccagcagaccaacagagtattagaagtcacaaacagctcactcagacagcagctgagactgaaaatcacacaactcggccagtcagcagaagacctgcaggggagtcgcagagagttagctcaatcacaggaagccctgcaagttgagcagcgcgcccaccaagctgcggagggccagttgcaggcttgtcaggccgatagacaaaaaacgaaggaaaccttacagtctgaagagcagcaaagaagagctctggaacagaagttgtctaacatggaaaatcgtttgaagcccttttttacgtgcggctctgcagatacatgctgccccagcggatggattatgcatcaaaaatcatgcttttacattagcttgacaagcaagaactggcaggagagccaaaagcaatgtgagacactaagctccaaattagcaactttcagcgagatatacccccaatcccacagttactacttccttaatagcttgttaccgaacgggggatcgggcaatagctattggactggactgagttctaacaaagactggaaattgacggatgacacacagagaacccgaacctacgcgcagagctctaagtgcaacaaagtgcataagacgtggagctggtggacacttgagtcagagtcttgtaggtcctccctgccatatatctgtgagatgaccgcattcagatttcctgattag

SEQ ID NO: 111418 - DNA, 363 bp, Artificial Sequence
  Description of Artificial Sequence: Synthetic coding sequence
atggccgaagcaatcacttatgcggacctccgtttcgtgaaggcacctctgaagaaatctataagttctcgactgggccaggacccaggggccgatgatgatggtgagattacttatgagaatgtacaagtgcctgctgttcttggggtgccatcaagtctggcctcttctgtgttgggggataaggccgcggtgaaatccgagcagcctaccgcctcatggcgcgcagtgacatcgccggcagttggacggattctgccttgcgaatgtgcttgcgccggacaacctaggggtcaagttctggccccagtcccagctgccgatggggccggacctaggggcgtgcagctcctgccgggatag

SEQ ID NO: 111419 - DNA, 360 bp, Artificial Sequence
  Description of Artificial Sequence: Synthetic coding sequence
atggctgaagccatcacctatgctgacttacggttcgtcaaagctcctttgaaaaagagcatctctagccgattgggtcaggatccgggcgccgacgacgacggcgagataacctacgagaatgtccaggtgcccgccgtgctgggcgtgcctagttcactggcctcgagcgtgctgggggacaaggcggccgttaagtccgaacagcctaccgcaagctggagagcagtcacatcacctgccgtgggccgcattctgccctgcagaacaacgtgccttcgctacctgctcctagggctgttgctgacatgcctgctgttgggcgtgaccgctatttgtctgggcgtgcggtgcgaatag

SEQ ID NO: 111420 - DNA, 1080 bp, Artificial Sequence
  Description of Artificial Sequence: Synthetic coding sequence
atggccgaggctatcacgtacgccgacctccgcttcgtcaaggcccccctgaagaaaagtattagcagcaggctgggtcaagaccccggagctgacgatgacggggagatcacctacgagaatgttcaagtgcccgcggtgcttggcgtgccctctagcctggcttcctctgtgttgggcgataaggctgccgttaaaagcgagcagcctacggccagctggcgtgcagtgacatccccagccgtgggccgtattctcccatgcaggactacttgcctaaggtatctgcttctgggattgttactcacctgcctgcttttaggtgtcaccgcgatttgcctcggagtccgttacctacaggtttcccagcaactccagcagaccaaccgggttctcgaggtgaccaattccagtctgcgccaacagctacggctaaaaatcacacaattaggccaaagtgccgaggatctgcaaggcagcagaagagagcttgcacagtcacaggaggcactgcaggtggaacagagggcccaccaggcagccgaaggtcagttacaggcgtgtcaggccgaccgccagaaaaccaaagaaactctgcagagtgaggagcagcagcggagagcactggagcagaagctctcaaacatggagaacagactgaaaccattttttacatgtggctccgccgatacgtgctgccccagcggatggataatgcaccagaagtcctgtttctacatatcactgacttctaaaaattggcaggagagtcagaaacagtgtgaaactctgtcttcgaagcttgccacattctcagaaatctatccccagtctcattcttactactttttaaacagcctgctgcccaatggcggcagcggcaactcctattggaccgggctgtcaagcaacaaggactggaagctgacagacgacacccagcgtacacggacatacgcacagtcaagtaagtgcaataaggtgcataagacatggagttggtggactcttgaatcagagtcatgcaggagttctctcccgtatatttgcgaaatgaccgcgtttcggttccctgattag

SEQ ID NO: 111421 - DNA, 1080 bp, Artificial Sequence
  Description of Artificial Sequence: Synthetic coding sequence
atgcagacgagaaatccccagagtcatggggagaatggtgccagcccttggtcttggggagaccgcctcggccccgggccggacccaggtgctgatgatgatggggaaattacatatgagaatgttcaggttcccgcagtattgggagttccttcttccctggcatcctccgtgctgggcgacaaggctgctgtgaaaagcgagcagcccaccgctagttggcgggccgtcactagcccagctgtgggccggattttgccatgtagaacgacatgcctgaggtacctgctgcttggactcctgttgacgtgtcttctgctgggtgtgaccgctatatgcctgggagtgcgctacctgcaggtgtcccagcagctccaacagacgaatagggttctcgaagtgacaaacagctccctgcgtcagcagcttaggctcaagataacccagctgggccaaagcgcagaggacctacagggcagtcgacgggagctggctcaaagtcaggaggctctccaggttgagcaacgggcccaccaggcagcggagggccagctgcaggcttgccaggccgacaggcagaagacaaaggaaacgttgcagtccgaggagcagcagaggagagcacttgagcagaagctgtccaatatggaaaaccggctcaagccgttctttacctgtgggtcggcggacacatgctgcccgagtggctggatcatgcaccagaagagctgcttctatattagtctgacctctaagaactggcaggaatctcagaagcagtgtgaaacactatcctctaagctcgcgacattctcggagatctacccacagtcccactcgtattacttcttgaattccctcctgccaaacggcgggtctggtaactcctactggactggcctgtccagcaacaaggactggaaattaacagatgatacccagcgaacaaggacctacgctcagtcatccaaatgtaacaaagttcataaaacctggagttggtggactctggagtcggaatcttgtagatcctctctgccttatatatgcgaaatgacggccttccgtttcccagattag

SEQ ID NO: 111422 - DNA, 891 bp, Artificial Sequence
  Description of Artificial Sequence: Synthetic coding sequence
atgcacagacgacgctctagaagttgccgcgaagaccaaaaacctgtgatggatgatcagcgcgacctcatatcaaacaatgaacagctccccatgctggggaggcgcccaggggcacctgagagcaagtgttcacggggggccctgtacacaggattttcaatcttggttactctactgctggctggacaggcaactaccgcgtactttttataccagcagcagggaagattggacaagcttaccgttacgagccagaatctccaactcgaaaacctgcggatgaagctgccaaaaccccctaagccagtgtcaaagatgagaatggccacccctctcctcatgcaggcactcccaatgggcgccctgccacagggacccatgcagaatgccacgaagtacggcaacatgacagaagatcacgttatgcatctgctacagaatgccgaccccctcaaagtgtacccacctctgaaaggctctttcccagagaatctgagacatctgaagaataccatggagacaatagactggaaagtgttcgaatcttggatgcatcactggctactgttcgagatgtctcggcactcactagagcagaagcctaccgatgcacctcctaaagttctcactaaatgtcaggaagaggttagtcacattcccgcagtccaccccggcagttttagacctaagtgtgacgagaacggtaactaccttcccctccagtgctatggaagtattgggtactgctggtgcgtattcccgaacggcactgaagtgcctaatactcgttcccgagggcaccacaactgctctgagtccttggagttagaggatcccagcagtgggctgggtgttacaaagcaggaccttgggccagttcctatgtag

SEQ ID NO: 111423 - DNA, 699 bp, Artificial Sequence
  Description of Artificial Sequence: Synthetic coding sequence
atgcacagaagacggtcacgaagctgccgggaagaccagaaacctgtcatggatgaccagcgtgatctgatcagtaataacgagcagttgcccatgctcggccggaggccaggagctccagagtcaaaatgctctagaggcgctctgtataccggtttcagtattctcgtgacgttgcttttagccggtcaggccaccaccgcctattttctgtaccaacagcagggacggctggataaactcaccgtgacctctcagaacctccagttagagaatcttagaatgaagctgcctaagccaccaaagccagttagtaagatgaggatggcaacccccctactgatgcaagccctgccaatgggagctctcccgcaaggacctatgcaaaacgctaccaaatacggcaatatgaccgaggatcatgtgatgcatttgctccagaacgcagatcccctgaaggtgtaccccccactgaaagggtcattcccagagaatttacgtcacttgaagaacaccatggagacaattgactggaaagtgttcgaaagttggatgcaccactggctgctgttcgagatgtcacgccatagcttggaacaaaaacctacggacgccccacccaaagagtctcttgaactggaggacccaagcagtggactgggcgttaccaagcaagatttaggccctgtgcctatgtag

SEQ ID NO: 111424 - DNA, 483 bp, Artificial Sequence
  Description of Artificial Sequence: Synthetic coding sequence
atgcatcgaagacgttcgcggtcctgtagggaagaccaaaaacccgtgatggatgaccaaagggatctgatttctaacaatgaacagctcccaatgctgggccggaggccaggagcgcctgaatccaagtgtagcagaggtgccttgtacaccggcttctctatactagtgactttgctattggcgggccaggctaccaccgcttactttctataccagcaacagggccgactggacaagctgactgttacctcacagaatctgcagctcgaaaacctgaggatgaagttgccaaagccgccgaagcccgtcagcaagatgaggatggccacgcccctgctcatgcaggcgctgccgatgggggctctcccccagggcccaatgcagaatgcaacaaagtacggcaacatgactgaagatcatgtcatgcatctcctgcagagccactggaattggaggactagattactgggatgggtgtag

SEQ ID NO: 111425 - DNA, 951 bp, Artificial Sequence
  Description of Artificial Sequence: Synthetic coding sequence
tagagaagttgcagagaagatcaaaaaccggtgatggacgatcagcgggatcttatttccaataatgaacagctgccgatgttgggccggcggcctggggcccccgagtcgaagtgttccagaggagccctgtacactggctttagtattctcgtgacccttctcctggcgggacaggccaccacggcctacttcctctatcagcagcaaggacggctggacaagctcacggtcactagccaaaatctgcagctggagaatctgcgcatgaagttacccaagccccctaagccggtctccaaaatgcgtatggctacaccactgctgatgcaggcactccctatgggagcgttgcctcagggcccaatgcagaatgctacaaagtatggcaatatgaccgaggaccacgtgatgcacctgcttcagaacgctgatcccctcaaggtgtatcctcctctcaagggaagctttccggagaatctgagacacttgaagaacactatggagacgattgattggaaggtgtttgaatcctggatgcaccactggctactttttgaaatgtcacggcattccctggagcagaagccaaccgacgcacccccaaaggtcttgaccaagtgccaggaagaagtttctcatattccagctgtgcaccctggcagttttcgtcccaaatgtgacgaaaacggcaactatctgcctctccagtgttacggcagcattggatattgctggtgtgtgtttcctaatggaaccgaagtgcccaacacaaggagtagaggccaccataattgttccgagagtctggagttggaagatccttcctctggactcggggtgaccaaacaggatctggggccaggcaaggggctggcggaagggcacctcgttacctcctcttcctcaccagccgggcccgccccattgtgggccggcgagggcgtgtag

SEQ ID NO: 111426 - DNA, 369 bp, Artificial Sequence
  Description of Artificial Sequence: Synthetic coding sequence
atgcacaggagaaggagccgctcatgccgagaagatcaaaaacccgtgatggatgatcagcgcgatctgatctctaataacgagcagttacccatgttgggccgccggcccggggcacccgagtctaagtgttcaagaggtgctctgtatacaggatttagcatacttgtgacactgctgctcgctggccaagccacaaccgcatactttttgtaccagcaacagggccggctcgacaaattgactgtcacatcccagaatctgcagttggaaaatctgcgcatgaagttgccaaagccgcacgccgagtgccatcaggtctggcaacatgaccggggaccatgtgacgcgccagcgcctgagtgctag

SEQ ID NO: 111427 - DNA, 459 bp, Artificial Sequence
  Description of Artificial Sequence: Synthetic coding sequence
atgcatcggaggcgctctcggagctgcagggaggaccagaagccagttatggacgaccagcgggacttgatttccaataacgagcagctccctatgctcgggcgcaggcctggcgcccctgaatctaagtgctctcgaggggccctgtacaccggatttagcattctcgttaccctactgttagccggccaggccacaacggcctatttcctctaccagcaacaagggagactggataagttgacggtgacatcccagaaccttcagctcgaaaacctacggatgaaactgccaaaacccccaaagccagtgagcaaaatgagaatggctactcccttgctcatgcaggctctgcccatgggggcactcccacagggccctatgcagaacgccaccaagtatggcaacatgaccgaggaccacgtgatgcatctgttgcaggaagtggccaaatcctag

SEQ ID NO: 111428 - DNA, 690 bp, Artificial Sequence
  Description of Artificial Sequence: Synthetic coding sequence
atggcgaggctggctcttagtcctgtcccgagccattggatggttgctctgttattgctgctctctgccgagcctgtccctgccgcccgttccgaagaccggtatcgcaaccctaaggggtcggcttgctcacgaatttggcagtctcccaggtttatcgctcggaaacgcggttttacagtcaagatgcactgttacatgaacagtgcttccggcaatgtgagctggctgtggaagcaagaaatggacgaaaacccacagcagctaaaactagaaaaaggacggatggaagagtctcaaaacgagtcactcgctactctgacaatccaggggattcggtttgaagataatgggatatatttttgccagcagaaatgtaacaatacgagcgaggtatatcagggttgtggtacagagcttcgcgttatgggcttcagcacccttgcccagctcaaacaaagaaatacactcaaggatggcattattatgatacagactttgcttatcattctgttcatcattgtgccaatcttccttctgcttgataaggacgattctaaggcaggaatggaagaggaccatacttacgagggcctcgacatcgaccaaacagccacttacgaggacattgtaacgttgcgcactggagaagtcaaatggtccgtgggcgaacaccctggccaggagtag

SEQ ID NO: 111429 - DNA, 378 bp, Artificial Sequence
  Description of Artificial Sequence: Synthetic coding sequence
atggcccgacttgctcttagtccggttcctagccactggatggtggccctgctgctcctgctgtccgctgaacctgtcccggccgcaagatcggaggatcgatatcgtaaccccaaggggtttagtacgctggctcagctgaagcagagaaacaccttgaaagatggcattattatgatccagaccctgctcatcattcttttcattatcgtgcccatctttttgcttctcgataaagacgacagtaaagcaggtatggaggaagaccatacatacgagggtttggacatagatcagacagcaacctatgaagatattgtaaccctgcgaaccggggaagtgaagtggagcgtgggagagcatcccggccaggaatag

SEQ ID NO: 111430 - DNA, 693 bp, Artificial Sequence
  Description of Artificial Sequence: Synthetic coding sequence
atggcacggctcgcactgtcccctgttccatcacactggatggtcgcgttgttgctcctgctcagtgcagccgaacccgtcccagccgctagatcggaggacagataccgcaacccgaagggctcggcctgtagtagaatctggcagtctccacggtttatcgctcggaagagagggttcacggtaaaaatgcattgttatatgaactcagcttccgggaatgtgtcctggttgtggaagcaggaaatggatgaaaacccacagcaacttaagctggaaaagggtcggatggaagaatcccagaatgaaagcctagctaccttgacaatacaaggaatccgtttcgaggacaacggcatctatttttgccaacaaaagtgtaataacacatcagaagtgtaccaggggtgcgggacagaactgcgggttatgggattcagtacactggcacagttgaagcagcgcaacactctaaaagatggaatcatcatgatccagacactgctaataatcctgtttataattgtccccattttcttgctgctggataaagatgattccaaggcgggcatggaggaagatcacacctacgaaggacttgatatcgaccagaccgccacctatgaggatatcgtcacactgagaacaggagaggtcaagtggtccgttggtgaacatccaggccaagaatag

SEQ ID NO: 111431 - DNA, 711 bp, Artificial Sequence
  Description of Artificial Sequence: Synthetic coding sequence
atgggagtggagggatgcacaaagtgcatcaaatacctgctcttcgtgttcaactttgtcttctggctcgcaggtggagtgattctgggcgtggcattgtggcttcgtcacgatccacagactacaaatctgctatacttggagctgggagacaaaccggcaccaaacacattctacgtgggtatctatattctcattgccgtaggggccgtaatgatgtttgtgggcttcctcgggtgttatggagccatccaagagtcacagtgtttgctcggcacattcttcacttgcttggtgatcttgtttgcttgcgaagttgcagctggcatttggggattcgtgaataaggatcagatagctaaagacgtaaagcaattctacgaccaggccttgcagcaggccgtagtggacgatgacgcgaataacgccaaagcagtggttaagacattccacgagaccttggattgctgcggcagcagtaccttgaccgccctcacgactagcgtgctgaaaaacaacctgtgtccttcagggagtaacattatttcaaatcttttcaaggaggattgccaccagaagatcgatgacttgtttagcggcaaactgtatctgatcggtatagctgccattgtggtggcagtcataatgatattcgaaatgattctttcgatggttctgtgttgcggaatcaggaatagttcagtttattag

SEQ ID NO: 111432 - DNA, 618 bp, Artificial Sequence
  Description of Artificial Sequence: Synthetic coding sequence
atgtctcggggcttgcagcttctgcttctgagctgtgcctactctttggcgcccgccactcctgaggtaaaggtggcctgctcggaggatgtggatctgccctgcaccgcgccttgggatccccaggtgccgtatactgtgtcgtgggtgaaactgctcgaggggggggaagaaagaatggagaccccacaggaggatcatctcaggggccagcactaccatcagaagggccagaatggtagctttgacgccccaaatgagcgcccatattcattgaaaattcgtaatacaacaagctgcaattcgggaacatacagatgcacactacaggaccccgatggtcagcgcaatctatccgggaaggtgattctcagagtgactggctgtccagctcagcgaaaagaggaaacctttaagaaataccgggccgagatcgttcttttacttgccctggtgattttctatctgacccttattatcttcacctgcaaattcgcgaggctgcagtcaatttttccggatttctcaaaggctggcatggagagggccttcctcccggtgaccagccctaataaacatcttgggctagttacacctcacaagacagagctagtctag

SEQ ID NO: 111433 - DNA, 351 bp, Artificial Sequence
  Description of Artificial Sequence: Synthetic coding sequence
atggaccctcagtgcaccatgggcctctcaaatattctttttgtgatggccttcctcctctccgaactagaggacccccaaccaccacctgatcatatcccctggataacggcagtattgcccacagtgataatttgtgtgatggtattctgcctgatcctgtggaagtggaaaaaaaaaaagagaccaaggaattcttataaatgcgggacaaatacaatggaacgagaggaatcagaacaaacaaagaaaagggagaagattcacatccccgagcgttccgacgaggcgcagcgagtgttcaaatcttccaaaacctctagctgtgataagtccgacacttgtttttag

SEQ ID NO: 111434 - DNA, 990 bp, Artificial Sequence
  Description of Artificial Sequence: Synthetic coding sequence
atggacccccagtgtactatggggctcagcaacatcttgtttgtcatggcgtttctgttgtcaggagccgcacctctgaagatccaggcctactttaacgagacagccgacctcccttgccagttcgcgaatagtcagaaccagtctctgtcagaactggtggtgttctggcaagatcaggagaaccttgtcctgaatgaggtgtatctagggaaggagaaattcgatagcgtgcacagcaaatatatgggccgcacatccttcgactctgattcgtggacgcttcgcttgcataacctgcagatcaaagataaggggctgtatcagtgcatcattcaccataaaaaacccactgggatgatccgtatacatcagatgaatagtgaactatccgtactcgccaacttttcacagcccgagatagttccaattagcaatattactgagaacgtgtacattaatttaacctgctcttccattcacggctatcccgagccaaagaagatgtctgtactcctgcgcacaaagaacagcactatcgaatatgatggcgtgatgcagaaatctcaggataatgtgacagagttgtatgacgtttccatcagtctcagcgtgagtttcccagacgtcacttccaacatgactatcttttgcatccttgagacggacaaaactagacttctatcgtcaccattttctatcgagctggaagaccctcagcctcctcccgatcacattccttggataactgctgtgctccctacagtaattatctgtgtgatggtgttttgccttatactatggaagtggaagaagaaaaagcggcctaggaattcatacaagtgcgggacaaacacgatggaacgtgaggagtccgagcagactaagaaacgagaaaagattcacatacccgagcggagcgacgaggcccagcgcgtgttcaaatctagcaagacctcttcatgcgacaaaagcgatacttgtttttag

SEQ ID NO: 111435 - DNA, 972 bp, Artificial Sequence
  Description of Artificial Sequence: Synthetic coding sequence
atgggcctgtctaacatcttatttgtgatggccttcttgcttagtggcgcggctcccctgaagattcaggcttacttcaacgagacagccgacttgccctgccagttcgcaaattcccagaaccagtcactgagcgagcttgtcgtcttctggcaggatcaagagaacctggtactaaacgaggtgtatttgggtaaggagaagtttgattcagtgcacagcaagtacatgggccgcacttcttttgatagcgatagctggactttgcgtttacataacctccagatcaaagacaaagggctctatcaatgtataattcatcacaaaaaaccaacagggatgatcaggatccaccaaatgaactccgagctgtccgttttggccaacttttcgcaaccagaaatcgttcccatctccaatattacagaaaatgtatacattaacctcacttgctcctctatacacggctacccagagcctaaaaagatgagtgtgctgctgcggactaagaatagtaccattgagtatgatggggtcatgcagaaaagccaggataatgttacagaactgtatgatgtcagcatcagcttaagcgtgtcatttccggacgtgaccagtaacatgactatattttgcatcctggagaccgataagacaagactgttgtcctcacctttctccattgagctggaagatccccagcctcctcctgaccatatcccatggattacagccgtgctccccactgtcataatctgcgtcatggtcttctgtctgattttgtggaaatggaaaaaaaaaaaacgccccagaaatagttacaaatgcggtacaaataccatggagcgggaagagtccgaacagacaaaaaagagggaaaaaattcatattccggagcgttctgatgaagcccagcgggtattcaagagcagcaagacctcctcctgcgataagtccgatacctgcttctag

SEQ ID NO: 111436 - DNA, 504 bp, Artificial Sequence
  Description of Artificial Sequence: Synthetic coding sequence
atggggctgagcaatatactcttcgttatggcctttctgctaagcggcgcagctcccctgaagattcaggcctactttaatgagacagccgatctgccctgccagttcgctaattctcagaatcagagcctgtccgagctggtcgtgttctggcaggaccaggagaaccttgtcttaaatgaggtctatctaggaaaggagaagttcgactcagtacactcaaaatatatggggcggaccagctttgactctgacagctggacactgcgtttacataacctacagatcaaagacaaagggctctatcagtgtataatccatcacaaaaagccgactgggatgattaggattcaccagatgaactccgagctgtccgtcctcgccaatttcagccaacccgaaattgtgcccatttctaatatcacagagaatgtatacatcaatcttacatgttccagtatccatgggtatcccgagcccaagaagatgtccgtgcttctgtag

SEQ ID NO: 111437 - DNA, 744 bp, Artificial Sequence
  Description of Artificial Sequence: Synthetic coding sequence
atggggaggactagcttcgatagcgactcttggacattgaggctgcacaatctccaaatcaaggataaaggtctctaccagtgcattatacaccacaaaaagcccacaggaatgatcagaatccaccagatgaatagtgaactcagcgtactcgcaaatttctcgcagccagagatcgtgcctatcagcaatatcaccgaaaatgtgtatattaaccttacatgcagctccattcacggttatccagaacccaagaaaatgtccgtgctgctccgcacaaagaattctacaattgagtacgatggcgtaatgcaaaagtcccaggataatgtgacagaactgtacgacgttagcattagcctcagcgtgtccttccctgatgtgacatcaaatatgacaattttctgtatcctagagacagataaaacccgcctcttgagttctccattctctattgagcttgaggaccctcaaccacctcctgatcatatcccttggattaccgctgtcctgcccaccgtaatcatatgcgtgatggttttttgcctaattctctggaagtggaagaagaagaaacgacccaggaatagctataagtgcggcaccaacaccatggagagggaggagtctgagcagactaagaagcgggagaagattcatatacccgagagaagtgatgaagcacagagggtgtttaagtcttccaagacctcttcatgcgataaatctgatacttgcttctag

SEQ ID NO: 111438 - DNA, 654 bp, Artificial Sequence
  Description of Artificial Sequence: Synthetic coding sequence
atggacccgcagtgtaccatggggcttagtaatattctgtttgtcatggcattcctgttgagcgcaaatttcagtcagcccgagattgtcccaatatcaaacatcactgagaacgtgtatatcaatttaacatgttcttctattcacgggtatcctgaaccaaagaagatgtccgtgttgctgagaaccaaaaatagcacgatcgagtatgatggtgttatgcaaaagtcccaagataacgtcaccgagttgtatgacgtaagcatctccctgtctgtgtcatttccagacgtcaccagcaacatgaccatcttctgcattctggagacagacaaaacccggctcctttcgtcccccttctcgattgaacttgaagaccctcagcctccacccgatcatatcccgtggattacggctgtgctccccaccgtcatcatctgtgttatggtgttttgtttaatcctttggaaatggaaaaaaaagaaaaggccacggaactcatacaagtgcggcactaacacaatggagagggaggagtctgagcaaacaaagaaacgggaaaaaattcacattcccgagcgcagcgacgaggcgcagagggtttttaagtcctcaaagacaagctcttgcgataagtcagatacttgcttttag

SEQ ID NO: 111439 - DNA, 732 bp, Artificial Sequence
  Description of Artificial Sequence: Synthetic coding sequence
atgcggccgcggctttggctcctgctggctgcgcaattgaccgtgttacatggcaactcagtactacaacagacaccagcatatataaaagtccagactaacaagatggtgatgctttcatgtgaagctaaaatttccctgtctaacatgaggatctactggcttagacaaagacaggcgccctcgagcgacagccaccacgaatttttggctctttgggactctgcgaagggaacgattcacggggaagaggtggaacaagaaaagatcgctgtgttcagagatgcgtcaagatttattctgaacctcaccagtgtcaaaccagaagactccggaatctacttttgtatgatcgtggggagcccagagctcactttcgggaaaggaacccaactgtctgtggtggatttcttacctactactgcacaacccactaagaagtctactcttaaaaaacgcgtgtgccgcctgccgaggcctgaaactcagaaagggccgttgtgctctccaattaccctgggacttctcgtggcgggtgttctggtgctgctcgtgagtctcggtgtggcaattcacttatgttgccggagaaggagagcaagacttcgctttatgaaacagccacagggtgaaggcatctcaggcacctttgtaccgcaatgcctgcatgggtactactccaacacgactaccagccaaaagctgctgaacccctggatcctcaaaacttag

SEQ ID NO: 111440 - DNA, 642 bp, Artificial Sequence
  Description of Artificial Sequence: Synthetic coding sequence
atgcgacccagactgtggctactgctcgcagcacagcttactgttctgcatggtaactctgtgctgcagcagacccccgcatatattaaagtgcagactaataagatggtgatgctgtcttgcgaagcaaagatttccttgtccaacatgcgaatttactggctgaggcaaaggcaggctccaagtagcgatagccaccatgaattcctggccctgtgggactccgctaagggaacaattcatggggaggaggtagagcaggagaagattgctgtgttccgagacgcctctcggtttatcctcaatctgacctcagtgaagccagaagatagtggaatctacttctgtatgattgttggatcccccgagctgaccttcggtaaaggtacacagctgtccgtggttgacttcttgccaactaccgcgcaaccaactaaaaaatcgacgctgaaaaagcgtgtgtgtaggttgcctcggccagaaactcaaaaaggacgccgcagaagggccagactgagattcatgaagcagccccagggggagggtatcagcggcaccttcgtgcctcagtgtctgcacggatactattctaacactacaacgtcacagaagttgcttaacccttggatactgaagacttag

SEQ ID NO: 111441 - DNA, 633 bp, Artificial Sequence
  Description of Artificial Sequence: Synthetic coding sequence
atgcgccctcggctctggctcctcctggccgcccagctgaccgtactgcacggtaattccgtgctgcagcagactcctgcatacatcaaagtccagactaacaagatggtcatgctctcctgcgaagctaagatttcgctgtccaacatgaggatctactggttgcgccagagacaagccccatcgtcggactctcaccacgagttcctcgcattgtgggatagcgcaaaaggcaccatccacggtgaggaagtggaacaagaaaaaatcgccgtatttagagacgcgagtcgtttcatattaaatcttacctctgttaaaccggaagatagcgggatttacttctgcatgatcgtgggctccccggagctgacatttgggaagggcacacagttgagtgtggtggacttcctgcccactacagcccagccaacaaaaaagagtactttgaagaaaagagtgtgccgactgccaaggcctgaaactcagaagggacctctgtgctctccaattactcttggactgctcgttgctggcgtgctggtgctgctcgtctcactgggcgtggctatccatctgtgttgccggcgcaggagggcccggctaagattcatgaagcaattctacaagtag

SEQ ID NO: 111442 - DNA, 666 bp, Artificial Sequence
  Description of Artificial Sequence: Synthetic coding sequence
atgcgacccaggctgtggttgctcctggccgcacagcttactgtgcttcatggcaatagcgtcttacaacaaacacctgcttacattaaagtgcaaaccaacaaaatggtgatgctctcttgtgaagctaagatttctttatcaaacatgaggatctactggctgcggcagagacaagctccttcttctgactcacatcacgagttcctcgcactgtgggattctgccaagggaacgattcatggggaagaagttgaacaggagaagattgccgtgtttcgggacgctagccgatttatcctcaacctgacttccgtgaagccggaggatagcgggatttatttctgcatgattgtgggaagtccggaactaacattcggcaagggtactcagctgagtgttgttgacttcctgcctacgactgcccagcctacgaagaagtccactcttaaaaagcgggtttgccgactgccgaggcccgaaacccagaaggggccactgtgctcacccatcacactgggtttgttagtggccggcgtacttgtgctgctcgttagcttaggcgtggcaattcatctgtgctgtcgtcgacggagagcacggctccggttcatgaaacaactcaggctccaccctcttgaaaagtgcagcagaatggattactag

SEQ ID NO: 111443 - DNA, 597 bp, Artificial Sequence
  Description of Artificial Sequence: Synthetic coding sequence
atgcgcccccggttgtggctgttgctcgccgctcagcttacagtcctgcacggcaacagcgtgttgcagcagactcccgcttatatcaaggtacagacgaataagatggtcatgttgtcttgcgaggccaaaattagtctcagtaatatgaggatttactggctccgccagcgacaggcaccctcgagcgactcccaccacgagttcctcgctctgtgggattccgctaagggtacaatccacggggaagaggtcgaacaggagaagatagccgtttttagagatgccagccgatttatccttaacttgacttcagtaaaacctgaagacagtggcatatacttctgcatgatcgtcggcagtccagagttgactttcggaaagggcacacaactgtcagtcgtagatttcctgcctactaccgctcagccaacaaagaagtccactttgaagaaacgcgtgtgtcggctgccgcgccccgagacacagaaaggattgaagggcaaagtctatcaggaacccttgagccccaacgcatgcatggacacgaccgctatcctgcaaccccacaggagttgcctgacccacggtagttag

SEQ ID NO: 111444 - DNA, 93 bp, Artificial Sequence
  Description of Artificial Sequence: Synthetic coding sequence
atgcgccctcgactgtggctcctgttagccgctcagctgaccggcaggaggcgtcgcgcccgcttgagattcatgaaacaactatataagtag

SEQ ID NO: 111445 - DNA, 624 bp, Artificial Sequence
  Description of Artificial Sequence: Synthetic coding sequence
atgagaccaaggctgtggcttcttttagcagcgcagctaacagtgcttcacggcaattctgtgctgcagcagactcccgcctacatcaaagttcagactaacaagatggttatgttatcctgtgaagctaagatatcgttatcaaacatgcgcatctactggctccggcaaagacaggcgccaagttcagactcccaccatgaatttctggcgttgtgggactctgcaaagggaacaattcatggggaggaggttgaacaggaaaaaatcgccgtgtttcgcgatgcttcccggtttatcttaaacctgacctcggtaaagccggaagactcaggaatctacttttgcatgatcgtggggagccccgagcttaccttcggtaaaggcactcagctgagcgtggtcgatttcctgcccaccaccgcacagccaactaagaagtctactttgaaaaaacgtgtgtgcagacttccaaggccagaaactcagaagggacctctgtgtagtcctatcacactgggacttttggtggccggcgtgctggtcctgctggtgtctctcggcgtggcaatccatttgtgctgcaggcgacgacgcgcacggcttcgctttatgaagcaatag

SEQ ID NO: 111446 - DNA, 153 bp, Artificial Sequence
  Description of Artificial Sequence: Synthetic coding sequence
gagaggggtagggagcgccgggtaaaactccggttctctgctcggccccaaggggaaggaatttccggcaccttcgttcctcaatgcttgcacggctactatagtaacaccactaccagccagaagctacttaatccctggatccttaagtag

SEQ ID NO: 111447 - DNA, 687 bp, Artificial Sequence
  Description of Artificial Sequence: Synthetic coding sequence
atgcccgtgaaaggaggtaccaaatgtatcaagtatctgctgttcggttttaatttcatcttctggcttgccgggatcgccgtgctggcaatcggactgtggctgagattcgatagtcagactaagtctatttttgaacaagagaccaataataacaactcaagtttctatacgggagtgtatattctgatcggtgcaggtgccctcatgatgctggtgggcttcctaggttgctgcggagccgtacaggaatctcagtgcatgctgggactcttctttggctttctcctggtcatcttcgccatcgaaatcgctgcagctatttggggctactctcacaaagacgaggtgatcaaagaggtgcaggagttctacaaggatacttacaataagttgaaaacaaaggatgagccccagcgggagaccctgaaggccattcattatgctttaaactgttgcggtctggcagggggcgtcgagcagttcatttccgacatctgccccaaaaaagacgtgctggagacttttacagtgaagagttgcccagatgccataaaggaagtctttgacaacaaattccatatcataggagctgtcggaatcggcatcgccgtggtaatgatctttggcatgatttttagcatgattttatgttgcgcaatcagaagaaatcgggagatggtttag

SEQ ID NO: 111448 - DNA, 480 bp, Artificial Sequence
  Description of Artificial Sequence: Synthetic coding sequence
atgatgcttgtaggatttctcggatgctgtggagcagtccaagaatcccagtgcatgcttggactgtttttcggcttcctgttggtgatctttgctatagaaattgctgctgccatttgggggtactcccacaaggatgaggtcattaaagaggtgcaggaattctacaaagacacctataataagttgaagacgaaagacgagccccagcgcgagacacttaaggcaatccactatgccctcaattgctgcggactagccggcggtgtggaacaatttataagcgacatttgtcccaaaaaggatgttctcgagacattcaccgttaagtcctgtcccgatgcgatcaaggaggtctttgacaacaaatttcatataatcggagctgtaggcataggcatcgccgttgtgatgatttttggtatgatcttcagcatgattttgtgttgcgcgatcaggagaaatagagagatggtgtag

SEQ ID NO: 111449 - DNA, 687 bp, Artificial Sequence
  Description of Artificial Sequence: Synthetic coding sequence
atgcccgttaagggcggaactaagtgcattaagtacctgctcttcggcttcaactttattttttggttggccggtatagctgtgctggcaattggattgtggctgcgatttgactcacaaactaaatctatcttcgagcaggagacgaataacaataactcctctttttacacaggcgtctacattctcattggagcaggcgctctgatgatgctggtcgggtttctgggttgttgcggagccgtacaggaatctcagtgtatgttgggcttgtttttcggtttcctactggtaatttttgccatcgagattgcggctgccatttgggggtattcccataaagacgaggtgataaaagaggtacaggagttctataaggacacctacaacaagttaaagacaaaggatgaacctcaacgggagacgctgaaggctatccattacgccctgaattgctgcgggctcgctgggggcgtggaacagttcataagtgatatttgcccgaaaaaggacgtgctggaaactttcaccgtcaagagctgtccagatgctattaaggaggtgtttgacaacaagtttcacatcatcggagctgtcggaatcggtattgccgtggttatgatttttggaatgatttttagcatgattctttgttgcgctatacgacggaatagggaaatggtttag

SEQ ID NO: 111450 - DNA, 687 bp, Artificial Sequence
  Description of Artificial Sequence: Synthetic coding sequence
atgccggtaaaagggggcacaaaatgcatcaagtacctacttttcgggtttaacttcatattttggctggctggaatcgctgttcttgcaattgggttatggctgcgatttgatagccagacaaagtcaatctttgaacaggaaacaaataataataactccagtttttacaccggggtttatatcctaatcggcgccggggcactgatgatgctcgtcggctttctgggctgctgtggggctgtccaagaatcccaatgcatgctcggccttgccacaaagcggacaatgtttccaccctttctcgaagaccatgtgtgcttcttcagcctgaatccccagtttttcggtttcctcctggtcatttttgccattgagatcgcggcagcaatctgggggtatagccacaaagacgaggttattaaagaggtgcaagagttctataaggacacatacaacaagctcaagacaaaggatgagccccagagggagacattaaaagcaattcattacgctctgaactgttgcggcctcgcggggggcgtcgagcaattcattagcgacatctgccccaagaaggacgtacttgagacttttacggtcaagtcttgtccagatgccattaaggaggttttcgataacaagtttcacattatcggtgctgttggtatcgggattgctgtgtag

SEQ ID NO: 111451 - DNA, 546 bp, Artificial Sequence
  Description of Artificial Sequence: Synthetic coding sequence
atgcccgtaaaagggggcaccaagtgcattaaatacctgctgttcggtttcaactttattttttggctagcgggcatagctgtactcgctatcgggctctggctccggttcgactctcaaacaaaaagtatctttgagcaagagacaaataataataattccagtttttataccggcgtgtatatcttaatcggcgcaggggccctcatgatgctcgtcggcttcttggggtgctgtggggctgtccaagaaagtcagtgcatgctcggcctttttttcggttttctgctggtgattttcgccatcgagattgctgctgcgatctggggctacagtcataaagatgaggtgatcaaggaagttcaggaattctacaaggacacttataataaactaaaaacgaaggacgaaccacagagagaaacactgaaagccattcactatgccctaaatctgtggttcggctggggtaggggcacggtttatttgcggcatctcccacaggagggaaggaccaggaatctacatagggaggtgctgtcctag

SEQ ID NO: 111452 - DNA, 426 bp, Artificial Sequence
  Description of Artificial Sequence: Synthetic coding sequence
atgctgggcttattcttcggctttctgctagtgatctttgctattgaaattgccgctgccatatggggctattcccacaaagacgaggttattaaggaagttcaggaattctacaaggacacttacaacaagctgaagactaaagacgagcctcaaagagagacactcaaagccatccactatgcccttaactgctgcggcttggcaggtggcgtagaacagttcatcagtgacatctgtccgaagaaggacgttttggaaactttcacagtcaaaagttgccccgatgcgattaaggaggtctttgacaacaagtttcatataatcggagctgtcggcattggaattgccgtggtcatgatctttggaatgatattttctatgattctatgctgcgccattaggagaaatagagaaatggtttag

SEQ ID NO: 111453 - DNA, 1758 bp, Artificial Sequence
  Description of Artificial Sequence: Synthetic coding sequence
atggaaaagaaatggaaatactgcgccgtgtactacatcattcagattcacttcgtgaagggcgtctgggagaaaaccgtcaatactgaggaaaacgtgtacgccaccctcggctctgacgtaaatctcacttgtcaaactcagactgtcgggtttttcgtgcagatgcagtggagtaaagtgactaataaaatcgatctgattgccgtgtaccacccccagtatgggttttattgcgcctacggccgcccttgcgaatccctggtcaccttcacagagacacctgagaacggatcaaagtggaccttacacttacgcaatatgagctgctccgtgtccggaagatatgagtgcatgctcgtgttgtatcctgaaggtatacaaacaaagatctacaacctgttgatacagacccatgttactgcagatgagtggaatagtaatcatacaatagaaatagagattaaccaaaccctggaaatcccctgcttccagaactctagttcaaagatctcctctgagttcacctacgcctggagcgtggaaaatagtagcactgactcttgggtgttactttctaaaggaatcaaggaggataatggcacccaggagacactgatcagtcaaaatcatctcatcagcaacagtacgttgctcaaggacagggtaaagctggggaccgactacaggctccatcttagcccagtgcagattttcgacgatgggcggaagttctcctgccatatccgagtcggccccaataaaatactccgcagtagcactacggttaaagtcttcgccaagcccgagatccctgtcatagtcgagaataactctaccgatgtgctggtcgagaggcgctttacctgtctgctcaaaaatgtcttccccaaagcgaatataacatggttcattgatgggtcattcctgcatgacgaaaaagaaggaatctacatcactaatgaggaaaggaagggcaaggacggctttctggagttgaaaagtgtactgactagggtccactccaacaaacccgctcaatcagacaatctgactatctggtgtatggccctcagccctgtgcctggaaataaggtttggaacatatcttctgaaaaaataaccttcctgctcggcagtgaaattagcagtacagaccctcctttgagtgtcaccgagagcacgctcgatacccagccctcacccgcctctagtgtgtccccagcgaggtaccccgccactagcagtgtgaccctggtggacgtgtcagccctccgcccaaacaccactccccagccctctaatagttctatgaccacaagaggtttcaactacccttggacatcaagtgggacagacaccaaaaagtcagtgagccggattccgtccgagacatattcatcctccccttccggggctggaagcacactgcacgacaacgtgtttacaagtactgctcgcgctttttctgaggtgcctactactgctaacggcagcacaaaaacaaatcatgtccacattactggcatcgttgttaataagcctaaagatggtatgagttggccagtgattgttgccgcactgctgttctgctgtatgattctgtttgggctaggcgtccggaagtggtgtcagtatcaaaaggagatcatggaaagaccgcccccgtttaaaccccctccacctcctataaagtacacgtgtattcaggagccaaatgaatctgatctgccgtaccacgagatggaaacactgtag

SEQ ID NO: 111454 - DNA, 1710 bp, Artificial Sequence
  Description of Artificial Sequence: Synthetic coding sequence
atggaaaagaagtggaagtactgtgccgtgtactatatcattcagatccacttcgttaagggagtgtgggagaaaaccgttaacactgaagaaaacgtgtacgccactctcggtagcgacgtgaatctcacctgtcagacccagacggtcggttttttcgtgcagatgcaatggtcaaaggtcactaataagattgatttgatcgccgtgtatcatccccagtacgggttctattgcgcatatggtagaccttgcgaatcgctcgtgacctttaccgaaacccccgagaacggtagtaaatggacactccatcttagaaacatgagctgttcagtttctggcagatatgagtgcatgctagtgctgtaccccgagggcatccaaaccaagatctataatttgctgattcagacccacgtaactgcagatgagtggaacagcaatcacacaatcgagatcgagatcaatcagaccctggaaatcccctgcttccagaactcatcgagcaagatcagtagcgaattcacttacgcttggtccgtagaggacaatggaactcaggaaacgctgatttcccagaaccatctgataagtaacagtacattactgaaggaccgtgtcaagctggggacagattacaggcttcacctgagcccggtgcagatctttgacgatggtcggaaattttcgtgccacatcagggttggccctaacaagattctgaggtccagcacaacagtgaaggtatttgccaagccagaaattcccgtcatagtagagaacaattctaccgatgtgctggtggaacggcgctttacttgcctgttgaaaaacgtatttcctaaagctaatatcacctggttcatcgatggatccttcctacatgacgagaaggagggaatctacataaccaatgaggaacggaagggtaaagacggcttcttggaactgaaaagtgtactaacacgagtccatagcaacaaaccagcccagtctgacaacctgacaatttggtgcatggcactgagtccagtgccaggaaacaaggtgtggaacatttcaagcgagaagatcacatttttattaggctctgagatttcaagcaccgatccaccactgtctgtcacagagagcaccctggatacacagccatctcctgcaagcagcgttagcccagcccgctaccctgctactagctccgtgacactggtcgacgtttcagcgctgaggcccaacaccacaccacagcctagcaacagcagcatgactacgcgaggttttaattacccatggacaagctccggaacggataccaaaaagtctgtcagcaggatcccgtcagagacatacagcagttcccccagcggtgccggctctacccttcatgataacgtgtttacctccaccgcgcgagccttcagtgaagtgcctactacagctaacggaagtaccaaaactaaccacgtgcacatcacgggaatcgtggtgaataaaccaaaagatgggatgtcatggccagtgattgtggctgctttattgttttgctgtatgatcctcttcggtttgggagtccgaaagtggtgtcagtaccagaaggagatcatggaacgtccccccccctttaaacccccgcctccccccataaagtatacatgcatacaggaaccgaatgaaagtgatctgccataccacgagatggaaaccctgtag

SEQ ID NO: 111455 - DNA, 2508 bp, Artificial Sequence
  Description of Artificial Sequence: Synthetic coding sequence
atgggaggtcgggtgttcctagccttctgtgtttggctgacactgcctggcgcggaaacccaggattcaaggggctgcgctaggtggtgccctcagaatagctcatgtgttaacgctaccgcatgtagatgtaatccagggttctctagctttagtgaaatcatcacgactccgaccgaaacttgtgatgatataaacgagtgtgcgacgcctagcaaggtgagctgcggaaagtttagtgactgctggaacacggagggctcttacgattgtgtgtgcagtcctgggtacgagccagtgtccggcgctaaaacttttaaaaatgagtcagagaacacctgtcaggatgtagacgagtgccaacagaacccgcgtttatgcaaatcttacggcacatgtgttaataccctaggttcctacacatgtcagtgcctaccggggttcaaattcattcctgaggatcccaaggtatgtactgatgtgaacgagtgtacatctggtcagaatccttgccactccagtactcactgcctcaacaacgtgggttcataccagtgccgatgtaggcctggctggcaacccataccagggtcacccaacggacctaacaacaccgtgtgtgaggacgttgacgagtgtagttctggccagcaccagtgtgactcgtccaccgtttgtttcaacaccgtaggcagctattcgtgtagatgtcgtcccggttggaaaccccgccacgggattccaaataatcagaaagacacagtgtgcgaagacatgacctttagtacttggacccctccccctggcgttcactcacagactttgtcacgcttttttgacaaggtccaggatcttggccgtgactcgaagaccagcagtgctgaggttacaatccagaacgtgattaagctggtagatgagctcatggaggccccgggcgacgttgaagcccttgctccacctgtacggcatctcatagctactcagctactgagcaatctcgaggatattatgaggatacttgcaaaaagcttgcccaaggggccattcacctacatttctccatctaataccgagctgacactcatgatccaggaacgcggcgataaaaacgtcacaatggggcagtcttccgctcgcatgaaactcaattgggctgtcgctgccggggcggaggatcccggccccgccgtggccggaatcctgagcatccagaatatgacaactctgctcgccaatgcttctttaaatctccattctaagaagcaggctgagctcgaggagatttacgaaagctccataagaggagtgcaattgagacgacttagcgctgtaaattctatctttctctctcacaataataccaaggagttaaatagtcccatcctgttcgctttctctcatttagagtcttccgatggggaagccggcagggaccctccagctaaagatgttatgcctgggcctcggcaggagctcttatgtgccttttggaagtccgatagcgatagaggtggtcattgggctacagaagggtgccaggttttgggtagtaaaaacgggtccaccacatgtcaatgctcgcatctgtccagcttcgctattctgatggcgcattacgatgtggaagattggaagctgactctcattacccgtgtggggctggccctgtcgctgttctgcctgttgctatgtatcttgacgtttctcctcgtgcggccaattcagggatctaggactacgatccatctgcatttgtgcatctgtttattcgtgggaagcacaattttcctggcagggatcgaaaacgaaggcggtcaggtgggcctacgatgtcggctcgtagcaggcctccttcattactgttttctggcggccttctgctggatgtccctcgaaggattagagctctactttctcgtagttagggtcttccagggacaaggcctctccacgcgctggctgtgtctgatcggatacggagttccattactcatcgtgggtgttagcgcggcgatatactctaagggctacgggcgaccaagatattgttggctggatttcgagcaggggtttctgtggtctttcctcggccctgtgacttttatcatcctgtgcaatgcagttatcttcgtaactacagtgtggaaactaacccaaaaattctctgaaatcaatcccgatatgaagaaactaaaaaaagccagagctctgacaataactgccatcgctcagctgtttctcctaggatgcacctgggtatttgggctctttatctttgatgatcggtcactggttctgacctatgtgttcacaattctgaactgcctacagggggcttttctctaccttttacactgtctattgaacaaaaaagtacgggaggaatacaggaaatgggcgtgcctggtggctggaggctcaaaatatagcgagtttacttctactacaagtggcactggacacaaccagactcgggctctgagggcttcagagtccgggatttag

SEQ ID NO: 111456 - DNA, 2361 bp, Artificial Sequence
  Description of Artificial Sequence: Synthetic coding sequence
atggggggcagggtgtttcttgcattctgtgtgtggctgacccttcctggagctgaaactcaggacagccgaggatgtgccagatggtgtccgcagaattcctcctgcgttaacgcaactgcttgcagatgcaatcctggattctcgtctttctctgaaattataacaactccaactgaaacatgcgacgacatcaacgagtgcgcaacgccttcaaaggtgagctgcgggaagtttagtgactgctggaacacagaaggttcgtacgactgcgtgtgctcacctgggtacgagcccgtttctggggccaaaacgtttaagaacgagtccgagaacacatgtcaggacgtcgatgagtgccagcagaatccccgcctttgtaagtcttatggcacctgcgtgaatacattggggtcgtatacctgccagtgtctcccaggttttaaatttattccagaggatcccaaagtctgtaccgatgtggacgaatgttcttctggccagcatcagtgcgactcaagcacagtgtgttttaacacagttgggtcttactcctgccgatgtcggcctggatggaaaccaaggcatggcatcccaaacaaccaaaaggatacggtgtgtgaagatatgactttttctacatggacgccgcccccgggcgtgcactcccagaccctaagcaggttcttcgacaaggtacaggacttaggacgcgactcaaagacttcttctgcagaagtcaccattcagaacgttattaagttagtggatgagctgatggaggcccctggtgacgtagaagctcttgctcctcctgttcgtcatttgatcgctacccagctgctgtcaaacctggaggacattatgagaatactggctaaaagccttcccaaaggcccgtttacatacatatctcctagcaataccgagcttaccttgatgatccaggagcggggggacaagaatgtcactatgggacagtcttcagcccgtatgaagctgaattgggccgttgccgccggagcagaggatcccggacctgcagtggcaggcatccttagtatccagaatatgaccacgttattggctaatgctagtcttaacctgcattcgaaaaagcaagccgagctcgaggaaatttacgagtcgtccattagaggcgttcaactgagacgactctctgcagtgaattctatttttctcagccataacaacaccaaggagctgaattcccctatcctctttgcctttagccacttggaatccagtgatggtgaggcaggtagagaccccccagcgaaagatgtaatgccgggcccccggcaagagctgctgtgtgccttctggaagtctgattccgaccggggggggcattgggcaacagagggctgtcaggtgctagggagcaagaacggttcaactacctgtcaatgcagtcacctgagctctttcgccatcctgatggcccactacgacgtggaggactggaaactgaccctcatcactcgcgtggggcttgccctatcactcttttgtctgctgttgtgtatactgacattccttttggttcgacctattcaaggcagcagaaccaccattcatctgcatttatgtatttgtcttttcgtgggcagcactatttttctagctgggatagagaatgaaggggggcaggttgggctccgctgccggctcgtcgctggactgctccactattgttttctggctgcattttgctggatgtccctcgagggcctggagctgtacttccttgtggttagggtgtttcaaggccagggcctgagcacacgctggctttgcttgatcgggtacggcgtgcctctgctgatcgtgggagtgtctgctgccatctattccaaaggatatggaagacctaggtactgttggctcgatttcgagcaaggatttctttggtccttcttggggccggtcaccttcatcattttatgcaatgcagtcatctttgtgactacagtttggaaactaacacaaaaattttccgaaatcaaccccgacatgaaaaaacttaaaaaagctcgcgcgctgaccataacagccatcgcccagctgtttttgctaggctgcacctgggttttcggcctgtttatttttgacgataggtctctggtgctgacatacgtttttactatactcaattgcctgcagggcgcattcctgtatctgttacactgcctgctgaataaaaaagtgcgcgaagaatatcgcaaatgggcctgcttagtggcagggggatctaagtatagcgagttcaccagcaccacatcaggcactgggcacaaccagacaagagcattgagagcgagcgaaagcggcatttag

SEQ ID NO: 111457 - DNA, 2229 bp, Artificial Sequence
  Description of Artificial Sequence: Synthetic coding sequence
atgggcggtcgcgtcttccttgcattctgtgtgtggctgacactccccggtgccgagacacaggacagccgcggatgcgcacgctggtgtccccagaatagtagttgtgtcaatgccacagcctgtcgatgtaatcctggctttagcagcttctccgaaatcattacaacaccaaccgaaacttgtgatgacatcaacgaatgtgctacccccagcaaagtcagctgcggcaagttcagcgattgctggaacactgagggttcttacgactgtgtctgtagccccggatacgaacccgtgtctggtgcaaagaccttcaaaaatgaaagtgaaaatacgtgccaggacgtggatgagtgttcctccggacagcaccagtgcgatagttcgactgtttgcttcaataccgtcggaagttactcttgtcgctgtagaccaggatggaagccccgacacggcatacctaataaccagaaagacactgtatgtgaagacatgacattctctacctggacaccccctcccggtgtccattcacaaaccctgtcaagatttttcgacaaagtgcaggatctgggccgtgacagtaagaccagctctgccgaggtcaccatccagaacgttatcaagctggtggatgaattgatggaagccccaggtgacgtggaggcattggcaccccctgtgcggcatttgattgctacccagttactcagcaatctggaggacattatgcgaatcctcgccaagtctcttcccaaaggtcctttcacctacatctctccaagtaacacagagttaaccctgatgatccaggaaaggggagacaaaaacgtgaccatgggccagtctagtgccagaatgaaactcaactgggccgtcgctgccggtgccgaggatccgggaccggcagtggctggaattctcagcattcaaaacatgacaaccctcctggcaaacgctagtctcaacttgcactccaaaaagcaggcagagcttgaggaaatctatgagagctcaatccggggggtccaactgcgccggctctctgcggtgaattccatcttcctgtctcataacaacactaaagagttaaattcccccatcctcttcgccttctcccacctggaaagctccgacggagaagccggtagggaccccccagccaaggatgtgatgcctggccccagacaggaactgctctgtgctttttggaagtcggatagcgatcgcggcggccactgggccacagaagggtgccaggttctcggctccaaaaatgggagcaccacttgccaatgcagtcacctaagctcctttgccatactgatggcacattatgacgtcgaggattggaaattaacacttataacacgcgttgggctggcactgagcttgttctgtctgttgctttgtattttgacttttctgttagtgcgaccaatccagggaagccgcactaccatacatctgcatctatgcatctgtctgtttgtcgggagtacaattttccttgccgggatagagaatgaaggtgggcaagtgggactcaggtgtaggctggtggccggactattgcattattgctttttagctgccttctgctggatgtctctggagggtttggaactctacttcctggtggtgagggtctttcaggggcagggactgtccaccagatggctgtgcttgatcggttatggagttccgctgttgattgtaggagtgagcgctgctatctacagcaagggatacggccgacccaggtactgttggctcgatttcgaacagggctttctgtggtcatttttgggaccagtaacattcatcatcctttgcaatgctgttattttcgtcacaactgtgtggaaacttacacagaagttctcggagattaaccctgacatgaagaaactgaaaaaagctcgcgccctgacgataaccgcgattgcccagctttttttgcttggttgtacatgggtctttggcctgtttattttcgatgaccgcagcctggtccttacttacgtgttcaccattttgaactgcctccagggtgccttcctctacttgctccactgcctgcttaataagaaagtccgtgaagagtaccgaaagtgggcctgtcttgtagcaggtggttcaaaatacagtgagttcacctccaccacttccggtaccggccacaaccagacgcgggcactgcgagcaagtgaatcaggtatttag

SEQ ID NO: 111458 - DNA, 2358 bp, Artificial Sequence
  Description of Artificial Sequence: Synthetic coding sequence
ggcggacgtatcatgcgggcattttgcgtttggttaactctgcctggtgctgaaacccaggactcccgtggatgcgcaaggtggtgcccacagaactccagttgtgttaatgccaccgcctgcagatgtaaccctggtttttcctcattctcggaaattatcacgacacctaccgaaacttgtgacgatataaacgaatgtgcaacgccatccaaagtcagctgcggaaaattctcggattgctggaataccgagggaagctacgattgtgtgtgtagcccaggatatgaacctgtctctggtgcgaagactttcaaaaatgaaagtgaaaacacctgccaggacgtggatgaatgccagcagaatcctcgcctttgcaaaagctatggcacatgcgttaacaccctggggagctacacctgccagtgcctgccaggctttaaattcatcccagaagaccctaaggtctgcacagacgtagatgagtgcagctctgggcagcaccaatgtgactcaagcacggtttgttttaacactgtgggttcttatagctgtaggtgccgccctgggtggaaacctcgacacggcatccccaacaatcaaaaggatacagtttgcgaggatatgaccttcagcacgtggacacctccaccaggagtgcattctcagaccctcagccgattcttcgacaaggtccaggatctgggccgggatagcaaaacctccagtgctgaggttaccatccagaacgtaattaaactcgtggatgagctcatggaagctccaggcgacgtggaagccctggctccccccgtcagacacttaatcgccactcagcttctgagcaatcttgaagatattatgcgaatcctggctaagtctctccctaaaggcccctttacctatatttcccctagcaacacagagttaacgctgatgatccaggaaaggggtgataagaacgttactatggggcagtctagcgcccggatgaagctcaattgggcagtggccgccggagccgaggatcctgggcccgctgtcgccggcatcttgtccatacagaacatgaccacattgctggccaatgctagcctgaatctgcattcaaagaaacaagcggagctggaggagatttacgaatccagcattcggggcgtgcagctgcggcggctctccgccgtaaattcaatcttcctgagccacaacaacaccaaagaactgaactcaccgattctattcgcctttagccacttagaaagttcagacggggaagcagggcgtgaccctcccgccaaggacgtaatgcctggacctcggcaggagctcctgtgcgccttttggaaaagcgatagtgacagaggcgggcactgggcaaccgaggggtgccaagtccttggctcaaagaacggctctacgacatgtcaatgtagccatttatctagttttgcaatccttatggcccattacgatgtagaggactggaagctaacactgataactcgggtgggcctggctctcagtttgttttgcctcctgctgtgcatcttaaccttcttgcttgtgaggcccatccaggggtcccgaaccaccatacacctgcacctgtgtatttgtctatttgtaggatctacaattttccttgctggcattgagaatgaaggggggcaggtgggactgcggtgccgacttgtagctggactgctccactactgctttctggccgcattttgttggatgagcctggaaggcctagagctgtactttttagttgtacgtgtgtttcaggggcaaggcctgtctactcgctggttgtgtttaatcggatacggcgttcccctgctgattgtgggcgtgagtgctgctatctacagcaaagggtatggtagaccacgttattgctggctggacttcgagcaaggattcttgtggtctttcctaggccccgtgacattcataatcctgtgtaacgctgtaattttcgtgaccaccgtgtggaagctcactcagaagttctctgagatcaatcccgacatgaaaaagctgaagaaagctagagccctgacaataactgccattgctcagttgttcctcctgggctgcacctgggtctttggactgtttatctttgacgatagaagtttggtgttaacatatgtattcactatccttaattgccttcagggggcctttttgtatctattgcactgcctgctgaacaaaaaagtgagagaagaataccgcaaatgggcttgtctggttgctggaggctcgaagtattctgagttcacgagcaccaccagcggaaccggtcacaatcaaactcgtgccctgcgagcatctgagtctgggatttag

SEQ ID NO: 111459 - DNA, 297 bp, Artificial Sequence
  Description of Artificial Sequence: Synthetic coding sequence
atgtccgtcaggttgcatgtcccctccggcagccgagggtctgaactgagtgctctgattcaggctattggagcgagcacctctggaaaaccgaaatgttttgtctgcatcctaaggtccgggctgtctgttgcgctgtccctgtcagtgtacttccttctgctctttagtcggacccgcgggggcgggcatggggaaccccccgaatgccagagacgggcatcctgcagtgcatatagttttcgcgagattgaagattgcaggcagaaacaaccaaggaggtggcagcagggttag

SEQ ID NO: 111460 - DNA, 231 bp, Artificial Sequence
  Description of Artificial Sequence: Synthetic coding sequence
atggctagaggcgccgccttggcactcttactgttcgggctgctgggagtcttggttgctgcaccaggatttggcgacctgaggctgcaggctgcaaggggcggccggcccggggttgcctgccactctcatgctctgcgtcccggacccaagttcggcatagctcgatcccttagaccgggttggtggggcgaaggtaaggagaaattagagaagaatttcgaaccatag

SEQ ID NO: 111461 - DNA, 534 bp, Artificial Sequence
  Description of Artificial Sequence: Synthetic coding sequence
atggcacgcggcgccgcacttgctctcctgctgtttgggctcctaggtgttctggttgccgcccccgacggcggctttgacctgtccgatgccttgcccgataatgaaaacaagaagcccacagctatccctaaaaagccgagtgccggggacgattttgatctcggtgatgcggtagtggacggcgaaaatgatgacccacgtccacccaacccacccaagcccatgcctaacccgaacccgaaccatccatcctcgagtgggtctttctctgacgccgatctggccgatggagtgagcgggggggagggcaagggtggcagcgatggcggtgggagccaccggaaagagggcgaggaggcagacgctccgggtgtgattccaggaattgtcggggcagtcgtcgtggctgtggccggggccatcagctctttcatcgcctatcaaaaaaagaaactttgtttcaaggagaacggacaactcgccggaagcctgggaccctgtattggtataaggcgcgaggccgacggatag

SEQ ID NO: 111462 - DNA, 510 bp, Artificial Sequence
  Description of Artificial Sequence: Synthetic coding sequence
atggctcgcggggctgctttagcccttctgttatttggcctgctcggcgtcctggtcgctgcccccgatggcggcttcgatttgtctgacgctttgccgggcgacgacttcgatctgggggacgccgtcgtggatggcgagaacgatgatccacgcccacccaatcctcccaaacctatgccgaaccccaacccaaaccacccatcctcctccgggtctttctctgacgcagacttagccgacggcgtttcaggcggggaaggtaaagggggctcggacggtggcggttcacatcgtaaagagggagaagaggcagacgccccaggcgttattcctggaatcgtgggtgccgtcgtcgtggcagttgcaggtgccataagctctttcatcgcctatcagaagaaaaaactgtgcttcaaggaaaatgcagaacaaggcgaggtagacatggaatcacatcgaaacgccaatgcggagccagctgtacagagaacactacttgagaagtag

SEQ ID NO: 111463 - DNA, 558 bp, Artificial Sequence
  Description of Artificial Sequence: Synthetic coding sequence
atggccaggggggccgctttagccctgctccttttcggactgctgggggttctcgttgcagccccggacggcggatttgatttgtctgacgcattgcccgacaatgaaaataagaagccaaccgcaattcctaaaaaacccagtgcaggtgatgactttgatctcggggacgcagttgtggacggtgagaacgacgatccacgcccaccgaatcccccaaagccaatgcctaatcccaatcccaatcacccgagctcaagcggcagcttctcggacgcggatctggcagatggggtttctgggggtgaaggaaagggcggatccgacggaggtggctctcacaggaaggagggagaagaggcagacgcacctggagtgattccagggattgtgggggctgtggttgtggcagtcgccggagccatctccagtttcatcgcctaccagaaaaaaaaactctgttttaaggaaaatgccgagcagggagaagtggacatggaatctcaccggaacgccaatgcggaacctgctgtgcagcgcacgcttctcgagaaatag

SEQ ID NO: 111464 - DNA, 606 bp, Artificial Sequence
  Description of Artificial Sequence: Synthetic coding sequence
cgcaggtggggcagaccagcaggcaccccaggtgcctctagcttgccagggcggacaagatgcgcgcatggaggtcccggaccggaggaggccccgacgttctccccaacattgtttcttgaaccttttcaacgggaaaagagcgcattcgtggtgggcgttgccaattcatacatgtggggcgggctcggtagagatggcggctttgatctgagcgacgcattgcctgacaacgagaataaaaagcctacagctattccaaagaagcccagcgcaggagatgactttgatctaggagatgcagtggtggacggagaaaacgatgacccgcgcccaccaaatccgccaaaacctatgcccaaccctaaccccaatcatccctcttcatccggaagctttagtgacgccgacttagcagacggtgtgtcaggaggagagggaaagggcggtagcgacgggggagggtcacatcgcaaggaaggcgaggaagccgatgcaccgggggtgattcccgggatcgtcggtgcagtcgtcgtcgccgtggcaggcgcaatctccagcttcatagcataccagaaaaagaagttgtgctttaaggaaaattag

SEQ ID NO: 111465 - DNA, 438 bp, Artificial Sequence
  Description of Artificial Sequence: Synthetic coding sequence
atggtggcttggcggtcggccttcctggtgtgtctggctttttctttagcaaccctcgtccagcgcggatccggggatttcgatgatttcaatcttgaagatgccgttaaggagacctcttctgtgaaacccgccctggggatgtatcacaagctggacgggctcaagcagcagaacttcattctgtcccttttctggatgttagaggtattgtatcagggggtggggtgggcaacattctctctcaaggccttggggaaaaacttaagcctgacatttcccactagcggcggtagccgctgttccttggtctgcggctgcatcacacctatatctgcgtctgtggtgacatggtgctcacctttctgcgtgtccctactctccctcaccaagatgctagtgagcggctttaaggctcatttggataaccccggctag

SEQ ID NO: 111466 - DNA, 573 bp, Artificial Sequence
  Description of Artificial Sequence: Synthetic coding sequence
atggtggcctggcggtcagccttcctggtatgcctcgcattcagtctggcgactctggtgcagcggggatctggggactttgacgatttcaacctggaagacgccgttaaagaaaccagttctgtgaagcggaatgacttcgacctggcggacgcattggatgacagaaacgacagggatgacggtaggaggaaaccgatcgccggcggagggggattctccgacaaggacctggaggacattgtgggtggaggggagtataagcccgacaaggggaagggggacggtaggtacgggagtaacgatgaccctggatccggtatggtagcagagcccggtactatcgctggggtggcttctgcactcgccatggccctaattggagcagtctcaagctacattagctaccagcaaaaaaaattttgcttctctatacagcaaggcctaaacgcggactacgtgaagggcgagaatcttgaggccgtggtttgcgaggaaccacaggtgaagtattcgacccttcacacgcaaagtgcagagcctccaccaccgccagaacctgctcgtatttag

SEQ ID NO: 111467 - DNA, 789 bp, Artificial Sequence
  Description of Artificial Sequence: Synthetic coding sequence
atggtggcctggcggtctgccttcctcgtctgcctggctttcagtctcgctacgctggttcaaaggggatcaggagatttcgacgatttcaacctggaggacgctgtgaaagagaccagctcggtgaaacagccatgggaccacactacaaccacaactacgaaccgccccggcacaactcgcgcacccgccaaacccccaggatccggtcttgacctggcagacgcactcgacgaccaggatgatggccgtagaaaaccaggcatcggaggcagagagcggtggaaccatgtgaccactaccaccaagcggccagtgaccactagggcacccgcaaacaccctgggcaatgattttgatctggccgatgctctggacgatagaaacgatcgagatgatggtaggcgcaaaccaattgcaggcggggggggcttctctgataaggatttggaggatatagtagggggcggcgaatataaacccgataaagggaagggagacgggcggtatgggtccaacgacgatcccggctcagggatggttgccgagcctgggaccattgccggggtggcttcagcgctggccatggcgctgatcggcgcagtttccagctacatctcctaccagcagaagaagttctgcttctccatacagcaaggtctgaatgcggattacgtaaagggtgaaaatctggaagcggttgtgtgtgaagagccacaggtgaaatatagtacactgcatactcaatccgcagagccaccaccacctccagagcccgcaaggatatag

SEQ ID NO: 111468 - DNA, 474 bp, Artificial Sequence
  Description of Artificial Sequence: Synthetic coding sequence
gagacgtctagcgtgaagcagccctgggaccataccaccacaactactaccaacaggcccggcaccacgcgtgcccctgctaaaccacctgggagcggactggatctcgctgacgctctggatgaccaggacgacggtcgaaggaagcctggcattggtggccgggaacgctggaatcatgtcaccactactacaaagcggcccgtcaccacgcgagctcccgctaacaccttgggaaatgacttcgacttggccgatgcgctggatgataggaatgatagagatgacggtaggaggaaacccattgccggcggggggggtttctccgacaaggacctggaggacattgtgggaggcggggaatataaaccagacaagggcaagggggatggtcgctatggaagcaatgatgaccccgggagcggaggctttctcaatcctgaggctcctgtgggccacgttaaaggaaagtag

SEQ ID NO: 111469 - DNA, 570 bp, Artificial Sequence
  Description of Artificial Sequence: Synthetic coding sequence
atggtggcttggcggtcagcttttctggtgtgtctggctttctcgctggctactctggtgcagcgcgggtccggtgactttgacgatttcaacttggaggacgcggtgaaggagacctcttccgtcaaacaaccctgggatcacacaaccacgacaactactaatcggcccgggactacacgggccccagccaagcctcccggctcaggattggacttggccgacgctctcgacgaccaagacgatggccggaggaaacctggcatcggggggagaggagatgggcgttacgggtccaatgatgaccccggttccggcatggtagcagagccaggcaccatcgccggcgtagcctcggctctggccatggcccttatcggcgccgtgtcttcttacatcagctatcagcaaaagaagttctgcttctcgatccagcaaggactgaatgcagattatgtcaagggagagaatctagaagctgtcgtttgtgaggagccccaggttaagtattccaccctgcatacacagagcgctgaaccacccccccctcccgagcctgccagaatctag

SEQ ID NO: 111470 - DNA, 819 bp, Artificial Sequence
  Description of Artificial Sequence: Synthetic coding sequence
atggtcgcctggcgcagcgcgtttttagtgtgtctggcctttagcctagccacactcgtgcaacggggcagtggagacttcgatgatttcaatctggaagacgccgttaaggagacctcaagcgtgaagcagccatgggaccacaccacaactaccactacgaaccgccctggaacaacaagggctcctgcgaagccccctggtcctaccgaagggtcgggcctggacctcgccgacgctctagatgatcaagatgacggtcggcgaaagcccggtattggcgggagagagcgttggaaccatgtgaccacgaccaccaaacgtcccgtgaccacccgggcccctgccaataccttgggtaacgactttgatctggccgatgctttagatgacagaaatgacagagatgacggcaggcggaagcccatcgcagggggcggggggttctcagataaggatctcgaagatattgttgggggcggcgaatacaaacccgacaaaggcaagggcgacggacggtacggtagtaacgatgaccccggctccggcatggtggccgaaccaggtacaattgccggagtggccagtgctctagctatggcactgatcggcgctgtttctagttacatatcataccaacagaagaagttctgctttagcatacagcacgcagcggccggacaggagggactgaatgctgactacgtgaaaggagagaatctagaagcggtggtgtgcgaagagcctcaggtgaagtattcgacactacacacccaatcagctgagcctccacctccaccagagcccgccagaatctag

SEQ ID NO: 111471 - DNA, 642 bp, Artificial Sequence
  Description of Artificial Sequence: Synthetic coding sequence
atggtggcttggagatctgcctttctcgtctgtctggcctttagcctggccaccttagtgcagcgcggttcgggtgattttgatgatttcaatttggaagatgcagtgaaggagacgagcagtgttaagcagagatggaatcatgttacaaccacgactaagagacccgtgaccacacgggcccctgcgaatacgcttggcaacgacttcgatcttgccgatgccctggacgatcgaaacgaccgggacgatgggcgacggaagccgattgcaggggggggtggattttcggataaggatctggaggatattgtcgggggcggtgagtataagccagataaggggaagggagatgggcggtacgggagcaatgatgatcctggtagcggcatggtagcagaaccaggaaccatcgctggagttgcctcagctctggctatggcgctgataggtgccgtcagttcttacatctcttaccagcagaagaagttttgcttttcaattcagcaggggttgaacgccgattacgtgaaaggggagaatctggaagcagtggtgtgtgaggagccgcaggttaagtattccactttgcatacacagtcagctgagccgccccctccacccgaacctgcgagaatatag

SEQ ID NO: 111472 - DNA, 1785 bp, Artificial Sequence
  Description of Artificial Sequence: Synthetic coding sequence
atggccgcagagtccggagagcttatcggagcctgcgagttcatgaaggaccgactgtattttgctaccttaaggaataggcccaagtccaccgtgaacacacactatttttccatagatgaggagctcgtttacgagaacttttatgcggactttggtccgcttaatctggcaatggtctatagatactgctgtaagctaaacaagaagctgaaatcgtactcactctcccggaaaaaaatcgtgcattatacatgttttgaccagaggaagagagcgaacgccgccttcctgatcggcgcgtacgccgtgatctacctgaaaaagacacctgaagaggcctacagagcactactttccggaagtaacccaccttatctgccattccgggatgcatcctttggaaattgcacttacaacctcaccatcctggactgcttgcagggtatccgaaagggcttgcagcacgggttttttgactttgaaactttcgacgtcgacgaatatgaacattacgagagagtggagaacggcgatttcaattggatcgttccaggaaaatttctcgcatttagcggacctcacccaaagagtaaaatcgagaatggctacccactccacgctcccgaagcctacttcccttattttaaaaagcataacgtgaccgcagtagtgaggctaaataaaaagatatatgaggctaagcgatttactgacgcaggctttgaacattacgatctgttttttatagacgggtccaccccttctgataacatcgtcagacggttcttgaatatttgcgagaatacagagggcgccattgccgttcattgtaaagcaggacttggcagaactggcaccctcatcgcctgttacgtgatgaagcattaccgcttcactcatgcggagattatcgcgtggatcaggatttgccgccccggcagcatcattggaccccagcaacactttcttgaagaaaagcaagcaagtctatgggtgcaaggggatatatttaggtcaaaattgaagaacagacctagctctgaaggcagcattaacaagatacttagcggactggacgacatgagtataggagggaatctaagtaaaactcagaatatggagagatttggagaggacaatctggaagacgacgatgttgaaatgaagaacggaataactcagggagacaaattgcgtgcactgaaatcgcaacgtcagccgcggacgagccctagttgtgcattcaggtctgacgacactaaaggccaccctcgggcggtgagtcagccatttcgcctttcgagcagtctgcaaggatcggccgttacgttgaagaccagcaagatggctctttccccctcagccaccgccaaaagaatcaataggacaagcttgagttccggggccaccgtccgttctttttctattaactcgcgcttagctagctcactgggtaatctgaacgcagccactgatgatccggaaaacaaaaagacttcgtcaagctctaaagccggattcactgcaagccctttcaccaaccttcttaacggtagcagccagcctacaacgagaaattatcctgaactgaataataaccagtacaatcgcagctccaactcaaatggaggtaatttaaactcacccccaggtccccatagtgccaagacagaagaacacacaacaatcctgaggccttcctacaccggactttctagtagctccgcccgtttcctgtcccggtcaatcccctcattgcaaagcgaatacgtgcattattag

SEQ ID NO: 111473 - DNA, 1872 bp, Artificial Sequence
  Description of Artificial Sequence: Synthetic coding sequence
atggccgcagagtctggagagctaattggcgcttgtgagttcatgaaggaccgactgtatttcgctacgctacgtaaccgacctaaatctactgtcaatacacactatttctctatagatgaagaactggtgtacgaaaatttctatgcggactttgggccattaaatctggccatggtttataggtactgttgcaaactaaacaagaagctcaagtcctattctttatcacgaaaaaagatcgtccactatacctgctttgaccagcgtaagcgcgcaaatgcagcctttctgatcggcgcttatgccgttatatacttaaagaaaaccccagaggaggcttatcgagctctgctgagcggatctaacccgccctatctgccctttagagatgcttcgtttggtaactgcacctataatttaactattttggattgtctgcaagggatccgtaaaggactccagcacggtttctttgatttcgagaccttcgacgtggacgagtacgagcactatgaacgagttgaaaatggtgacttcaactggattgtaccaggaaaattcttagcctttagtggccctcatcctaaatcaaagatagaaaacgggtatcctctccacgccccagaggcctattttccctactttaaaaagcataacgttacagcggttgtgcgattgaataagaagatctatgaggcgaaacggtttaccgacgctgggttcgagcactacgatctgttcttcattgacggctccaccccaagtgataacatcgtgcggcgattcttgaatatttgtgagaataccgagggtgctattgcggtgcactgcaaagccggcttgggacggacaggcacgctcatagcatgttatgtcatgaaacactatcgcttcacccatgctgagatcatcgcgtggatccgaatttgtcgacctggcagcatcatagggccgcagcagcattttctcgaagagaagcaggcttcactgtgggttcagggtgatatctttcgctctaagttgaaaaaccggccgtctagtgaagggtcaatcaataagatactctctgggctggatgatatgagtatcggtgggaacctctccaagacacaaaacatggaaagattcggggaagataatttagaggatgacgacgtggaaatgaaaaacggcatcacgcagggggacaaactgcgcgctcttaagagccagaggcagcccaggacctcccccagttgtgccttccggtccgatgataccaagggccatccgcgcgctgtctcacaacccttccgattgtcctcaagcctccagggcagcgcggtgaccctgaagacctctaagatggctctctccccaagtgccactgctaaaagaattaacagaacatccctgtcctctggtgccacagtcaggtctttcagcatcaattctagacttgctagttccctgggaaatcttaatgccgccaccgacgatcctgagaataagaagacttcatctagcagcaaagcagggtttacagccagtccattcaccaatctgttaaacgggtcctctcagccaaccacgcgtaattacccagagctcaacaataatcaatataacaggagcagcaattccaatggtggaaatctgaactccccccctgggcctcattcggccaagaccgaagaacatacaactatcctgcgcccatcctataccgggctctctagtagcagcgctcgctttctgagccggtctattcccgtatcggcccaaacacctcccccaggtccacagaaccctgaatgcaacttctgcgctttgccttctcaaccccgcctccctcccaagaaatttaattccgccaaggaagccttttag

SEQ ID NO: 111474 - DNA, 1152 bp, Artificial Sequence
  Description of Artificial Sequence: Synthetic coding sequence
atggcggccgagtctggagagctgataggagcttgtgagttcatgaaggaccgtttatactttgcaacccttcgtaatagacctaaatcaaccgtgaacacacattacttttctatcgatgaagagctcgtttacgaaaacttttatgccgattttggtcccctgaacctcgcaatggtgtacagatactgctgtaagctgaacaagaaactcaagtcctacagcctatcccgaaagaagatagtccactacacctgttttgaccaacggaagcgcgctaatgccgcattcctgatcggggcatatgcggttatctacctcaagaagacgcccgaagaggcctatcgggcattgctgtccggtagcaacccgccttatttgcccttccgcgatgcgtcctttggtaactgcacttacaacctcaccattctggactgtctgcagggcattcggaaagggctgcagcatggctttttcgacttcgagactttcgatgtggacgaatacgagcactacgagagggtcgaaaacggggattttaattggattgtccctgggaagtttctggctttctctgggccacaccctaagtctaagatcgagaacgggtacccattgcacgccccagaagcatatttcccatatttcaagaagcataacgttacagcagtggtgagactgaacaagaagatttatgaggcgaaacgttttacagatgctggatttgagcactacgacctgtttttcatcgatgggagcaccccttcagacaatatcgtgcgtagattcctgaatatctgtgagaacacggagggtgcgattgctgtgcactgcaaagccgggctgggacgcaccggcaccttgatcgcgtgctacgttatgaaacactatagattcacacacgctgagatcatagcttggatccggatctgtaggccagggtccattatcggcccccagcagcattttttagaggagaagcaggcatctttgtgggttcagggcgacatatttcggtctaagttaaagaatcggccgagcagtgagggctcgattaataaaattctcagtggtctcgatgacatgtctattggcggaaatctgagcaagacccagaatatggaacggttcggggaggtcagtttcccttag

SEQ ID NO: 111475 - DNA, 576 bp, Artificial Sequence
  Description of Artificial Sequence: Synthetic coding sequence
atggctgcggaaagcggcgagcttatcggagcatgcgaatttatgaaagatagactgtactttgctaccctgagaaacagacccaaatcaaccgtgaatacacattatttcagtatagacgaggagctggtttacgagaatttctatgctgacttcggcccactcaacttggctatggtgtacaggtactgctgcaagctgaataaaaagctcaagtcttatagcctttctagaaaaaagatcgttcattacacctgcttcgaccagagaaagagagcaaatgccgcctttttgataggagcatacgcagtaatataccttaagaagacccctgaagaagcatatagggctctgttgtccggtagcaatcctccttatcttccgttccgagacgcaagctttggaaattgcacctacaacctgacgatcctggattgcctacaggggatcaggaaaggactacagcacggtttttttgattttgagacgttcgacgtggacgagtacgaacactatgaggtgatcctgtttactcccctgaaaccaacatttctgatttcaaagtctatcatgtag

SEQ ID NO: 111476 - DNA, 822 bp, Artificial Sequence
  Description of Artificial Sequence: Synthetic coding sequence
atgggcaattttctgagccgcgaaaacaaagtgcaggtgatttcggagtcagaccgactatactttgcaaccttacgcaaccgccccaagagcacagttaacacccactatttctcaatcgatgaggaactggtttacgagaatttctacgcagatttcgggccgctgaacctggccatggtgtataggtactgttgcaaattgaacaagaagctgaagtcatatagcttgtctcgtaagaagatcgtacattacacgtgttttgaccagagaaaaagagcaaatgccgcttttctcataggagcttacgccgtgatctacttaaaaaagacacccgaggaggcctaccgcgcgttgctcagcggctccaatccgccctacctgccatttcgggacgcatccttcggcaattgtacatacaacctcacaattctagattgcttgcagggtatccgcaaggggctgcagcacggctttttcgactttgaaactttcgacgtggacgaatacgagcactacgaacgagtcgagaatggagactttaactggattgtgcctggtaagttcttagcattcagcggccctcaccccaaatccaagatagaaaatggctatccccttcacgcgccagaagcctacttcccttacttcaaaaagcacaacgtgactgctgttgtgcgtttaaataagaagatttatgaagccaagcggtttactgacgctgggttcgagcactacgacctttttttcattgatgggtctaccccatctgataacatagtaaggcgctttctcaatatttgcgagaacaccgaaggctag

SEQ ID NO: 111477 - DNA, 1698 bp, Artificial Sequence
  Description of Artificial Sequence: Synthetic coding sequence
atggtctacaggtattgctgcaaactgaacaagaaactgaagtcctactcactgtctagaaaaaagatcgtccattatacatgctttgatcagcggaagagggcaaatgcagcctttctgatcggagcgtacgcggtgatatacctcaaaaaaacacccgaggaagcatatcgggctttgctatcaggcagcaatcctccgtacctgccctttagagatgccagcttcggaaattgtacctataacctgacaattctcgactgtctgcagggtattagaaagggactgcaacatggcttcttcgacttcgaaaccttcgacgtggatgaatacgagcattatgaaagggtagagaatggcgactttaactggatcgtgccgggcaaattcctcgccttcagtggcccacaccccaagagtaagattgagaatggctatccgcttcacgccccggaagcgtacttcccctattttaagaagcacaatgttacagcagtcgtcaggctaaataaaaagatttacgaggcgaagaggtttacagacgctggatttgagcattatgacctgttcttcatcgacggaagcacgccgtctgacaatatcgttagaaggtttctcaacatctgcgagaacaccgagggggccattgccgtacactgcaaggccggcctcggccggactgggactttgattgcctgctacgtgatgaagcactatagatttacacatgccgagatcatcgcgtggattaggatctgccggcctggttctatcatcggtccacaacaacactttttggaggagaaacaagcgtcgctctgggtgcagggggatatttttcgcagtaagttaaaaaatcggccctcatcagagggatccatcaacaaaatcctctccggactggacgacatgtcaatcggcggcaatttgtcgaaaacacaaaacatggagcggttcggagaggacaacctagaagatgatgacgtagaaatgaaaaatggaatcacgcaaggcgacaagctccgagccctcaagagtcagcggcagccccgcacctctccaagttgcgcatttagatcagacgacaccaaaggacaccctcgtgccgtcagccagccattccgcttatcctcctctctgcagggatcagccgtgaccctcaaaacttctaaaatggctcttagcccctcagctacagccaagaggataaatcggacgtccctttccagcggggctacagttcggtccttctcaattaactcccgccttgcaagtagtctgggaaatttgaatgctgccaccgacgatcctgaaaacaaaaagacctcgagttcttccaaggctggctttaccgcctctccatttacaaatcttctgaacgggtcatcccagcctaccaccagaaattacccagaactgaacaataaccagtacaacagatcctccaacagtaatgggggaaacttgaattccccacctggacctcatagtgccaagacagaagaacataccacgatactgcgcccaagttacacaggtttatctagctcaagcgctaggttcctctcacgctcaatcccagtctccgcacagaccccaccgcctggccctcagaatccagagtgcaacttttgtgccctgcccagtcaaccccggctaccccccaagaagttcaacagcgccaaggaggcgttctag

SEQ ID NO: 111478 - DNA, 1833 bp, Artificial Sequence
  Description of Artificial Sequence: Synthetic coding sequence
atggcggccgagtctggggagttgatcggcgcgtgtgagtttatgaaagatagactctacttcgcaacgctgcgaaaccgcccgaaaagcacagtaaacacacactatttttctatcgacgaggagctcgtgtacgagaatttctacgccgatttcggtcccctgaacctggctatggtgtaccgctattgttgcaaactgaacaaaaagttgaagtcgtactctttatcccgcaaaaagatagtgcactatacatgttttgaccagcggaagagagcaaacgccgccttcttgattggcgcttacgccgtaatctatctcaaaaaaactcccgaagaagcttatcgggctctcctgtccggttccaaccccccttacctgccgttcagggacgcgagcttcggtaattgcacttataacctcactatcctcgactgcttacagggaattagaaaaggcctccagcatgggttcttcgacttcgaaaccttcgacgtggacgagtatgagcactatgaaagggttgaaaacggtgatttcaactggatcgtcccagggaaatttctggccttcagtggcccgcatcccaaatccaaaattgagaacggatacccactgcatgcgcccgaagcctattttccatatttcaaaaaacacaatgtgacagctgttgttcgcctcaataaaaagatttacgaggccaagcggttcacagacgccggattcgagcactatgatttgttctttattgacggctcaacccccagtgataacattgtgagaagatttcttaacatttgcgagaatactgagggcgctatcgcagtgcattgcaaggcggggctcggacgtactgggacactgatcgcctgctatgtaatgaaacactaccggtttactcacgccgaaataatcgcctggattcgcatatgtcggcctggatcaatcatcggtcctcagcagcattttcttgaagagaaacaggcgagcctgtgggtgcagggcgatatttttcggtccaaactgaaaaataggccatctagtgagggttcgatcaataagattctgagtggcttagatgatatgagtatcgggggaaatctgtcaaaaacgcagaatatggagagatttggcgaggataatctggaagacgatgatgtggagatgaagaacgggatcactcagggcgacaagctgagagcactcaaatcacagcgacagccccgcaccagtccaagttgcgcttttagatcggacgacacaaaaggacatccaagagcagttagccagcccttccgattatcttccagtttgcaaggatccgccgtaaccttaaagacatctaagatggcactgagccccagcgccaccgcaaaaaggatcaatcggacctctctctctagcggagctacggtgaggagctttagcatcaatagtcgcttggcaagttctctgggcaacttgaacgcagcgaccgatgacccggaaaacaagaagacctcctcatccagcaaggctggtttcactgcgtctccctttacaaaccttttgaacggctcgagtcaacctaccacgagaaattaccccgaactgaataacaaccagtataacagaagcagcaacagcaatggaggaaacttaaattctccccccggaccgcactccgccaagactgaggaacacactacgatcctgcgcccctcctacaccggtctctcatcttcttccgctcgttttctgagtcgttccattccatgttcatgtctgcttctggtgtttaggaagccttttctcggatcccctcttctgagcctgccaatcagccacctatag

SEQ ID NO: 111479 - DNA, 1416 bp, Artificial Sequence
  Description of Artificial Sequence: Synthetic coding sequence
atgaagcgaaaatcagagcgtaggtccagttgggctgctgccccaccttgctcgagacgttgcagtagcacctctcccggcgtgaaaaaaattaggtcttccactcagcaggatcctagacgacgggacccccaggacgatgtctacctggacattacagatagactctgcttcgccatcctgtattcacgacccaaatccgcctcaaatgtgcattatttctccattgacaacgagctggaatacgagaacttctacgcagactttggacccctcaacctcgctatggtgtatagatactgctgtaaaatcaataagaaactgaaaagcattacaatgctccgcaaaaagattgtgcacttcacaggttccgatcaaaggaagcaggccaatgccgctttcctcgtcgggtgctacatggtgatctacctgggccgaactcccgaagaggcttataggatactgattttcggagagactagctacatcccctttcgcgacgccgcctacggctcctgcaatttttacataactcttcttgattgttttcacgccgtcaaaaaagctatgcagtacggattcctgaactttaattccttcaacttggatgagtatgagcattatgaaaaggccgaaaacggcgatttaaactggatcatacctgatcgatttatagctttctgcgggccccactccagagcccggctcgagagcggctaccatcagcattcacctgagacctacattcaatactttaagaaccacaatgtgaccacaattatccggttgaataagagaatgtatgatgcaaagcggtttactgacgccgggttcgaccatcatgatctgttctttgccgacgggagtaccccgacagatgcgatcgttaaagagttcttggacatttgtgagaacgctgagggcgccatcgccgtgcactgcaaagcgggcctggggagaacgggaaccctgattgcttgctatatcatgaagcattaccgaatgactgctgccgagactattgcctgggttcgcatctgtcggcctgggagtgtcataggacctcagcaacagtttctcgtgatgaagcagactaacctttggttggagggcgactacttcagacagaaactcaaagggcaagagaacggacagcaccgtgctgcctttagcaagcttctgtccggcgtagacgatatttcaatcaacggagtggagaaccaggatcagcaggaaccagagccgtattccgacgacgacgagatcaacggcgttacccaaggtgacaggctgcgtgccctaaaatcacgcaggcagtctaagacaaatgctattcccctcacggacggatggctgagccaggccgtcacatttctggatcgactgctcatttggctgggaatccataaagattag

SEQ ID NO: 111480 - DNA, 1458 bp, Artificial Sequence
  Description of Artificial Sequence: Synthetic coding sequence
atgaagagaaagtccgagagaaggagctcatgggcggccgcacccccgtgctcacgccgctgcagcagcaccagccccggagtgaaaaagattagatctagcacacagcaggacccacgtagacgagacccacaggatgatgtgtatttggatatcactgataggttatgtttcgcaattctgtattcgcggccaaaaagcgccagtaacgtgcactacttttcgattgataatgaactggagtacgagaacttttatgccgactttggccccttgaatctggcaatggtgtacaggtactgttgcaaaatcaacaagaagctaaagtcaataactatgcttcgcaaaaagattgtgcatttcactggtagcgaccagagaaaacaggcaaatgccgcctttctagtggggtgttacatggttatctacctggggcgaactcctgaggaagcgtaccggattctgatcttcggtgaaaccagctacatcccatttagggatgccgcatacggctcctgcaacttctatatcaccctgttggactgctttcacgcagtcaagaaggccatgcagtacggctttttgaactttaactccttcaatctggacgagtatgaacactatgaaaaagccgaaaacggcgaccttaactggataatacctgaccgattcattgctttctgtggaccgcatagcagggctaggctggagtctgggtatcaccagcattcaccagagacctatattcaatacttcaagaaccacaatgtcactaccataatccgactgaataagcggatgtatgacgctaaacgcttcaccgatgccgggttcgatcaccatgacctcttctttgccgacggcagcactcccacagacgcaattgtaaaagaattcttggatatatgcgaaaacgctgagggcgcaatcgcagtccattgtaaagccgggctcggcagaaccggaacactgatagcatgttacataatgaaacattacaggatgacagccgccgagaccatcgcctgggttcgaatttgtagacccggcagtgtcatcggaccacaacagcagtttctggtgatgaaacagaccaatctatggctggagggcgattactttcgacagaagctgaaaggccaggagaatggccaacacagagctgcgttcagcaagttattgtccggcgtagatgatataagcatcaatggcgttgaaaatcaagaccagcaagaacccgaaccatactccgacgatgatgagattaacggtgttactcagggcgatcgtctgcgcgccctgaaatcacggcgtcagagcaagaccaacgccatccctctaacgtgccctttggcagttctcacaagtgcactctgttccgtcgtgatttggtggattgtttgtgactatattctgccaatcctacttttttgcctggacgggtttaggacacagtag

SEQ ID NO: 111481 - DNA, 1380 bp, Artificial Sequence
  Description of Artificial Sequence: Synthetic coding sequence
atgaaacggaagtcagagcggcggtcctcatgggccgctgcacctccctgctctcgcagatgtagttccacctcgccaggcgtcaaaaagatccgaagctcaactcagcaggatcccaggagacgggacccccaggacgatgtctacctcgacattacagacagactttgcttcgctatactatatagccgaccaaaatcggcatctaacgtccattacttttctatcgacaatgaattggaatacgaaaatttttatgccgatttcggtccattaaacctggccatggtgtacagatactgctgtaagatcaataagaagcttaaatccataaccatgctcaggaagaagatagttcactttactggcagtgatcagagaaagcaggccaatgctgcattcctggtggggtgctacatggttatttatttgggcagaacccccgaagaagcttaccgtatcttaatcttcggtgagactagttatatcccctttagggacgctgcctatgggtcttgtaacttctatataacactgctcgactgtttccacgcagtgaaaaaggcgatgcagtacggcttccttaattttaattcgttcaatttggatgagtatgaacactacgagaaagctgaaaacggggacctcaattggatcattccggataggttcatcgccttctgtggcccacacagtcgtgctagactggagtctggatatcatcagcacagtccggagacttatattcagtattttaagaaccacaatgtaacaactatcatccggctgaacaaaaggatgtacgacgctaagagattcacggatgctggctttgatcatcacgatctgtttttcgcggatgggtccacaccaaccgatgccatcgtcaaggaattcctcgacatctgcgaaaatgctgagggcgccattgccgtgcactgcaaagccgggcttggccgcacgggcaccctgatcgcatgctacatcatgaaacactataggatgacagccgccgaaactattgcttgggtgagaatctgtaggcccggaagtgtgatcgggccccagcagcagttcctcgtgatgaaacagaccaatctctggctcgaaggcgactatttcagacaaaaacttaaaggccaggagaacggccagcatcgagcagccttttccaaactattgtcaggtgtcgacgacatctccatcaatggagtcgaaaaccaggaccagcaggagcctgaaccctactccgacgacgacgaaataaacggagtgacacagggcgatcggctgcgggcgttaaagagcagaagacagtcaaaaactaatgccatcccgctgaccttgtccatctcaagaaccaagaccgtgctgcggtag

SEQ ID NO: 111482 - DNA, 1497 bp, Artificial Sequence
  Description of Artificial Sequence: Synthetic coding sequence
atgaagaggaagtctgaacgccgcagttcctgggcagccgctcccccatgctcccgaaggtgctcttcgacatctccaggagtgaaaaagattcgcagttcgacccagcaagacccacggcgccgggaccctcaggacgatgtctacctcgacattacagacaggctgtgcttcgccattctttactcccgccccaagagcgcgagtaatgttcactatttctcaatagataacgagttggaatatgaaaacttttatgccgacttcggtccactgaatttggctatggtgtatcgctattgctgcaagatcaacaaaaaactgaaatcaatcacaatgcttaggaagaagattgtgcatttcaccggatcagaccagcgcaaacaggccaacgccgccttcctcgtgggctgctacatggttatctatttggggaggactcctgaagaggcctatcggattcttatatttggtgagactagttacatacctttccgcgatgcggcctacggatcttgtaacttttacattaccctgctggattgcttccatgccgtgaaaaaagcgatgcagtacgggttcctcaacttcaatagtttcaatctggatgagtatgagcactacgagaaggctgagaatggcgatcttaattggatcatccccgacaggtttatcgccttttgtggcccacactcgcgggccaggcttgagtccgggtatcatcagcatagccctgaaacttatatccagtactttaagaatcacaatgtgacgacaataatccgcctgaacaagagaatgtatgacgctaagcgatttaccgacgctgggttcgaccatcacgacctgtttttcgccgacggaagcacgcccaccgacgcgatcgtgaaagagtttctggacatctgcgagaatgccgagggggcaatcgccgtgcactgtaaggcaggccttggtaggacgggcaccctaattgcttgctacattatgaagcattatcgcatgaccgccgccgaaactattgcatgggtgaggatttgtcgccccgggtccgtgattggcccccagcagcaattcctggtgatgaagcaaactaacttgtggctcgaaggggattatttccgccagaagctgaaaggccaggaaaacggacagcatcgcgcagctttcagcaaattgctgtcaggagtggacgacatatctataaatggcgtggagaatcaggaccaacaggagcccgaaccatatagcgacgacgatgagattaatggagtcacacaaggggaccgcttgcgggccttgaagagcagacggcagagcaaaactaacgctattccactgactgtgatcttgcagtcttctgtgcagtcgtgtaagaccagcgagcctaacatctccggcagtgccgggatcacgaagcgtaccaccaggtccgcctcccgcaaatcatccgtgaagagtctgtccatttcacggaccaagaccgttctgaggtag

SEQ ID NO: 111483 - DNA, 1386 bp, Artificial Sequence
  Description of Artificial Sequence: Synthetic coding sequence
atgtctcgggaaggcgccggcgctgctttggtggccgaggttataaaggatcgactttgcttcgcgatcttatatagcaggccaaagtcggcttccaacgtgcattacttctccatcgataatgaattggagtatgaaaacttctatgcagacttcggacctctcaacctcgccatggtctacagatattgctgcaaaattaataaaaagcttaagagtattacaatgttgaggaagaagattgtgcacttcacaggatctgaccagcgtaagcaagccaacgcggccttcctggtgggttgctatatggtgatctacctgggacgaactcctgaagaagcctacaggatcctgatcttcggtgagactagctatatccccttcagagatgcagcatacggaagttgcaacttctatataactctactggattgtttccatgccgtgaagaaagcgatgcagtacggctttctgaattttaattctttcaacctggacgagtacgagcattatgagaaagcagaaaacggcgacctaaactggattatacccgacaggttcatcgctttctgcggcccccacagccgggcgcgattagagtcaggatatcaccagcactcccccgagacttatattcagtatttcaagaaccataatgtgacaactatcattagactgaataagcgaatgtatgatgctaaaagatttaccgatgccggcttcgaccaccacgacctgttcttcgctgacggttccacccctaccgacgctattgtcaaagaattcctagacatctgtgagaatgcagagggagccatcgcagtgcactgtaaggccggcttggggcggactggaaccctgatcgcttgctacataatgaagcactacaggatgaccgctgcggaaacaatcgcctgggtgagaatatgtagaccaggctcagttatcggaccccagcagcaatttctggtcatgaagcaaacaaatctgtggctcgagggtgactactttagacaaaagcttaagggtcaggagaacggtcagcatcgggccgcgttctctaagctactgagcggcgtggacgacatcagtatcaatggcgttgaaaatcaggatcagcaggagccagaaccttacagcgacgatgatgagatcaatggggtgactcagggcgatcggttaagggcccttaaatcaaggagacagtcaaagacaaatgcaattcccctcacagtgatccttcagagcagcgtccagagttgcaagacgagcgaacccaatataagtggtagtgcaggaataactaaacggacgacacgcagcgcctcacggaaaagcagcgttaagtctctatccatcagtaggacaaagactgtgcttcggtag

SEQ ID NO: 111484 - DNA, 1458 bp, Artificial Sequence
  Description of Artificial Sequence: Synthetic coding sequence
atgaaaagaaagagtgagcggcggagttcatgggctgccgctccaccttgcagtcggagatgttcgagcactagccctggcgttaaaaaaattcggagctcaactcaacaggaccctaggcgcagggatccacaagacgacgtttacctggatattactgataggctgtgttttgccatcctctatagcagaccgaaatcagccagcaatgtgcattatttttcaatcgataacgagctggagtatgagaatttttatgccgactttggcccactcaacctggcaatggtttaccgatactgttgcaagatcaacaaaaagctaaagagtattacaatgctacgcaagaagattgtgcatttcactggctctgaccagcggaaacaggctaatgccgcctttcttgtggggtgctatatggtcatttacctcggtcgcacccccgaagaggcctaccggattctaatattcggcgagacttcatatatcccgttccgtgatgcagcgtatggatcttgtaatttctatattaccctgctggattgcttccatgctgtgaagaaagctatgcaatacgggttcctcaatttcaattcattcaatttggacgagtacgagcactatgagaaggccgaaaatggggatcttaattggattatccctgatcggttcatcgcattttgcggtccacacagtcgcgcccgtctcgaatccgggtaccatcagcactcgcccgaaacgtacattcagtattttaaaaaccacaacgtcacaacaatcataaggctcaataagcgaatgtacgatgccaagagatttacagatgcaggctttgaccaccacgatctgtttttcgcagatggcagcaccccaacagacgccattgttaaggagtttttggacatttgcgagaatgcagagggagcaatcgctgttcattgcaaggccggacttgggcggacaggaacactgatcgcctgctacattatgaagcactaccgcatgactgccgcagagacaatcgcatgggttcgaatctgccgcccgggttcagttatcggaccgcagcagcagttcctggtgatgaagcagaccaacctgtggctggagggggattattttcggcagaaactgaaaggccaggagaacggccagcacagagccgctttcagcaagctgttgagcggagtggatgacatctcaatcaacggagttgagaaccaagatcagcaggagcctgaaccctactcagatgatgacgagatcaatggcgtaacccaaggtgacaggctccgcgcactaaagagccgacgccagagcaagactaatgctattcctctgacctgtcctctcgctgtactcacttccgccctgtgttcggtggtgatctggtggattgtctgtgattatattttacctattcttctattttgcctcgatggcttccgaacccagtag

SEQ ID NO: 111485 - DNA, 5346 bp, Artificial Sequence
  Description of Artificial Sequence: Synthetic coding sequence
atgtccggcgaggtgagattacgccaattagagcaatttatcttggatggccctgctcaaacaaatggtcagtgcttcagcgtggagacactgctggacatcctcatctgcctgtatgatgaatgcaataactcacccctccgcagagagaaaaatatccttgaatacctggaatgggcgaagccgtttacttcaaaagtgaaacagatgcgcctacatcgagaagatttcgagattttgaaagtgatcggacgtggcgccttcggtgaagtggccgttgtgaaacttaaaaatgcggataaagtgttcgctatgaagattcttaataaatgggagatgcttaaacgggcggaaaccgcttgttttagagaggaaagggacgtgctggttaacggggataataagtggattacaacgctgcactacgcgttccaggatgacaacaatctctacttggtcatggattactatgtgggcggggaccttttaactctcttgagcaaatttgaagataggctaccagaagacatggccagattctacttggcagagatggtgatcgccattgatagtgtgcatcagctgcattatgtgcacagagatattaaaccggataacatcttgatggatatgaatgggcatattcgcctcgccgactttggatcctgcctgaagctgatggaagacggtaccgtacagtccagcgtagccgttgggactcccgattatatcagcccggaaatcctgcaggctatggaagatggcaaaggccgatacggcccggaatgcgattggtggtccttaggcgtgtgcatgtatgagatgctatatggcgaaactccgttctatgcagagagccttgtcgaaacctacggtaaaattatgaaccacaaagagcggtttcagtttcctgcgcaagtcaccgatgttagcgagaacgcaaaggatctcatcaggagacttatctgctcgcgcgaacatagactcgggcagaatgggatagaagacttcaagaagcacccgttcttttctggtattgactgggacaatatacgaaactgcgaggcaccttacatccccgaggtatcatctcccaccgatacatccaattttgacgtggatgacgattgtctaaaaaactcagaaacaatgccaccaccgacgcacacagcattcagtggtcatcatcttccgttcgttggatttacctatacctcctcatgtgttctatcagatcgttcctgcttacgtgttacagctgggccaacaagcttggacttggatgtgaatgtgcagagaaccctggataataatcttgccacagaggcctatgagagacggataaaaagactggaacaggagaagttggaactgtccagaaaacttcaggaaagtactcaaaccgtacaggcactccaatactctactgtggatggaccactcaccgcttctaaggacctggaaatcaaaaatctcaaagaggaaattgagaaactcaggaagcaggttactgaatcatcccacctagagcagcaactggaggaagccaacgcagtcagacaggagctggatgatgcgttccggcagattaaagcatacgagaaacagatcaagacactgcagcaggagcgcgaggatcttaataaagagctggtgcaggcctctgaacgcctgaagaaccagtcaaaagagctgaaggatgctcactgtcaacgaaagctggcaatgcaggagttcatggaaatcaatgaacgcctgacagaattgcatacacagaagcagaagctcgccaggcatgtgcgggataaggaagaggaggtggacctggtcatgcagaaagtcgagagtctgcggcaagaactgagacgcactgagagggccaagaaagaactggaagttcacactgaggctctcgctgcagaggcctctaaagaccggaaactgagggagcagtcggagcattattctaaacagttggaaaacgagttggagggcctgaagcagaagcagatcagttacagcccaggagtttgttctatcgaacatcagcaggaaatcactaaactcaaaacagatttggaaaagaaaagcattttttacgaagaagagctgagcaaacgcgaaggcatacatgccaacgaaattaagaacctgaagaaggagctccacgactccgagggtcaacagcttgccctgaataaagagataatgattctgaaggataagctggagaagaccaggcgggagtcccagtctgaacgggaagaatttgaaagtgagttcaagcaacagtacgagagggagaaggtgctcctgaccgaggagaataagaagctgacctcggaactggacaagctgacaacgctgtatgagaatctcagtattcataatcagcagcttgaggaggaggtaaaagatctcgccgataaaaaagagagcgttgcacattgggaggcccagatcacggagatcatccaatgggtcagtgatgagaaggacgcccgggggtacctccaggctcttgcatctaagatgactgaggaattagaagcacttagaaactcttccctgggcacaagagccacagacatgccatggaagatgcgacgctttgctaaacttgatatgagcgcaagacttgagttacagagtgcacttgatgcagagatcagagccaaacaggctatccaggaggagctgaacaaggtgaaggctagtaacatcattaccgagtgcaaactcaaggattccgagaagaaaaatctggaactcctgtccgaaatcgagcaactgatcaaggacacagaggaacttagatcagaaaaagggattgaacaccaggactctcaacatagctttttggcatttttgaatacgccaaccgacgcccttgatcaattcgaaaccgtggacagcacgcccctgtcagtgcacaccccaacgttaaggaaaaagggctgcccgggcagtaccggctttccgcccaaacgaaaaactcatcaattctttgtgaaaagtttcaccactcctactaagtgtcaccagtgcacgagtctcatggtgggtttaattcgccagggatgtagctgtgaggtgtgtggctttagctgccatatcacatgcgtcaacaaggctccaactacgtgtcctgtaccacccgagcagactaaaggaccgcttgggatagaccctcagaagggtatcggaacagcatatgaaggacacgtaaggatcccaaagcctgccggggtgaaaaaagggtggcagcgcgcgttggccattgtgtgcgattttaaactttttctctatgatatcgctgagggaaaagctagccaaccctccgtggttattagccaggtaattgatatgagagacgaggagtttagcgtgagctctgtcctggcttccgatgtgatccatgcatcccgaaaagatatcccatgtatcttccgggttacagcgtcacagctgtcagcgagcaacaacaaatgttccatcctgatgctggcagataccgagaacgagaagaacaagtgggtgggggtcctgtccgagctgcataagatcctcaaaaaaaataagttccgcgacagatctgtgtatgtgccaaaggaggcgtacgactctaccttgcctcttatcaaaacaacacaggccgctgcgatcatagatcatgagcgaatcgccctgggaaacgaggaaggactattcgttgtgcacgtaacaaaggacgaaattattcgagtgggtgacaacaaaaagattcatcagatcgagctgattcctaacgatcagttagtggccgttattagtgggcgtaataggcacgtgagactgtttcccatgtcagccctggatggcagagaaacagatttctataagctttccgaaactaagggctgccagaccgtcacgtcaggaaaggttcggcacggcgctctgacgtgtttatgcgtcgcaatgaagagacaggtgctgtgttacgagctgttccagagcaagacgagacaccggaagttcaaggagattcaggtcccttataacgtgcaatggatggccattttctctgagcagctgtgtgttgggttccaatccgggtttttgaggtaccctttgaacggagagggcaatccttacagtatgctacactcgaatgatcatacactcagttttatcgctcaccaacccatggacgcgatatgtgccgtggaaatcagtagcaaagaatacttactctgcttcaactcaattggcatctatactgattgtcaggggcgtcgctcccggcagcaagagctcatgtggccagctaacccctcgagttgctgttataacgctccctacctatccgtttactctgaaaatgccgtcgacatctttgacgtgaactcaatggagtggatacagacactcccgctcaaaaaggtcaggcctctcaacaatgagggcagtctgaacctgctgggcctggagactattaggctaatctattttaaaaacaagatggccgaaggggacgaacttgtggtcccggaaaccagtgataacagtagaaagcaaatggttaggaacatcaataacaaacggcgctattccttccgcgtacctgaggaagagagaatgcaacagagacgggaaatgcttcgcgatccagagatgagaaacaaattaatcagtaatcctactaatttcaaccacatcgcccacatgggcccaggcgatggtatacaaatccttaaagatttaccaatgcctggcttcccctatccttctccccaccaccactccggacttatttcatctccaatcaatttcgagcatatctatcatatgacagtcaattccgcggagaagttcctgagcccagattcgattaacccagaatactctccctcactccggagcgtgcctggaaccccctctttcatgacactccgcaaccccagaccgcaggaatcgcgcactgtgttcagcggcagcgtgtcaattccttccatcactaaatctcgacccgagccaggccggtccatgagtgcatcttccggcctgtcagcacggtccagtgcccaaaacggcagtgctctgaagagggaattctctgggggttcgtacagtgcaaagagacaaccaatgccttccccaagcgaaggctctctttcctccggcggaatggatcagggaagcgatgcccccgcccgggacttcgatggggaagattccgacagtccacgccattctaccgcaagtaactcatcaaatctaagctcacccccctctcccgccagtccaaggaaaacaaagagtctcagtcttgaatctaccgatagaggatcatgggacccatag

SEQ ID NO: 111486 - DNA, 2457 bp, Artificial Sequence
  Description of Artificial Sequence: Synthetic coding sequence
atgatcctgaaggataaactggagaaaacgcgacgcgagtcccagtcagagagagaagagtttgaatctgaattcaagcagcagtacgaaagggagaaggtgttgcttacagaagaaaataagaaacttacgtcggagctcgataagctcacaacattgtatgaaaacttgagtattcataatcagcagcttgaagaggaggtgaaggatttggcagataaaaaggagtccgttgcccattgggaggcccagattacggagattatccagtgggtatccgacgaaaaagacgcccggggctacctgcaggctctcgcgagtaaaatgaccgaagaactggaggccctgcgtaattcttctctcggaacacgtgccaccgacatgccctggaaaatgcggcggtttgccaagcttgatatgtctgcaagactcgagctgcagtctgctctggacgctgaaattcgggctaaacaggccatccaggaggagctaaataaggtgaaggcctctaacattatcacagaatgcaagctgaaagactccgagaaaaaaaacttagagctgcttagcgagatcgagcaactaattaaggatacagaggaactgcgcagcgaaaaggggattgagcatcaggacagtcagcattctttcctggcctttctgaacactcctactgacgcgctggaccagtttgaggatagcttctcctcctcgtcctcttcgctaatcgactttttagatgacactgaccccgtggaaaacacttatgtgtggaatccctcagttaaattccacatccagagtcgctccacttccccttccacatcatcggaagctgagcctgttaaaactgtagattcgaccccactgtccgtacacaccccaactctccgtaagaagggttgccctggatctacgggctttccgccaaaaagaaaaactcaccagttctttgtgaaaagcttcacaaccccaacaaagtgccatcagtgcactagcctcatggtgggtctcattaggcagggttgctcctgtgaagtgtgcggattttcatgccacataacctgtgttaacaaggcacctacaacgtgtcccgtccccccggagcagaccaagggacctctgggaatcgaccctcagaaaggcatcggtaccgcatacgaaggacatgtgcggataccgaagcccgcgggagtgaaaaaaggctggcagagagcgctcgcaatcgtgtgcgattttaaactctttctgtacgatatcgcagagggtaaagcatcacaacccagcgttgtgatctcacaggtcattgatatgcgtgatgaggaattctccgtcagcagcgtcctagcctccgacgtcatacacgctagtagaaaggacatcccttgcattttcagggtcaccgcttctcaactttctgcttcgaataacaaatgttctatcttgatgctggcagacacagagaacgagaagaacaaatgggtgggggtcctgtctgagctgcacaagattcttaaaaaaaataagtttcgggaccggagtgtgtatgtgcccaaggaagcctatgattccaccctgccccttattaagacaacccaggccgccgccattatcgaccacgaacggatcgcactcggtaatgaggaggggctcttcgttgtacacgtgaccaaagacgagataatccgggtgggcgacaacaagaagatccaccagatcgagcttatacccaacgatcagctggtggctgtcattagcggacgcaatcgccacgtccggctctttccaatgtccgcccttgatggccgtgaaactgatttctataagctgtcagagaccaagggctgtcaaactgtgacgagcgggaaggtcagacacggcgccctaacctgcctgtgcgtagcgatgaaacgacaggtcttatgctatgagctcttccagtctaagacacgacacagaaaattcaaagaaatccaagtaccttacaacgtccagtggatggccatcttcagtgaacagttatgtgtcgggttccagtctggctttctcagatatcccttaaacggggagggaaacccctacagcatgctccatagcaacgaccacaccctgagctttatcgctcaccagcctatggacgctatttgtgccgtcgaaattagtagcaaggagtatctgctgtgtttcaatagcatagggatctacaccgattgccaaggccgccgatcgcgtcagcaggagcttatgtggcccgcaaacccctcctcgtgttgttacaacgcgccttacctgagcgtctactctgaaaatgcagttgatattttcgacgtgaactccatggaatggatccagaccctgcctcttaaaaaggttcgtccgctgaacaatgaaggaagtctgaatctcctggggctggagacaattagacttatctatttcaaaaacaagatggcttag

SEQ ID NO: 111487 - DNA, 5076 bp, Artificial Sequence
  Description of Artificial Sequence: Synthetic coding sequence
atgtccggagaagttagactgagacagctggagcagttcatcctggacgggccagcacaaacaaatggacagtgcttcagcgtcgagactcttctcgatatcctgatttgtctctacgatgaatgtaataatagcccactaagacgcgaaaagaatatattggaatacctggagtgggcgaagccattcacatccaaagtcaagcaaatgaggctgcaccgggaggatttcgaaatcctgaaggtaatcggacgcggagcgtttggggaggtggcggtggtgaagctgaagaatgctgataaagtgttcgctatgaaaattctgaacaagtgggagatgctcaagagggccgagactgcctgctttagggaagagagggacgtgctggtgaacggagacaacaaatggatcactacgcttcactatgcatttcaggatgacaataacttgtacctggttatggattactacgtaggcggcgatcttctcacactcctgtcaaaatttgaagacagactgcctgaggacatggctcggttctacctggccgaaatggtaatagctattgactctgttcaccagttgcactacgttcacagagacataaaacctgacaacatcctgatggatatgaatggtcacattcgacttgccgacttcggctcctgcctcaagctgatggaggacgggactgtgcagtccagtgtcgcagttggcacgccggattatatctcccctgaaatcctgcaggcgatggaggatggcaagggtagatatgggcctgaatgcgattggtggtcgctgggtgtctgtatgtatgagatgctgtacggggaaacccctttttatgctgagagtctcgtggagacttatggcaagataatgaatcataaggagagattccagtttcccgcccaggtcaccgacgtatccgagaatgccaaggatctgattcggagactcatttgctcaagggaacatcgccttggccagaatggaatagaagatttcaagaaacatccttttttcagcggtatagattgggacaatatcaggaattgcgaagccccttacatccctgaagtctcttcacccacagacacctccaacttcgacgtcgacgacgattgcctgaaaaatagcgagaccatgcccccaccgacacacactgctttttctggtcatcacctaccctttgtgggattcacttatacctcaagctgtgtcctcagcgataggtcctgcttgcgcgtgaccgcaggccccacgagtctggacctcgacgttaacgttcagaggaccttggacaataacttggctacagaggcgtatgaacgccgcatcaagcgcctggagcaggaaaaacttgaactgtcccgcaagctgcaggaatctacacagacggtccaggccctgcagtactcgaccgtggatggccccctgaccgcgtcaaaagatctggaaatcaaaaaccttaaggaggagatagaaaaactgcgtaaacaggtgactgaatctagccatttagagcagcagctggaagaggcgaacgccgtgcgccaggaacttgatgatgcattcaggcagatcaaggcatacgaaaagcagatcaagacgttacagcaggagcgtgaggatttgaataaggaactcgtgcaggcttccgagaggctaaagaaccagtccaaggagttaaaggatgctcattgccaacggaaacttgctatgcaggaatttatggaaattaatgaaagactgaccgagttacacacgcagaagcagaaattggcacggcatgtgcgggataaagaggaggaagtggatctggtgatgcagaaagttgagtcattacgacaagaactcagaagaaccgagagagcaaagaaagagctggaagtacacactgaagctctcgcggccgaagccagtaaagatcggaaactccgcgagcagtcagagcactactccaaacagctggaaaacgagctcgaaggcctaaaacagaaacagatcagctactctcccggcgtgtgcagcatcgaacatcagcaggaaattaccaaacttaagactgacctcgagaagaaaagtatcttttatgaagaagagctaagtaagcgcgaggggattcatgcgaacgaaattaagaatctgaagaaagagttgcatgacagtgagggccagcagctggctctgaacaaggaaatcatgattttgaaggataagttagaaaaaacccgtcgagagtctcagtctgagcgagaggagtttgagtctgaattcaagcagcagtatgaacgagaaaaggtgctactcaccgaggagaacaagaaattaacttctgaattggataagctcacaaccctgtatgaaaacctctccatccacaaccagcagctcgaggaagaggtcaaagacctggccgacaaaaaggagagcgtggcccattgggaggcccagatcacggaaatcatccagtgggtctccgatgagaaggatgcccgtggctacttacaggcattggcgtctaaaatgactgaagaactggaggccctgcggaattcttctctgggcactagagccactgacatgccgtggaaaatgcggcgctttgcgaaactggacatgtccgcacgccttgagctacagtcggctctagatgccgagattcgtgccaagcaggctatccaggaggaactgaataaagtgaaggctagcaatattataaccgagtgcaaactgaaggacagcgaaaaaaaaaatttagagctgctgagcgaaatagagcaacttattaaagataccgaagagctgcgcagcgaaaaaggcatcgaacatcaggatagtcaacactcctttctggcctttctcaacacacccactgatgcactggatcagtttgagcgcaaaacacatcaattttttgtaaagtcttttacaacgcctaccaagtgtcaccagtgcacttcattgatggtgggactaattcgtcagggctgttcgtgtgaggtctgcggtttcagttgccacatcacatgcgtgaataaagcccccaccacgtgcccagttcctccagagcaaactaagggcccactcgggattgatcctcagaaaggtatcggtaccgcctacgagggccatgtcagaatccccaagcctgcgggggtgaaaaaaggttggcaacgggccctggccatcgtatgcgactttaaactgtttctatacgacattgctgaggggaaggcttctcaaccttctgtggtgatatctcaggtgattgacatgcgtgacgaggagttttctgtgtcctcagtcttggcaagtgacgtgatccatgcgagccgtaaggatatcccctgcatttttcgggtcacagcctcccagttgagcgcctccaacaataagtgttccatactgatgttagccgataccgagaatgagaagaacaagtgggtcggcgttttatccgaacttcataagatactgaaaaaaaacaaatttcgtgataggtccgtgtacgttccaaaagaggcttacgactccaccttgccattgatcaagactacccaggccgccgccatcatcgaccacgagcggatcgccctgggcaacgaggaaggcctcttcgtggtgcatgtgacaaaagacgagatcatcagggtgggggacaataagaagattcaccagattgaactgattcccaacgaccagttggttgccgtaattagtggaagaaaccgccacgtccgtctgttcccgatgtcggctcttgacggtagggagacggacttttataaattatccgaaacaaaagggtgtcagactgtgacaagcggcaaagttagacacggagccctgacatgtctgtgtgtcgctatgaaaagacaggtgttgtgttacgaactattccaatcaaagacgcgccaccggaagtttaaggagatccaggttccctacaacgtacagtggatggctattttttccgagcaactgtgtgtcgggttccagtcaggttttttgaggtatccacttaacggcgaagggaacccttattcaatgctgcattcgaacgatcatacgttgtctttcatcgcacaccagcctatggatgctatctgcgctgtggaaattagcagtaaggagtacctcctctgctttaactccattggtatctataccgattgtcaaggcaggcgcagccgccagcaggagttgatgtggcccgcaaatccaagcagctgttgttacaatgcaccttacctcagcgtttacagcgaaaatgctgttgatatatttgacgtgaactcaatggagtggatccagacactacctctcaagaaggtgagaccgcttaataacgagggttccctaaacttgctagggctcgagactattcggctgatatacttcaaaaacaaaatggccgagggtgacgaactagtcgtgcccgagacctccgataattcccgaaagcagatggtccggaatatcaataataaaaggagatactcctttagagtccctgaggaggagcgcatgcagcagagaagggaaatgctgcgcgacccagaaatgcggaacaaactgatttctaatcctacgaacttcaatcacattgcacacatggggcccggggacggcatacagatcttgaaagatctgcctatgaacccgaggcctcaggaaagtaggacagtgttttctggatccgttagcattcccagcattacgaagagcaggcctgagcctggcaggagtatgtcagcttcgtcaggcctgtcagctagaagtagtgctcagaatggcagtgccttgaagcgggaattcagtgggggctcctactcggccaagaggcaacctatgccgtcccccagtgaagggagcttgagttcaggcggcatggatcaaggctcagacgcgcccgccagggacttcgacggcgaggatagtgattctccgcggcacagtacagcgagcaactctagtaacctttcctcccccccctcaccagcaagcccgcggaagactaagtctcttagcctcgagagcacagatcgggggagctgggacccatag

SEQ ID NO: 111488 - DNA, 5199 bp, Artificial Sequence
  Description of Artificial Sequence: Synthetic coding sequence
atgagcggagaagtgaggcttagacagctcgagcagtttatcctggatggacccgcacagacgaatggtcaatgctttagtgtcgaaacactgctggacatcctaatctgtctgtacgatgagtgtaacaactctccactgagaagggagaagaacattttggagtacctggagtgggccaaaccctttacttcaaaggtgaaacagatgcggctgcacagagaagattttgaaatcctgaaggtgattgggcgcggcgctttcggcgaagtggctgtcgttaagctgaagaatgccgacaaagtgttcgcaatgaagatccttaataagtgggagatgcttaagagagccgagacagcttgcttcagagaggaacgcgatgttctcgttaacggtgacaacaagtggataacaactttgcactacgcctttcaagatgacaacaacttgtatttagtaatggattactacgttggaggggatctgttgacattgctgtccaagtttgaggatcggttgccggaggacatggcaaggttctacctcgccgaaatggtgattgccatagattcagtacaccagctccactatgtgcatagagacattaagcccgacaacatcctgatggacatgaatgggcacatccggttagccgatttcggctcttgtctgaagctaatggaagacggaactgtgcagtctagcgttgcagtggggaccccagattatatttctcctgaaatccttcaggctatggaggacgggaaaggacggtatggcccagagtgcgattggtggtccctgggggtctgcatgtacgagatgctgtacggggagacaccgttttatgccgaaagcctggtcgagacgtatggcaaaatcatgaaccacaaagagagattccagttcccagctcaggttacggatgtcagcgaaaatgcgaaagacctaattaggagactgatatgcagccgagagcatagactgggccagaacggaatcgaggactttaaaaaacacccgtttttttcgggaatcgactgggataacatccgaaactgcgaggcgccatacattcctgaagtaagcagccccacagacacatccaactttgatgtcgacgatgattgccttaagaactccgaaaccatgccacctcctacacatactgcatttagtggacatcatctgccctttgttggatttacctatacaagctcatgtgtactgtcggatcgatcatgtttaagagtgaccgcaggacccacaagtctggacctcgatgtaaacgtccagcgcacgttggataacaacctggccaccgaggcttacgaaaggcggatcaagcggcttgagcaggaaaagctcgagctgtccaggaagcttcaggaatccactcaaacagtgcaggctttgcagtattcgactgtcgatggtccccttaccgcctctaaggacttggagattaagaatctcaaagaggagatcgagaaactgagaaaacaggtcacagagtcaagccacctggaacagcaactggaggaggctaacgctgttcgacaggagctcgacgacgcatttcggcaaatcaaggcttatgaaaagcagatcaagacactccagcaggaacgcgaggatctcaataaggaactggtgcaggcaagcgagcgccttaagaatcagagcaaggagctaaaagacgcgcactgtcagcgcaaactcgctatgcaggaattcatggagattaatgagcgcctcaccgagctgcacacgcagaaacagaaacttgcccggcatgtccgggacaaagaggaggaggtcgatcttgtgatgcaaaaggttgagagcctcagacaggaactgagaaggaccgaaagggcgaaaaaggagctcgaagtacataccgaggccctcgccgccgaggcctccaaggatagaaagttgcgagaacagtctgaacattactcaaaacaactagagaatgaattggaagggctgaaacaaaagcagatctcctactcccccggagtatgctctatagaacatcaacaggaaatcaccaagctaaagactgacctggagaaaaagtccattttctatgaggaggagctgtcgaaacgagagggaattcacgcaaatgagatcaaaaatttaaagaaagagctccacgactccgagggccagcaactggctctgaacaaggagatcatgatcctgaaagacaaactggagaaaaccagaagagaatcccaatccgaacgtgaggagttcgagtccgaatttaaacaacagtatgagcgggagaaggttctcttgacagaagagaacaagaaactgacttctgaactcgacaaacttaccactctttacgagaatctcagtatccacaatcagcagctagaagaagaggtcaaagatttagccgacaagaaggaatccgtagctcactgggaggctcagattaccgagattattcagtgggtctcagatgaaaaagatgccaggggctacctgcaagcactggcctccaaaatgacagaagaattagaggcactccggaattcaagtctgggcactcgtgcaacagatatgccttggaaaatgagaagattcgccaagctggatatgtccgcccggctcgagctgcaaagtgctttagatgcagagataagagccaagcaggctatccaggaagaacttaataaggtaaaggctagcaacatcatcaccgagtgcaaactaaaagacagtgagaaaaagaaccttgagcttctctccgaaatagagcaactcattaaagatacagaagagttacgaagcgaaaaaggaattgagcaccaggattcccagcattccttcctggcattcctgaacacaccaacagacgccctagaccagtttgagcgttcaccatcgtgtaccccagcgagtaaaggtaggagaaccgtggactcgacccccctgagtgtgcatactcctaccctgcgtaaaaaggggtgccccggtagcacaggctttcctcctaagaggaaaacccaccaattctttgtgaaaagtttcactacacctaccaaatgccatcaatgcacaagcttgatggtgggactgatcaggcagggttgcagttgcgaagtgtgcggattcagctgccacatcacctgtgtcaacaaagcccctaccacttgtcccgtgccacccgagcagaccaagggccccttaggcattgatccccagaaagggatcggtactgcttacgaagggcatgttcgcatcccgaagcctgctggggtgaagaagggatggcaacgagccttagctatcgtttgcgactttaaactctttttgtacgatattgctgaaggaaaagcaagtcaacccagcgtggttatctcccaagtcattgatatgagggacgaggaattctcagtgtcctctgttttagccagtgacgttatccatgctagtcggaaggacatcccttgcatcttccgcgtgaccgcctcacagctgagcgcctcaaataataagtgttccatcctgatgctggccgacaccgaaaatgagaaaaacaagtgggtgggtgtgttatccgagctgcacaagatccttaagaaaaacaaatttcgcgaccgttctgtctatgtgcctaaagaggcatatgacagtaccctaccactgataaagacgacgcaggccgcagccattatcgaccacgagcggattgcccttgggaacgaggaaggcctgttcgttgtacacgtgacaaaggacgagatcattagggttggagataataagaagattcaccaaattgagttaatccccaacgaccagctggttgctgtgatttcggggcgtaaccgacacgtgagattgtttccaatgtcagccctggacgggagagaaacagacttttataaactgagcgagaccaaggggtgccagaccgtcacctccggtaaggtgagacatggtgcactcacctgcctttgcgttgcgatgaaacggcaagtcctgtgttatgagctgttccagagtaagacaaggcaccgtaagtttaaggagattcaagtgccctataacgtacagtggatggccatcttttctgagcaactgtgtgtgggtttccaatctggcttcttacgttacccactaaatggcgaagggaacccttattctatgttacactcaaacgatcacacattgagcttcatagcccatcagccgatggacgccatctgtgcagttgagatatctagcaaggagtatctgctctgcttcaatagcatcggcatctacacagattgtcaggggcgcaggtccaggcaacaggagctgatgtggccagcaaatccctcttcttgttgctataacgccccgtatctcagcgtttattccgagaacgctgttgatatttttgacgttaacagcatggaatggattcagaccttgccgctgaagaaagtgcggccacttaataacgaaggctccttaaacctactaggccttgagaccattcgcctcatctacttcaaaaataagatggcagagggggacgagttagtggtgccggaaacgagtgacaactctagaaagcagatggtccggaatattaacaacaaacgccgatactcattccgagtgccagaggaagaacgaatgcagcagagaagggagatgttacgggatccagagatgagaaacaaactgatatccaatccgactaatttcaaccatatcgcgcatatggggcccggcgatggcattcagatactgaaagacttaccaatgaatccacgccctcaggaatcccggaccgtgtttagcgggagtgtgtcaataccatctatcacaaagtcaaggcctgagccggggagatcaatgtcagccagttctggactcagtgcacggtcctcagcccagaacggcagcgccctgaaacgcgagttcagtggtggtagttacagcgccaagcggcagccgatgcccagtcccagcgaaggatccctgtcttccggagggatggaccaggggagcgatgctcctgcaagggactttgatggagaagatagcgactcgccccgccacagcactgcttctaattcatccaatctcagctctcctccctccccagctagcccacggaaaactaagtccttgtctctcgagtctaccgaccgagggagctgggatccctag

SEQ ID NO: 111489 - DNA, 5265 bp, Artificial Sequence
  Description of Artificial Sequence: Synthetic coding sequence
atgagtggcgaagtgagactccgtcagctcgagcaattcattctggatggcccagctcagaccaatggccagtgtttctccgtggagaccctcctcgacatacttatctgtctctacgatgagtgcaataactcacctctgcggcgtgaaaagaacatcctggagtacctggaatgggctaagcccttcaccagtaaagttaaacagatgaggcttcatagggaagactttgaaatcctgaaagttattggtagaggggccttcggagaagtggccgtggtcaaactcaaaaacgccgacaaggtgtttgccatgaagattcttaataagtgggagatgctaaagcgtgctgagaccgcttgtttcagggaggagcgggacgtgctcgtaaacggggacaataaatggataacgactttgcactatgcttttcaggacgacaacaatctctacctcgtcatggactactacgtggggggtgatcttctgaccctgctgtctaagttcgaggatcgattacccgaagatatggcccgcttctacttggctgagatggtgatcgcaatagacagtgttcatcaactccattacgtgcatcgcgatattaagccagacaatattttgatggacatgaacggccatatcagactggctgatttcgggtcatgtttgaaacttatggaggatgggacagttcagagtagcgtcgcagttggcactccggactacatttctcccgagatactgcaggcaatggaagatggtaagggccgctacggcccggaatgtgattggtggagtctcggcgtgtgtatgtacgaaatgctctacggggagacccctttctacgccgagagcctcgtggaaacctacgggaagataatgaaccacaaagaaagatttcagttcccggctcaggtgacagatgtctcagagaacgctaaagacctgatcagacgactgatttgtagtcgagagcacaggctggggcaaaatggcattgaggacttcaaaaaacatcccttcttttcgggtatcgactgggataatataaggaactgcgaagcaccttatatccccgaggtttcgagtccaacagacactagcaattttgacgtcgatgacgattgcctcaaaaattccgaaaccatgcccccaccaactcacacagccttctctgggcaccaccttccctttgtgggatttacctacacctccagctgtgtgttgagcgatcggtcatgcttgcgcgtcaccgccggccccaccagtctggacctggatgtgaatgtgcagaggacattagataataatctggctaccgaggcttatgagcggcggatcaaaagacttgagcaggaaaagctggaactcagtaggaagttgcaagagtccacacagactgtacaggctctgcagtatagcactgtagacggacccctcaccgcatccaaggatctcgaaatcaagaacctcaaggaagaaatcgaaaaactccgtaagcaggtaacggagagttctcatctagagcaacaactggaggaagctaatgctgttcggcaggaactcgatgacgcattccggcaaattaaagcgtacgagaaacagattaaaactttacagcaggagcgggaggatctgaacaaggagctcgtccaggcctcagagcggctgaagaaccagagcaaagagctgaaggacgcccactgtcagcgaaaattggccatgcaagaatttatggaaatcaacgagaggctgaccgagctgcatactcagaagcagaagctggcccggcacgtacgcgataaagaagaggaagttgacctggtgatgcagaaagtggaatcattacggcaggaactgcgccggacggagcgcgctaaaaaagaacttgaggtccacacggaagcgcttgccgccgaggccagcaaagaccgaaaactgcgcgagcagtctgagcactatagcaaacagctcgaaaatgaacttgaaggtcttaagcagaagcagatatcttacagccccggggtgtgttctattgagcatcagcaggaaattaccaaacttaagacagatctggaaaagaaatcgatcttctatgaggaagaattgtctaagagggaaggcattcacgcaaacgagatcaagaatcttaagaaggaactccacgactcagagggacagcagctggccctcaacaaggagatcatgattcttaaggacaaactggagaagacgaggcgtgagagtcagagtgaacgcgaggagttcgagagtgagtttaaacaacagtacgagcgggaaaaagttctgctgacagaagaaaataagaagcttaccagtgaattggacaagctgacgaccctttatgaaaacctgagtatacacaaccagcagctggaggaagaagtaaaagatctggccgataaaaaagagagcgttgctcactgggaggctcaaattactgagatcattcagtgggtctcggatgaaaaggatgcccgcggctatctccaggcattagcctccaagatgacagaagagctcgaggcgttgcgtaactcctcccttggtactcgtgccaccgatatgccctggaagatgaggcggttcgcaaagctggacatgagcgcccggctggagcttcagtctgcactggacgcagagatccgcgcaaagcaggcgattcaggaagagctcaacaaggtcaaagcttctaatatcatcactgaatgcaaacttaaagactcggagaaaaaaaacctcgagctcctctcggagatcgaacagctcattaaggatacagaggaactgcggtcagaaaagggcattgaacaccaggattcccagcactccttcttggcatttctgaacactcctaccgacgcgctcgaccagttcgaaaccgacccagtcgagaatacgtacgtttggaaccctagcgtgaagttccacatacaatcgcggtcaacctcgcctagcacaagctccgaggcggagcctgtaaagacggtcgacagtactcccctgagtgtgcacacacccacactgcgtaagaaaggttgtcccgggtctacagggtttcctccgaaacgaaagacacatcagttctttgtgaaatcattcactaccccaacaaagtgccatcaatgtacttctctaatggtgggcctaattagacagggctgctcgtgtgaggtttgcgggttctcttgtcacatcacctgcgtgaacaaggccccaacaacatgtcccgtgccaccagaacagaccaaaggccctttggggatcgatccccaaaaagggataggcacggcttacgagggacacgtgcggatcccaaaacctgctggcgtgaagaaaggctggcagcgggctttggccatcgtctgcgattttaaacttttcttgtatgacatcgcggaggggaaagcgagccagccatctgtagttatctcccaggtgatcgacatgagagacgaggaattctccgtctcatctgtgctcgcttccgacgtcatccacgcatcccgtaaagatatcccgtgtatctttcgggttaccgcatcacagctctcagctagtaataacaagtgctctatacttatgcttgccgatactgagaatgagaagaataagtgggttggcgtactctccgagctgcacaaaattctaaaaaaaaataaatttagagatagatctgtgtacgtgcccaaggaagcttacgatagcacacttcctctgattaagaccacgcaggcggccgctattatcgatcacgaacgaatcgctctaggcaacgaggaaggactgttcgtcgttcacgtaaccaaggatgagataatccgtgtgggcgataacaaaaaaattcaccagattgagctgatccccaatgaccagttagtagctgtgattagcgggcgtaaccgtcatgttaggctgttccctatgtctgcgctagacggccgcgagactgacttttacaaactgagtgaaaccaaaggatgccaaaccgtgaccagcgggaaagtgcggcatggcgctcttacctgcctgtgtgttgccatgaaacgccaagtgctctgttacgaactgtttcagagcaaaacccggcaccgtaagttcaaggagatccaagttccctataacgtgcagtggatggccatcttttccgagcaactctgcgtgggcttccaatccgggttcctgcggtaccccctgaacggcgaagggaacccatattcgatgttgcattcaaacgatcacacacttagtttcattgcacatcagcctatggatgcaatttgcgcagtggaaatatcttccaaggaatacctcctctgcttcaactctatagggatctacactgattgtcaaggacggcgtagccgccagcaggagctgatgtggcccgctaatccctcgtcatgttgctacaacgctccatatctttcggtctattccgaaaatgccgtggatatttttgacgtgaatagcatggagtggatacaaactttgcctctgaagaaagtcaggccactcaataatgaaggcagtctgaacttacttggcctggaaaccattcgcttgatctattttaaaaacaaaatggccgaaggcgacgagctggtggtccctgaaacatcagataactccagaaaacagatggtgcgtaatattaataacaagagacgatattcgttccgggtgccggaagaggagaggatgcaacagcgccgggagatgctgagagacccggaaatgcggaataagctaatctccaaccccacaaactttaaccatatcgcgcacatgggaccaggcgatgggatccagatactgaaggatctgcccatgaatcccagacctcaagagtccagaacggtgttcagcggatccgtaagtatccccagtattaccaagtctaggcctgaaccaggccgttcaatgtctgcctcgagcgggctgagcgctcgatcatcagctcagaacggctccgctctcaaaagagagttctctggaggtagttatagcgcaaagaggcagcctatgccaagtcctagtgaagggtcccttagcagcgggggaatggaccagggcagcgatgcgccggcaagagattttgatggggaggatagtgattcacccagacattccacagctagtaatagctctaatctgtcatctcctccgagtcccgcctcacctaggaagaccaagagtcttagcttggaaagcaccgatagagggagttgggatccctag

SEQ ID NO: 111490 - DNA, 4917 bp, Artificial Sequence
  Description of Artificial Sequence: Synthetic coding sequence
atgtcgggggaagttcggctcagacagctcgagcaatttattcttgatggacctgcgcaaaccaacggtcagtgtttcagtgtggagacattactggatatcctaatctgcctctacgatgaatgtaataattcaccactgcgccgagagaagaacattttggaatacctggaatgggctaaacctttcacctccaaggtcaagcagatgcgactgcatagggaggacttcgagattctcaaggtgatcggtcgaggagcatttggggaagtggcagtggttaagctaaaaaacgctgataaagtgtttgctatgaaaattctcaacaagtgggaaatgttgaagcgcgccgagacagcttgcttcagggaggagagagacgtgctggtcaatggagacaacaaatggattacaactctgcattatgcattccaagatgataataacctgtacctggttatggactattacgtcggtggagacctgcttactttgctaagcaaattcgaggataggctgcccgaagatatggcacgcttctacctggcggaaatggtgatcgccatcgattctgtgcatcagttgcactatgtacatagagacatcaaaccagacaacatcctgatggatatgaatggccacatccgcttagccgatttcggatcatgcctgaagcttatggaggacggcacggtgcaaagctcagtggcagtcggaaccccagactacattagccctgaaatcctccaagccatggaggacggtaagggtaggtacggaccagaatgcgactggtggtcattaggggtctgtatgtatgagatgctctacggcgagactcctttttacgccgagtccttggttgaaacctatgggaagattatgaatcataaagaacggtttcaattccccgcccaggttacggacgtctccgagaacgccaaggacctgatccgtcgtctgatttgtagtcgagagcaccgcctgggtcagaatggaatagaggactttaagaaacatccttttttctccggaatcgactgggacaacatccggaattgtgaagctccatacatcccggaggtatcatcccctacggatacctccaattttgacgtggatgacgactgccttaagaattccgaaacaatgcctccgcccacccacaccgcatttagcgggcaccatctaccttttgtagggttcacgtacacaagctcatgtgtgcttagcgaccggagctgtctgagagtaaccgcaggaccaaccagcttagacctggatgtgaatgtccaacggacccttgacaacaacttggccaccgaggcctatgagcggcggatcaagagattggagcaggagaaacttgaactgagccgcaagctacaagaatctacccagacagtgcaagctctgcagtactcaactgtcgacggccctctgaccgccagcaaggacctagaaatcaagaacttgaaagaagaaattgaaaagctgcgcaagcaggtgaccgaatcttcacacctcgagcagcaattagaagaagccaacgcagtgcgacaggagctggatgacgcattcaggcagattaaggcctacgagaagcagatcaaaactctccagcaggaaagagaggacctcaataaactagaagtgcatacggaggccttggccgccgaagcgtccaaagaccgcaaactccgggagcagagtgagcactacagcaagcagctggaaaacgaactcgagggcctaaagcagaagcagatatcttatagcccaggtgtttgctcaatcgagcaccagcaggaaattaccaagctaaagacagacttagagaagaagtccatcttttatgaggaggagctttccaagagagagggaattcacgcaaacgagatcaagaatctgaagaaggaactccacgattctgagggacagcagttagcattaaacaaggagataatgattttgaaggataagttggagaagactagacgagaatctcaaagcgaaagagaggaattcgaatctgagttcaagcaacaatacgaacgtgaaaaagtgctgttgaccgaggagaataagaaactgacctcagagctggacaaactgaccacgctgtatgagaatctgagtattcacaatcagcaactcgaggaggaggtgaaggacctggctgataagaaggagtctgtggcccactgggaggcccagatcaccgagatcatccagtgggtgtcagatgaaaaagatgccagaggctatctacaggcgctcgccagtaaaatgaccgaagaactagaggctctccggaactcatcactcgggactcgggccactgacatgccttggaagatgagacggtttgctaagttagacatgagtgcgagactcgagctgcaaagtgctctagatgctgagatcagagctaagcaggctatccaggaggaactgaataaggttaaggcctccaacattataaccgaatgtaaactgaaagactccgagaaaaagaatttagagctactttccgagatagagcagttaatcaaggatacagaagagcttcgttctgagaaaggaatcgagcaccaggacagtcaacactcatttttggccttccttaacacgccaactgatgctttggaccagttcgagacggtcgatagtacacctctctcagtgcatacaccaactctgagaaaaaagggctgtccggggtcaacgggattcccacccaagcgaaagacacaccaattctttgttaaaagttttaccacccctacaaagtgtcaccaatgcactagcctgatggtcggcctgatccggcagggatgctcatgcgaagtttgcgggttctcctgccacattacctgtgtcaacaaggccccgacaacgtgtcccgtccccccagaacaaacaaaaggcccgctaggtattgatccccagaaggggataggcacagcctatgaggggcacgtgcggattcccaagcccgcgggcgtcaagaaaggttggcagcgtgctctggccatagtatgtgattttaaactcttcctctatgatatagccgagggtaaagcgtctcagcctagtgtcgtcatttcccaggtgattgacatgagggacgaggagttctccgtctcctcggtgctggccagtgatgtgatccacgcttccagaaaggacataccctgcatttttagagtgactgcctcccagctttccgcaagcaataacaaatgtagcatcctgatgcttgccgacacggaaaacgaaaaaaataaatgggtgggggtgctctctgagctgcacaagatactcaaaaagaataaatttagggatcggagcgtgtatgtgccaaaagaagcctatgactcgactctgcccctgatcaagactactcaggcagccgccattatcgaccacgagcgtatagccctgggtaatgaggagggtctgttcgtggtacacgttaccaaggacgagatcattagagtgggcgataataagaagatacaccagatcgagttaattcctaatgatcagctggttgccgtcatttctggccggaatcgtcacgttagactctttcccatgagtgcactggatggtcgcgagactgacttttataagctgagcgagaccaaagggtgtcaaacagtgaccagcgggaaagtgagacatggcgctctgacttgcttgtgtgtggcaatgaaaagacaagtgctctgctacgagttgttccagtccaaaactcgccacagaaaatttaaagagatccaggtgccctataacgtgcagtggatggccatattctctgagcaactttgtgtgggcttccagagcggctttttgcggtatcctttgaacggagagggaaatccctacagtatgcttcattctaatgatcatacactgtcattcattgctcaccaacctatggatgctatttgtgcagtggagatctcctcaaaggagtatctgctgtgttttaattctatcggcatatacactgattgccagggccggcgttcacggcagcaggaattgatgtggccagccaacccctccagttgttgctacaatgcaccttacctttccgtttatagtgaaaacgccgtggatattttcgacgtgaactctatggaatggatccagacgctgccgctgaagaaagtccggcctctaaataatgagggctctttgaacttactggggctcgaaacaatccggttaatctatttcaagaataaaatggccgagggcgacgaactggtggtgcctgaaacatcagataattctcgtaaacaaatggtccgtaatattaataacaagaggaggtactctttcagggtaccagaagaggaacgcatgcagcagcgcagagaaatgttgcgggaccccgagatgagaaacaagctgatctcaaaccctactaattttaatcacattgctcatatgggcccaggggatggtatccaaattctgaaggacctccctatgaatccccgacctcaggagtcaaggaccgtgttcagtgggagcgtatctatcccatcaattaccaaatctcgtcccgaacctggtcggagcatgagcgccagtagtgggctgtccgcacggagttccgcacagaacggcagcgccttgaagagagaattttctgggggatcatacagtgccaagcgccagccaatgccttcgccctccgagggatcgctgtcctcaggcggaatggatcagggcagtgacgcacccgcgcgcgatttcgatggcgaggactcagatagtccccggcatagtacagccagcaacagctcaaacctttcctcacctccatccccagcttcccctcggaaaacaaaatctctctctctagaatctacagatagagggtcttgggacccctag

SEQ ID NO: 111491 - DNA, 5160 bp, Artificial Sequence
  Description of Artificial Sequence: Synthetic coding sequence
atgtctggcgaggtgagactacggcagctcgagcagtttattttggatggcccagcccagaccaatggacagtgtttctctgtggagaccttgctggacatcctcatttgcctgtacgacgaatgtaataacagtcccctgcggcgggaaaaaaatatcttggagtatctggagtgggctaagcccttcaccagtaaagtgaagcaaatgcgcctgcatcgagaggacttcgaaatcctcaaggttatcgggagaggagcctttggagaagtcgctgtggtcaagctgaaaaacgcggacaaagtattcgctatgaagatcctaaacaaatgggaaatgctgaagcgagccgagaccgcttgctttagggaggagcgcgatgtgttggtcaacggcgacaacaaatggattacaaccctgcactacgcgtttcaggatgataacaatctgtatcttgtcatggactattacgttgggggagacttactgaccttgctgtcaaaattcgaggacaggctacccgaagatatggcacggttctacctagcggagatggtgattgcaatcgattccgtacatcaactgcattatgtccaccgcgatattaagccagacaatatcctgatggatatgaacggtcatatccgacttgccgattttgggagctgtctaaagctcatggaagacggaactgttcagtccagcgtggccgtgggcacacccgactacatctcccccgagatcctgcaggcgatggaggatggcaaaggtaggtatggaccggaatgtgactggtggagccttggcgtgtgcatgtacgagatgctctatggagagacacccttttatgctgagtcacttgtcgaaacctacggcaagatcatgaatcacaaggagcggttccaattccctgcacaggtaaccgatgtgagcgagaacgcaaaagacctgattcgtcggctgatctgcagccgagagcatcggctaggacagaatggaatcgaggattttaaaaaacaccctttttttagtgggatcgattgggacaatataaggaattgcgaggcgccatatatccccgaggtaagcagccccaccgatacaagcaacttcgacgtcgacgatgattgcctgaagaattcggagaccatgccaccacccacgcacaccgctttcagtggacaccatctcccctttgtcggattcacatatactagtagctgcgtgctttctgatcgatcctgtctgagagtgacagctggcccaacctccctggatctggacgtgaatgtacagcgcacactggataacaatttggcaaccgaggcctacgaacgtagaatcaaaagacttgaacaggaaaaactggaactttccaggaagctgcaggagtcgacacagaccgtacaggctctgcaatacagcacagtggatggccccctgacagctagcaaggacctggaaatcaagaacctaaaagaggaaatagaaaaactgcggaaacaggtcacggaaagtagccacctcgaacaacagctggaagaggccaatgcagtccgtcaggagcttgatgacgccttccggcagataaaggcttatgaaaaacagattaagacactccaacaggaacgcgaggatctgaacaaagaactggtgcaagcatccgagcggctcaaaaaccagtccaaagagctgaaagatgcccattgccagcgtaagctggcgatgcaggagtttatggaaattaacgaaagactgactgagcttcatacccagaagcagaaactggcccgtcatgtccgcgataaggaggaggaagtagacctggtgatgcagaaggttgagagcctacgccaggagctcagaagaacagagagagctaagaaggaactcgaagtgcacaccgaagcactcgccgctgaagctagcaaagataggaaactgagagaacagtccgaacactattccaagcagcttgagaatgagctggaaggtctgaaacagaaacagatttcatacagtcccggtgtgtgtagtattgagcatcagcaggaaatcaccaaattgaagacagatctggagaagaagtctattttctatgaggaggagctctcaaagagggaaggtatacatgcgaacgagattaaaaacctcaaaaaggagctgcatgactccgaaggccagcagttagccttaaataaggaaataatgatactgaaagacaaattagagaaaaccagaagagagtctcaaagcgaacgagaagagtttgagagtgagtttaagcagcagtacgagcgagaaaaggtgctgttgacagaggagaataaaaagctcaccagcgaactcgataaattaaccaccctgtacgagaacttgagcattcacaatcagcagctcgaagaggaagttaaagacttggcagataagaaagagtctgttgcccattgggaggcacagatcacagagattattcaatgggtttccgatgagaaggacgcccgcgggtacctccaggctctggcttccaagatgaccgaggaactcgaagcactgcggaactcctcgctgggaacaagagccacagatatgccttggaaaatgcgccgcttcgccaagctggacatgtccgcaagacttgagctgcagtctgcgctggacgctgaaattcgcgccaagcaggctatacaggaggaactaaacaaggtcaaagcgtcaaacatcatcactgagtgcaagctgaaggacagcgaaaagaagaatctagagctgctctcagagattgaacagttgatcaaagatactgaagaactgaggagtgaaaaaggaatcgagcatcaggattctcagcactctttcctagcctttctaaatacgccaacagacgccttggatcagtttgagaccgtggactccacgcccctgtcggtgcatacgccgaccttgaggaaaaaggggtgtcccggcagtactggtttccctccgaagcggaagacccaccagttcttcgtgaagagctttacaacccccaccaagtgccaccagtgtactagcctgatggtagggctgataagacaagggtgctcttgcgaggtgtgtggctttagttgccacattacatgtgtgaacaaggctcccacaacctgtccagtgccaccagaacaaactaagggaccgttgggtatagaccctcagaagggaataggcactgcatacgagggccacgtccggatacccaaacccgccggcgtaaagaagggctggcagagagcgctggccattgtctgcgatttcaaacttttcctttatgacatcgctgaggggaaggcttcccagcctagcgtagtgatctcccaggtcatagacatgagggacgaagagttctcagtctcttcggttctggcttccgacgtaatccatgcttccagaaaggatataccatgcatatttcgggttactgcctcccagcttagcgcctctaataataagtgttctattctcatgttggcggatactgagaacgaaaaaaacaaatgggtgggagttctttccgagctgcataagattctgaagaaaaacaagtttagggatcggagcgtatatgtgccaaaagaagcatatgattcaacgcttcctctgatcaagactacccaggctgccgctatcattgaccatgagagaattgctctgggtaacgaagaaggtctgtttgtggtgcacgttacaaaggatgaaattatacgggtaggcgacaacaaaaagatccaccagatcgagctgataccgaacgaccagctggtagctgttatatcaggtaggaacagacatgtccgactctttcctatgtcggcgcttgacggtcgggagaccgatttctataagctgagcgagactaaagggtgccagactgtcacctcagggaaggtccggcatggcgctcttacatgcttgtgcgtggccatgaagcggcaggtcctgtgctatgagctttttcagtcaaagacccgccatcgcaagtttaaggagatacaggtcccctacaacgtgcaatggatggccatattcagcgagcagctctgtgttggattccaatccggtttcctaaggtatcccctcaatggagaaggtaacccctactctatgcttcattctaatgatcatacactcagtttcatcgcccaccaacccatggacgcaatttgcgccgtggaaatcagcagcaaggagtacctgctgtgctttaatagcattgggatatatactgattgtcaaggccgtcgtagccgccagcaggagttgatgtggcccgctaaccctagctcttgttgttacaatgccccttatctgagtgtttatagcgaaaacgccgtggacatctttgatgtcaattctatggagtggattcagactttacccctgaagaaagtgcggcccctgaacaatgaaggttccctcaacctcctgggtctcgaaactattagactgatctactttaaaaacaagatggccgagggagacgagctggtggtaccagagacatccgacaacagccgaaaacagatggtacggaacatcaacaacaagagaagatattcatttcgcgtcccggaggaggagcgtatgcagcagaggcgcgaaatgctgcgagatcctgagatgagaaacaaacttatcagtaaccccacgaattttaaccacattgcacacatgggccctggggatggcattcaaatcctgaaggacttgccaatgaacccccgtcctcaggagtcccggacagtgttcagtggctctgtatccatcccaagcatcaccaaaagccgccctgagcccggcagatccatgagtgcaagtagcggcctctcagcaaggtcttctgctcagaacggctctgccttaaagagggaattctcaggaggctcttatagcgccaagcgccagcctatgccttctcccagcgagggaagcctgtctagcgggggcatggatcagggaagcgatgcccccgcacgggatttcgatggggaggactcagatagccctcgccatagtacggcgagcaactcttctaacctttcttctccgccctccccagcttctccccgaaaaactaagagcctgagcctcgaatccacagatcgcggcagctgggatccctag

SEQ ID NO: 111492 - DNA, 1641 bp, Artificial Sequence
  Description of Artificial Sequence: Synthetic coding sequence
taagacattgcagagggtaaggccagtcagccctctgtcgtgatctcccaggtcattgacatgcgcgatgaggagttcagcgtaagttcagtgctggccagtgacgtgatccacgcaagcagaaaggatatcccgtgcatcttccgagtgacggctagccaactgagcgcgagcaacaataagtgtagtattttgatgctggccgacaccgaaaatgaaaagaataaatgggttggcgtgctaagtgagctgcacaagatactgaagaaaaataagttccgcgacaggtcagtgtacgtgcccaaggaagcctatgatagcacacttccgctgatcaaaacaactcaggcagcagcaattattgatcacgagcggatcgctctgggaaatgaggaaggcttattcgtggtccacgtgacaaaggacgagattataagagtgggagacaacaagaagattcaccaaattgagctcatacctaatgaccagctggtagccgtgattagcgggcggaacagacacgttcgactattccccatgtcagccctcgacgggcgtgagactgacttctacaaactcagcgaaaccaaggggtgccagaccgtgacttcggggaaagtgcgccacggagctctgacatgtctgtgtgtagccatgaagcggcaagtcctgtgctacgaattgttccagagtaagaccagacacagaaagtttaaagagatccaggtcccttacaacgtgcagtggatggcaattttcagcgagcagctgtgtgtcggattccagtcaggcttcttgcggtaccctttaaacggcgaggggaacccatactctatgctgcattcgaacgaccacaccctgtccttcatcgcccaccagcccatggacgcgatctgcgcagtagaaatctcaagtaaggagtatttactgtgcttcaatagcattggcatctatactgattgccagggaagacgtagtcgccagcaggaactgatgtggcccgcgaacccaagttcatgctgctacaacgccccttatctatccgtctactctgagaacgcggtcgacatttttgacgttaactccatggagtggatccaaacactgccactgaaaaaagtgagaccgctaaacaatgaaggtagtctcaaccttttaggactggagaccatacgcctgatttactttaagaacaagatggcggagggagatgagctagtggtgcccgaaacaagtgataattctaggaaacagatggtccggaacatcaataacaaaaggcggtactcgtttagggtcccagaagaggagcgtatgcagcagaggagggagatgctacgcgaccctgagatgaggaacaaactcataagtaatccgactaacttcaaccacatcgctcatatgggcccaggcgacggaatacaaattttgaaggacctgccgatgaatcctcgccctcaagaatcccgtactgtgttctctggctccgtttccattccgtcaataaccaagtcccgtcctgagcctggaaggagtatgtcagcttccagtgggttaagtgcatccaaatgcagagggtatcggaaagtgccactgcggcaaggcgaccctcaattgccgcctttactgtcaagaggatag

SEQ ID NO: 111493 - DNA, 2187 bp, Artificial Sequence
  Description of Artificial Sequence: Synthetic coding sequence
tgagtgagcgatgaaaaggacgcaaggggctacctccaggcactggcgtcaaaaatgaccgaggaactggaggcgctccgaaatagctccctgggaacgagagctaccgacatgccctggaagatgaggcgattcgctaagctggacatgtccgcacggctcgaactgcagtcagctcttgatgccgaaattagagccaaacaggccattcaggaggagttgaacaaggttaaagcctctaacatcattacagagtgtaagcttaaggattccgaaaaaaaaaacttagagttgttgagtgagatcgaacagctaattaaagatacagaggaactccgttccgaaaagggtattgagcaccaagacagtcaacattcctttctcgcctttctgaacaccccaaccgacgcactggaccagtttgaagattccttcagtagttcttcaagctctctcattgatttcctcgatgatacggatccagttgaaaatacatatgtatggaacccttcagtgaaatttcacatccagtctaggagcacatctccttcgacaagctcagaagctgagcctgtgaaaacggtggactcaacaccactgtccgttcatacccctacactccggaagaaaggctgtcccggctcaacaggattccctccgaagagaaagacccatcagtttttcgtgaagagctttacgacccctacaaaatgccatcagtgcacttccctgatggtagggctcataaggcaaggctgttcttgtgaagtctgcggattctcttgtcacataacatgcgtcaataaggccccgacaacctgcccagtgccaccagaacagaccaagggtccgctgggaatagacccacagaaagggataggtaccgcctatgagggccatgtgagaatccccaagcctgccggggtgaagaagggctggcaacgggctctggctatagtctgtgatttcaagctgtttttgtatgacatcgcagagggaaaagcttcacagccatcagtggtgatttcacaggtaatagacatgcgggatgaagaattctctgtttctagcgtcctggctagcgatgtcatccacgcatctcgaaaggacatcccctgtatatttcgggtcaccgcatcacagctgtcagccagtaataataaatgtagcatcctgatgttggcggacaccgaaaacgagaaaaataaatgggtaggggtcctctccgagctccacaagatactgaagaagaacaaatttagagatcgaagcgtctacgtgcccaaagaggcttacgacagcacccttcctttaatcaagacaacacaggccgccgctattattgatcacgaacgaatagccctcgggaatgaggaaggtcttttcgtagtccatgtaacgaaggatgagatcatacgggtgggtgacaacaaaaagatccatcaaatagaattgatccccaacgatcagcttgtcgctgtaatcagtggccggaaccggcacgtccgactctttcctatgagtgcactcgacggtcgagagactgatttttacaaactctccgaaactaaaggatgccaaacagtcacgtcagggaaggtgcgacatggagctttaacatgcctttgcgtcgcaatgaagcggcaggtcctgtgttacgagctcttccagagtaagactaggcatagaaagttcaaggagatacaagtcccctataatgtgcagtggatggccatcttctccgaacagctgtgtgtgggtttccagtcaggtttcctccgatacccgctgaatggagagggcaatccctattccatgctgcactccaacgatcacaccctgagttttatcgctcatcaaccaatggatgcaatttgtgccgtggagatcagcagtaaggagtatttattgtgctttaatagcatcggtatctataccgactgccagggacggcggagtcgccaacaagagctgatgtggcctgctaaccccagctcgtgttgttacaatgccccttatctctctgtgtacagcgagaatgccgttgacatatttgacgtgaattccatggaatggattcagactctgcccctcaaaaaggtccgcccattaaataacgaaggtagtttgaatcttttgggtctggagacaatcagattaatctacttcaaaaacaagatggcatag

SEQ ID NO: 111494 - DNA, 3147 bp, Artificial Sequence
  Description of Artificial Sequence: Synthetic coding sequence
tgagagggcattcacgcgaatgagattaagaacctgaaaaaggagctacacgattcagaagggcagcaactggccctgaacaaggaaatcatgattttgaaagataagctggaaaagacgcggagggaaagccagtccgaacgcgaagagttcgagtctgagtttaaacaacagtacgagcgggagaaggtgttgctgacagaggagaataagaaactcacctcagaactagataaactcacaactctctatgaaaacctaagcattcacaatcagcaattagaggaggaggtaaaagatctcgccgacaaaaaggagagcgtggcccattgggaggctcaaatcacagaaatcattcagtgggttagtgatgagaaggacgcccgcggttatctccaggctcttgcatctaaaatgaccgaagagttagaggccctgcggaacagttccctcgggacaagagcgaccgatatgccctggaagatgcgcagattcgctaaattggacatgagcgctagacttgagctgcagagcgccctagacgctgaaattcgagccaagcaagccatccaagaagagctgaataaggttaaagcgagtaatatcattacggaatgtaagttgaaggatagcgagaaaaagaacctcgagctcctgtctgaaatcgaacagcttatcaaagataccgaggagctacgctctgaaaaaggcattgagcaccaggactcccagcattctttcctcgccttcttgaacacccctaccgatgcccttgaccagttcgagactgatcctgtggaaaacacctacgtatggaacccgagcgtgaagttccatatacagtcaagatctacgagcccttccacttcctcggaagctgaacccgtgaagacagtagactccacccccttaagcgtacatacgcccaccctgcgtaagaagggatgccccggtagcacaggctttccccccaagcgcaagactcatcagttctttgtaaagagtttcaccactcctactaaatgccatcaatgtacctctttgatggtcgggcttattcgccagggatgttcttgcgaagtatgcgggttttcttgtcatattacctgcgtgaacaaggctccgactacctgccccgtgcctcctgagcaaaccaaaggacccttaggtatcgacccacaaaaagggataggaactgcctacgaaggccacgtgagaatccccaagccggctggggtgaagaagggatggcaaagagcactcgccatcgtttgcgacttcaagctcttcctatacgacatcgctgagggcaaagcatcccagccatccgtcgtgatttctcaagttatcgatatgagagacgaggagttctccgtgagttccgtgctggctagcgatgtcatccatgctagtcggaaagatattccatgcatttttagggtcacagcctcccagctcagcgctagcaacaacaaatgtagcattctgatgcttgccgacacagaaaacgagaaaaacaaatgggtcggtgtgctgagcgagttacacaaaattctgaaaaagaacaaatttagagaccgaagtgtctacgtgcccaaagaggcatacgactcaaccctccccctaattaagaccacacaggcagctgctataatcgaccacgaacggatcgccctcggaaacgaagagggcctctttgtcgtccacgttaccaaggatgaaattatacgtgtgggtgacaataagaagattcaccaaatagagttgatccccaatgaccagctggtagctgtaatctctgggagaaatcgccacgtgaggctcttcccaatgtcagcccttgacggccgggaaacagatttctacaagctatccgagactaagggatgtcagaccgtcacatcaggtaaagtgcgccacggcgctctcacatgtctctgcgtagccatgaagcgacaggttctctgctatgagctattccaatcaaagacaaggcatagaaagttcaaggaaatccaggtcccatataacgttcagtggatggctattttttctgagcaactgtgcgtcggttttcagtccggattcctgcgatatcctctgaacggcgagggaaatccctactctatgttgcacagcaacgaccatacgctcagtttcatagcacatcagccaatggacgccatatgtgccgtggaaattagctcaaaggagtacctgctctgctttaactcaatcggtatatacacagactgccagggcagacggagccgacagcaagaactgatgtggcctgccaacccctcgtcatgctgttataacgcaccctacctctctgtatactccgagaacgcggtggatatctttgacgtcaactccatggagtggatccagactctgcctttaaagaaggtgagaccactgaacaatgagggctccctaaatctactaggcctcgaaacgataaggcttatatattttaagaacaaaatggcagaaggtgacgagctcgttgtgccagagactagcgacaactctcgcaaacaaatggttagaaacattaataataaacgtagatattctttcagagtgcctgaggaggagcgtatgcagcaaagacgcgaaatgctgagggatcccgaaatgcggaacaagctcatcagcaatcccaccaatttcaaccacatcgcacatatgggtccgggggacggaatccaaatcctcaaggatttgcccatgaacccacggcctcaggaatcacgcaccgtgttctcgggaagcgttagcatccccagcattacaaaatcacggccggagccaggccgctctatgagcgcaagtagtggcttgagtgcccggtcctccgcgcaaaatggatccgccctaaagcgtgagttcagtggtgggtcatatagcgccaagcgtcaacccatgccaagcccatcagaagggtctctgtctagcggaggcatggaccaggggtcagatgccccggcgagggattttgacggggaagattctgacagccccaggcatagcactgccagcaattcctcaaatctgtctagtcccccatcccctgcttctcccagaaaaacgaagagtttgagtctggagtccaccgatagaggatcgtgggatccctag

SEQ ID NO: 111495 - DNA, 2955 bp, Artificial Sequence
  Description of Artificial Sequence: Synthetic coding sequence
tgacagctcgaagaagaggtgaaggacttggctgacaaaaaagaatcagtcgcgcattgggaggcacagattacagagattatccagtgggtctccgatgagaaagacgcacggggttacctgcaggcgttagctagtaagatgactgaagagctggaagcactgcggaatagcagcttggggacacgcgcaactgacatgccatggaagatgcggcgatttgccaagctcgacatgagtgcccgcctggaactccagtctgccctggacgccgagattagggcgaagcaagctattcaagaggaactcaataaggttaaggccagtaacataattaccgaatgcaaactgaaagatagcgaaaagaagaatcttgaattattatcagagatcgagcagctgattaaagataccgaagagttgaggagtgaaaaggggatcgagcaccaggactcccagcattcctttttagccttcctgaacaccccgacagatgccctcgatcagttcgagacagtcgacagcacgccgctcagtgttcataccccgaccctgcgaaagaaaggttgtcctggctccaccgggttccctccgaaacgcaaaacacaccagtttttcgtgaaaagcttcacaacaccaacaaagtgccatcaatgtacatcactgatggtgggcctcatccgccagggctgctcctgtgaagtttgcggatttagctgccatattacatgcgtcaataaggcgcccaccacctgtcccgtgcccccagagcagactaagggcccacttgggatcgaccctcagaaaggcatcggtacagcctatgaggggcatgtcagaatccccaaaccggccggcgtgaagaaaggttggcagagggcccttgcaattgtctgtgacttcaagctgtttctgtatgatatagcagaaggcaaagccagtcagccttccgtcgttatctctcaggtgatcgatatgcgcgacgaggaatttagtgtcagcagcgtcctggccagtgacgtcatccatgcctcgaggaaggatattccatgcatctttcgcgtgaccgctagccagctcagtgcttcgaataataagtgcagcattcttatgctagctgatacagagaacgaaaaaaataagtgggtcggagtgctgtctgaactgcacaaaatcttaaaaaaaaataagtttcgagatcgctctgtttacgtgcctaaggaagcctatgattccacactgcctctaatcaaaactacccaggcggcagccatcattgaccatgagagaattgcccttggcaacgaggaaggcttgttcgtggtgcatgtcactaaggatgaaatcattcgcgttggagacaataagaaaatccaccaaatcgaactaatcccaaatgatcagctggttgctgtgatttctggacgtaacagacacgtgcgcctcttccctatgtctgcgctcgacggcagagagaccgacttttacaagctgtctgagactaaggggtgtcagaccgtgaccagtgggaaggttcgccacggcgccctcacctgtctgtgcgtcgcgatgaaacgacaggtgctctgctacgagctatttcagtccaagacaaggcacagaaaatttaaggagatccaggttccctataacgtccagtggatggccatcttctccgagcagttgtgcgtgggcttccagtccgggttcttgagatatcctcttaatggtgaaggcaacccctattcgatgcttcactctaatgaccataccttgtcatttattgctcaccagcctatggatgctatctgtgcagtggagatatcgtccaaggagtatctgctgtgcttcaatagtattggaatttacaccgattgccaggggagacggagcaggcagcaggaactgatgtggcccgctaaccctagcagttgctgttataatgctccctatctctccgtttactcagagaatgctgttgacattttcgacgttaactccatggaatggattcaaaccctgccccttaagaaggtgcgaccattgaacaatgagggctcattaaacttgcttggacttgaaaccatccggctcatatattttaagaataagatggccgaaggcgatgagttggttgtccccgaaacgtcagacaactccaggaagcagatggtacggaacattaacaacaaacggcgttactccttccgagttccagaggaagaacggatgcagcaacgcagagagatgttacgcgaccccgagatgcgcaacaagctgatctccaaccctactaatttcaaccatatcgctcatatgggccctggagatgggattcagatactcaaagacctgcccatgcctggatttccttacccgtcaccccaccatcatagcggcctgatatccagtccaattaattttgaacatatctaccacatgactgtgaactccgccgaaaagttcctgtcgcccgatagcattaaccctgagtattctccatccctacggtcagttcctggtaccccttccttcatgaccctgagaaacccgaggccccaggagtccagaacggttttttccggcagtgtctcgataccaagcattactaaaagccgccctgagccgggccggtcaatgtccgctagtagtggcctctccgcccgctcctccgcccagaatggctctgcactgaagagagagttctcagggggctcttactcagcaaagcgccaaccaatgccgtctccctcagaggggagcctcagcagcggcggtatggatcagggtagtgatgcccctgctagggactttgatggcgaagatagcgactccccacggcacagcaccgcttcaaatagcagtaacctgagtagtccaccctcacctgccagtccccgaaagaccaaaagtctttctctcgagagtacagacagaggtagttgggatccatag

SEQ ID NO: 111496 - DNA, 5100 bp, Artificial Sequence
  Description of Artificial Sequence: Synthetic coding sequence
atgtcgggagaggtacgactgcgacagctagaacagttcattctggacgggcccgcacagacaaatgggcagtgcttcagcgtcgagacactgctggatattttaatttgcctatacgatgagtgtaacaactcgcccttgaggcgcgagaagaacatcctcgaatacttagaatgggccaaaccgtttacctccaaagtgaagcagatgcggctgcacagagaggacttcgagatcctgaaggtaatcggtagaggtgcattcggtgaagtcgccgtcgtgaaactcaaaaacgctgataaggtgtttgccatgaagatactcaacaaatgggagatgttaaaacgagccgaaactgcctgctttcgcgaggaacgggacgtgctggttaacggcgacaacaaatggatcaccacgctccactatgcatttcaggacgataataatctgtacttggtgatggattactacgtgggcggcgaccttcttactttgttgagtaagtttgaagatcggctgcccgaggatatggcccggttctatctcgctgaaatggtcatcgccattgacagtgttcaccagctccactatgtccacagagatataaagccggataatatcctgatggacatgaatggacacattaggctggctgatttcggctcttgtttaaagctcatggaggacggcaccgtacagagcagcgtggctgtgggcacgcccgactacataagtccagaaattttgcaggccatggaagacggcaagggacggtatgggccagaatgcgattggtggagcctgggagtgtgtatgtacgagatgctgtatggagagactcccttctatgctgaaagcctcgtggagacatatggtaaaattatgaatcacaaggaacggtttcagttccccgcccaggtgaccgacgtatcagagaacgccaaggatctgatcagacggctgatttgctccagagaacaccgcctggggcagaatggtatagaggacttcaaaaaacatccctttttcagtgggatagactgggataatatcaggaactgcgaagccccatacattcccgaagtgtcttcacccaccgacaccagtaatttcgatgtggacgacgactgtctgaaaaactcggaaactatgcctcccccgactcacaccgccttctccggccatcaccttccttttgtcggatttacgtatacctcaagctgtgtcctgagtgacagaagttgccttcgggtcactgccggacctaccagccttgatctggacgtgaacgtgcagaggacactggataacaatctggcaacggaggcttatgagcggagaatcaaacgtttggaacaggaaaaactggaactgtctaggaaattacaagaaagtacccagacagtgcaggccttgcagtactcaacagtggacggacctctgactgcaagcaaagacctggaaatcaagaacctaaaggaagagatcgagaagctgcgcaagcaagtcacagaatctagccacctcgagcagcagctcgaagaggctaatgccgttcgtcaggagcttgacgacgccttccgtcaaattaaagcgtacgagaaacagattaaaacactgcaacaggagcgcgaggaccttaataaagagctggtgcaagcctccgaacgtctgaaaaaccaatctaaggagttgaaagatgcccactgccagaggaagcttgctatgcaggagttcatggaaatcaatgagaggctgactgagctgcatactcagaaacagaagctggcaaggcatgtacgtgataaagaagaagaagtggacctggtcatgcagaaagtggaatctctgcgccaagagttacgaaggacggagcgagctaagaaagagctggaagttcacaccgaggccctggctgcagaagcctcaaaagataggaaactgcgcgagcagagtgagcactattctaagcagctggagaatgagctcgaggggttgaagcaaaaacaaatttcctacagtcccggtgtgtgttccatcgaacaccagcaggagatcacaaagttgaagactgacctggagaaaaagagcatcttctatgaagaggagctatctaaaagggagggaatccacgcaaatgagatcaagaacctcaagaaggaactacatgattccgagggacagcagttggcgttaaataaggaaatcatgatccttaaagataagctcgagaaaacccggcgggagagccagtctgagagagaagaatttgagagcgaattcaaacagcaatacgagagggagaaggttctactgacggaagaaaataagaaactaacaagcgaactggataaactgaccacactctacgagaacctatccatccacaaccagcagctggaagaagaggttaaagatctggccgacaagaaggagtccgtggctcattgggaggcccagattacggaaatcatccagtgggtttcagacgaaaaggatgctagggggtacctgcaggcacttgctagcaaaatgacagaagagctcgaggccctacggaacagttcgctgggcacacgggctaccgacatgccatggaaaatgcgtcgctttgcaaaacttgatatgtccgcacgcctcgaactccagtctgctctagatgccgagatccgagccaaacaagccatccaggaggagctgaacaaagtaaaagcatctaacataattactgagtgtaagctgaaggatagcgagaaaaagaacctagaactcctctcagaaatcgagcagctgatcaaagacacagaggagctacggagcgaaaaggcttccaagggtcggagaacagtagattccacccccctcagcgtgcacacccctacactcaggaaaaaggggtgtcctggaagcacaggttttccaccaaaacggaagacccatcaattctttgttaagagtttcacaacacctaccaagtgtcaccagtgtacctccctgatggtgggtttgatacgacagggctgcagctgcgaagtttgtggcttttcatgccatattacttgtgtgaacaaggctcctactacctgcccagttcccccagagcagacaaagggccctttgggcatcgaccctcaaaaagggataggcacagcttatgagggccatgtgcgtatccccaaacctgccggcgtgaaaaaggggtggcagagggctctggctattgtatgcgacttcaagttattcttgtacgatattgccgaaggaaaggcttcccagccctccgtcgtgataagccaggtgatcgacatgcgggatgaagaattttccgtgtcttcggtgttggccagtgatgtcattcacgcctctaggaaagacattccatgcatttttagggtgacggcaagtcagttgagcgcaagcaacaataagtgctctatcctgatgctggcagacactgaaaacgagaagaacaagtgggttggagtgttaagcgagctgcataaaatcttaaaaaagaacaagtttagagaccgcagcgtgtacgtccctaaagaagcctatgattccacattgcccctgatcaagaccactcaggcagctgcgatcatcgatcacgagcggattgccctggggaatgaggaggggcttttcgtcgtccatgtgactaaggacgaaatcataagagttggagacaacaagaaaattcaccagatagagcttattcccaatgaccaactggtggctgtgatatctgggagaaaccgccatgtgcgcctgttccccatgagcgcactagatggtagagagacggacttttataaactctcagagactaagggctgccagaccgtgactagtgggaaggtgagacatggggccctcacatgcctgtgtgtggctatgaagcgtcaggtgttatgttatgagttattccagagtaagacaagacacagaaagttcaaagagattcaagtgccttataacgttcaatggatggctatctttagcgagcagctctgcgtggggtttcaatcggggttcctcagatacccccttaatggcgagggcaacccttattctatgctccattcaaatgaccataccctgtcgtttatcgcacaccagcctatggacgccatctgtgctgttgagatctctagcaaagagtacttgctatgctttaacagtatcggtatttatactgactgtcaaggcaggaggtctcgccaacaggagctgatgtggccggccaatccttcctcctgctgttataatgcaccctacctctcagtatactccgaaaacgccgtggacatctttgacgtaaactctatggaatggatccagacactgcccctcaaaaaggtgaggcctctgaacaatgagggctcactaaatttactcgggctggaaaccattcgcctgatctacttcaaaaataagatggcagagggggacgagctggttgtgcccgaaaccagcgacaacagccggaagcagatggtgcgcaacattaataacaagcgtagatattctttccgggtgcccgaggaagaacggatgcagcagaggcgcgagatgcttcgtgatcctgaaatgcggaacaagttgatttccaacccaactaattttaatcatattgctcatatggggcccggagacgggatacaaatcctgaaagatctgcctatgaatccaaggcctcaggaatcccgcactgtgttttctggtagcgtgtccatccccagtattaccaagagcaggccagaacccggccgcagtatgagtgcctcatctgggctctcagccagatcttccgcacagaacggcagcgccttaaaaagagaattttcaggtggaagctactccgcaaagagacaacctatgcccagtccgtccgaaggatctctatccagcggaggaatggaccaggggtctgacgcccccgcgagagactttgatggggaagactcggactcacccagacattcaacagcgtcaaacagctccaacctctcatcacccccttctcctgcatcacctcgtaagacaaaaagcctttccctcgagagcacagacaggggctcttgggacccttag

SEQ ID NO: 111497 - DNA, 5136 bp, Artificial Sequence
  Description of Artificial Sequence: Synthetic coding sequence
atgtctgccaaagttcgacttaaaaaattggaacagctgctcctggatggcccctggagaaatgagagcgctctgtccgtggagacacttctggatgtgctggtctgcttgtacacagaatgcagtcatagtgcactccgcagggacaaatacgttgcggagttcctggaatgggcaaaacccttcacacagctggtcaaagaaatgcaactgcatagagaggacttcgagattattaaggtgatcggccgcggcgcctttggcgaggtagccgtggttaaaatgaagaataccgagagaatttacgccatgaaaatacttaataaatgggagatgcttaagagagctgaaactgcatgtttccgtgaggagcgcgatgtgctggtgaacggagactgccagtggattaccgctctccattacgcctttcaggacgaaaaccacctgtacctggttatggactattatgtggggggtgacctgttgacactgctttcaaagttcgaggacaagcttccagaggacatggctcggttctatataggtgaaatggttcttgctatagatagcatacaccaactacattatgtgcatcgagacattaagccagacaacgtcctcttagatgtcaatggacatatccgtctggcagactttggcagctgtcttaaaatgaatgacgatggaaccgtccaatcatcggttgctgtgggaacgcctgactatatttctcctgaaatccttcaagcaatggaagacgggatgggtaagtatggacctgaatgtgactggtggagcttgggcgtttgcatgtacgaaatgctttacggcgagacccccttttacgccgaatctcttgtggagacatacggaaagatcatgaaccatgaggagagattccagttcccatcccacgtgaccgatgtatcagaagaagccaaggatctcatccaaagactgatctgttctagggagagacggcttggacaaaacggcattgaagacttcaagaagcacgcctttttcgaaggtctgaactgggagaatatccgcaatctagaagccccatatatccccgatgtgagtagcccctccgataccagcaatttcgacgtggatgatgatgtgctgcgcaacaccgagatcctcccgcctggcagccatactgggttctctggtctgcacctcccatttatcggcttcacttttaccactgagtcctgcttctccgaccgcggcagcctgaaaagtattatgcagagcaatactctgaccaaggacgaggatgtgcagcgcgacctcgagcattccctgcagatggaggcatatgaaagacggattcgccggctcgagcaggaaaaactggagcttagtcggaaattacaagaatcgacacagacggtgcaaagcctccacggctccagcagggccctgtcaaactccaaccgcgacaaagagataaagaaactgaacgaggagatagaacgacttaagaacaagattgctgatagtaacaggctggaacggcagttagaagacaccgtcgccctgcggcaggaacgtgaagacagtactcagaggctgaggggccttgaaaagcaacaccgagttgttcggcaagagaaagaagaactccataagcagctcgtggaggccagcgagaggctgaagagccaggcaaaagagctgaaggatgcccatcagcagcggaagcttgcactccaagagttctcagagttaaacgaaaggatggcggagcttcgagcccagaaacaaaaggtgtctcgccaactacgggataaggaggaagaaatggaagtcgctacccagaaggtagacgcaatgaggcaggaaatgcgccgagccgagaaattgaggaaggaactggaagcccagttggatgacgcggtagccgaagcttccaaggaacgcaaactccgcgaacactccgagaatttctgcaagcagatggagagcgagctcgaagcactgaaggtaaagcaggggggaagaggtgctggcgcaactcttgaacaccagcaggagatctcaaagataaaatccgagctcgaaaagaaggtcctattttatgaggaagaactggtgaggagagaggcctcgcatgtgttagaggtgaaaaatgtgaaaaaggaagttcatgactctgaaagccaccagctggccctgcagaaggagattcttatgctgaaagacaagctggaaaagtctaagcgcgagcgacataatgaaatggaagaggccgtaggcaccataaaagacaaatatgagcgagagagggcaatgctgtttgatgagaacaaaaaactgacagccgagaatgagaaactgtgttcttttgtggataaactcactgcacagaacagacagttagaagacgaactgcaggatctagccgcaaaaaaggaatccgtcgctcactgggaggcacaaatcgctgagattatccagtgggtttcagatgaaaaagatgcccgagggtatctgcaggctcttgcttccaaaatgactgaggagctcgaagccttacgtagttctagcctggggtcccgcacgctggaccccctttggaaggtgcgacggtcgcagaaactggatatgtcagctaggctcgagttacagtccgctctggaggccgaaatcagggccaagcagttggtccaggaagagctgcgtaaggtgaaagacgcaaacctcacccttgaatctaagctgaaggatagcgaggctaagaaccgcgagctgttggaagaaatggaaatccttaaaaaaaagatggaagagaagtttagggccgacactggcttgaagctgcccgacttccaggattccatatttgagtatttcaacaccgcgccactggcccacgatctcaccttccggacctcaagtgcttcggagcaagagactcaggcccccaagcctgaagccagcccatcaatgtccgtggccgctagcgagcaacaagaggacatggcccgaccacctcagagaccatctgccgttcccctacctacaactcaggctttagcccttgccgggcccaagccgaaggcccatcagttctccatcaagtcattcagctcccccactcagtgctcgcactgtacaagcctcatggtgggattgatcaggcagggatacgcatgcgaagtttgcagcttcgcatgtcatgtgtcctgcaaggacggcgcaccgcaggtgtgccccatccctccagagcagtccaaacgcccattgggcgtggatgtccagcggggcatcggtaccgcttataaaggccacgtcaaggtccccaaaccaacaggagtgaaaaaagggtggcagcgagcctacgctgtcgtgtgtgactgtaaactttttctctatgacttgcccgagggcaagtctacccagccaggtgtcatcgcaagccaggtgctggatctgcgggatgatgagttcagtgttagtagtgttttagccagcgatgttatccacgcaactcggagagatattccctgcattttccgcgttaccgcttctctgctgggggcacctagcaagactagttccctactcatcttgacagaaaatgagaacgaaaaacgcaaatgggtagggatccttgaaggcctccagtcaattttgcacaaaaatcgcctgaggaatcaggttgtccacgttccactggaggcatacgacagtagcctccctctcatcaaagccatcctaaccgccgctatcgtagacgccgataggattgccgtcgggttggaagaaggactgtatgtcatcgaagttacgagggacgtgatcgttagagccgctgactgtaaaaaagtgcatcaaatcgagctcgcgcctcgggagaagatagtgatccttctctgtggccgtaaccaccacgtgcacctctatccctggtcttcactcgacggggctgagggatcctttgatataaagttgccggagactaagggttgccagttgatggccacggcgacactgaagagaaattctgggacctgtctgttcgtagcagtcaaaagactgatcctgtgctacgaaatccaacgcacaaagcccttccacaggaaattcaatgaaatcgtcgctccaggcagcgttcagtgtctagcggtgttgcgtgatagactatgcgtgggatacccaagcggcttttgcctgctgtcgatacagggcgacgggcaacctctcaacttggtgaatccaaacgatcccagcctagctttcctctctcagcagtccttcgatgctttgtgtgctgtggagttagagagcgaggaatacctgctgtgtttttcgcacatgggcctttatgtggatccacagggccgcagagcccgagcccaagagctgatgtggcccgccgcacccgtggcctgctcctgtagccccacacatgttaccgtatactccgagtatggtgtcgatgtattcgacgtgcggaccatggaatgggtgcagactattggcctgcgcaggatccgccctcttaattccgagggaaccttgaacttactaaactgcgagccccctcgcctgatatacttcaagtccaagttctccggcgccgtgctcaatgtacccgatacaagcgataattccaagaagcagatgttaaggacacgaagtaagcgccggtttgtgttcaaggtccctgaagaagaaaggctgcaacagcgcagggagatgctgagggacccggagttaagaagtaagatgatctccaaccctactaactttaatcacgtggcccacatgggtccaggcgatggcatgcaggtgttgatggacctgccccttagtgctgttcctccctcacaggaagagcggcccggccctgccccgactaacctggccaggcagccgccgtcaagaaacaagccatacatcagttggccatcaagcggcggttctgagccctctgtaaccgtgcctttaagatccatgtccgatcccgatcaggatttcgataaagaaccagattcagactctacgaagcactctacaccttccaattcgagcaatccctccgggccccccagccctaactcacctcaccgctcacagctgcccctcgaagggctggaacaaccagcctgtgatacctag

SEQ ID NO: 111498 - DNA, 1593 bp, Artificial Sequence
  Description of Artificial Sequence: Synthetic coding sequence
aaggtgcggcgctcccagaaattggatatgagtgctcggcttgaactgcagtctgctctcgaggcagaaatccgggccaagcagttagtccaggaagagctgagaaaggtcaaagacgctaatctgactttggagagcaagctgaaggacagcgaggccaaaaacagggagctgctggaagagatggagatcctgaagaaaaaaatggaggaaaagttcagagcagacaccgggctcaagctgcctgacttccaagacagcatttttgagtatttcaacaccgctccactggcacacgacctaacttttagaacaagtagcgcatcagagcaggaaacccaagcccctaaacctgaggcctcaccttccatgagcgtggcagcaagtgaacaacaggaacctaaggcacaccagtttagcatcaagtctttctcatctccaacacagtgttctcattgcacctcactgatggtgggactcatacggcagggctatgcctgcgaagtttgtagcttcgcttgtcacgtcagctgtaaggatggagcacctcaggtttgtcccatcccacccgagcaatccaagagacccctcggggttgatgtgcagaggggaatcgggacagcttacaaaggacatgtgaaagtccctaaaccaacaggtgttaagaaaggctggcagagagcatacgctgtggtgtgcgattgcaagttgttcttatatgatctgcctgaggggaagagtacccagcccggggtgatcgcctcccaggtactagatcttcgagatgacgagttctcagtcagctccgttctcgcctcagatgtgattcatgctacgaggagggacataccttgtattttcagagtaacagctagcctcctcggcgccccctctaaaacctccagcctgctcatcctcaccgagaatgagaatgaaaaacgcaaatgggtcggcatcctcgagggcctgcagtccatactgcacaagaaccgcttgcggaatcaagtggtgcatgtcccgttggaggcctatgattcatcgctcccactcattaaagccatattaaccgctgctattgttgacgcggatagaatagccgtcggcctggaagagggcctatatgttatcgaagtgactcgagacgtgattgtgagggccgcggattgcaaaaaagtccaccaaatagagctggccccgcgggaaaaaattgtgatcctattgtgcggcagaaatcaccacgtgcacctctatccatggtcatccctcgatggtgcagaaggcagcttcgatatcaagctgcccgaaacaaaggggtgccagctcatggccaccgctaccctcaaacgtaattccgggacttgcctttttgtcgctgtcaagagactgatcctgtgttacgagatccagcggactaagcctttccatcgaaagtttaatgagatcgtcgctccaggctccgtgcagtgcctggctgtcctgagagaccgactgtgcgtgggatacccctctggtttctgtctgctgtcaatccagggtgatggccagccactcaatctcgtcaatcctaatgatccatccttggcatttctgtag

SEQ ID NO: 111499 - DNA, 4656 bp, Artificial Sequence
  Description of Artificial Sequence: Synthetic coding sequence
atggagcggcgcctaagggccctcgagcagctagcccgtggagaagcaggaggctgtccagggttagacgggcttctcgatctccttctggctctgcatcacgagctcagctccggcccactccggagggagcgttccgtggctcaatttctctcttgggcttcccccttcgtttctaaggtaaaggaactacgtctgcaaagggatgatttcgaaattctgaaggtgatcgggcggggtgcgtttggcgaggttacggtcgtccgacaaagagacacaggccagatattcgcaatgaagatgttgcataaatgggaaatgctgaaacgcgctgagaccgcatgttttcgagaggagcgagacgtgttggtgaaaggtgattcaagatgggtcacgactttgcattatgcattccaagacgaggaatacctctacctggttatggattactacgccggaggcgatcttctaaccctgttgagtagattcgaagatagactgccaccagaactggcccagttctacctagccgagatggtactcgccatccacagcctccaccagctgggctacgtgcatagggatgtaaagccggataatgtgctcctcgatgtaaacggacacattcggctcgcagatttcggtagctgcctccggttgaacacgaatggcatggtagattcttctgtcgccgtcgggactccagattatattagccccgaaatccttcaggccatggaagaggggaaggggcattatggacctcagtgtgattggtggagccttggcgtatgtgcctacgagttactgttcggagaaaccccattctacgccgagagcctggtggaaacttatgggaaaatcatgaatcacgaggaccacttacagttcccccctgatgtgcccgatgtgccagcttctgcccaggacctgatcagacagctgttgtgccgacaggaggagaggctgggaagaggagggcttgatgacttccgaaaccaccctttttttgagggcgtggattgggaaaggttagcatcctctaccgccccttatatacccgaactgcgcggccccatggacaccagcaatttcgacgtcgatgatgacaccctgaaccacccagggacactgccaccaccatcacacggcgctttttcagggcaccacctgccttttgtgggcttcacctacacaagtgggtcccacagcccggagtcatcctctgaggcctgggccgccttagaacgaaaactccaatgcttggagcaggagaaggttgagctgtcgcgaaagcatcaggaagccctgcacgcgcctactgaccaccgcgaactggagcagcttagaaaggaggtccagacgctccgggaccggctgcctgaaatgctgcgcgacaaagcatctctcagtcagactgatgggccccctgcagggtcgcccggtcaagactccgacctacggcaggagttggatcgacttcaccgggaactagccgaagggcgagcaggcttacaagcgcaagaacaggagttgtgcagggcccagggccaacaggaagaacttctgcagcggctgcaggaggcacaggaacgcgaggctgctacagcaagccaaaccagggctctgtccagccagttggaggaggctagagcagcccagagagagctcgaggctcaggttagctccttaagcagacaggtgacacagctgcaagggcagtgggaacagcgcctggaggagtcttcccaggccaaaacaattcacacagcctccgaaaccaacggtatgggcccacccgaaggcggcccgcaggaagcacagcttagaaaagaggtggcagctctgagggagcagctggagcaggcccattcacaccgccctagcggcaaagaagaggctttatgccagttgcaggaggaaaaccgacgactgtcacgggagcaagagagactggaggccgaactggcccaggagcaggagtctaaacagcgactcgagggggagcgaagagaaactgaatcaaattgggaagcacaactcgctgacattttgtcttgggtgaatgatgagaaggtgtctcggggttacctgcaggctttggccaccaaaatggcagaagaattagagtctttgcgcaatgttggtacacagacactccccgccagaccactagatcaccagtggaaagcacggcgtctgcagaagatggaggcgtccgcccggcttgagctgcagtccgcacttgaagcagaaattcgggccaagcagggtctgcaagaacggttaactcaggtgcaggaagcccagctgcaggccgagcgccgtcttcaggaggccgaaaagcaaagccaggcgctgcagcaagaactagcgatgctgcgcgaggaactccgtgctcgcggccctgtcgacaccaagccatctaacagtctgattcccttcctatcgttccgctcctctgaaaaggactctgctaaggaccctggcatcagtggtgaggccactcggcatggtggggagcctgacttgcgaccagaggggcgtaggtccctcagaatgggcgcagtgttccccagggcccccaccgcaaataccgcgtccacagagggtctacctgcaaaacccggctcccacaccctccggccaaggtcctttccttctcccaccaaatgcttacggtgtacctctctaatgctcggactgggccgacagggcctggggtgtgatgcatgcggctacttttgtcatacgacctgtgcgccacaggcacccccatgccctgttccccccgaccttctccgaactgcactgggggtccatccggagaccggaaccgggacggcttacgaagggttcctctccgtcccccggccatctggagtgcgtagaggttggcaacgggttttcgctgcactctctgatagtcggctgcttctgtttgatgctccggatttacggctcagtcctccctctggcgcactcctgcaggtgctggacctgagagacccccaatttagtgccaccccagtgttggcttcagacgtcatccacgcgcagtcaagggatcttcctagaatctttcgggtgaccactagccagctggcagtgcctccaaccacatgcacggtgctgcttctagcggaatccgagggggagcgtgagaggtggctgcaagtgcttggggaactgcaacgtctgcttctcgacgcgcggccccgtcctaggccagtttacactctcaaggaggcctacgacaacggcttaccactgttgcctcacaccctctgtgcagcaatacttgaccaggatcgcctggccctcggaactgaggagggcctgttcgtcatccacctgagaagtaacgatatcttccaagtgggcgaatgccgcagagtccagcagctgacactgtcacctagcgctggcctgctggtcgttctgtgtggacgagggccttctgtaaggctgttcgccctggccgaacttgagaacatagaagtggcgggagcaaagatcccggagtctagaggatgtcaggtccttgcggctggctctatcctacaggcccggaccccggtgctctgcgtggccgttaaaaggcaggtactgtgttaccagcttgggccaggccctgggccttggcaaagacgtattagagagctccaggcccctgcaaccgtgcaatcactggggctcctgggggatcgactgtgtgtcggagcagctggcggttttgccctgtacccgctcctgaacgaggccgcgcccctggctctaggtgctggtctagtacccgaggagctgcctccttcgcgcgggggacttggggaggcattgggagccgtcgagctgagcctgagtgagttcctgctgctgtttaccactgccggcatctacgtggatggggcagggaggaaatcacggggacatgagttactttggcctgccgcccctatggggtggggctacgcagctccctatctgaccgtgtttagtgaaaatagcattgatgtcttcgacgtacggcgggctgaatgggtgcagacagtgccgctcaagaaggtaaggccactgaatccagaaggcagcttgttcctatatggaacagagaaagttagactcacgtatctgagaaaccagttggccgaaaaagacgaatttgatatcccagacctgaccgacaatagccggcggcagttgttccgcacaaaatcaaaacgacggtttttttttagggtgtccgaagagcagcagaaacagcagcggagggaaatgctgaaggatccattcgttaggtctaaattgattagtcctcccacgaattttaaccatttggttcacgtaggccccgccaacggaagaccgggagcccgggacaaaagtcccgctcctgaagaaaagggacgagttgccagggggtcagggccacagagaccgcatagcttttccgaagccctgcgccgtcctgcttctatgggctcagagggcctggggggcgatgccgatcccatgaagagaaagccttggacctctctcagcagtgagtcggtttcttgtccccagggcagcctgagtcccgcgacaagtctcatgcaggtctcggagcgccctcgcagcttacccctaagccctgaactggagagctccccttag

SEQ ID NO: 111500 - DNA, 1176 bp, Artificial Sequence
  Description of Artificial Sequence: Synthetic coding sequence
atgccaggtcctcaaggcggtcgtggcgccgcaactatgtccctaggcaaactaagccctgtgggctgggtttcaagcagtcagggcaagaggaggctgacagcagacatgatctctcaccctcttggggacttccgccacaccatgcatgtgggtagggggggcgacgtcttcggagacacatcttttctatctaatcatggtggctcctcagggtccacacatagatctcctagatccttcctggcaaaaaagctgcagctagtccgtcgcgttggagcgccacctaggcgcatggctagtcccccggctccgtcccctgctcctcccgccatttcacccataattaagaacgccatatctcttccacaattgaatcaggccgcatacgattcactcgtggttggaaaattaagctttgactccagtcctacctcgtccaccgacggacactcctcatatggccttgattctggcttctgcaccatctccaggttgccacgctctgagaaaccccacgacagggaccgagatgggagcttcccctctgagcccgggctcagaagatctgactcgttgctgagttttcgcttggacctggacctcggaccatctctgttatcagaacttctcggagttatgtcgctgccagaagctccagcagccgaaactcccgctccagccgccaatcctcctgcacctaccgcaaacccaacaggtccggctgcgaacccgcctgctactaccgctaacccaccagcacccgctgctaaccccagcgctcctgccgctaccccaactggacccgcggctaacccgccagctcccgctgccagttctactcctcatggacactgccctaacggggtgaccgccggtctcggccctgtcgctgaggtgaagtcctcacccgttggaggggggccaaggggtcccgctggtccagcactgggccggcactggggagcgggatgggatggaggccaccactatccagaaatggacgcaagacaggagcgtgtggaagtattgccgcaagctcgggctagctgggagtccctcgacgaagagtggagggcgcctcaggccgggtcccggactcctgttccttccacagtgcaggcaaacacgttcgagttcgccgacgctgaggaagatgacgaggtaaaggtctag

SEQ ID NO: 111501 - DNA, 183 bp, Artificial Sequence
  Description of Artificial Sequence: Synthetic coding sequence
atgccagggccacagggaggacgcggagctgctacgatgtctctcggcaaattgtcaccagtgggctgggtgagctcttcccaaggaaagcggcgactcactgcggacatgatatcccaccccctgggggattttagacacaccatgcacgttgggagagggggggatgtgtttggagactag

SEQ ID NO: 111502 - DNA, 213 bp, Artificial Sequence
  Description of Artificial Sequence: Synthetic coding sequence
atgccaggcccgcaagggggcaggggagcagccactatgagcttgggaaaactctcccctgtcggatgggtgagttcctcacagggaaaaaggcgcctgacagctgacatgatctctcatcccctgggagacttccgacataccatgcacgtagggcggggcggcgatgtgttcggcgatacaagtttcttgtcgaaccacgggggctcttag

SEQ ID NO: 111503 - DNA, 147 bp, Artificial Sequence
  Description of Artificial Sequence: Synthetic coding sequence
atgcctggcccgcaagggggccgaggagcagccaccatgagcctcggaaaactatcccctgtgggctgggtgagtagcagccagggaaaaaggcgtctaactgctgacatgattagccatccccttggggacttcaggcacacatag

SEQ ID NO: 111504 - DNA, 633 bp, Artificial Sequence
  Description of Artificial Sequence: Synthetic coding sequence
atgagcacaaaggtaccaatttacctgaagcggggttcccgcaagggtaagaaagagaagcttcgggacctacttagttccgacatgattagcccccctttgggggattttagacataccatccacatcgggtccggcggcggctcagacatgttcggagacatctcattcctccagggcaagttccacctgctgcccggaacaatggtggaagggccagaggaagatgggactttcgacctgccttttcagtttacacgaacagctaccgtgtgtgggcgcgaactgccagatggcccatcaccactcttaaaaaatgccatttccctaccggtgattggcggaccacaggcccttactctccctaccgctcaagctcctcccaagcccccaaggcttcacttggagacaccacaaccttccccccaggaggggggatcagtcgacatttggaggataccggagaccggctctcctaatagcggtctgactcccgaatccggcgccgaagaaccgttcttgagtaacgcatcctccctgctttcactgcacgtggacctgggcccgtctattttggatgatgtcctacagattatggatcaagatctagactcgatgcagattccaacatag

SEQ ID NO: 111505 - DNA, 633 bp, Artificial Sequence
  Description of Artificial Sequence: Synthetic coding sequence
atgtccactaaggtgcccatttacttgaagaggggctccagaaagggaaagaaagaaaaactgagggacctattgagctccgacatgatcagtcctccactcggagacttccgtcacaccatccacatcggatccgggggcgggagtgacatgtttggcgacatctcttttctgcaaggcaaatttcaccttctaccaggtacgatggtcgagggtcctgaggaagacggaacattcgatttgccgttccagtttaccaggacagccaccgtgtgtgggcgggagctccccgacggtcctagcccattattaaagaatgcgatcagcctccccgtaattggcggtccccaggccctgaccctcccaacagcccaagcaccccccaagccacctcggctccacctggagacgccccagccttctcctcaggaggggggcagcgtagacatctggaggatccctgaaactggaagtccaaacagcggcctgacacccgagtccggagctgaagagccgtttctgagcaacgcatcatccctgctctctctgcacgttgaccttggtccttccatccttgacgacgtgctgcagatcatggaccaagacttggattccatgcagatccctacatag

SEQ ID NO: 111506 - DNA, 633 bp, Artificial Sequence
  Description of Artificial Sequence: Synthetic coding sequence
atgagcactaaagtccctatttacctgaagaggggtagccgaaagggaaagaaagaaaaactgcgcgatcttttatcaagtgacatgatatcaccgcccctgggtgatttccggcacacgattcacatagggagcggcggtggatccgatatgtttggggatatttcattcctgcagggcaaatttcatcttctgcctggaaccatggtggaaggtccagaagaggatggaactttcgacctgcctttccagttcacccgtaccgccaccgtctgtgggcgggaactgcccgacgggcctagccctctattgaaaaacgcgataagtttgcctgtgattggcggcccccaggctcttacactgcccacggcccaggctcctcctaaaccccccaggctgcatctggaaaccccacaaccatcaccacaggaaggggggtctgtagacatatggaggatccccgagaccggcagcccgaactcaggcctaacacccgaatcaggcgccgaagaaccctttttgagtaacgcctcctccctgctgtccttgcatgtggacctgggcccttcgattcttgacgatgttcttcagatcatggatcaggatctggatagtatgcagattccaacctag

SEQ ID NO: 111507 - DNA, 765 bp, Artificial Sequence
  Description of Artificial Sequence: Synthetic coding sequence
atgcccgcaaaaacacctatatacttaaaggcagctaacaataaaaaaggtaaaaaatttaagctgcgcgatatcctgtcacccgatatgatcagtcctcccttgggggattttagacatactattcatataggcaaggagggccagcacgacgtgtttggggacatttccttcttacagggcaactacgagctccttccgggcaatcaggagaaagcccacctcggtcagttcccggggcataatgagttctttagggctaattctacgagtgacagtgtgtttactgaaactcctagtcccgtgttgaaaaatgctatatctctgccaactatcggggggagccaggccctaatgctgccactgcttagccccgtcacctttaactcgaagcaagagagctttggacctgctaaactgcctaggcttagttgcgaaccagtgatggaggaaaaggcccaggagaaatcttctctcctagagaacggaacagtgcaccagggagacacctcctggggttcttctgggtcggcttcccaatccagccaagggcgcgattcacatagcagttccctgtccgagcagtacccagattggccagccgaagacatgttcgaccaccccacaccctgtgagctgatcaaaggtaagaccaaatcggaagagagcctcagcgacctgacaggatcccttctgtcacttcaactggacctcgggcccagcctcctggatgaagtgttaaacgttatggacaaaaataagtag

SEQ ID NO: 111508 - DNA, 45 bp, Artificial Sequence
  Description of Artificial Sequence: Synthetic coding sequence
atgccagccaaaacaccgatttacttgaaagcggccaacaattag

SEQ ID NO: 111509 - DNA, 108 bp, Artificial Sequence
  Description of Artificial Sequence: Synthetic coding sequence
atgcccgccaaaacaccaatttacttaaaggccgccaacaataagaaaggcaagaaatttaaactgcgcgatatcctgtcccccgacatgatcagcccgcctctttag

SEQ ID NO: 111510 - DNA, 651 bp, Artificial Sequence
  Description of Artificial Sequence: Synthetic coding sequence
atgccagccaagactcctatttatcttaaggctgcaaacaataaaaaaggcaaaaaattcaagttacgcgatatcctatctcccgacatgatttcccctcctctgggcgattttaggcacactatccacatcgggaaggagggccagcacgacgttttcggcgacatctccttcctccagggaaactacgagctgcttcctggcaaccaggaaaaggcacacctgggacagttcccaggacataatgagtttttccgcgcaaacagtacttctgactcagtattcactgaaacaccaagtcctgttctcaagaacgccattagtctgcctactattggaggttcacaggctcttatgctgccattgctatctcccgtgacattcaacagtaagcaggagtctttcgggcctgccaagttaccgcgtctctcctgcgaacccgtgatggaagagaaggcccaggagaagtcatcccttctggagaatgggactgttcaccagggggacaccagctggggctccagtggctcagcctcccagagctctcaagggagagatagtcattcctcatccctttctgagcagtacccggactggccagcggaggatatgtttgaccaccccactccctgtgagctgataaagggttag

SEQ ID NO: 111511 - DNA, 1071 bp, Artificial Sequence
  Description of Artificial Sequence: Synthetic coding sequence
atgcccattctaaaacagctcgtgagctcttcagttcactctaagaggaggtcacgtgccgacctaactgccgagatgatctctgccccactcggagattttcggcatacaatgcatgtgggccgcgccggcgacgctttcggggacaccagcttccttaattcaaaagccggcgagcctgacggagagtctctcgatgaacagccttcgtcctctagtagcaaaagatctctgctctctaggaagttccgcggcagcaagaggagccaatcggttacacggggcgagagggagcagcgggatatgttgggcagccttagagattctgcactcttcgtgaagaacgcgatgagcctcccgcaacttaatgaaaaggaggccgccgagaaggggacatctaagttacccaaatctctcagtagctcccccgtcaaaaaagccaatgatggcgaagggggcgacgaagaagctgggacagaggaggctgttccccgtcgtaacggcgcagctggaccacactcccccgatcccctgctcgacgaacaggcctttggagacctgaccgacctacccgtcgtccccaaggccacctacggcctgaagcacgccgagtccatcatgtccttccatatcgacctgggccctagcatgctgggggatgtgctttccatcatggacaaggaggaatgggaccccgaggaaggtgagggcggataccacggcgacgaaggcgctgccggtaccatcacacaagcgcctccctatgccgtggccgccccccccctcgcgagacaggagggtaaggccgggcctgacctgccttcccttccatcccatgcactcgaggacgaggggtgggctgcggccgctccttctccaggatctgctcgaagcatgggcagccacacaactcgagatagtagtagcctgagtagttgtacctcgggtatactggaggaacgatcacccgcttttcgcgggcctgacagagccagagccgcagtgagcagacagccggacaaagagttcagctttatggatgaggaagaagaggacgaaattcgcgtgtag

SEQ ID NO: 111512 - DNA, 861 bp, Artificial Sequence
  Description of Artificial Sequence: Synthetic coding sequence
atgcctattttaaaacagttggtgtcgtcatccgtccactctaaacgacgatccagagccgacctcactgcagaaatgatctctgcccccctgggtgacttccggcacactatgcatgttggcagagccggcgacgctttcggagacacttccttccttaacagtaaggcagctgagaaagggacctcaaagctgcctaagtcgttgtcctcatcccccgtgaaaaaagctaacgatggcgagggcggcgacgaagaagccggaacggaggaggccgtgcctagaaggaacggtgctgccggcccccactcccccgacccgctgctcgatgaacaggcctttggggacctcactgacctgccagtcgtgcctaaagccacatacgggttaaagcatgccgagtccattatgtcgtttcatatagacctcgggccttcaatgctgggagacgtgttatcgattatggataaggaggagtgggaccccgaggagggcgagggaggctatcatggggacgaaggcgccgctggcacgatcacccaggctccgccctacgccgtggctgccccgcctctcgcaaggcaggagggtaaagcaggccccgatctgccctccttaccaagccacgctctcgaagacgaaggctgggctgcagccgccccctccccagggagcgctagatcaatgggttctcacacaacgagggactcttcctcactgagttcatgtacttccggaatacttgaggaaaggagccctgcattcaggggtcccgatcgtgcgcgtgctgccgtgtcgcggcagcccgacaaagaattttcctttatggacgaagaagaggaagacgagattcgggtgtag

SEQ ID NO: 111513 - DNA, 1551 bp, Artificial Sequence
  Description of Artificial Sequence: Synthetic coding sequence
atgactctcctgattacgggggactccatcgtttccgcggaggcggtttgggaccatgtgaccatggccaaccgcgaactggcgttcaaggcgggtgatgtcattaaggttctggacgcctccaacaaggactggtggtggggccagatagacgatgaagaggggtggtttcctgcatcgttcgttagactgtgggtgaaccaggaagacgaagtggaagagggcccttctgatgttcagaatggccacttagatcctaatagcgattgcttgtgcctgggacgcccgctgcagaatcgtgaccagatgcgcgccaatgtcatcaatgagattatgagcacagaaagacactacatcaaacaccttaaagatatctgtgaaggatatctaaaacagtgcagaaagagaagggatatgttctctgacgagcaactcaaggttatatttgggaacatcgaagatatctacaggttccagatgggcttcgtgagagatttggagaaacagtacaacaatgacgacccccacctttctgaaatcggaccctgcttcctggaacaccaggatggattttggatttatagtgagtactgcaataatcatcttgacgcatgcatggagctgtccaaactgatgaaggactcacggtaccagcatttttttgaagcatgccggctcctgcaacaaatgattgatattgccatagacggatttctcctcacacctgtgcagaagatttgcaagtaccctctccagctagccgagctactcaaatataccgcccaggaccactctgactatcgctatgttgccgctgccctggcagtaatgagaaatgtaacgcagcagatcaatgagcgcaagcggagactagagaatattgataagatcgcccagtggcaggcctctgtactagattgggagggcgaggatatcctcgaccggtcctcggaattgatctacacaggggagatggcctggatctaccagccatacggaagaaaccagcagagggtgttcttcctgtttgatcaccaaatggtgttatgcaagaaagaccttattcgtagggatatactgtactacaaagggaggatagatatggacaagtatgaagtggtggacatagaagacgggagggatgacgacttcaacgtttcaatgaagaatgcatttaaacttcacaataaggagacggaggagattcatctgttcttcgcgaaaaagctggaggagaagataaggtggctcagagcatttcgtgaggagcgtaaaatggtacaggaggatgagaagataggatttgagattagcgagaaccagaagaggcaggctgccatgactgtccggaaagtccccaagcaaaagggcgttaactcagccaggtccgtgccccctagctacccacctccacaagatccactcaatcatggacagtacttggttcccgacgggatcgctcagtcacaggttttcgagttcacagagccaaagaggtcacagagccctttctggcaaaatttttctagattaacaccattcaaaaagtag

SEQ ID NO: 111514 - DNA, 1245 bp, Artificial Sequence
  Description of Artificial Sequence: Synthetic coding sequence
atgcgcgcaaatgtgatcaacgaaatcatgtctactgagcggcattacatcaagcatcttaaagacatctgtgagggttatctcaagcaatgcaggaagaggcgggacatgttttctgacgaacagcttaaggttatcttcggcaatatcgaggacatctaccgttttcagatggggttcgtacgtgatctcgagaagcagtataacaacgacgacccccacctgtctgagatcggtccttgttttctggagcaccaggacggtttctggatctactccgaatactgtaacaaccacctggacgcatgcatggagcttagcaagttgatgaaggacagtcggtaccagcacttttttgaggcctgtagactactccaacaaatgattgacattgccattgacgggttcctactgactcctgtccaaaagatttgcaagtaccccctgcagctggccgagctgctcaaatacactgcccaagatcactctgactatagatatgtggctgccgccctggccgtaatgaggaatgtgacacagcagattaatgagcgaaagcggaggctggagaacattgacaagattgcacagtggcaggcgagtgtcctggactgggaaggcgaagatatcctggaccggagtagtgagctcatttatacaggcgaaatggcgtggatttaccagccttatggaagaaatcagcagcgggtttttttcctttttgaccatcagatggtgttgtgcaagaaggatcttatacggcgggatatcctttactataagggtagaatcgacatggacaagtacgaagtcgtggacattgaagacggaagggatgacgatttcaatgtgagtatgaagaatgcatttaagctacacaataaggagaccgaggagatccacctgttcttcgctaagaagttagaggagaagattagatggctgagggcctttagagaggagcgaaagatggttcaggaagacgagaagatagggtttgaaattagcgagaatcagaagcggcaagcagctatgacagtgaggaaggtacccaagcagaagggggtcaattcagcccgttctgtcccaccctcataccctcccccacaggaccctctgaatcacggacagtatttagtgcccgatgggatcgcccagtcacaagtcttcgaattcacagagcccaagagaagtcagagccctttctggcagaatttcagcagactgactcccttcaaaaaatag

SEQ ID NO: 111515 - DNA, 1488 bp, Artificial Sequence
  Description of Artificial Sequence: Synthetic coding sequence
atggccaaccgggaactggcttttaaggctggggacgtaatcaaggtgcttgatgcctctaacaaagactggtggtggggacaaatcgatgacgaagagggttggtttcccgcctcttttgtcagactctgggtgaatcaagaggatgaagttgaggaaggccctagcgatgtccagaatgggcatcttgatcctaattctgattgcctgtgtctcggacgcccattgcagaaccgggatcagatgcgggcgaatgtgatcaatgaaataatgtcaactgagcgtcattacatcaagcacctgaaggacatttgcgaagggtatttgaagcagtgccgcaaacgtcgggatatgttttccgatgagcaactgaaagtgatcttcgggaacatagaggatatctacagattccaaatgggttttgttagagatcttgaaaaacagtacaacaacgacgaccctcatctgagtgagattgggccctgcttcctggaacaccaggacgggttctggatttacagcgagtattgcaacaatcacctggatgcttgcatggaactgagcaaactgatgaaggacagcaggtatcagcacttttttgaggcctgtagactcctccagcaaatgatcgatattgcaatagatggctttctgcttacgccagtgcagaaaatctgcaagtaccctttacagctggctgagcttcttaagtacacagcccaagatcacagcgattaccggtatgtcgccgccgcattagccgtaatgcgcaatgtgactcagcagattaacgagcggaaacggaggcttgagaacatagacaaaattgcacagtggcaggctagcgtgctggactgggagggggaagacatcttggatcgcagctccgaattgatatacactggagagatggcctggatttatcagccttatggacggaaccagcagcgtgtgttctttttgttcgaccaccagatggtgctctgtaagaaagacttgataaggagagacatcctttattataagggtcgaatcgacatggataagtatgaggtcgttgacattgaagacggacgggacgacgacttcaacgtcagcatgaagaacgccttcaagctgcataataaagagaccgaggagatccatctatttttcgcgaagaaactggaagaaaagatcaggtggctgagggcctttagagaagagcgtaaaatggttcaggaagatgaaaagatcggttttgaaatatcagagaaccagaaacggcaggctgcgatgactgtccggaaggtgccgaaacagaaaggggtgaactcagctaggtccgtgccaccaagctacccacccccccaggaccctctaaaccatggccagtatctggttccggacggaatagcccagtctcaggtgttcgagttcacagaacccaaaagatctcagtccccgttttggcagaatttctcacgcctgactccctttaaaaaatag

SEQ ID NO: 111516 - DNA, 1437 bp, Artificial Sequence
  Description of Artificial Sequence: Synthetic coding sequence
atgctcattaccggagattctatagtgtcagccgaggctgtctgggaccatgtcactatggcaaatagagaactggcatttaaagctggcgatgtgatcaaggtgttggacgcatccaacaaagattggtggtggggacagatagacgatgaagagggttggttccctgcatcatttgtgaggctttgggtgaaccaggaagacgaagttgaagaagggccgtcagatgtgcagaacgggcatctcgacccaaatagtgattgcctgtgtctgggaagacccctgcaaaatcgcgaccagatgcgtgccaacgtgataaacgagatcatgtcgaccgagaggcactatatcaagcatttgaaagatatttgcgaagggtacctgaaacagtgtcggaagcgccgggatatgttttccgacgagcagctgaaagtgatctttggcaacattgaggacatctatagatttcaaatgggatttgttcgagacctggaaaagcagtacaacaacgatgacccgcacctcagcgagattggaccttgctttctggaacaccaggacggcttttggatatactcggagtattgcaataaccatctcgacgcttgtatggagctatcaaaactgatgaaggacagccgataccagcattttttcgaagcctgtcggctgctccagcagatgattgatattgccatcgatgggttcctccttacacctgtacaaaagatctgtaagtaccctttgcaacttgccgagctactgaagtataccgcacaggaccatagtgactaccgctacgtggccgcggcgctcgccgttatgcggaacgttacacaacaaattaacgaacgcaagagacggttggagaatattgacaaaattgcccaatggcaggcctcggttctggactgggagggcgaggacattctggatcgaagctccgaactcatctatactggcgaaatggcctggatctaccagccttatggcagaaatcagcagcgcgtctttttccttttcgatcatcaaatggtgttatgcaaaaaagatctcattaggagagatattctttattataaaggcagaatcgatatggataagtatgaagtcgtcgacatagaggatggcagagacgacgacttcaacgtgtcgatgaaaaatgcatttaaactccataataaggagactgaggagattcacttgttcttcgctaaaaaactggaggagaaaatcagatggcttagggctttccgcgaggagcggaaaatggtccaggaggacgagaagatcggcttcgaaatcagcgagaatcagaaacggcaggccgccatgaccgtacgtaaactgcccttcccacagctgtcggaagccaggatctgcagccctaaagggtttgcctctgtgtttaacgggacatgttgcggcgaatcttag

SEQ ID NO: 111517 - DNA, 732 bp, Artificial Sequence
  Description of Artificial Sequence: Synthetic coding sequence
atgatcgacattgctatagatgggtttctgctgacaccagtgcaaaaaatttgtaagtacccattgcaactcgctgagctgcttaagtatactgcccaagatcattcggattatagatacgttgctgcggccctcgccgttatgagaaacgtaactcagcagatcaatgagcgaaagcggaggctcgagaacattgacaagatcgctcagtggcaggcttctgttctggactgggaggatctgattaggcgggatattctctattataagggtcgcatcgatatggataagtacgaagtggtggatatagaagatgggagagacgacgactttaatgtgtccatgaaaaacgcatttaaattgcataacaaagaaaccgaagaaatccatctctttttcgccaaaaagctggaggagaagatcaggtggcttcgggcctttcgagaagagagaaaaatggttcaggaggacgagaagatagggtttgaaatttctgagaatcagaagcgccaggcagctatgactgtgcgcaaagtgcccaagcagaaaggggtgaacagcgcacggagcgttcctccctcctacccaccaccccaggaccccctcaaccatggtcagtatctggtgccagacggcatcgctcagagtcaagtctttgagtttacggagccaaagcggagccagtcgcctttttggcagaattttagcagactcacaccttttaagaaatag

SEQ ID NO: 111518 - DNA, 1392 bp, Artificial Sequence
  Description of Artificial Sequence: Synthetic coding sequence
atgcagtggattagaggtggttccggaatgctctgggtcaaccaggaggacgaggttgaggaaggccctagtgacgtccagaacggccatctggacccaaactctgactgtctatgtcttggccgacctctccaaaaccgcgaccagatgagagccaacgtaattaatgagatcatgtccactgaaagacattatatcaagcatctgaaggacatctgtgaaggctacctcaagcagtgtaggaagcgtcgggacatgtttagtgacgaacagctaaaggtgatttttgggaatatagaggatatttatcgatttcagatggggttcgtaagagacttggagaagcaatataacaatgatgatcctcacctgtctgagatcggcccctgcttcttagagcaccaagatggcttttggatctattctgagtactgtaacaatcatctcgacgcttgcatggaattaagtaagctcatgaaagactcacggtaccagcacttttttgaggcttgccgcttactgcagcagatgatcgatattgccatcgacggattcttgctcacacctgttcagaaaatttgtaagtatcccttgcagctcgccgagttactcaaatacactgctcaggaccattctgactacagatatgtggccgcggctttggcagtgatgcgaaatgtgacccagcagatcaatgagcggaagagaagattggaaaacatcgacaagatagctcagtggcaggcctccgtgctggattgggaaggggaagacatactggatcggagtagtgagctaatctatacaggagaaatggcctggatctatcagccctacggtaggaaccagcagagagtgttcttcctgttcgatcatcagatggttctctgtaaaaaggatctgatcagacgcgacattctgtattacaaaggtcggatcgacatggacaagtacgaggtggtcgatatagaagatggacgcgacgatgactttaacgtgtccatgaagaacgcctttaagctgcataataaggaaaccgaggaaattcacctattcttcgccaagaaactcgaggagaaaatacgctggcttagagcattccgagaagaaaggaagatggtgcaggaggatgaaaaaatcggctttgagataagcgagaaccagaaaagacaggccgcgatgactgtgcggaaagtgcctaaacaaaaaggcgttaatagcgcccggtcagtgccaccatcatatccacctcctcaggatccgctcaatcacggtcagtatctcgtccctgacggcattgcccagtcccaggtcttcgagtttaccgaacccaagcgctctcagtcacctttttggcagaatttcagccgccttacaccatttaagaaatag

SEQ ID NO: 111519 - DNA, 2409 bp, Artificial Sequence
  Description of Artificial Sequence: Synthetic coding sequence
atgcctcggattatgataaagggcggagtctggaggaatacagaggacgaaatcctcaaagccgccgtaatgaagtatggtaaaaaccagtggtccaggatcgcttctctccttcatcgaaaaagtgctaaacaatgtaaagcccggtggtatgaatggctggacccatccattaaaaagaccgagtggtcccgcgaggaggaggagaaacttctgcacctggcaaaactcatgcccactcagtggcggacaatcgccccgattattggcaggaccgccgcccagtgcctggagcactatgagttccttttagacaaggctgcccagcgtgacaacgaggaagagaccaccgacgaccctaggaaattgaaacccggcgaaatcgatcccaaccccgaaacaaagccggcaagaccagatcccatcgacatggacgaggacgaacttgagatgctgagtgaggctcgcgcacggctcgcaaacacacaagggaagaaggccaagcggaaggcgcgcgaaaaacagctggaagaggccagacgtctggcagccttgcagaaacggagagagcttcgggcagcaggaatagagatccagaagaaaaggaagaggaagcgtggagtggactataatgctgagattccatttgagaagaagccggccctcggcttctacgatactagcgaggaaaactaccaagcgctggacgccgacttccgcaaactgaggcaacaggatctagatggagagctgcgatctgagaaagaagggagggaccgtaaaaaggataagcaacacctgaagagaaaaaaggagtccgacctgccctctgctatccttcagaccagcggggtttcagagttcaccaagaagaggtctaaacttgtgttgcccgcaccgcagatatcagacgccgaactccaggaggtcgttaaggtaggccaggcctctgagatcgccagacaaacggccgaggagtctggaatcaccaattcagcctcatcaacactgctgtccgagtataacgtaaccaataacagtgtggctctccggactccccgcacacctgcgtcccaggataggattttgcaggaggcacagaatttaatggccctaaccaatgtggacaccccccttaaaggcggacttaacacgccactgcacgaaagcgacttctccggagttaccccccagcgccaggtggtacagacaccaaacactgtactctctacgccctttagaacgcctagcaatggggctgaaggcctgacacctcggtccgggactacaccaaaaccagttattaattcgacacccggcagaactcccttacgagacaagttaaacattaatccagaagacggtatggccgactactccgatccttcctatgtcaaacaaatggaaagagaatctcgtgagcacctacgactcggactcctggggcttccagcccctaaaaatgactttgaaatcgttctccccgagaacgccgaaaaggaattggaagagagagagatcgacgatacatacattgaggatgcggccgacgtggacgcccgcaagcaagcaattcgggatgccgaacgtgtaaaggagatgaaacgtatgcataaggctgtgcagaaagatttgccccgcccgtcagaggtaaacgagacaatactgcgccccttgaacgtcgaaccacccctgaccgacctgcaaaagagcgaagaactaatcaagaaagagatgatcaccatgctgcactatgatcttctccaccatccatacgagccctctgggaacaaaaagggtaaaactgtgggcttcggaacaaacaattcggagcacatcacctatttggagcacaatccatatgaaaaattctctaaggaagaattgaagaaagcacaagacgtcttggttcaggaaatggaagtggtcaagcagggaatgtcacatggtgaactgagcagcgaagcctacaatcaggtgtgggaagagtgttacagtcaggtcctgtatctcccgggccagtcgcggtacacaagggccaaccttgcttcgaaaaaagatagaattgagagtctggagaaaaggctcgagatcaaccgcggccatatgactaccgaagcaaaacgcgccgccaagatggagaagaaaatgaaaattctgctcggcggctaccaatccagggcgatggggcttatgaaacagttgaacgatctgtgggatcagattgaacaggcccacctggagcttaggacttttgaagagctgaagaaacacgaagatagtgccatccctaggcgattagagtgcctgaaggaggacgtgcaacgccagcaggaacgcgagaaggagctgcaacacaggtacgccgaccttctgttagaaaaggaaactctgaagtctaagttttag

SEQ ID NO: 111520 - DNA, 1455 bp, Artificial Sequence
  Description of Artificial Sequence: Synthetic coding sequence
atgcggcactctaaaaggacctattgtcccgactgggatgataaggactgggactatggcaagtggcggtcgtcatcctcacacaaacgcaggaaaagaagccactcttcagcccaggagaacaagcgctgcaaatataaccattccaagatgtgtgattctcactacctggaaagcaggagcattaatgagaaagactaccattcgagacgatacattgacgaatacaggaatgattacacacagggctgtgaacccgggcacaggcagcgtgatcacgaatctcggtatcaaaaccactcaagtaagtcaagcggacggtctggccgtagctcctacaagtcgaagcaccggattcaccatagtacatctcatcgcagaagccacggcaagtcccatcgcagaaagcgtacccgctctgtcgaagatgatgaagagggacatcttatttgtcagtcgggggacgtgcttagtgcacgatacgagattgttgacacccttggggaaggcgccttcggaaaggtggtcgagtgtatcgatcataaggccggcggtaggcacgtggccgtgaagatcgtgaagaacgtggaccgatattgtgaagctgctaggagcgaaattcaggtgcttgaacatcttaacaccacagaccctaacagcacgtttcgttgcgtccaaatgctggagtggttcgaacaccacggccatatttgcatcgtgttcgaattgctagggttgtcaacttacgattttattaaggaaaatggcttcctgccctttaggctggatcatattagaaagatggcatatcagatctgcaagagcgtcaactttctgcactccaacaagcttactcacacagacctgaaacccgaaaatatcctgtttgtgcaaagtgattacactgaggcatataatcctaaaatcaaacgggacgaacgcaccttaataaatcctgatattaaagttgtggactttggctctgcaacctatgacgacgagcatcattccactctcgttagcacgcggcactaccgggcccccgaggtcatcctggccctgggttggagtcaaccttgcgatgtgtggtccattggttgcattttgatcgaatactatttagggttcaccgtgttccctactcacgattccaaggagcacttagcgatgatggagagaatcttaggcccactgcccaagcatatgatccagaaaacacgcaaaagaaagtatttccatcacgacaggctcgactgggatgagcattcatctgcagggaggtacgtctcccgccgctgtaaaccactgaaggagtttatgctgagccaagatgtcgaacacgagcggctgttcgacctcatccaaaaaatgctcgagtatgaccccgctaagcggatcactctgcgagaagctctcaaacaccctttttttgatttactgaagaagtccatctag

SEQ ID NO: 111521 - DNA, 1365 bp, Artificial Sequence
  Description of Artificial Sequence: Synthetic coding sequence
atgaggcacagcaaaagaacatattgtccggattgggacgataaggactgggactatgggaagtggaggagttcaagctctcataagcgtcggaaacgttcacacagctcggctcaggagaataagcgctgtaaatacaatcattcaaaaatgtgcgattcacattatctggaatccagatctattaacgagaaagattatcactcacgaaggtacatagatgagtaccgcaacgactacacgcagggctgcgaaccaggacatagacagcgcgaccacgaaagcaggtatcagaatcacagcagcaagtcatctggcagatccggaagatcctcctataagtccaagcacaggattcaccactccaccagccacaggagatcacacggtgatgagatcgtggataccctcggggaaggcgcatttggaaaagtagtcgaatgtattgatcacaaagccggagggcggcatgtagccgtgaaaatcgtcaagaacgtcgacaggtattgtgaagcggcaaggtctgaaatacaggttctcgaacacctcaacacaacagatcccaacagcaccttcagatgtgtgcaaatgctggagtggttcgaacatcatggacatatctgcatcgtttttgaattactggggctgtctacctacgactttatcaaggagaacggcttcttacctttcaggctggatcacatcaggaaaatggcgtatcagatctgcaagtctgtcaattttctgcactcaaataaacttacacatacggatctgaaacctgagaatatcctttttgtacagtccgactatactgaagcttacaatcccaaaataaaacgtgatgagcggacgttgataaatcctgatatcaaggtcgtggacttcggttccgccacttatgatgacgagcaccactctactctggtctccacaagacactacagagccccagaagtgattctggccctgggatggtctcagccttgcgatgtgtggagcatcggatgcatactgatcgagtactatttgggcttcacagtctttcctacccatgatagcaaagagcacttagccatgatggaaaggatattgggtccccttcccaagcatatgattcaaaaaactcggaaacgcaagtattttcatcacgatagactggactgggacgaacattccagcgcaggaagatacgtgtctcggagatgcaagcccctgaaggagtttatgctgtcgcaggacgttgaacacgagcggctgttcgacctgatacaaaagatgctggagtacgatcccgcgaagaggatcaccctgcgagaagcattgaagcacccatttttcgatctcctgaaaaaaagcatctag

SEQ ID NO: 111522 - DNA, 1581 bp, Artificial Sequence
  Description of Artificial Sequence: Synthetic coding sequence
atggcagccggcaggcggccagcgtctgcactgtggccagagaggcggggctcccccctccgaggggatctcttaggatttcagaacgtccgggaacccagttcctgcggggagactctgtccgggatgcgacactccaaaaggacgtactgccccgactgggacgacaaggactgggactacggtaaatggcgctcctcctccagccacaaacgtcgaaagcgctcccattcctcagctcaggagaacaagcgctgtaaatataatcatagcaagatgtgtgacagtcattatctggaaagcaggtcaatcaatgagaaggactaccattcaaggcgctacatcgatgaataccggaacgattatacacagggctgtgagcccggacatcggcagcgcgaccacgagtcacgttaccagaatcactcgtcaaaatcctccggccgctcaggccgaagctcatacaaaagcaagcacagaatccatcacagcacgagccaccgaagaagtcatggaaaatcgcaccgccgtaagagaacgagatctgtcgaagacgacgaggagggacatttaatctgccagtcgggcgatgttctctcagcccgttacgaaatcgtcgatacacttggcgaaggggccttcggtaaagtggtggagtgcattgatcataaagcaggaggaagacacgtggccgttaaaattgttaaaaatgtagataggtactgcgaagcggctagatctgagattcaggttctggagcacctgaatacaacggatcctaatagcacctttcggtgtgtgcaaatgctcgaatggttcgagcatcacggtcacatctgtatcgtgttcgagctattgggcctgagtacatacgatttcataaaggagaatggcttcctcccatttaggttagaccacatcaggaaaatggcctaccagatttgcaaaagcgtgaactttcttcatagcaataaactgacccatacggatctaaaacctgagaatatattattcgtccagtctgactatactgaggcctataatccaaagatcaaacgggatgaacgaactctgataaatcccgatattaaagtggtggatttcggcagcgctacctacgacgacgaacaccacagtacgttggtcagtactcgccactacagagcccctgaagtgatcttggctctgggctggtcccagccttgcgacgtgtggagtatcggctgtatactcattgagtattatcttggatttaccgtcttcccgacacacgatagcaaggagcacctcgcaatgatggagcgcatcttgggcccgttaccgaaacacatgatccagaaaaccagaaagcgtaagtacttccaccacgatcgcttggattgggatgagcactccagtgctggcagatatgtgagcaggcggtgtaagccccttaaggaattcatgctgtcccaggatgtggaacatgaacggttgtttgaccttattcagaagatgttggagtatgaccctgctaagaggataaccttgagagaagccttgaaacatccatttttcgatctactcaaaaaatctatctag

SEQ ID NO: 111523 - DNA, 1494 bp, Artificial Sequence
  Description of Artificial Sequence: Synthetic coding sequence
atgcctcacccgcgtcgataccactcttccgaaaggggttcgcgtggtagttacagggagcactaccgttctcgcaagcataaaagaagaaggagtcgttcctggagctcatcatctgatcggaccagacgcagaagacgtgaggattcctaccacgtccggtctagaagttacgacgaccggtcctctgatcgtcgggtgtatgacaggaggtattgcggaagttataggcggaatgattacagtcgggacaggggcgacgcgtactatgacacggactacaggcactcttatgagtaccagcgtgagaatagtagttatagatctcagcgcagttcaagaagaaagcatagaaggcgccgacgacggtcccggacattcagtagaagcagttcccattcttctagaagggccaagtctgtcgaagacgatgcagaagggcatctcatatatcacgtgggggattggctccaggaacggtacgaaatcgtgtctacgctgggcgaggggacattcggccgcgtggtgcaatgtgtagatcatcgacgcgggggggcaagggttgcgctcaaaattattaaaaacgtggaaaagtacaaggaagcagctaggcttgagatcaacgtccttgaaaaaattaacgaaaaggacccagataataagaacctctgcgtccagatgtttgattggtttgattaccacgggcatatgtgcatttcttttgagctgctgggcttgtctacctttgatttccttaaagataataattacctcccgtaccctattcaccaggtgcggcatatggcttttcaactgtgccaggccgttaagtttcttcacgataataagctgacgcacaccgacctgaagcctgagaacatactcttcgtgaatagtgactacgagctgacatataacctggagaagaagcgggatgaacggtccgtcaagtctactgccgtcagagtagtggactttggatcagctaccttcgatcatgagcatcattctactatcgtgagcacccgccactacagggcgcctgaggtaatcttggaacttgggtggagtcagccatgtgacgtgtggtcgattgggtgcataatattcgaatattatgttggatttacacttttccaaacccacgacaatagagaacatctagctatgatggagcgaattttagggcccatcccttctcgcatgattcgtaagactaggaagcagaagtatttctatcgggggcgtctcgattgggacgaaaacacctccgccggtagatacgtgcgcgaaaactgcaagcctcttagacgctatctgacgtcggaggcagaagaacatcatcagctgtttgatctgatagaatcaatgttagaatatgaacccgccaagcgtctcacactcggcgaagcactgcaacaccccttcttcgcacgattaagggccgagcccccaaacaagctgtgggacagcagcagagatatctcaagatag

SEQ ID NO: 111524 - DNA, 1497 bp, Artificial Sequence
  Description of Artificial Sequence: Synthetic coding sequence
atgcctcatccacggcggtaccactcctcagaacgcgggtcaaggggaagctatcgcgagcactaccgcagcagaaaacataaacgtcggaggtcgcggagctggtcgtcgtctagtgataggacaagaagacgccgtagggaggactcctatcatgtgaggagccgatcaagctatgacgatcgatcttccgacagacgggtgtatgaccgtcgttattgcggtagctatagaaggaacgactattcccgtgaccggggagatgcatattatgacacggattatcgacacagttacgagtaccagcgcgaaaatagttcttacagaagccagagatctagcagacggaagcataggcgccgcagaaggcgctcgcggacgttctcaaggtccagctcccacagcagcagacgcgctaagagcgtggaggacgatgctgagggccacttaatttatcatgtgggagactggctgcaggagcgctacgagatcgtgagcacattgggcgagggtacatttggacgcgttgtgcaatgtgttgatcatcgccgagggggcgcaagagtcgcccttaaaatcattaaaaacgttgagaagtataaggaagcggcacgcttggagattaatgttttggaaaagatcaacgagaaagacccggataataagaacctgtgcgtccaaatgtttgactggtttgactaccacggacatatgtgcatctctttcgagttgctgggactatccacgttcgatttcctcaaagacaataattatctgccatatccaatacaccaggtgaggcacatggcctttcagttatgtcaggcagtcaagtttctgcacgataacaagctaacccataccgatctcaagccagagaatattctgttcgtcaattctgactatgagctgacctacaatttggagaagaagcgtgatgagcgctcagtcaagtccacagcagtcagagtcgtagattttgggtctgccacattcgatcacgagcaccatagtacaatcgtctccactcggcactatagagctccagaagtgatcttggaattaggctggtcccagccctgtgatgtgtggagcatcggatgcatcatattcgaatactatgttggcttcactttatttcagacacatgataacagggaacatctggccatgatggagagaattctgggaccgataccatctcggatgatcaggaagaccaggaagcagaagtacttctacaggggccgattggactgggatgaaaacaccagcgccggacgttatgtgcgcgaaaattgcaaacccctccggcgatacctaacaagtgaggccgaggagcatcaccagctgttcgatctcatcgagagcatgctggagtatgaaccagcaaagcgtctcactctaggggaggcacttcagcacccgttttttgcccggctcagagccgagccacctaataaactttgggactcctctcgcgatatctctcgctag

SEQ ID NO: 111525 - DNA, 1500 bp, Artificial Sequence
  Description of Artificial Sequence: Synthetic coding sequence
atgcctcatccgcgacgataccacagctctgagagggggtctcggggtagttacagagaacactaccgctctcgaaagcataaacgcaggaggtcgcgcagttggtcttctagttcggatcggactcggaggaggcgcagagaggattcttaccacgtgcggagcaggtcgagttatgatgataggtcttctgacagaagagtctacgatagacgatattgcgggagttataggagaaacgattactcccgagatcggggtgatgcatactacgacaccgactacaggcactcgtacgaatatcagcgtgagaactcctcatatcgatcacaacggtccagcaggcggaagcatcgacggcggcggagaaggagccgaacgttttcacgatcttccagtcaacattcctcacggcgggctaaatcggtggaagatgatgcggaagggcacctaatctaccatgttggagactggctccaagaaagatatgaaattgtttcaacactcggcgaggggacatttgggcgggtggtgcagtgcgtcgatcacaggcgggggggcgccagggttgctctcaaaattatcaagaacgtggagaagtacaaggaagccgccaggcttgaaatcaatgtgctggagaaaatcaatgaaaaagaccccgataacaaaaacctgtgcgttcagatgttcgattggtttgattaccatggccatatgtgtattagttttgagcttctcggcttaagcaccttcgatttcctgaaggataacaattacctgccgtatccaatccaccaggtgaggcacatggcgttccagctgtgccaagccgtcaaattcctacacgacaataaactcactcacaccgatctaaagcctgaaaacattctgtttgtcaatagcgattacgagttaacgtacaatctggaaaagaagagagacgagaggtcagtgaagtcaactgctgttagggtcgtcgatttcgggtccgccacatttgatcacgagcaccacagcactattgtctccacccggcactaccgagcccccgaggtcatcctcgaactgggctggtctcagccttgcgacgtttggagtataggatgtataatttttgagtactacgtcgggttcacactgtttcagacacacgacaacagagagcacttagccatgatggaaaggattctgggccctatccctagccggatgattcggaaaacgcggaagcagaaatacttttaccgtggcaggctagattgggatgagaacacgtcagccggccggtacgtgagagagaactgcaaacccctgcggagatatcttacatcagaagccgaggagcatcatcagttgttcgatctgattgaaagcatgctggagtacgaaccggccaaacggctcacactgggagaggcactccagcatcccttctttgcccgcctcagggctgagccccccaacaagctatgggactcatcacgggatatctctcgctag

SEQ ID NO: 111526 - DNA, 816 bp, Artificial Sequence
  Description of Artificial Sequence: Synthetic coding sequence
atgttcgattggtttgactaccacggccacatgtgtatatcattcgagctcctaggattatcgacattcgacttcctaaaggacaacaactacctcccttatcccatccaccaggtaaggcatatggcttttcaactatgtcaggcggtcaagttcctgcacgataataaattaactcatacagacctgaagccagaaaatatactctttgttaattccgactacgaactgacatacaacttagagaaaaagagagacgaacggagcgtcaaatccacggcagtgagggtggtcgatttcgggtcagctacgttcgatcacgaacaccactccacaatagtgtctactaggcactacagggctcctgaggtcatcctggaactcggatggagccagccatgcgatgtctggtccatcggttgcatcatattcgagtattatgtcggatttaccttgtttcagacacatgataatcgggaacacctggcaatgatggagaggattcttggtcccatcccatcccgcatgattcgcaagactcggaagcaaaaatacttctaccgtggacgcttggattgggacgagaatactagtgctggcagatacgtgcgggaaaactgtaaaccacttagacgatacctcacctccgaggccgaggagcaccaccagctcttcgatctgatagaaagcatgctcgaatacgaaccagccaagagactgaccctgggcgaggccttacagcatcccttctttgctcggctacgcgccgagccccccaacaagctgtgggattcttccagggacataagcagatag

SEQ ID NO: 111527 - DNA, 1500 bp, Artificial Sequence
  Description of Artificial Sequence: Synthetic coding sequence
atgccccacccccgcagatatcacagctctgagaggggatcacgaggatcttaccgcgagcactatcgatctcggaagcacaagcgcagacgaagtcgcagttggtcctcatcttccgaccggaccagaaggcgaagaagagaagattcatatcacgttagaagcagatccagctacgacgacaggagttccgataggcgtgtgtatgataggcggtactgtggttcataccgacgcaatgattattcccgtgacaggggtgatgcttattatgataccgactaccgccatagctatgagtaccagagggagaattcctcatatagatctcagcgctcttcccgccggaaacataggaggagaagaaggcggtcacgtacgttttctcgctcctctagtcaacattcctcccggcgcgcaaaatctgtggaagatgacgccgaaggacacctgatctatcacgtgggcgactggctacaggagcggtacgaaatcgtgagcacgctgggcgagggcaccttcggccgggtggtgcagtgcgtggaccaccgcagaggaggagctagagtagctttgaaaattattaaaaatgttgagaagtacaaggaggcagcaagactggagatcaacgtgctagagaagattaacgagaaagaccctgacaacaagaacctatgcgtccagatgtttgattggtttgactaccacggccatatgtgcattagcttcgaactccttggactgtctacatttgatttcctaaaggacaacaactatcttccataccccatccaccaggtccggcatatggcattccagctttgccaggcagtcaagtttttgcacgacaataaactaacacataccgatttaaagcctgaaaacatcttgtttgttaatagcgattacgagctgacctataatctggagaagaagcgcgacgagagatcagtgaagtctaccgccgtgcgcgtcgtggacttcggcagtgctacatttgaccacgaacaccattccaccatagtgtccacacgacactaccgtgcccccgaggttattctggagcttgggtggagccagccttgtgacgtctggagcattgggtgcatcatcttcgagtactacgttgggttcacactctttcagacgcacgacaaccgggagcatctggcaatgatggaaaggattctggggcctatcccaagtcggatgattagaaaaactcgcaaacagaagtacttttaccgcggtcgactggattgggacgagaacacctccgcaggccggtacgttcgggagaactgtaaacccctgcgaagatacctcacgtctgaagcagaagaacaccaccagctttttgatctgatcgaaagcatgctggaatatgagcccgccaagcggttaactctgggggaggccctccaacatccatttttcgctcgcctcagagccgaacccccgaacaagctgtgggatagttctcgcgatatttcacggtag

SEQ ID NO: 111528 - DNA, 1473 bp, Artificial Sequence
  Description of Artificial Sequence: Synthetic coding sequence
atgcaccactgcaaaaggtatcggagtcccgagcccgacccttacctctcataccgctggaaacgtcgccgctcttactcccgggagcacgaggggcgcttgagatacccctcccgccgggagccaccacctcggcgatcccgcagccgctcccacgacaggctcccctaccagaggaggtacagggagcggagagattccgacacgtaccgctgtgaagagaggagcccctccttcggagaagattactatggcccatcccggagtaggcatagacgcaggtcccgcgagaggggcccatatagaactaggaagcacgcccatcattgtcataagcgacgcactcggagctgttccagtgcaagcagccgaagtcagcagtcctcaaagcgaagttcccgcagtgttgaggatgataaggaaggtcatctcgtgtgcaggataggggattggttacaagagaggtatgaaatcgtcgggaacctgggtgaaggaaccttcgggaaggtggtggagtgtcttgaccatgcccgggggaagtcgcaggtggccttaaaaatcatccgtaatgtgggcaagtatagggaggcagctcggcttgaaattaacgtgctgaagaaaatcaaagaaaaagataaagaaaataagtttctgtgcgtgctcatgagcgactggtttaatttccacggtcacatgtgtattgctttcgaattgcttggaaagaatacattcgagttccttaaggagaataactttcagccttaccctcttcctcacgtccggcacatggcataccagctgtgtcatgccctcaggttcctgcacgagaaccaactcacacacaccgatctcaaacccgaaaacattctgttcgtgaattctgagttcgaaaccctgtataatgaacacaagtcctgcgaggagaagtctgttaagaacacatccattcgagtggctgacttcgggagtgccactttcgatcacgaacaccacaccaccattgtcgccacgcgacattatagaccccccgaggttatcctcgagttggggtgggctcagccttgcgatgtttggtccatcggctgcatactcttcgaatactatcgcggtttcactctgtttcagactcatgagaacagagagcaccttgtgatgatggagaagatcctagggccaatcccatctcacatgattcatcgcaccaggaagcaaaaatacttttataagggaggcctggtttgggacgaaaatagttcggatgggcgctatgtgaaagagaattgtaaacccctaaaatcttacatgctccaggacagtttagagcatgtgcagctttttgatctgatgcgcagaatgttggagtttgaccccgcgcagcgtatcactttagctgaagctcttctacaccccttttttgcaggccttacaccggaggaacgaagcttccacacctcaagaaatccttctcgctag

SEQ ID NO: 111529 - DNA, 459 bp, Artificial Sequence
  Description of Artificial Sequence: Synthetic coding sequence
atgcaccattgtaaaaggtaccggagcccggagccagatccatatctgtcgtaccgctggaagaggcggcgaagttactccagggagcacgaggggcgacttagatacccatccaggagagaacctcccccccggcgcagcagatccagatcacatgataggctaccataccagcgtcggtatcgggagcgaagagactctgacacctaccggtgcgaggagcgctctccatctttcggcgaggactactacggtccttctaggtccagacaccggcgtaggtctagggaacgcgggccataccgcacgagaaaacatgcccatcactgccacaaaaggcgcacacgctcgtgtagtagtgccagcagtatgaggctgtggggcacctgggtcaaggcccctctcgcacggtggtggtctgcctggactatgccagagggaagcctgcgccttccatag

SEQ ID NO: 111530 - DNA, 1404 bp, Artificial Sequence
  Description of Artificial Sequence: Synthetic coding sequence
atgcatcattgcaaacggtaccggtctcctgaaccagacccctacctttcctatagatggaagaggaggcgttcctattctagagagcacgagggaaggctcagatacccatccaggagagaacctccccccagaaggtctcgaagtagaagccacgatagattgccataccagcgtcgctacagagaaagaagagactcagacacctaccgctgtgaggagaggagtccaagctttggcgaagactactatgggccgagccgctccagacatcgcagaagatctcgggaacggggcccataccgaactcggaagcatgctcatcactgccataagcggagaaccagaagctgctcaagtgcttctagccgaagccagcagtccagcaagcgctcttccaggagcgtcgaggacgacaaggaaggtcatctcgtctgccgtatcggggattggctgcaagagcgctggaagagtcaagtcgcactgaaaatcataaggaatgtgggcaagtacagggaagctgctagactggaaataaacgtgctaaagaaaatcaaagagaaagacaaagaaaacaaattcctgtgcgtcctcatgtccgactggttcaactttcatggacacatgtgtatcgcgtttgagcttttaggtaagaatacctttgagttcttgaaggaaaacaattttcaaccgtacccgctcccccatgtgagacacatggcctaccagctctgccatgctctgcggttcttacatgagaatcagctcactcacacggacctgaagccggagaacattctgtttgtcaacagcgagttcgagactctctacaatgagcacaagtcttgtgaggaaaaatctgttaagaacacctcaatcagggtagctgacttcggaagcgcaaccttcgaccacgagcaccacaccacaattgtggccacaagacattacagacctcctgaagtgattctggagctcggatgggcccagccctgtgatgtgtggagcattggctgcattctattcgaatattatcggggtttcactctgtttcaaacgcatgagaatagggagcaccttgtcatgatggaaaaaatcttgggccccatccctagtcatatgatccataggaccaggaagcagaagtatttttataaaggaggcctcgtgtgggacgagaactcatccgacggccgttacgtgaaggagaactgtaagcccctgaaaagctatatgttgcaggattccctggagcacgtccagctcttcgatcttatgaggaggatgctggaatttgaccccgcccagcgtattactctggccgaggcccttctgcacccgttttttgccgggctgaccccagaagagcgtagttttcacacaagcagaaatcctagtaggtag

SEQ ID NO: 111531 - DNA, 1473 bp, Artificial Sequence
  Description of Artificial Sequence: Synthetic coding sequence
atgcaccattgcaagaggtaccgctctccggagcccgacccatatctttcctatcggtggaagagaaggaggtcgtactctcgggagcacgagggccggctgagatacccaagccgccgggagcctcctcctcgacggtctcgtagccgcagtcacgacaggttaccctatcagaggagataccgagagaggcgcgactcagatacgtacagatgtgaagagcgctcaccctcgtttggtgaggactactatgggccaagtagaagcaggcacagacggaggtctcgtgaacgagggccctaccgcacccggaaacacgcccaccattgtcacaagaggcgaactaggtcgtgttcctccgcaagttcaagaagccagcagtcctcaaagagaagcagccggtccgtggaagatgataaagagggacatcttgtctgtcgcatcggggactggctccaggaacgttacgagatcgttggtaatctgggggaaggtaccttcgggaaggtcgttgagtgtctcgatcatgccagaggcaagtcacaggtagcgctgaaaatcatcagaaatgtaggcaagtaccgcgaagccgcaaggctagaaatcaacgttctcaaaaaaattaaagagaaggataaggaaaacaaattcttgtgtgtcttaatgagcgactggttcaattttcatggccacatgtgtatagcctttgaattattgggcaagaacacattcgagtttctcaaggagaataactttcaaccttaccctctgccccatgtgcggcatatggcttatcagctctgtcacgcactcagatttctgcatgaaaaccagctaacacacaccgatctgaagcccgagaacatcctgttcgtgaatagtgaatttgagacactctacaatgagcacaaatcctgcgaagaaaaatcggttaagaacacctccattcgcgtggctgacttcggatctgccacattcgatcacgagcaccacaccactatcgttgcaacccgacattatagacctccagaagtcatccttgagctcggctgggcgcagccttgcgacgtttggagcattggttgcattctcttcgagtattatcgcggcttcaccctgtttcagacacacgagaatagggaacacctggtgatgatggaaaaaattttaggtcctatacccagccatatgatccaccgaactcgtaagcagaagtacttctacaagggcggcctggtgtgggacgaaaacagcagtgacggcagatacgttaaggagaactgcaagccactcaagtcttatatgttgcaggacagccttgaacatgtgcagctgttcgacttgatgcgtcggatgctcgaatttgatccagcccaaagaatcacccttgcagaggcactcctacacccattcttcgcgggactgactcctgaggagagatcatttcataccagccgaaatccctcaaggtag

SEQ ID NO: 111532 - DNA, 1917 bp, Artificial Sequence
  Description of Artificial Sequence: Synthetic coding sequence
atgcctgttctgagcgcaaggaggcgagaacttgccgatcacgcgggatcaggtaggaggagcggcccatcaccaacggcacggagcggacctcacttgtccgcactgagggcccagcccgcacgcgccgctcatcttagtggtcgaggcacatacgtgagaagagatacggctggaggcggtccagggcaggcccggcctttgggaccaccaggaacatcacttttgggccgtggtgcacgccggagcggggagggttggtgcccgggagcctttgagagtggcgcgagggccgctaggccaccctccagggtggagccccgtttggcaactgcagccagtcgggagggtgcagggcttcctcgggctgaagtcgctgctggctctggcaggggagcccggtctggagaatggggcttggctgctgccggagcctgggagaccatgcatcactgtaagcgctatcggagcccagaacccgacccttacctgtcctatcggtggaagcgtcgtcgcagttatagtagggaacacgaaggacggctcaggtatccatcccgtagagaaccacctcccaggaggagccggtcacgatctcacgatcgactgccataccaacgtaggtatagagaaaggcgggattccgatacttatcgttgtgaagagcggagcccctcgtttggcgaggactactacggtccgtcccgcagccgacatagaaggaggtctcgggagcgaggcccttacagaacccgcaagcacgcacaccactgtcacaagcgcagaaccaggagttgctcctcagcgtcaagtcggtctcagcaatcttctaagcgttcttctaggtctgtggaggatgacaaggaaggtcacctagtatgtcggattggcgattggctccaggaaagatacgagatcgttggaaatttgggagaagggacattcgggaaggtcgtggaatgcctcgaccacgcccggggcaaaagtcaggtggctctgaagattatacgaaacgtagggaaatatagggaggccgcacgtcttgagattaatgtgcttaagaaaatcaaagaaaaggataaagaaaataagtttctttgcgttttgatgtcggactggtttaacttccacggacacatgtgcatcgcattcgaactgctgggaaagaacacttttgaattcttaaaagaaaacaattttcagccttatcccctgccgcatgtgcgtcacatggcgtatcaattgtgccatgccctgaggtttctgcacgagaatcaattaacgcacaccgatctgaagccagaaaacatattgttcgtgaactcggagttcgagaccctgtacaacgaacataaatcttgcgaagagaagagtgtgaagaacacaagtatccgtgtagccgactttggttccgccaccttcgaccatgagcaccacaccacgattgtggctaccaggcactaccgacctcccgaggtaatcctcgaactgggttgggcacagccttgtgacgtctggtcaattggatgtattctctttgagtattatcgcggatttacactgttccagacacatgaaaaccgagaacatctggtcatgatggagaagatcctcggccctatcccttcccacatgatccacaggacccgcaaacagaagtacttctacaagggaggacttgtgtgggacgaaaatagctcagacggtaggtacgtgaaagagaactgcaagcctctgaaatcatatatgctccaagactcccttgagcacgtccagctgtttgacctcatgcgaagaatgctcgagttcgatcccgctcagagaattacattggccgaggctctccttcacccgtttttcgcggggctcactcctgaggagcgttcgtttcacacctctaggaacccgtcccgatag

SEQ ID NO: 111533 - DNA, 327 bp, Artificial Sequence
  Description of Artificial Sequence: Synthetic coding sequence
atgagcctgacgtcctcctcctccgtgagggtggaatggatagccgccgtcactatcgcggctggtacagcagccatcggctacctggcttacaagaggttctatgtgaaagaccaccgcaataaagccatgatcaatctccatatacagaaggacaatcccaagatcgtacatgcctttgatatggaggacctcggtgacaaggctgtctactgccgctgttggcggagcaagaagttccctttttgcgacggggcgcacacaaagcacaatgaggagactggagacaatgtcggcccacttattattaagaagaaagagacctag

SEQ ID NO: 111534 - DNA, 408 bp, Artificial Sequence
  Description of Artificial Sequence: Synthetic coding sequence
atggtcctagagagcgttgctcgcattgttaaagtacagctacctgcataccttaagcgcttgccagtccccgaatctattaccggctttgcacggctcacggtatccgagtggctgcgtctgctgcctttcttaggcgttctggctcttctcggctacctcgccgtgcgcccgtttcttcccaaaaagaagcagcagaaagatagtctgatcaacctgaagattcagaaggagaacccaaaggtcgtgaacgagataaacattgaagacctctgcctcactaaagccgcctactgtcggtgttggaggagcaagactttccccgcctgcgatgggtcacacaacaaacacaacgagcttacaggggataatgtcggacctctcatccttaagaagaaggaggtgtag

SEQ ID NO: 111535 - DNA, 384 bp, Artificial Sequence
  Description of Artificial Sequence: Synthetic coding sequence
atgcggggagccggggccatcctccgacccgcagctaggggagcgagggacctgaatcctagacgagacatctcaagctggctggcccagtggtttccaagaacacctgctcggagtgtggtggctctgaagactcccatcaaggtggagttggtggcaggtaaaacatatcgctggtgcgtatgtggacggtccaaaaagcagccgttttgtgacgggagccatttcttccagagaacagggttatccccactcaaattcaaggctcaggagacgaggatggtggccctgtgcacttgcaaagcaacgcaacggcccccatactgcgatggcactcatcgatcagagagagtgcagaaggctgaggtgggatcccccctatag

SEQ ID NO: 111536 - DNA, 1740 bp, Artificial Sequence
  Description of Artificial Sequence: Synthetic coding sequence
atgcccagtgcctcctgcgatacactactggacgacatcgaggacatcgtatctcaggaggacagtaagcctcaggatcgccatttcgtccgcaaagatgtggttccaaaggttaggcggagaaacacacaaaagtacctccaggaggaggagaattctcccccatctgactctacaattccagggatccagaagatctggattcggacctggggttgtagtcacaacaactccgacggcgaatatatggccggacagttagcagcctacggctataaaattactgagaacgccagcgacgccgatttgtggctcctcaacagttgcaccgtgaagaaccccgccgaggaccacttccggaacagcattaagaaagctcaggaagagaacaaaaagatcgtgctggcaggatgtgtgccacaggcccagccgaggcaagactatctgaagggtttgtctattattggtgtccagcagatagatagggtggttgaggtcgtagaagaaaccataaaaggacacagcgtccgcctgttaggccaaaagaaagataacggccggaggctgggcggagctcggctggatctgccaaagatccgaaaaaacccattaatcgagattatttctatcaataccgggtgcctcaacgcctgcacatattgcaaaaccaaacacgcacggggcaacctcgcttcctatcctatcgatgagttggtagatagagctaaacagagcttccaggagggagtatgtgaaatttggcttacgtccgaggacacaggggcctatggacgtgacatcggtacaaatctacccaccctgctctggaaactggttgaagtgatccccgagggcgccatgctgcgtttgggaatgacaaaccccccctacatactcgaacacctggaagagatggcaaagatactcaaccatccccgagtatacgcattccttcatatccctgtacaatctgccagcgacagcgtactgatggaaatgaaaagggaatactgcgtggcagattttaaaagagtggtcgacttcctgaaggagaaagtgcccggtataacaattgctacagacatcatctgcggatttcctggagaaaccgatcaggattttcaggaaaccgtgaaacttgtagaagaatacaaatttccatccctgttcattaatcagttctatccccgacccggaacacccgcagccaaaatggaacaggtacccgctcaggtgaagaagcaaaggacgaaggacctctcaagagtgttccattcttactctccatatgaccataaaatcggcgagcggcagcaggtcctagtgaccgaggagagtttcgattccaaattttatgtggctcacaaccagttctacgagcaggtcctcgtgcctaaaaatcccgctttcatggggaaaatggttgaggttgacatttacgagtctggcaagcactttatgaaagggcaacctgtgtccgacgccaaagtgtatacacctagcatttctaaacctctggccaagggcgaggtttccggcctgactaaggatttccgtaacggtctcgggaaccagctgtctagcggatctcataccagcgctgcctcacagtgcgatagcgcctcttcaagaatggtcctccccatgccgaggctgcaccaagattgtgccctgcgaatgtctgtgggtcttgccctcctgggcctgctgtttgcgtttttcgtgaaggtttataactag

SEQ ID NO: 111537 - DNA, 1740 bp, Artificial Sequence
  Description of Artificial Sequence: Synthetic coding sequence
atgcccagcgcctcatgcgacaccctgctggatgatatagaggacatcgtgtcacaagaggacagcaaaccacaggacagacacttcgtccggaaggacgtcgtgcccaaagttcggaggaggaatacccaaaaatatttgcaggaggaagagaactcacccccctctgattcgaccatccccggcatccagaagatatggattcgtacttggggctgtagtcataacaatagcgatggcgagtacatggcagggcaacttgcggcttatggctacaagatcactgagaacgcctccgatgccgacttatggctgctgaactcctgtactgtcaagaatcctgcggaagatcatttcaggaattcaattaagaaggcgcaggaggagaacaagaagatcgtgttggctgggtgtgttccacaggcccagcctcggcaagactatttgaagggcctgagtatcatcggtgttcagcagattgatcgggttgtcgaagtggtcgaagaaaccatcaagggacacagtgtgcgactgcttgggcagaaaaaagataacggccgccgcctcggcggtgccaggttggacttacctaagatacggaagaacccacttatcgaaattatatcaatcaatacaggatgtctgaacgcttgtacctattgcaagaccaagcatgctagggggaacctcgcaagctaccccatagatgaactggtcgacagagctaaacagagcttccaagagggagtctgcgagatttggttgacctccgaggatacaggggcttacggtcgcgatatcgggactaacctgcccacattgctatggaagctcgtggaggtgattcctgagggcgcaatgctgcgcctaggaatgacaaaccccccttatatcttggagcatctggaagaaatggccaagattcttaaccaccccagagtttatgcctttctccacattccagtgcagagtgcctctgacagcgtgttgatggagatgaaacgcgagtattgtgtcgctgacttcaaacgggtggtcgattttctgaaagaaaaggtgccagggattacaattgcgacagacatcatatgcggatttcccggggagacggaccaggattttcaggaaaccgtgaagttagttgaggagtataagttccctagtctgtttattaaccagttctacccgagacccgggacccctgcagctaagatggagcaggtgccggcccaggtgaagaagcagcggaccaaggacctttcacgggtctttcacagctactcaccatatgatcacaaaattggcgagcgccagcaagtgttggtgacagaggaaagcttcgattcgaaattctacgtcgcccataaccaattctacgaacaggtgctcgtgcccaaaaatcctgccttcatggggaagatggttgaggtggacatatatgagagtggtaagcactttatgaaggggcaaccggttagcgatgccaaggtgtacacacccagcatttcaaagcctctagcaaaaggcgaggtatccggcctcaccaaggactttcgaaacggactgggcaaccaattgagtagcggctcacacacctccgccgcatcacagtgcgattctgccagctcccgcatggtactgccaatgccccggctacaccaggactgtgctctcagaatgtccgtcggcctagccctcctgggtcttctgttcgcttttttcgtgaaggtgtataattag

SEQ ID NO: 111538 - DNA, 1467 bp, Artificial Sequence
  Description of Artificial Sequence: Synthetic coding sequence
atgctatcaaggcgctacgaaggtgagattccgaaaaatatctgcaaacggaaaaagaccgtccaccaggttacagagaacgccagtgacgcggatctatggctactgaactcctgcaccgtcaagaacccggctgaggaccactttagaaatagtataaaaaaagcgcaagaagagaataaaaaaattgtgctagctggctgcgtaccacaggctcaaccccgccaggattacttgaaggggctgagtatcatcggtgtacagcagattgacagggtggtggaggtcgtagaggagacaatcaagggccatagcgttcggctgctgggacagaaaaaggataatgggcgtcgactggggggcgccaggctcgacctgcctaagatccgcaaaaatcccctgatcgaaattatctcaattaacaccggctgtctgaacgcctgcacatactgtaagacaaagcacgccagaggaaaccttgcttcttaccctatcgatgagctggtggacagggctaagcagagttttcaggagggcgtatgtgaaatttggctaacgagcgaagacactggtgcatacggccgtgatataggcaccaacctccccacactattatggaagctggttgaggtgataccagaaggcgccatgctgcggctgggcatgacaaaccctccctacattctcgagcacctcgaggaaatggctaagatcctgaatcacccccgtgtctatgccttcctgcacattcccgtccagtccgcctccgattctgtcctgatggaaatgaaacgagagtattgtgtggcagactttaagagggtagttgacttcctgaaagaaaaggttcccggcataacaattgccacagacatcatatgcggcttcccaggggagactgatcaagacttccaggaaaccgttaaattagttgaggaatacaagtttcccagtctgttcattaatcagttctatccgcggcccggaaccccggcagcaaagatggaacaagtgcccgcccaggtcataggtgagaggcagcaagtgttggtaaccgaagagagttttgattccaaattctacgttgcccataaccagttctatgagcaggtacttgtgccgaaaaaccccgccttcatggggaaaatggtggaagtggatatctacgaatccggcaagcatttcatgaagggacaaccggtttccgacgccaaagtgtataccccaagcatctcaaaacccttggccaaaggagaagtctccggtcttacaaaagactttaggaacggtctggggaaccagctaagttcagggagccacacatctgccgctagtcagtgcgatagcgcgtcatcccggatggtcctccccatgcctcggttacaccaagactgcgcactgcggatgtccgtgggtcttgcactcctcgggctcctttttgccttcttcgtgaaagtctacaattag

SEQ ID NO: 111539 - DNA, 4824 bp, Artificial Sequence
  Description of Artificial Sequence: Synthetic coding sequence
atgatggacttagtcctggaggaggatgttacagtgcccggaactctgtcaggatgtagtggtctggttccctccgtacccgatgacctcgacggtattaatcctaacgcaggtcttggtaacgggctgctccctaacgtttccgaagagacggtgagccccacgcgtgctcggaacatgaaagacttcgagaatcaaatcaccgagttaaaaaaggaaaatttcaatctcaaactgcgaatctattttttggaagaaagaatgcagcaggagtttcatggtccaaccgagcatatttacaagacaaacatcgagttaaaggtggaagtggagagtctgaagcgtgaactgcaggaacgggaacaactcctaataaaggcctctaaggcggtcgaatcacttgccgaagctggaggttcagagatccagagagttaaagaagacgcaagaaagaaggtgcagcaggtcgaggacctgctgactaaacgtatcctattgttagaaaaggcaaaggatgttaccgccgcacaggccgaattggaaaaagccttcgcgggtactgaaactgaaaaggcattaagacttcgcttagagagcaagctgtctgagatgaagaagatgcatgagggtgatctggctatggctctggtgctggatgaaaaagatcggttgatcgaagagctcaagctcagcttaaaatctaaagaggcactcattcagtgtctgaaagaagagaagagtcaaatggcctgccctgacgaaaatgtctcctctggagagctgaggggtctctgtgccgccccaagagaggagaaagagcgagagacagaggctgcgcagatggaacatcaaaaggagcgcaattcttttgaagaaagaatccaggcactcgaggaggatcttcgagagaaggagcgggaaattgccaccgagaagaaaaattccctcaaaagagacaaagctatacaaggcttgacaatggccttaaaaagtaaagagaagaaggtggaggaactaaactctgagattgaaaaattaagcgccgcgtttgccaaagcaagggaagccctgcaaaaggcacagacacaggaattccagggctccgaagactatgaaacagccctgagcgggaaagaagcactgtcggcggcgcttcgatctcagaaccttactaagtcaacagagaatcacagactcaggaggtccataaaaaaaattactcaggaattgtccgacttgcagcaggagcgtgagcggcttgaaaaagatcttgaagaagcacaccgagaaaagtccaagggagactgcaccatacgcgatctgaggaacgaagttgaaaagctgcggaacgaagtaaacgaacgtgaaaaagccatggagaacaggtacaaaagccttcttagtgagagtaataagaagcttcacaaccaagaacaggtgattaaacatttgactgaaagtacaaaccaaaaggatgttctgctccagaaatttaacgagaaggacctggaagtgattcagcagaattgttacctcatggcagcagaagatctggagctccggtccgaggggttaatcaccgagaagtgctcgtctcagcaaccacccggctccaagacaatctttagtaaagagaagaaacaatccagcgactatgaggaactgatccaggtgctcaagaaggaacaagatatttacacccatctggttaagagtctgcaggagagcgattcaataaataacctgcaggcagagctcaataagattttcgcattaagaaaacagctggaacaggatgtgttgagctaccagaacctcagaaagacgctcgaagagcagatctccgaaattagaagacgagaggagagcttctctctgtactcggatcaaaccagctatctgtcaatctgtctcgaagagaacaataggttccaggtagagcactttagtcaggaagagcttaagaagaaggtctccgacctgattcagctcgtgaaagagttgtacaccgataatcaacatctcaaaaaaacaatatttgatttgtcttgtatggggtttcagggtaacggctttcctgaccggctggcatcgactgaacaaacagaggaagctaagaagtctaggctgcccatcctcattaaacctagcaggagccttggcaacatgtatcggctgccggctacccaggaggtcgtcactcagctccagagccagattcttgagctccagggagagctcaaggaattcaagacttgtaataaacagctgcatcagaaactgatcctggcagaagcagtcatggaagggcggcctaccccggacaaaacccttctgaatgcccagcctcccgtgggcgcggcctatcaagattcccctggcgaacagaagggaattaagactaccagttctgtctggagggacaaggagatggactcagaccagcagcgtagttacgaaatcgacagcgaaatctgcccgcccgatgatctcgcatctcttccaagctgtaaagaaaatcccgaggatgtgctttccccaacatctgtagccacttaccttagcagtaagagccagccctcggccaaggtgagcgtgatggggactgatcagagtgagtccattaacacatcaaacgaaacggagtacctcaagcagaaaatacatgacttggagacagagctcgagggctatcaaaactttatatttcagttacaaaagcacagccagtgcagtgaagccatcataacagttctttgcgggaccgagggggcacaggacggtttgagcaaacccaaaaatggaagcgatggggaagagatgacgttttcatcactccaccaggtgaggtacgtcaagcatgttaaaattttgggaccgcttgcgccggagatgatcgattcacgagtactggagaacctcaagcagcaattggaggagcaggagtataagctgcaaaaggaacagaatcttaacatgcagttgttctccgagattcacaacctccagaataaattccgagatctgtccccaccaagatatgacagcttagtgcaaagtcaagccagggagttatctctgcagagacagcaaatcaaggacggccacggcatctgtgtgatctccaggcaacacatgaacaccatgataaaggcattcgaggagctgctacaggctagcgatgtggattactgcgttgccgaggggtttcaagagcagctcaatcagtgtgccgagctcctcgagaagctggagaagctgtttctgaatggcaaatcagtgggggtcgagatgaacacgcaaaacgagctgatggagcgcatcgaagaggacaacctaacatatcagcatctcctgcctgagagcccagagccatctgcctctcacgctctgtctgactacgagacctcagagaagtcctttttctcccgggaccagaagcaggacaatgagacagaaaaaaccagcgtcatggtgaacagcttttcccaggatttgctcatggagcacatacaagagatacggacactacggaaacgactcgaagaatctatcaagactaacgaaaagctgcgaaaacaattagaaaggcaagggtctgaattcgttcagggttccactagtatcttcgcttctggcagtgaactgcatagctcacttaccagcgaaattcacttcctgcggaagcagaatcaggcactcaatgctatgctgataaaaggctctagggataagcagaaggaaaacgataagctgcgcgagagcctgtctaggaagactgtcagtctcgagcacttacagcgggagtatgcttcggtgaaggaagaaaacgaacgactgcaaaaagagggttctgagaaggagcgccacaaccagcagctaattcaagaagtccgttgcagtggtcaggagctctccagggttcaagaagaagtgaagttgcgacagcagttactctctcagaatgacaagttactccagtccctccgcgtggaactgaaggcttacgagaagctggacgaagagcaccgaaggctcagggaggcctcaggtgagggctggaagggacaggatccctttagagatctgcactccttgctgatggagatccaggcattgagattgcaacttgagaggtctatcgaaacttccagcactttacagtcacgactgaaagagcagctggcaagaggcgctgagaaggctcaggagggcgccttgacactggccgtgcaagctgtgtctatccctgaggtccccctccagcccgataagcatgacggagacaagtatccaatggaaagtgataacagcttcgatctcttcgacagttctcaggcagtcacacctaagtccgtttctgaaaccccacctctgtccggcaatgacacagatagcctcagctgtgactcagggtcaagtgcgacgagtaccccatgtgtctcgagactggttaccgggcaccatctgtgggcctctaaaaatggacggcatgtccttggcctgatcgaggattacgaggcactgctgaaacaaatcagccagggccagcgcctcctcgcggagatggacattcagacccaggaggcaccttccagcacatcccaggagcttggcaccaagggcccccatcctgccccactgtccaaatttgtgagttctgtatccacagcaaagctgacgttggaggaagcctatcgacgattaaaactcctgtggcgggtctcactgcctgaggatggacagtgccctcttcactgcgaacagattggcgagatgaaggcggaggttacaaagctgcacaagaagctcaaaaagtcatag

SEQ ID NO: 111540 - DNA, 5682 bp, Artificial Sequence
  Description of Artificial Sequence: Synthetic coding sequence
atgatggacctggttcttgaagaggacgtcacggtgcccggcacactaagcggctgctccggactggtgccttcggtcccggacgacctggacggaatcaacccaaacgctgggctgggaaacggattactgccaaacgttagtgaggagacggtgtcacccacccgtgcaagaaatatgaaggacttcgaaaatcagatcactgaactgaagaaagagaatttcaatttaaaattgaggatctattttttagaggaacggatgcaacaggaatttcatggacccaccgaacatatctataaaacaaacatcgaactcaaggtcgaggtcgagagccttaaacgcgagttacaagaacgcgaacagctgctaattaaagcgtctaaagccgttgaatcacttgctgaggcgggtgggagtgaaatacagagggtcaaggaagacgcccgaaaaaaagtgcagcaagtcgaggatctgcttaccaagcgtattcttttgctggagaaggacgtcacggcagcccaggccgagctggaaaaggcctttgccggaacagagacagaaaaagcattacgtctgcggctcgagtccaagctttctgagatgaagaaaatgcacgagggcgaccttgccatggctctagtgcttgatgagaaggatagattaattgaagagctcaagctttccctcaagtccaaagaggcccttatccagtgcctcaaagaagaaaagagccagatggcttgtccagacgagaatgtgagctccggagaactgaggggactttgtgctgctcctagagaagagaaggaaagggagaccgaggccgcccagatggagcaccagaaggagagaaattcgttcgaagaacggatccaggccctggaggaggatctaagggaaaaagagcgcgaaatcgctacagaaaaaaagaattcactaaaacgcgacaaagctatccaagggttgaccatggctttgaaatctaaagagaagaaagtggaagagctgaactctgaaatagaaaaattgagcgcagcattcgccaaagccagggaggccctgcagaaggcacagacccaagagttccagggatcagaggattacgagacggctctgagcggaaaggaggcattgagcgctgcactgcggagccagaacctgaccaagtctacagaaaatcatcgactcagaagaagtattaaaaaaattacacaagaactgtccgatttacagcaagagagagaacgactagaaaaagacctggaagaagcccatagggagaagtcaaagggagattgcacaatacgcgaccttaggaatgaagtagagaagctgcgaaacgaggtgaacgaacgggagaaggcaatggaaaatcgttataagtcgcttctcagtgagtcaaataaaaagctacataatcaggaacaagtcatcaaacatctgaccgagtccacaaaccagaaggacgtcctcttgcaaaagtttaatgaaaaggatcttgaggtgatccagcaaaactgctacctgatggccgctgaagacctggaactgcgtagtgagggacttataacggagaaatgctccagccagcaaccacctggtagtaaaaccattttttccaaggaaaagaaacagagcagtgattacgaggaactaatccaggtattaaagaaagaacaagacatttatacccacctcgtgaaaagccttcaggaaagtgacagcatcaataatctccaagccgagctgaataagatatttgcccttcgcaagcagcttgaacaggatgtgctgagctaccaaaacctgcgcaagactctggaagagcagatttccgagatacgccgacgcgaagaggagtccttctctttatactctgaccaaacgtcttacctgtctatctgccttgaggagaataacaggttccaggtggaacacttttcccaagaagagcttaaaaagaaggtcagcgaccttatccagctcgtgaaagaactgtatactgacaatcagcacctgaagaagaccatttttgatcttagctgtatgggctttcaggggaacggattccccgaccgactggctagtaccgaacaaacagagctactggcatctaaagaggatgaagatacgatcaagatcggggaagatgacgagataaatttcctgtctgaccagcacctgcaacagagcaatgaaataatgaaagacctctccaaaggtggatgtaagaacggttacttgcgacacacagagtccaagatctccgactgcgatggagcacacgctcctggttgcttagaagaaggagcgtttatcaacctgctcgcccccctatttaatgagaaggcgaccttattgctggagtctcgaccggatctgttgaaggtggtgcgagaactgctgctcggtcagctgtttctcactgagcaggaggtctcaggcgaacacctcgacggaaaaactgaaaagaccccgaaacagaagggtgaactggtgcatttcgtccagactaatagtttttcaaagcctcatgacgagctgaaactgtcctgtgaagcccagctggtgaaggctggcgaggttcccaaagtggggctcaaagatgcctccgtgcagacagtcgccaccgagggagacctattgagatttaagcacgaggcaactcgcgaagcctgggaagaaaagcccatcaacacggctcttagtgcggagcatcgtccagagaacctgcacggtgttcccgggtggcaagccgcgttgctgagcttgccaggcatcacaaaccgggaggcaaaaaagagccgactgcctattcttatcaagccgtcgcgctccctcggcaatatgtatcgtctgcctgctacccaggaggttgtcactcagctgcagagccagattctggagctacagggcgaactcaaagagtttaaaacttgcaataaacaactgcaccagaagctgatccttgcagaggctgtgatggaagggcggcccactcctgacaagacattgttgaatgcccagccaccagtgggggcagcctatcaagactcgcctggcgaacagaaaggcattaaaaccacctcctcagtttggagagataaggaaatggatagcgatcagcagagatcctatgagattgattcagaaatatgcccacccgacgacctcgcctccctgccttcctgcaaggaaaatcccgaagatgtcctgtctccaacgagcgtggccacctatctcagtagcaaatctcagccatccgcaaaggtgtccgtgatggggacagatcagtccgaaagtatcaacacaagcaacgaaactgaatatctaaaacagaaaatccacgatctcgagactgagctcgaggggtatcagaacttcattttccagctgcagaaacattcccaatgcagcgaagcgatcatcacagtgttgtgtggaactgagggggcacaggatggcctctcgaagcctaaaaatggatcagacggagaggaaatgacctttagttctctgcaccaagttagatatgtgaaacacgtaaagatcttaggcccactcgctccagagatgatcgatagccgcgttttagaaaaccttaaacaacaactcgaggagcaggaatataagctgcaaaaggagcagaacctcaacatgcaactattttccgagattcataatctacagaataaattcagggatctgtcaccgcccagatacgattcgctggtccagtcacaagccagggaactgtccttacaaagacagcagattaaggatggacacggcatttgcgttatcagccgccaacacatgaataccatgattaaagccttcgaggaattactgcaagcttccgatgtggattactgtgtcgcagagggcttccaggagcagttaaatcaatgtgcagaactgctggagaagctggagaaactgttcctgaatggcaaaagcgtcggcgtcgagatgaacacccaaaacgaattaatggaacgcattgaggaagataacctgacgtaccagcatctgctgcctgagagccccgagcccagtgctagccatgctctatcagattatgaaacgagcgaaaaatctttcttttcccgtgatcagaagcaggataacgagactgaaaagacctctgtgatggtcaatagctttagccaagacctgctgatggaacatatccaggagatccgtactctcaggaagagattggaggagtctattaagactaacgagaaactgaggaaacagctggaaaggcaggggagtgaatttgttcaaggtagcacatcaatcttcgcatccggctctgaactgcacagctctcttaccagcgagatccacttcttgcgcaagcagaaccaggctttgaacgccatgctcatcaaaggcagccgcgataaacagaaagagaatgataagctgcgggagtctctgtctcgcaaaacagtctctctggagcatttgcagagagaatatgcctctgtcaaagaggaaaatgaaagactgcagaaggaaggatccgagaaagagcgtcacaatcaacaactgatccaagaagtgcggtgttcaggccaggaactgtcaagggtccaggaggaggtgaagctgcgccagcagcttctaagtcagaacgacaaactgctgcaatctcttcgggttgagctgaaggcctatgagaaactcgacgaggaacatagaaggctaagagaggcttcaggagaaggttggaagggccaagaccctttccgggacctgcattccctactgatggagatccaggccctacgcctgcaactagagaggtctattgaaacctcctccaccctgcagagtcggcttaaggagcagttggctcgcggggccgagaaagcccaggagggcgccttgacactcgccgtgcaggccgtgagtattcccgaagttccgttacagccagacaagcacgatggagataagtaccctatggaatctgacaactcattcgacttgtttgactcatctcaggctgttaccccaaaaagcgtgtccgagacaccgcccctgtccgggaacgacacagactctctgtcatgcgactctggctcttctgctacatccaccccttgtgtgtccagacttgtgactggtcatcacctctgggccagcaagaacggccgacacgtactgggtttaatagaagactatgaagctttgttaaagcagatatcccaggggcagcggctccttgcggaaatggatatccagacacaggaggcaccgagctctacgagccaggagctaggcactaagggccctcaccccgccccactatctaaattcgtaagctctgtaagcacagctaagctgactcttgaggaagcctatcgaaggcttaagcttctgtggcgggtgtcgctgccagaggatggacagtgccctctgcattgtgaacagataggcgagatgaaagccgaagtcactaagctccacaaaaagctctttgaacaagaaaagaagctgcagaataccatgaaattactgcaattgagcaagaggcaagagaaggtcatattcgatcagctagtggtgacccataagattctgcgaaaagcgcggggaaacctcgaactgcggcccggcggggcacacccggggacttgtagccctagcaggcccggaagctag

SEQ ID NO: 111541 - DNA, 5559 bp, Artificial Sequence
  Description of Artificial Sequence: Synthetic coding sequence
atgatggatctggtgctcgaggaggacgttaccgtgcccggcacactgtccggctgcagcgggctggttccgtctgtacccgacgatctcgacgggattaacccgaacgccggtcttggcaatggccttctgccaaatgtgagcgaggagaccgttagccctacacgggccagaaacatgaaggattttgagaaccagattactgaattgaagaaagaaaactttaacttgaagctccggatttactttttggaggaaagaatgcaacaggagtttcatggccctactgagcacatttataagactaatatcgagttgaaagtcgaagtggaaagcctcaagcgtgaattgcaagagcgagagcaactgcttatcaaggccagcaaggctgtcgaatccctcgctgaggcgggcggtagcgagattcaaagagtcaaggaggacgctcggaaaaaagttcagcaggtggaagacctcctgacaaagagaattttattactcgagaaggatgtcactgccgcccaggctgagctggaaaaggcctttgccggcaccgagactgaaaaggccttgcgacttaggctagaatctaaactctccgagatgaaaaagatgcacgagggcgacctggcaatggcgctcgttctcgatgagaaagatcggttgatcgaggaactcaagctgagcttaaagtctaaggaggccctgatccaatgtctgaaggaggaaaagtcccagatggcatgtcctgacgaaaatgtctcaagcggcgaacttaggggcctctgtgccgccccaagggaggagaaggagagggagaccgaggctgctcagatggagcaccagaaggaacgcaactcttttgaggagcgtatccaggcactagaggaggacctgcgagaaaaggagagggaaattgcaacagagaagaagaacagcttaaaacgtgacaaggctatacaaggactcactatggcgctgaagtccaaggagaaaaaggtagaggagctcaacagcgagattgagaagctttccgcagccttcgcgaaggcacgagaggcacttcagaaggcacagacccaggaattccagggatctgaggattatgagactgccttaagcggcaaagaagctttatcagcagccctgcgcagtcagaatttaaccaagagcaccgagaaccacagacttcgcagatctattaagaagatcacccaggaactttctgatctgcagcaagagcgggagaggctcgagaaggatctggaagaagcccacagagagaagtccaaaggagactgtacaataagagatcttaggaatgaagtggagaaacttcgaaatgaggtgaacgagagggagaaggccatggaaaacaggtacaagagtttgctgagcgagagtaataagaaacttcataatcaagagcaagttattaagcacctgacagagtccactaatcaaaaagatgtgctccttcagaagttcaacgagaaagatctcgaagtcatacagcaaaactgctatctaatggcagccgaggatctggaactaaggtcagaaggattgatcactgagaaatgcagctcgcaacagcctcctggcagcaaaacaatcttctccaaagaaaagaaacagtcatctgattacgaggaactcatccaagtattgaaaaaggagcaggatatttatacgcacctggtcaaatccctccaggagagcgactccataaataaccttcaggcggaactcaacaagatcttcgccctcagaaagcagctggaacaagatgtcttgtcttaccagaatctccggaagacactggaagaacagatatccgagatacgtcggagggaggaggaatcattctccctctattctgatcaaaccagttacctcagcatttgtctggaagaaaacaacagatttcaggtagaacacttttctcaggaggaactaaagaaaaaagttagtgacttgatccaactcgtaaaggagttatacacagataaccagcacctcaagaagactatcttcgacttgtcttgcatgggttttcaaggcaacggtttccctgatcggctggccagtaccgagcagaccgaactgcttgcgtcaaaagaggatgaagacaccatcaaaataggggaagatgacgaaattaacttcttgtccgaccagcaccttcagcaatcaaacgaaatcatgaaggatctctcaaagggcgggtgcaaaaatggatatttgcgccataccgaatcaaaaatttcggattgtgacggcgctcatgccccggggtgtttggaagaaggggcgttcattaatttactcgctcccttgtttaatgaaaaagccaccctcctcttggaatctcgccctgatctcctgaaggtcgtcagggagctgttgctgggccaattgttcctgactgagcaggaggtgtcgggagaacacctggacgggaaaactgaaaaaaccccaaagcagaaaggcgaactggtccacttcgttcagaccaattctttctcaaagccgcacgacgagctgaaactttcctgcgaagctcaattagtgaaggcgggggaggtgcctaaggtgggcctcaaggacgcatccgtccagactgtcgctacggagggcgatttactcagattcaaacacgaggccactagagaggcatgggaagagaaaccaatcaataccgccctgtccgccgagcaccgcccggagaacctgcatggggtaccaggttggcaagcagccctcctctccctgccagggatcacaaaccgtgaggccaagaagtctcggctgcctatcctgattaagccttctagaagcctgggcaatatgtacagactacctgccactcaggaagtcgtgacacagctgcaatctcagatcctggaactgcagggggagctgaaagagttcaagacttgtaataagcagctgcaccagaagttaatcctggctgaggctgtgatggagggccgccccaccccagataagacactcttgaatgattctgaaatttgcccgcctgacgacttggcatctctgccttcttgcaaagagaacccagaagacgtcctcagcccaacctctgtcgctacttatctttcttccaagagccagccctccgcgaaggtatctgtaatgggtaccgatcagagtgagagcataaatacatcaaacgaaactgaatatctcaagcaaaagatccacgacctggagaccgaacttgaaggctaccaaaacttcatctttcagctccagaagcactcacaatgctccgaagccatcatcactgtactgtgcggaaccgagggcgcccaagatggactgagcaaacctaagaacggcagtgatggtgaagaaatgacattttccagtctgcatcaggtacggtatgtgaaacacgtaaagatcctggggcctctggcacccgagatgatcgacagccgcgtcctggagaatctgaagcagcaactggaagaacaggaatataagctgcagaaggagcagaacctgaatatgcagcttttcagcgagatacacaacctgcaaaacaagttccgggacctatcccctccgcgttacgactctctggtgcagtcccaggccagagaactgtctttgcagcgccagcagattaaggatggtcacgggatctgtgtgatcagtcggcagcatatgaacacaatgattaaagcatttgaggagttgctgcaggcttccgatgtggattactgcgtcgcagagggtttccaggagcaactgaaccagtgtgctgagctgctggagaagcttgaaaaattgtttctcaacggcaagtccgtaggcgtagagatgaacacgcaaaatgagttgatggagaggatcgaggaagataacctgacctatcagcaccttctaccagagtctccagagccatcagcgagccacgcgttgtctgattatgagacttctgaaaagtcatttttctcacgcgatcagaaacaggataatgagactgagaagacaagcgtgatggttaactccttttcacaggacctgctgatggagcatattcaggaaattcgaacacttcgcaagcgcctcgaggagtccattaaaactaacgagaagctgaggaaacagctggaaaggcagggctcggaatttgtacagggaagcaccagcattttcgcttctgggagcgagctgcactcatccctgacctcagaaattcacttcctgcgcaagcagaaccaggcactgaatgccatgttgataaagggaagcagggataagcagaaggagaacgacaagctccgcgaatccctctcaagaaagactgttagcctggaacatctccagcgcgaatacgcgagcgttaaagaagaaaacgagcgcctccaaaaggaggggtctgagaaggagaggcacaaccaacagctaatacaggaagttagatgcagtggacaggaactgagtcgcgtgcaggaggaggtcaagttacgccagcagctgctgagccagaacgacaaactgctgcagagcctcagagtcgaacttaaggcctatgaaaagcttgatgaggaacaccgacgtctccgcgaagcgtccggtgaaggctggaagggtcaggatccttttagggacctgcactccctcctgatggaaattcaagcgctgcgtctccaactcgagaggtcaatcgagacaagctcaacgctccagagtcgccttaaagagcagctggctaggggggctgagaaggcacaagagggagccttaaccctggctgttcaggcagtctcaatccctgaagtgccgttgcagcccgataagcacgatggggacaagtatcccatggagtcagataattcattcgaccttttcgattcttctcaggcagtgacacccaagagtgtgtctgagacacctcccctcagcgggaatgataccgacagcctgtcttgcgacagcgggtcaagcgccacctccactccatgtgtttcacgcctcgtgactggacatcatctgtgggcctctaaaaatggtcgccacgtgctcgggttgatcgaggattacgaagcgttgctcaagcaaatctctcaggggcagaggctcctagcagagatggacattcaaactcaggaagcgccaagtagcacaagccaggagctggggacaaaagggccgcacccggctccgctgtctaagtttgtgagcagcgtgagtacagccaagctgactctggaggaggcctataggcgcttaaagctgctgtggcgggtaagtctgcctgaggatggccagtgtccgctgcactgtgagcagataggtgagatgaaagccgaggtcacgaaattgcacaagaagctgtttgagcaggagaagaagttacagaataccatgaagcttctgcagctgagtaaacgacaggagaaagttatcttcgatcagttagtggtcactcacaagattctgaggaaagccaggggtaatctggagctacggcctggaggcgcccaccctggcacatgctccccgtcacggccagggagttag

SEQ ID NO: 111542 - DNA, 5445 bp, Artificial Sequence
  Description of Artificial Sequence: Synthetic coding sequence
atgatggatctggtgctggaagaagacgtcactgtgcctggaacccttagcggctgttccggtctggtaccatccgttcctgacgacttggatgggatcaacccgaacgctggcctcgggaacggattactccctaacgtgagtgaggagaccgtttcgccaaccagggctcggaacatgaaggactttgaaaatcaaattacagagcttaagaaggagaattttaacctaaagctccgaatctactttctcgaagagagaatgcagcaggaattccacggacctactgagcatatttataagacaaacattgagcttaaggtggaggtcgaatcccttaagagagaactccaggaacgcgagcagctgcttattaaggcatctaaagcagtggagtctctggcagaagcagggggctctgaaatccagcgcgttaaggaagatgctcgaaaaaaagtacagcaggtagaggatttgctaacaaagaggatcttgttactggaaaaagacgtcacggccgcacaggctgagctcgagaaagctttcgctgggaccgagaccgaaaaggcccttaggctccggctggaatctaaactgtcagaaatgaaaaaaatgcacgagggggatctggcgatggcactggtgctggatgagaaggaccgcctcatcgaggaattgaaactgtctctgaaatcaaaggaagccttaattcagtgcctgaaagaggaaaagagccagatggcgtgcccagatgagaacgtgtcaagcggcgaactccgcggtctctgcgctgccccaagagaggaaaaagagcgcgagaccgaggctgcccagatggaacatcagaaggagaggaattctttcgaagagaggattcaagcactggaggaagacttgcgcgaaaaggagcgcgagatcgccactgaaaagaagaatagcctcaagcgcgacaaggcaattcaggggttgaccatggcccttaaatctaaagaaaagaaagtagaggagctaaattccgaaattgagaaattgtcagctgcatttgcgaaagcccgtgaagcacttcagaaggctcagacccaggagttccagggctcagaggattatgaaaccgcactttctggaaaggaggccttgagtgccgctttaaggagccagaaccttaccaagtccacggaaaaccataggctgcggagaagcattaaaaagatcacacaggagctgtcagacctccaacaggaacgagaaaggcttgagaaggacctggaggaagcccatcgggagaaaagtaaaggggattgtacaatacgggatctacgcaatgaggttgagaagctgcgcaacgaggtcaatgagcgggagaaggcaatggagaacagatacaagagcctgctgagcgaaagtaataaaaagctacacaaccaggagcaggttattaagcatctgactgaatccaccaatcagaaagacgttctactccaaaagttcaatgagaaggacctggaggtgatccagcagaattgttatttgatggctgccgaggacttggaattgcgctcggaaggtctgataacggagaagtgttcctctcaacagccccctggtagcaaaaccatctttagcaaggagaagaaacagagttccgactacgaggaactgattcaggtgctgaagaaggaacaggacatatacactcacctggtcaaatccttacaagagagtgattcaatcaacaatttacaggcagaactgaataagatttttgcccttcggaaacagctcgagcaggacgtattaagctatcaaaatctaagaaaaacccttgaagagcaaatcagtgagatccgacgtcgtgaggaagagagtttcagcctgtattctgaccaaacgtcctacctaagcatctgcctcgaggaaaataataggtttcaggtggagcacttctctcaagaggaacttaaaaaaaaagtttctgacttaatacagttggtcaaggagctgtacactgataaccaacatctgaagaagacaatctttgacctgtcatgtatggggttccagggtaacgggttccctgatagactggccagcaccgagcagacagaattgttggcttctaaggaagatgaggatactatcaaaatcggcgaagatgacgaaataaattttctgtccgaccagcacctccagcagtctaacgaaatcatgaaagatttgagcaagggtggatgtaagaacgggtacctcagacacaccgagtccaaaatatcggactgcgacggcgcacatgcccctgggtgtcttgaggagggagcctttatcaacctcttggccccgcttttcaacgaaaaggcaaccctattactggaatccagaccagatttgctcaaagtcgtcagagagctgctgctaggacaactgtttttgaccgagcaggaagtttctggagaacacctggacgggaagactgaaaagacacctaaacagaaaggcgagttggtgcatttcgtgcagacaaatagttttagtaagccccacgatgaactcaaactgtcatgcgaggctcaattagtcaaagccggcgaagtccccaaggtgggattgaaggatgcgtcggtgcagaccgtggccaccgaaggagacttactcagattcaagcacgaagcaacccgagaagcatgggaggagaaaccgatcaacaccgccctgtcagcagagcaccgtccagaaaacttgcacggagttcccggctggcaggccgcattactgtcactgcctggaataaccaatcgtgaggcaaagaagtctagattgcccatcctcataaaaccttccaggagtctgggcaacatgtaccggttgccggctacccaggaagtcgtaacacagctccagagccagatattggaactgcaaggggagttgaaggagtttaagacttgcaataagcagctccaccagaaacttattctagctgaggctgttatggaaggacgtccaacacctgataagacgcttctgaacgcccagcctcctgtgggtgcagcttaccaggatagccccggagagcagaagggcattaagaccacctccagtgtctggcgcgataaggagatggacagtgaccaacagaggagctacgagatagattccgagatatgtcctccagatgacttagcctctctgccctcttgtaaagagaaccccgaagatgtcctgagtccaacctcggtggcgacttatctaagttccaagagtcagccatccgcaaaggtttctgttatgggcaccgaccagtccgaaagtattaatacttctaatgaaacagaatacctcaaacagaagatccacgacctcgaaacggaactggagggctaccagaacttcatcttccaacttcaaaagcatagccagtgtagtgaggccattataactgtgttatgcggcacggagggggcccaggatggcctctctaagccaaaaaacggttctgacggcgaggagatgacctttagctcactgcatcaggtgcggtacgttaagcatgtcaaaatacttggcccgttggcacctgagatgatcgatagccgcgtgctggaaaatctgaagcagcagcttgaggaacaggaatataagcttcagaaggaacagaacctcaatatgcagctttttagcgagattcataaccttcaaaacaaatttagggatctttcccctcccagatatgattcactggtccagtcccaagcccgcgagttaagcttacaaaggcagcagataaaggacggtcacggcatttgcgtgatcagcagacagcacatgaataccatgattaaggccttcgaggaattgctccaggctagtgacgtggattattgcgttgccgaaggtttccaggagcagctgaaccagtgtgccgagttactcgagaaactggagaagctctttctcaatgggaaaagtgtcggagtggaaatgaacacccaaaacgagttgatggagcgcattgaagaggacaatctaacctaccaacatctgctgccggagagccccgagccttcagccagccatgcgctgagcgactacgagacatccgagaaatccttcttctctcgggaccagaagcaggacaacgaaacagagaagacctccgtgatggtgaattcgtttagtcaggacctcctcatggagcacatacaggaaatccgcaccttacgcaaaagattggaagagtcgattaagactaatgagaaactgagaaaacagttggaaaggcaggggtctgaattcgtgcaaggatcaaccagcatctttgctagtggctccgaactccactctagcctgacttccgagatccactttctgagaaagcagaatcaagccctgaacgccatgttgatcaaaggcagccgcgacaagcagaaggaaaacgataagttgagggaatccctctcccgcaagaccgtgagcctggaacacctccaaagagagtacgccagcgttaaagaggaaaatgagcgtcttcaaaaagaaggatccgaaaaggagcgacacaatcagcagctgatccaggaagttaggtgctctggccaagaactctctcgtgtgcaggaagaagtgaaacttcggcagcagttattgtcccagaatgataagcttttgcagtccctaagagtagagctgaaggcttacgaaaaactggacgaggaacacagaaggctacgggacggcgacaagtaccctatggaaagtgataattctttcgatctgtttgactcatctcaagccgtgactcccaaaagtgtttctgagacaccacccttatctgggaacgacaccgatagcttgtcctgtgattccggatctagcgccacgagtaccccctgtgtaagcaggctcgtaaccggccaccatctatgggcctccaagaacgggcgccatgtgcttggccttatagaagactatgaagccctgctgaagcagatatcccaaggccaaaggctccttgccgagatggatattcagacccaagaagctccgtcatccacctcacaagaactgggcaccaagggcccccacccggctcccttgtcaaaatttgtttcgtcagtgagcacagctaaacttacccttgaagaagcatatcggaggctgaagctcctgtggagagtatcactgccagaagatgggcaatgtcctctccattgcgaacaaattggcgaaatgaaggctgaagtgacaaaactgcacaagaagctgtttgaacaggaaaagaaactgcagaacacaatgaagctgctgcaactgtccaaaaggcaggagaaggtgatcttcgatcagctcgttgttacacataagatattgagaaaggcacgaggaaatctcgaactgcgacccggcggagctcacccgggtacgtgttctccatcccgcccaggttcttag

SEQ ID NO: 111543 - DNA, 5586 bp, Artificial Sequence
  Description of Artificial Sequence: Synthetic coding sequence
atgatggaccttgtgcttgaggaggacgtcaccgtgcctggcacactgtcaggatgtagtggactcgtccctagcgtgccagacgacctcgacgggatcaatccaaacgctgggttgggcaacggcctgctgcctaacgtttccgaagaaaccgtttctcctaccagagcgaggaacatgaaagattttgagaatcagatcaccgaattgaaaaaagaaaatttcaacttgaagctacggatctatttcttagaggagcggatgcaacaggaattccatggcccaaccgaacacatatataagaccaacattgagctgaaagtagaagtcgagagcctgaagagggaactgcaggagagggaacagctacttattaaagctagcaaggcagtggagtcattggctgaggcaggtgggtctgaaattcagagggtcaaagaggacgctaggaagaaggtacagcaggtggaagatctcctgacgaaaaggatactgctgcttgaaaaagacgtgacagccgcccaggcagaactcgaaaaggcgtttgcagggacagaaaccgagaaggcactgcgcctgagactggagtccaagctgagtgagatgaaaaaaatgcacgagggagacctggcgatggctctcgtgttagatgagaaagacaggctcattgaggagctcaaactaagcctcaaaagtaaggaggcactgattcagtgccttaaagaagagaagtctcagatggcttgtcccgacgaaaacgtgtcttccggcgaactgcggggactgtgcgccgcaccacgggaggagaaggaacgagagactgaagccgctcaaatggaacaccagaaagaaagaaactccttcgaagagcggatccaagctctggaagaagaccttcgcgaaaaggagagggagatagcaacagagaagaaaaactctctaaagagggacaaggccatccaaggattaacaatggctcttaagtctaaggagaagaaggtcgaagagctgaattccgagatcgagaagctgtcagccgccttcgccaaagcaagggaggcccttcagaaggctcaaacccaggagtttcagggtagcgaagattatgaaactgccctgagtggaaaggaggccctgtccgctgctttgcgctcccaaaatcttaccaagagcaccgaaaatcaccggctcaggcggagtatcaagaaaatcactcaagaattgtcggacttgcaacaagagcgagaaaggctcgagaaagatctggaagaggcccatagagaaaagtccaaaggggactgtaccatccgggacttgcggaacgaggtggagaagctacgtaacgaggtaaatgaacgtgagaaggctatggagaacagatataaaagtctcctgagcgaatcaaacaaaaagcttcacaaccaagaacaggttatcaaacatttgacggaatcaaccaatcagaaggatgtgttgttgcagaaatttaacgagaaagacttggaagtgattcaacagaattgttatctcatggccgcagaagacctggaactccgctcagaagggctaataacagaaaagtgctcatcacagcagccccccggatccaaaacaatattctcaaaggagaagaagcaatcatctgactatgaggagctgatccaggtgctgaaaaaggaacaggatatctacacacatctagtaaaaagccttcaggaatccgattctatcaataacctgcaggcagaactgaataagatttttgccttgcggaagcagttggagcaggacgtgctgagctaccagaacctgcgcaaaaccttagaagagcagatcagcgaaatcagacgacgcgaggaggagtcattttctctgtattccgatcagacatcttacctctccatctgtctggaggagaacaaccggttccaggtggagcactttagtcaggaggagctgaaaaagaaggtgtcggacttgattcagcttgtgaaggagctgtacacagacaatcaacacctgaagaaaactattttcgatctttcatgcatggggtttcaggggaacgggttccccgatagactagccagcaccgagcaaaccgagattatgaaggatctgtctaaagggggttgcaaaaatggttatctaagacacacagagagcaagataagtgactgcgatggtgcccacgctcccggctgcctcgaggagggtgcattcataaacttgctggcccctttattcaacgagaaagctaccttgctgctcgagtcaagaccagacttacttaaagtcgtgcgagagctccttttgggacagttattcttgaccgaacaggaagtttcaggagagcatctagacggtaagaccgaaaagacacccaaacaaaagggggaactagtccactttgtgcagacgaatagtttctctaagccacatgatgagctgaagctcagctgtgaagctcagctggtgaaggccggcgaggtgcccaaagtggggctcaaggatgccagtgtgcagaccgtagcaactgaaggcgacctgctgcgatttaaacacgaggccacaagggaggcttgggaggagaaaccaattaacacagccctctcggccgaacacaggccagaaaacttgcacggtgtacctggctggcaggcagctctgctgagcctccctggcatcaccaatcgcgaagcaaagaagtcacgacttccaattctgattaaaccaagccgttcgttgggaaatatgtaccgcctgccagctacacaggaggtcgtgacccagcttcaaagccagatcctggaactgcagggtgaacttaaagaattcaagacatgcaacaaacagttgcaccagaagctgatccttgccgaggcagttatggagggccgacccacaccagataagacgctgctcaatgcccaaccacctgttggcgccgcatatcaggattccccaggggaacagaagggaattaaaacaacttcctccgtttggcgtgacaaggaaatggacagcgatcagcagagaagctatgaaatagacagtgaaatttgtccacctgacgacttagctagcctaccgtcttgcaaagaaaacccagaagatgttctcagtcctacgtctgtagcaacgtaccttagcagtaagagccagccctctgctaaagtgagcgtgatgggcactgaccagtctgagtcgattaacacctccaacgaaaccgaatacctgaagcagaagattcatgaccttgaaacagagcttgaaggctatcagaatttcatcttccaactgcagaaacactctcagtgttctgaggccattatcacagtgctctgtgggactgagggagcccaggacggcctgtcaaaacctaagaacgggagcgacggtgaagagatgaccttttcttctttgcatcaagtgcggtacgtcaagcacgtgaagatactcggacccctggcacccgagatgatagacagccgcgtgcttgaaaatctgaagcagcagctggaggaacaagagtataagctgcagaaagagcaaaatctcaacatgcagctgttttctgagatccacaacttgcagaacaagtttagagacctgtctcctcccaggtatgattctctggtgcagtctcaagccagggaactgagcttgcagcggcagcagatcaaagatgggcacggcatatgcgtgatatcccgtcagcacatgaacactatgatcaaggccttcgaggaacttctgcaggcctctgatgtagattactgtgttgctgaaggattccaggagcagctcaaccagtgtgccgaactcctggagaagctcgagaagctgttcctgaatggaaaaagtgtgggagtggagatgaatacccagaatgaactcatggaacggattgaagaggacaacctgacatatcagcatctcctgcctgagtctccggagccgtctgccagccacgcattgtcggactacgaaacctctgaaaagtcattcttcagccgcgaccagaagcaggataatgaaacagagaaaacctcagtgatggttaacagcttctcgcaggacctgctcatggaacacatacaggaaatacgtactctccgcaagcgtctcgaggagtccattaaaactaacgaaaagttgcgcaagcagctggaaagacaggggagtgaatttgtgcaggggagcacgagcattttcgctagtggttccgagctgcattcatctctaaccagcgaaatacatttcttgcgcaagcaaaaccaggccctgaacgcaatgctcatcaaggggagcagggacaagcaaaaggagaacgataaactacgagagagcctgtccaggaaaaccgtttcccttgagcacctacaacgtgagtacgctagtgttaaggaggaaaatgagcgtctgcagaaggaaggcagtgagaaggaaaggcataaccagcagcttatccaggaggtgcgctgtagcgggcaggaactctcgagggtgcaggaggaggtgaaactccgtcagcagctgttgtcacaaaatgataaattgctgcagtcgttgcgtgtggaactgaaagcgtatgagaagttagatgaggaacatcgccggctgcgagaggcttccggcgaggggtggaagggccaagacccatttagggatctccatagtctattgatggagatccaggctctgaggttacagctcgagcgctctatcgagacctcaagtaccctgcagtccaggctgaaggagcagttggccaggggagccgagaaggcgcaggagggtgcgttgaccctagccgtgcaagccgttagcatcccagaagtccctctgcagcccgataagcatgacggtgacaaataccctatggagagtgacaacagctttgacctgttcgattcatcgcaggccgttaccccgaaaagcgtcagcgaaactccccccttgtcaggaaacgacacagactctttatcctgtgactccgggtcatcagctactagcaccccctgtgtgtccagattggtgaccggccaccacttatgggcgagtaaaaacggaaggcacgtcctgggccttatcgaggattacgaagcactcctgaagcagatctcccaaggccaacggctgctcgccgaaatggacatccaaacccaggaagccccctcatccacatcacaggagctgggtacgaagggcccacatccagcacctctgagcaagttcgtgagttccgtgagcactgccaagttgacacttgaggaggcatacagacgactgaaactactgtggcgagtgtctctgcctgaggacggtcagtgtccattgcactgtgaacaaataggcgagatgaaagccgaagtcacaaagctccacaaaaagctttttgaacaggagaagaagctacagaatacaatgaaactgcttcaactctccaagcgccaggagaaggtcatttttgaccagctcgtagtaacccacaagattttgcgaaaagcacggggaaatctagagctgcgccccgggggtgcgcatcccggtacctgctccccttcccgccccggttcatag

SEQ ID NO: 111544 - DNA, 1521 bp, Artificial Sequence
  Description of Artificial Sequence: Synthetic coding sequence
atggaggaccaccagcacgtacccatcgatatccagacctctaaactgctggactggttagtggaccgtcggcactgcagccttaagtggcagagtttagtacttacaatcagagaaaagatcaatgccgccattcaggacatgcccgagtctgaggagatcgctcaactccttagcggatcatacattcactactttcattgcctgaggatcctggatttgttgaagggcacagaggcttccaccaaaaacatcttcggccggtatagtagtcaacggatgaaagattggcaagagataatagcactttacgaaaaggacaacacatatcttgtggagctgtcctcactcctcgtaagaaacgtcaactatgagattcccagcctgaaaaaacagatcgcgaagtgtcagcagttgcagcaggaatatagccgtaaagaagaagagtgccaagccggcgcggctgagatgagggaacagttctaccatagctgtaagcaatatggcatcacaggagagaacgtgcgcggcgaactcctcgccttggtgaaggatttaccttcgcagttggccgagatcggggcggccgcccagcagtctctcggggaggcaattgacgtgtatcaggcctcagtgggcttcgtttgtgagagtcctacagaacaagtattgccaatgctcaggttcgtgcaaaagagaggaaacagtacagtctatgagtggcggactggcacggaaccctctgttgtcgagcgcccacacctggaggagttgcccgagcaggtggctgaggacgccatcgattggggggactttggcgtggaggcagttagcgagggaaccgattctggcatcagtgcagaagctgccggcatcgactggggcatctttcccgagtcagattctaaagaccctgggggggatggcatcgactggggtgatgacgcagtcgccttacagattacagtactagaagcagggacacaggcccccgagggagtagcacggggacctgatgctctcacactgttggagtacacggagacgcgaaatcagttcctggacgagctcatggagttggagatcttcctagcacagcgagccgtcgaactctccgaagaagcggacgtacttagtgtgtcccagtttcagctggccccggcaatcttgcagggacagacaaaggaaaagatggttaccatggtgagcgtgctggaggatctgatcggaaaattgacttctctgcagctgcagcacctgtttatgattttggcgagtccgcgctacgtcgatagagtgacagagtttctccaacagaagctgaaacagtctcagctgcttgccttaaagaaggaactaatggtacagaagcagcaagaagctcttgaggagcaggctgccttggagcctaagttggacctgcttcttgagaagacgaaggagttgcagaaattgatagaagcggacattagcaagaggtactccggacggcccgtcaacctgatgggcacgtccctgtag

SEQ ID NO: 111545 - DNA, 1596 bp, Artificial Sequence
  Description of Artificial Sequence: Synthetic coding sequence
atgagacggcagtctatgactagtgcaactagagacctgcatactgctctggatggtaaggctactcagggcgggaaaaaggatcaccagcatgtacctattgacatccagacctcaaaactgctggattggttggtcgacaggagacactgctcactgaagtggcagagcttagtgctgacaatacgagaaaagattaatgctgccatccaggacatgccagagagcgaggagattgcccagctcttgtccgggagctatattcactattttcattgcttgcgcatcttagatcttttaaaaggcacagaagcaagtacaaaaaacatcttcggacgctattcatctcagaggatgaaagactggcaagagattattgcgctgtacgaaaaagataacacataccttgtggagctctctagcctcctggtgcggaatgtcaactatgaaatccctagtttgaaaaaacagatcgccaaatgtcaacagttgcagcaggagtactcaaggaaagaggaggaatgccaggccggggcggccgaaatgcgggagcagttttaccactcttgtaaacagtatggcattactggcgaaaatgtcagaggggaactcctcgccctggtgaaagaccttcctagccagctggccgagatcggtgctgctgcccagcagagccttggagaggcaatcgacgtgtatcaggcctcagtcggatttgtgtgtgagtcgcctaccgagcaagtgctgcctatgttgcgcttcgtacagaaaagaggaaattcaaccgtctacgaatggcggactggcaccgagcccagtgtggtcgagagacctcatctggaggaactccctgaacaagtggctgaagacgccatcgactggggtgacttcggggtggaagcagtgtcagagggaacggactctggcatttccgcagaagcagccggaattgactgggggatcttcccggagtcggacagtaaggatcctggtggggatggcattgactggggtgatgatgcagtcgccttgcaaattacagtcctggaagctggtacccaagctccagagggcgtggctcgcggccctgacgcactgacactactggaatacaccgagaccaggaaccagttcctggacgagctgatggagctcgaaattttcctggctcagagggccgtggagctgagcgaagaggccgatgtgctctccgtctctcaatttcagctggcacctgccattctgcaggggcagaccaaagaaaagatggtgaccatggtatcggtgctggaagatctgatcgggaagctcaccagcctccaattacagcatctcttcatgatactggcctctccgcggtacgtggaccgcgtgaccgagtttctacagcaaaaattaaagcaatcgcaactgttagcacttaaaaaagagctgatggtgcagaaacagcaggaggccctggaggagcaggctgctctggaacctaagttagatttactgttggagaagactaaagaactgcagaagctcattgaagcagatatctccaagaggtacagtgggcgaccagtcaacctgatgggcacttcactatag

SEQ ID NO: 111546 - DNA, 3864 bp, Artificial Sequence
  Description of Artificial Sequence: Synthetic coding sequence
atgcaccccgatctcgggcccctctgtaccctgttatacgtcaccctgacaattctctgctcatcagtgagttctgatttagccccttattttaccagtgaacctctgtccgcagttcagaaacttggcgggccagtggttctgcattgttcggcacaacctgtgacaacccgaatttcttggctgcataacgggaaaactctcgatggcaatctggagcatgtgaagattcatcaggggaccctgacaatcctgtccttgaatagctctctattagggtattaccaatgcttggctaataacagtatcggcgctattgtctccgggcccgccactgtgtccgtggccgtgttgggtgatttcggttcatctactaaacatgttattacagcagaagaaaaatctgccggattcattggatgcagggtgccagaatccaatcctaaggcggaagtcaggtataaaatccggggcaaatggttggagcactctaccgaaaactaccttatcctaccttccgggaacctgcagattctcaacgtatctttagaggataaagggtcttacaaatgtgccgcctacaaccccgtcacccaccagctaaaggttgaacccattgggaggaagctccttgtgtccagaccctcctcagacgatgtccatatcctgcatcctactcatagccaggcacttgcagtgctaagcaggagcccagtcacactcgaatgtgtggtttccggtgtcccagccccacaggtgtattggctgaaagatggccaggacatcgcaccaggcagtaactggcggagattatacagtcatctggctaccgacagtgtggaccctgccgatagcgggaactatagctgcatggctggaaacaaaagtggcgacgtcaaatatgtgacttacatggtcaatgtcctcgagcatgcaagtatctccaagggattgcaggatcaaattgtcagtttgggggcaacggttcacttcacttgcgacgtgcacggtaaccccgctcccaactgtacctggtttcacaatgcgcaacctattcatccttccgctcgtcacttgaccgctggtaatggcctcaagatcagcggagtcacagtggaagatgtcggcatgtaccagtgtgttgctgacaacggtattggcttcatgcactcaactggacggcttgagattgagaatgacggtggcttcaagcctgtaataatcaccgcccctgtgagcgctaaagtggctgatggcgactttgtgaccctgtcatgtaatgcctccgggttgccagtgccagtaatacgctggtatgactcccatggcttaattacgtctcacccatcccaggtgctacggtctaagtcaagaaagagtcaactttccagaccagaggggcttaacctggaaccagtttatttcgtactcagccaagcaggcgctagctctcttcacatccaagcggtgacgcaggagcatgcgggcaaatatatctgcgaggctgcaaacgaacatggtaccacgcaggccgaagcctcactgatggtggtgcctttcgaaacgaataccaaggctgaaactgttacccttcccgacgcagcacaaaacgatgacagatccaagcgggatgggtcggaaaccggcctgctgtccagcttcccagtcaaagtgcatccttccgccgtcgaatccgcacccgagaagaatgcaagtgggatctctgtgcctgacgccccaattattttatcacccccacagacccatacacctgacacctacaacctggtgtggcgtgctgggaaagatggcggactgccgataaacgcatactttgtgaagtatcgtaagcttgacgatggcgtagggatgctcgggtcctggcacacggtgcgcgtccctgggagcgaaaacgagttacacttggctgagcttgagcccagttctctgtatgaagtgctgatggtcgcccggtcagccgctggagagggccaacctgcaatgcttacattcagaaccagtaaggagaagacagcttcgtccaaaaatacccaagccagcagccctccagttgggattcctaagtatccagtggtgtcagaggctgccaacaacaactttggagtggtgctgaccgactcctctcggcattcgggcgtgccagaagcccctgataggcctacaatatccaccgcgtcggagacatcagtgtatgtgacgtggatcccacgggccaatggcggcagtcccataaccgcatttaaagtcgaatacaaaaggatgaggacttctaattggctggtggccgctgaggatatccccccttcaaaactctctgtagaagtgagaagtctggaacctggctcaacctataaatttcgcgtgattgctattaaccactacggcgaaagttttaggtctagcgctagcaggccgtaccaagttgttggatttcctaacagatttagttccagaccaattacaggacctcacatcgcatataccgaggccgtgtctgacacccagatcatgctgaaatggacttacataccctcttcaaataataatacaccaatccaggggttttatatctattacaggcctaccgacagcgataacgacagtgattataaacgggacgtcgtggaaggatccaagcagtggcacatgattggccatctgcagcccgagacatcctacgatattaagatgcagtgctttaatgaaggaggagagagtgaattcagtaacgtcatgatttgtgagacaaaggttaagagagtgcctggcgcatccgagtatcccgtcaaagaccttagcaccccccctaacagtctgggaagcggcggcaacgtaggccccgcaactagtcctgctaggtccagcgatatgctttacttaattgtcgggtgcgtgcttggggtcatggttctgatacttatggtctttatagctatgtgcttgtggaagaatcggcagcagaacacaattcagaagtacgatcccccgggctatctttaccaggggtcagacatgaatggtcagatggtcgactacacaaccttatcaggcgccagtcagatcaatggaaatgtccacggcggcttcttgaccaatggggggctctcgtccggttattcccacctgcatcacaaagtgcccaacgccgtcaacggtattgtgaacgggtcccttaacggaggcctgtactccggccatagcaatagccttacacggacacatgtagactttgagcatccccaccacctggtcaacggaggggggatgtacacagcagtccctcagatcgaccccctggaatgtgtgaactgtagaaattgccgcaacaataatcgctgtttcactaaaactaactccaccttttccagttctcctcccccagtagtgcccgttgtggccccttacccccaggacggcctagaaatgaaacccttatcgcatgtgaaggttccggtatgtttgacctcagccgttccggattgtggacaactccccgaagagagtgtcaaggacaatgtggagccagttcctacccagcgaacttgttgtcaggacatagtgaatgatgtgtcctcggacggcagcgaggatccagccgagttttctcggggtcaggagggcatgatcaacctgcgcattcctgatcacctccagctcgcaaaatcatgtgtgtgggagggcgactcatgtgcccattctgagacagagatcaacatcgtgtcatggaatgccctgattttgcctcccgtcccagagggatgtgcagaaaagaccatgtggagcccccccggaatccctctggattctccaacagaagtactgcagcagccgagggagacctag

SEQ ID NO: 111547 - DNA, 3795 bp, Artificial Sequence
  Description of Artificial Sequence: Synthetic coding sequence
atgcaccccgacctgggacctctgtgcactctactatacgtgactcttaccatcctttgctcgagcgtgtcttcggacctggcgccatattttacttccgaaccactctctgccgtgcagaaacttggagggcctgttgttctgcattgctccgcacagcctgtgacaactcgcatcagttggctgcacaatggaaaaactctcgatggtaacctggaacacgtaaaaattcaccaaggaacattgactatcttatccttaaactcctctctactgggctactaccaatgtctagcaaataatagcatcggagcaatagtctcaggaccggcgactgtctctgtagccgtcctcggagattttggtagttcaacaaagcacgtgataaccgcagaagagaagtctgcaggcttcatcggatgtcgggtcccggaatctaatcccaaggccgaggtgaggtacaagattcgcggcaaatggttagagcacagtaccgagaattatctgatcctcccaagcgggaacttgcagatccttaatgtctcactggaggataagggctcttataagtgcgccgcttacaatcccgtcacccaccagctgaaagtcgaacccatcgggagaaaactgctagtcagccgcccttcgagcgacgacgttcacatacttcacccaacacattctcaggccttggctgtcctgtctagaagtccagtcacgctggagtgcgttgtgtctggggtacctgcaccccaggtatattggctcaaggacggccaagatatcgcacccggttctaactggcgtcggctgtatagccatttggcaacggatagcgtggacccagcagactccggaaactattcgtgtatggcgggaaataagtcgggagacgtcaaatacgtgacgtacatggtaaacgtgctcgaacacgctagtatttccaaggggcttcaggatcaaattgttagtcttggtgctacagttcactttacctgtgacgttcacggcaacccagcccccaactgcacctggttccataacgcccaacccatccacccgtccgccaggcaccttactgcgggcaacggtctgaaaatctcaggcgtgacagtggaggacgtaggcatgtatcagtgcgtcgccgataatgggattggctttatgcattctacgggtcgactcgagatagaaaatgatggtgggttcaaacctgtgatcataacggcgcctgtgagtgcaaaagttgccgacggtgatttcgtgacattgtcctgcaacgccagcggcctgcctgttcctgtgatccgctggtacgattctcatggcctgattacgtcccatccatctcaagtgcttaggtccaaatctcgcaagagccagctgtctcgtcccgaggggcttaacttggaacctgtgtactttgtgctgtcccaggccggcgcttcctctctccacatccaggccgtaacgcaggaacatgccgggaaatacatctgtgaggccgctaacgaacatggaactactcaagccgaagctagcctgatggtagtcccattcgaaacaaacactaaggccgaaactgttaccctgcccgatgcggcccagaacgatgacagatctaagcgcgacgggtcagagactggcctcctgtctagctttcccgttaaggtccacccatcagctgttgagagtgctcccgagaaaaatgcttccggaatatctgtgcctgatgctccaatcattctgtccccccctcaaacacacaccccagacacctataatctcgtgtggagagccggaaaggatggcgggctcccaataaatgcttactttgttaagtatcgcaagcttgacgatggagtcggtatgctcggcagctggcacacagtgagagtacctggatctgagaacgagctgcatctggccgagctagagcctagctccttatacgaggttctaatggtagctcgctcggctgctggagaagggcagcccgcaatgctgacctttcgtacatccaaagagaaaactgcttcaagcaaaaacacccaggccagctccccgcctgtgggaatacccaagtacccggtcgttagcgaagctgccaacaataattttggcgtcgtactgacggacagcagtaggcactcaggagtcccagaggccccagacagaccgactatctccacggctagcgaaaccagtgtttatgtgacttggattccacgagcgaatggagggtccccaattacagcatttaaggtggagtataagcgcatgcgcacctctaattggttagttgctgcagaggacatcccaccctctaaactgagcgttgaggtaagaagtcttgaaccaggctcaacatacaaattcagggtaatcgcgatcaaccattatggcgagtctttcagatcctctgcaagtcgcccctatcaggtcgttggcttccccaacagattttcctcgagacctataaccggaccccacatagcctatactgaggctgtgtctgacacccagatcatgctcaaatggacatacattccctctagcaacaataacacccccatacagggcttttacatatattatcgacctactgactctgataacgactccgactataagcgtgacgtagtggaaggaagtaaacagtggcacatgataggacacctgcagcctgaaaccagctatgacatcaaaatgcaatgtttcaacgagggaggtgagagtgagttctccaacgtgatgatctgcgaaaccaaagtcaaaagggtgcccggagcttcagaatatcccgtgaaggatctgtccacccccccaaactcattgggatccggaggcaatgtcggacccgctacctctcccgcgagaagttccgacatgctgtacctgatcgtagggtgcgtactgggcgtgatggtcctgattctgatggtcttcatcgcaatgtgtctgtggaaaaacagacagcagaacaccatacagaagtacgatccgccaggctacctgtaccagggatcagatatgaacggccagatggtagactacactaccctaagtggggctagccagatcaacggtaatgtccatggaggcttcttaactaacggtggactgagttctggctatagccacctccaccataaagtgcccaatgccgtgaatggaatcgtcaatggaagcctcaacggcggtctctactctggccactctaacagcctgacccggactcacgtcgatttcgagcatccacaccatcttgttaatggaggtggcatgtacactgctgttccccagattgatcccctggaatgtgtgaattgtaggaattgcaggaacaacaacagatgttttaccaagacaaattccacattttcttcatctccaccaccagtggtaccagttgtggcgccatatccgcaggacggtttggagatgaagcccctgtctcacgtgaaagtgcccgtgtgcctcacatccgccgtgcctgattgcggtcaactcccagaagagtccgtgaaggataacgtagaacctgtccccacacagagaacctgttgtcaagacatagtgaacgatgtgtcaagcgatgggtccgaggatcctgcggaatttagccggggagattcctgcgcccatagtgaaacagaaatcaatatcgtatcttggaacgctctgatcctcccacctgtcccggagggttgtgccgaaaaaaccatgtggagcccccccggtatcccattggattcaccaaccgaggtgcttcagcaaccaagggagacatag

SEQ ID NO: 111548 - DNA, 1386 bp, Artificial Sequence
  Description of Artificial Sequence: Synthetic coding sequence
atgcttgagctccgacaccgggggtcgtgcccagggccaagagaggctgtcagccctccccaccgcgaaggtgaggcagctggaggagaccacgagactgagtcgacatccgacaaggagactgatatcgacgacagatatggagatttagactctcggaccgattccgatattccggaaatcccaccctcttccgaccggactcccgagatcctaaaaaaggctcttagtgggttatctagtcgatggaagaactggtggattagaggtatcctcacgctgactatgattagcctgttcttcctgattatttacatgggctcttttatgctcatgcttcttgtcctgggaattcaggtgaagtgtttccatgaaattataacaatcggatatcgagtttatcatagctacgatctgccctggttccgcaccctgagctggtatttcttattatgtgtgaactatttcttttatggggagacagtggctgactacttcgcgacttttgtgcagagggaagaacaactgcagttcctgattcgatatcatagatttatctctttcgcgctctacttggccggcttttgcatgttcgtcctcagcctagtgaagaagcattatagattacaattctacatgtttgcgtggactcacgtgacccttctgatcactgtgacccagtcacacctggttatacagaacttatttgagggcatgatctggtttcttgtgccaatcagcagtgtaatttgcaatgacataactgcttatctgttcggatttttttttggaaggacacctttgattaaattgtcaccaaagaagacatgggaaggcttcataggaggtttcttcagcacagtggtcttcggttttatagccgcatacgtgctgtccaaataccaatatttcgtgtgtccggtggagtaccggagcgacgtgaactcttttgtgaccgagtgtgagccgtccgagctgtttcagctccaaacctatagcctgcctccattcctgaaagccgtgctacggcaagagcgtgttagtttataccctttccaaatccactcaatcgcgctgtctactttcgcctcacttatcggccccttcggaggctttttcgcgagtgggttcaaacgagcgttcaagattaaagattttgccaacaccatcccaggtcacgggggtattatggatcgatttgactgccagtatctgatggccacgttcgttcatgtgtacatcacatcttttatacgggggcccaatccttccaaagtgctccagcaactgcttgtcctccagcccgagcagcagttgaacatctacaagacattaaaaactcacttaattgagaagggcatactgcagccaacactaaaagtgtag

SEQ ID NO: 111549 - DNA, 978 bp, Artificial Sequence
  Description of Artificial Sequence: Synthetic coding sequence
atgtcacgtctgaggcacccccggacacgctactttctcctctgtgtcaactactttttttacggtgagactgtcacagactactttttcaccctggtccagcgagaagaaccgttacgcattcttagcaaataccatcgattcattagcttcacactctacctgatcggcttttgcatgttcgtcctgtcattagtaaagaagcattaccggctgcagttctacatgtttggctggacgcacgttaccctgctcattgtggttacgcagagtcacctggtgattcataacctgtttgaaggcatgatctggtttatcgtgccaatctcatgcgtcatctgcaatgatatcatggcgtatatgttcggattcttctttggcagaactcccctgataaagctgtcaccaaagaagacctgggaagggttcattgggggcttctttgcgactgtggtgtttggtctcctccttagttatgtgatgagcggttatcggtgctttgtatgtcccgttgagtataataacgacaccaattcttttaccgttgactgcgaaccctcagacctgtttcgtttgcaagagtataatatccccggggtgatccagagcgtgattggctggaagaccgtccggatgtaccccttccagattcactccatagccctgtccactttcgcttcactgatcgggccttttggaggatttttcgcttctgggttcaaaagagccttcaagatcaaggatttcgccaacacaattcctgggcacggtggaatcatggacagattcgactgccagtatttaatggccacgttcgtgaatgtgtacatcgcgagctttatccgtggtcccaatcccagcaaattgattcagcagttcttgaccctgagaccagaccagcagctccacatcttcaacaccctgaggagccatttaatcgataaggggatgctgacttccaccactgaggatgaatag

SEQ ID NO: 111550 - DNA, 753 bp, Artificial Sequence
  Description of Artificial Sequence: Synthetic coding sequence
atgagccggttacgtcatcccagaactcggtggaaaaattggtgggtcagaggcattctaaccctggccatgatcgctttcttctttataattatctacctaggacctatggtgctcatgattatcgtgatgtgtgtgcagattaaatgtttccacgagataatcacgatcggatacaacgtatatcattcctatgacctgccatggtttagaaccctaagctggtacttcttgctctgcgtgaattacttcttctacggggaaactgttacggactacttctttacattagtgcagcgcgaagaaccattacggatcttatcaaagtaccaccgatttataagctttactctctacttgattggtttctgtatgttcgttctctccttggtgaaaaaacattaccgactccagttctacatgttcggctggacccacgtcaccctattaatcgtcgtgacccagtctcaccttgtgatccataatttgttcgaaggcatgatctggttcatcgtgcccatttcttgcgttatctgtaatgacatcatggcatacatgttcgggttttttttcggacggactccactcattaagctgagtccaaaaaaaacttgggaagggtttattggtggctttttcgctactgtcgtttttggccttctgctctcttacgtgatgtcgggctaccgttgcttcgtgtgtccagtggaatataataacgatacaaattctttcacagtagattgtgaatag

SEQ ID NO: 111551 - DNA, 1338 bp, Artificial Sequence
  Description of Artificial Sequence: Synthetic coding sequence
atgacagaactgcggcaacgggttgctcacgagccagtggccccgccagaggacaaggagtcagagagtgaagctaaagtggatggagaaaccgccagcgatagcgagagtagggctgaatccgcacccttgcctgtgtccgcagacgatactcctgaggtactgaacagggccctgtctaacttgtcttccagatggaagaactggtgggtacgcggcattctcacactggccatgattgccttcttcttcatcatcatatatcttggaccaatggttttgatgattatcgtcatgtgcgtgcaaatcaaatgctttcacgaaattataaccattgggtataacgtgtatcactcttacgatctcccttggttccgaaccctgagttggtacttcttgctctgcgtaaactacttcttctacggtgagaccgtgacagattacttttttaccctcgttcagagggaggagcccttacggattctcagtaagtaccataggtttatttccttcacactctaccttattggcttttgtatgtttgtgctgagtctggtcaaaaaacactaccgacttcaattctacatgttcggatggactcacgtgaccctgctgatagtggtaactcagtctcacttggtcattcacaatctcttcgaaggcatgatctggtttattgtgccaatttcttgcgtaatctgtaatgatattatggcctacatgttcggatttttttttggccggacgcccttaattaaactgtcaccgaaaaaaacctgggaaggctttataggcggatttttcgctaccgtcgtcttcggactgctactcagctatgttatgtcaggctaccgatgctttgtgtgtcccgtagaatataataacgacaccaacagttttacagtggattgtgagcccagcgacctgtttcggttgcaggaatataacatacctggagtcatccagtccgttattggctggaaaactgtgcggatgtatcctttccaaattcactcgatagccttaagcacattcgccagcctgatcgggccctttggggggtttttcgcaagcggatttaagagagcatttaagattaaagatttcgccaacactatccccggccatggcggcatcatggatcgctttgactgccagtaccttatggccacattcgtgaatgtctacatagcgagtttcatccgcggacccaacccatccaagctcatccagcagttcctgactctgcggccagaccagcagttgcatatcttcaataccctgagatctcacctcattgataagggcatgctgacaagcaccaccgaggacgagtag

SEQ ID NO: 111552 - DNA, 648 bp, Artificial Sequence
  Description of Artificial Sequence: Synthetic coding sequence
atgtttgttctaagtctggtgaaaaaacattacaggctgcaattctacatgtttggatggacacacgtgaccctgctcatcgttgtgactcagagtcatctagtcatacataatctgttcgaggggatgatatggttcatcgtgcctatcagttgtgtgatttgtaacgatattatggcgtatatgtttggtttctttttcggacgaacgcccctcatcaagctgtcaccaaagaaaacctgggagggatttattggcggattttttgctactgtcgtgttcgggttgttaaagacggtgcggatgtacccattccaaatacacagtatcgctttgagcacgttcgcatctttaatcgggcctttcggcggattcttcgcctcggggttcaagagagcttttaaaatcaaagattttgccaacactattcctggtcatggagggattatggaccgattcgactgccagtacttgatggccactttcgtcaacgtgtatattgctagctttatcagggggccaaatccttctaaactcatccaacagtttctcacattgcggcctgatcagcagctgcacatcttcaacaccctgcggtcacatctgatcgataaggggatgctgacttccactacagaagacgagtag

SEQ ID NO: 111553 - DNA, 3675 bp, Artificial Sequence
  Description of Artificial Sequence: Synthetic coding sequence
atggagcccctgctgctgggtcgcgggctgattgtctacctcatgttccttttgttgaagttctccaaggctattgagataccaagctcagtgcagcaggtacccaccatcatcaaacaaagcaaggtgcaagtagccttcccattcgacgaatactttcagatcgagtgcgaggcgaaggggaatcccgaacctacctttagttggactaaagatggtaatcctttttatttcacagaccatcgtatcattccttccaacaatagtggcactttccggatccctaatgaaggtcatatcagccactttcagggcaagtaccggtgctttgcttcgaacaaactgggtatagctatgagtgaagagatcgagttcatcgttcctagtgtccccaaattccctaaagagaagattgacccattggaggtggaggagggtgatccaatcgtgctgccctgtaatcccccaaaaggacttccgcccctgcacatctactggatgaacattgaacttgagcacattgaacaggacgagagggtgtacatgagtcaaaaaggtgatctctacttcgccaacgtggaagaaaaggatagtaggaacgactattgctgtttcgctgccttcccccggttgcgaacaatcgtgcagaaaatgcctatgaagctgacggttaactctctcaaacacgccaatgacagcagcagtagtactgagattggctcaaaggctaactcaattaagcagcgcaaaccgaagttacttcttccgccgacagagtcagggtccgaatcctctattacaatactcaagggcgaaatcctcctcctggaatgtttcgccgagggccttccaaccccacaagtagactggaacaagattgggggtgatttgcctaagggaagggaaactaaagagaactacgggaagacccttaagattgagaacgtgtcttatcaggataagggcaactacagatgcacagcatccaatttcctgggcacagccacccacgacttccatgtcatcgtggaggagccgcccaggtggaccaagaagccacagagcgcagtctacagcacagggagcaatggaatccttctctgtgaagccgagggtgagccgcagcccacaattaaatggcgagtcaatggaagcccggttgataatcatccttttgcgggagatgtggtatttcccagggagatttccttcactaatctgcagcccaaccacaccgccgtgtaccagtgtgaggccagtaatgtgcacggcacaattttagccaacgccaatatagacgtggttgatgttaggcctctgattcagacaaaggacggagaaaactacgcaacagtggtggggtacagtgcctttctccactgcgagtttttcgccagccctgaggccgtcgtctcatggcaaaaggtcgaggaagtgaagcctcttgagggccgcaggtaccacatctatgagaatggcacgttgcagattaaccgcactacagaggaggatgccgggtcatacagctgctgggtcgagaacgctattggcaagacagccgtgactgcgaacctggatatacgcaacgccaccaaactgagagtcagtcctaagaacccgcgcattccaaaactccatatgctcgaactacactgtgagagcaaatgcgatagccatttgaaacactcactcaagctttcatggtccaaagatggagaggcttttgaaattaacggcaccgaggacgggcggataatcatcgacggtgcgaatcttacgatctccaacgttaccctcgaagaccagggtatttactgttgctccgcgcacaccgcgctggacagtgcagctgatattacacaagtgacagtcctagacgtgcctgatcctcccgagaacctgcacctgagtgagcggcagaatagaagtgtacgcctgacatgggaagccggcgcggatcataacagcaacatatccgaatatatagtcgagttcgaaggcaataaggaagagccgggaagatgggaagagctgacacgcgtgcagggaaagaagaccacagtcatattacctctcgccccgtttgtgagataccagttccgcgtgatcgccgtgaatgaagtaggccgctcccagccttcccagccttccgatcatcacgagaccccaccagcagcccccgatcgaaatcctcaaaacatcagggtgcaagcgagtcagcctaaagagatgattatcaagtgggagccactcaaatctatggagcagaacggcccgggcctagagtatcgtgtgacctggaagccccagggtgcgcctgttgagtgggaggaggaaacagttacaaatcatactcttcgggtgatgacgcccgcagtatatgctccatatgatgtaaaagtacaggcaattaaccaactgggttcaggccccgacccacaatcagtcactctctactcaggcgaagactatccggacacggcccccgtcatccacggcgtagacgtgataaacagcacactcgttaaggtcacgtggtcgacagttcctaaagacagggtccacgggagactcaaggggtatcagatcaattggtggaaaactaaatctctcctggacggaagaacccaccccaaagaggtgaatatactgaggttctccggccagaggaactctggtatggtcccgagcctggacgccttctctgagttccatcttaccgtactggcgtacaatagtaaaggtgcgggccctgaaagtgaaccatatatctttcaaactccggagggagtgccggagcagcccacatttctcaaagttatcaaagtggataaagacactgcaaccttgtcatggggtctccctaaaaagttgaacggcaatcttactggttatctactccaataccagataataaatgatacctatgaaataggagagctgaacgacatcaatatcacgacgcccagcaagccctcgtggcacctttctaacctcaatgctacaaccaaatacaagttctatcttagggcttgtacgagccaggggtgtggcaaacctataacggaggagtcctctacactgggcgagggttctaagggcatcggcaaaatatctggcgtcaatctgacgcagaagacacacccgatagaagttttcgagcctggcgctgagcacatcgtcaggctcatgactaaaaattggggcgacaatgacagcatctttcaggatgtgattgagaccaggggtcgtgaatacgctggactttatgacgacatttccacacagggttggttcatcggactgatgtgcgccatcgccctcctcaccttgctgttgctgaccgtatgctttgtcaagaggaataggggcggcaagtactccgtgaaggaaaaagaagacctgcaccccgatcccgaaatccagtccgtgaaagacgagaccttcggggaatatagcgattccgatgaaaaacccctgaaaggaagcttgcggagcctaaaccgggacatgcagcccacggaaagcgccgattcactggtcgagtacggggagggagaccacggactgttctcagaagatggctcgttcattggcgcttacgctggatctaaggagaaaggatcggtggaatccaatggcagctctacggccacctttcctcttcgcgcatag

SEQ ID NO: 111554 - DNA, 3627 bp, Artificial Sequence
  Description of Artificial Sequence: Synthetic coding sequence
atggaaccactgctgctcggccgaggcctgattgtgtacttaatgttcttgctgctgaagttctccaaggctattgagattccctccagcgtgcaacaggtaccaactatcattaaacaatcgaaagtgcaggtagcttttcccttcgacgaatattttcagatcgaatgtgaggctaaggggaacccagagcccaccttttcttggactaaggatggaaatccattctatttcactgatcacaggattatcccatccaataattcaggaacttttaggatacctaatgagggccacattagtcatttccagggaaagtacaggtgctttgcctctaataagctgggcatcgcaatgtccgaagagatcgagttcatcgtcccatccgtgccaaagttccccaaagagaaaatcgatccattggaagttgaagaaggggaccccatcgttcttccgtgtaaccccccaaagggcctgccacctctgcatatctactggatgaatattgaattggaacacattgagcaggacgagagagtttacatgtcccagaagggcgacttgtacttcgccaacgtggaggaaaaagactctcgaaacgattattgctgctttgcagcctttcctcgactcagaaccatcgtccagaaaatgccgatgaagctgacggtcaactcaagcaactctatcaaacagcgaaagcctaagcttttgctcccacctacagagagtgggagcgaaagttccataaccatcctcaagggcgagattctgctgctggagtgttttgctgaaggcttacctacaccccaagtggattggaataaaatcggcggagatctcccaaagggccgagaaaccaaagaaaattacgggaagacactgaaaattgaaaacgtgtcttaccaagacaaaggaaactaccggtgtaccgctagtaattttctaggaactgcaacccacgattttcatgtgatcgtcgaggagccccctagatggaccaagaaacctcagtctgctgtgtacagcactgggtctaacgggatcctgctgtgcgaagccgaaggcgagcctcagccaacgattaagtggagggttaatggcagccctgtggacaatcaccccttcgccggggatgtggtctttccacgggaaatctcatttaccaatctgcaaccaaaccacacggcagtgtaccagtgtgaagcttcaaatgtgcacggtaccatcctcgcgaatgcaaatatcgatgtcgtggatgtaaggccgcttattcagactaaagacggggagaattatgcaaccgtcgtcggctattccgcttttttgcactgcgaattttttgcttcgcctgaggctgttgttagttggcaaaaggtggaggaagtaaagcctttggaaggtagacgataccatatatacgaaaacggaaccctgcagattaaccggacaacagaagaagacgcaggctcttattcctgttgggtggagaacgccatcgggaaaacagctgtgactgcgaatctggatatccggaacgctaccaagctcagagtgtctcctaaaaaccctagaatccctaagcttcacatgcttgagctgcactgcgaatcgaaatgcgacagtcatctgaaacatagtctgaaactgagttggagtaaggacggggaggcgtttgagatcaacgggaccgaagatggccggataatcattgatggcgcaaatttgactataagtaacgtgacgctggaagatcaaggcatctactgctgctcggcgcatacagccctggattctgccgccgacattactcaggtaacagtgctcgacgtacctgatcccccagaaaatttacatctaagtgagcgccagaatagaagtgtcaggttgacttgggaagcgggagcggaccacaacagtaatataagcgagtatatagtcgagtttgagggtaataaagaagagcccgggcgctgggaggaactgacaagagtgcagggcaagaagacaactgttattttgcctctggcacccttcgtgcgctatcagttccgggttatagcagtgaatgaggtgggaaggtcccaacctagtcagccttcggatcaccacgagacccctcctgccgcccccgaccggaatccccagaacattcgggtgcaggctagtcagcccaaggagatgatcatcaaatgggagccccttaaatctatggagcagaatggccccgggctggaatatagagtgacttggaagccacagggggcaccagtcgagtgggaggaggaaactgtcacaaaccacacgctgcgtgttatgacaccagctgtgtacgccccatacgacgtgaaggtgcaggcaattaaccagctcggctccggtccagacccacagtccgtgacgctatacagcggggaagattatccagacacagcccccgtcatccatggcgttgatgtgataaacagcactttggtcaaggtcacctggtccaccgtcccaaaagaccgggttcatggacggttgaaggggtaccagatcaattggtggaaaaccaaatctctcttggacggacggacacacccgaaggaagtaaacatcctgagattcagtggacagcgtaactccgggatggttccctctctggacgcattttcagagttccacctgactgtgcttgcctacaattcaaaaggtgccgggccagagagcgaaccttacatcttccagacacctgagggagtgccggagcagccaacatttctgaaagttatcaaagtggataaggacacagctaccctgtcatggggattgcccaagaaactaaatggtaatctcactggatacctgctgcagtaccaaattatcaacgatacttacgagatcggggagctgaacgacatcaatattactaccccctccaagccaagttggcacctgagcaacctgaacgccaccaccaagtacaagttttatctgcgcgcttgcacttcacaaggctgtgggaagcctattactgaggagagttccacactcggggagggctccaagggcatcggaaagatatccggagtgaacctgacgcagaagacccacccgatcgaggtgtttgagcccggagccgagcacatcgtgcgtcttatgaccaagaactggggcgacaatgacagtatctttcaggatgttattgaaacacgcggcagagagtatgccggcctgtatgatgacatctcaactcagggatggttcattggactcatgtgtgcaattgccctgcttacgctgctgttgctgaccgtatgcttcgtgaaacgaaaccgtggaggcaaatacagcgtaaaagagaaagaggacctacatcccgatcctgagatccagagtgttaaggatgaaaccttcggagagtactctgattcagatgagaagccactgaagggaagtctgaggagtttgaatagagacatgcagcccacagagtccgctgattctttggtcgaatatggggagggcgatcatgggcttttcagcgaagacggctcttttattggagcttacgctggctctaaagagaaaggtagcgtcgaatccaatggtagcagtaccgcaacctttccactcagggcctag

SEQ ID NO: 111555 - DNA, 291 bp, Artificial Sequence
  Description of Artificial Sequence: Synthetic coding sequence
atggagcctcttctactgggcaggggactgatcgtatatctcatgttcttgctgcttaagttttctaaggccattgaaatcccttctagtgtacaacaggtgccaaccattatcaagcagtccaaagtgcaagttgcgttcccattcgatgaatacttccagattgaatgtgaggcaaaaggaaatccagagcccactttctcttggactaaggacggcaatcccttttactttacggaccacaggatcatcccatctaataattccgggactttccgaatccccaattag

SEQ ID NO: 111556 - DNA, 201 bp, Artificial Sequence
  Description of Artificial Sequence: Synthetic coding sequence
atggagccactgctcctgggtcgagggctgatagtgtacttaatgttcttactactgaaattttctaaggccatagagattccaagctccgttcagcaagtccccactatcattaagcaaagtaaagtccaggtagctttcccctttgatgaatatttccagattgaatgtgaagccaagggaaatcctgaacctacctag

SEQ ID NO: 111557 - DNA, 546 bp, Artificial Sequence
  Description of Artificial Sequence: Synthetic coding sequence
atggaaccccttttgctgggaagggggctgatagtttacttaatgttcctactgcttaagtttagcaaagccattgagatacccagctctgttcaacaggtacctaccatcattaagcagagcaaggtgcaggttgcatttccttttgatgaatattttcagatagagtgcgaagccaagggcaaccccgagccaacattctcatggactaaggacggaaatccgttttatttcacagaccaccggataatcccttctaacaactctggcacatttagaattcccaacgaaggccacatttctcacttccagggtaagtaccgctgtttcgcttctaataagcttggtatagcgatgagcgaagaaatcgaattcatcgtgccatccgttcctaaattcccgaaggagaaaatcgaccctcttgaggtggaagagggagatcccatagtgctgccgtgtaatccgccgaaggggctcccaccactgcacatctactggatgaacattgaacttgaacacatcgagcaggacgagagggtctactag

SEQ ID NO: 111558 - DNA, 954 bp, Artificial Sequence
  Description of Artificial Sequence: Synthetic coding sequence
tagagcgtgacactgtatagtggagaggactaccccgacacggctccagtgatccatggcgttgacgtaatcaacagcactctagtcaaagtgacctggagcaccgtgccaaaagatcgcgtgcatggtcgactcaaaggataccagattaactggtggaaaactaaatctctactggatgggcgcactcaccctaaagaggtgaatattttaaggttctctgggcagaggaattccggcatggtcccatctctggacgctttctccgagttccatttaacagtcctcgcatataactccaaaggggccggtcctgaatccgagccttatatctttcagacccctgaaggcgtacctgagcagcctacatttttgaaagtcatcaaagtcgataaggatacagctactctatcatggggtttaccaaagaagctcaacggaaacctgactgggtatctcctgcagtatcagatcataaatgatacctacgagattggggagctaaatgatataaatatcacgacaccctcaaagccttcttggcacctttcaaacctcaatgcaaccaccaagtacaagttttaccttagggcatgtacctcgcagggttgtggtaaaccaatcacggaggagagctctaccttgggagaaggtaaatacgcagggctgtacgatgatatatcaacacaaggttggttcatcggactcatgtgtgctatcgcattactcaccctgttgctgctgaccgtatgttttgtgaaacgtaatagaggaggtaaatatagtgttaaagaaaaggaggacctgcaccccgaccctgaaatacagagcgtgaaggacgaaacctttggggaatattccgacagtgacgaaaagcccttgaaaggctcactacgctccctcaacagggacatgcagccaacggagtccgcagacagtcttgtcgaatattag

SEQ ID NO: 111559 - DNA, 258 bp, Artificial Sequence
  Description of Artificial Sequence: Synthetic coding sequence
atggaacccctgctcttgggaaggggcctaattgtctacttaatgttccttctgcttaagtttagcaaggctatcgagattccctcaagtgtgcagcaggtcccaacaatcatcaagcagtctaaggtccaagtcgcgtttccattcgatgagtatttccaaatcgagtgcgaggcgaaagggaatccagagcctacctttagttggaccaaggatggtaacccattttacttcaccgatcataggattatcccttag

SEQ ID NO: 111560 - DNA, 450 bp, Artificial Sequence
  Description of Artificial Sequence: Synthetic coding sequence
atggaaagtcgcgggaagtcagcttctagccctaaacctgataccaaggtacctcaggtgactactgaggccaaagttccaccagccgccgatggcaaggcccctctcaccaaaccctccaaaaaagaagctccagccgagaagcagcaacctcccgccgctcctactaccgcacccgcaaagaagacttctgctaaggccgaccccgcgttgctcaacaatcattctaaccttaaacctgctcccaccgtgccgagctccccagacgctacgccggagcctaaggggcccggagatggcgccgaggaggatgaagccgcgtcaggtggccccggcggacggggcccatggagctgcgaaaactttaaccctctgctggtggctggcggggttgcagtggccgcaattgcccttatacttggagtggccttcctggtccgcaaaaagtag

SEQ ID NO: 111561 - DNA, 627 bp, Artificial Sequence
  Description of Artificial Sequence: Synthetic coding sequence
atgtcctccgaaccacctcccccttaccctgggggtccgacagcccctctcttggaggagaagtctggcgcgccccccacgccaggcaggagctcaccagcggtgatgcagcctccccccggtatgcccctgcccccagcagacatagggccccccccctacgaaccaccagggcacccaatgccacagcccggcttcatccctccccacatgagcgccgatggcacatatatgccccctggattttaccctccccctgggccccatcctcctatggggtattatcctcctggaccatacactccaggaccttatcctggacctgggggccacaccgctactgtgcttgtgccatccggagctgctacaaccgtcactgttctgcaaggcgaaatctttgagggcgcccccgtacaaactgtttgcccccattgtcagcaggccatcaccactaaaataagctacgagatcgggctgatgaacttcgtgctcggcttcttctgctgctttatggggtgtgatctgggctgttgcttaatcccatgcctcattaacgattttaaggacgtcacacatacttgtccctcctgcaaggcatacatctacacttacaaacgcctgtgttag

SEQ ID NO: 111562 - DNA, 456 bp, Artificial Sequence
  Description of Artificial Sequence: Synthetic coding sequence
atggcggccagcacttcaatggtacccgtggctgtgaccgccgctgtggcacccgtcctctccatcaacagcgactttagtgacctgcgcgagataaagaaacagttactgctgatcgccggccttacccgggagcgtgggctgcttcacagctctaagtggtctgcggagctcgctttctccctacctgctttgcctttggcagagcttcagcccccaccaccaatcactgaggaggacgcccaagatatggatgcttacacgctggcaaaagcctactttgatgtcaaggagtatgacagggctgcccactttttgcacggttgcaactctaaaaaagcatacttcctctatatgtactcaagatatctggtgcgggccatcttgaaatgccactccgctttttcagagacaagcatattccgaactaacggcaaggttaagtcctttaagtag

SEQ ID NO: 111563 - DNA, 1794 bp, Artificial Sequence
  Description of Artificial Sequence: Synthetic coding sequence
atggcagcctctacttccatggtccctgtggctgtgacagccgcggtggctcccgtgctttcaatcaactctgatttttccgatctgagggagatcaaaaaacagctgctgcttatcgccgggctgactagggagagaggcttgcttcatagcagcaagtggtccgctgagctagccttcagcctccctgccttaccattggccgagttacagcctcccccccccattacggaggaggacgctcaggacatggacgcatacacattagctaaagcgtatttcgatgtgaaggagtatgaccgtgccgcacacttcttgcatggctgcaatagcaagaaggcatattttttgtacatgtatagccgctatctgtcaggagagaaaaaaaaagacgacgagacagtcgacagcctggggcctctggaaaagggacaggtcaaaaacgaagcactccgggaactgagagtggagctgtctaagaagcatcaggcacgggagttggatggctttggcctgtatctttatggggtcgtgctgcggaaactggatctggtgaaagaggctattgacgtatttgtggaggctacccacgtccttccgcttcactggggagcctggttagagctatgtaatctgataaccgacaaagagatgcttaaatttctttccctgccagatacctggatgaaggagttctttctcgcacatatctatactgagttgcagctgattgaggaggcactccagaaataccaaaacttgatcgacgtgggtttttctaagtcttcttatatcgtgagtcagattgcagtcgcttatcataacatccgagatattgataaggctctaagcatctttaatgaactgcgtaagcaggatccctatcgcatcgagaacatggatacattctcaaaccttctgtacgtgcggtccatgaagtctgagttgtcctatcttgcccacaatctgtgcgagattgacaaatatagagttgaaacttgctgtgttatcggtaactactactccttgagaagtcagcatgagaaagctgccttgtacttccagagggccctgaagctgaatccgagatacctcggggcctggaccctcatgggccatgagtacatggaaatgaagaacacttctgctgccatccaggcctaccggcacgccatcgaggtgaacaaaagagactaccgagcgtggtacggcttgggccagacctacgagatcctgaagatgccattttattgcttatattattataggagggcacaccagttgcggcctaacgactctagaatgttggttgctttgggcgaatgttatgagaagttgaaccagttggtcgaggccaaaaagtgctactggagggcgtacgcagtgggggatgttgagaaaatggcactggtcaagcttgcgaagctgcacgaacagctcacggaatcagagcaggcagcacagtgctacattaagtatatccaggacatttacagctgcggtgagatagtggagcacctggaagagagcaccgcttttagatacctggcccagtactatttcaaatgcaagctgtgggatgaagcctcaacatgtgcgcagaagtgttgcgcctttaatgacacccgagaggagggcaaagccctgttgcgccagatcctccagttgcgtaatcagggcgaaactcctactactgaggttcctgcgccatttttcttacccgccagcttaagcgccaataataccccgacccggagggtgtcaccactgaatctgtctagcgttaccccgtag

SEQ ID NO: 111564 - DNA, 1575 bp, Artificial Sequence
  Description of Artificial Sequence: Synthetic coding sequence
atggagctcggaccagaaccaccccatcggcggcggcttctgttcgcatgctctcccccgcctgcctcacagcctgttgtgaaggctttgttcggggcaagcgcagcaggcggcctgtcacctgtaacaaatctaaccgtgacgatggaccagttacagggcctggggagcgactatgaacagccactcgaagtaaagaacaattcaaacctgcagcgcatgggatcctccgagtccacagattcaggtttctgtctggatagccccggccctctggattccaaagaaaatctcgaaaaccccatgaggcgaatccattccctgccccaaaagttgctgggatgctcacctgccctgaaaagatcccattccgactcattggatcatgatatctttcagctcatcgacccagatgagaataaggaaaacgaggccttcgaatttaaaaagccagtaaggcctgttagccgtggatgccttcactctcatggactgcaggaggggaaagacctcttcacccagcgtcaaaatagcgcgcctgcccggatgctctcgagcaacgagcgggatagcagcgaacccgggaatttcattccccttttcactcctcagtccccagttacagctaccctgtcagacgaggacgacggcttcgtggacctgcttgacggcgagaacctcaaaaacgaggaggagactccatcctgtatggcctcattgtggacagccccgttagtcatgcgcaccactaatctggacaatcggtgtaaattgtttgacagcccctctctttgcagttcttctactcgatctgtgttgaagcggccagaacgctctcaggaggagtcacctcccggtagtactaagaggcggaagagcatgtcgggcgcaagtccaaaagagtccaccaaccctgagaaggcacacgaaacacttcaccagagcttgtccttagcctcctccccaaagggtacaatcgagaatatcctggataatgatccgcgggatctcattggcgatttctccaaggggtacctgttccacacggtcgctggaaaacaccaggaccttaaatatatttctccggaaatcatggctagcgtgctcaatgggaaattcgctaatctgataaaggaatttgtgattatcgactgcagatacccgtatgagtacgaaggcggacacatcaaaggtgccgttaacctccatatggaggaggaggttgaagactttttgctaaagaagcctatcgtcccaaccgatggcaaaagggtgattgtcgtgtttcattgcgaattcagctctgagcgaggcccacgtatgtgccgctatgtgcgagaaagggacagattaggcaatgagtatccaaaactccactatcccgagttgtatgtgctgaagggaggctataaagaattctttatgaagtgccagtcttattgcgagcctccctcttacaggccgatgcaccacgaagactttaaagaggacctcaagaagtttcggaccaaaagtaggacatgggcgggagagaagtcaaagagagagatgtattctaggctgaaaaagctgtag

SEQ ID NO: 111565 - DNA, 1455 bp, Artificial Sequence
  Description of Artificial Sequence: Synthetic coding sequence
atggagctgggtcccgagcctccgcaccgaagaaggctgctgtttgcgtgttcgcctccacccgctagccagccagtggtgaaagctctgtttggcgcttctgccgcgggtggtctgtcaccggtcaccaatcttacagtcactatggatcagctgcaagggctgggatctgactatgagcaacccctcgaggtgaaaaataactccaacctgcagaggatggggtcttccgagtctactgacagcggcttctgcctggactctcctggtcctctggattctaaagaaaacctggagaatccgatgagaagaatccacagtctgccacaaaagttgctgggatgttcgcccgccttgaagaggagccactcagactcgcttgaccacgatattttccagctgatcgaccctgacgagaacaaggaaaatctgagctccaatgagagagactcctcagaaccaggcaatttcatcccactatttacccctcaaagcccagtaacagccacacttagtgatgaagatgatggcttcgtggacctgttggacggtgaaaatttgaaaaatgaggaggagaccccgtcttgcatggcaagcttatggactgctcctcttgtgatgaggacaacaaacctggataatcggtgtaaacttttcgatagcccatccctttgctcttctagtactaggagcgtgctaaagcggcccgaaagaagccaggaggaatcccccccgggctctactaagcggcggaagtcaatgtccggcgctagccctaaagagagtacaaaccctgagaaagctcatgaaacactgcatcagagtctgtccctcgcctccagtcctaaggggacgattgagaacatcctcgacaacgatccgcgcgatcttatcggtgacttcagcaaaggctatcttttccatactgttgccgggaagcaccaggatttaaaatatatcagcccagagattatggcatcagtgctgaacgggaaatttgctaaccttattaaggagttcgttattattgattgtcggtatccttacgaatacgagggaggacacataaaaggcgctgtaaatctccacatggaagaggaggtggaagattttctgttaaaaaagcccattgtacccaccgacgggaaaagagtgatcgtcgtctttcattgtgaattcagttctgagcgcggccctagaatgtgtcgttatgttagagaaagggataggttgggcaacgagtatccgaaattgcactaccctgagttatacgtgcttaaagggggttataaagaattctttatgaagtgccaatcctactgcgagccaccttcctacagacctatgcatcatgaggattttaaagaagacttgaagaagtttcggaccaagtcaagaacttgggccggtgaaaagtcaaaacgggagatgtacagtcggttaaaaaagctctag

SEQ ID NO: 111566 - DNA, 432 bp, Artificial Sequence
  Description of Artificial Sequence: Synthetic coding sequence
atggagctgggaccagagccaccacaccggagacgcctgctgtttgcatgctcgcccccccctgcaagccagcccgtggtgaaggcactgttcggcgctagcgctgccggcgggctctcgcctgtcaccaatttgacagtgactatggaccaactacaagggttgggaagtgactacgaacagccacttgaggtcaagaacaacagtaatctgcagcgcatgggtagctctgaatctactgactctggtttttgtttagatagtcctggccctctggattctaaagagaatctcgagaaccctatgaggcggattcacagcctccctcagaagttgctgggttgctctccggcgctcaaacggagtcactccgattccttggaccatgatatattccagctgattgacccggatgagaataaggagaactag

SEQ ID NO: 111567 - DNA, 1743 bp, Artificial Sequence
  Description of Artificial Sequence: Synthetic coding sequence
atggaagtaccacaacccgagcctgcacccggcagcgctctatctcccgcaggagtgtgcggcggcgcacagaggcccggccacttgcccggccttctcctcggaagtcacggtttacttgggtcaccagttcgagcggccgcctcctctccggttactactcttactcagaccatgcacgatcttgctggtctcgggtctgagacccccaagtctcaagtaggcacgctgctgttccgtagtcggagcaggctgacccatttaagcctaagcagaagagcttcagaaagttccctttcatcggagagctccgaaagctcagatgcaggcctgtgtatggattctccatcacctatggacccacacatggccgagcagacgttcgagcaagcgattcaggcggcatctaggatcattagaaatgagcaatttgcaattcgtagatttcaatccatgccagtcaggttgctgggccactcacctgtcctgagaaatatcacaaactcccaggcccctgatggtaggaggaaatccgaggctggaagcggtgcagctagttcctccggagaagacaaggagaatgatggcttcgtcttcaagatgccctggaagcccacacatccaagctctacacacgccctggctgagtgggcaagcagacgtgaagcgttcgcacagcgaccgtcctcggcacctgacctaatgtgcttgtctccagacagaaagatggaggtggaggagctgtctccattagccctaggacggttttcactgacccccgcagagggggacacagaagaggacgatggcttcgtcgacattctcgagagcgacttgaaagatgacgatgcagtacctcccggaatggagtctctgatctcggctccactggtgaaaactctggagaaggaggaggagaaagacctcgtaatgtattcgaagtgtcagcgcctcttcagaagtccttctatgccctgttcagtgattcgcccaatactcaagaggctggagaggcctcaggacagggacacccccgtgcagaacaagagacgtcgaagcgtgacaccaccagaagagcagcaggaagcagaagagcccaaagccagggttttaagaagtaagagcctctgccacgacgagatcgaaaatcttctcgattcagaccacagggagcttataggggactatagcaaggccttcctccttcagacggttgacggaaaacaccaggatctgaaatacatctccccagagacaatggtcgccttgctaaccggcaagttttctaacatcgtggacaagttcgtgattgttgactgccgctatccttacgagtacgagggcggtcacatcaaaaccgcagtaaatttacctctcgaacgcgacgccgagtccttcctcttgaagagcccgattgctccttgttccctggacaaaagagtgatcttgatattccactgcgagttctcaagtgaaagagggcccagaatgtgccgatttatacgagaacgggatcgagctgtgaatgactaccctagcctgtactaccccgagatgtatattctcaagggggggtataaggagttcttcccccagcaccccaatttctgtgagccccaggactacaggccaatgaaccatgaggcttttaaagacgagctgaagacttttcggctgaagacgcgctcatgggctggagaacgcagccggagagaactgtgctctagacttcaagatcagtag

SEQ ID NO: 111568 - DNA, 1620 bp, Artificial Sequence
  Description of Artificial Sequence: Synthetic coding sequence
atggaggtccctcagccggagccggcgcctggatctgcattgtctcctgccggtgtctgcggaggcgctcagcggccagggcacctgccaggactgctgctgggatctcatggcttgctggggtcccctgtgcgcgcagcggcatcgtcccctgttacaactctgactcaaacgatgcatgacctggcaggacttgggtccgagaccccaaaaagccaggtcgggactctattgttcagatccagatcccgtttgacccacctgtccctgtctcggagggcgagtgagagctcattgagtagcgagtcttctgagtcatcagacgccgggctgtgtatggattccccctctccaatggacccgcacatggctgagcagacctttgagcaagcgatccaggccgcgtcccggatcatcagaaacgaacaattcgcaatcaggcgatttcagtcgatgcctgatggatttgtcttcaaaatgccctggaaacctacacacccctcatcaacccacgctttagctgagtgggcgtcccgcagagaggccttcgcccaaagaccatcaagtgcacccgatcttatgtgtctgagccccgacaggaaaatggaggtagaggagctcagtccactcgccttgggcagattttcactgacccccgctgagggcgataccgaagaggacgatggctttgtggatattctcgagagcgacctgaaagacgacgacgccgtgcctcctggaatggagagtctcattagcgccccactcgtcaaaactctggaaaaggaagaagaaaaagacctggtcatgtactccaaatgccaacggctgtttagaagcccctctatgccgtgctctgtgattcgccctatccttaagcggcttgaacggccacaagatcgggacaccccagtgcaaaacaagagacgaaggtctgtcacaccccccgaggaacagcaagaggctgaagaacccaaggccagagtgttgcgttctaaatctctctgtcatgacgagatagaaaacctgcttgacagcgatcatcgggaactcattggggactactccaaagccttcctgctgcagacggtcgacggtaaacaccaagatcttaagtatatatctcccgaaacgatggtcgccttgctgaccggcaaattcagtaacatagtggataagtttgtaatagtggactgcagatacccctacgaatatgagggcgggcacattaagacagcagttaacttgccattggaacgagacgccgagtcattcctgctaaagtccccaatcgccccatgctccctcgataaacgcgttattctaatatttcactgcgaattctcttctgaacggggtccacggatgtgccgcttcatccgggagcgggaccgcgcagttaatgactatccctccctgtactatccagagatgtatattctgaagggagggtataaggagttttttccccagcatcccaatttctgcgagccccaagactatcgcccgatgaatcacgaagcgttcaaggacgagttgaagacctttagactcaaaacacgctcctgggccggagagcggagcaggcgagagctgtgttcccgccttcaggatcagtag

SEQ ID NO: 111569 - DNA, 1551 bp, Artificial Sequence
  Description of Artificial Sequence: Synthetic coding sequence
atgcattctgaaacccccaagtcccaggtggggaccctcctgtttcgaagccgcagcagattgacccacctcagtttatctagacgcgcaagtgaaagttctctgtcgagcgagtcctctgaaagttctgatgcgggcctttgcatggacagtccctccccaatggacccgcacatggctgaacagacttttgaacaggccatccaggcagcctcaagaataattaggaacgaacagttcgcaattcgccgctttcagagtatgccagtgcgcctgctgggccattcacctgtgctccgaaacattactaatagtcaagcacctgacggcagacgaaagtccgaagccggcagtggcgccgcttctagcagtggcgaggataaagagaatgacgggttcgtcttcaagatgccctggaagcctacacacccctcatctactcacgccctagccgaatgggccagccgccgcgaagcttttgctcaaagaccaagcagtgcccctgacctgatgtgtctgagccccgatagaaagatggaagtggaagagctttctcctttggcactgggacgcttttctctcacgcctgccgagggggatacagaggaggatgatggcttcgtcgacatcctggagagcgacctgaaggacgacgacgctgtgcccccaggcatggaatctttaatatcggctcccctggttaaaacccttgaaaaggaggaagagaaagacctggtcatgtattcaaaatgccagagactatttaggtcccctagcatgccctgctcggtcatcagacctattttgaagagactcgagcgtccacaagatagggatacccccgttcaaaataagcgtaggcgatcagtgacccctccagaggagcagcaggaagcggaggagcctaaggctcgcgttttgaggtcaaaaagcctctgtcacgacgagatcgaaaaccttctggatagcgaccaccgcgaactgattggagattatagtaaggctttcttgctgcagaccgttgacgggaaacaccaggacctcaagtatatcagccctgaaacgatggtggcgttgttgacaggaaagttctctaatattgtcgataaattcgtcattgtcgattgtagatatccttacgagtatgagggcggccacatcaagacagccgtgaacctaccgctggaacgcgacgctgagtccttcctcctaaaaagtcctatcgctccatgctctctcgataagagggtgatcctgatttttcactgcgagtttagctcagaacgagggccacggatgtgtcgtttcatacgtgagcgagaccgtgccgtaaatgactacccgtccctgtactatccagaaatgtatatactcaaaggggggtataaagaattcttccctcagcaccccaacttctgtgagccacaagactatcggcctatgaatcacgaagctttcaaagatgaacttaagactttcaggctgaaaaccagatcttgggccggagaacgcagcagacgcgaactgtgctcgaggttacaggaccaatag

SEQ ID NO: 111570 - DNA, 1470 bp, Artificial Sequence
  Description of Artificial Sequence: Synthetic coding sequence
atgcatagcgagacgccgaaaagccaggtgggaactctgttattccggagccgtagtaggctgacacatttgagcctgagccgcagggcctctgagagtagcttgtcgtcagaatcgtcagagtcttctgatgccggcctgtgcatggattccccatctccgatggatccccacatggctgaacaaacctttgagcaggctattcaggccgcttccaggatcattcgtaatgaacagtttgccattcggcggtttcaaagtatgcccgtccgtcttctgggacattccccagtccttcgcaacataaccaactctcaagccccggacggcaggagaaagagcgaggctggctctggcgctgcctccagctcaggtgaggataaggagaatgatggtttcgtattcaagatgccttggaagccaactcacccaagctccacccatgcattagcggaatgggcatcacgaagagaagcctttgcccaacgtccatcttctgcgcccgatttaatgtgccttagccccgaccgtaagatggaggtcgaagagctgagtcctctcgccctgggccggttttcattgaccccagccgagggggatactgaggaggatgacggatttgtcgatattctcgagagtgaccttaaggacctcgttatgtactctaaatgtcagcgactgttccgctccccgagcatgccttgctcggtgatcagacccatccttaagcggctcgaacggccccaggacagggatactccagtgcagaataagcggaggaggagtgtgaccccccctgaggagcagcaagaagctgaggagcctaaggcgagagtcttgcggtcaaaatctttgtgtcatgatgagatagagaatctgctggattctgatcatagggagctcattggggactactcgaaagcgttcctcctgcaaactgtagatgggaaacaccaggacctcaaatatatctcaccggagacaatggtggccctgcttacaggtaagtttagcaatatcgtggataagtttgttattgtggattgtcggtacccttatgagtacgagggaggacatatcaaaaccgccgtcaacctcccattggagcgggacgcagagtccttcttgctcaagtcccctattgccccgtgtagtctagacaaacgcgtcatcttgattttccattgtgaatttagctcagaacgagggccccgcatgtgcagatttatcagggaaagggacagggccgtgaatgattacccaagtctgtattaccccgaaatgtacattcttaagggaggatacaaggagtttttcccccagcacccaaatttttgcgagcctcaggattatcgacctatgaatcacgaggctttcaaagacgagctgaaaacattcagactgaaaaccaggtcctgggcgggtgaaaggtcacgaagggaactctgttctcggctgcaggaccagtag

SEQ ID NO: 111571 - DNA, 1701 bp, Artificial Sequence
  Description of Artificial Sequence: Synthetic coding sequence
atggaagtaccacagcccgagcctgctccaggttccgcccttagcccggccggggtgtgcggtggcgcccagcgccccggtcaccttccaggtctccttctcgggagtcatggtctgttggggtcccctgtgcgagccgctgcatcaagccctgtgactaccctcacacagaccatgcatgacctcgcaggactaggaagtaggagtaggctgacacatctgtcactatctcggcgagcaagtgaatcatctctctcctcagagtcatcagagtcttcagacgctgggctgtgcatggacagcccaagccccatggacccgcacatggctgaacagacattcgaacaggcgatccaggcagcctccaggatcataagaaacgagcaatttgccattaggcggtttcagtcaatgccggtcaggctcctcgggcattcaccggtcctgagaaatataaccaattcccaggctccagacggccgccggaaaagcgaagcaggaagcggggcagccagctcatctggggaggataaggagaacgacggttttgtgttcaagatgccatggaagcccactcatccttcttctacgcacgcgctagccgaatgggcctccagacgtgaggccttcgcacagagaccatcaagcgcaccagacctgatgtgtctatctcctgatcgaaaaatggaagttgaagagttatcccccctcgcgttggggagattttctctcacacctgctgagggcgatacggaagaggatgacggcttcgtcgacatacttgagagcgatctcaaagacgatgacgctgtgcctccgggaatggagagcctcatttccgccccgctcgtgaaaacccttgagaaagaagaggaaaaagacctggtgatgtacagtaagtgccagagactgtttcgttcccccagcatgccatgttccgtgatcagaccaatccttaaacggctcgagagaccacaggatagagatactccggttcaaaataagcgccgcaggtccgtcacgccgccagaggaacaacaggaggctgaggagccaaaggcccgggtgctgagatctaagtccttgtgccatgatgagatcgaaaacttgctggattccgaccatcgcgagttgatcggtgattactcgaaggccttcctcctgcagaccgttgacggcaagcaccaagatcttaagtacatttcacctgaaactatggtggccctccttacagggaagttcagtaacatagtggataagtttgtgatcgtggactgcaggtacccgtacgagtacgaaggtggccatattaaaaccgcagtgaacctccctctggagcgcgacgcagaaagctttcttctcaagtctccgatagccccgtgtagtctcgataagagggtgattctgatttttcactgtgaattttctagcgaacgcggaccacgcatgtgtcggttcatccgcgagcgcgatagggccgtgaatgattacccttcactgtattaccccgagatgtacattctaaaaggcggatacaaagagtttttcccccaacatcccaacttttgtgagccgcaggattatcgccccatgaatcacgaggcctttaaggatgaacttaagaccttcaggttgaagacaaggagctgggcaggagagcgctcaaggcgcgaattgtgttcaaggctccaggaccagtag

SEQ ID NO: 111572 - DNA, 2475 bp, Artificial Sequence
  Description of Artificial Sequence: Synthetic coding sequence
atgactgtactgcaggaacctgtccaggctgccatttggcaggccctgaaccattatgcctaccgtgacgctgtcttcttggcggagcgcctgtacgcggaggtgcacagtgaggaggccctgtttttgcttgccacgtgttattacaggtcaggcaaagcctacaaggcataccgcctgcttaaagggcactcttgcactacaccccaatgcaagtacttgctggcgaagtgctgcgttgacctgtcaaagctggccgagggcgaacagatactgagtgggggagttttcaacaaacaaaagtcacatgacgacatcgtgaccgagttcggagactccgcctgtttcacactttccctactgggccacgtgtattgtaagaccgacaggctggcaaaaggatcagaatgttaccagaagtcgctatccttaaaccccttcctctggagccctttcgagagcttgtgtgagattggggagaagccagatcccgatcaaacctttaagtttacctcactccaaaattttagtaactgccttcccaatagttgcacaacccaggtgccaaatcactccttgagccacaggcagcccgagaccgtactcacggaaactcctcaggatacaatcgaactgaatcggcttaacctcgaatcatcaaacagtaagtactcactgaatacagatagcagcgtctcttacatagactctgccgtgatctcaccagacacagttccgctggggaccggaaccagcatcctctccaagcaggtgcagaacaaaccgaagacgggacggagccttctaggagggccagcagccctgtcccccctaactcccagctttggcatcctcccacttgaaacaccctctcccggagacgggtcctacctgcagaattataccaatactcctcccgtgattgacgtaccctccacaggcgctccctccaagaagtccgtggctagaattggacaaactggaactaagagcgttttctctcagtcaggtaacagtcgggaagtcacgccaatactggcccagacccagtccagtgggccccagacgtccacaacgccacaggtgctgtctcctacaataacaagtcctcctaatgcgttgcctaggcgcagttctcggctcttcacctctgattcgagcactacaaaagagaattctaagaagctgaaaatgaaatttccccccaaaatccccaacaggaagacaaagtctaagactaacaaggggggtataacacagccgaacattaacgactctctggagatcaccaagctcgatagttctatcattagcgaagggaaaatctccaccataactccccagatccaggctttcaatttgcaaaaagcggcagccgaggggcttatgtctctactgagggagatgggaaaaggttatttggccctttgcagctacaactgtaaggaggccatcaacattttgtcacacctgccctctcaccactacaacactggttgggtgttatgccagattggacgggcctacttcgagctgagtgaatatatgcaggctgaaaggatttttagcgaagtccggagaatcgagaactatagggtggaaggcatggaaatttactcgacgaccttgtggcacctgcagaaggatgtggccttgtccgtcctctctaaggacctgactgatatggacaaaaatagcccagaagcgtggtgtgccgccgggaattgcttctcactccagcgggagcacgatatcgctattaagtttttccaaagagctattcaggttgatccaaattacgcctacgcctatacccttctgggccacgagtttgtgcttaccgaggaactggataaggcattagcctgcttcaggaacgcaatccgggtgaacccgagacactataatgcatggtacggcctcggaatgatttattacaagcaggagaagtttagcctagccgagatgcattttcagaaggcgttggatataaatccgcagagtagcgttctgctgtgccatatcggcgtggtacagcacgccttaaaaaagtccgaaaaggccctggacacgctgaacaaagccatagtcatcgatcctaagaaccccctttgcaagttccaccgcgcctcagtcttgtttgccaacgaaaagtataagtctgccctccaagagttggaagagctgaagcagatcgtgcccaaggagtccctggtgtattttctgatcggaaaagtgtacaagaagctcggacaaacccaccttgccttaatgaatttcagctgggcaatggaccttgatcccaagggcgccaacaaccagataaaggaagccattgacaaaagatatctcccagatgatgaagaacctatcacacaggaggagcagatcatgggaacagacgaatcacaggaatccagtatgacagacgctgacgacacccagttgcatgcagcggagtcagacgaattttag

SEQ ID NO: 111573 - DNA, 2292 bp, Artificial Sequence
  Description of Artificial Sequence: Synthetic coding sequence
atggctagtacgaagccactgtgtctcccccgttgtggcttcccccgacgtacacccctatgtcgaagacttgctgaaggtgagcaaatcctgtccggcggggtcttcaataagcagaaatcccacgacgacattgtgactgagttcggcgattccgcttgttttacactgtctctgctggggcacgtgtactgcaaaacagatcggctggcaaaaggtagtgagtgctatcaaaagtcgttgtccctgaacccttttctttggtccccatttgagagtctatgtgaaatcggcgagaaacccgatccggaccaaacttttaagttcacctcactccagaacttttctaattgcctcccaaactcctgtaccacccaagtgccaaaccacagcctgtcacatcgccagcccgagaccgtgctcacagagacgccccaagatacaattgagctaaaccgacttaatttggagtccagcaatagcaagtattccctcaatactgatagctcagtttcatacattgattccgccgttatatcgccagacaccgtgcccctgggaaccggcacctctatcctgtccaagcaagttcagaataaacccaagacaggacgctctctgctgggcggtcccgccgctctcagtccattgactccttctttcgggatcctgcctttggagacgccatctccgggcgacggatcttacctgcagaactatactaacacacccccagtgatcgacgtgccctcaactggggcgccctccaaaaagtctgtggcaagaattggacaaactggcaccaaaagtgtctttagtcaaagtggaaatagtcgggaggtgacgcctatcctggcgcaaacccagtcctccggtccacaaacatccacgactcctcaggtactttcacctactattacaagcccccccaatgctctcccacggaggtcttctcgtttgttcacctcagattcatctacaactaaagaaaattcgaaaaaactaaaaatgaagtttccaccgaagatcccaaatcgtaaaaccaagtccaagacgaacaaaggtggcatcacacaacctaacattaatgatagcctggaaatcacgaagctggactcttcgattatttccgagggaaagatatcgacaatcacaccgcagatccaggcgttcaacttgcagaaagctgcagcagagggtcttatgtctctgctgagggagatggggaaggggtatctggctctgtgcagttataactgtaaagaggccattaacatcctctcacaccttccttcacaccactacaacacaggttgggttctgtgtcagattggtcgcgcctacttcgagctctccgaatacatgcaggcagaaagaattttttccgaagtacggagaatcgaaaactatcgagtggaagggatggagatctattccacaacactctggcatctgcaaaaagacgtggctctgtctgtcctgtctaaggacctgaccgacatggacaaaaactcccccgaagcctggtgcgcagctggaaattgttttagccttcagagagagcacgatattgctatcaaattcttccagcgcgcgatccaggttgacccaaattatgcctacgcctatacgttgctggggcacgaattcgtgctcacagaagagttggataaagctctcgcgtgtttccgaaacgctatcagggttaaccctagacactacaacgcgtggtacgggctgggaatgatctactacaaacaggagaaattctctttggcagaaatgcactttcagaaagcgttagacattaacccgcagtcctcagtgctgctctgccacataggggtggtgcagcacgctctgaaaaaaagtgagaaggccctggacacgttaaacaaagctattgttatcgaccccaaaaatccactgtgcaaattccaccgggcatcagtgctctttgctaatgaaaaatacaagtccgctttgcaggagctggaagagttaaaacaaatcgtgcccaaggaatcattagtgtactttcttataggtaaagtgtataaaaaactaggacagactcatctcgctctgatgaatttctcctgggctatggacctcgacccgaaaggcgctaataaccaaataaaagaggccattgacaaacggtacctgcctgatgatgaagagcccattacccaggaggagcagatcatgggaaccgacgagtcccaggaaagttctatgaccgacgcggacgatacacaactccacgccgcagaaagtgatgaattttag

SEQ ID NO: 111574 - DNA, 2472 bp, Artificial Sequence
  Description of Artificial Sequence: Synthetic coding sequence
atgacagtgctccaggaacctgttcaggcagccatctggcaggcccttaatcattatgcctacagggacgccgtgtttctcgccgaaaggctatatgctgaagtgcactcagaagaggctctctttctacttgctacctgttattacaggtctgggaaagcttacaaggcctataggctgctaaaaggacactcgtgcactacccctcaatgcaaatacctgctggccaaatgctgtgtggatctttcaaagctagcggaaggggaacaaatcttgtccggaggggtgttcaacaagcaaaagagccacgacgacatcgtgactgagttcggtgacagcgcctgctttactctctccttacttggtcacgtctattgcaaaacagacagacttgcaaaaggtagtgagtgctatcagaaaagtttaagtctcaacccctttctgtggagcccatttgaaagcctctgtgagatcggggaaaagccggaccccgaccaaacatttaagtttacttcactccagaacttctctaactgcctacctaacagctgcacgactcaggtgcctaatcactccctctcccaccgccaacctgagacagtgttaaccgagactccgcaggataccattgaattgaatcgtctgaacctggaatccagcaactccaaatacagtctgaataccgactcctcagtgtcctacatcgactcggctgtaattagccctgatactgtgccactggggacgggaaccagcatactctctaagcaggtccagaacaagcctaagactgggagaagcctgttaggaggaccggcggctctgtctcctcttactccatcgtttggcatactgccgctggagaccccgtcaccgggtgatgggagttacctgcagaactacacgaacaccccccctgtgatcgatgtacccagtaccggggcacccagcaagaagtcggtggcaaggatcgggcagaccgggaccaagagcgtgtttagtcaaagcggtaattcgagggaggtaaccccgatccttgcgcaaacgcagtcatcaggcccccagacgagtacaactccacaagtcctgagtccaactattacttctccgccgaatgccctcccccgccggtcatcccggctgttcacatccgacagctctactacgaaggagaactccaaaaagctgaagatgaaatttccgcctaagattcctaatagaaagactaagtcaaaaacaaataagggtgggataacacagcctaacatcaacgacagtctcgagatcacaaaactcgacagctccatcatctctgagggtaaaatcagcactatcacaccccagatccaagctttcaatcttcagaaggccgcggccgggttgatgtccctgctgcgcgagatgggcaaaggctacttggccctgtgttcctacaattgcaaggaggccatcaacattcttagccatcttccctcccatcactacaataccggatgggttttatgccaaattgggagagcatattttgaactgtctgaatacatgcaagcagaaagaattttctcagaagttagacggattgaaaattatcgggtggaagggatggaaatttactcaaccacactgtggcacttacagaaggacgtggctctcagtgtgctgtctaaagatctcacagacatggataaaaatagcccagaagcctggtgcgcagcagggaattgcttcagcctccagagagaacacgatatcgcaatcaagttttttcagcgagcaatacaggttgatccaaactacgcatatgcgtacaccctgctaggtcatgagttcgtgctgactgaggagctcgacaaggcacttgcatgcttccgaaatgccatccgggttaatcctaggcactacaacgcttggtacgggctgggaatgatatattacaagcaggaaaagttcagtctcgctgaaatgcattttcagaaggccctggacattaatccccagagctctgtcctcctttgccacataggcgttgtacaacatgctctgaagaaaagcgaaaaagcccttgatactctgaataaagcaattgtgatcgatcccaagaaccctctctgcaagtttcatagggccagtgtcttgttcgccaacgaaaagtataagtctgccttgcaggaactcgaagagttaaaacagattgtgcctaaggagagtctagtttacttcctgattggcaaagtgtataaaaaactgggtcagacacacctggcacttatgaattttagctgggcaatggacctggaccctaaaggcgccaacaaccaaattaaggaagctatcgataagagatacctgccagacgacgaggaaccaatcactcaagaggaacaaataatgggcactgatgagtctcaggagtcttccatgactgacgctgatgacacacagctccacgccgccgagtccgacgaattttag

SEQ ID NO: 111575 - DNA, 2493 bp, Artificial Sequence
  Description of Artificial Sequence: Synthetic coding sequence
atgactgtgctccaggaaccggttcaggcagccatctggcaagccctgaaccattatgcataccgggacgccgtgttcttggccgaacgcctgtatgccgaagtacacagtgaggaggccttgttcctgctggcaacgtgttattacagatctggcaaggcttataaggcataccggttactcaagggccactcctgtacaactccccaatgtaagtacctgctggccaagtgttgtgtggatttatccaaactcgctgaaggagagcagatcttgagtggaggcgtttttaacaaacagaaaagtcacgacgatatcgtgacggaatttggcgactctgcctgtttcacgctcagtctgttaggccatgtatactgtaagacagaccgtctcgccaagggctcagagtgctaccaaaagagcctgtcgctgaacccattcttgtggtcaccctttgagagtctctgcgaaattggtgaaaagccagacccagaccaaacctttaagtttacaagcttacagaacttctccaattgtctccccaacagctgcaccacgcaggtccccaaccactctttgagccacagacagcctgaaaccgtgctgacagagacacctcaagatacgatcgagttgaatagactcaatctggagtcaagcaattctaaatactcacttaatactgatagcagtgtgagctacatagattccgcagttattagtccagacacagtccctttagggactgggacatctatcctctccaagcaggtgcagaataaaccaaagactggacgctcactccttggaggtcccgctgctctgtcgcctttaacaccttctttcggcattctgcccctggagaccccctctcccggtgacggaagttatcttcaaaactataccaacacaccacccgtcattgatgtgccttccaccggggcccccagtaaaaagacatttcgcgttctccagtctgtggcacgcataggacagacgggaaccaagtctgtgttttcacagtcaggtaattcgagagaggtgactccgatcctggctcagacccagagctctggtccacagaccagcaccacaccccaggtgctctcacccacaataacaagtcctccaaatgcactacctagaaggtcgtcacggctttttactagtgattccagcactacaaaggagaattctaaaaagctgaaaatgaaattcccaccaaaaatcccaaacagaaagacaaaaagcaaaacaaataagggcggcatcactcagccgaatattaacgattccctagagataactaaacttgatagctctataatctcagaaggcaagatatcaaccatcacacctcagatccaggcgttcaacctccagaaagccgctgccgaaggcctgatgtctctgttgcgggaaatgggaaagggttatctggcgctttgttcctacaattgtaaggaggcaatcaacattctgagtcacttaccatcacaccactacaacaccgggtgggtgttgtgccaaatcggtagggcgtatttcgagttgtcagaatacatgcaagctgaacgcattttctcagaggtaaggcggattgaaaactacagagtcgaagggatggagatttactcaaccactctgtggcacctccagaaagatgtcgcattgtctgtactcagcaaggatctgacagacatggataagaatagcccggaggcttggtgcgcagctggcaactgttttagcctgcagcgggaacatgacatcgcgatcaaattcttccaaagggctatccaggtggaccccaattacgcttacgcttacacccttcttggccacgagtttgtgctcacagaggagttggataaggcactggcctgcttccgtaatgccattcgggtaaatcctcgccattacaatgcatggtatgggctcggcatgatctattataagcaggagaaattctcattagccgagatgcacttccagaaagctcttgacataaatccacagagttccgtgctcctgtgccacatcggtgtggtccaacacgccctgaagaaaagtgaaaaggccttggataccctgaacaaggccatcgttatcgatcctaagaacccgttgtgtaagttccatcgcgcgtcagtgcttttcgcgaacgagaaatataaaagcgctctccaagaactcgaggaactgaagcagattgttccaaaggagtcattggtatatttccttatcggcaaggtgtataaaaaactcggccagacccatctggccctgatgaacttctcttgggccatggatctggaccctaaaggagcaaataaccaaataaaggaagcgatcgataagcgctatctacccgatgacgaagagcctattacccaggaagaacaaataatgggcactgacgaaagccaggaatcttctatgacggacgctgatgatacacagctacacgcagcagaatccgacgagttttag

SEQ ID NO: 111576 - DNA, 1740 bp, Artificial Sequence
  Description of Artificial Sequence: Synthetic coding sequence
atgagtgccgccatcgcagcccttgcagcgtcatacggctcgggatccggcagcgagagcgacagtgatagcgagagttcaaggtgtccgctacctgcagcagattccctgatgcatctcacgaagagcccaagctcaaagccatcactagccgtagctgtagacagcgccccagaggtcgcagttaaggaagacctggagaccggggtgcatttggatccggccgtgaaagaggtgcagtataatccgacttatgagactatgtttgcccctgaatttggaccagaaaatcctttccggactcagcagatggccgccccgagaaacatgctgtccgggtacgccgagccggcacacatcaatgacttcatgttcgagcagcagagacggacatttgccacatacggctacgcactcgatccatcgctggacaatcatcaggtaagtgcgaagtatatcggctcggttgaggaggccgaaaagaatcagggactgactgtgttcgagacagggcaaaagaagaccgagaaacggaagaaatttaaggaaaacgacgcctcaaatatcgatgggttcctgggcccttgggcaaagtacgtggacgagaaggatgtggccaaaccctctgaggaggagcagaaagagctggacgaaataaccgccaaaagacaaaaaaagggcaaacaagaggaggaaaagccaggtgaggaaaaaactatacttcatgtgaaggagatgtacgactaccaaggtaggagctacctacatatcccccaggacgtcggtgtgaacctcaggtccactatgccacctgagaagtgctacctccccaaaaagcagatccacgtatggagtggccataccaagggcgtgtccgccgtgcgattatttccactttctggacacctcctgttatcttgttccatggactgcaagatcaagctgtgggaagtatacggagaacgacgttgtctccggacctttattggccacagtaaggctgtgagggatatctgcttcaatacggctggtacccagtttttgtccgcagcatatgaccgttacctgaaactgtgggatacggaaacaggtcagtgtatttcacgatttactaatcgcaaggtgccttactgtgtgaagtttaacccggatgaggacaaacagaatctcttcgtggccggaatgtctgataaaaaaattgtccaatgggatattcggtcgggcgagatagtccaggagtacgaccggcatctcggagcagtcaacacaattgtgtttgtggacgagaaccgtaggttcgtttccacttccgacgacaaatcattgagagtgtgggagtgggatatacctgtggacttcaagtatattgccgaaccatcaatgcactccatgccagcagtaactctgtccccaaacggaaaatggctagcgtgtcagtccatggataatcagattctgatcttcggcgcccagaaccggtttcgcctcaacaaaaaaaagattttcaagggccatatggtggcaggatatgcgtgtcaggtggatttctcacccgatatgagctatgtgatcagcggcgacggaaacgggaagttgaatatctgggactggaaaaccaccaagctgtattcccgctttaaggcacatgacaaggtttgcatcggagcagtgtggcatccccacgaaacctccaaagtcattacctgtggatgggatggtctcatcaagctttgggactag

SEQ ID NO: 111577 - DNA, 1620 bp, Artificial Sequence
  Description of Artificial Sequence: Synthetic coding sequence
atgtctgctgccattgcagccctggctgcaagttatggaagcggctcaggctccgagtcagattctgattctgagtcgagccggtgtccccttcctgccgccgatagtctgatgcaccttacaaaatcccctagttctaagccgagcttagccgtggcggtggacagcgcccctgaagtggctgtgaaggaagatctcgaaaccggagtgcacctggatcccgccgttaaagaagtgcagtacaatcccacctacgaaaccatgtttgcgcctgaattcggccctgagaaccccttccgaacgcagcagatggccgcccctcggaatatgctgagcggctacgcagaacccgctcatattaatgattttatgtttgaacagcagagacgcactttcgccacttatggatacgctctagatccatcactcgataatcatcaagtgtcagccaagtacatagggagtgtcgaggaggctgagaaaaaccaaggcctcactgtttttgagacagggcagaagaagactgaaaaaaggaaaaaattcaaggagaatgatgcatctaatatagacggattcctgggcccctgggcaaagtatgtggacgaaaaagacgttgctaaaccctcagaagaggagcagaaagagttagatgagattacagctaagcggcagaagaagggcaagcaagaagaggagaaaccaggggaagagaagacgatcctgcatgtcaaggaaatgtatgactatcaggggcgaagttacttgcacattcctcaagacgtaggggtcaacttgaggtccaccatgccccccgagaagtgctatttaccaaagaaacagatccacgtgtggagcggacacacgaaaggagtgagtgccgtgcgtctgttcccgcttagtggacatctgctgttaagctgtagcatggactgcaaaatcaagctgtgggaggtgtatggggaacgccggtgtttacggaccttcatcggacacagcaaggcggtgcgggatatctgttttaacactgcaggcacacaattcctctccgccgcttatgaccgatatcttaagctgtgggacaccgagaccggacagtgcattagtcgcttcaccaataggaaagttccttactgcgtcaaatttaaccccgatgaggataagcaaaacctgtttgttgccgggatgtcagataagaagatcgttcagtgggacatacggtcgggagagatagtgcaggagtacgacagacatttaggggctgtaaacacaattgtgttcgtcgacgagaatcgccggttcgtgagcacaagtgatgacaagagccttagggtatgggaatgggatatacctgtggacttcaagtatatcgccgagccttctatgcactctatgccagcagttaccctatccccaaatggaaaatggctggcatgtcagagcatggacaatcagattctgattttcggggcacagaaccggtttaggctgaacaaaaaaaaaattttcaaaggacacatggtggccggatatgcctgccaggtagatttttccccggacatgcgcgtacctcaatcttttcagaacctcaaagaggtcacagccggtccacaggagggatag

SEQ ID NO: 111578 - DNA, 1740 bp, Artificial Sequence
  Description of Artificial Sequence: Synthetic coding sequence
atgtctgcggccatagccgcccttgcggcgtcctatggcagcggttccggatccgagtctgactcagactccgagtcatcccgctgccctctgccagctgcagattccctgatgcatttgaccaagagcccttctagtaagccttccctggccgtggcagtcgactctgccccagaggtggcggtaaaagaagatctggagaccggcgtgcacttggatcccgccgtcaaggaagtgcagtacaaccccacctacgagactatgttcgcacccgagttcggccctgaaaatccgttcaggacccagcagatggcagctcctcgtaacatgctcagcggctatgccgagcccgcccacatcaacgactttatgttcgaacagcaaagaaggactttcgcaacctatggctatgccctcgatccttctctggacaaccaccaggtgtccgcaaaatacatcggctctgtagaagaggctgagaaaaaccaagggctgaccgtgttcgagactggtcaaaagaagaccgagaagcgtaaaaagtttaaggagaatgatgcatctaacatagatgggttcttgggcccatgggccaagtatgttgatgaaaaagacgtggctaaaccctccgaggaagagcagaaagagctcgatgaaataacagccaaacggcagaagaaaggcaaacaggaggaagagaaaccgggagaagagaagaccatactacacgtgaaggagatgtacgattaccaggggaggtcttacttacatattccgcaggacgtcggggttaatctgcgctccaccatgcccccggagaagtgttacttgcctaaaaagcagatccacgtgtggtccgggcacacaaagggtgtgtcagcagtccgcctcttcccactctctggccacctgctcttgtcatgcagcatggactgtaagattaagctctgggaggtgtacggagaaaggagatgcctccgcacttttatcggccactcaaaggcagtgagggacatctgttttaacacggctggtacacagtttctatctgctgcatacgaccgctacttgaagctgtgggacacagaaacaggccaatgcatctcccgcttcactaacagaaaagtcccttactgcgtaaaatttaatcccgatgaggataaacagaatctattcgtcgccgggatgtctgataagaaaatcgtccagtgggacattcggagtggggaaattgtccaagaatatgataggcatcttggggcagtgaatacaatcgtctttgtcgacgagaacaggagattcgtgagcacgtctgatgataagtcgctcagagtctgggaatgggatatcccagttgattttaagtacatcgccgaaccttccatgcactcaatgccagcagttaccctctctccaaatggcaagtggctggcctgccagtccatggacaaccagattcttatcttcggcgcgcagaaccgctttcgtctaaacaaaaaaaaaatcttcaaggggcacatggtcgccggctacgcatgtcaggtcgatttctcccccgacatgtcatacgtgataagcggcgacggcaacggcaagctgaacatttgggactggaaaacaacaaagctctatagtaggtttaaggcccatgataaagtttgtatcggagccgtttggcatcctcacgaaacctccaaggtcataacctgcggttgggacggactcattaagttgtgggattag

SEQ ID NO: 111579 - DNA, 1620 bp, Artificial Sequence
  Description of Artificial Sequence: Synthetic coding sequence
atgagtgccgctattgcagctctggcggccagttacggctcgggcagtggctcagaaagcgattcagactccgagtcctccaggtgtccgctgcccgccgctgactccttgatgcacctgactaaatcgccgagctcaaagccaagtctggccgtagccgtggactccgcccccgaagtggccgtgaaagaggatcttgaaacaggcgtacacctggatcctgcagtaaaagaagtgcagtataacccgacttacgagacgatgttcgcccctgagtttggaccggagaacccctttcgaacacaacagatggcggcccctagaaacatgctctctgggtatgccgaacccgctcacattaatgacttcatgtttgagcagcaaagaaggacatttgcaacttacggttatgctctggatccctccctggacaatcatcaagtatccgccaaatacattggcagtgttgaggaggccgaaaagaatcagggattaactgttttcgaaacaggccagaaaaaaacagagaaacggaaaaaattcaaagaaaacgacgcaagcaacattgatggttttctcggaccttgggcaaaatacgtcgatgaaaaagacgtcgcgaaacccagtgaagaagagcagaaagaacttgacgagatcacggcgaagaggcagaagaaaggaaagcaggaagaggaaaagcctggggaggaaaaaaccattctacacgtgaaggaaatgtacgactaccagggaaggtcctacctgcacatcccgcaggatgtgggagtgaatctcaggagtacaatgccccccgaaaagtgctacctgcctaagaaacagatccatgtatggagcgggcacacgaaaggagtctcagcagttcgcctgttcccactgtccgggcacctgctgctcagctgtagtatggactgtaagattaaattatgggaggtttatggggaaagaaggtgcctgcgcacattcatcggccactccaaggcggtacgagatatctgcttcaacacagctgggacacaattcttatccgctgcttacgatcggtatctgaagctgtgggacacggagactggtcagtgcatttcgcgcttcaccaatcggaaggtgccttactgcgtcaaattcaacccggacgaggacaagcagaacctgtttgtggccggtatgagcgataaaaagatcgtccagtgggacatcaggagtggagagattgtgcaggaatacgatcgccacctgggcgctgtgaatactatagtttttgtcgatgagaacagacgatttgtttcaacatcggacgacaagagtctcagagtgtgggaatgggacatccccgtggattttaagtacatcgcagaaccttcaatgcactctatgccggccgtaacattgagcccgaacgggaagtggctggcatgccagtccatggacaaccagatcttgatcttcggcgctcagaaccgttttcggctcaacaaaaaaaagatcttcaaaggtcacatggtggcaggttatgcatgtcaggtagactttagtccggacatgagggtgccacagtctttccaaaacctgaaagaggtgaccgccgggcctcaagaaggctag

SEQ ID NO: 111580 - DNA, 378 bp, Artificial Sequence
  Description of Artificial Sequence: Synthetic coding sequence
taaaatatgcttagcggatacgcagagcctgcccatataaacgactttatgtttgagcaacagcgccggaccttcgccacatacggttatgctctggacccttctttggataatcaccaggtgagtgctaaatacattgggtctgtggaggaggccgagaagaatcaggggttaacagtcttcgagacggggcagaagaaaacggagaagaggaaaaaattcaaagagaacgacgcctcaaacatcgacggcttcctcggcccctgggccaagtacgtggatgaaaaggatgtggcaaaacccagcgaggtgagctttgacgtttttaattgccagttcagatatacactttacctttacgaggggtacctgcactag

SEQ ID NO: 111581 - DNA, 495 bp, Artificial Sequence
  Description of Artificial Sequence: Synthetic coding sequence
atgagtgccgcgatagccgcccttgccgcaagctatggctccggctccggctctgagagcgactcagacagtgaatcctcccgctgccccttgcccgcagctgattccttgatgcacctgactaagagcccgtcaagcaagccatccctggcagtggctgtggatagcgctcccgaggtggctgtgaaggaagacctcgagacaggtgttcatctggacccagctgtgaaggaagtgcaatataatccaacctatgaaaccatgttcgcccccgaattcggccccgagaatccatttaggacacaacaaatggctgcacccagaaacatgttgtctgggtacgcggagcccgcccatattaatgattttatgttcgaacaacaacgtcggacattcgcgacttacgggtacgctctggatccctcattggataaccaccaagtgtctgcaaagtatatcggaagtgttgaggaagccgagaaaataaaggtgtag

SEQ ID NO: 111582 - DNA, 213 bp, Artificial Sequence
  Description of Artificial Sequence: Synthetic coding sequence
atggccgctccgcggaacatgctaagtggatacgctgagcccgctcatatcaacgattttatgttcgagcaacagcgccgcacctttgccacttatggctatgccctggacccctcactggacaaccatcaagtgagtgctaagtatatcggatctgtagaagaggctgagaaaaatcagggtctgacagtgttcgagacaggccaaaagtag

SEQ ID NO: 111583 - DNA, 1305 bp, Artificial Sequence
  Description of Artificial Sequence: Synthetic coding sequence
atgagcattctgaagattcatgcgcgggagattttcgattccaggggaaaccctaccgttgaggttgatctattcacttcaaagggactttttagggcggccgtgcccagcggcgcttctaccgggatctacgaggccttagaacttcgcgataatgataaaacacggtacatgggaaaaggggtaagtaaggccgtggaacacatcaataaaaccatagcacctgcgctcgtgtctaagaaattaaatgtgacagaacaagaaaaaattgataagctaatgatcgaaatggatggcaccgagaataaatcaaagtttggagccaatgccatcctgggcgtgagcttggcggtgtgtaaagctggggctgtggaaaaaggcgtacccctatatagacacattgctgatttagccggaaattcagaggtaatactgccagtacctgccttcaatgttatcaatgggggcagccatgctggaaataagctcgccatgcaggaatttatgatattgccagttggggctgcaaacttccgcgaggccatgcgcatcggcgcagaggtgtaccacaatctcaaaaatgtgattaaagaaaaatatggtaaagatgctaccaatgtgggagatgaagggggttttgcccccaacatacttgaaaacaaagaaggactcgagttgttaaaaaccgccattgggaaggcaggatataccgataaagttgtgatcgggatggatgtcgcagcatcagaatttttccgcagtgggaaatacgacctggacttcaaaagcccggatgacccgtcaaggtacatctctcctgaccagctggcagacctgtataagtcatttatcaaggattatccagtagtgtccatcgaggacccatttgatcaggacgactggggggcttggcaaaagttcaccgcttctgctggtatccaggtggttggcgatgacctgactgtgactaacccaaagcggatcgctaaggcggtgaatgagaagtcatgcaactgcctcctgctaaaagtgaaccagatcgggtcagtgacagaatcacttcaagcttgtaagctggcccaggctaatggttggggtgtgatggtgtcgcatagaagtggtgagaccgaggatacatttatcgcggacctcgtggtgggcctgtgtacaggacagatcaagacaggcgcaccttgccgcagtgagcggttggctaaatacaaccagttactgagaattgaagaagaactaggaagcaaggccaaatttgccggacgaaacttcaggaatccgctggccaagtag

SEQ ID NO: 111584 - DNA, 360 bp, Artificial Sequence
  Description of Artificial Sequence: Synthetic coding sequence
atgaggaaaaccgcgtcttcttgcccagctagcctgacctgcgactgctatgctacagacaaggtctgtagtatctgcctgagccggcgacagcaggtcgcgccccgtgctggaacacccgggttcagggccccagaagttctgaccaagtgcccaaaccagactaccggaaaatcaatcctttgttccaaggaagttcctgctcaggatctacgtaagctatgtgagagactacgggggatggatagctcaacccctaagctcacgtctgacattcaggggcatgccagtcaccagccggccatctccgagaagacggatcacaaagccagttgtttggtgcagacacccccaggctag

SEQ ID NO: 111585 - DNA, 474 bp, Artificial Sequence
  Description of Artificial Sequence: Synthetic coding sequence
atggaggctagcctgggcatccagatggatgaacctatggcattctcgcctcaaagagataggttccaggcggaaggttctctgaagaagaatgagcagaatttcaagctcgccggcgtgaaaaaagacatcgagaaactctatgaagctgttccccagctgtccaatgtcttcaagatcgaggataagatcggggaaggtactttcagtagtgtctacctggccactgcacagctccaggtcggtcctgaggagaagatcgccttgaaacatctaatcccaacctcacaccccattcggatcgcggcagaacttcagtgcctcacagtcgccggagggcaggataacgtgatgggtgtgaagtattgcttccgtaaaaatgaccacgtggtaattgcgatgccctacctcgaacatgaatccttcttggacatcctcaattcgctctcattccaggaggttagagagtactag

SEQ ID NO: 111586 - DNA, 1725 bp, Artificial Sequence
  Description of Artificial Sequence: Synthetic coding sequence
atggaagcctctctcggaatccagatggatgagcccatggccttttctcctcaacgtgatcgctttcaggccgaaggatccctgaagaaaaatgaacaaaatttcaagctcgccggagtgaaaaaagacattgagaagttgtatgaagccgtacctcagctcagtaacgtctttaagattgaggataaaataggcgaaggaacattctctagcgtttacctagctacagcacagttgcaagtgggacctgaggagaagattgctttgaagcatctgatcccaacatcccacccaattcgaatcgctgctgaactacagtgtctgacagtcgccggcgggcaagataacgttatgggagttaagtactgctttcgcaagaatgatcacgttgtgatagctatgccatacctggagcatgaatccttcctcgatatcttgaacagtctcagtttccaggaggtgagggaatatatgctgaatctgttcaaggctcttaagaggattcatcaattcggtatcgtgcatcgcgacgtgaaaccatctaactttctttataacaggcggttgaagaagtacgctcttgtggatttcggcctggctcagggtacccacgatacgaagatcgaacttctcaagtttgtgcagtcagaagcccaacaggaaagatgctcccaaaataaaagtcacatcatcaccggaaataagattccgctgagcggtcccgtgcccaaggaactcgatcagcagtctacaactaaggcttccgtgaagcgcccctataccaatgcacagattcagataaagcagggcaaggatggtaaggaaggatctgtaggcttgagcgtgcagaggagcgtttttggggaaagaaacttcaacattcattcttctatctcccatgagtccccagcagttaagctgatgaagcaatcaaagactgtggacgtgctgagcagaaagcttgccacgaaaaaaaaagctatctctacgaaagtgatgaactccgccgttatgagaaaaaccgcctcctcgtgtcccgcatctctgacctgcgattgctacgctaccgataaggtctgctcaatctgtctcagccggcgccagcaagtggccccacgagcagggacaccaggattcagggccccggaagtgctcactaaatgcccgaaccagaccacagccatcgacatgtggagcgccggggtgatttttctgagccttttgagcgggagataccccttctataaagcatccgacgacctaaccgccctggcgcaaataatgacaattagaggatcacgtgaaactattcaagccgctaagacgttcggaaagtccatactctgtagtaaggaagttcccgcacaggatctgaggaagttatgcgagaggctgcggggaatggatagctcaacacccaaactcactagtgatattcagggtcacgcctcacatcagccggcaatttctgaaaaaacagaccataaggcatcatgcttagtgcagacccctccagggcagtactccgggaactcttttaagaagggagacagtaatagctgcgaacactgttttgacgagtacaatacaaatctggagggctggaatgaggtacctgatgaagcatatgacttgctggacaaactgttggatctcaatcctgcctccagaattaccgctgaggaagccctcctccatccgttctttaaagacatgagcttgtag

SEQ ID NO: 111587 - DNA, 1641 bp, Artificial Sequence
  Description of Artificial Sequence: Synthetic coding sequence
atggaggcctccctggggattcagatggatgagccaatggcctttagcccacagcgcgacagattccaggcagaagggtccttaaagaagaacgagcagaacttcaaactcgccggtacgttctcttccgtgtacctggcgactgctcagctgcaggtgggccccgaggaaaagattgcactcaagcatcttattcccacgtcccaccctatccggatcgccgctgaactccagtgtctgactgtggccggcggccaagacaacgtgatgggcgtcaaatactgcttcaggaaaaacgatcatgttgtgatagccatgccttatttagagcacgaatcctttctcgatatcctgaactccctgtcgttccaagaggtccgagaatacatgctgaatctcttcaaagccctcaagagaatacaccagtttgggattgttcaccgggatgtgaagccatcgaacttcctatataacagaaggttgaagaaatatgccctggtagactttgggctggctcaaggcactcacgacactaaaattgaactgctcaagttcgtgcagtccgaggcacagcaggaacggtgtagtcaaaacaagtcccacatcattaccggcaacaagattcctctcagcgggccagttccaaaggaactagatcaacagagcactacaaaggcatccgtgaagagaccttatactaatgctcagattcaaattaaacagggaaaggatgggaaggagggaagtgttggtttaagtgtgcaacggtccgtgttcggagagaggaattttaatatccacagcagcatctcgcacgaaagcccagcagtgaaactaatgaagcagtcaaagaccgtagacgtgttgagcagaaaactcgcaaccaagaagaaggcaatatctaccaaagttatgaacagcgccgtcatgcgtaagacagcctcctcttgccccgcctctctgacttgtgattgctacgccacagataaagtatgcagcatatgtctgagtagacgacagcaggttgccccgcgggccggtactcctgggttcagagcccccgaagtgttaaccaagtgtcccaatcagaccacagcgatcgacatgtggagcgccggagtcatctttctctccctgctctccggtcgataccctttctataaagcctccgatgatttaaccgctttagctcagatcatgaccatccgggggtcaagagagaccattcaggcagcaaagacgtttggcaagtccatactctgctcaaaggaagtccctgctcaggatctccggaaactctgcgaacgtctgagagggatggattcatccactccaaagcttactagcgatatccaagggcatgcctcccatcagcctgccatctctgagaagaccgatcacaaagccagttgtctagtgcaaacacctcccggccaatacagtggcaatagctttaaaaagggtgactcaaatagttgtgaacattgtttcgacgaatataacactaatctggagggatggaatgaagttcctgacgaggcctatgatcttttagacaaactgctggaccttaacccagcgtctaggattacagctgaagaggcattgctccatcccttcttcaaagatatgtcactgtag

SEQ ID NO: 111588 - DNA, 3453 bp, Artificial Sequence
  Description of Artificial Sequence: Synthetic coding sequence
atggcccagttcggcgggcagaaaaaccccccctgggccacgcagttcactgcaactgcggtgagtcaacctgcagccctcggcgttcagcagccttcccttctcggggctagccctaccatctacacacagcagacagctctggctgccgcaggccttactacacagacccctgccaattatcagctgacccaaaccgctgctctccaacagcaggccgctgcagctgctgctgccctccagcaacagtattcgcaacctcaacaggcactgtactctgtgcagcagcagcttcagcaaccacaacaaacactgcttactcagccagcagtggcgctccctacttccctatctctgtcaacaccacagccaacggctcagatcaccgtgtcctatcctacacccaggagcagccagcagcaaacgcagccccagaagcagcgggtgttcaccggggttgttacaaagctccacgataccttcggcttcgtggacgaggatgtcttttttcaactaagtgctgtgaaaggcaagactccccaggtaggtgaccgagtgttggtggaagctacttacaacccgaacatgccatttaagtggaacgcacagaggatccagacattaccgaatcagaatcaatcacagactcagcctttgctgaaaacaccaccggccgtcctgcaaccaattgctccccagacaacttttggtgtccagacccaaccccagccacaaagcttgttacaggcccaaatctccgcagcaagtatcacccctttgctgcagacacaaccgcagccactcttacagcaacctcaacagaaggcagggcttctgcaaccccctgtgcggatagtgtcccagcctcaaccagcgcgcagattagacccgccctccagattctccggccggaatgatcgcggtgaccaggttccgaatcgcaaggatgatagaagtcgagaacgagagcgcgagaggaggcgcagccgagagcgatctccacagaggaagcgtagtagagagcggagtcctcgtagggagcgggaacgctcacctagacgtgtgaggagggtggtccccagatacaccgtacagttttccaagttcagcttagattgtccgtcatgcgacatgatggaactgcggaggaggtaccaaaacctatacattcccagtgatttttttgacgcccagttcacttgggttgacgcttttccactctcccgtccattccagcttgggaactactgcaacttttacgtgatgcaccgggaagtcgaaagcctcgaaaaaaacatggccatcctggacccgcctgacgccgatcatctatatagtgccaaggtgatgttaatggccagtccatcaatggaagacctgtaccataagtcatgcgcactggccgaggatcctcaggagctgagagacgggtttcagcaccctgcccggttggtcaagttcttagtcggaatgaaggggaaagatgaagccatggcgattggggggcattggtctcccagtctcgatggcccagatccagaaaaggatccttccgtcctgattaagactgcaatccgctgttgtaaggctcttaccggaatcgacttgtccgtctgtactcagtggtataggttcgcggagattcggtatcacaggcctgaagagacgcataaagggaggactgtcccagctcacgtggaaacagtggtgctttttttccctgatgtgtggcactgtctgccaacccgtagcgaatgggagacactgagtaggggctataaacagcaacttgtggagaagctccaaggtgagagaaaggaggcagatggggagcaggatgaagaagaaaaggacgatggggaagccaaagaaattagcacccccactcactggtcaaaacttgatccaaaaacgatgaaagtgaacgatctgcgtaaagaactcgaatctcgcgcgctctcatctaagggattaaagtcacaactgatcgcccggctgacgaagcagctgaaggtcgaggaacagaaagaggaacagaaagaactggagaagagtgaaaaagaggaggacgaggatgatgacaggaaatcagaagatgacaaggaggaggaggaaagaaaaagacaggaagagattgagaggcagcgccgtgagcggagatacatcctgcctgacgagcctgccatcatagtgcatccaaactgggccgccaaatccggcaaatttgactgtagcatcatgtctctatcagtactactggattatcgcctggaggacaataaggagcactccttcgaggtgtccctgttcgccgaactctttaacgagatgctccagcgggacttcggagttcgcatatataaatccctactttctctccccgagaaggaggacaaaaaggagaaggataaaaaatcaaaaaaagacgagcgcaaggacaagaaggaagaacgagacgacgaaaccgacgaacctaaacccaaacggagaaaatccggtgacgacaaagacaagaaggaggatcgcgacgaaagaaaaaaagaggataaacgaaaggacgactctaaagacgacgacgaaacagaggaggataacaatcaggatgagtatgaccctatggaggcagaggaagcagaggatgaagaagacgaccgcgatgaagaagaaatgacaaagagagacgacaagcgggatatcaaccgatattgcaaggaacggccatctaaggataaggagaaggaaaaaacacagatgattacgataaaccgcgatctgttaatggcatttgtctactttgatcagagccattgtggttatctgcttgaaaaagatcttgaggagatcctgtacaccctgggcctgcatctgtcccgcgctcaagtcaagaaattgctgaataaggtagtcctgcgcgagagctgcttctacaggaagctgaccgacacaagtaaagatgaggagaatcatgaagagtccgagtccttgcaggaggacatgttaggaaaccggctgttactgcctacccccaccgttaagcaggagtctaaggatgtagaggagaatgtcggccttatcgtttacaatggagccatggtcgacgtcggctcgctgttgcaaaagttagaaaagtccgagaaggttagggccgaagtagaacagaagttgcaactcctcgaggagaagacagatgaagacgagaagacgatcttgaacctcgagaactccaataaaagtttgtcaggcgaactccgagaggtgaaaaaagatctgtcccagttgcaggagaatcttaaaatcagtgagaacatgaatcttcagttcgaaaatcagatgaacaagaccatccgcaatttatccaccgttatggacgagatccacaccgtactgaagaaagataacgtgaagaacgaagataaagaccaaaagtctaaggagaacggcgcttcggtctag

SEQ ID NO: 111589 - DNA, 3408 bp, Artificial Sequence
  Description of Artificial Sequence: Synthetic coding sequence
atggcccagtttggaggccaaaagaaccccccatgggccactcagtttaccgctactgcagtttcccagcctgcggctctgggcgtgcaacaacctagccttctcggggccagccctacgatctatactcagcagaccgctttagccgcggccgggctgactactcagactcctgcaaattatcagttgacccaaactgcggccctccaacaacaggcagctgctgcggcagcagcgttacagcagctgcagcagccgcagcagactctcctcacccagccagctgttgctctgcctacatccttatcactctccacaccccagccaacggcccaaattaccgtaagctatcccacaccaagatcttcccaacagcagactcagccgcagaaacagcgtgtgttcacaggcgtggtaactaagctgcatgacacattcgggtttgtggatgaggacgtattttttcaactgtcagcggtgaaaggaaaaaccccgcaggtgggggaccgagtgctcgtcgaagcgacgtacaaccccaacatgccatttaagtggaatgctcagcggatccagacactgccaaatcaaaatcagtcccagacacagcctctgttaaagacgccccccgctgttctccagccaatcgccccccagacaacatttggggtgcagacccaacctcagccacaatctttgctccaggcacaaatttctgctgcctcaattacaccactgctgcagacccagccacagcctctgctgcagcagccacaacaaaaggctggactgctccagccgcccgtacgcattgtcagccagcctcagcctgcgcggaggctcgaccccccctccagattcagcggacgaaacgaccgcggcgaccaggtgcctaaccgtaaggacgacaggagccgcgaaagagagcgagagaggagaagatcccgagaaaggtccccacagcgcaagcggtcgagagagagatcccctagaagagagcgggaacgctctccaagacgcgttaggagggtcgttcctcggtataccgttcagtttagcaagttttccctcgactgcccaagctgcgacatgatggaactccgacgtcgctaccaaaatctgtacatcccctcagatttcttcgacgcccagttcacctgggtagatgctttccccctctctcggccttttcaactgggaaattattgtaacttctatgtgatgcatagagaagtcgagtctctggagaaaaacatggctatcctcgaccctccagatgcggaccacctgtattcagcaaaggtgatgttaatggcctcaccctcaatggaggacctataccacaagagctgtgccttggccgaggaccctcaggagcttagggacggatttcagcaccctgctcgtctcgtgaaatttctcgttggcatgaagggcaaggacgaggccatggctattggagggcattggtcccctagcctcgacgggcccgacccagagaaggatccctctgtcctcattaagaccgccattcgttgctgcaaagctctcaccggaatagacctgtcagtgtgcacacaatggtatcggttcgccgagatcagataccatagacccgaagaaacccataaaggtaggaccgtgccagctcacgtcgaaacagtggtgttgttcttccccgacgtatggcattgcctgcccacacggtctgagtgggagacgctgtctcggggttacaagcagcagctggtggaaaaactgcaaggcgagcgaaaagaggccgacggcgaacaggatgaggaggagaaggatgacggggaagccaaggagattagcacaccaacacactggtccaagctggaccccaaaactatgaaggtcaacgacctgcgcaaggagctagaaagccgagcgctctcctcaaagggccttaaaagccagctgattgcccggttgaccaaacagctgaaggttgaggaacaaaaagaagaacaaaaagagttggaaaagtcagagaaggaggaagatgaagacgatgataggaaaagtgaggacgacaaagaagaagaagagcggaaaagacaggaggaaattgagcgccagcggagagagagaaggtacatccttccggatgaacctgccatcattgtccaccccaactgggccgccaagtctgggaagtttgattgcagcattatgtctctctctgtcctcttagattaccgactggaggacaataaagagcatagctttgaagtgagtctgttcgcagagctgttcaatgaaatgctgcagcgagatttcggggtgagaatctacaaatctttgctcagcttgccagagaaggaagacaagaaggagaaggataaaaagtccaagaaagacgagcgtaaggacaagaaggaggagcgtgatgatgaaacagatgagccaaagccaaagagaagaaagtctggcgacgataaggataagaaggaagacagggacgagcgcaagaaggaagacaaacggaaagacgactcaaaggatgatgacgagactgaagaagacaataaccaggatgagtatgaccccatggaagcggaggaggccgaggacgaggaagacgatcgggacgaagaggagatgacaaagagggacgacaaacgtgatatcaatcgatattgcaaagagcgcccaagcaaggacaaggagaaagagaagacccagatgataaccatcaacagagacctcctgatggcatttgtgtattttgatcagagccactgtggttacctattggagaaagacttggaggagattctgtatacgctgggtctccatctctctagagctcaagtgaaaaagctgctcaataaagtggtcttaagagagtcatgtttctaccgcaagttaactgacacatcgaaggacgaagagaaccatgaagagtcagagagcttacaggaggatatgttgggaaatagactgctactgcctacacccaccgttaagcaggaatctaaggacgtggaggagaacgtaggcctgatcgtgtataacggggctatggtcgacgtgggatcactgctccaaaagctagagaaatccgagaaagttagggccgaagtagagcaaaagctacagttactggaggagaagacagacgaggacgagaaaaccatcttgaacctggaaaattctaacaagtcactgtcaggggaactgcgggaagtgaagaaggacctttctcagctccaggaaaacttgaaaatttctgaaaacatgaacttgcagttcgaaaaccagatgaataagacaatccgaaacctcagtactgtaatggacgaaatacatactgttttaaagaaagataacgttaagaacgaggacaaagatcaaaaaagtaaagaaaacggtgccagcgtttag

SEQ ID NO: 111590 - DNA, 360 bp, Artificial Sequence
  Description of Artificial Sequence: Synthetic coding sequence
atggctcagttcggcgggcagaaaaatcccccatgggctacccagtttaccgcaaccgcagtgagccagcctgctgcgctgggcgtgcagcaaccttctctgcttggcgccagtcctacaatatatacccaacagactgcactggccgccgctggacttactacgcagacccccgctaactaccagctgacccagacggcagccctgcaacagcaggccgcagccgctgccgccgccctgcagcagcaatactcccagcctcagcaggcactgtattcagttcagcagcagctgcaacagcctcaacaaacactgcttactcagccagccgtagccttgcctacatccctgtccctgtag

SEQ ID NO: 111591 - DNA, 516 bp, Artificial Sequence
  Description of Artificial Sequence: Synthetic coding sequence
atggcccagtttggaggccagaaaaaccccccatgggcgacacagttcactgcgaccgctgtgagtcagccagctgcgctcggggtacagcaaccttcgcttctcggcgccagtccgactatttacactcaacagaccgcccttgcagccgctggcctcacgactcaaaccccggctaactatcagctaacccagaccgccgccctgcagcagcaagcagctgcagcagcagccgccctgcagcaacagtacagtcagcctcagcaggcgttatatagcgtccaacaacaactccagcaacctcagcagactctcttaacacagcctgctgtggccctccccacttcgctaagtctctccactccccaacctaccgcccaaatcactgtaagctatcctaccccaaggtcaagtcagcagcaaactcagcctcagaaacagagggtgtttactggcgtggtgaccaagttgcacgatacgtttggattcgtcgacgaagatgtgtttttccaatag

SEQ ID NO: 111592 - DNA, 3132 bp, Artificial Sequence
  Description of Artificial Sequence: Synthetic coding sequence
atggcgcagtttggtggccaaaagaatcccccctgggctacccagtttactgcaacggcagtgtctcagccagccgccttgggcgtgcagcagccttcactgctaggcgcctcgccaacgatatatacccagcaaacggccttagccgccgctgggcttaccacccaaacccccgcgaattaccaactcactcaaacagctgccctgcagcagcaggcggcagcagccgccgcagcgctccagcagctgcagcagccccagcagactctgttaacccagcccgccgtcgccttacctacatctttgtccctgtctaccccgcaacctaccgcacagatcaccgtctcatatccgactcccagatccagccagcagcagacccagccccagaaacagcgggtgttcaccggggtggtcactaagcttcatgacacctttggttttgtggatgaagacgttttctttcagctttcagcggtcaaaggaaaaaccccgcaggtgggagacagggtcctggtcgaggcaacctataatccgaatatgccgtttaagtggaatgcacagaggatccagacactgccgaaccagaatcagtcccagacacagccccttttgaagaccccgcccgctgtacttcagccaatcgctccccaaacgacctttggggtgcagactcagcctcagcctcagtcactgttacaggcgcaaatatctgctgcttcaatcacgcctctacttcagactcagccacagccactcctgcagcaaccccagcagaaagctggccttttgcagccacctgtccgaatcgtctcacagccacagcccgcgaggcgactggaccctccctcgcgctttagtgggcgcaatgaccgcggcgaccaggttcctaatagaaaggacgatagatcacgcgaaagggaaagggagcggcggaggtccagggaaagaagcccgcagcgcaaaaggtcaagagagagaagtccaaggcgtgagcgagaaagaagtcctcgccgtgttaggcgcgtggtgccacgctacactgtccagttctccaaattcagcctcgactgccccagctgtgacatgatggaattgcggcggagataccagaacctctacattcccagcgattttttcgatgcccagttcacctgggtagacgccttccctctcagcagacccttccaattgggcaactattgtaacttctatgttatgcaccgggaggttgagagtctcgaaaaaaatatggcgatcttggatcctcctgatgccgaccatctttactcggctaaggtgatgctcatggcgagccctagcatggaagacctgtatcacaagtcatgtgctctcgcagaagatccacaagagctgagggacggatttcagcatcccgcccgtctggttaagtttttggtgggcatgaaagggaaagatgaagccatggcaatcggtgggcactggtcaccttcactggacggacctgatcctgagaaagatccttctgtgctgataaagacagctatacgatgctgcaaggccctgacgggaatcgacctctcagtctgcactcagtggtataggttcgcggagatccgctaccatcggcccgaggagacgcacaagggccggacagtcccagctcacgtggaaaccgtggtgctgttttttcctgatgtgtggcattgcctgcccaccaggtctgagtgggaaaccttatcaaggggctacaaacagcagctagtcgagaagcttcagggtgagcgcaaagaggccgacggagaacaggatgaagaggagaaagacgatggggaggccaaggaaatttctaccccaacgcattggagtaaactcgacccaaagacgatgaaagtgaacgatctgcgcaaggaactggaaagcagggccttgtcctctaaaggactgaaatcgcagcttattgcccggctcaccaaacaactgaaggtagaggaacagaaggaagagcaaaaggagctcgagaaaagcgaaaaagaggaggatgaagatgacgacaggaaatctgaggatgacaaagaggaggaggagcggaaacgtcaagaagagatcgagcgacagagaagagagcgcagatatattctccctgacgaacctgcgatcattgtgcatccgaactgggcagccaaatcaggcaaatttgactgtagtattatgagtttgtccgtgttgttggactatcggctggaagataacaaggagcatagtttcgaggtgagtctgttcgctgagctgtttaatgagatgctccagcgcgacttcggcgtgcgtatttacaaaagtctgctctccttgccagagaaggaggacaagaaagagaaagataagaaaagcaagaaagatgagagaaaagataaaaaggaagagagggatgatgagaccgatgaaccaaaacctaagcggcgaaaaagcggcgacgacaaggacaagaaggaggaccgggacgagagaaagaaggaggataaaagaaaggacgactccaaagacgatgacgagacagaagaagataacaaccaggacgagtacgatccaatggaagctgaggaggccgaggatgaggaggatgatagagatgaggaggaaatgactaaacgtgacgataagagagacattaacaggtactgtaaggagaggcctagtaaggataaggagaaggaaaagacacagatgatcacaatcaatagggacctgctcatggccttcgtatactttgaccagtctcactgcgggtatctgctggaaaaggacttagaggagattctgtacacacttggcctgcacttatctcgggcgcaagtgaagaaacttttgaataaagtggtattgcgtgagtcatgcttctataggaaactcaccgacactagtaaggatgaggagaatcacgaagaatctgagtcgctgcaggaagatatgctggggaatcggctgctgctacccacccccacagtcaagcaggaatcgaaggacgtggaggagaatgtgggccttatcgtttataacggtgccatggtcgatgttgggtcactgctgcaaaagctagaaaagagtgagaaagttcgcgccgaagtcgagcagaagcttcagcttctgtag

SEQ ID NO: 111593 - DNA, 726 bp, Artificial Sequence
  Description of Artificial Sequence: Synthetic coding sequence
atgtttgctcgcggtttaaagcgcaaatgcgtgggccacgaagaagacgtggagggagctctggccggactgaagaccgtgagcagctacagcctgcagaggcaaagcttattggacatgtcattggtcaaactccaactgtgtcacatgttggttgaacccaatctgtgtcgatccgttttgatcgcgaatacggtgagacagatccaggaagagatgactcaggatggtacttggaggaccgtagctccacaggccgctgagcgggcacctctggataggctcgtttccaccgagatactgtgcagagctgcttggggacaagaaggagcccacccagcgcccgggctgggggacggtcatacccaagggccggtttccgacctgtgccctgtcacctccgcccaagcccctcgacacctacaatcatccgcttgggaaatggatgggccaagggagaaccgaggttcctttcacaagagtctggaccagatatttgaaactctcgagacaaagaaccccagctgtatggaggagctgttctcagacgtggactctccttactacgatctagacactgtgttaaccgggatgatgggaggagcccggccagggccttgtgagggtctggaaggcctcgcaccagctactcctggacctagttcttcctgtaagagcgacctgggtgagctggatcacgtggttgagatcttggttgagacctag

SEQ ID NO: 111594 - DNA, 726 bp, Artificial Sequence
  Description of Artificial Sequence: Synthetic coding sequence
atgtttgcccgtggcctgaagcgtaagtgcgtaggtcatgaggaagatgtggagggggccctagcaggcttgaagaccgtctcttcttacagcttacagcgccaatccctgttggacatgtctcttgtaaagctccaactctgccacatgctggttgaacctaatctctgccgatctgtactgattgccaatactgtgcgccagatccaggaagaaatgactcaggacggtacctggaggacagttgccccacaggccgccgagagggcccctctggaccggcttgtgtcaactgaaattttgtgtagggcagcttggggccaagaaggcgcccatccagcgcccggtctgggggatgggcatacccagggacccgtgagtgacctctgccccgtgacaagcgcccaagctccaagacatttacagtccagtgcttgggagatggacgggccgcgagaaaataggggcagtttccacaagagtctagatcagatctttgaaacgcttgaaacaaaaaaccctagttgcatggaggaactgttttcggacgtagatagcccttattacgacctggacactgtgctgaccgggatgatgggaggtgcccgcccaggtccttgcgagggcctcgaggggctggccccggccacccctggcccgagcagctcttgcaagagtgatcttggtgagctggaccacgtggtggagatcctcgtggaaacttag

SEQ ID NO: 111595 - DNA, 759 bp, Artificial Sequence
  Description of Artificial Sequence: Synthetic coding sequence
atgtcaggtagacgaacgcgaagcggcggcgccgcccaacgcagtggacccagggctccttcacccactaagcccctccgtaggtctcagagaaagtccggttctgaactaccatctatcctgcccgaaatctggcctaagacaccatctgctgcggctgtgcggaaaccaattgtcctaaagaggattgttgcgcatgccgtggaggttccagcagtacaaagccctaggcgcagccccaggatctccttcttcctcgagaaggagaatgagccacctgggcgagaacttactaaagaagacctgttcaagactcattcagtgcctgcaacaccaacaagcactcctgtccctaatcctgaggccgagagttcgtccaaggaaggagagctcgacgccagagacctcgaaatgtccaagaaggtgcgaagatcttacagccgactcgaaactctggggagtgcaagcacctcaacccccggcaggcgcagctgctttggcttcgagggcctgctgggcgcagaggacttgtccggagtctcaccagtggtgtgtagtaagctcactgaggtaccgagagtctgtgccaagccatgggctccagacatgacgttgcctgggatctcacctcctcccgagaaacaaaagcgtaaaaagaaaaaaatgccagagatcctcaagaccgaattagatgagtgggccgctgccatgaacgcagaattcgaggcggccgagcaatttgatctgctggtggagtag

SEQ ID NO: 111596 - DNA, 216 bp, Artificial Sequence
  Description of Artificial Sequence: Synthetic coding sequence
caatttcttgaccaggaagactggggccctcaaaggacctcaaaagaaattaggcagctgcagaacgactgtatgcgactgagggagtccctaaacactacgcaggtgcacaacttggctctcggggaaaaactccagaatttgccgaccctactgtacaaaagcctgaaggagggcgctcaggcaattcaagaggaggctcaggccattcagtag

SEQ ID NO: 111597 - DNA, 1353 bp, Artificial Sequence
  Description of Artificial Sequence: Synthetic coding sequence
atggacgcccggcgagttccacaaaaagacctgagagtgaaaaaaaatctgaaaaagtttcgttacgtgaagctcatttccatggagacctctagttcctctgacgacagctgtgactcattcgcgtctgacaacttcgccaatacaaaacccaaatttcgttcagatatatctgaagaactcgctaatgtgttttatgaagatagcgacaatgagagcttctgtgggttctcagagtccgaggttcaggatgtgcttgatcactgcggctttctgcagaagcccaggcccgacgtcacaaatgagctggcgggaatattccacgcggattccgacgacgagagtttctgcgggttttccgaaagcgagatccaggatgggatgaggttacaaagcgtaagagagggatgccgcaccagatcacagtgccggcattccggcccgctgcgtgtggcgatgaaattccctgcccgatcaactcgcggcgccaccaacaagaaggccgaaagtagacagccttctgagaactccgtgacagacagcaacagcgattccgaggacgaatccggcatgaacttcttagagaaacgtgcactaaatatcaaacagaataaagccatgctggctaaactgatgtcagaattagagagtttccccggatcctttagagggaggcaccctttgccagggtccgattcccaatcccgccggccccgccgaaggacctttcccggagtcgcgtcacggaggaaccctgaaagacgggcccggcccctgacacgctctcgttctaggattctgggatcattggatgccctcccgatggaggaagaggaagaggaggacaagtatatgctggtacgaaagagaaagacagttgatggctacatgaatgaagacgatcttccccggtctcgacggtcacggtcgagtgttacgctccctcacatcatccgtccggtggaggagatcacagaagaggaactggagaacgtatgcagtaactcacgcgagaagatctataaccgctcgctgggaagcacctgccatcaatgcagacaaaagaccattgatacgaagactaactgcagaaacccagactgttggggtgttcggggccaattttgtggaccctgcctccgtaaccggtatggcgaagaagtccgagatgcacttctagatccgaactggcactgcccgccttgtaggggtatctgcaattgcagtttttgtcgtcagcgcgacggcaggtgcgccaccggggtgcttgtgtacctggccaaatatcacggttttggaaacgttcacgcttacctgaagtccctgaagcaagaattcgaaatgcaggcttag

SEQ ID NO: 111598 - DNA, 1116 bp, Artificial Sequence
  Description of Artificial Sequence: Synthetic coding sequence
atggatgctaggcgcgtaccccaaaaggacttgagagtcaagaaaaacctgaaaaagttcagatatgtcaaactaatcagcatggagacctcgtcaagcagcgacgattcatgtgatagtttcgcatccgacaatttcgctaacacaagactgcagagtgtccgggagggttgtagaacccggagccagtgccggcacagtggccctctcagggtggctatgaaattccctgcgcggtctacgagaggggccaccaacaaaaaggccgaatcgaggcaaccaagtgagaatagtgtgactgattccaattccgacagtgaagatgagagcgggatgaacttcttggaaaagagggccctcaacatcaagcagaataaggcgatgctcgcgaagctgatgtccgaactcgagagcttccctggttcattcagagggaggcaccccttgccgggaagtgatagtcaaagtaggcgcccacgacgccgtacatttcctggagtagcaagccgtagaaatcccgaaaggcgagcacgtccactaacaaggagcaggagccgcattttgggctcacttgatgcactccccatggaggaagaggaggaagaggacaaatatatgcttgtgcggaagcggaaaacggttgacggctatatgaacgaagatgacttaccacggagtcgccgttctagaagcagcgtaacacttccccatatcattcggcccgttgaggaaatcacagaagaagaactggagaatgtgtgcagtaatagccgcgagaagatttataaccggagcctcgggtccacatgccaccaatgtagacaaaaaacgatcgatacaaaaaccaactgcaggaatcccgattgttggggagtccgaggtcagttctgtgggccttgcctgcgaaaccggtatggcgaggaggtgcgcgatgccttactcgatccaaattggcactgtcctccttgtaggggcatatgcaactgctccttttgtagacagcgcgatggccgctgcgccaccggtgttttggtataccttgccaagtaccatggctttgggaacgttcacgcctatctgaagagcctgaaacaggagttcgaaatgcaggcatag

SEQ ID NO: 111599 - DNA, 966 bp, Artificial Sequence
  Description of Artificial Sequence: Synthetic coding sequence
atggacgctaggcgggtcccccagaaggaccttcgcgtcaagaaaaacctcaagaaatttcgttacgtaaagctcatatcaatggagaccagttcctcctccgatgactcttgcgactcctttgcttccgataatttcgcaaacacaagactgcagtcggtccgcgaaggctgcagaacccgatcacagtgccggcacagcggccccctccgggtggctatgaaatttcctgcccggtccacacggggggcaactaacaaaaaagcagaatcaaggcagccatctgaaaactccgttaccgactctaacagcgactcagaagatgagtccggtatgaatttcttagagaagagggccctgaacattaagcagaataaagctatgttagcaaagctcatgtccgagcttgagtcgttccccgggtcatttaggggacgtcatcctctccccggttctgactcccaatcccggcgtccacgcagacggactttccctggcgtcgcttccaggaggaatccagagaggcgggctcggccactgacgaggagtcggtcccgcatcctggggtcactggatgctctgccaatggaggaagaagaagaggaagataagtacatgctggtgcggaaacggaagaccgtggacggatacatgaacgaggatgatctcccacggagccggcggtctcggagcagtgtgacactccctcatataattcggccggtggaggagatcaccgaggaggaacttgaaaatgtctgcagcaattccagagaaaagatctataatagatccctcaactggcactgtccaccatgtcgtggcatctgtaactgtagcttctgccggcagcgggatggaaggtgcgcaactggcgtgctcgtttacctggcaaagtatcacgggtttgggaacgtgcacgcttatctcaagagcctcaagcaggagtttgaaatgcaggcctag

SEQ ID NO: 111600 - DNA, 1263 bp, Artificial Sequence
  Description of Artificial Sequence: Synthetic coding sequence
atggaaactttgagttccgaggaaagctgcgacagttttgactcactcgagtctggcaagcagcaagatgtgcgattccatagcaaatacttcactgaagagttgcggcggatttttattgaggataccgattcagaaacggaggattttgccggattcacacagagcgaccttaatggcaaaactaacccagaggtcatggtggtcgagtccgacctgtcagatgacgggaaagcctctctcgtctccgaagaggaggaggacgaagaggaagataaggcgaccccgcgaaggtcccggtccaggcgctcgtctatcggcctaagggtggcctttcagtttccaactaaaaaactcgcaaacaagcctgacaaaaactcttcctccgagcagcttttctcctcagcccgattgcaaaacgaaaaaaaaacaatcctggaaaggaagaaggattgtcggcaagtgatacagagagaagacagtacgtctgagtctgaagatgactcccgggacgaaagtcaggagagctcagacgcattgctgaagcgaacgatgaatatcaaagagaataaagccatgttggctcagttattggctgagttaaactccatgcccgacttttttcccgtgcgtactcccacatccgcatctcgaaaaaaaaccgtgcgcagagccttctccgagggtcagattacacgccgcatgaatcctacccgatcagcacggcctcccgaaaagttcgcccttgagaactttactgtgtctgccgccaaattcgctgaggaattctacagctttcgccgcaggaaaaccatcggtggcaaatgtcgcgagtacagaaggcgacacagaatctcatcctttagacccgtcgaagatatcaccgaggaggacctggagaacgtcgcgatcacagtgagggacaaaatctatgataaagtactcggcaatacttgtcaccagtgccgtcaaaaaacaattgacacaaaaaccgtttgtaggaatcaggggtgttgtggcgtgagaggacagttctgcggaccgtgcttgaggaaccgttacggcgaggatgtccgatccgccttactggaccctgactgggtgtgcccaccttgcaggggcatctgcaattgtagttattgtcgcaagagagacggcagatgcgccacggggatcttgattcatctagccaaattctatggctacgacaatgtgaaggaatacctggaaagtctccagaaagaactagtcgaggataactag

SEQ ID NO: 111601 - DNA, 1227 bp, Artificial Sequence
  Description of Artificial Sequence: Synthetic coding sequence
atggagctggccacccgatatcagattcccaaagaggttgcggatatctttaacgctccatcagacgatgaagaatttgttggctttagggatgacgtgccaatggagacactcagttcggaagagagttgtgactcttttgacagcctggagtccggtaagcaggtggttgagagtgacctaagcgatgacggaaaagcgtctttggtcagcgaggaagaggaggatgaagaagaagacaaggccacccctagacgatcccgtagccgccgcagctcaatcgggctccgggtggcatttcagttccctactaagaaactagccaacaagccagataagaactcttcttctgagcaactctttagttcagctaggctgcagaacgagaagaagactattctggaaaggaagaaggattgccggcaggtcattcagcgtgaagactctacctctgagagcgaggacgattcccgagacgaaagccaggaatcctcggatgcactactgaaacggacgatgaacataaaagagaacaaagctatgcttgctcagctgctggcagaactcaactctatgccagattttttcccagtccgcacccctaccagcgcaagccgcaaaaagacagtaagacgtgcctttagcgagggacagattacacgccggatgaacccaacaagaagtgccagaccacctgaaaaattcgccctcgaaaatttcacagtcagcgctgccaagttcgcagaagagttttactcctttcgccggcgcaagaccattgggggcaagtgcagggaatacagaagaaggcaccgtatttcctcttttaggcccgtcgaagacataaccgaggaggacctggaaaatgttgctattaccgtccgggataagatctacgataaggtcctgggtaacacatgtcatcagtgtcgccagaaaaccatagatacaaagaccgtgtgccgaaatcagggctgctgcggagtaaggggccagttttgcggtccgtgtctgagaaatcgctatggggaggatgtgcggagcgcactcctggatcccgactgggtctgtccaccctgccgggggatttgtaattgcagttactgccgaaagagggatggcaggtgtgccaccggaattcttatccacttggctaagttctacgggtacgacaatgtgaaggaatatctggaatcattgcagaaggagctcgtggaagataactag

SEQ ID NO: 111602 - DNA, 1365 bp, Artificial Sequence
  Description of Artificial Sequence: Synthetic coding sequence
atggaactggcgacacggtatcagatccctaaggaggtcgccgacattttcaatgcaccatctgatgacgaggagttcgttggcttccgcgacgacgtgcctatggaaaccctctcttcagaggagagttgcgactctttcgattctctggagagcgggaagcagcaggatgtgaggtttcatagcaagtacttcactgaggagcttagacgcatatttatcgaggataccgattccgagacagaggatttcgctggttttacccagagcgacttgaatggcaagactaaccccgaagtgatggtggtggagtcagatctctctgacgatggtaaggctagcttggtctcagaggaagaggaggatgaagaagaggacaaggccacccctcggcggtcaaggtcccgcagatcttccattggcctgcgcgtggcatttcagttcccaactaaaaagcttgccaataagccggataaaaattccagctcggagcagttattttcatctgcgcggctgcagaatgaaaaaaaaaccattctggagcggaaaaaggactgcagacaggttatccagagggaagatagcacctctgaatcagaagatgattcacgcgacgaaagccaggagtctagcgacgcactgctgaaaaggaccatgaacataaaagaaaataaagcaatgttagctcagcttctggctgaattaaatagcatgcccgatttttttccagttcggactccaaccagcgcctcaagaaaaaagactgtcaggcgcgctttctccgagggtcagatcacccggcggatgaacccgacaagatcagcaagaccccctgaaaaattcgctctcgaaaactttacagtctccgcggctaaattcgcagaggagttttattcttttagacgcagaaagactatcggtggcaaatgccgcgaatacagacgaaggcaccgcatttcctcgttccggccagtggaagacattaccgaggaagatctcgaaaatgtagctatcaccgtgagggacaaaatctatgacaaggttctgggcaacacctgccaccagtgtagacaaaagacgattgacacaaaaaccgtgtgccgtaatcagggatgttgtggcgtgcgagggcagttctgcggcccatgtctaaggaatcggtatggcgaagacgttaggagtgcactgctggacccagactgggtttgccccccttgccgcgggatttgtaactgctcatattgccgaaaaagggacggaagatgcgctactgggatcctcatacacctcgctaagttttacgggtacgataacgtcaaggaatatcttgagagcctccagaaagagctggttgaggataattag

SEQ ID NO: 111603 - DNA, 291 bp, Artificial Sequence
  Description of Artificial Sequence: Synthetic coding sequence
atggagaccttatcttccgaggaatcttgtgacagcttcgactccctagagtcaggtaagcagcaggacgtccgctttcactctaagtactttactgaggagctccgacggatttttatcgaggataccgattccgaaacagaggatttcgcgggtttcacccagtcagatttaaacgggaagactaatcccgaggtgatggttgtggagagcgacttaagtgacgatgggaaggcttcgcttgtctcagaagaagaggaggacgaagaagaagataaagcaactccctag

SEQ ID NO: 111604 - DNA, 843 bp, Artificial Sequence
  Description of Artificial Sequence: Synthetic coding sequence
atggcccctaggaaagggtcttctcgagtcgcaaagacaaacagtttgcgccgaagaaagctcgcttccttccttaaggacttcgaccgggaggtcgaaattcggatcaagcagatcgaatccgacaggcaaaacctcctgaaggaggtggacaacctctacaacatcgagatcctccgtctgcccaaagcccttcgtgaaatgaactggcttgactattttgctctaggaggtaataagcaagcgctggaagaggcggctaccgccgacttggacataaccgagatcaacaagctcacagccgaagctatccagaccccactgaaaagcgcgaagacgagaaaagtgatccaagtcgatgagatgattgtcgaggaggaagaggaggaggagaatgagcgtaaaaaccttcaaaccgcacgcgtgaagcgctgccccccctcaaagaagcgaactcaaagcatccagggtaaggggaaaggtaagagatccagccgggccaatactgtcaccccagccgttggaagactggaggtgagcatggttaagcctactccaggcttgacaccacggttcgactctcgcgtattcaagaccccagggctcaggacacctgctgcaggcgagaggatttataacatcagtggcaacggaagccctttggccgattccaaagaaatctttcttactgtgccggtgggcggaggcgagtctctgagactacttgcatccgacttacaacgccacagtattgcgcaattagatccagaggctctgggaaacattaagaagctgtccaaccgattggcccagatttgtagctcaatccggacccacaaatag

SEQ ID NO: 111605 - DNA, 843 bp, Artificial Sequence
  Description of Artificial Sequence: Synthetic coding sequence
atggctcctcggaaaggctctagtcgggtggctaagactaatagtctgagaagacggaagctggcctcatttctgaaggatttcgatagggaggtggagattaggatcaagcagattgagtccgatcggcagaatctgctgaaggaagtggacaatctgtataatatcgagatcttgcgacttccgaaagcactgcgtgagatgaattggcttgattacttcgcattgggtggaaacaagcaagctctcgaggaggcagcaaccgcggatctagatatcacagagatcaacaagctcacggccgaggctatacagacacctctaaagtctgcgaaaacaaggaaagttatccaggtggacgaaatgattgtggaggaagaggaagaagaagagaacgaacgtaaaaatctccaaacagcccgggtgaaacggtgtcccccgagtaagaagcgcacccagtctattcaggggaaggggaaagggaagagaagctctagggccaacacggtgacgccagccgtgggccgactcgaagtgtctatggtgaagcccacccccggcctgactcccagattcgactcaagagtgttcaaaactccgggcctccggaccccagcggctggcgaacgaatctataacataagcggcaatggtagccctttggctgacagtaaagaaatctttctgaccgttcccgtgggtggcggtgagtctctccgactgctcgcatctgatctccagcggcattctatcgcgcagctggacccagaggcgcttggcaacattaaaaagctctctaaccgcctagcacagatctgttcgtccatcagaacgcataagtag

SEQ ID NO: 111606 - DNA, 414 bp, Artificial Sequence
  Description of Artificial Sequence: Synthetic coding sequence
atgcccaacttcgctggtacttggaaaatgcgcagttccgagaatttcgatgagctactcaaagccctcggggtgaacgcaatgctgagaaaagtcgccgtggctgctgcctccaaaccccatgttgagataagacaagacggcgatcagttctacataaagacaagcacgaccgtccgtacgaccgagatcaattttaaagtgggagaggggttcgaggaggagacggtggacggtcgcaagtgccgatccctggccacttgggaaaacgagaacaagattcattgtacacagactctcctcgaaggtgatgggcccaagacttactggacgcgcgagctggccaacgacgaactcatcctgacattcggagctgatgacgtcgtctgtactagaatatacgtgcgcgagtag

SEQ ID NO: 111607 - DNA, 249 bp, Artificial Sequence
  Description of Artificial Sequence: Synthetic coding sequence
atgcctaatttttctgggaattggaagataatcagaagcgagaactttgaggagctgctcaaagttctgggggtgaacgtgatgttaaggaaaattgccgtcgccgcagcttccaagcccgcagtggaaataaagcaagaaggagatactttctatattaaaacttccactaccgttcgcacgacagagattaactttaaggtcggcgaagagttcgaggaacagaccgtagacggtagaccctgctag

SEQ ID NO: 111608 - DNA, 417 bp, Artificial Sequence
  Description of Artificial Sequence: Synthetic coding sequence
atgccaaacttctccggaaactggaaaatcattcgctcagagaacttcgaggaactcttaaaggttctgggcgttaatgtgatgctgcgcaagatcgctgttgccgccgccagtaagcctgccgttgaaattaagcaagagggcgatacattctacatcaaaacctctaccacggtgcgcacaaccgagattaactttaaggtcggtgaagaatttgaagaacaaacggtcgacggaagaccctgtaagtctttggtgaagtgggagagtgagaacaaaatggtgtgcgagcagaaactcctgaagggagagggacctaaaacgagctggacaagagaactgacgaacgacggtgaactgattttaactatgaccgccgatgacgtagtgtgcaccagggtgtatgtgcgagagtag

SEQ ID NO: 111609 - DNA, 417 bp, Artificial Sequence
  Description of Artificial Sequence: Synthetic coding sequence
atgcctaattttagtggcaattggaaaatcatccgtagtgaaaacttcgaagaactcctgaaggttttaggcgtgaacgtgatgctgcgaaagatcgccgtcgcagccgcgtccaagcccgccgtggagataaaacaggaaggggatacattctacataaagacttctacaaccgtgaggacaacagagattaattttaaagtaggcgaggaatttgaagaacagactgttgatggacgcccatgcaagtcacttgtgaaatgggaatccgagaacaagatggtctgcgagcaaaagctcttaaagggagagggtccaaagacctcatggaccagggagttgacaaatgacggtgaactgatcctgacgatgacagcagacgacgtggtgtgcactcgagtgtacgtgagggagtag

SEQ ID NO: 111610 - DNA, 744 bp, Artificial Sequence
  Description of Artificial Sequence: Synthetic coding sequence
atgggtacctcatccacagactcccagcaggccgggcatagacggtgttcgacctccaatacctctgccgagaatctgacgtgcctctcactccccggctctcctggcaaaaccgcacccctgcccggtcccgcgcaagccggcgccgggcagcccctgcccaagggctgcgccgcagttaaggccgaggtcggcatcccagctcctcatacctcccaagaagtgcgaatccatatccgacgcttgctgtcatgggcggcccctggtgcttgcggtcttaggtctacaccctgcgctctcccacaagcgctcccacaagcacggccatgtcctggacgatggttttttcctggctgctcactccctactggaggcgcacagactatactgtcactgtggacctggagacactttctgaattgggctctgcagcagagagaggagaactctggcagggcacgccgggtacctcctgttcccaggactgctcctgtgagcaaaggtgagggctcccaccctccacagaattcgaatggcgagaaggtcaaaaccattacgcccgacgtgggcttacaccagagcctgacatccgatcccactgttgccgtgctaagggctaaacgagctcctgaggcccacccccctaggtcctgctcagggagcctgactgctagggtttgccacatgggagtctgccagggacagggagacactgaagatgggagaatgaccttgatgggatag

SEQ ID NO: 111611 - DNA, 744 bp, Artificial Sequence
  Description of Artificial Sequence: Synthetic coding sequence
atgggcacgtcatccaccgattctcagcaagccggccaccgccgttgctcgacgagcaatactagcgctgaaaacctcacctgcctctccctccccggttcgccaggcaaaacggccccattgccaggccctgctcaagccggggcgggacagcccctgcccaaaggatgtgctgccgtcaaggccgaagtgggcatccctgctcctcacacttcccaggaggtcaggattcacatacgcagactgctttcatgggccgcccctggggcctgtggactgcggtctaccccctgcgcactgccacaagccctgcctcaggctagaccttgccccggccgctggtttttcccaggctgctccctgcccacaggcggggcacagaccattctttcgctttggacatggcgccattttttgaactgggctcttcaacagcgggaggaaaatagcggcagagctcgtagagtgcccccggtgcctcgcacggcccctgtgagcaagggcgagggaagccatcctccgcagaatagcaatggggaaaaagtgaagacaatcaccccagatgttggactgcaccagtcattaacgagcgatccaacagtggcggtactgcgggcaaaaagagccccagaagcacatccccctcgctcatgctcaggcagcctgacagcacgcgtctgccacatgggcgtgtgtcaaggccagggcgacaccgaggacgggcgcatgacacttatgggttag

SEQ ID NO: 111612 - DNA, 4218 bp, Artificial Sequence
  Description of Artificial Sequence: Synthetic coding sequence
atggccgcccgctctcccccctctcctcatccctcccctcccgcccggcaactaggaccacggagtccacgggtgggacggggcgccgaggtgcacgccatgagatcggaagctagcggctttgccggcgctgctagagaagtggttgccgacgaaagcgacaaaatttgggtaggcgaggaaggtagcggcggcagacggggtccgggcggagctgctcctgctcacgcccctctgttgtcagcacccatgggatctcggcgtcttgaaggcatatcggtggaagaggcaatggtgacccgcactcaactccttgaggaggagttatccagcttaaaggaagagttagcactttgccaggctgataaagaatttgtgtggagtctctggaagcgcctgcaggtgactaacccggacttaacccaagttgtaagcttggtcgtagagcgcgagaagcagaaatccgaagccaaagacagaaaggttctcgagattttgcaagtaaaagatgccaagattcaggaattcgaacagcgcgagagcgtcctgaaacaggaaatcaatgaccttgtcaagcggaagattgccgttgacgaggaaaatgcattccttcgcaaagagttttccgacctggagaagaagttcaaggacaagtctcaggagataaaagacactaaggaatgtgtccaaaataaagaggagcagaaccgtcttgtgattaagaacttggaagaagaaaacaaaaaactgtcaacacgttgtaccgacttactcaacgatttggaaaagctgaggaagcaggaagcccatctgcgcaaggagaaatatagcactgacgcaaaaattaaaaccttcgaggataatctcatagaggccagaaaagaagtagaggtctcccaatcaaagtacaacgcactgtctctacaattatcaaacaaacagaccgagctgattcaaaaagatatggacatcacactagttcgccaggaacttcaggagcttcaaaacctctataagcagaacagtacccacacagcacagcaggcagaactgatccagcagttgcaggtacttaatatggatactcaaaaggttctgcgtaatcaggaggacgtgcatacagctgagagcatcagctatcagaagctctataatgagctacatatctgcttcgaaacgaccaagagcaacgaggctatgctgagacagtccgtgaccaatcttcaggatcagctgctccagaaggaacaggagaatgcgaaactcaaagagaagctgcaggagtcacagggtgctcccctgcccctcccgcaggagtccgatcccgattattctgcacaggttccgcaccgccccagcctgtcgagtctcgaaactctgatggtcagccagaaatctgagattgaatacctccaggagaagcttaaaatagccaacgaaaagctgagtgagaacataagtgccaacaaaggtttctccaggaagtccattatgacatctgccgagggcaaacacaaggagccccccgtaaagaggagccggtcgctgtctcctaaatccagttttaccgactctgaggagctccagaagttgcgtaaagcagaacgcaagattgaaaatttggaaaaggcactccaactgaaatcccaggaaaacgatgagctcagggatgcacatgaaaagaggaaagaacgactgcagatgttgcagactaactaccgggccgtgaaggagcagcttaaacagtgggaggagggttctgggatgaccgaaatccgcaagattaaacgggccgacccccagcaactccgccaggaggattccgatgcagtctggaatgagctggcctatttcaaacgcgaaaatcaggaactgatgattcaaaagatgaacctggaggaagagcttgatgaattaaaagtgcacattagcatcgacaaagcagccattcaggagctcaatcggtgtgtcgccgagaggcgagaggagcagctctttcgaagtggtgaggacgacgaggttaagagaagcacacccgaaaaaaacggaaaggaaatgctcgagcaaaccctccagaaagtgaccgagctggaaaacagactgaaaagcttcgagaagcgaagccgtaagctgaaggagggcaacaaaaagctgatgaaggagaatgattttctgaaaagtttgcttaagcaacaacaggaagatacagaaactagggagaaagaattagaacagataatcaaagggagtaaggacgtggagaaggaaaacacggaactgcaggtgaagatcagcgagctcgagacagaggttacatccctgcggcgccaagtagctgaggctaacgccctcaggaacgaaaatgaggagcttatcaacccaatggagaagtctcatcagagcgcagaccgggccaagagcgaaatggcaacaatgaaagtgagaagcggtagatacgactgcaagaccacgatgaccaaggtaaagttcaaagctgctaaaaaaaattgtagcgtcggcaggcaccacacagtgttaaatcactcaatcaaggtgatgtcaaatgtgtttgaaaacttgtcaaaggacggatgggaggacgtttcagagagctcttcagactccgaagctcagacatcccagaccctaggtactatcatagttgaaacatcacagaagatcagtcccacagaagacggtaaggaccaaaaggagtcggatcctacagaagatagccagacacaggggaaggagattgtgcagacatatttgaacatcgatggcaagactcccaaggactactttcacgataaaaatgccaagaaaccgacgttccagaagaagaattgtaagatgcaaaaaagctcacacacagccgttccaactcgagtgaatcgggagaagtataaaaacattactgcacagaagagctcctcaaatatcatcctcctgcgagaaaggatcatctccctgcaacaacagaacagtgtcctacaaaacgccaaaaaaacagccgaactcagtgtgaaggagtataaagaggttaacgagaaactgctccaccagcagcaggtgagcgatcagagattccagacaagtagacaaactatcaagaagctaaatttggatctcgccggactccgtaaggaaaaggaggacctgctgaagaaattagaatccagtagcgaaatcacgagtctggcggaggagaactctcaggtgacatttccaagaatccaggtaacctctcttagccccagccgctctatggatctagagatgaaacagctgcagtataaactgaagaatgctaccaatgagctgaccaagcagtcatccaacgtgaaaactcttaaattcgaattattggccaaggaggaacatatcaaggaaatgcacgaaaaaatttccagaatggagcgggatattaccatgaagaggcaccttatcgaagaccttaagtttcgccaaaaagtcaacctggagtcaaataagtcctttagtgaaatgctccaaaatctcgacaagaaggttaagacactcacggaggagtgctccaataaaaaagtgtctattgactcgttaaagcagcgactgaacgttgcggtgaaagagaagtcccagtatgagcagatgtaccagaaaagcaaagaagagctcgagaagaaggatctgaagttgacactactggtcagccgcatctctgaaactgaaagtgctatggccgagattgaaacggcagcttcgaagcaattgcaggaactggcccttcagagcgaacaggtgctggaaggcgcccagaaaaccttactcctcgctaacgaaaaagtggaggagtttactacttttgttaaggcccttgccaaggagctgcagaacgacgtgcatgtggtaagaaggcaaattagggagctcaaaaagatgaagaaaaaccgggacgcctgtaagacatccacccacaaggctcagaccttggctgccagcatcctgaacattagccgatccgacctggaggaaatcctcgacactgaagatcaagtggaaatagagaagactaaaatcgacgctgagaacgacaaggagtggatgttgtatatccaaaagttgctagaaggacagagtctggcactgagccctcggctgaagtgtaacggcgcaattgtagctcaccagaacctacggttgcccgactctagttccagtgccagcgcctcatag

SEQ ID NO: 111613 - DNA, 1176 bp, Artificial Sequence
  Description of Artificial Sequence: Synthetic coding sequence
atggccgcccgaagccccccatccccacacccttccccaccagcgcggcagctgggacctaggagccctagagtcggcagaggcgcagaggtgcatgcgatgcggtccgaggcttccggctttgccggagctgcccgcgaagtggtagcagacgagtctgacaagatatgggtgggcgaggaaggctcgggcggacgaagaggcccggggggggcagctcctgcccacgcccccttactctcggcccccatgggaagcaggagacttgaagggatctcggtggaagaggccatggtgacgagaacacagctcctggaggaggagctgagctctctaaaagaggagctggcgctgtgccaggcggacaaggaattcgtctggtcattgtggaagcggctccaagttacaaatcctgatctgactcaggtggtgtcgctggtggtggagagggaaaagcagaagtctgaggctaaggacagaaaggtgctggaaatattacaggtgaaagacgccaagatacaggagttcgagcaacgggaatctgtgctgaaacaagagataaacgatctcgtcaaaagaaagatcgcagtggacgaggagaatgccttcctgaggaaggaattcagcgacttggaaaaaaagtttaaggataaaagtcaggagataaaagatacaaaggagtgcgtgcaaaacaaggaagagcagaatagactcgttatcaaaaatctagaggaggagaataagaaattatctactcggtgtactgacctgttgaacgatttagagaagttgcgaaagcaagaggcccacctccggaaagagaagtactctaccgacgcgaagatcaagacttttgaagacaacctcattgaggcccgcaaggaggttgaggtttcccagtccaagtacaacgcactgagtctccagctgtccaataagcagacagagttgatacagaaagacatggatattaccctggtgaggaaggagctgcaagagctacagaacctgtataagcagaattctacccacactgcccagcaggcggagctcatccagcagctgcaagtactaaatatggatacgcagaaagtactgaggaaccaggaagacgtacatactgcagaatcaatcagctatcagaaggtgtgtttctactctgtgattaagatgtag

SEQ ID NO: 111614 - DNA, 4221 bp, Artificial Sequence
  Description of Artificial Sequence: Synthetic coding sequence
atggctgctcgctctccaccttctccgcacccaagtccacccgcgcggcagctgggcccgaggtctcctcgtgtgggtaggggagccgaggtgcatgctatgaggagcgaggcaagcggctttgccggcgccgcccgagaggtcgttgccgacgagtctgacaagatatgggtaggcgaagagggcagcggaggtcgccggggccctgggggagcagccccagcgcatgcccctctgttgtccgcccctatgggatcacgtaggctggagggtataagcgtcgaggaggctatggtgactagaactcagttactggaggaggaactgtcttccctgaaggaagagctggctctttgccaggcagacaaggaattcgtgtggtccctctggaaaaggttgcaggtaactaacccagacctgactcaggtggtgagtctggtcgtggagagggaaaagcagaaaagcgaggccaaggaccgcaaagtcctcgagattctgcaggtgaaggacgccaagatccaagagtttgagcagcgcgaaagcgtcttgaagcaggaaattaacgatctggtgaagaggaaaattgccgtcgatgaggaaaacgcttttctgcggaaggagttttccgatttggagaaaaagtttaaggacaagtcacaggaaattaaggacaccaaggagtgcgtgcagaataaggaggagcagaacagattggtgatcaagaatctggaggaggagaacaagaagcttagtacccgttgcacagatctgttaaatgatctcgagaaactgcgcaagcaggaggctcaccttagaaaagaaaagtactccaccgatgcaaaaatcaagacatttgaggataatctcattgaggcgcggaaggaggttgaagtcagccagtctaagtacaatgcattgtcccttcaactaagtaacaaacagactgagctcattcaaaaggatatggacatcacgctagtccgaaaggagctgcaggagctccagaatctttataagcagaacagcacacacaccgctcagcaggcagaacttatacagcaactacaggttttgaacatggacacccagaaagtactcaggaatcaagaggacgtgcatacagctgaaagcatcagctaccagaagttgtacaacgaacttcacatttgcttcgagacaaccaaatcaaatgaggccatgctcagacagagcgtgactaacttacaggaccaactcctgcagaaagagcaggagaatgccaaattaaaagagaagctgcaggagagtcagggggcaccactgcccctacctcaggagagtgaccccgactacagcgcccaggtaccccatagaccgagcctgtcatccctagaaaccctgatggtatcccaaaagtcagagatagagtacttacaggagaagctcaagatagctaatgagaaactgtcagagaacatctctgcaaacaagggcttttcacgaaaatctattatgacgtcagctgagggtaagcataaggagccccctgtcaagcgctctagatcacttagcccgaaaagctcatttactgacagcgaggagttacagaaactgcgcaaggccgagcgcaagatcgaaaatttagaaaaggctttgcagttgaaatcccaggagaatgatgagttaagggacgcgcacgaaaagcgcaaggaacgactgcaaatgttgcaaactaactatagagctgtaaaggagcagctgaaacagtgggaagaaggcagtgggatgactgaaatccgcaaaatcaaacgggcggatccccagcagctccgccaggaagactctgacgcggtatggaacgaacttgcctactttaagcgggaaaatcaagagttgatgatccagaaaatgaacctagaagaagagcttgacgagcttaaagtccatatcagcatagacaaagccgctattcaggagttaaaccgatgcgttgctgaacgtcgagaagaacagctctttcgctccggagaggatgatgaggtgaagcggtccaccccagagaaaaacggtaaggaaatgctggaacagactttgcaaaaagttacagaactggagaatcgccttaagtcttttgagaagcgaagcaggaagctaaaagagggtaataagaagctgatgaaagagaacgattttctgaagtcactgcttaagcagcaacaggaggacactgagacaagggaaaaggaattggaacagattattaaggggtcaaaagacgtggaaaaggagaataccgagctgcaagtcaagatcagcgaactcgaaaccgaggtgacgtccctgaggaggcaagtggccgaggcaaatgctctgagaaatgagaatgaggagctgataaatccaatggagaagtcacaccagtctgcagatagggcaaaaagtgagatggcgactatgaaggtacggtcgggaaggtatgattgtaagactacgatgaccaaggtaaagttcaaggctgcgaaaaagaactgctctgttgggcgacaccacactgttctaaaccatagcattaaggtgatgtcaaacgttttcgagaacctgtcaaaagatgggtgggaagacgtgagtgaatctagctcagacagcgaggcacagacttcccagacattgggaacgatcattgttgagactagccagaaaatctcccccacagaggacggtaaggatcagaaggaatcagatcctactgaggactcacaaacccagggaaaggaaattgttcaaacttatctcaatatcgatgggaagacgcccaaagattatttccatgataaaaatgctaagaagcccacgttccagaaaaagaattgcaaaatgcagaaaagctcccataccgccgtgcctacccgagttaatagagagaagtacaaaaacatcaccgcccagaagtcctcctctaatattatactactgagggagcgcatcatctccctgcagcaacaaaatagcgtgctccagaatgcaaaaaagaccgcagaattgagcgtcaaggagtacaaagaggtgaacgaaaaactactccatcagcaacaggtttccgatcagcgatttcagacgtcacggcagaccattaaaaaactgaacttggatttagccggactccgcaaagaaaaagaggatctgctgaagaagctcgagtcaagctcagaaatcactagcttggcagaggagaactcccaagtaacttttccgcgcatccaggtaactagcctgtctccctccaggtctatggatctagagatgaagcagcttcagtacaaattaaaaaacgcaactaacgaacttacaaagcagtcgagcaatgtgaaaaccctcaagttcgaactactcgccaaagaagagcatatcaaagaaatgcacgagaagatctctcgtatggagcgtgacattactatgaaacgacacttaatcgaagacctcaagttcaggcagaaggttaaccttgagtcaaataagtccttcagcgaaatgctgcagaatctggataagaaggtcaagactttgacggaggaatgctcaaataaaaaggtgtctatcgattctttgaaacaacgtcttaacgtggccgttaaagagaaatcccagtacgagcaaatgtaccaaaagtcaaaggaagaactggagaagaaagacctgaaactcaccctcctcgttagtaggatctcagaaacagaatctgcaatggccgagatcgagaccgctgccagtaagcaactacaagaactggctctccaatcagaacaggtcttggaaggagcgcagaagacactcctcctagcaaacgagaaagtggaagagttcacgacattcgttaaagccctcgccaaggagctccagaatgatgtacacgtcgtcagacgacagattcgggaactcaagaagatgaaaaagaaccgtgacgcctgtaagacaagcacccacaaagcccaaaccctcgcggcctccatcctgaatatctcaaggtcagacctggaagagatccttgacacggaggatcaggttgaaatcgaaaagacgaagattgatgccgaaaatgacaaggagtggatgctctatatccaaaagttgctggagggccagttgccttttgccagttacctgctggaggcagtccttgagaaaattaatgaaaagaagaagctggttgagggttatttcactataatgaaggacatcagatag

SEQ ID NO: 111615 - DNA, 4221 bp, Artificial Sequence
  Description of Artificial Sequence: Synthetic coding sequence
atggctgctagatcaccgcctagccctcacccttcccccccagcccggcagctgggtccacgttcgccacgtgtcgggagaggcgcagaagtgcacgcaatgagaagcgaggcaagcggtttcgcaggagctgctcgcgaggtagttgccgacgagagcgacaagatttgggtcggggaggaagggagcggcggaagacgcggccccgggggtgctgcacccgcgcacgctcctttgctgtctgcccccatgggttctagacgacttgaaggcatctccgtcgaagaagcaatggtgacccggacccagctcttagaggaagaactgtcttctctgaaggaggagttagcgttgtgtcaggccgataaggagttcgtctggagcctatggaaaaggttgcaggttaccaatcctgatttaacccaggtggtgagcctggtagtagaaagggagaagcagaagagcgaggcgaaagatagaaaagtactggaaatcctacaggtgaaggatgctaagattcaagagttcgagcaacgcgagtcggtgctgaaacaagagattaatgatcttgtcaagcggaagatcgccgtggacgaggagaatgcctttctgagaaaggaattttcagacttagagaaaaaatttaaagacaagtctcaggaaattaaagacacaaaagagtgcgtgcagaataaggaggaacagaatcggctagttattaagaatctggaggaagagaacaagaaactttctactcggtgcacagacctgttaaacgatctggaaaagctgaggaagcaggaggctcatttaaggaaggaaaaatattccactgacgcaaagatcaagacattcgaagataatctaatcgaagctaggaaagaggttgaggtcagccagagtaagtacaatgctttatcgctgcagctgagcaataaacagacagaactgatacaaaaagatatggatatcacgctcgtacggcaggaattacaggagctccaaaacctctacaagcagaactccacgcataccgcccaacaggccgagctaatacagcagctgcaagtgctgaatatggatacccaaaaggttttgaggaatcaggaggacgtgcacaccgccgaaagtatatcatatcagaagctctataatgagctgcatatctgctttgagaccaccaagtctaatgaggccatgttgcgccagagcgtaaccaatctgcaagaccaactgctccaaaaagagcaggaaaacgcaaagctcaaagaaaaactccaggagagtcagggggcacccctgcccctgccccaggagagcgatccggattatagtgcccaggtccctcacagacccagcctttcctccttggagaccctgatggtgagccaaaaatctgagattgaatatctgcaggagaaattgaaaattgctaatgagaaattgtcagaaaacattagcgccaacaagggtttctcccggaagtctataatgacgagcgccgagggcaagcataaggaacctccagtcaagagaagccggagccttagcccaaaatccagcttcacggactccgaggaactgcagaaattacggaaagccgaacgcaagatagagaatctagaaaaagcgttgcagctgaaaagccaagagaacgatgaactgagggacgcccatgagaagcggaaagagcggctgcaaatgctccagactaattatcgagccgttaaagagcaactgaagcagtgggaagagggcagcggcatgacggagattaggaaaattaagagggccgacccccaacagttgcgccaggaagattccgacgcagtgtggaatgaattagcctactttaagagggaaaaccaggaactcatgattcagaagatgaacctcgaggaggagttggatgaactcaaagttcacatttcaatcgataaggccgccatccaggagctgaaccggtgtgtcgctgagcggagagaggagcagcttttccggtcaggcgaggacgacgaagtcaaaagaagtacgcctgagaaaaatggcaaggaaatgctggaacagaccttgcaaaaagtaactgaactcgaaaatagactgaagtcatttgaaaagaggtcaaggaaactgaaagaagggaacaagaagctcatgaaggaaaacgattttctcaaaagcctcctgaaacaacaacaagaagataccgaaaccagggagaaagaacttgaacagattattaaggggagcaaggacgtcgaaaaagagaacacggaactccaggtgaagatatctgagctggagactgaagtaaccagcctcaggcgccaagtggccgaggccaacgcgttgcgaaacgaaaacgaagaattgatcaatcccatggagaaaagtcaccagagtgcagacagagccaaaagtgagatggccactatgaaggtgcgctccggtcgatatgactgtaagaccaccatgacaaaagtgaaattcaaggctgcaaagaagaactgcagtgtgggccgccaccacactgtccttaaccatagtattaaggtcatgtcaaacgtgtttgaaaacttgtccaaggacgggtgggaggacgtctcagagagctccagtgattccgaagctcagacgagtcagacattggggacgattatcgttgagacctcacagaagatcagtcctactgaggatggcaaagaccagaaggagagcgatcccactgaggatagtcaaacacaggggaaagagatcgttcaaacctatctgaatatcgacgggaaaacgcccaaggactacttccacgataagaacgcgaaaaagccgactttccagaaaaagaattgtaaaatgcagaaaagtagccacaccgccgtccccactagagtgaaccgggagaaatacaagaatataacagcacagaaaagctcaagcaacattatcttattgcgagagcggatcatatctctgcaacaacaaaacagcgtgttgcagaacgccaaaaagacagccgaactgtccgtgaaggaatacaaggaagtgaacgagaagctgctgcaccagcagcaggttagtgaccagaggttccagactagcaggcagacgatcaaaaagcttaatctagacctggctggcctgagaaaagaaaaggaggaccttctgaaaaagctggaatcttccagcgaaatcacaagcttggcagaggagaattctcaggtcaccttcccacgcattcaggtcacgagtttatccccctcgagaagcatggatctcgagatgaagcaactacagtacaagttgaagaatgctacgaatgagcttaccaagcagagcagtaatgtgaaaacactcaaattcgagctgctcgccaaggaggagcacattaaggaaatgcacgagaagattagtaggatggagagggacatcactatgaagagacaccttatcgaggatttgaagttccgccagaaggtaaatcttgagagcaacaaatccttctccgagatgctgcagaacttggacaagaaggtgaagacgttaaccgaagagtgtagtaacaagaaagtgagcatagatagcttgaaacagagactcaatgtggctgtcaaagagaagagccaatacgagcagatgtaccagaaatcaaaagaggagttagaaaagaaagatttaaaactaactctgctcgtgtctagaatttcggagacagaatcagctatggccgaaattgagacagccgctagtaaacaattgcaagaactggcacttcagagcgagcaagtactcgaaggagcccaaaaaacccttctgctcgccaatgagaaggtggaggaattcacaacattcgtgaaagccctggccaaagaactccagaacgacgtgcatgtcgtccgcaggcagatccgcgaattaaagaagatgaaaaagaatcgagatgcatgtaagacttcgacccacaaggctcagacgctggccgccagcattctcaatatctcccgcagcgatttagaggaaattttagatacagaggatcaggtggaaatagagaaaaccaagatcgatgctgagaatgacaaggaatggatgctatatattcagaaattactggagggccagctcccgttcgcatcctacttgctggaggccgtacttgagaagatcaatgagaaaaagaaactggtggaaggatactttaccatcatgaaggatataagatag

SEQ ID NO: 111616 - DNA, 519 bp, Artificial Sequence
  Description of Artificial Sequence: Synthetic coding sequence
atggcttccggatttaaaaagccttccgccgcatccaccgggcagaaaaggaaggtcgccccgaaacccgagttaaccgaagaccagaagcaagaagtcagagaggcctttgacctttttgacgtagatgggtccggtactatagacgctaaggagctaaaggtggccatgagagccctcggattcgaaccacgcaaggaagagatgaaaaaaatgatcagtgaagtggatcgcgagggaactggaaaaatttcattcaatgacttcctagctgtaatgacacaaaagatgtccgaaaaggacaccaaggaggagattctgaaggccttcagactgtttgacgacgatgaaaccggcaaaatcagcttcaaaaatttgaagagagtcgctaatgagctgggcgagaatttaaccgacgaagaactgcaggagatgatagacgaggccgatcgcgatggggatggagaggtgaacgaggaagagttcctgagaatcatgaagaaaactagcctgtactag

SEQ ID NO: 111617 - DNA, 519 bp, Artificial Sequence
  Description of Artificial Sequence: Synthetic coding sequence
atggcaagcaatttcaaaaaggcgaatatggcttctagcagtcagcgcaaaaggatgtcacctaagccggagcttacagaagagcagaagcaggagatacgggaggccttcgacctgtttgatgctgatggcacagggaccattgatgtaaaggagctgaaagtcgcgatgcgcgctctggggtttgaaccgaagaaagaggagattaaaaaaatgatctccgagatcgacaaggaaggcaccggcaagatgaacttcggggacttcctgaccgtgatgacacagaaaatgtccgaaaaagatactaaagaagagattctgaaggcctttaaactgtttgatgatgatgaaacagggaaaattagtttcaaaaatctgaaaagagtggcaaaggagctcggcgaaaatcttacggatgaggagttgcaggagatgattgacgaagccgacagagatggggatggtgaagtcagtgagcaggagtttctgcgcatcatgaaaaagacatcgctttactag

SEQ ID NO: 111618 - DNA, 378 bp, Artificial Sequence
  Description of Artificial Sequence: Synthetic coding sequence
atggctatgcaggccgccaaaagggctaacatccgcctaccacccgaagtgaaccgcatcctgtatatcaggaacttaccatacaagataaccgcggaagaaatgtatgacatctttggaaagtatgggcccattcggcagatcagggtgggtaacacaccagagaccagggggaccgcatatgtcgtatatgaagacatcttcgacgccaagaatgcatgtgatcacttgagcggttttaacgtgtgtaacaggtacctcgtcgtgttatattataacgccaatagagcattccaaaaaatggacacgaaaaagaaagaggagcagctgaaactgctaaaagaaaagtacgggattaacactgacccaccaaagtag

SEQ ID NO: 111619 - DNA, 423 bp, Artificial Sequence
  Description of Artificial Sequence: Synthetic coding sequence
atgggtccaagacgccgctcccgtaagcccgaagctcccaggcgtagaagcccctcccccacccccacccccggacctagccgccggggcccttcactgggggcaagctcccaccagcattcacggagaaggcagggttggctgaaggaaatccgcaaattacagaaatcgacacatcttctcatccgaaagttgccgttctcccgtttggcacgcgaaatctgcgtgaaattcacccgaggggtggactttaactggcaggcacaggcactgctggcattgcaggaagccgccgaggcgttcttagtccacttgttcgaggatgcctacctgctcactttacacgcaggcagagtcacactgtttccgaaggacgtgcagttggctcgtcggattagaggactggaagagggactcggctag

SEQ ID NO: 111620 - DNA, 1800 bp, Artificial Sequence
  Description of Artificial Sequence: Synthetic coding sequence
atgggtccaaagcgtagacagctgacctttagagagaagtctcggattatccaggaggttgaggaaaatcctgaccttagaaagggcgagattgccaggaggttcaatatacctcccagcactctatctacaatactcaagaacaaacgcgctatattggccagtgaaagaaaatatggggtggcctctacttgcagaaaaactaataagctctccccatatgataagctggaggggctcctcattgcatggttccagcagatcagggccgcgggtctccccgtgaagggtatcatactgaaggaaaaggccctgcggattgcggaagaactcggtatggatgattttactgcttcgaatgggtggcttgatagattcaggcgacgacatggagtggtgtcctgctcgggcgtcgcgcgggcccgggcacgaaacgcggccccgcggaccccagccgctcccgcatctccggcagccgttcctagcgagggatccggaggcagcacgaccggatggcgggcgagggaagagcagccacccagtgttgctgaggggtacgcttcccaagatgtttttagtgccaccgagacttcactgtggtacgactttctgccagaccaagccgctggtctctgcggcggagatgggaggccaagacaggctacgcagcgtctaagcgtgctcctgtgcgcaaacgcagacgggtcagagaaactaccccccctggtggccggaaagtccgcaaagccccgcgccggccaagccggcctgccatgcgactacaccgcaaattcaaaggggggagtaacaacccaagccctggccaagtacttgaaggcattagacacccggatggccgccgagagcaggagggtgctcctcctcgccgggaggctagctgcacaatcattggacacaagtgggctacgacacgttcaactggcttttttccccccagggacagtccatcccctggagcgaggagtggtccagcaggtcaagggacactaccgacaggccatgctgcttaaggcgatggctgcattagaagggcaggacccctctgggctgcagctgggacttacagaagcccttcactttgtggccgcagcatggcaggccgtggagccttccgacatagccgcatgtttcagagaagccgggtttggcgggggcccgaacgctactattaccacatctctgaaatcagagggagaggaggaagaagaggaagaggaggaggaggaggaggaagagggtgaaggagaagaggaagaggaggaaggcgaagaagaggaggaggaggggggggaaggtgaagagctcggcgaggaggaagaagttgaggaagaaggtgacgttgactctgacgaagaggaagaagaagacgaggagtcgtcgtcggagggacttgaagccgaagattgggcacagggagtagtggaggccggagggtcttttggggcctatggagcacaggaggaagcccagtgtccaacactgcacttcttagaagggggtgaagattcagatagtgattctgaagaagaagatgacgaggaggaggacgatgaagatgaagatgacgacgacgatgaagaggatggcgacgaagtgccagtgccttcttttggcgaggcgatggcgtactttgcaatggtgaaacgataccttacgtccttcccgattgacgaccgagtccagagtcatatactacacctcgagcacgaccttgtgcatgttacacgcaaaaaccacgcccgccaggctggagtcagaggcctggggcatcagagctag

SEQ ID NO: 111621 - DNA, 417 bp, Artificial Sequence
  Description of Artificial Sequence: Synthetic coding sequence
gaggatgaagagtctagtagtgaagggcttgaggctgaagattgggcccaaggagtagtcgaggctggcggctctttcggagcatatggtgcgcaagaagaggcccaatgccctacattacacttcctagagggtggtgaagattcagattctgactctgaggaggaggacgatgaagaggaggacgatgaggatgaagacgacgacgacgatgaagaagacggcgacgaggtgcctgttccgtcctttggagaggccatggcttactttgccatggtgaagcgatacctcacaagctttccaatcgacgacagagttcagagccacatcttgcacctcgagcatgatctggttcacgttactcggaagaatcatgcacggcaagcgggagttaggggactcggacaccaatcctag

SEQ ID NO: 111622 - DNA, 2832 bp, Artificial Sequence
  Description of Artificial Sequence: Synthetic coding sequence
atggccgccagtggccttgaccacctcaaaaacggttataggagaaggttctgtcggccctcccgagccagggatattaacacggaacaagggcagaacgtgcttgagatccttcaggattgttttgaggaaaaaagtctggccaatgatttttcaaccaactctaccaaaagcgtaccaaactccactaggaagatcaaagacacatgcatacaatccccttctaaagaatgccagaagtctcaccctaagtctgtgcctgtatcttctaagaagaaggaagccagtctccagttcgtggtggaaccttcggaagccacaaacagaagcgtgcaggcccacgaagtgcaccagaaaattttggccacagacgtgagttccaagaacaccccagactctaaaaagatttctagcaggaatataaacgatcaccactccgaagcggatgaagaattctatttgagcgtgggcagcccttctgtgctcctggacgctaagactagcgtaagccagaatgtcatcccatcatcagcacaaaaaagagagacatacacattcgagaactcggtcaatatgctcccatcctcgaccgaagtatcggtgaagaccaagaagcgcttgaattttgatgataaagtgatgctgaaaaagatcgagattgacaacaaagtgtctgacgaggaagacaagacctcagaaggccaggagcgtaagccgtctggatctagtcagaaccggatacgcgactcggagtatgagattcagcgccaggcgaagaaaagcttctctacgctgttcctggagacggtgaagaggaaatccgagtccagccccattgttcggcacgccgccactgctcctccgcactcatgcccccccgacgataccaagctgatcgaagacgagtttataatcgacgaaagcgatcagtcattcgcaagtaggtcatggattaccattccccgcaaggcgggctcgctcaagcagagaacaatctcacccgcagagtctacagccctgctgcagggaagaaagagcagggagaaacatcataacatcctcccaaagaccctggccaacgataagcattcccacaaaccccatccggtggagactagccaaccttcagacaaaacagtattggatacttcttacgcactcatcggagagaccgttaacaactacaggtcaactaagtatgaaatgtactccaaaaacgcagagaagccctcgagaagcaagagaacaatcaaacagaaacagcgcaggaagttcatggccaaaccagctgaggagcagttagacgtaggacagagcaaggacgagaacattcatacatcccatataacccaagatgaatttcagaggaattctgacagaaatatggaggagcacgaagagatgggcaatgattgcgtatctaaaaagcagatgcctcctgtggggtccaagaaatctagcacgagaaaagacaaagaggaatctaagaagaagcggttctccagtgagtcaaagaacaagcttgtcccagaggaggttaccagcactgtgactaaaagccgcagaatttctcgccggccaagcgactggtgggtcgttaaaagcgaagaaagccccgtctatagtaatagttcggtccggaacgagctacctatgcatcacaattcgtccaggaagtccactaagaaaaccaatcagtcttctaagaatataaggaagaaaaccatcccactaaaacgtcagaagacagcaacgaagggaaaccaaagagtgcagaagttccttaacgctgaaggtagtgggggtatagtgggccacgacgagatctcccgatgttcactgtccgagcccctcgaaagcgacgaagctgatcttgcaaaaaaaaagaacctcgattgttctcgaagcacgagaagttccaagaatgaagataacatcatgaccgcacagaacgtcccactgaaaccccaaaccagcggctatacatgtaacatacccacagagagcaatctcgattccggcgaacacaagacctctgtgctggaagagtctggcccctcgcgactcaataataactacttgatgtccggaaaaaacgacgttgatgacgaggaggtgcacgggtcttcggacgactcaaaacagagcaaggtgatccccaagaatcgtatccaccataagctggtccttccatcgaacacacccaatgtgaggcggacaaaacgcacacggttgaagcccctcgagtattggcgaggggagcgtatcgattaccagggtcgaccctccggaggatttgtgatcagtggcgtgctgagcccagataccatctcaagcaaaaggaaggccaaggaaaacattgggaaagtgaacaaaaaatccaataagaagagaatttgtttggataacgacgaaaggaagaccaatcttatggttaatttaggtatccctctgggcgatcccttgcagcctaccagggtaaaggacccagaaaccagagagatcatcctgatggatctggtgcggccacaagatacctatcagtttttcgtgaagcacggcgaactcaaggtatacaagacactggacacaccttttttctctacagggaaattgattctcggcccccaggaggagaagggtaaacagcacgtcggccaagacattctggtgttctatgtcaactttggcgacctgctctgcaccctgcatgagaccccatatatcctaagtacaggagactcattttatgtcccatctgggaattactataacattaaaaacctaaggaatgaagaatctgtgctattattcacacagatcaaacgctag

SEQ ID NO: 111623 - DNA, 8106 bp, Artificial Sequence
  Description of Artificial Sequence: Synthetic coding sequence
atggctgaagagggggccgtcgctgtgtgtgttcgggtccgtccgttaaactcgagagaagaaagcctgggtgagactgcacaggtttattggaagaccgataacaatgttatatatcaggtagacggatcaaaaagctttaactttgacagagtgttccacggcaatgaaaccacaaaaaatgtgtacgaggagatcgcggctcccatcattgattccgcgatacaaggttacaacggaacaattttcgcctacggacagaccgcctccggaaaaacctataccatgatggggagtgaagaccatctaggcgtgatccctcgcgcaattcatgatatcttccagaagatcaagaagtttcctgacagggaattcttgcttcgcgtgtcctatatggaaatctataatgagacaattaccgacctcctgtgcgggacccagaagatgaaaccacttattattcgcgaggacgtgaatagaaatgtctatgtggccgatctgactgaggaagttgtgtacactagcgagatggcattaaagtggattactaagggcgagaaaagcaggcattacggggagacaaagatgaatcagcggtcgtcaaggagccatactatttttaggatgatactggagagcagggaaaaaggggaacctagtaactgtgaaggttcagtgaaggtgagccacctgaatctggtggacctagccggatccgagagagccgcccagacaggtgctgccggtgtgcgactgaaggagggctgcaatatcaaccgaagcctcttcatcctaggccaggtgatcaagaagctctctgatggccaggtggggggctttataaattacagggactccaaactgacgcggattttgcagaatagccttggtggtaatgctaaaacacgaatcatttgcacaatcactcccgtgagctttgatgagaccttaactgcccttcaattcgccagcaccgccaagtacatgaaaaacacaccctacgtgaacgaagttagtactgacgaagccctgctgaagcgctataggaaggagataatggatctaaaaaagcagctggaggaagtttcgttggagacccgcgcccaagctatggagaaggatcagctggcccagctgctggaagagaaagatttgcttcagaaggtgcagaatgagaagattgaaaatctcacccggatgctggtcacttcatcctccctaacactgcaacaggaacttaaagccaaacgtaagcgccgcgttacttggtgcttggggaagatcaacaaaatgaaaaattcgaactatgctgaccagtttaatatacctacaaatataaccacaaagacccataaacttagcattaatttactgagggagatcgacgagagcgtgtgctctgaatctgatgtgttcagcaacacattggacactttgtcagaaatcgaatggaacccagccaccaagctgctgaatcaggagaatatagaaagtgaattgaactcccttcgggctgattacgacaacctcgtcttggactacgaacagttgcgcactgaaaaagaagagatggagttaaagctcaaagagaaaaatgatcttgacgaattcgaagccctggaacgaaagacaaagaaagatcaggaaatgcagttgattcatgagatcagcaacctgaaaaacttagttaaacatgcggaagtctacaatcaggatctggaaaatgagctatccagtaaagtagagcttctcagggaaaaagaagaccagattaagaagctgcaagaatacatcgacagccaaaaactggagaacataaagatggaccttagttactctctagagtcgatcgaggaccccaagcagatgaaacagactctcttcgatgctgaaaccgttgcacttgacgctaagcgggagtccgcatttttgagatcagaaaatttggaacttaaggaaaagatgaaggaactcgcaacaacgtacaagcagatggaaaatgacatccaactttatcagtcccagttggaggccaagaaaaagatgcaagtggatttagaaaaagaactgcaatcagcctttaatgagataaccaaactcacaagtcttatcgatggaaaagtgcctaaagatctgctatgcaacttagagcttgaaggtaagattaccgacctccagaaggaactaaataaagaagtggaggaaaatgaggcactaagggaagaagtgatacttttgtctgagttgaagtctctgccttccgaggtcgaaagactgagaaaggaaatccaggacaagagcgaagagcttcatatcatcaccagcgagaaagataaactgttcagcgaggtcgtgcacaaggaatcaagggtacagggtctactggaggagattgggaagaccaaggatgatctggccaccactcagagcaattataaatcgactgaccaggaattccaaaatttcaaaaccctccacatggatttcgaacagaaatacaagatggtgttagaggaaaacgaacgaatgaaccaggaaatcgttaatctgtctaaggaggctcaaaagttcgacagctccctaggagctttgaaaacagagttgagctacaaaactcaggagctccaagagaaaacgcgcgaagttcaggaacggcttaatgaaatggaacaactgaaagaacagctagaaaatcgggattccaccctgcaaactgtggaaagggaaaagacccttattaccgagaagctccagcaaaccttggaagaggttaagacactgacgcaggagaaagatgacctgaagcagttacaggagtccctgcagatagaacgtgatcagctgaagagtgacatccacgatactgtgaatatgaacatcgatactcaggagcagcttagaaacgcactggagagtttgaaacagcatcaggagaccattaacacattaaaatctaaaatatcggaagaggtgtcccgtaacctgcacatggaagaaaacacaggcgaaaccaaagacgagtttcaacaaaagatggttggcattgataagaagcaggacctggaagctaaaaatactcagaccctaaccgccgacgtcaaggacaacgaaatcattgagcagcagaggaagatcttctcactcatccaagagaagaatgagttacagcagatgttggaatcagtaatcgcggagaaagagcaactgaaaacagatctgaaggaaaacattgaaatgacaatcgaaaaccaggaggagcttagattgctgggggatgagcttaaaaaacaacaagagatcgtggcacaggagaaaaatcacgctatcaagaaagagggtgaactgagccggacctgcgatcgcttggccgaagttgaggagaagctgaaggaaaagtcccagcaactacaggaaaagcaacaacagctgctgaacgttcaggaggagatgagcgaaatgcaaaaaaagatcaatgagattgaaaacctgaaaaacgagttgaagaataaagaactgactttagagcatatggaaaccgaacggcttgagctcgcacaaaaactgaatgaaaattatgaagaggtaaagagcattacaaaggaaagaaaggttctgaaagagttacaaaagtcattcgagacggaacgagatcatcttcggggatacatcagagaaatcgaggcaacgggcctgcagacaaaggaagagcttaaaattgcccacattcacctgaaagagcatcaggaaacaatcgatgagcttaggagatcagtaagtgagaagactgcgcagatcataaacacgcaggaccttgaaaaatcccacacgaagcttcaggaggagatccctgtactgcatgaagagcaggagctgttgcctaacgtaaaggaggtgtcagaaacacaggagactatgaacgaattggaactgcttactgagcagtccacgacaaaggactctactacactggcccgcatcgagatggaacggctgcgcctgaacgagaagtttcaagagtcgcaggaagagattaaatccctgaccaaagagagggacaatctcaaaacaataaaggaagctctggaggtgaagcacgaccagctgaaagaacacatccgtgaaacgctggctaaaattcaggagagccagtcaaaacaggaacagtcactaaatatgaaagagaaggataacgagaccacaaaaatcgtgtccgagatggagcagttcaagcccaaggacagcgccttattgcggatcgaaatcgagatgctgggtctctcgaaaagattacaggagagtcatgacgagatgaagtcagtcgccaaggagaaggatgacctgcagaggctccaggaggttctccagagcgagagcgatcagcttaaggaaaacattaaagagattgtggccaagcatcttgagacggaggaggagctcaaagtcgcccattgctgcctgaaagagcaggaggagactatcaacgaactccgagttaacctttctgaaaaagagaccgaaatctcaactatccaaaagcagttagaggctattaacgataaactgcagaataagatccaggagatatacgaaaaggaggaacaattcaacattaagcagattagcgaagtgcaggagaaggttaatgaattgaaacaattcaaagagcacaggaaagccaaagatagtgcactccaatccattgagtccaagatgctcgagcttacgaaccggttgcaggagtcccaggaggagattcaaatcatgatcaaggagaaggaggagatgaagcgcgtgcaagaggcccttcagatcgaaagggatcagctaaaagagaacacaaaggagattgtcgccaagatgaaagaatctcaggaaaaagagtaccagtttcttaaaatgacagctgtcaacgagactcaggagaagatgtgcgaaattgagcatcttaaggaacaatttgagacccagaaacttaatcttgagaacatcgagaccgaaaatattaggctgactcaaatcctacacgagaacctggaagagatgaggagcgtgacaaaggaacgagacgatctcagatctgtggaggagaccctgaaagtggagagggaccagctgaaagaaaacctgcgggagactatcacccgtgaccttgagaaacaggaagagctgaaaatcgtgcacatgcaccttaaggaacaccaagaaactattgacaaactccgcggcattgtatctgaaaagacgaacgagatctccaacatgcagaaagacctggagcactccaacgacgccttgaaagcccaagatctgaagattcaagaagaactccgaatcgcccatatgcatctcaaggagcaacaagagacgattgacaaactgaggggcattgttagcgagaaaactgataagctgagtaatatgcagaaagaccttgagaatagtaacgctaaactacaagaaaagatccaggaactgaaagctaacgagcatcagttgattacgctcaagaaggacgtaaatgaaacgcaaaaaaaagtgtcagaaatggagcaactgaagaagcagatcaaagaccaaagcctgaccctgtctaagctggagatcgagaacctcaaccttgcccagaagctgcacgaaaatctggaagagatgaagagtgtgatgaaggagcgcgacaatctccggcgggtcgaggagactctgaagctggagcgcgaccagctcaaggaatcgttacaagagaccaaggcacgggaccttgagatccagcaggagctgaagactgcccgcatgctgagcaaggaacacaaggagacagtggacaagctgcgagagaaaatcagcgagaaaaccatccagatctccgacatacagaaggatctggataaatccaaagacgagctccagaaaaagattcaggagctccagaaaaaggagctgcagctgctgcgagtgaaagaagacgttaacatgtcacataaaaaaatcaacgaaatggaacagctcaagaagcaattcgaggcgcagaacttatccatgcagagcgtacgaatggataactttcagctgaccaaaaagttacatgagtcactcgaggaaataaggatcgtggctaaggagcgagacgagctccgcaggatcaaggagtctctcaaaatggagcgagaccagttcatcgctactctgcgggagatgattgcacgtgacaggcaaaaccaccaggtgaaacccgagaagagattgctgagtgatggtcaacagcacctgacagagagcctacgtgaaaagtgcagccggatcaaggaacttctaaaacggtacagcgagatggatgaccattacgagtgcctgaaccgactcagccttgatctagagaaggagatcgagttccaaaaagagctaagtatgcgtgtcaaggccaacctttccctgccatacttgcaaacgaaacacatagagaagctgttcaccgcaaaccagcgatgcagtatggagttccacagaataatgaaaaaactgaaatacgttctgagttatgttacaaagatcaaagaggaacagcacgagtctataaataagttcgaaatggatttcatagacgaggttgaaaagcaaaaagagcttcttattaaaattcagcatcttcaacaggattgcgatgtcccttcgagggaactgagagatttgaagttgaatcagaacatggatcttcatattgaagaaattctgaaggatttttccgaatcagagttcccctcgattaagaccgagtttcaacaagtgctgagcaatcgtaaggagatgacacaatttctggaagaatggctgaacactcgatttgacatcgaaaaactgaaaaatggaattcaaaaggagaatgatcggatctgtcaggttaataacttctttaacaaccgcatcattgccattatgaacgaatccaccgaatttgaggagagaagcgccactatctccaaggagtgggaacaggatctaaaatcccttaaggaaaaaaacgaaaaattattcaagaattatcagacactcaaaacctctctggccagtggtgcccaagtcaacccaacaactcaggacaataagaatccacacgtgacttccagagcgacacagctcaccaccgagaagatccgagagctcgagaattcactccacgaggccaaagagtccgctatgcacaaggaaagcaaaattattaagatgcagaaagagctcgaagtcacaaacgacatcatcgcaaagctgcaagccaaggtacatgagtccaataagtgtctggaaaaaactaaggagactatccaggttctgcaagacaaggtcgcgctcggcgcgaaaccatacaaggaggagatagaagacctgaagatgaaactcgttaagatagacctggagaagatgaaaaacgctaaagaatttgagaaagaaatcagtgcgaccaaggctacggtggaatatcagaaggaggtcatccggctcctgcgagaaaacctccggcggagtcaacaagcacaggacacatctgtaataagcgaacacaccgatcctcaaccaagtaacaagccactcacctgcggcggagggtccggtatcgtgcagaacactaaggccttgatcttaaagagtgaacacatccgactcgagaaggaaattagtaagttaaaacagcagaatgagcagctgataaagcagaagaatgagctcttgtccaacaatcaacacctgagcaacgaagtcaagacttggaaagagcgcactctaaagcgggaagcgcacaaacaggttacctgcgaaaatagtccgaagtccccaaaggttaccggtacagctagtaaaaagaagcagatcacaccttcacagtgcaaagaaagaaacttgcaagatcccgtccctaaggagagtcctaagtcctgcttctttgatagtcggagtaaatccctgccctccccccaccccgtgcggtattttgataattcttcactcgggctttgccctgaggtccagaacgcgggcgctgaatcagtggacagccagcccggaccttggcatgctagctctggcaaggacgttccagagtgcaagactcagtag

SEQ ID NO: 111624 - DNA, 7743 bp, Artificial Sequence
  Description of Artificial Sequence: Synthetic coding sequence
atggctgaggagggcgccgttgccgtctgcgtgagggttcggccccttaattctcgcgaggagtctctgggcgaaacagctcaggtttactggaagacagacaacaacgtgatataccaggtcgatgggtctaaaagttttaactttgacagggtgttccacgggaatgagacaaccaaaaacgtctatgaagagattgcagctcccatcatcgatagcgccatccagggctataacggaacgatatttgcatacggccagactgcctcgggtaagacatacaccatgatggggtccgaggatcatctgggcgtcatcccacgggcgattcacgatattttccagaagatcaagaagtttcccgaccgtgaatttctgttgagggtgtcctacatggaaatctataatgaaactataacagatctactgtgtgggacccagaagatgaaacctcttatcatacgggaagatgtgaatcgcaatgtgtacgtggccgatctgacagaggaagtggtttacacttcagagatggcgctgaaatggatcacgaagggcgagaaatcccgccactacggagagacaaagatgaaccagcggtccagtcggtcacacacgatcttcaggatgattctggaaagcagggagaaaggtgagcccagtaattgcgaaggctcagttaaggtttcacatctgaacctcgtcgacctcgctggttccgaacgagctgcacagaccggtgcagctggtgtccgtctcaaagaaggctgtaatattaatcgatcactatttatcctcggccaggtgatcaagaagctgtccgacggacaggtgggcggcttcatcaactatagggactcaaagctgacgcggatccttcagaactccctgggaggaaatgccaagacaaggattatttgcaccatcacaccagtgtcttttgatgagaccctaaccgctctccagttcgcgtcaacagctaaatacatgaagaacacaccatatgtgaatgaagtttccaccgacgaggccctgctgaaaaggtatcgaaaggagatcatggatctcaaaaaacagctggaggaagtcagtttagagacgcgggctcaggccatggagaaggatcagcttgctcagctgctggaggagaaagacctgcttcagaaagtccagaatgaaaagattgagaatctgacaagaatgctggtgacatccagctctctgaccctccaacaggagctgaaagccaagcgaaagcgacgcgttacatggtgcttggggaagatcaacaaaatgaagaatagcaactatgcagaccaattcaatatccccacaaacatcactaccaaaacccataaactgtctatcaatcttctgcgtgagatcgatgagagcgtgtgttccgaaagcgacgtgttcagtaatacgctggatacactgagtgagatagaatggaatccggcaactaaactcctcaaccaggagaatatagagtctgaactcaactcacttcgcgccgactatgataatttagtgctggattatgagcagctccgcacagagaaagaagaaatggaactgaagctaaaggagaagaacgacctggacgaattcgaagccctggaaaggaagactaagaaggatcaggaaaacgaactgtcctctaaagtcgagctgctgagggaaaaggaagatcaaatcaaaaagctgcaagaatacatcgactcacagaaacttgagaatatcaaaatggacctgagctactccctggagagtatagaggatcctaagcagatgaaacagacgctctttgacgctgagaccgtcgcgctcgacgctaaacgagagtctgcgttcttgaggagcgaaaacctcgagctgaaagaaaaaatgaaagagctcgcaaccacttataagcagatggaaaatgacatccagctctaccaatcccaactggaggcaaaaaaaaaaatgcaggtcgatctagagaaggaactccagtctgcatttaatgaaatcacgaagctgacctctctgatcgatggcaaagtgcctaaggacctgttatgtaatctggagctggaaggaaaaatcacagatctgcaaaaggagctgaataaagaggtagaggaaaacgaggcactgcgagaggaggttatcctgctgagtgagctcaaaagccttccgtccgaggtcgagcgcctgcggaaagagattcaagacaagagtgaggaattacacattattacaagtgaaaaggataaactgttcagcgaggtcgtgcataaggaaagcagagtgcagggactgttagaagagatcggcaagacgaaagacgacctcgccaccacccagagcaattataaaagtacggatcaggaatttcagaatttcaagacgctccatatggactttgagcagaagtacaagatggtactggaagaaaatgaacggatgaatcaggagatcgttaaccttagcaaggaggcccagaagtttgacagttccctgggagctctcaagacggaactgagctataaaacccaggagcttcaagaaaagacgagagaggtccaagagaggctgaatgagatggagcagctgaaagagcagttagagaaccgtgactctacattacagaccgttgagcgcgagaagacccttattaccgaaaagctgcagcaaacattagaagaagtgaagacgttaacacaagagaaagatgatttaaaacagctgcaggaatcattgcagatcgaacgcgaccagcttaaatctgacattcatgatacagtgaacatgaatatcgacacccaggagcagcttcgcaacgccctcgagtcccttaaacagcaccaggaaacgatcaatacactgaagagcaaaatctcagaggaggtatccaggaatttgcatatggaggagaacactggtgaaactaaggatgagttccagcaaaaaatggtaggaatagataagaaacaagatctggaagctaaaaacacccagacattgacagctgatgtgaaggataacgagattatcgagcagcagaggaaaatcttctccctgattcaggaaaaaaatgaactgcaacagatgctggagagcgttattgccgagaaagagcagttgaaaactgatctaaaggagaacattgagatgaccatcgaaaaccaagaggaactgagactgctcggagacgaactcaaaaagcaacaagaaatagtggctcaagaaaaaaatcatgccatcaagaaagagggggaactttctcgcacttgcgaccggctcgcggaagtggaggagaaactcaaagagaagagccagcagctgcaggagaagcagcagcagctccttaatgttcaggaggagatgtctgagatgcagaaaaagataaacgaaattgaaaatttgaagaatgaactgaagaacaaagaactgaccttggaacatatggagacggaaagactggaactggcccagaagttaaatgagaattatgaagaggttaagtcaatcacaaaggagcgtaaggtccttaaggaactgcagaagtcttttgaaactgaacgcgaccatctgcgggggtacattcgggagatcgaggctacaggactccaaactaaggaggaactgaagatagcacatatccatctcaaggagcaccaggaaaccattgacgagttgagacgctctgtatcagaaaagaccgctcagatcataaatacgcaggacttggagaagagtcacaccaagcttcaggaggaaattcctgtacttcatgaggagcaagagttactgcccaacgtgaaggaagtctcagaaactcaagaaactatgaatgaactcgagttactgaccgagcagtctaccaccaaggattcaaccaccctcgcgcgcatcgaaatggagcgactgcggttgaacgagaaattccaggagagccaggaggaaatcaagagcctcacaaaagagcgagataatcttaaaactatcaaggaggccctggaggtcaagcacgaccagctgaaggaacacatccgcgagacgctggcgaagatccaggaaagccaatccaagcaggaacaaagcctgaatatgaaggagaaagacaatgagactacaaagattgtctcggagatggaacaatttaagcctaaggactctgcgcttctgcgcatagagattgagatgcttggccttagcaagaggctgcaggagtcccacgatgagatgaaaagtgttgccaaggagaaggacgacttacagaggttgcaggaagtgctccagtccgagtccgaccagctcaaggaaaatatcaaggagattgtcgccaaacacctggaaactgaagaggaactaaaggtcgcacactgttgcctcaaagaacaggaagaaactattaacgagctgagggtcaacttatctgagaaagagactgagatttctactattcagaagcagctggaggcaatcaatgacaagctgcaaaataagatccaggaaatttatgagaaggaggagcaattcaatatcaaacagatctcggaagttcaggagaaagttaacgaactgaaacagttcaaagagcaccggaaggctaaagactccgctctgcagagcatcgaaagtaaaatgttggaactgactaacaggctgcaggaaagccaggaggaaatccagatcatgatcaaggaaaaggaggagatgaagcgagtgcaggaggcgttacaaattgagcgcgatcaactcaaggagaacaccaaggaaatcgtggccaagatgaaggagtcccaagagaaagaataccagtttctgaagatgactgccgtgaacgaaacccaggagaagatgtgtgagatagagcatctcaaagagcaatttgagacccagaaactgaatctcgaaaacatcgagactgagaacatccgcctcacccagatcctgcacgagaaccttgaggaaatgcgctctgtcactaaggagagagacgatttaaggtcagtggaggagacactgaaagtcgaaagggaccaactgaaggagaatctcagagagacgataactagagacctcgagaaacaggaagaactcaagatcgttcacatgcatctgaaagaacaccaggagaccatcgacaagctgagaggaatcgttagcgagaagacaaatgagatctccaatatgcagaaggacctggagcattcgaacgacgcgctgaaggcacaagacctaaaaatccaggaagaactgcgaatcgctcacatgcacctgaaggaacagcaagagacaatcgataaactgagagggattgtgagcgagaaaactgacaaactgtccaacatgcaaaaagatttggaaaattcaaacgccaagctccaggaaaaaatccaagaactgaaagcaaatgagcaccagctgatcaccttaaaaaaggatgttaatgagactcagaagaaagtctctgagatggaacagctgaagaaacagatcaaggatcaaagcttgactctctccaagctagagatagaaaatctgaatcttgcacagaaactgcacgagaatctggaggagatgaaaagtgtgatgaaggagcgggacaatcttaggcgagtcgaagaaacgctgaagctcgagcgcgaccaattgaaggagtccctacaggagactaaagcccgtgatctcgaaattcagcaggagttaaagacagctcgaatgttgtctaaggagcataaggagaccgttgataagttgcgagagaaaatttccgagaaaacaatccagatttctgacatacagaaagacctcgacaaatccaaggatgagcttcaaaaaaaacaagatagacagaatcatcaggtgaaaccagagaaacggctgttgtctgacgggcagcagcacctaacagaatccttacgagaaaagtgctccagaatcaaggaactcctgaagcgatattcggaaatggatgatcattacgagtgcctgaatcgtctgtctctggatctcgagaaggaaatcgagtttcagaaggaactgagcatgagagtgaaagctaacctgtccctgccctaccttcaaacaaaacacattgagaagctattcaccgcaaatcagcgctgcagcatggagttccaccggatcatgaagaagctgaagtacgtacttagctatgtgaccaaaatcaaagaggagcagcacgagtcaatcaataaattcgagatggacttcatcgatgaggtcgagaagcagaaggaacttcttatcaagatccagcatctacagcaggattgcgatgtcccatcgagagagctgcgggatttgaaactgaaccagaacatggaccttcatatcgaagaaattctcaaagacttttcagagagtgaatttccttctatcaagacagaattccagcaagtgctctcaaacaggaaggagatgactcagtttctggaagagtggctgaacactcgatttgatatcgaaaaacttaaaaacggcattcaaaaggagaatgatcgcatctgtcaggtgaataacttcttcaataatcgcataatcgcgattatgaacgagtcgactgaatttgaagagcgtagcgcaacaataagcaaagagtgggagcaggatctcaagagcctgaaggagaagaatgagaaactgttcaaaaattaccagactctcaaaacgtccttagctagtggtgcccaagtgaaccccactacccaagataacaagaaccctcatgttacgtcaagggcgacacaactcactaccgagaagattagggaactggagaactcgctgcacgaggccaaggagtccgctatgcacaaggagagcaaaataatcaagatgcagaaggaacttgaagttacgaacgacattatcgcgaagctgcaggcaaaagtacatgaatccaacaagtgcctggagaagacaaaggagacaatacaagtgctacaggacaaggtagccctgggagcaaaaccctacaaagaggaaattgaggatctgaagatgaaactcgtgaagatcgaccttgagaagatgaagaacgccaaagaattcgagaaagaaattagtgcaactaaggctaccgtcgaatatcagaaagaagtgataaggctcctgcgtgagaacctcaggaggtcacagcaggctcaggatacctcggtgatctccgagcatacagaccctcagccttcgaacaagccactcacctgcggaggaggttccggcatcgtgcaaaacaccaaggcactgattcttaaatccgaacatatcaggctggagaaagagattagcaaactgaagcagcaaaatgagcagctcatcaagcagaagaacgagctgctgagcaacaatcaacacctttctaatgaggtgaagacatggaaggaacgcacattgaaaagagaggctcataagcaggtgacctgcgagaactcaccaaagtcacctaaggtcacaggcacggccagtaaaaagaaacagatcacaccttcccaatgtaaagaaaggaacctccaagatcccgtgccgaaagagagtccgaaaagttgttttttcgattcccggagcaagtctcttcccagtccccaccccgtcagatacttcgataatagctcactggggctctgccctgaggtgcagaatgcaggggccgagtcggtggacagccaacccggtccttggcatgcctcaagcggcaaagacgtccctgaatgcaagacacagtag

SEQ ID NO: 111625 - DNA, 7038 bp, Artificial Sequence
  Description of Artificial Sequence: Synthetic coding sequence
atggctgaggaaggagccgtggcagtttgcgtcagagtgaggcccctgaatagccgcgaggagagtctgggcgagaccgcacaggtgtactggaaaactgataataatgtgatctatcaagtggacgggagcaaaagctttaatttcgatcgggtctttcatgggaatgagaccactaaaaacgtttacgaagaaatagctgcgcccattatcgactcagccatccagggttacaacggtaccattttcgcttacggccaaaccgcatctggcaagacctataccatgatgggtagcgaggatcacctgggcgtaatcccacgcgccatccacgacatatttcagaaaatcaagaagtttcctgacagggaattcctactgagagtttcctacatggagatatacaacgaaactattaccgacctgctatgcggcacacagaaaatgaaaccactaatcatccgggaggatgtcaatagaaacgtttacgtggccgaccttaccgaggaggttgtgtacacttctgagatggccctcaaatggataacgaagggcgagaagagccgccattacggcgaaaccaaaatgaatcaaagatcctcgagaagccacacaattttcagaatgattctcgaaagccgggaaaaaggtgagcccagcaactgtgagggcagcgtgaaagtctctcatctcaacctggtagacctggctggcagcgagcgcgccgcacaaacaggggctgccggagttagacttaaagagggctgcaatatcaaccggagcttattcattctcggccaggtcataaagaagctcagcgatgggcaagtgggcggattcatcaattaccgggatagcaagctgacgcgcatcctgcaaaactccttgggtggaaatgcaaaaacacgaatcatatgcacaatcacgccagtctcattcgatgaaacgctgaccgcgctccaatttgccagcaccgcaaagtacatgaagaatacgccctacgtgaatgaagtgtcaacagacgaggccctacttaaacgttacagaaaagaaatcatggatttaaaaaagcagttagaagaggtttctctggagacccgagcccaggctatggaaaaggatcagcttgcacagctgttagaagaaaaagacctgttgcagaaggtgcagaatgagaagattgaaaatctgactagaatgctcgttaccagcagttccctgaccctgcagcaggagctaaaagcaaaacgaaaacgacgggtgacgtggtgcctgggcaaaataaacaaaatgaagaactcaaactacgctgatcagtttaatattcccaccaacataacaaccaagacccacaagctgtccatcaatctcctgagagagatcgatgagtccgtgtgctccgagtccgatgtgtttagtaacactctcgacacactctctgaaatagagtggaaccctgccacgaaactgctgaaccaggaaaacatcgagagtgagttaaactctctgagggctgattacgacaatctagttcttgattacgagcaactgcggacggagaaggaagagatggagctcaagcttaaagagaaaaatgacttggacgagtttgaagctctggaacggaagacaaaaaaggaccaagagatgcagctgatacatgagatcagtaaccttaagaatctggtcaagcacgccgaggtttataatcaggatcttgagaacgaattgtcatcaaaagtggaactgctgagggaaaaagaagatcagattaaaaagctgcaggaatacattgattcccagaaactggaaaacattaaaatggatctgagttattctcttgagagtatcgaagacccaaagcagatgaagcagacactctttgacgccgaaacagttgctctggacgctaagagagagagcgccttcctgcggagtgagaatcttgagctgaaagagaagatgaaagagctggctaccacttacaagcagatggagaatgatatacagctgtaccaatcccagttggaggccaagaaaaaaatgcaggtggacctcgaaaaagagctccagtccgccttcaatgagattaccaaactcacttccctcatagatggcaaagtgcccaaggatctcctgtgtaatctggaactggagggcaagatcaccgatctgcagaaagaactgaacaaagaagtcgaggagaacgaagcacttcgggaggaagtgatcctcttatcagagcttaagtccctcccctccgaggtggagcggctcagaaaggagattcaggataagtctgaagaactgcatatcattacatctgaaaaagacaagcttttctcagaggtggtacacaaggagtctcgggttcagggactgctggaagaaattggaaagaccaaggatgatctggcgaccacacagtccaattataaatctactgaccaagaattccagaattttaagaccctccacatggacttcgagcagaaatataagatggttctggaagagaacgagcggatgaaccaggagatcgttaacctgtccaaagaagcacaaaagttcgattcctccctgggcgcccttaaaactgaactaagctacaaaactcaggaactgcaggagaagactcgagaggtccaagaacggctgaacgaaatggaacagctgaaagaacagctcgaaaatagagactccaccctgcagaccgttgagagagaaaaaactctcattactgaaaaattacagcagacattggaggaagttaaaacattgactcaggaaaaggacgatctgaaacaattacaggagagtctgcagattgagcgggaccaactcaagtctgatatacacgacactgtgaacatgaatattgacacccaggaacagctgaggaacgctctagagtccttgaagcagcatcaggagaccatcaacacattgaagagtaagatcagcgaggaggttagccggaacttgcacatggaggaaaacacaggcgaaacaaaagacgagttccagcagaaaatggtcggtattgacaagaagcaggatttagaggccaagaatacacaaactttaactgcagatgtcaaggacaatgagatcattgaacaacaaagaaaaatatttagcctgatacaggagaaaaacgaactacagcagatgctcgagtctgtgattgccgaaaaagaacaattgaagacagatttaaaggagaacatagaaatgaccatcgagaatcaggaggagctgcggctcctgggggacgagttgaagaaacaacaggagatagtcgctcaggaaaaaaaccatgccatcaaaaaagagggggaactgagtagaacgtgcgaccggctggccgaagtggaagagaaactaaaagaaaagtcacagcaattgcaggagaagcagcagcagcttttaaacgttcaggaggaaatgtctgagatgcagaagaagataaatgagatagagaaccttaagaatgaattaaaaaataaagagcttacactggagcacatggaaaccgaaaggcttgagcttgcccaaaaactgaatgaaaactatgaggaagtgaagagcattaccaaagagcggaaggtgctgaaagaactgcaaaagagcttcgaaacggaacgtgaccatctcaggggatacattcgggagatagaagccacaggacttcaaaccaaagaggaattgaaaattgcacatatacacctcaaggaacaccaggagactatagatgagctaaggcgaagcgtatctgagaaaacggcccagatcatcaatacacaggatctggagaaatcccataccaagctgcaggaggaaattcccgtgttgcatgaggagcaggaactgcttcctaatgtcaaagaggtttcagagacccaagagacaatgaacgaattggagctcctgacagagcaatccacgaccaaggattctacaactctagctcgcattgagatggagcggctgaggttaaacgaaaagttccaagagagccaggaggaaatcaaatctttaacaaaagagcgcgacaacctaaaaactattaaagaggccctcgaggtaaaacacgatcagctgaaagaacatatcagagaaaccttagcaaagatacaggagtcgcagagtaagcaggaacaatctctcaacatgaaagaaaaagataatgagactaccaagatagttagcgaaatggagcaatttaaacccaaagatagtgcgttactcaggattgagatagagatgctaggtctcagcaaacggttgcaggagtctcacgacgagatgaaatcggtggccaaggaaaaagacgatctgcaacgcttacaggaggtccttcaaagcgaatccgaccagttaaaagagaacatcaaggaaattgtcgctaagcacctggagaccgaggaggagctcaaggtggctcactgctgtctcaaagaacaggaggaaactattaatgaattgagggtcaatcttagtgaaaaggagacagaaattagtacaattcagaaacagttggaagcgatcaatgataagctccagaacaagattcaggagatctacgaaaaggaagagcaatttaacatcaagcagattagcgaagtgcaggaaaaggtgaatgaactgaaacagttcaaagagcatcgaaaggcaaaggatagcgccttgcagtcgatcgagagcaagatgctggaactaacgaaccgcttgcaggagtctcaagaggaaattcagattatgattaaagagaaagaggagatgaagcgcgttcaggaggctttacaaattgagagggatcagctaaaggaaaacacaaaagagatcgtcgccaagatgaaggaatctcaagaaaaagagtatcaatttttaaagatgacggccgtgaacgaaacccaggagaaaatgtgcgagattgaacatctgaaagagcagttcgaaacacagaagctgaacctcgagaacatagagactgagaacattaggctcacacagattctgcacgagaatctcgaggagatgcgatccgtaacgaaggaacgagacgaccttagatccgtcgaggagaccctcaaagtagaaagggaccagttaaaagagaatctacgagagacaataactcgggacttagagaaacaggaagagctgaaaatcgtccacatgcacctaaaggagcatcaggagacaatcgataagttaaggggtatcgtttcagaaaagacaaatgagattagcaacatgcagaaggatctagaacactctaatgatgccctgaaagcgcaggatctgaaaatacaagaggaactgaggatcgcccacatgcatctcaaggagcagcaggagaccatagacaaactccggggaatcgtctccgagaaaaccgataaactgtctaacatgcagaaagacttggagaatagtaatgccaagttgcaggaaaaaatacaggaattgaaggcaaacgagcatcagttgatcactctgaagaaagacgtgaacgaaactcagaagaaagtgtccgagatggagcagttgaaaaagcaaataaaggatcagagcctgaccctgagcaaacttgaaattgaaaacctcaatctagcgcagaagctccacgaaaatctggaagagatgaagagcgtaatgaaagagagggataatttacgcagagtggaggaaacactgaagcttgaacgcgatcaactcaaagaatccctacaggagacaaaggccagggatttagaaatacagcaagaactcaagaccgctagaatgctcagtaaagagcacaaggagaccgtggacaaattgagagagaagatcagtgagaagacaattcagatcagcgatatccagaaggacctggataagagcaaagatgagctgcaaaagaaaatccaagagctccaaaaaaaagagttgcaattgttaagggtcaaggaagacgtgaacatgtcccacaagaaaattaacgaaatggagcagctgaagaagcagttcgaagcacaaaatcttagcatgcagagcgtgcgaatggataattttcagcttactaaaaagctccacgagtcactcgaggaaatcagaatcgtggcaaaggagagagacgaattgcgccggatcaaagaaagcctgaagatggagagggaccagtttattgcgactctccgagagatgatcgcacgggatagacagaatcaccaggtcaaaccggagaaacgcttgcttagcgacggtcaacagcatctgacagagtccctgcgggagaaatgtagtcgcattaaggaattattgaaacggtactccgaaatggatgatcactacgaatgcctgaaccggctgagcctggatctagagaaggaaatagagtttcacaggatcatgaaaaaactgaagtatgtgctttcctacgtaacaaagatcaaggaggaacagcacgagagcattaacaaatttgagatggacttcatagacgaggtcgagaaacaaaaggagctcttgatcaaaattcagcacctgcagcaggactgtgacgtgccttcaagagagcttcgggacctgaagctgaatcagaacatggatttacatatagaagaaatactgaaggacttcagtgagagcgaattccctagcatcaagacagagttccagcaagtgctgtctaaccgcaaggagatgacccagttcctggaagaatggctcaatacgagatttgatatagaaaaattaaaaaacgggattcagaaagagaacgatcgaatctgccaagttaacaacttttttaacaaccgtatcattgccattatgaatgagtctacagaatttgaggagcgctccgcaacgatcagcaaggagtgggagcaggaccttaagtccctgaaggaaaagaacgaaaaactgtttaagaactatcagacattgaagacctccctcgccagtggggctcaggtgaaccctaccacacaggataacaagaaccctcacgtgacatcgagagctacccaattaactacagagtag

SEQ ID NO: 111626 - DNA, 9345 bp, Artificial Sequence
  Description of Artificial Sequence: Synthetic coding sequence
atgagttgggccctagaggagtggaaggaaggtctccccacacgagccctccaaaaaatccaggagctcgagggacagctcgacaaactcaagaaagagaaacagcaaagacagttccagttagacagtctagaagccgcgttgcagaagcagaagcagaaagtcgagaacgagaagactgaaggcaccaacctgaagcgtgagaatcagcggctcatggaaatctgtgaaagtcttgagaagacaaagcaaaaaattagccacgaacttcaggtaaaggaatcgcaggttaactttcaggagggacagctgaactcaggtaagaaacagatcgaaaagctcgaacaggagctcaaaagatgtaaaagtgagcttgaacggagtcagcaagccgcgcagtctgccgatgtttcattaaatccctgcaataccccgcagaaaatcttcactacgcccttaactccttcacagtattattcgggttctaagtacgaggatctgaaggagaaatataataaggaagtggaagagcgcaagcgcttagaggctgaggtgaaagcactgcaagcaaaaaaagctagccagaccctgccccaggccacaatgaaccatcgcgatattgcccgccaccaggcctctagttccgtgttctcctggcagcaggaaaaaactccctcacacttatccagcaacagccagagaactccaataaggagggatttctccgccagttacttcagcggggagcaggaagtcacaccttcaaggtctactctgcagataggaaaacgagacgcaaacagctcattttttgataacagctcctcaccacacttattagaccagctcaaagctcagaaccaagaactgaggaacaagatcaatgagttggagctgagacttcagggccatgagaaggaaatgaaggggcaggtaaataaattccaagaattgcagctgcaactcgaaaaggctaaggtagagcttatcgagaaggagaaagtgctcaataagtgcagagatgagctcgtccggaccacagcacagtatgaccaggcaagcactaaatatacagccctcgagcagaaattgaagaaattgacggaggatctgagctgtcagagacagaatgctgagtctgctcgatgtagtctggaacagaagattaaggaaaaagaaaaggaattccaggaggaattgtcccgccaacagaggtcttttcaaactctcgatcaggaatgtatacaaatgaaggccagacttactcaggagctgcagcaggctaagaatatgcataatgtgctgcaggcagaattggacaaactgaccagtgtgaagcagcagttagagaacaatttggaagagtttaagcagaagctgtgccgggccgagcaggccttccaggccagtcaaattaaagagaatgagttacggcgatcaatggaggagatgaaaaaggaaaataatctgctcaaaagccattccgagcagaaagcacgggaggtgtgtcacctcgaggccgaactgaagaacatcaaacagtgcctgaaccagtcccaaaacttcgccgaagaaatgaaggccaagaacacctcccaagaaacgatgctgagggatctgcaggaaaagattaaccagcaggaaaattcccttactctggagaagctgaagctagccgtcgcggacctggaaaagcagcgtgactgtagtcaggacctcttaaagaaacgtgaacaccatatcgagcagctcaacgacaagctaagcaagaccgagaaagagagtaaggccctcctcagcgctctggagctcaagaagaaggagtacgaggagttgaaggaagaaaagacacttttttcatgctggaaatcagaaaacgagaagttgctgacacagatggagagtgagaaagagaatctgcagagcaagatcaaccacttggagacttgcttaaagacacagcagatcaaatctcacgaatacaacgagcgcgtgagaaccttagaaatggatcgcgaaaatctgagcgtagagatacgaaaccttcataatgtcttggatagcaaatcagtcgaggtggaaacccagaagctggcctacatggaattgcagcagaaagccgagttttcagaccagaagcatcagaaagaaattgaaaatatgtgcttaaagacgagccagctgaccggccaggtcgaagacttagagcacaaactgcagctcttgagtaatgaaatcatggacaaagatcggtgctaccaggacctccatgccgagtatgaaagcttaagagaccttctgaagtcgaaggacgccagcttagtaacaaacgaagatcaccagcgatccctgctggccttcgaccaacagcccgcaatgcatcatagcttcgctaacatcatcggcgagcaaggatcgatgccctccgaaaggagcgagtgccgtctggaagcggaccagtcccctaagaactccgccattttgcaaaatagagtggatagtttggagttctccttggaaagtcagaagcagatgaacagcgacctgcagaaacaatgcgaggaactcgtgcaaataaaaggagagatagaggaaaacctcatgaaggccgagcagatgcatcagtcttttgtcgcggagacctcacagagaatttccaaactccaggaggatacctcggcacaccagaatgttgtggcagagacactgtcggcattagaaaataaagaaaaagagctgcagctgcttaatgataaggtagaaactgagcaggccgagattcaggaactgaaaaagagcaatcacctgctcgaagactctctgaaagagcttcagttgctgtccgagacactctccctggagaaaaaagaaatgtcatcaatcatcagcctcaataaacgggaaatagaggaactgacccaagagaatggaacactgaaggagattaatgcctctctcaaccaagagaagatgaaccttatccagaaaagcgagtcattcgcaaactatatagatgagagggagaagtctatcagtgagctctctgaccagtataagcaagagaaactgatcttactgcagaggtgcgaggagacagggaatgcatacgaagatctcagtcagaagtataaggcagcacaggagaaaaatagcaagcttgaatgtctgctgaatgagtgtacctctctttgtgaaaatcgcaaaaacgagttggagcagttaaaggaggctttcgccaaagagcaccaggaattcctgaccaagctcgcatttgccgaagagcgcaaccagaaccttatgctcgagctcgagactgtacagcaggccctacgctccgaaatgaccgacaatcaaaataactccaaatctgaggccggcggacttaaacaggagattatgaccctaaaggaagagcagaataaaatgcaaaaggaggtgaatgatttgttgcaggagaatgaacagctaatgaaagttatgaagaccaaacacgagtgtcagaacctggagtccgagccaatccggaactccgttaaggagagggaatccgagaggaatcagtgtaacttcaaaccccaaatggatctagaagtgaaggaaatttctctggatagctacaatgcgcagctcgttcagcttgaggccatgctaagaaataaagagctgaagctacaggagagcgagaaagagaaggaatgtctgcaacacgaactgcagaccatccgaggggacctggagacttcaaatttacaggatatgcaatcgcaggagatctctggtttgaaggattgcgagatcgatgcagaggagaaatatatttcgggaccccacgagctatctacaagccagaatgacaacgcccatttgcagtgctcccttcagaccaccatgaacaagctgaacgagttagaaaagatatgtgagattctgcaggctgagaagtatgaactcgtgacggaactaaacgattccaggtctgagtgtattactgccactcggaaaatggccgaggaggtaggcaaactgttgaacgaggtcaaaatcctcaacgacgactcaggtcttttgcatggagaactggtagaggatatcccagggggtgaattcggggaacaaccaaatgaacagcatccagtcagtctggctcctctggatgagtccaattcatatgagcacctgaccctaagtgataaggaggtccaaatgcacttcgctgaactccaggagaaattcttgtctctgcagagcgaacacaagatattacatgaccagcactgccagatgagcagtaagatgtcagaattgcaaacctacgtggattcactcaaggctgagaacctggtgctttccaccaatctgaggaatttccagggagacttagttaaagaaatgcagctcggcctggaggagggattggtgccttctctatcaagctcttgtgttcctgacagcagctctctctccagtctcggggacagttccttctaccgggccctattggagcagaccggcgatatgtcactgctctctaatcttgagggtgctgtgtctgccaaccagtgttctgtggacgaagttttctgctcctctctgcaggaggagaatctgactaggaaagaaacaccaagtgctcccgctaaaggagttgaggagcttgagtctctgtgcgaggtttatcggcaaagcctagagaagctagaagaaaaaatggagtcacaaggtataatgaaaaataaagaaattcaggagcttgagcagcttttgtcgagtgaaagacaggagctggactgcctgcgaaaacaatacctgtcggagaatgaacaatggcagcagaagctgacctctgtgacgctagaaatggagtccaagctcgctgccgagaagaaacaaaccgagcagctgtcgctcgaactcgaagtcgccaggttacaactccaggggctagacctcagcagcaggagtctcctcggtattgacactgaggatgccatccaaggacgcaatgaaagttgtgatattagcaaggaacatactagcgagactaccgagcgaaccccaaagcatgacgtccatcaaatctgcgacaaagacgcacaacaagacctcaacctcgacatcgaaaaaattacggaaactggcgcagtgaaaccaacaggcgagtgttccggggagcagtcccccgacacaaactacgaaccaccaggggaggataaaacgcagggttccagcgagtgtatctctgagctctcattctcaggccctaatgcccttgtgcccatggacttcctgggtaaccaggaggatatacacaatctgcaactacgtgtgaaggaaacctcaaatgagaatctcagactgctgcacgtgattgaggaccgggataggaaagttgagtccctgctgaacgagatgaaggaactggactcaaagctgcacctgcaagaagtgcagttaatgacaaagattgaggcttgtatcgaacttgaaaaaatagttggcgaactgaaaaaagaaaattcagatttgagcgaaaagctggagtacttctcttgtgaccaccaggaacttctgcagagggtcgaaacttctgagggtcttaattccgacctcgaaatgcacgctgacaagtctagccgggaagacattggggacaacgtggcgaaagtcaacgacagctggaaagagcggttcctggacgtcgagaacgagttaagccggatcagatcagagaaagccagcatcgagcatgaagctctgtacctggaagctgacctcgaggtcgtgcagacagagaagttgtgcctggagaaggataatgagaacaagcagaaagttatcgtctgtctcgaagaagagctcagcgttgtgacttcagagaggaaccaactgagaggggaactggatacgatgtcgaaaaagacaaccgccctggatcagttgtcagaaaaaatgaaggagaagacccaggaactcgaaagccatcagtctgaatgcttgcactgtatccaggtagctgaagccgaggtgaaagagaagaccgaattgctgcagaccctgtcttccgatgtgtccgagctcctaaaggacaagacccacctgcaggagaagctccaatccttagaaaaggattcacaggcactgagcctgaccaaatgcgagttggagaatcagattgctcaactgaacaaggagaaggagctgcttgtcaaagagtccgagagtttacaggctaggttaagtgaaagcgactacgaaaaacttaatgtcagcaaggccttggaggcagctctcgtggaaaaaggagagtttgctctgcgtctttcgtcaactcaggaggaggtgcaccaactcaggagggggattgagaagcttagagtacgcatagaggccgacgagaagaagcaattacatatcgctgagaagctgaaggagcgggagagggaaaatgattctcttaaagacaaggtcgaaaacctcgaacgggaactgcagatgtcagaggagaatcaggagttggtgatcctggacgcagagaactccaaagctgaggtagagaccctgaaaactcaaatcgaagaaatggcccgctccttaaaggtcttcgagcttgacctggtgaccctgcgtagtgagaaagaaaacctgaccaagcagatacaggagaaacagggtcagctgagcgaactggacaagctcctgagctcattcaagtccctcttggaagaaaaagagcaggcggaaattcagattaaagaggaaagcaaaaccgcagttgagatgttgcagaaccaactaaaggagctcaatgaagctgtggctgcgctctgcggcgaccaggagattatgaaagccacagagcagagtctcgaccccccaattgaggaggaacaccaattaaggaactcaattgagaaactgagagctcgtctggaggccgatgaaaaaaagcagctgtgcgtgctacaacagctgaaagaaagcgagcatcacgcagacttgcttaagggcagggtggaaaatctcgagcgcgaactcgaaatcgcgcggactaaccaggagcatgctgccctcgaagctgagaattcaaagggagaggtggagacgctcaaggccaagatagagggaatgactcagtcattgcggggactggagctggatgtcgtgactatccggagcgagaaggaaaacttgaccaacgagttgcaaaaggaacaggaacggatctccgagcttgagatcattaactcatcctttgaaaatattctccaggagaaggaacaggagaaggttcagatgaaagagaaaagctcaaccgccatggagatgctccagacacagctgaaagaactgaacgaaagagtggcggcactgcacaacgaccaggaggcctgtaaagccaaagaacaaaatctgagtagtcaggttgagtgcctggaattggaaaaggctcaacttctgcagggactcgatgaagccaaaaataactacattgttctgcaatcgagtgtaaacggattgatccaggaggtagaggatggaaaacagaaactcgaaaaaaaagatgaagaaatatcacgtctgaaaaatcaaatccaggatcaggagcagctggtgagtaagttgtctcaagtcgagggtgagcaccaattgtggaaagaacaaaacctggagctgcgaaatctgacggtggagcttgaacagaaaatccaggtgttgcagtcgaagaacgctagccttcaggacaccctggaggtccttcagagctcatataagaacttagagaacgaacttgaactgaccaaaatggacaagatgtcctttgtcgagaaagtcaacaagatgaccgctaaagaaactgagctccagcgcgaaatgcacgaaatggctcagaaaactgcggagctccaggaagagctgtccggggaaaaaaatcgactggcaggggagctccagctcctattggaagagataaaatcctctaaggaccagctgaaggagctgactctagaaaattcagagctcaagaaatctctagactgtatgcacaaagaccaggtggaaaaagaggggaaggtgcgagaggaaatcgccgagtatcagttgaggctacatgaggcagaaaaaaaacatcaggctctcctcctcgacactaacaaacaatacgaggttgaaatacagacttaccgcgagaagctgacttcaaaggaagagtgcttaagtagtcagaagctggaaatcgatctgcttaaaagtagcaaggaggagctcaacaactctctaaaagcaaccactcaaattctggaggagctgaaaaaaacaaaaatggacaatttaaagtatgtcaatcagctgaaaaaagagaatgaacgggcgcaggggaaaatgaaattgctcattaaatcttgcaaacagctagaggaggaaaaagaaatcctgcagaaggaacttagccaactgcaggcagctcaggagaagcagaagacaggtactgtaatggatactaaggtcgacgagctcacaacagagatcaaggagctgaaagagacccttgaggaaaagacaaaggaggccgacgagtacctcgataagtactgcagcctgctgatcagtcacgaaaagctggagaaagcaaaggagatgctcgaaacccaggtggctcatctgtgttctcaacaatccaagcaggactccaggggctctccacttctgggtcccgttgttcctggccctagcccaattccatctgtcactgaaaagcgactctcctctggccagaataaggcctctggaaaaagacagagaagtagtggtatctgggaaaacgggcgcggaccaacccccgcaacaccagagtctttttccaagaaaagtaaaaaggctgtgatgagcggaatccaccctgccgaggacaccgagggcaccgagtttgaacccgagggtcttcccgaggtcgttaaaaagggcttcgctgatatccccacgggtaagacgagtccttacatcctgagacgaactactatggctacccgcacaagtccccgcctcgcggcccaaaaattagctctgtcccccttgagcttagggaaagagaatttggcagagtcgtctaaaccaaccgccggggggagccgtagccagaaggttaaggtcgcccagcggtctcctgttgactccggcactattcttcgcgaacctactacaaagagcgtcccggtcaataatctgcctgagaggagccctaccgacagcccacgggaagggctcagggtcaagagagggcggctggtacccagccctaaggcaggcttagaatcgaatgggtcagagaattgtaaggtacagtag

SEQ ID NO: 111627 - DNA, 528 bp, Artificial Sequence
  Description of Artificial Sequence: Synthetic coding sequence
ctgatgatcaagggtcgcaagggaaaagtaaacaagatgacggccaaagagactgagctccagcgtgagatgcacgagatggcccaaaaaacagccgagttgcaggaggaattaagtggagaaaaaaatagactggccggagaactgcagctgctcctggaggagatcaagtcctctaaggatcagttgaaggaactcaccttagagaacagcgaacttaaaaagtccctcgactgcatgcacaaggaccaggtcgaaaaagagggcaaggtgcgagaagagatcgcggagtaccagctgagactgcatgaagcagaaaagaaacatcaggcactgctgctagacacgaacaagcaatacgaggtggaaatccaaacatatcgggagaagttgacatctaaggaggagtgcttaagcagtcagaaactggaaatcgacctccttaagtctagcaaagaggaactgaataactcactgaaggcaaccactcagatcctcgaagaactgaagaagacaaaggaaaattag

SEQ ID NO: 111628 - DNA, 4017 bp, Artificial Sequence
  Description of Artificial Sequence: Synthetic coding sequence
atgtttcttatgcctacaagctctgagctgaacagcggccagaacttcttgacgcagtggatgacaaatccctcacgcgccggggttatactgaatcgcgggttccccattttggaggctgacaaagagaagagggctgcagtcgacatctctacatcattccctattaagggaacgcacttttccgattccttcagctttatcaacgaggaagatagtctcctggaggagcagaaattggaatcaaataacccttataagccccagtccgataagagtgagacgcatacagcatttccatgtatcaagaaaggaccacaagtcgcagcttgccatagcgcccctggccaccaggaagagaacaagaacgatttcatcccagatctggctagcgaatttaaagaaggagcttataaagatccactctttaagaaactggaacaactcaaggaagtacagcagaaaaagcaggaacagctgaaaagacagcaactggagcaacttcagcgtcttatggaagagcaagaaaagttgttaaccatggtctcgggacagtgcaccctccctggcctcagcctgctgcccgacgaccaatctcaaaagcatcgtagtcctggcaacactacgactggagagagggctacctgctgctttccgagctatgtttatcccgacccaactcaggaggagacttacccgtcaaacatcctctctcatgagcagtccaatttctgccgtaccgcccacggcgactttgtgctgacgtccaaacgcgcctcaccaaatctgttctccgaagcccagtaccaggaagccccagtcgaaaagaacaaccttaaggaagagaatcggaatcaccctaccggggaaagtatactgtgttgggagaaggtcaccgaacagatacaggaagctaatgataaaaatctccaaaagcatgatgactcctccgaggtggctaacattgaagagcgcccaattaaggcagccatcggtgagcggaaacagacctttgaggattacctggaggaacagatccagcttgaggagcaagagttgaaacaaaagcagctcaaagaggccgagggaccactgccgattaaggccaagccaaaacagccatttttaaagagaggagagggcctggctcggttcaccaacgcgaaaagtaaattccaaaagggaaaggagtcaaagctcgtcaccaaccaaagcacatcagaagatcagcctcttttcaagatggaccgtcagcagctccagaggaagaccgccttgaagaacaaggaactgtgcgctgacaatcctatcctgaaaaaagacagcaaagcacgcactaaatctggctcagtgaccctatcccagaagcccaaaatgctgaaatgcagcaatcgcaaaagcctgagcccgagtggcctcaaaattcaaacaggcaaaaaatgcgatggccagttcagggatcagataaagtttgaaaacaaggtgaccagtaataacaaggaaaatgtaaccgaatgtcccaagccgtgcgacacagggtgtaccggctggaataagactcaaggaaaggaccggttacctctttctacgggtccagcaagccgccttgctgccaagagtcccattcgcgagactatgaaggagagtgagtcctccctcgatgtgagcctgcagaaaaaactggagacttgggagagagagaaggaaaaggagaatctggaactggatgagtttctttttttggaacaagccgccgatgaaatttcattttcttctaactcatccttcgtgctgaaaattcttgaaagagatcagcagatctgtaagggacaccgcatgtcaagcactcccgtgaaggctgtccctcagaaaaccaacccagcagatccaatcagccactgtaatcgatccgaggacctggatcataccgccagagagaaagagagcgagtgtgaagtcgctccaaagcagctgcattcactgagctccgccgatgagctgcgtgagcaaccttgcaaaattcgtaaagccgtccagaagtctacatcagaaaaccagacagagtggaacgctcgcgacgacgagggcgttcccaattccgacagttctactgattccgaggaacagcttgacgtgactatcaagcctagcactgaggacagggaacgtgggataagctcgcgggaggactctccacaggtgtgtgacgacaaaggaccttttaaggacacccgcacccaggaggataaaaggcgggatgtggacttggatctgagtgacaaagactacagctctgacgaaagcattatggagagcattaaacataaagttagcgagccaagcagatcttcttcattatccctgtcgaagatggatttcgacgacgagcgcacttggacagatctcgaggaaaatctgtgcaaccacgacgtggtgctcggaaacgagagtacatatggcacaccccagacgtgttaccccaataacgaaataggcattctggataagactatcaaacgcaagatagcccccgtgaaaagaggggaggatctgtcaaaatctcggcggtctagaagtccacccaccagtgagctcatgatgaaattctttccttccctgaagccaaagccaaaatccgatagccacctggggaacgagttgaagttgaacatctcgcaggatcaaccccccggggataatgctaggagccaggttttacgcgagaagattattgagcttgagacagaaatcgagaaatttaaggctgagaacgcatccctggctaagctgaggatcgagcgggaatctgccctcgaaaaactcagaaaggaaatcgcagatttcgaacagcagaaggcaaaggaactggccaggattgaagaattcaagaaagaggaaatgaggaaactgcagaaagagagaaaagttttcgaaaaatacactacagctgctagaacgtttccagataagaaggaacgggaagaaatacagacgctcaaacagcaaattgctgatttgcgcgaggacctcaaacgcaaagagactaagtggtcctcgactcatagccgactcaggtcccagatacagatgttagtcagggagaacactgatttaagggaggagataaaggtaatggagcgattcagattggatgcatggaaacgagccgaggcgattgaaagcagcctagaagtggagaagaaagacaaactcgccaatacctccgtccgctttcaaaactcgcaaataagtagcggaacccaggtggaaaagtacaagaagaattacctgcccatgcaaggcaatccgcctaggagaagcaaatccgctccacctcgagacttgggtaacctcgataagggccaagccgcctcaccacgcgaacctcttgagccacttaattttccagatcccgaatacaaagaggaagaagaggatcaggacattcagggcgagatatcacatcccgacggaaaggtggaaaaagtgtataagaatggctgtagagtgattctgtttcccaacggcacgcgcaaagaggtgagtgcagatggcaaaacgattaccgtgaccttttttaacggggacgtgaagcaggtgatgcccgatcaacgggtaatatattattacgcggcagctcagacaacgcataccacttatcctgagggcctggaagtcctgcatttctcttcgggccagatcgagaaacactaccctgacggaagaaaggagattacatttcctgaccagacagtgaagaatctgtttccagacggacaagaagagtccatttttccagatggaactatcgtgagagtccagagggatggaaacaagctgatcgaattcaataacggtcagagggaattgcataccgcgcagttcaagaggcgagagtaccccgatggcactgttaagactgtttacgctaacggccaccaggagaccaaatacaggagcggacggataagagtaaaagacaaggaaggcaatgtgttgatggacacagagctgtag

SEQ ID NO: 111629 - DNA, 3411 bp, Artificial Sequence
  Description of Artificial Sequence: Synthetic coding sequence
atgtttctgatgccaacctcttccgagttgaattccggccagaacttcctgactcagtggatgactaatccatctagggcaggcgtgatcctaaaccgggggttccctattcttgaagccgataaagagaaacgggcagcggtggacatatcgacgtcattcccaattaagggcactcacttttctgactccttttcatttatcaacgaagaagatagcttactggaggagcagaagttggaaagcaataacccttacaagccccagagtgacaaatctgagacccacaccgccttcccctgcattaagaagggcccacaggtggctgcatgtcatagtgccccagggcatcaggaagaaaataaaaacgatttcattccagatctcgcctcagagtttaaggaaggggcctataaagatcccctgtttaagaagctcgaacagctgaaggaagttcagcaaaagaagcaagaacaactgaaaagacagcaattagagcagttgcaacggctcatggaggaacaggaaaaactccttactatggtgtctggtcagtgcacgcttccaggattgagccttttacctgacgaccagagtcaaaagcaccgatcccctggcaacaccaccaccggagagcgggcaacatgctgctttccctcctacgtttatcccgaccccactcaagaagaaacctacccttccaacatcctctcccacgagcagtccaacttttgccgcactgcccatggggactttgtgctgacgagcaagcgcgcctcacctaacctcttttctgaagcccaataccaggaagcaccggtcgaaaagaacaatctaaaggaggagaaccgaaaccacccgactggcgagagcatcctttgctgggagaaggtgaccgaacaaatccaggaagctaacgacaagaacctgcagaaacacgacgatagctcagaagtggccaacatcgaagaacgccctatcaaggcagccattggagaacgtaaacagacctttgaggactatctcgaggagcagatccaactggaagagcaagaactcaaacaaaagcagcttaaggaggctgaggggccgctgccaatcaaggctaaacctaaacaaccctttctgaagaggggggaaggccttgcacgctttaccaatgccaaatcaaaatttcaaaaaggtaaggagagcaagctggtcaccaatcaatccacaagcgaagaccagcctctcttcaagatggatcgacagcagctgcagagaaagacagccctgaagaataaggagctctgcgcggacaatcccatactgaaaaaagactctaaggcccgtaccaagtctggttccgtcacactgtctcagaaacctaagatgttgaagtgtagtaacagaaagtccttgtcgccttccggactcaaaatacaaacagggaagaaatgtgacggtcaatttcgcgaccaaattaagttcgaaaacaaagtcacttctaacaacaaggagaacgtaacggagtgccctaaaccatgtgatactggttgtactgggtggaataaaactcaggggaaggatcggctccctctgagcacgggccctgctagccgactggctgctaaaagtcccattcgggagaccatgaaagaatctgagtcctccctcgatgtctccctgcagaaaaagttagagacttgggagcgagagaaggaaaaggaaaacctagaactcgatgaattcctattccttgagcaggccgcggacgaaataagcttttccagcaatagcagctttgtgctgaagatcctagaaagagaccaacagatatgtaagggccaccgaatgtccagtacgccagttaaggcagtgcctcaaaaaacaaaccccgctgatcccatctcccattgcaataggagcgaggatttggatcatactgctagagaaaaggagtctgaatgtgaagttgctcccaaacaactgcatagcttgtccagcgcagatgagctgcgggaacagccttgtaagataaggaaggccgtgcagaaaagcacctcagaaaatcagacggaatggaatgcgagagatgatgaaggagtccctaactctgatagtagtactgattctgaggaacaactggacgtcactatcaagccatctaccgaggaccgtgagcggggtatctctagccgggaagactctcctcaagtctgtgacgataaaggcccctttaaagacacccgcactcaggaggataaacgtcgcgatgtggacctggacctgtcagataaagactattcctccgatgaatccatcatggagtccatcaaacataaggtgtctgaaccatctcggtccagctccctctcgttaagtaaaatggacttcgacgacgaaaggacatggaccgatctggaagagaacctttgcaaccacgacgtggtgctgggaaatgagtcaacttacggtacgccccagacctgttatccaaacaacgaaattggtatactagacaagacaatcaagagaaaaatcgcgcccgtcaagcggggtgaagatctgagcaaatccaggcggagcaggtcaccgcccacctccgaacttatgatgaaattttttccctcacttaaacctaaaccaaaaagcgattctcacttggggaatgagctgaagcttaatatttctcaggaccaaccaccgggcgataacgctcggtctcaggttctgagggagaaaataatcgaactcgagacagagatagaaaagtttaaagctgagaacgcttctctggccaaactcagaatcgagagggaaagtgctttggagaaactgcggaaggaaatcgcagactttgagcagcagaaggcaaaagaactggcccgcatcgaagagtttaagaaggaggagatgcgaaagctgcaaaaagagcgcaaggtgttcgaaaagtataccactgcggcacggaccttccctgacaagaaagagcgagaagaaatccagacgctgaaacagcagattgccgaccttcgtgaggacttgaagcgaaaggaaaccaagtggtcctcaactcactctcgcctgcggagccagattcagatgctggtcagggaaaacacagacctccgggaagagatcaaggttatggaacgatttcggctggacgcctggaaacgagccgaggcgattgagtcttccctggaagtcgagaagaaggacaaattagcaaatacgtctgttcgttttcagaattcacagatcagcagcgggacacaggtggagaaatacaagaaaaactatctacccatgcagggcaccgcccagcctccccacactccatcgtctctgctagccgaccacctgcctcccctgtcttcattccgaccatttagccgaaatatacagctctgttataccttttag

SEQ ID NO: 111630 - DNA, 3261 bp, Artificial Sequence
  Description of Artificial Sequence: Synthetic coding sequence
atgtttttaatgcctactagtagtgagcttaacagcggccaaaacttcctgacccagtggatgacgaacccgtctcgtgctggcgttatcctcaacaggggttttcctatcctcgaggccgataaagagaaacgcgcggctgtggacatcagtacaagctttcccatcaaaggaacccatttcagcgattccttcagcttcatcaacgaggaagactcattactggaagaacagaaacttgaatctaacaacccctataaaccacagagcgacaagagtgagacccataccgccttcccatgtataaaaaaggggccccaagtggcggcctgccacagcgctccaggacaccaggaggagaataagaacgactttattcccgatctggcctcggagttcaaggagggagcatacaaagatcctcttttcaaaaaactggagcagctgaaagaggtgcagcagaagaaacaggaacagctgaagcgccagcagctggagcagctgcagagattgatggaggaacaggaaaaactgctcaccatggtgtctgggcagtgcactttacctggcttgtcgctcctgcccgacgatcagagccaaaagcataggagcccaggtaacaccactacaggtgagcgagcgacatgctgttttccctcatacgtatacccagaccctacacaggaagaaacatatccatccaacatcctgtctcacgagcaaagcaatttctgtaggactgcccacggagattttgtactcacatctaagagagccagtcccaaccttttctccgaggctcagtatcaagaagccccagtcgagaagaacaatttgaaagaagagaatcggaatcacccgacgggtgaatccatactgtgctgggaaaaagtgaccgaacagattcaagaagccaatgacaaaaatctgcagaaacatgacgattcttcagaggtcgcaaatatcgaggaacgacctatcaaggcggccatcggggaacggaagcaaacatttgaagactatctcgaggaacaaatccagttggaggaacaggagctgaaacagaaacagctcaaggaggctgagggccctctcccgattaaggccaaaccgaagcaacctttcctgaagcgcggtgaggggctagccagattcactaacgcgaagagcaagttccagaagggaaaggagtcgaagttggtaactaatcagtctacctctgaagaccagccgctgtttaagatggaccggcagcagctgcagcggaaaactgccttgaaaaataaggagctgtgcgccgataatccaattttgaaaaaagactctaaagcccgcactaaaagcggcagcgttactctttctcagaagccaaagatgctgaagtgcagtaataggaaaagtctgtcacctagcggtcttaaaatccaaacaggtaagaagtgtgacggacagttccgggatcaaataaaattcgagaataaggttacaagcaataataaggaaaatgtgaccgagtgtccaaagccctgcgatactggctgtaccggatggaacaaaacccaaggaaaggacagattacctctgagcacagggcccgcctcccgcctggctgctaagagccctattagagaaacaatgaaggagtccgagagttccctggatgttagcctgcagaagaaactggagacctgggaacgagagaaagagaaggagaacctggagctagacgagtttttgtttctggaacaggcagcagatgagataagcttctcatcgaactctagcttcgtactcaaaattctggaacgagatcagcagatttgtaaaggacatcggatgagcagcacacccgtgaaagcagtgccccagaagactaatcccgcggatcctattagccactgcaaccgaagtgaagacctggatcacacggccagagaaaaggaatctgagtgtgaggtagcccccaaacagctgcatagcctttcatcagcagatgaactgcgggagcagccctgcaaaatccgcaaggccgtacagaaatctacaagcgaaaatcagactgagtggaatgcaagagatgacgaaggcgtgcctaatagcgattcctccactgactcagaggagcagcttgatgtgacaatcaaaccctctacagaagatagagaacgtggcatctctagtagggaagactctccccaggtttgcgacgataagggccctttcaaagatactcgcacccaggaagacaagcgccgcgacgttgatttagatctatcagataaagactattctagtgacgaatccattatggagagcataaagcacaaggtttctgagcccagtagatcaagttcactcagtctgagcaaaatggatttcgatgacgagcggacttggaccgatctggaagagaacctgtgtaatcatgacgtagtgctcggtaacgagtccacctacggcacgccccagacttgttacccaaacaatgagatcggaatactggataaaacaatcaagcgcaagatagcccctgtcaaacgcggagaggacctgagcaaatcccgtagaagtcggagcccccctacctccgagctcatgatgaagttctttccctccttaaagccaaaacctaaatctgattctcatctcggtaatgagttgaagcttaatatttcccaggaccagccaccgggggataatgctcgctcccaagtgctgagagaaaagatcatagagctggagacagagatcgaaaagttcaaggccgagaacgccagtctcgcgaaactcagaatcgagagggaatccgccctggaaaaactccggaaggaaattgctgactttgagcaacagaaagccaaagaactggctcgcatcgaggaatttaagaaagaggagatgcgcaagcttcagaaagaacgcaaggtgttcgaaaaatataccactgcagctcggactttccccgacaaaaaagaacgagaagagatacagacgttgaagcaacaaattgccgatctcagggaagatctgaaacgcaaggagactaaatggagctctacccactcacgcctgagatctcagatacagatgctggtcagagagaatacagatctcagggaggagatcaaagtgatggagcgatttcgccttgacgcctggaaacgcgctgaggccatcgagtctagcttggaagtggagaaaaaagataaactcgcagcaatccacctcgaagatccttcactacacctgctggtgatttag

SEQ ID NO: 111631 - DNA, 1035 bp, Artificial Sequence
  Description of Artificial Sequence: Synthetic coding sequence
atggacagttacagcgcccctgaatctacacctagcgccagcagtcgaccagaggattattttatcggcgccacacctctccaaaagaggcttgaaagtgtgcggaagcagtcatccttcatcctgacgcccccgcgtaggaagattccacagtgctcccagctccaggaggatgttgatccacagaaggttgcttttcttttgcacaaacagtggacgctgtacagcctgactcccctgtataagttcagctactctaatctgaaagaatactctcgacttctgaacgctttcatagtagctgagaagcagaagggtctggcagtggaggtgggcgaggacttcaatatcaaggtgatcttttccacacttctcggaatgaaggggacgcagagagatcccgaggcatttctcgtccagatagtctctaaatcccagctgcctagcgaaaacagggaaggcaaagtcctctggacagggtggttttgttgtgtgtttggcgactcattacttgaaactgtgtcggaggatttcacatgcctccccctcttccttgcaaatggcgccgagagcaatacagccataattggaacgtggttccaaaaaacatttgactgctatttctcccccttggctatcaatgcattcaatctgtcatggatggccgcaatgtggacggcctgtaaaatggaccattatgtggccactaccgagttcctctggtcagtgccttgttccccccagtcccttgatattagtttcgccatccaccctgaggatgcgaaggccttgtgggatagcgttcacaaaactcccggtgaagtcactcaggaggaagtggacctgtttatggattgcctatactctcacttccaccgccacttcaaaattcatttgtctgctacccgcctggtgcgggtgtctacctccgtggcaagtgctcacaccgacggcaagatcaaaatcctgtgccataaatacctgattggtgttctcgcttatctgaccgagcttgccatcttccagatcgagtag

SEQ ID NO: 111632 - DNA, 1173 bp, Artificial Sequence
  Description of Artificial Sequence: Synthetic coding sequence
atggatagttatagcgcacccgagagcacccctagcgcctcatcaagacctgaagattactttatcggagctacccctctgcagaaacggttagagtcagtacgcaagcagagcagcttcatcctaacgcctcctcgacgcaagattccacaatgctcccagttgcaggaagacgtggatccccagaaggtcgcattcctactccacaagcagtggacattgtattctctgacaccattgtacaagttttcttatagtaatctcaaggagtattcccgactcctcaacgccttcattgttgccgagaaacaaaagggactggccgtagaagtcggcgaagactttaacattaaggtgattttctccaccctgctcggcatgaagggtacccagcgtgatccagaggctttcctggtccagggtctcatattgtcaccacgcctggaatattctggtaccattcttgtggactgcaacttgtgtctgctcggatcctccgacccttccactttagcttttcaggtggccggcactgcaggggcttgccatcatactcggattgttagcaagtcacaactgccgagcgaaaatagagagggaaaagtcctgtggacgggttggttctgttgtgtgttcggagatagccttctcgaaactgtgtctgaagatttcacgtgcctaccacttttcctggctaatggcgccgagtctaatacagcaatcattggaacatggttccagaaaacctttgattgctattttagccccttagcgataaacgcatttaacctgtcctggatggctgcaatgtggacagcatgtaagatggaccattacgtcgccacgacggagttcttgtggagtgtcccctgctcccctcagtccctggacatctcatttgcaatccaccccgaggatgctaaggctctgtgggactccgtgcacaaaacccccggggaggtcactcaagaagaagtggatctgtttatggattgtctgtactcgcattttcaccggcactttaagatccaccttagcgctacgaggttggtcagggttagcacctctgttgcctctgcccatacagacggaaagattaagattctgtgtcataaatatctgatcggcgtacttgcctacttgacggagctagcaatcttccagatcgagtag

SEQ ID NO: 111633 - DNA, 1035 bp, Artificial Sequence
  Description of Artificial Sequence: Synthetic coding sequence
atggactcttattctgcccccgagagtactcctagtgccagtagtcggcccgaagattacttcattggcgccacccccctgcagaagcggctcgagtctgtgaggaaacaaagcagttttatcctgacaccaccaaggcggaaaatccctcagtgcagccagctacaggaagacgttgacccacagaaggttgccttcctcctccacaagcaatggaccctttactccttgaccccactgtataagtttagttacagtaacctcaaggagtattcaaggcttctcaacgcctttatcgtggctgagaagcagaaagggctcgctgtggaagtgggcgaggacttcaacattaaggtcatcttctctaccctcttggggatgaagggcacccagcgggacccagaggctttcttagtgcaaatcgtcagcaaatctcagctgccctctgaaaatagggaaggcaaagttctctggaccggttggttttgctgtgtgttcggcgattctctgttggaaactgtctctgaggattttacctgtttgccccttttcctggccaatggtgcggagagtaataccgcaatcataggtacctggtttcagaaaacctttgattgttatttcagcccattggcaattaatgctttcaatctaagttggatggcagcaatgtggacagcctgcaagatggatcattatgtagccactaccgagtttttgtggtctgtaccttgcagccctcagagtctggacatttcctttgctatacatccagaggatgctaaagccttgtgggatagcgtccacaaaactccgggcgaggttacccaggaggaagttgacctgtttatggactgcctgtatagtcattttcataggcacttcaagattcacctttccgccacacgccttgtgagggtatcaacaagcgtggcatcggcgcacaccgatggaaagatcaagatcctttgtcacaagtaccttatcggcgttctggcatatctgactgaactggccatcttccaaatagagtag

SEQ ID NO: 111634 - DNA, 615 bp, Artificial Sequence
  Description of Artificial Sequence: Synthetic coding sequence
atggacgaaacagtggctgagttcattaagaggacaatcctgaaaattccaatgaatgaacttaccactatcctcaaggcctgggatttcttgtccgagaatcagctgcagacggtgaactttaggcagaggaaggagagcgtggtgcaacatcttatccatttatgtgaagagaaaagagcctccatctctgatgctgctctgctggatatcatttacatgcagtttcaccagcatcaaaaagtctgggaggtatttcagatgagcaagggacccggcgaggatgtcgacctcttcgatatgaagcagttcaagaactcgttcaaaaaaatcctgcagagagcgctgaagaatgttacagtcagctttcgggagactgaggagaatgccgtctggatcaggatcgcctggggtactcagtacactaagcctaaccaatacaagcctacgtacgtcgtctactactcccagacgccatacgccttcacttcgagcagcatgttgcgccgtaatacgccgctcctgggccaggaactagaggcgaccggcaagatctacctccgccaggaggagataattctggatattaccgagatgaaaaaggcttgcaattag

SEQ ID NO: 111635 - DNA, 1020 bp, Artificial Sequence
  Description of Artificial Sequence: Synthetic coding sequence
atggacgaaacagttgcggaattcataaagagaacaatactgaagatccccatgaatgaactgaccaccattcttaaagcatgggactttctgtccgaaaaccagctgcagacagtgaatttcaggcagaggaaggaaagcgtggtgcaacacttgattcacttgtgtgaagaaaaaagggcgagcatttcagacgctgccctcctagacattatctacatgcagttccaccagcaccaaaaagtgtgggaggtcttccagatgagtaagggccccggggaggatgttgaccttttcgatatgaagcagttcaagaacagctttaagaaaatcctacagagggcactgaaaaatgtgaccgtgtcattcagagagactgaggaaaatgctgtctggatccgtattgcttggggaactcagtatacaaagcccaaccaatacaaacccacttacgttgtgtattatagccagaccccatatgcttttacatcttcgtccatgctgcgaagaaatacccctctgttgggtcaagcccttacaatcgcgagtaagcatcatcagatagttaagatggacctccgaagcagatacttagattctttaaaagcaatcgttttcaagcaatacaatcagacatttgagactcacaattcgacaacaccactgcaggaacggagcttggggctagacattaatatggacagccggattatacacgagaacatcgtcgagaaagagcgcgtccaacgtataacccaggaaacattcggggactacccacagccccagctggaattcgctcagtataagctggagactaagttcaagagcggcctcaacggcagcatcttggcggagagggaggaacccctccgctgcctgataaagttttcaagtccacacctgctagaggccctaaagtctctggccccggctggaatcgctgacgctcctctgtctcccctgctgacatgcatccctaataagagaatgaattacttcaagataagggataaatag

SEQ ID NO: 111636 - DNA, 918 bp, Artificial Sequence
  Description of Artificial Sequence: Synthetic coding sequence
atggacgagaccgtcgccgaattcattaagcggactattctcaagatccctatgaatgagttaaccactatcttaaaggcttgggacttcttatcagagaaccaattgcaaactgtgaattttcggcaaaggaaggaaagcgtggtgcagcatttgattcacctttgcgaagagaagagggcttcaatatccgacgccgcgctgctcgatataatctatatgcagttccaccaacaccaaaaggtgtgggaggtgtttcagatgagcaaaggccccggcgaggatgtcgatctcttcgatatgaagcaattcaagaacagcttcaagaaaatcctgcagagagcactaaagaatgtaactgtgtctttccgggagacagaggagaatgcagtctggattcggatagcctgggggacgcagtacaccaagccaaaccagtacaaacccacttatgtggtgtactattctcagaccccttacgcatttacatctagctctatgctgcgccgcaatacacccctgctgggacagactttcgaaacccacaattccacaacacctctgcaagaaaggtcccttggactagatattaacatggattctagaatcatccacgagaatatagttgagaaagaacgcgttcagcggattacgcaagagaccttcggcgactacccgcaaccccaactcgagtttgcccagtataagctagagactaaatttaaaagcgggctaaatggtagcatcctggccgaacgggaagagcccctgcggtgtctgattaaatttagctcgccacacctactggaagcactgaagtctctcgctcctgctggcatagccgatgcaccactgtcacccttgctcacctgcattcctaataagcggatgaactattttaagatccgggataaatag

SEQ ID NO: 111637 - DNA, 960 bp, Artificial Sequence
  Description of Artificial Sequence: Synthetic coding sequence
atggacgagactgtcgctgagtttattaagcgcaccattctgaagattcctatgaatgagttgaccacgattctgaaggcttgggatttcctcagtgagaaccagctgcagacggtgaacttccgacagcgtaaagagtcagtggtgcagcatttaatccacctgtgtgaggagaagagggccagtatcagtgatgcggccctgttggacatcatctgtgaggacgtggacttgtttgacatgaagcagtttaagaactcatttaagaaaatactccaaagagcgctgaagaatgtaaccgtaagcttccgagagacagaggagaatgccgtatggatacggatagcctggggcacccagtacactaaacccaaccagtacaagccgacttacgtggtgtactacagtcagacaccatacgcttttacctcttcatctatgctgagacgaaatacacccttgctgggccaggctctgaccatcgcaagtaaacatcaccaaatcgtcaaaatggatctgagatcacgatatctcgacagtctgaaagccatcgtatttaaacagtataatcagactttcgaaactcataattcgaccactccactacaagaaagaagtctggggcttgacatcaatatggattcccggatcatccatgaaaatatcgttgaaaaggagcgcgtgcagagaatcacacaggaaaccttcggggattatccccagccacagctggaatttgcacagtataaactcgaaacaaagttcaaatccggccttaacgggtccatcctcgcagagagagaggagccgctgaggtgtcttatcaagttctcctccccccacctgctagaggctctcaagtctttggcccccgcaggaattgctgatgctcctttgtctccactgctgacatgcattccgaacaaacgcatgaactatttcaaaattagagacaaatag

SEQ ID NO: 111638 - DNA, 1062 bp, Artificial Sequence
  Description of Artificial Sequence: Synthetic coding sequence
atggacgaaacggtcgccgaatttatcaagaggacaatattgaaaatcccaatgaatgagctgacgacaattctcaaagcctgggactttctgagcgagaaccagttgcagactgtgaactttcgtcagaggaaagagagtgtcgttcagcatcttattcacctgtgtgaggagaagcgggcctcaatctccgatgccgcactgctggatatcatctacatgcagtttcaccagcaccagaaagtgtgggaagtgtttcaaatgtctaaaggccctggagaggacgtggacctattcgatatgaagcagtttaaaaactcctttaaaaagattctgcagcgagccttgaaaaacgtgacagtgagcttccgcgagaccgaagagaatgcagtttggattcggattgcttgggggacccagtatactaaacctaaccagtacaaacccacctacgtggtctattactcccagacaccctacgccttcacctcctcatcaatgctgaggcggaacactccgctgctgggacaggcgctgactattgccagcaagcaccaccagatagtgaagatggacctgaggtcacgctaccttgacagcctcaaggccattgtgttcaagcaatacaatcaaacctttgaaacccacaattctacaacaccgctgcaagagcgctcactggggttggacatcaacatggattctcgaatcatccacgagaacattgtcgagaaggagagggtacagaggattactcaagaaacctttggtgattatccacaacctcagctggaatttgcacagtacaaactggaaacaaagtttaaaagcggcctgaatggctcaatattagcagagcgtgaggaaccactcaggtgcttaattaaatttagttcccctcacctactggaggcacttaaatccttggctcctgccgcgctggtgtgtcgcatccagaagctgctgtgctattccgggagtcactcgcaagggacgcaggacccatcatcatggcaaaaagacctatacctgctgttcgttcctctctatcccagatgctag

SEQ ID NO: 111639 - DNA, 903 bp, Artificial Sequence
  Description of Artificial Sequence: Synthetic coding sequence
atggagcaagctaaccctcttagacctgatggtgagagtaagggtggggttctggcgcacctggagcggctggaaacccaggtcagcagaagtaggaagcaatccgaagaacttcagagcgtccaggctcaggaaggtgcattggggacaaaaatccataagcttcgtaggctgcgcgacgagctccgggccgtggttcggcaccggcgagcctctgtgaaagcctgtatagctaacgtggagcccaaccagactgtagaaatcaacgagcaggaggccctggaagagaaactggaaaacgtgaaagctattttacaagcatatcactttacaggcctgagcggcaagctgacaagtcgaggagtgtgtgtttgcattagcacagccttcgaggggaacctgcttgacagttactttgttgacctggtgattcaaaagcccctgcgtatccaccaccattcagtccctgtttttatcccactcgaggagatcgccgccaagtaccttcagacaaacattcaacattttctgttctccttatgcgagtacctgaacgcctacagcggccggaagtaccaggccgatcgcttacagtctgattttgctgccctgctgactggaccactgcagcgcaatccactgtgcaacctactcagtttcacttataagttagatcccggcggacaatcctttcccttttgtgcccgtttgttgtataaagatctcactgcaacgttgcctacagatgtgactgtgacctgtcagggagtggaggtcctgtctacctcatgggaggagcagcgcgcgtcccatgaaaccctgttttgtactaagcccctccaccaggtgttcgccagcttcacaagaaagggcgaaaaactagacatgtcactggtgtcctag

SEQ ID NO: 111640 - DNA, 903 bp, Artificial Sequence
  Description of Artificial Sequence: Synthetic coding sequence
atggaacaggctaatcccctgaggcccgatggggagagtaagggcggggtgcttgctcatttagagcgtcttgagacccaagtctcgcggtcccgcaaacagtcagaggagttacagagtgttcaggcccaggaaggagccctgggcaccaagattcataagctcaggagactccgtgacgaattgcgggccgttgttaggcatcgaagggcatctgttaaagcctgcattgcaaatgtcgaaccaaatcagactgtggagatcaacgaacaggaggcgcttgaggagaagctggaaaatgtaaaggctattctgcaggcgtatcatttcactgggctgtcaggcaagttgaccagtcgtggcgtgtgcgtttgtatcagcaccgcgtttgaaggaaacctgctcgactcctatttcgtggatctggtcatccaaaagccgttaaggatccaccaccactctgtgcctgttttcattcccctcgaggaaattgctgcaaagtatctgcaaacgaatatccagcatttcttgttcagtctttgcgaatacctcaatgcttactctggtcgaaaataccaggccgatcgtctgcaatctgacttcgcagccctgctgaccggtcctcttcagaggaacccactgtgtaatctcctgtccttcacctacaaactcgaccccggtgggcagagtttccctttttgcgcccgattactgtacaaggatcttacggcgaccctgcctaccgacgtcaccgttacctgccaaggtgtggaggtgctttccacgagctgggaagagcaacgcgccagccatgaaactctgttctgcaccaagcctctgcaccaggtattcgcatcgttcactcggaagggcgagaagcttgacatgtcccttgtcagctag

SEQ ID NO: 111641 - DNA, 885 bp, Artificial Sequence
  Description of Artificial Sequence: Synthetic coding sequence
atggctggcattctggcctctggcttgggcgtactcgcacacttagaacgtctggagacacaagttagcagaagccgtaagcagtccgaggaactacaatctgtgcaagcgcaggagggggcgttgggaaccaagattcataagctgaggaggttgagagacgagttgagggcagttgtgcgccatcggcgggccagcgtgaaggcatgtatcgccaacgtggagccgaaccagacagtggaaattaacgaacaggaggcattggaagagaagctggagaacgtgaaggcgatcttgcaggcttaccattttaccggtctctctgggaagttaacttctaggggtgtgtgtgtatgcatttccacagcctttgaggggaatctgctggacagttactttgtcgacctcgtgattcaaaagcctcttaggatccatcaccactctgtccctgtttttatacccttggaggagattgcggccaagtatctgcagactaatatacagcactttctgttttcactgtgcgagtacctgaacgcatacagtgggagaaaataccaggccgaccggctccaatcagacttcgcagccctgctaacaggaccactccagcggaatccactgtgcaatcttctctcatttacctataagctggacccgggaggccagtcttttcccttttgcgccagactgttatacaaggacctgacagccacacttccgacggatgtgacggtgacctgccagggagtcgaggttctgtcaacttcttgggaggagcagcgggccagccatgagacgctgttctgcaccaagccactgcaccaggtcttcgcctcgtttacgaggaagggtgaaaaactagatatgtcgctggtgtcatag

SEQ ID NO: 111642 - DNA, 309 bp, Artificial Sequence
  Description of Artificial Sequence: Synthetic coding sequence
atgcaggagaaatatcctgacgccgtgtacctgtccgagggcccatccagttgctctatgggtatcaggagcgcctcaagaccgggttttgagctggtgatagtatggcgtattcagatcgatgaggacgggaaagttttcccgaaacttgatctgctgacaaaagtacctcaaagggcccttgagttagacaagaaccgggctatcgagactgctccactgtccttccggacactagttggtctgcttgggattgaggccgcccttgagagcctgatcaaaagtctgtgtgccgaagaaaacaactag

SEQ ID NO: 111643 - DNA, 348 bp, Artificial Sequence
  Description of Artificial Sequence: Synthetic coding sequence
atggaagctccctcatggtcggtgctccagagatccggcgacgaggagaaatacccagatgcagtttatctcagcgagggcccgtcaagctgcagtatggggattaggtccgcctctcggcctggctttgagctggtgatcgtatggcgcatccagatcgatgaagacgggaaagtctttcctaaactcgacctgttgaccaaggtgccccaaagggccctggaacttgacaagaatcgcgctatcgaaacagcacccctcagctttcgtactctggttggtcttctcggtatcgaggctgcactggagtcactcatcaaatctctctgtgcagaggagaacaattag

SEQ ID NO: 111644 - DNA, 867 bp, Artificial Sequence
  Description of Artificial Sequence: Synthetic coding sequence
atggacgccgagctggccgaggtgcgtgccctacaggccgagatcgctgcactcaggagggcctgcgaagaccctccagcaccctgggaagaaaaatcccgcgtccagaagagctttcaagcaatacaccaatttaacctcgagggatggaaatctagcaaggatctgaagaaccagctcggccaccttgagtctgaactgtcattcctgtccaccttgaccggcatcaacatcagaaatcactctaaacagactgaggatttaacatctaccgagatgacggagaagagtatcaggaaagtgctccagaggcacagactgagtggtaactgtcatatggttacatttcagctggagtttcagatcctggaaatacagaataaggaaaggctaagctctgccgtgacggatttgaatatcatcatggagcccaccgaatgttccgagcttagcgaattcgtctcacgcgccgaagagcgaaaggacctttttatgttcttccgtagtctgcatttctttgttgaatggtttgagtataggaaaaggacgttcaaacatctgaaagagaagtatccagacgccgtgtatttgagtgagggaccttcaagctgcagtatggggatacggtctgccagcagacctgggttcgagctagtaatcgtttggaggatccagatcgatgaggacgggaaggtcttccccaaactcgatctgctgaccaaggtgccccagagagcattagagcttgacaagaacagagctatcgagaccgcgcctttgtcgttccgcaccctggtgggattgttgggcatagaagctgcactggagtccttgataaagtcactgtgtgccgaggagaataactag

SEQ ID NO: 111645 - DNA, 744 bp, Artificial Sequence
  Description of Artificial Sequence: Synthetic coding sequence
aagcgcgccgggcgaagcgactcttgtgccgctgggccagcagcagtttctaacgctccttggactcagagctggcagaggtgtgcaccctgtaagctccgctctcgaccatgcggcgaaagagtgaggacccatagacggccgggtaagcgcagccccgaaagttctatacgaaaagtcttgcagcgccatcgtctgtcgggcaattgccacatggtgacctttcaattagaattccagattctggagattcagaacaaggaaaggttaagttcagccgttacagatctgaatattattatggagccaaccgagtgctctgaactgtccgagttcgtgtcccgagccgaagaaagaaaggacctttttatgttctttcggtcactgcattttttcgtcgaatggttcgaatacaggaagcggacctttaaacacctaaaggaaaagtatcctgacgcagtgtacttaagcgaaggtccatcatcctgttccatggggattcggtctgctagtcgccctggattcgaactagttatcgtgtggcggatacaaatcgacgaggatggaaaggtgtttccaaagctggacctcttgaccaaagtgccccagcgggctttggagctcgacaagaaccgagcgattgagaccgcgcccttatcctttaggacgctggtcgggcttttggggatcgaagccgcacttgagtcactgatcaaatctctgtgcgccgaagagaataattag

SEQ ID NO: 111646 - DNA, 807 bp, Artificial Sequence
  Description of Artificial Sequence: Synthetic coding sequence
atgtccggtaaggctaacgcctccaaaaagaatgctcagcagctgaagagaaatccaaagagaaagaaggacaatgaggaagtggttctctccgaaaataaggtgagaaacaccgtcaaaaagaacaagaatcaccttaaagacctatcctccgaagggcagaccaagcatacgaatttgaaacacggcaaaactgctgcttcaaagagaaagacctggcagcccctgagcaagtctactcgagaccatctgcagaccatgatggagtcggtgattatgacaattctttctaatagtattaaggagaaagaggaaatccaataccatcttaatttcctgaaaaagaggctcctgcaacagtgtgagacacttaaggtcccgcctaaaaaaatggaggacttgactaatgtctcgtcactgctcaacatggagagagcacgtgataaagcgaatgaagagggtctggccctgttacaggaggagattgacaaaatggtggaaactactgagctgatgactggtaatatacagtcccttaaaaacaagattcagattctggccagcgaagtggaagaagaagaagagagggtgaaacagatgcatcagatcaacagctccggagtcctgtccctgccagagctgagccaaaaaacattgaaggccccgaccttgcagaaggagatcctggctcttatccctaatcagaatgcacttttgaaggacctggacatcctccacaactccagtcagatgaagagcatgagcacatttatagaagaagcttacaagaagctggatgcaagttag

SEQ ID NO: 111647 - DNA, 807 bp, Artificial Sequence
  Description of Artificial Sequence: Synthetic coding sequence
atgtctggcaaagcgaacgcctccaagaaaaacgctcagcagctaaagagaaaccctaagcggaagaaagataatgaggaagtggtgctgtctgagaataaagtgcgtaacacagtcaaaaagaacaagaaccacttaaaagacctgtcttccgagggacagacaaagcacacaaacttgaagcacggcaagacagccgcatccaagcgcaagacctggcaaccccttagcaagagcaccagggaccatctccagaccatgatggagtcagtgattatgactatattaagcaattcaataaaggaaaaggaagagatacagtatcatcttaatttcctcaagaagcggctactgcagcagtgcgaaactctcaaggtcccgcctaaaaagatggaggacttgacaaacgtgagctccctgctgaatatggagagagcccgagataaggcgaatgaagagggactggcattgcttcaggaggagattgataaaatggtggagactacagagctgatgaccggcaacatccagtccctcaagaataagatccagatactcgcttccgaagttgaagaagaagaagaaagggtcaagcaaatgcaccagatcaatagtagcggtgtgctgagcctcccggagctgagccagaagaccttaaaagcccctacattacaaaaagagattctcgctttaattccgaaccagaatgccctgcttaaggacctggacatcctgcacaattcttcccaaatgaagtcaatgtccacgtttatcgaagaagcttacaaaaagctggatgcttcatag

SEQ ID NO: 111648 - DNA, 384 bp, Artificial Sequence
  Description of Artificial Sequence: Synthetic coding sequence
atgggagacaagcccatctgggagcagatcgggagtagttttatccaacattattatcagttatttgataatgacaggactcaacttggagccatttacattgacgcgtcctgcctcacatgggagggtcagcagtttcagggaaaagcagccattgtcgagaagttaagcagcctgccattccagaagatccagcactccatcactgcccaggatcatcagcccacccccgattcgtgtataattagtatggtggtgggtcagcttaaggccgacgaagacccaatcatgggatttcaccagatgtttctgctgaagaacattaacgatgcctgggtctgcacaaacgatatgttcaggctggccctgcacaactttggctag

SEQ ID NO: 111649 - DNA, 786 bp, Artificial Sequence
  Description of Artificial Sequence: Synthetic coding sequence
atgtcatggtgctgtctgtggctctgccttagttcggtcggccgaaccggtagtgcaggacccagtctccccttctcagagctgtgttcgctgggactactccgtctcagaccggtgttctccccactgcattccggtcctggaaaacctgctcagtttcttgccggcgaggctgaagaagtgaacgcgttcgcactcggcttcctcagcacttcgtccggagtttccggagaagacgaggtggagcctttgcacgacggagtggaggaagctgagaaaaaaatggaggaagagggagtctctgtgagcgagatggaggctaccggtgcccagggcccgtcgcgcgtcgaggaagcagaggggcacacagaggttaccgaggccgagggcagtcaagggactgcagaagccgacggcccaggggccagcagcggcgatgaggacgcctcaggcagagctgcctccccagagtctgctagctctacacccgagagcttacaggcccgacggcaccaccaatttctggaacccgccccggcccctggggcagcagtcctgtcttctgaacctgccgagccgctcttggtcaggcaccccccaaggccacggaccaccggacctaggcctagacaggatccccacaaagcagggctgagccattacgtgaaactgttctcgttctatgccaagatgccaatggaacggaaggccctggagatggtcgaaaaatgcatctttgtgatgatctggagatacctgttacttatgctggccgccagactctag

SEQ ID NO: 111650 - DNA, 1686 bp, Artificial Sequence
  Description of Artificial Sequence: Synthetic coding sequence
atggccgaccataatcctgattctgattccactccaaggaccctcctgcgccgagtgttagatacggccgatcctaggaccccccgccggcctcgctccgctagagccggggcccggcgagctctactcgagaccgcatcacccaggaaactctccgggcagaccagaacaattgcacgaggcaggagccacggggctagatccgttggccgcagcgctcatatccaggcctctggacacctggaggagcaaaccccccgcacactgttaaaaaacatccttctgaccgcgccagaaagctccattctgatgccagagtctgttgtgaagcctgtgccagccccgcaggcagtgcagcctagccgacaggaatctagttgcggctccctcgaacttcagctcccagaactggagccgccaaccaccctcgcacctggactcctcgcccccggcagaagaaagcaacgcttgagactaagtgtgtttcagcagggggtcgaccagggactttcactgtctcaagagccacagggcaatgcggatgcctcctccttgacacgcagtttgaacctcaccttcgcgactccattgcagcctcagtccgtgcaacgacccggcttggctaggcggcctccagcacggcgtgccgtggacgtaggggccttcttgcgagacctcagggatacgtcactcgccccgcctaacatcgttttggaagatacacagccgttctcacagccaatggttggctcaccgaacgtatatcactccctcccctgcacccctcacacaggagctgaagacgctgaacaggccgcagggcgtaagacacagtcctccgggcccggcctccagaagaacagtcccggaaaacctgcccaattcctcgctggagaggccgaggaagtcaatgccttcgcactggggtttctgagtacgagttccggagtatcgggcgaagatgaagtagaaccgcttcacgatggtgtcgaggaggccgagaaaaagatggaggaggaaggagtgtccgtctcagagatggaggcaacaggcgcacaaggcccaagtagggtcgaagaggcagaggggcacacagaggttaccgaagccgagggcagtcaaggcaccgctgaagccgacggccctggcgcatctagcggggatgaagacgcttcgggaagagctgcgtcgcctgaatccgctagtagcactcccgagagcctgcaggccaggcgacaccatcagttcttagagcctgcccccgcaccaggggcagccgtcctaagcagtgagccagcggagcctctcctggttaggcatccccctcggccgaggacaacggggccgcgcccccgccaggatccacacaaagcgggactcagccattatgttaagcttttttctttttacgcaaaaatgcccatggagaggaaagctctagagatggtggagaaatgtctcgacaagtattttcagcatctgtgtgacgatctggaagtttttgctgcccacgccggtcgaaagacagtcaaacctgaggacctggagctgctcatgcgccggcaggggttggtgacggatcaagtatcactccacgtgttggttgaaagacatctacccctggagtacaggcagctgctgataccatgcgcctactccgggaacagtgtctttcctgcccagtag

SEQ ID NO: 111651 - DNA, 447 bp, Artificial Sequence
  Description of Artificial Sequence: Synthetic coding sequence
atgccagagtctgtggtcaagccagtgcccgcaccccaggccgtccagccatccaggcaggagagcagttgtggctccctggaactacagttaccagagttagagccccctacgaccttggcaccaggtctactggcacctggcaggcgcaagcagcgccttagactgtctgtgttccagcaaggtgtcgaccagggactcagcttatcccaggagccacaaggaaatgcggatgcctccagcttgacccgtagtttgaacctgacctttgccacgccccttcagcctcaaagtgtccagcgccctggccttgctcggcgcccacctgctcgaagggctgtcgacgtgggggcgtttctgagagacttacgcgatacaagtctggccccaccttccaaggtcggtttttcccctgccggcctatgggggaagctgtcccctctgtag

SEQ ID NO: 111652 - DNA, 1686 bp, Artificial Sequence
  Description of Artificial Sequence: Synthetic coding sequence
atggccgatcacaatccagactcggacagtacaccccgtaccctcttgagacgagtgctggataccgccgatccaagaactcctcgccgtcctcgaagcgctagggcaggagcccgccgggctctgctagagaccgcgtcaccccgcaagttgtccggacagactcgcactattgcaaggggccggtcccacggtgctcggtcagtgggaagatctgctcacattcaggcctctgggcacctggaagagcagactcccagaacgctgctgaagaacattttactgacagctccagaatcctcgatcctcatgccagagtctgtggtcaaacccgttcccgcacctcaggccgtgcaaccgtcacggcaggagagcagctgtggctctctggagttgcagctccctgagctggagccgccaacaactctcgctccaggcctgttagctccggggagacggaaacagcggctacgtctctcagtgtttcaacagggagtggaccagggactgtcattaagccaggaaccacaaggaaacgctgacgccagtagtctcacccgatcgctgaacttaacgttcgcaacaccactgcagccccagtccgtacagcgacctggcctcgcaagacgcccacccgcccggcgcgccgtggatgtgggagcgtttctgcgggacctgcgagacacctctctggcccctcctaacatcgttcttgaagatacacagccctttagccaaccgatggtggggagtcctaacgtttaccattctcttccttgcaccccccatactggcgccgaggatgctgaacaggccgctgggaggaagacacagagttcaggacctggcttgcagaaaaacagccctggtaaacctgcccagttcctggccggagaggcagaagaggtgaacgcttttgccctggggttcctgtccacatcttctggagtgagcggcgaggatgaggtggagcctctgcacgacggcgtggaggaggctgaaaaaaagatggaagaagaaggtgtatcagtgagtgagatggaagccaccggagctcaaggaccttcccgggtggaggaagccgaagggcatactgaggtcactgaagctgaagggagccaaggtaccgcggaggccgacggacccggagcaagcagcggagacgaagatgcttccggccgggccgccagccccgagtcagcctcatcgaccccggagagcctgcaggcaaggcggcaccatcagtttttggagccagctcctgcacccggcgccgcagttctttcctcagaaccagccgaacccctcctggtccgccacccacctaggccacgcaccactggacccaggccccggcaggaccctcacaaagctgggttaagccactacgtcaaacttttctcgttttatgctaaaatgcctatggagcgtaaggcacttgagatggttgagaaatgtctcgataaatactttcagcacctgtgcgacgatctggaggtgttcgctgcccacgccggcaggaagacagtgaagcctgaggacctcgagctgttgatgaggagacagggcctggtcacggaccaggtctccctgcatgtgttggtggaacgacatcttcctctagagtaccgccagttgctgatcccatgcgcatattccggaaacagtgtgtttcctgcccagtag

SEQ ID NO: 111653 - DNA, 819 bp, Artificial Sequence
  Description of Artificial Sequence: Synthetic coding sequence
atgagaagatcccggtcatctgccgctgctaagctgcggggacagaagcgctccggggcatcagcagctcctgctgcatccgcggccgccgctctggcaccctccgctacccgcactaggcgatctgccagtcaggccggttcgaaatcacaggcagttgaaaagcccccttctgaaaagccacgcttgcggaggagctctccccgcgcacaggaggaaggacctggcgagccacccccaccggaattggccctgctccccccacctcccccaccgcccccaacacctgcaaccccgacttcttcagcttctaatctcgacctcggcgaacaaagggagcggtgggaaacgttccagaagcgacagaaactgactagtgagggtgcagctaagctcttgctggacactttcgagtaccagggactggttaaacacacaggaggatgtcactgtggagcagttagattcgaagtctgggcctcagcggatctccatatcttcgactgtaactgctccatatgtaagaagaagcagaatcgccacttcatcgtcccagcctcaaggttcaagttattaaaaggtgctgaacacatcaccacttataccttcaatacccataaagcgcaacataccttttgtaagagatgtggcgtgcaatccttctataccccacgctccaaccctggcggatttggcatcgctccccattgcctggatgagggcaccgttaggagcatggtgactgaggagtttaatgggtctgattgggagaaagctatgaaagagcataagacgatcaaaaatatgtccaaggagtag

SEQ ID NO: 111654 - DNA, 2961 bp, Artificial Sequence
  Description of Artificial Sequence: Synthetic coding sequence
atggtcagcaaatctgaccaactactcattgttgtgtcaatcctcgagggacgccattttcccaagcggccaaagcacatgcttgtggtggaggcaaaattcgacggcgagcagttagctactgaccccgttgatcacaccgaccagcctgaatttgccacagagcttgcttgggaaatcgaccgcaaagccctgcatcagcatcgcctgcagcgaacccctattaaactccagtgcttcgccctggatccggtgacctctgccaaagagaccatcggttatatcgtgttggatctgagaacggcacaggaaaccaagcaagctccgaaatggtatcaactcctctcgaacaaatacactaagtttaaatccgaaattcagatcagcatcgcattggagacggacaccaagcctcctgttgactctttcaaggccaaaggggcacctccaagggacggcaaagtgccagctatcctggcaggacttgatccaagagatatcgtggccgtgttaaacgaggaaggaggatatcatcagattgggcctgcggaatattgtacagactcatttattatgagcgtcacaatagcctttgccacccagctcgagcagttaatcccttgcaccatgaagttacctgaacggcagcccgaatttttcttttattactcccttttaggtaatgatgtcaccaatgaaccgttcaacgacctgattaaccccaatttcgagccagagagagccagcgtgagaattcgaagcagcgtggaaattctgagagtatacctcgccctgcagagcaagttgcaaatccatctttgctgcggcgaccagtcactcgggtcgactgagattcctctcaccggactgttgaagaagggctccacggagataaatcagcatccggtaaccgtggaaggagctttcactctcgatcctcccaacagggcaaaacagaagcttgcaccaatccccgtagaattggctccaaccgttggcgtgtctgtggctcttcagcgggagggtatcgactcgcagtcgttaatagaactgaagacccagaatgagcatgaaccagaacactctaagaagaaagtgctgaccccaatcaaggagaagacacttaccggtcccaaatcacccactgtaagccccgtccctagccataaccaatccccccctactaaagacgacgcaactgagtctgaagtggagagcctccaatacgacaaggatactaaaccaaaccctaaggctagctcatccgtccctgccagtctcgcacagctggtcactacctccaatgcgagcgaggtcgcctctggtcagaaaatcgccgtgccagccacttcacaccacttctgtttcagcatagacctgaggtctatacatgccctagagataggctttccaatcaactgcatccttcgctatagctaccccttcttcgggagtgcagcccccatcatgaccaatccccctgttgaggtgcgcaagaatatggaagtgtttctacctcagagctattgcgctttcgacttcgccaccatgcctcaccagttgcaggatacctttttgcgcatccctcttctggttgagttgtggcataaggacaagatgtccaaggacctgctgctgggcattgcccgcatccagctttccaatatcttatcatccgagaaaacccgatttctgggatccaatggcgaacagtgttggaggcagacatacagcgaaagtgtgccagttattgctgcccaaggatcaaataaccggattgcagatctgagctacacggttactctggaagactatggactggtcaagatgagggagatcttcatctctgactcctctcagggagtctcagcagtgcagcagaagcccagcagtctgcctcctgcaccttgccccagtgagatccaaaccgaacctcgggaaacactcgaatataaggccgccctagagctggagatgtggaaagagatgcaggaagacatattcgaaaaccaactgaaacagaaagagctggcccatatgcaggccctcgccgaggaatggaaaaaaagggaccgcgaaagagagtcacttgtgaagaaaaaggtagctgagtataccatcctcgaggggaagctacaaaagactcttatcgacttggagaagagggagcagcaattggcaagcgtggagtccgaactgcaacgcgaaaaaaaggagctgcagtccgaaagacaaagaaacctgcaagagttgcaggattccattcggcgagccaaggaagattgtattcaccaggtggagcttgagcgcctcaagatcaagcaattggaagaggacaaacatagattacagcagcagttgaatgacgcagaaaataagtacaagatccttgagaaagaatttcagcaatttaaggatcagcagaataacaaaccagaaatcaggctacagtccgagatcaacttactgacactggagaaagtggagctggaacgaaaactggagtccgctacgaagagcaagctgcactacaaacagcagtggggcagggccctgaaggagctcgccaggctgaaacagagggagcaggagtcccagatggcccggctcaagaagcagcaggaggagcttgagcaaatgcggctgcgatacctggcggccgaggagaaggatacggttaaaaccgaaagacaggaactgctggatattcgaaacgagctcaatagacttcgccagcaggagcaaaaacagtatcaggactcaactgagatagcttccgggaagaaggatggtccccacggctctgttcttgaagaaggactagacgactacctgacacgactgattgaggaaagagacaccttaatgcgaaccggtgtttataaccacgaagatcggattatatctgagctggaccggcagatacgtgagatccttgcaaagagtaatgcaagtaattag

SEQ ID NO: 111655 - DNA, 2883 bp, Artificial Sequence
  Description of Artificial Sequence: Synthetic coding sequence
atgttagtcgtcgaagccaagtttgacggcgagcagctggcaacagaccccgtggaccataccgaccaacctgagttcgccactgagcttgcctgggagattgatagaaaagctcttcatcagcacagactgcaacgcacgccgatcaaactgcaatgcttcgctctcgacccagtcacgtctgctaaggagaccatagggtacatagtgctggatctgcgcaccgctcaagagaccaagcaggcacccaagtggtaccagctgctgtctaacaaatatacaaaattcaagtcggaaattcaaattagcattgcccttgagactgacaccaaacctccagtggattcttttaaagcgaagggtgcgccaccgagagatgggaaggtgcccgctatcctggcgggcctagacccccgcgatatcgtcgccgtactcaacgaggagggcggataccaccagatcggtcctgcagagtattgtactgactcattcattatgagtgtgactatagcttttgcaacacagctggagcagctcattccatgcacaatgaaactgccggagagacagccggaattcttcttctactatagcctactcggtaatgatgttaccaacgaaccatttaacgatctgataaacccgaactttgaaccggaaagagccagtgtgaggattagaagcagtgtggaaatactaagggtataccttgccctgcaaagcaagttgcaaattcacttatgttgtggagaccagagtcttggcagtaccgaaattccgcttactgggttactcaagaaagggtccacagaaattaaccagcaccccgtgaccgtggaaggcgccttcaccctggacccacccaacagagcaaaacaaaagctggcacctatccccgtagagctggctcccaccgtcggcgtgtccgtcgccttgcagcgcgagggcattgactcccagtctctcattgagctgaaaactcaaaacgagcacgagcctgaacatagtaagaaaaaagtgctcacacccatcaaggaaaagacattgacgggccctaaaagtcctaccgtgtcgccagtgccttcccacaatcagagcccccccacaaaggacgatgccacagaaagcgaggtggagtctttgcagtacgataaagacaccaaaccaaaccccaaagcatcctccagcgtcccagctagtctggcacaattggtgactacttccaatgctagcgaggtcgcatccggccagaagatcgctgtcccggctacgtcgcatcatttctgctttagcattgacctcagatccatccatgccctggagatcggtttccccataaactgtattctgcgctactcctatccctttttcggttccgcagcccctattatgacgaatcccccagtggaagtcaggaagaatatggaggtttttcttcctcagtcctactgcgcatttgactttgctacgatgccccaccagttgcaggacaccttcctgcgaatccctttgctcgtcgaactgtggcacaaggataaaatgtccaaggatttactgctcgggattgcgagaattcagctttcaaatatcctgtccagtgaaaagacccggtttctcgggagcaacggtgagcagtgctggcgccagacctactctgagagtgtccctgtcattgccgcccagggatccaataaccgaattgctgacctatcttacactgtgacccttgaagattacggcctagtaaaaatgcgcgaaatttttattagcgattcgtcgcagggtgtgagtgctgtgcaacagaaaccttcatcgctgccccctgctccctgtccctctgagatccagaccgagcctcgggagacacttgaatacaaagcagccctggaattagagatgtggaaagagatgcaggaggatattttcgaaaaccagctcaagcagaaagagttggcccacatgcaggctctcgcagaggagtggaaaaagagagatcgcgagagagaatcactcgtgaagaagaaagtggctgagtacactatcctggagggaaagctccagaagaccctgattgacttggaaaagcgagagcagcagcttgcttccgtggagtctgaactgcaaagagagaagaaagaactccagagtgagcggcagcgaaatttacaagagctccaggactccatccgtcgggcaaaggaagactgtattcaccaggtggaactcgagcggcttaagattaagcaactggaggaggataagcatcgactccagcagcagttgaatgacgctgagaacaaatataagatcctcgagaaggagttccagcaattcaaagaccagcagaacaacaagcctgaaattcggctccagagcgaaatcaatttgctaactctagagaaagtggagttagagaggaagctggagtcggcaaccaaaagtaaactacattacaagcagcagtggggcagagcgctcaaggaacttgctcggctgaagcagcgagaacaggagtcccaaatggctagactaaagaaacaacaggaggagctggagcagatgcggctacgttacttagcggccgaggaaaaagacacagtgaagactgaaagacaggagctgcttgatatcagaaatgaactgaatcgtctgagacaacaagaacaaaaacagtaccaggacagtacggagatcgcaagtggcaaaaaagacggaccacatggcagcgtcctggaggaggggttggatgattacctgaccagattgatcgaagaaagagacacgttaatgagaaccggagtgtacaatcacgaggatagaatcatttctgagctcgatcggcagatacgcgaaatcttagctaagagtaacgcctccaactag

SEQ ID NO: 111656 - DNA, 2961 bp, Artificial Sequence
  Description of Artificial Sequence: Synthetic coding sequence
atggtctccaagtccgatcagctgttgattgtggtttctattctggaaggacgccattttcccaagaggcccaagcacatgctcgtggtggaggctaagttcgatggggaacagctggctaccgaccctgtcgaccacaccgaccagccagaattcgccactgaactggcctgggagatcgaccggaaggcactccaccagcaccggctgcagaggacccccatcaaacttcagtgcttcgccctggatcccgtgacaagcgccaaggagaccataggatacatcgtgttagacttgagaacagctcaagaaactaaacaggcccccaagtggtaccagctgttgtcgaacaagtataccaagtttaagtctgagattcagatttcgattgcgcttgaaactgacacaaagccgcctgttgacagctttaaggccaagggagcccctcctcgcgacggcaaggtgcccgcaatcttggccggattggacccaagagacatcgtcgccgtcctgaatgaggagggaggctaccatcagattggacccgcggagtactgcacagatagcttcattatgtcggtaactattgccttcgcaacacaactggagcagctgataccatgcaccatgaagttgcccgagagacaaccagaattctttttctactactccttgctgggaaacgacgtgacaaatgagccttttaacgaccttataaatcccaatttcgagcctgagcgagcttctgtcagaatcagaagctcggtcgagatcctgagagtatatctggccttacagtccaagttacagattcacctgtgctgcggcgatcaatctctggggtctaccgaaatcccactgactggccttctcaaaaagggttccacagaaattaatcagcatcctgtcacggtggaaggagccttcacacttgatccacccaatagggcaaagcagaagttggctccaatccccgtggagctggcacccactgtaggtgtcagtgtggccttgcagcgagaagggatcgattcccagagcctgatcgagttgaaaacccaaaatgaacacgagcctgagcactctaagaagaaggtactgacgcccattaaagaaaaaacacttacggggcctaagtctcccaccgtgtctcctgtgcccagtcacaaccaatcaccccctaccaaagacgacgcaaccgagagtgaagtggaaagcttacagtacgataaagacaccaaacctaatccaaaggccagttcttcggtgcctgcatccctggctcagcttgtcaccaccagtaatgcaagtgaagtggcctctggacagaagatcgccgtgcccgccacctcccaccacttctgcttttccatagacctgaggagcattcatgcactcgagatcggtttcccaatcaactgcatcctcaggtacagttatcccttttttggctctgccgctcctatcatgaccaaccccccagtggaagtgagaaaaaacatggaagtctttcttccacagtcttactgtgcttttgacttcgcaactatgccccaccagcttcaagatacatttctgcggatacctcttctcgtcgagctctggcacaaggataagatgtccaaagacctactgctgggaattgccagaatacagctcagcaacatactctcgagcgagaagactaggtttctcggaagcaacggcgagcagtgttggcggcagacctacagcgaaagcgttcccgtgatcgctgctcaggggagcaataatcgaattgccgacctaagttacacagtcactctggaggattacgggctagtaaagatgagagaaatttttatcagtgacagttcacagggcgtgtctgccgtgcagcagaagccatcgtctctcccccccgctccgtgcccatcagagatacagaccgaaccccgcgagacactcgagtataaggctgctttggagttggagatgtggaaggaaatgcaagaggatatctttgagaatcaactgaaacaaaaggagctggcccatatgcaggccctggccgaagagtggaaaaaaagggaccgagagagggagagtcttgtcaaaaagaaagtcgcagaatatactatcctcgaaggaaaattacagaaaacactgatcgatcttgaaaaacgagaacagcagctggccagtgtcgaaagcgaacttcaacgcgagaaaaaagagctccagagtgagcggcagcgtaatctccaggaacttcaagattctattcgaagagccaaagaggactgcattcaccaggtcgagcttgaaaggcttaaaatcaaacaactggaggaagataagcaccgccttcagcagcaactgaatgatgcagagaacaagtacaagatactggagaaagagtttcagcaatttaaggatcagcaaaataacaagcctgaaattagattacagtctgagatcaatctcctgacattggaaaaggttgagcttgagagaaaactggagtccgcaaccaaaagtaagcttcactacaaacagcaatgggggcgtgccctcaaggaattggccaggctgaaacagcgcgagcaagaatctcaaatggcccgactgaaaaagcagcaagaggagttggagcaaatgagactcagataccttgccgcagaggaaaaggacaccgtgaagactgagagacaggagctcctggacattcgcaatgagctaaataggttgcgccagcaagagcagaagcagtatcaggactctaccgagatcgcctctggtaagaaagacggcccccatgggtccgtcttagaggaggggctggacgattacttaacccgcctgatcgaggagagagacaccctcatgcgcacaggcgtgtacaaccacgaggacaggattatcagcgaattagaccggcagatccgggaaatcctcgcgaagtctaatgcatcaaactag

SEQ ID NO: 111657 - DNA, 1143 bp, Artificial Sequence
  Description of Artificial Sequence: Synthetic coding sequence
atggtatccaaatcagaccaactgctaattgttgtttccattttggaaggtcggcactttccaaagcgccctaaacacatgctggtcgtggaggccaagtttgatggtgaacagctagccacagacccagtagatcacaccgatcagccagaattcgcaacggagctcgcgtgggaaattgaccgcaaggcgctgcaccagcatagactgcaaaggactcccattaagctgcagtgcttcgcactggacccggtaacttcagctaaggaaaccattgggtacattgtgctggatcttcggactgctcaggaaacaaagcaagcacctaagtggtatcagctactgtcaaataagtacaccaagttcaagagcgagatacagatcagtattgccctcgagacggacaccaaaccacccgtcgactccttcaaagccaagggagcccccccaagagacggtaaagtccccgctatattggctggactcgatccccgtgatattgtggccgtccttaacgaggagggcggctaccatcagatcgggcccgctgaatactgcacagacagctttatcatgtccgtgacgatagctttcgcgacacaacttgagcagctgatcccgtgcaccatgaagctacccgagaggcagcccgagttcttcttctattactcgctgctcggaaacgatgtgaccaacgagccatttaatgacctcatcaaccctaacttcgagccagaacgcgcatcagtcaggatcaggagcagtgtcgaaattctgcgcgtgtacctggcattgcaatctaaactgcaaattcacctgtgctgcggcgatcagtcgctcgggtcaactgaaattcctcttactggattgttgaagaaaggatcaaccgagataaaccagcatcccgtgaccgttgagggggccttcacgctggacccacccaatagagccaaacagaaactggcaccaatcccagtggagctggcccctaccgtcggcgtctcagtggcccttcaacgcgagggcattgacagccaagacgcattctggtacagcgctctcgatattatctttcccctctttatttttctgtttttagtcttagacgcgatcaggaagttcgccaattacgaagagaagtag

SEQ ID NO: 111658 - DNA, 3828 bp, Artificial Sequence
  Description of Artificial Sequence: Synthetic coding sequence
atgagcctggactttggatccgtggcgctacctgtccaaaacgaggacgaagagtacgacgaggaagattacgaaagagaaaaggaattacagcagctgttaaccgatctaccccacgatatgctggatgatgacctctcttcacccgagctacagtattccgactgcagcgaagacggaacagacgggcaacctcatcatcccgagcagctggagatgtcgtggaacgagcaaatgctgcctaaatcccagagcgttaacggtccttcctgtcagggtctggagccatacaataaggtaacgtacaagccatatcagagcagcgctcagaacaacggctcccccgcccaggagattaccggtagtgacaccttcgagggtttgcagcagcaatttctgggagccaatgagaatagtgctgaaaacatgcagattatacagctgcaggtgcttaataaggccaaggaacgccagttggagaacctcattgagaagctgaacgagtcagaaaggcagatcagatacctgaatcatcagctcgtgatcataaaagacgaaaaagacggtttgaccctaagccttcgggagagccagaaattattccagaatgggaaggagagagaaatccagctggaggcccaaatcaaagccctagagacacaaattcaggccctgaaagtaaacgaagagcagatgattaaaaaaagcaggaccacagagatggccttggagtcccttaagcagcagctggttgacctccatcactccgaaagcctgcagcgggctagggaacagcatgagtcgattgtgatgggtctgactaagaaatacgaggagcaggttttatctctgcagaaaaatttggacgccactgtgaccgcgctgaaagagcaggaagatatctgctcccgtttgaaagatcacgtaaagcagttggagcgcaaccaagaggccatcaaacttgaaaaaaccgaaatcatcaacaagctgacccgcagcctcgaagaatcccagaagcagtgtgcacatctgcttcaaagcggcagtgtgcaagaagtcgcccagctccagttccagctccagcaagcccagaaagctcatgccatgtctgccaatatgaacaaggcattacaagaagagcttactgagctgaaagacgagatatctttgtacgagtctgcggcgaagctcggcatccatcctagtgactcagagggcgagctgaacatcgaactcacagagagttatgtagatctgggcatcaagaaggtgaactggaagaagtccaaagtgacttcgattgtccaagaagaggacccaaacgaagaactgagtaaggatgagttcatcctgaagctaaaggctgaagtgcaacgacttctaggtagtaactccatgaagcggcatctggtctcccagctgcagaatgacctaaaggattgccacaagaaaatagaagacctccatcaggtgaagaaggatgaaaagtctatcgaagtggagaccaaaaccgacacctccgagaaacccaagaaccagctctggcccgaatcatcaacatctgacgtcgtccgcgacgacattttgcttctgaagaatgaaatccaggtgctccaacagcaaaaccaggagctgaaggagacagagggcaagctcagaaatactaaccaagacctttgcaaccagatgagacagatggtccaagactttgaccacgataaacaggaagccgtggatcgctgcgagcgcacgtatcagcagcatcacgaggccatgaagactcagataagagagtctctgttagctaagcacgcgctagagaagcagcagctctttgaggcgtacgagcggacacacctgcagctgcggagtgaactggacaaacttaacaaggaagtcaccgctgtacaggaatgttatctcgaagtgtgtcgagagaaggacaacctcgaattgaccttgaggaaaacaaccgagaaggagcagcaaacgcaagaaaaaatcaaggagaaacttattcagcagttagaaaaagagtggcagtcaaagttggaccagaccattaaagctatgaaaaagaagaccctagactgcggtagccagacagatcaagtgacaacctccgacgtgatttccaaaaaagaaatggccattatgatcgaggagcagaaatgcaccattcagcaaaacctcgagcaagaaaaagatattgccatcaagggggcaatgaagaagttggagatcgagctagaactgaagcactgcgagaacatcaccaaacaggttgagatcgcggtgcagaatgcccaccagaggtggctgggcgaacttcccgagctggcagaataccaagctctggtgaaagctgagcagaaaaagtgggaggaacagcacgaggtgtccgtaaataagcggatctcttttgccgtctctgaggccaaggagaagtggaagagcgaattagagaacatgagaaaaaacattctgcccggtaaggaactagaggaaaaaattcattctctccagaaggaattggagcttaagaacgaagaagtgcctgtagttatcagagccgaactcgcaaaggcaagaagcgaatggaataaagagaagcaagaggagattcaccgcatccaggagcagaacgagcaggattacagacagttccttgatgatcaccgtaacaaaattaatgaggtcctcgccgcagcaaaggaggacttcatgaagcagaaaactgaactactgctgcaaaaagagacagagctgcagacctgtctggatcagagtcgacgagagtggaccatgcaagaggccaaacgcatccagctagagatttatcagtatgaggaggacatcctgaccgtgctcggagtgctgttatcagacactcagaaagaacacatttcagacagcgaagataaacaactgctcgaaataatgtctacctgttccagcaaatggatgagcgttcagtatttcgagaagctcaaagggtgcattcagaaggcttttcaggacaccctgccgctcctcgtggaaaacgccgacccagagtggaagaagagaaatatggctgagctgtctaaagactccgcctcacaaggcacaggccagggcgaccctggccccgccgccggtcaccatgcccaacccctggccttacaggcaaccgaagcagaggccgacaagaagaaggttctcgaaatcaaagacttgtgctgcggccactgcttccaggaacttgagaaggctaagcaagagtgccaagacctcaaaggcaagctcgagaagtgttgcaggcatttgcaacacctcgagcgcaagcataaggccgtagttgaaaagattggcgaggaaaacaacaaggtagtggaggagcttattgaggagaataacgacatgaagaataagcttgaggagttacagactctgtgtaaaactccaccgcgatcactgagtgctggagctatagagaatgcgtgtctgccctgttccggaggcgcactagaggagttacggggccagtatataaaagctgttaagaaaattaagtgcgatatgttgcgttatattcaggaaagcaaagaacgggcagctgaaatggtgaaagccgaagtccttcgggagagacaggagactgcccgcaagatgagaaagtactatctaatatgtctccagcagatccttcaagacgatgggaaggaaggtgccgagaagaagatcatgaacgccgcgagtaaactagcaaccatggctaaactactggaaacaccgatctcctccaagtcccaaagtaagactacacagtccggaatgagcaaatag

SEQ ID NO: 111659 - DNA, 5133 bp, Artificial Sequence
  Description of Artificial Sequence: Synthetic coding sequence
atgagtctggattttggttccgtcgctttgccggtgcagaacgaggatgaggagtacgatgaggaggattatgagcgagagaaggaactccaacagctcttaactgatctgccacacgatatgctagacgacgatctgtcgtcacctgaactgcaatacagtgactgtagcgaagatggcacagatggacagccgcaccacccagaacaattggaaatgagttggaatgagcagatgctcccaaagtcccaaagcgtgaacggctacaatgagattcaatctctgtacgccggggagaaatgtggaaacgtctgggaagaaaatcgaagcaaaacagaagacagacaccccgtgtatcatcccgaagaaggcggggacgagggcggttccggttactcaccaccctcaaagtgtgaacaaaccgatctgtatcatctgcctgaaaattttcggccttataccaatggtcagaaacaggaattcaataaccaagcgaccaacgtaatcaagttcagtgatccccagtggaaccacttccagggaccatcgtgccaggggctcgagccttacaataaagtgacctacaagccctaccagagctcagcacagaataacggctctcccgcccaggaaattactgggtccgataccttcgagggtttgcaacagcaattcctgggcgctaatgaaaatagcgccgagaatatgcagattatacagttgcaggtgcttaacaaagcgaaagagagacaactggagaacctcattgaaaagctaaatgaatccgagaggcagataaggtaccttaaccaccaattggtcattattaaggacgagaaagacgggctgacccttagtctccgggagtcccagaagttatttcagaacggcaaagagcgcgagatacagttggaggcacaaattaaggcacttgagactcagattcaagcccttaaggtgaatgaggagcagatgataaagaaatcccggactaccgagatggccctcgaatctctgaaacagcagttagtcgacctgcaccacagtgagagcctccagcgtgcccgcgagcagcacgaatccatagtgatgggattaacaaagaagtatgaggaacaggtcctgtccctgcagaaaaatctggacgcgaccgttaccgccctcaaggaacaggaagatatatgttctagactcaaagaccacgtgaaacagcttgaacggaaccaagaggcgatcaagctggagaagacagagatcattaacaaattgacacgaagcttggaagaatcccagaagcagtgcgcccatctgcttcagtctggaagtgtccaagaggttgctcagctgcaatttcagctgcagcaggctcagaaagcacatgccatgtccgctaacatgaataaagctcttcaagaagagctcaccgagctgaaggacgaaattagtctctatgagagcgctgctaagctgggaattcatccatccgactctgagggggagctgaacatagaactaaccgagtcatatgtcgacctggggatcaagaaagtcaattggaaaaaaagtaaggttacatcgatcgtccaggaggaggaccccaacgaagagttgtcgaaagatgagtttatcctgaaattgaaggccgaagtccagcgacttctggggtccaattcaatgaagcggcatctcgtctcccagcttcagaacgacctcaaggattgccataagaagattgaggacctgcaccaggttaaaaaagacgaaaagtcaattgaggttgagaccaagacggatacaagcgagaagcccaaaaatcaactctggcccgagagctcaacatctgatgtcgtgagagatgacatactgctcttgaagaatgaaatccaagtgctccagcagcagaatcaagagctcaaggaaacagagggtaaactgcggaatacgaatcaggacctgtgtaatcagatgagacaaatggtccaggatttcgatcacgacaagcaggaggccgtcgacaggtgcgagcgaacttaccaacagcatcatgaggcgatgaagacacagatcagggagagtctgctggccaagcatgctctagagaaacagcagctgtttgaagcatacgaacgaactcacctgcagctcagatccgaactggataaattgaataaagaggttacggctgttcaagagtgctacctcgaagtgtgtagggaaaaagacaacctggaacttacactgaggaaaactaccgaaaaagaacagcagacacaggagaagataaaggagaaattaattcagcagctggaaaaggagtggcaatcaaagttagatcagacaattaaggcaatgaaaaagaaaactctggattgtggctcgcagaccgaccaagttacgacatcagatgtcatcagcaagaaagagatggccattatgatcgaagagcagaagtgtaccattcagcaaaacctcgaacaagagaaggacattgcgatcaaaggcgccatgaagaaactggagatagagctcgaattaaagcattgcgaaaacataaccaagcaagtggagatagctgtgcagaacgcgcaccaacgctggctcggcgagcttcccgagcttgccgaataccaggcactggttaaagctgaacagaaaaagtgggaggagcagcacgaagtcagcgttaacaagagaatcagcttcgccgtctctgaagccaaagagaagtggaagtcagagctggagaatatgcggaaaaacatattgcctgggaaggagcttgaggagaaaatccactctcttcagaaggaattagagctgaagaacgaggaggtccccgtggtcatcagagccgagctggccaaggcgaggtctgagtggaataaggaaaaacaggaagaaattcatcgaatccaggagcaaaacgagcaggattaccgccaattcttggatgaccaccgcaacaagattaatgaagttctggcagccgccaaggaagacttcatgaagcagaaaacagagctcctgctgcagaaggagaccgaactgcagacttgtctggatcaaagcaggcgagaatggactatgcaagaggctaagaggatacagttggaaatttaccaatatgaagaggatattttaactgtgttgggtgttctcctatctgacacccagaaggaacacattagtgatagcgaagataagcagcttcttgaaattatgtctacatgttcatctaaatggatgtccgtgcaatactttgagaagctgaagggctgtatacagaaggcgtttcaggatacactgccgctcctggttgaaaatgccgacccagagtggaagaagaggaacatggccgaactgtcaaaggattctgcctcgcagggtacaggtcaaggtgatcctggcccagcggcggggcaccacgcccagcccttggccctgcaggctactgaggccgaagcagacaaaaagaaagtgttggagattaaggatttgtgctgcggtcactgctttcaagagctggagaaagccaaacaggagtgccaagatctgaaaggaaaactggaaaagtgctgtaggcacttacagcacttggaaaggaagcataaggccgttgttgagaagatcggggaagaaaacaacaaggtagtggaggagctgatcgaagagaataacgacatgaaaaataaactggaggaactccaaactctctgcaaaacaccccctaggagtttgtcagctggagccattgagaatgcctgcctcccgtgctctgggggggctttagaggaactccggggacagtatatcaaggccgtgaaaaaaatcaaatgtgatatgctgaggtacatacaggagagcaaagagcgcgcagctgagatggtgaaagcagaggtccttagagaacggcaggaaactgcccggaaaatgcggaagtattatctgatttgtctgcaacagatcctccaagatgacggcaaggagggggctgagaaaaagattatgaacgctgcctccaagctagccacaatggctaaactactggagactcccattagctccaagtcacagagtaaaacaacgcaatccgccctgcctcttacgtcagaaatgctgatcgcagttaagaagtccaagcgcaacgatgtgaaccagaagataccatgctgcattgagtccaagtctaacagtgtaaacactatcacacgcactctctgcgaacaggctcccaaacgccgggcggcctgtaatctgcagcgcctactagaaaatagcgaacaccagtccatcaagcacgtaggatccaaagagactcacttagaattccagtttggcgatggaagctgtaagcatttaaattctttacctcgcaacgtttctcctgagtttgtgccttgcgaaggcgaaggaggtttcggcctccacaaaaagaaggatctcctctccgacaacggcagcgagagccttcctcactcggcagcgtacccctttctcggtacactagggaacaaaccctcccccaggtgtaccccggggccctccgagagtggctgtatgcacattaccttccgggattctaacgagcgacttggccttaaagtttataagtgcaacccgcttatggaatccgaaaatgcagccagtgagaagagccagggattggatgtccaggagccccccgtcaaggatggaggagaccttagcgactgcttgggttggccctcttccagtgctactttgagtttcgatagcagagaagcgagctttgtccacggtaggcctcagggcacccttgagatccccagtgaatccgtgaaaagcaaacagttcagtccttcaggatacttgagcgacactgaagagtcaaacatgatctgccagactatgaagtgccagcggtaccaaacaccttatctgagtgaagagacgacttatctcgaacccgggaagataagtgtgaactgcggtcacccttcaaggcataaggcagaccggctcaagtccgatttcaagaaactgagctctactctgcccagttccgtgtgtcagcagccatcccgaaagcttattgtgcccctcagtagccagcaggattctggctttgatagcccattcgtcaatttagactag

SEQ ID NO: 111660 - DNA, 4965 bp, Artificial Sequence
  Description of Artificial Sequence: Synthetic coding sequence
atgtccttggacttcggctctgtcgcactcccagtgcagaacgaagacgaggaatacgatgaagaagactatgaacgtgaaaaagagctccagcaactgttaactgaccttcctcacgatatgctggacgatgacctcagctctcctgaactccagtattctgattgcagcgaagacgggactgatggacagccccaccatcccgagcaactcgaaatgtcctggaacgaacaaatgctgccgaagtcgcaaagcgtgaatggatataacgaaattcagagcctctacgcgggcgagaagtgcggtaacgtgtgggaagaaaacaggtctaagaccgaagacagacatcccgtgtaccatcctgaggaaggtggagatgagggagggtctgggtattcccccccaagcaagtgtgagcagaccgacctgtatcatctccctgaaaactttaggccctatactaatggacagaaacaggagtttaacaaccaagcgacaaacgtaatcaaatttagcgaccctcaatggaaccacttccagggaccttcttgtcaaggcctggagccttacaacaaagttacatacaaaccttatcagtctagcgcacaaaataatggctctcctgctcaggaaatcactgggtcagatactttcgagggccttcagcaacaattcttgggggccaatgagaattccgctgagaacatgcagataatccaattacaggttctgaacaaggctaaagagcgacagttggaaaatttgattgagaaacttaacgaatctgaacgccaaattcgctacctcaaccaccagctggtcataataaaggacgaaaaagacgggttgacactctctcttcgggagtcacagaagctgttccagaacggcaaagaacgtgaaatccagctggaggcccagataaaagcgctggaaacacaaattcaggctctgaaagtgaacgaagagcagatgatcaagaaaagccgcacaactgagatggctctggagagcttaaaacaacaactcgttgatttacaccacagcgaatctcttcagagggcaagggagcagcatgagtcaattgtcatgggattgactaagaagtatgaagagcaggtgttatctctacagaaaaatctagacgcgaccgtgacagctctaaaggagcaggaggatatttgttctcgacttaaggatcacgttaagcagctggagcgaaaccaagaagcaataaagttggaaaagactgaaataatcaataagctgacccgctccttggaagaaagtcagaaacagtgtgcacatcttctgcaatccggcagtgtccaggaggtggcccagctgcagtttcaactgcagcaagcacagaaggctcatgccatgagcgctaacatgaataaggctctccaggaagagttgacagaattaaaggatgagattagtctgtatgagtcggccgcgaaactcgggatacaccctagcgactcagagggagagctgaacattgaattaacggagtcgtacgtggacctgggcatcaagaaggttaattggaaaaagtcaaaggtcactagtatagttcaggaagaggaccccaacgaagagttgtcaaaagacgaatttatccttaaacttaaggcagaggtccagcgcctcctgggctctaatagtatgaagcgccacctggtttctcagctccagaacgatcttaaggattgccataagaagatcgaagacctacaccaggtaaaaaaggacgagaaatcaatagaagtcgaaacaaagactgatactagcgagaagccaaagaaccagctgtggcctgaatcatcaaccagcgacgtggttcgggatgacatcctattgctaaagaatgagattcaggtgctgcagcagcaaaatcaggagttgaaagagacagaagggaagctccggaataccaaccaagacctctgtaaccagatgagacaaatggtccaggatttcgaccatgataaacaggaagccgtggatcgatgtgagcgtacctatcagcagcatcatgaggccatgaaaacacaaattcgcgagtctctgctggctaaacacgctctcgagaagcagcagctgttcgaggcctacgaacgcacacacctgcagttacgcagcgagctagacaaacttaacaaggaagtcactgcagtgcaggagtgctatctggaagtgtgtagggagaaagacaacctcgagctaacattgagaaaaaccaccgaaaaagagcagcagacgcaggaaaagatcaaggagaaactgatacagcagctagagaaggaatggcagtctaaactggaccagactatcaaagccatgaaaaaaaagacattagactgcggcagccaaacggaccaagtcactacatccgatgtcatctctaagaaggagatggccatcatgatcgaagagcaaaaatgtacgattcagcagaacctggagcaggaaaaagacattgccattaagggagcaatgaagaagctcgaaatcgagttagagttgaaacattgcgagaacattacgaaacaggtggaaatcgctgtgcagaacgcccaccagaggtggttgggcgaattaccagaactagccgagtatcaagctttggtgaaagccgaacagaagaagtgggaggagcagcatgaggtgagcgtaaataaacgcatcagcttcgccgtctccgaagcaaaggagaagtggaagtccgaacttgagaacatgaggaagaacattttgcccggcaaggagctggaagaaaaaatccattcccttcagaaggaactggagttgaaaaatgaggaagtgccggtggtgattcgagccgagcttgctaaagccaggagcgagtggaataaggagaagcaggaagaaattcaccgcatccaggaacagaacgagcaagactatagacagttccttgacgaccataggaataaaatcaacgaggtcctcgctgcagcaaaggaggactttatgaagcagaagacagagctgctgctccagaaagagaccgagctgcagacctgtcttgatcagtctcgtcgggagtggacgatgcaggaggcgaagcggattcagttagagatttatcagtacgaggaggacattctgacggtactgggggtgcttctgtctgacactcagaaagaacacatcagcgacagcgaagataagcagttactggaaattatgtcgacttgcagctccaaatggatgtccgtgcaatattttgagaagctgaaaggctgcatccaaaaggcctttcaagatacgctgccactgctggtggagaatgccgacccagaatggaagaaacgcaatatggccgaactgagcaaggattctgcaagccagggcactggacagggagatccagggcctgctgcagggcaccacgctcagcccctggctcttcaggctaccgaggccgaagcagaggagaacaataaagtggtcgaagaactaatcgaggaaaacaatgatatgaaaaataagctagaagagctacagacgctgtgcaaaaccccgccaaggtcactgagcgccggagccatcgagaatgcgtgccttccatgctcaggcggcgcactggaggaacttcgaggccagtacatcaaagctgtaaagaagattaagtgcgacatgctccggtacatccaagagagcaaggaacgcgcggccgaaatggttaaggccgaggtcctgcgcgagcgtcaagaaacggcacgaaagatgagaaagtattatctaatatgtctgcagcagatcctgcaggacgatggaaaagaaggcgctgagaagaagataatgaacgcagcctccaagctcgccaccatggctaagctgctggagacacccatcagctctaaaagccaaagtaagacgacccagagtgcactccctctgacaagtgaaatgctaattgctgtcaagaagtctaagcgcaacgatgtcaatcagaaaatcccttgttgtattgagtccaaatctaattctgtgaacactatcactaggacactgtgcgaacaggcacctaagcgaagggcagcgtgcaatctccagcgcctgctggagaactccgaacaccaatcaattaagcatgtcggatctaaagagacccatctcgagttccagttcggagacggatcatgtaaacacctgaattctttgccacgcaacgtgtctccagagttcgtgccttgcgagggcgagggcgggtttggcctccataagaagaaagacctgctctctgataacggcagtgagtctttgccacattctgctgcctatccctttctcggcaccctcgggaataaacccagtcccaggtgtacccctgggccgagcgagtccggctgtatgcacataacctttcgagactcgaacgagcggctgggactgaaagtgtacaagtgtaaccccctcatggagtctgaaaacgcggctagtgagaagagtcagggactggacgtgcaggaacctcctgtgaaggacgggggagatctctctgactgcctgggttggccgtcttcctcagccacactgtcctttgatagccgcgaggcaagctttgtgcacggccgccctcagggaactctagagattccatcggaatccgtgaagtcaaagcagttttcaccatccggatacctaagcgatactgaagaatctaatatgatctgccagacaatgaagtgccagaggtatcagacaccttatttgtcagaggagacaacttatctcgaaccgggaaaaatctccgtgaattgcgggcatcctagcaggcacaaagccgatagactcaagagcgatttcaaaaagctctcctctacgcttccgtccagtgtttgccagcaaccttcacgcaagctgatagttcccttgtcctctcagcaggacagcggctttgactccccatttgtcaacctggattag

SEQ ID NO: 111661 - DNA, 1779 bp, Artificial Sequence
  Description of Artificial Sequence: Synthetic coding sequence
atgtctctcgacttcggttccgtcgccttgcccgtgcagaatgaggatgaggagtacgacgaagaggattatgaacgagagaaggagctgcagcaactactgacagatctcccacatgacatgctggatgatgatttgtcaagcccagagttacagtattccgattgttcggaggatgggacggacggacaacctcatcatcccgagcagctcgaaatgtcttggaacgaacagatgctacctaagtcacagagtgttaatggttataatgagatacagtcgctttacgctggggagaagtgcgggaatgtctgggaagagaatcggtctaagacagaggacagacacccagtatatcatcccgaggaaggcggtgatgagggtgggagcgggtatagcccaccgtccaagtgtgaacagactgatctttaccatctccctgaaaatttcaggccctacactaatggccagaagcaggagtttaataaccaggctacgaatgtcataaagttcagtgacccacagtggaatcacttccagggcccctcttgtcagggcttggagccttacaacaaagtaacttataagccctaccaatcctctgcacaaaacaatggcagccccgcgcaggaaatcactggcagcgacacgtttgaaggtttgcagcagcaattcctgggagcaaatgaaaatagcgctgagaatatgcaaatcattcaactgcaggttttgaataaggctaaggagagacagctggagaaccttattgagaaactgaacgaatctgagaggcagatccggtacttgaatcaccagctggtgatcatcaaggacgaaaaagacgggctcacgctcagcctaagggagagccagaagctgttccagaacgggaaggaaagggagatccaactggaggcccaaattaaggctctcgagacccagattcaggctcttaaagtgaacgaggagcagatgatcaagaagagccggactaccgaaatggctcttgagagcctgaagcagcagcttgttgatctgcaccacagtgaatctttgcagagggctagagagcagcatgaatccattgttatgggcctgaccaagaagtatgaagagcaggtgctgagcctccaaaaaaatctggatgctaccgtcacagctctgaaggaacaggaagatatatgcagcagacttaaagatcacgtgaagcagttagagagaaatcaggaggccattaagctggagaaaaccgagataatcaacaaactgacacgcagtcttgaggaaagccaaaaacagtgtgctcaccttcttcagtcgggatccgtccaggaggtagcacagctgcagttccaactgcaacaggcacaaaaagcacacgccatgtctgccaacatgaataaggcactccaagaagagttgacagagttgaaggatgagatctcgctgtatgagtctgcggctaaactgggcatccacccctccgatagcgaaggggaactcaatattgagcttacagagtcttatgtggatctcggaattaaaaaggtgaactggaagaaatcaaaagtgacgagcatcgtgcaggaggaggacccgaacgaagagctgtccaaagacgagttcattctgaagctcaaggccgaggtgcaaagactcctggggagcaatagtatgaagcgccacctggtcagccagctacagaatgatctgaaagactgtcacaaaaagattgaggacctccaccaggtgaagaagaagaaaaaaaagaaaaagtag

SEQ ID NO: 111662 - DNA, 207 bp, Artificial Sequence
  Description of Artificial Sequence: Synthetic coding sequence
atgtcgctcgactttggaagcgtggccttgcccgtccagaacgaggatgaggagtacgacgaggaagactacgagagagagaaggagctccagcagcttttaacagatctccctcacgacatgttggatgatgacctctcttcgccggaactgcagtatagtgactgttccgaagatggcaccgacggccaaccgcaccacccctag

SEQ ID NO: 111663 - DNA, 4755 bp, Artificial Sequence
  Description of Artificial Sequence: Synthetic coding sequence
atgagcctgacatcctggtttcttgttagttccggcggaacacgtcacagacttccacgggaaatgatcttcgtcggtcgtgacgattgcgagctcatgctccagagcagaagcgtcgataaacaacatgccgtgataaattatgatgcaagcactgatgagcatctcgtgaaagatttaggaagtctgaacggtacctttgtaaatgatgtgcgtataccggagcagacatacataacgctcaagctcgaagataaactcagatttggctatgataccaatctgttcacagtggtccagggagagatgagggtgcctgaggaagctctgaagcatgagaaatttacaatccaattgcaactgtctcagaaaagttcagaaagcgagctgagtaaatccgccagcgctaaatcaattgactctaaagtggctgatgccgccacagaggtccagcataaaacgacagaggccctaaagagcgaggagaaagctatggatataagcgcaatgcctcggggtacaccgctgtatggacagccaagttggtggggcgacgacgaggtggatgaaaaacgcgctttcaagacaaatggcaagcccgaggagaagaaccacgaggcgggcacctctggctgcgggatcgacgccaagcaggtggaagaacaatctgccgccgcgaatgaggaagttctctttcctttctgccgcgagccttcttacttcgagatacctactaaggagtttcagcagcctagccagataaccgagtctaccattcatgagatacctactaaggatacaccatcatcacacattaccggagcgggccatgccagctttaccatagagtttgacgactctacgcctgggaaggttacgattcgcgatcacgtaactaaatttacctcagaccagcggcataagagtaaaaaatccagcccagggacccaggacttgttaggaattcagacgggcatgatggcaccagagaataaggtagcagattggcttgctcagaataacccgcctcaaatgctttgggagcgtacagaggaggactcaaaatcaatcaaatccgacgtccccgtatacctgaagcgtctgaaggggaataagcatgatgatggcacacaaagcgattctgagaatgctggtgcccatcgcaggtgctctaagcgggccacacttgaggagcatcttagacggcaccatagcgagcataagaagctgcagaaggtgcaggcgactgagaagcaccaggaccaggcagtgaccagttccgctcaccaccggggcggacacggcgttccccacggaaagctgcttaagcagaaatccgaggaaccgagcgtctccatcccctttctccagacggccctgctgcgctcaagcggcagtctcggccacagaccgtcccaggaaatggacaagatgctgaagaaccaggctacaagcgctacatctgagaaggataatgatgatgatcagagtgataaggggacatacacgattgagctggagaaccctaattccgaggaggtggaggccaggaagatgatagataaggtcttcggcgttgatgacaatcaggattataacaggcctgtcattaacgaaaaacataaggacctcatcaaggactgggccctgtcatctgcggccgcggttatggaagaaagaaagcctctgaccacctcaggcttccaccacagcgaggagggaacaagctcttctgggagtaaaagatgggtgtcccagtgggcttcactggccgccaaccatacaaggcatgatcaggaagagagaataatggaattcagtgctccgctgccccttgagaacgaaaccgagatctctgaaagcggtatgactgtacggtcgactgggtccgccacatcactcgcctcccagggagagaggcgacggcgcaccctgcctcagcttccaaacgaagagaagtccctggaaagccatcgtgcgaaagtcgtgacgcagcgcagtgaaatcggagaaaaacaggatactgaactgcaggagaaggaaacccctactcaggtctaccagaaggataagcaggatgctgacaggccgttatccaaaatgaaccgcgcagttaacggcgaaactctcaagacgggcggagataataaaactctcctgcatctggggtcctcagccccgggaaaggagaagtccgaaaccgataaggagacctctctcgtcaaacaaacccttgcgaaactccagcagcaggagcagcgggaggaggcccagtggacaccgaccaaactgtcttcaaaaaatgtgtctggtcagaccgacaaatgtagagaggagaccttcaagcaagagagccagcccccagaaaaaaatagtggacattctactagtaaaggagatagggtggcgcagagcgagtctaaaagacgaaaggctgaggaaatcctgaaatcccagacacccaagggcggtgataaaaaggagagttccaaatcacttgtgcggcagggatcttttactattgaaaaaccctcgccaaacatccctattgagcttattccgcatatcaacaaacaaaccagctctaccccatccagtcttgcgcttaccagcgcttccagaatccgcgaaagatcagaaagtctggaccctgacagctccatggacactaccctgatactgaaggatactgaagccgtaatggccttcctggaagccaagttacgcgaagataataaaactgatgagggcccagatacaccatcctacaatcgagataactctatctcccctgaatccgacgtagacaccgcgagtaccatatctttagtcaccggagagaccgaaagaaagtccacccagaagagaaaatcatttacctctctgtacaaggataggtgttccactggcagtccgtctaaggacgtcacaaagagcagctcatcgggcgcgagagagaaaatggagaagaagacaaagtctagatctaccgatgtggggtctcgcgcagacggccgcaagtttgtgcaatccagtggccgcatacggcagccttcagtcgacttgacagatgatgatcagacaagctcagtgccccacagtgcaataagtgatattatgtcttctgaccaggagacctattcatgtaagcctcatggacgcaccccattgacgtccgcagacgagcatgttcactcaaaattggagggcagtaaggtgaccaaaagtaaaacatcacctgtggtcagcgggtcctcttccaagtcaaccacactccctagaccccggcctacgcgcacatccctgcttaggagagccaggcttggcgaagcttctgactccgagctggccgacgccgacaaagcatccgtggcatccgaagtctcgacaaccagtagcacctcgaaaccaccaaccggtagacgaaacatttcccgcattgatctgctggcccagcctcggcgcactcgtctcggcagtttgtccgcaaggtccgacagtgaagcaacaatctccagaagtagcgccagttccagaacagcagaggcaattatcagaagcggcgctcgacttgtcccaagcgacaaattttccccccgcattcgtgctaattcgatctcccggctgtccgatagtaaagtgaaatccatgactagcgcacatggtagcgcctccgtgaattcgcggtggcgcagatttcccaccgattacgcctccacttcagaggacgaattcggctccaatagaaatagtccgaagcatactagactgcgaacatcccctgctctgaagacgacgcgcctgcagagtgccggctccgcaatgcctacatccagtagcttcaagcaccgaattaaggagcaggaggactacataagggactggacggcacatcgggaggagatcgcccggatctctcaggaccttgcactgatcgcccgagagataaacgatgttgcaggcgagatcgactccgtaacatcttctggcacagcgccatctacaactgtgtctaccgcagcaaccacgccaggctctgctatcgacactcgggaagagttagtggaccgggtcttcgacgaatctttaaattttagaaagatacctccattggtgcactccaaaacacccgaggggaataatgggcgctctggcgatccccgcccacaggcagccgagcctcctgaccacttgacgattacacgaaggcggacatggtctcgggacgaggtgatgggcgacaatttactgctgtcttccgtgttccagttctcaaaaaaaattaggcagtctattgacaaaacagctgggaaaatccggatcctgttcaaagacaaagacaggaactgggatgatattgaaagcaagctcagagctgagtccgaggtacccatagtgaagacctcatcgatggagatcagctcgattctgcaagaactcaagagggtggaaaagcagctgcaagcgatcaacgccatgatcgatccagacggcactctcgaagctttgaataatatgggtttcccctcagctatgctcccatctccaccaaagcagaagtcctctcccgtgaacaatcaccattcccccggacagacaccgactctcgggcagccggaggctagggccctgcatcccgccgccgtgtctgcagccgccgagtttgagaacgcggagagcgaggctgacttttccatccacttcaacagatttaaccccgacggtgaagaagaagatgttactgtccaggagtag

SEQ ID NO: 111664 - DNA, 4383 bp, Artificial Sequence
  Description of Artificial Sequence: Synthetic coding sequence
atgtctctcacaagctggtttctggtgtcgtcaggcggaacccggcatagactgccacgagagatgatatttgtaggccgggacgattgtgaacttatgctgcagtcaaggtcagtggataagcaacatgctgtgatcaactacgatgcgtccacggacgaacatctggtgaaagatttaggctctttgaacgggacattcgtcaacgatgtcagaatcccagaacagacatacatcacactcaaactggaagataagctccgcttcggatacgacaccaatttatttaccgtggtccagggagagatgagagtgcctgaggaagcgctcaaacatgagaaatttaccatccagcttcagttatcccaaaaatcctccgagtccgaactctctaaaagtgcgtccgcgaagagcattgactccaaggtggctgacgcagcaactgaagtacagcacaaaacaaccgaagcactgaagtccgaagagaaagccatggacataagcgctatgccccgggggacaccactatatgggcaacctagctggtggggggacgatgaggttgatgaaaagcgcgccttcaagacaaatggaaagcctgaagaaaaaaaccacgaggccggcacctccggctgtggtattgacgccaagcaggtcgaagaacagtccgctgcagccaatgaggaggtgctcttccctttctgccgggaacctagttactttgaaattcctaccaaggaattccagcagccttcacagataactgaaagtaccattcatgagatcccaacaaaagacacaccttcaagccatatcactggcgccgggcatgcctctttcaccatagagttcgatgacagcacaccaggaaaggtcactattcgggatcacgtgacaaagttcactagtgaccagagacacaaaagtaagaagtcttctcccggcactcaggacctgttgggcatccagacagggatgatggcgccagagaataaagtggccgactggctggcgcagaataacccaccacagatgctgtgggaaaggaccgaggaagacagtaaatccattaagtctgacgtgcctgtttacctgaaaaggctgaagggcaacaagcacgacgacggcactcagtcagactcagaaaatgcaggggcgcacagaagatgcagtaaaagggctacattggaggaacatctgcgacggcaccactctgaacacaagaagttgcagaaggtgcaagccactgagaagcaccaggatcaagccgtcgtgttcggggtcgacgacaaccaggattataatcgcccggtgatcaacgaaaagcacaaggacctgatcaaggactgggcgctgagtagtgccgcagctgtgatggaggagagaaagccactgaccacctcgggatttcaccactctgaagaaggaacctcttcaagtggctctaagcgatgggtgtcacagtgggccagcttggccgccaaccacactaggcacgaccaggaggagcggattatggagttttcagctcctcttcctttagaaaatgagaccgaaattagcgagtcgggcatgacggtacgcagcactgggtctgccactagtctggccagccagggagaaagaaggagacgcaccctcccccagctacccaacgaagagaaatccttggagagccatcgagcgaaggtggtcactcagaggagcgaaataggagagaagcaggataccgaactccaagaaaaagaaactccgacacaggtgtatcaaaaagataaacaggatgccgatcggcctctgtctaaaatgaaccgggccgtgaatggcgaaactttaaagacaggcggcgataataaaaccctcctgcaccttggctcctctgctcccggtaaggaaaaatccgaaacagacaaagagacttccctcgtgaagcagactctcgcgaaactgcagcagcaggagcagagggaagaagcgcagtggaccccaacaaagcttagctcaaagaatgtctccgggcagactgacaaatgtagggaggaaaccttcaagcaggaaagtcaaccgcccgagaagaactcggggcactcaacttcgaagggcgatagggtagctcagagtgagtccaagcgcaggaaggcagaagaaatacttaaatcacagacccccaaggggggggacaaaaaggagtcttctaagtcactggtgagacagggttcattcacgatagagaaaccttcgcctaacatccctattgaacttatcccgcacataaataagcagacttcctcaacaccgtcttccctcgcgctgacctctgctagccgcattcgggagagatcagagagcctcgatcccgatagttctatggacacgacgctcatcttaaaagacaccgaagccgtaatggcattcctggaagctaaattaagagaggataacaagactgatgagggtccggacacaccttcttataatcgagataattccatctctcctgaatcggacgtagatactgcttcaaccattagtctggtgaccggcgagactgaacgcaaatctacccagaagcgcaagtcttttacctctctgtataaagataggtgttcgacagggtcacctagtaaggacgtgaccaaatccagtagtagtggtgcccgcgagaagatggagaagaaaaccaaatcccgctccacagacgtgggtagtcgtgcagatggcaggaagttcgtgcagtctagtgggcggattcgccagccgtccgtggatctaacagacgatgatcagacttcctctgtgcctcactccgctatctccgacatcatgtcctctgaccaggaaacatatagttgtaagccgcacggaagaactccgctgacaagcgcagacgagcacgtccattcaaaactggaagggagcaaagtgacaaagagtaaaacttctcccgtggtcagtggttctagctcaaagagtaccaccttaccccgaccacgccccacaaggaccagcctccttcgccgggccaggctcggggaggcatctgatagtgagctggcagatgctgataaggcctccgtcgccagtgaagttagcacaacttcgtccacctctaagccaccaacaggacgtcgaaacatatctagaatcgatcttctggcccagccacgcagaactagactggggagtctttcagcgcgcagtgactccgaggctacgatatctagaagctcagcaagttccaggaccgctgaggccattattcgctcaggcgctcgactcgtaccctccgataaattttccccacggatcagagcaaacagcatctctcggctctcggattctaaggtcaagtctatgacatcagcccacggctctgcatccgccttgaaaaccacgagactgcagtcagcagggagtgcaatgccaactagctcatcgtttaagcacaggattaaggaacaagaggactacatccgggattggaccgctcaccgcgaggagattgcccgaatcagccaggacttggctctgatcgcaagggaaataaacgatgttgccggcgagattgattcagtgacctcatctggaaccgccccttctacaactgtgagcacagcagcgactacccccgggagtgccatagatacacgagaagaggtgggcgatctgcacggtgagatgcataaactcgtcgaccgcgtgttcgatgagtcactaaacttcaggaaaattcctccactggtccacagtaagacacccgagggcaataatgggcggtctggagacccaagaccacaggcagccgaaccacccgaccaccttaccatcacacggaggagaacatggtctcgcgatgaggttatgggagataatcttttgctgagctcggtgttccaattctctaaaaagattcgccagagcatcgacaaaaccgccggaaaaattcgaatcttgtttaaggacaaagaccgcaattgggacgatatagagagtaaactgcgcgcagaatcagaggtgcccatagtcaagacctcaagcatggaaatctcctccatactacaggaactcaagcgagtcgagaagcagcttcaggccataaatgctatgatagaccctgatggcaccctggaagccttgaacaacatgggcttcccatccgcaatgctccctagccctcccaaacagaagagctcacctgtgaataaccaccacagccccggccagacgccgaccttaggccaaccagaagctcgcgccctgcacccagccgcagtgtccgcagctgccgaatttgagaacgccgaaagcgaggcagacttctctatccatttcaacaggtttaacccagacggagaggaggaggatgtcaccgtacaggagtag

SEQ ID NO: 111665 - DNA, 4461 bp, Artificial Sequence
  Description of Artificial Sequence: Synthetic coding sequence
atgagcctaacttcttggtttctggtgagctcaggcggtactaggcaccgtctgcctcgagagatgatctttgtagggcgcgacgactgcgaattaatgctccagtctagatccgtcgataagcagcacgccgtgatcaattatgatgcatcaactgacgagcatctcgtcaaggatctggggtctctgaacggaacttttgtgaatgacgtcaggatcccggaacaaacatatattaccctgaagttagaagacaagcttcggtttggttacgacacgaacctttttaccgtggtgcagggcgaaatgcgtgttccagaggaagcgctgaaacacgaaaagtttaccattcaactgcaactctctcagaaatccagcgaaagcgagctgtccaaatccgccagcgctaaatcgattgatagtaaggtggcagacgctgctaccgaagtccagcataagacaactgaagcactaaaatctgaggagaaagccatggacataagcgccatgcccagggggactcctttgtatggccaaccgtcctggtggggcgacgatgaagtggacgagaaacgtgctttcaagacaaatgggaagccagaagagaagaaccatgaggccgggacttccggctgcggaatagatgcaaagcaggtggaagagcagagcgccgcagcaaatgaagaagtcctgtttcccttctgtcgtgagcctagctacttcgaaatccctacaaaagagttccagcagccctctcagataaccgaaagcaccatccacgagatcccaactaaggacaccccatcaagccacattaccggagcaggacatgccagttttaccattgaatttgatgattccacacccggcaaagtaacaatacgtgatcatgttacaaagtttacctctgaccagcggcacaaatccaaaaaaagctcacccggaacacaggatctgctcggcatacagactggcatgatggccccagagaacaaggtggccgactggctcgcccaaaataacccaccccagatgctgtgggagcgaaccgaagaggactcgaaatctataaaatctgacgttcctgtttacttgaaaaggttgaagggcaataaacatgacgacggcactcagtcagactctgagaacgctggggctcatcggaggtgttccaaacgtgccacgctcgaggagcacctgaggaggcatcattccgagcacaaaaagttgcagaaagttcaggctactgagaaacatcaggaccaggctgtggtatttggtgttgatgataaccaagactacaatcgccctgtcatcaacgagaaacacaaggatttaattaaagactgggccctctcctctgcagcagctgttatggaagaaagaaaacctctgactaccagtggctttcaccactcggaggagggaacctcctcctcaggaagtaaaagatgggtcagccagtgggcatcgttggcagccaatcatacacgacatgaccaggaagaacggatcatggaattcagcgctcctctgccattggaaaacgagacagagatcagtgagagcggcatgaccgtcaggagcaccggctcagcaacctccttagcaagccagggagagcgcaggcggcgaaccttgcctcaacttcctaacgaggagaagtcactggagtcacacagagccaaagtggtcacccagcgttcagagattggcgaaaagcaggacacggaattacaggaaaaggagacccctacccaagtttatcagaaagataaacaagatgccgaccgaccactgtccaagatgaatcgagctgtaaatggggaaactctaaaaactggcggggataacaagacccttttgcacctggggagctccgctcccggaaaggagaaaagtgagaccgacaaggaaaccagcctggtgaagcagacacttgctaagctgcagcagcaagagcagcgggaagaagctcagtggacccctactaagctgagttcgaagaatgtttcagggcagacggataagtgccgggaagaaacatttaaacaagagagccaacctcctgagaagaactccggtcactctactagtaagggggaccgcgtagcacagtcagagagtaagaggcgtaaggcagaagagatcctcaagtcccagacccccaaggggggcgataaaaaggaaagttcaaagagtctagtcaggcaggggagctttaccattgaaaagccgagcccgaatatcccgattgagttgatccctcatattaataagcagacttccagcaccccaagctctctggctctgaccagcgccagccgcatccgagaacggtccgaaagccttgacccagatagctcaatggatactacattaattttgaaagacactgaggccgtcatggcttttcttgaggccaaactgagagaagataataagaccgacgaaggacctgacactccaagctacaatagagataactccattagccccgagtcagatgtggatacagcatcaaccattagcctggtcactggagaaaccgaacggaagagtacgcagaagaggaaaagcttcacttctctctacaaagataggtgctcaaccggctccccatccaaggacgtgacaaagtcttcctcttccggggctcgggagaaaatggaaaaaaagaccaagtcccggagtaccgacgtggggtcacgggctgacggacgcaagtttgtgcagtcatcaggcaggatacgacagccttctgtggatctcacagatgatgatcagacctcaagcgtgccccacagcgcaatatctgacatcatgagcagcgaccaagaaacttatagttgtaagccacacggccgtacgccattgaccagtgctgacgagcacgtgcacagtaagctggaaggctctaaagtcaccaagtctaagacctccccagtggtgtccggcagtagtagcaagagcaccaccctcccaagacccaggcccaccaggacatctttgctgagaagagccagacttggtgaggcaagtgacagcgagcttgcagacgcagacaaggcttccgtggcttccgaagtcagcactacctcatccacgtctaaacctccaacaggaagacggaacatttctcggatcgacctcttggcacagccccggcgtactaggctaggctccctgtccgcacggtcggatagcgaggctaccataagtaggtccagcgcttcctctcgaacagccgaggccatcatccgctctggcgctagattggtacctagtgataaatttagcccaaggatacgggccaattccattagcaggctgtcagactccaaggtcaagtctatgacgtccgcccatggcagcgcctccgtgaattcaaggtggcgccgattcccaactgactacgcaagcaccagtgaggacgaattcggatccaatagaaactcacctaaacacaccaggctacgcacttctccagcactaaagacaactaggctgcagtccgccggctccgccatgcccaccagtagtagtttcaagcacagaattaaggaacaggaagattatattcgagactggaccgcccacagggaggaaatcgcccgaatctcccaagacttagccttgatcgctcgggagatcaatgatgttgccggcgagatcgattcagtgacaagctccgggactgctcccagtaccacggtctccactgctgctaccacccccggctcagccatcgacacccgagaggaactagttgatagggtgtttgacgagagcctaaacttcagaaagatcccaccactggtgcatagtaaaacccctgagggtaacaacggccgaagcggagatcctcggccacaggctgccgagcctccagatcacttgaccattacccgcaggcgaacgtggtctcgagatgaagtgatgggggacaacctgcttttgtcttcggtgttccaattctctaaaaaaatccgtcagtctatcgataaaacagcaggcaaaatacgcattctgttcaaggataaggatagaaactgggacgatattgagagcaaactgcgcgcagagagtgaggtccccatcgtgaagactagtagcatggaaattagtagtatcctgcaggagctgaaaagagtagaaaagcagcttcaggctattaacgctatgatcgatccggacggcacgctggaggccctaaacaatatgggtttcccatcggcgatgctccccagccctcccaaacagaaatcgtcacccgtgaataatcatcattcccccgggcaaactcctaccctgggacagcccgaggccagggcccttcaccccgccgcagtgtctgctgctgccgagttcgagaacgctgagtcggaggccgatttcagcatccacttcaatagattcaaccccgatggagaggaggaagacgtgacggtacaggagtag

SEQ ID NO: 111666 - DNA, 1239 bp, Artificial Sequence
  Description of Artificial Sequence: Synthetic coding sequence
atgagagtcccggaggaggctcttaagcatgagaagttcactatccagttgcagctctcccagaagtccagcgagtcagagctgtccaagagcgcttccgcaaagtcaattgatagtaaggtcgcagacgcggcaaccgaagtgcaacataagaccaccgaggcgttgaagtcagaggagaaagccatggatatcagcgccatgcctcgcggtaccccactgtatggccagccttcctggtggggagatgacgaggtggacgagaagagagcgtttaaaactaatggcaaaccagaggaaaaaaatcatgaagccggtacaagcggctgtggtatcgatgccaaacaggtggaagaacagtctgccgctgctaacgaggaggtattgttccctttctgcagagagccctcttattttgaaattcccactaaggagtttcagcagcctagccaaatcaccgaatccaccattcatgagatcccaaccaaagatactccttccagccacatcactggggccggccacgccagtttcaccatcgagttcgacgactccactcctggcaaagttactatccgggatcacgtcaccaagttcacatctgatcaaagacataagtcaaaaaagtcatctccaggcacccaggacctgttgggtattcagaccggcatgatggctcctgagaataaagtcgctgattggctggcacagaacaatcctcctcagatgctatgggaaagaacagaggaagactctaaaagcattaaatcagatgtcccagtgtatcttaagcgtctcaagggcaacaagcatgatgacggtactcagagtgatagcgagaatgccggcgcccacagacggtgctccaaaagggccacactggaagagcatctcaggcgccaccacagcgaacataaaaagcttcagaaagttcaggctacagagaaacaccaggatcaagctgtgacctcctccgcccatcatcgcggcggccacggcgtccctcacgggaagttactcaagcagaaaagtgaagagccctccgtctccatccctttcttacagaccgccctcctccgctcatcaggctcgctgggacatcggccatcacaagagatggataaaatgttgaaaaaccaggcagactgtggatcagtggccttctgtggattcatgatattcaagctaaatctgatgattacaccattccctttcatcgatctgttctcctttttttag

SEQ ID NO: 111667 - DNA, 402 bp, Artificial Sequence
  Description of Artificial Sequence: Synthetic coding sequence
atgagcttgacaagttggtttctggtaagcagtgggggcacccggcatcgccttcctcgcgagatgatttttgtggggcgagacgactgcgagctgatgctgcaatcgaggagtgttgataaacagcacgccgttattaactacgacgcgagcactgatgaacatctggttaaggatctgggctcgctcaacggaactttcgtaaacgatgtcagaatccccgagcagacctacatcaccttaaaattagaggataagctaagattcggctacgataccaatctcttcactgtggtgcaaggtgagatgcgtgtgccagaggaggccctgaagcacgagaagttcacaattcagttgcagctgtcccagaagagcagtgaaagtgagctgagtaagagttag

SEQ ID NO: 111668 - DNA, 267 bp, Artificial Sequence
  Description of Artificial Sequence: Synthetic coding sequence
atgtctttgaccagctggtttctcgtctccagcggcggcaccagacatcggctccctagagaaatgatctttgtgggcagggacgattgcgagctgatgctgcagtcccgatccgtcgacaagcagcatgctgtgatcaactatgacgcttccaccgatgaacacctcgtgaaagatctgggaagtctgaacggcacctttgtgaatgacgtgcggatcccggaacagacatacataaccctcaagctggaggataaactacgctag

SEQ ID NO: 111669 - DNA, 336 bp, Artificial Sequence
  Description of Artificial Sequence: Synthetic coding sequence
atgagccttacgtcctggttcttagtctctagtggagggaccaggcataggctgcctagggagatgatattcgtcggacgagacgattgcgaactcatgctccagagccgcagtgtcgataaacaacatgcggtgataaactacgacgcctccaccgacgagcatctagtgaaggatctgggaagtctgaacggcactttcgtgaatgatgtgcgtatccctgaacagacatatattacactcaagctagaggataagctacggtttggttacgacaccaatttgtttaccgtggtgcagggcgaaatgagggtccctgaagaggctctcaagtag

SEQ ID NO: 111670 - DNA, 1407 bp, Artificial Sequence
  Description of Artificial Sequence: Synthetic coding sequence
atgtctagcgatcaggaaacctacagttgcaagcctcatggccgtaccccactcacatctgccgatgagcacgtacatagtaaattggaaggctcgaaagttacaaagtctaagaccagtcccgtggtaagcggctcaagctcaaaatccaccacccttccgagaccaaggcccacgagaacctctctgttgaggagagcccgactcggagaggccagtgatagcgagctggccgacgcagacaaggctagcgtcgcctctgaggtgtccaccactagctctacttccaagcctcctacggggcgaagaaatatctcgcgcatcgatctgctcgcacaacctagacgaactcgcctggggagcctatcggctcgctctgactctgaggcgaccatctccagatcgagcgcctcctccaggaccgcggaagccataatccgaagtggcgcccgcctagtgccaagtgataaattttcaccccgtatccgggctaattccatttctcggctttcagatagcaaagtaaagtccatgacttctgcgcatggatccgcttccgcgctgaaaacaacgcggctgcagtccgcgggctcagccatgccaacttccagctctttcaagcaccgcattaaggaacaggaggactacatccgggattggaccgctcaccgtgaagagattgcacgcatttctcaagacctcgccttaatcgccagggaaatcaacgacgtcgcaggagaaatcgactccgttacgtcttccggaactgccccgtccactactgtctccaccgccgctacaactccgggttccgccattgatacgcgagaagaggtcggagatttacatggagagatgcacaaattggtcgaccgggtgtttgacgagtctttgaattttcgaaaaatccccccacttgttcactccaaaactcctgagggcaataatggtcgctcgggagacccccggcctcaagcagcagagccgcccgatcacctgactattaccaggcggcgtacttggagcagggatgaagtgatgggagataatttgcttctgtctagcgtgtttcagttctcaaagaaaatcaggcagtcaattgataagacagcagggaaaatcagaattttattcaaagataaggaccgcaactgggatgatattgaatccaaattgcgtgccgagagcgaagtgcccatcgtgaagacaagctctatggaaatctcgtcgatcctgcaggaattaaagcgagtggagaaacagctgcaggccataaacgctatgatcgacccggatgggacattagaggccctgaacaacatgggttttccttcagcgatgcttcctagccccccaaagcagaaatctagccctgtcaataaccaccactctcctgctatgctgtag

SEQ ID NO: 111671 - DNA, 7161 bp, Artificial Sequence
  Description of Artificial Sequence: Synthetic coding sequence
atggaaacccggtcccccgggttaaataatatgaaaccacagtcattgcagctagttctggaagagcaggtcttagccctccaacagcagatggctgagaaccaggcagcgagctggagaaagttgaaaaacagtcaagaagcccagcaacgccaggccacattagtgcggaaactccaggctaaggtgctacaatatcgctcctggtgccaggagctagagaagcgactggaagctacaggaggaccaattccccaacggtgggagaacgttgaagaacctaacttagatgagctactggtccgcctggaggaggaacagcagaggtgcgagtctctggctgaggttaacactcagctgcgcttacacatggagaaggctgatgtcgtcaacaaggcactgagggaggacgtggaaaagctgactgtggattggtcccgtgcgcgggatgaactgatgaggaaagaatcacaatggcaaatggagcaggagtttttcaaggggtacctgaaaggggagcatggacggctgctgtccctgtggcgcgaagtcgtcacctttagaaggcacttcttggaaatgaaatctgccacagatagggatctcatggaactaaaagccgaacacgtgcgattgtcaggctctctcttgacctgctgcctgcgcctgactgtgggcgcgcaatctcgggagcctaacggttcaggtcggatggacggccgggagccagctcaattgctgctgctgctggcgaaaacccaggaactcgaaaaagaagctcatgagcggagccaagaactgattcagttgaagagtcagggcgatttggagaaggctgagctgcaggaccgggtgacagagctttctgctctccttacgcagtctcagaagcagaacgaagattacgagaaaatgataaaggccctccgcgagacagtcgagatcctcgagacaaatcacacagagctgatggaacatgaggcttcactttcaagaaacgcacaggaggagaaactgtctctccaacaggtgatcaaggacataacacaggtgatggtggaagagggagataacatcgcccagggttcagggcacgagaattcattagaattggactcttctatcttcagccagtttgactatcaagatgccgacaaggcactgacgctggtgcgtagtgtgctaacgcgccgacgccaggcggtccaagaccttcggcaacagttagctggttgtcaggaggcagtgaatctgctacagcagcagcacgatcagtgggaagaggagggtaaagccttgagacagcggcttcagaagctcacaggggaacgggataccctggccggtcagacggtagacctgcagggcgaggtggactcattgagtaaggagagggagctgctgcagaaggccagggaggagctccggcagcaattagaggtactggagcaggaagcctggcggttgcgtagggtcaatgtggaattgcaattgcagggggatagcgctcaaggccaaaaggaagagcagcaagaggagctgcacttggcagtgagggaacgcgagcgcctgcaggaaatgcttatggggctggaggccaagcagtccgagtctctgagtgagctgatcacactgcgggaagccctggaatcaagtcacttggagggggaactgctgaggcaggagcagactgaggtcaccgcagccctggctagggcagagcagtccatcgcagagcttagcagttccgagaacactctgaagactgaagttgcagatctccgtgcagcagccgtgaagttgtcggcactcaatgaggcactggcgctagataaggtcggcctgaaccagcagctcttacagctggaggaggagaaccaatccgtctgttcccgaatggaagctgcagagcaggccagaaatgcactgcaggtcgaccttgcagaagccgaaaaaagacgtgaggcgctttgggaaaagaatacccatctggaggcccagctgcaaaaggctgaagaagcgggggcagagctacaggcagacctacgggacatacaggaggagaaggaagagattcaaaaaaagctgagtgagagtcgacaccaacaagaagccgccaccacccagcttgaacagcttcaccaagaagccaagcgacaggaagaggtcttggcaagagcagtgcaggaaaaggaggccttggtgcgcgagaaggcagccctagaggtgcgcttacaggccgtcgaaagagatagacaggacttagctgaacagctacagggtctgtcctccgctaaggaactcctggaatcctctttgttcgaggcccagcagcagaactcagttattgaagtcacaaagggacaactggaggtgcagatccagacagtgactcaggccaaggaagtcattcaaggagaggtccggtgcctgaaactcgaactcgataccgagaggagccaggctgagcaggagagagacgcagctgcccggcaactggctcaagcagagcaggaggggaaaaccgctctagaacagcagaaggccgcacatgaaaaggaagttaatcaactccgtgaaaaatggatgcagcttgagacagagaaagagagggtgagcctgttagagaccctgctccagacgcagaaggagctggccgacgcctctcagcaattggagcgcttgaggcaggatatgaaggtgcagaaactgaaggaacaggaaaccaccgggatcctccagacccagctgcaggaggcacagagagaacttaaggaagctgcacggcaacatcgggacgatctggccgcactgcaggaggaatccagttccctgcttcaggataaaatggacttgcaaaagcaggtggaagatctgaagagccagctggttgctcaggatgattctcagcgcctagtagagcaggaggtacaagaaaagcttcgcgagacccaagagtataaccgtatccagaaagagctggaacgcgagaaggcatcccttacactatccctgatggagaaggagcagcggctgcttgtgcttcaggaggccgactcaatccggcaacaagagttaagcgccttgcgtcaggacatgcaggaagcacagggagagcagaaagaacttagcgcccagatggaactccttagacaggaggttaaagagaaggaagctgactttcttgcacaggaagcccagctcttggaagagctggaagcttcccacataacagagcagcagctccgagcctccctttgggctcaggaagctaaggctgcccagctgcagctaaggctgaggtcgacagagtcccaactggaggccctggccgctgagcagcagccgggcaaccaagcacaggcccaagcccagttggcgagcctgtatagcgccctgcaacaagccctcggttcggtatgtgagagtcggcctgagctgtctggcggaggggacagcgcccccagcgtttggggccttgaaccagaccaaaacggggctcggagcctctttaaacgtggaccccttttgactgcgctctccgcggaggccgtggcttctgcacttcataaacttcaccaagatctctggaaaacacagcagactcgagacgtgctccgcgatcaggtgcagaagctagaggagagactgacagacaccgaagccgagaagagccaggtccacaccgagttgcaggacctgcaacgacaactctcacaaaatcaggaagagaagagcaaatgggaaggcaaacagaatagtctggagtccgagcttatggaactgcacgaaacaatggctagcttgcaaagccgtctccgtcgagccgagctccagcggatggaggcgcagggcgaacgggagctactgcaggccgctaaggagaatttaacagcccaggtcgagcacctgcaggctgctgtggtcgaggccagagctcaggcctctgccgccgggatccttgaagaagatttacggaccgcacgatccgccctgaagctcaagaatgaggaggtggagtccgagcgcgaacgggcgcaggcgctgcaagagcagggtgaattgaaagttgcccagggtaaggccctgcaagagaatctggcactcctgacgcagaccttggcggaaagagaagaggaggtcgaaacgctgagggggcagattcaggaacttgagaagcagcgagagatgcagaaggcagccctggaattgctttcactagatctgaaaaaaagaaatcaggaggtggacctacagcaggagcagattcaggaactagagaaatgtcgaagcgtgttggagcacctcccaatggccgtccaagaaagagagcagaagctgactgtgcagagggaacagatccgagagctggaaaaggacagagagacccaacggaacgttctggagcaccagcttcttgagctcgagaaaaaggatcagatgatcgagtcccagagaggccaggttcaagacctgaagaagcagctggtcacccttgagtgcctagcactagagttggaagagaaccaccacaagatggaatgccagcaaaaattgattaaagagctggagggtcagcgcgagacacagcgggtggcgcttacacatctaacactggatttggaagagcgttcccaggaattgcaggctcagtcaagtcagattcatgatctggaatcccacagtactgtcctcgctcgagagctgcaagagcgggaccaggaggtcaagagtcagcgagaacagatcgaggagctccaacggcagaaagagcatctgacacaggatctcgagagacgagatcaggaactaatgctgcagaaggaacggatccaagtactagaggaccaaagaacaagacagaccaaaatactcgaggaagaccttgaacagatcaagctgtccctacgggaaagaggtcgggaactcactacacagcgacaactcatgcaggaacgcgccgaggagggaaaaggtccatctaaggctcagcgaggctccttggaacatatgaagttgattctacgcgacaaagagaaggaagttgaatgccaacaagagcatatacacgagcttcaggagctgaaagaccagctggagcagcagctccaaggcttgcaccgaaaggtgggcgaaacttccctgctcctgtcccagcgggagcaggagatcgttgtgcttcagcagcagcttcaagaggctagagaacaaggcgaactgaaggaacagagtttacagtcccagctcgacgaggcccagagagccctggctcagagggatcaggagctggaggccctgcagcaggagcagcagcaggcccagggacaggaagaaagagtgaaggagaaagccgacgccttgcaaggcgctttggagcaggcgcatatgaccctgaaagaacgacacggggaattgcaggaccataaagagcaagccaggcggttagaagaagaactagcagttgaggggaggagagtgcaagctctagaggaagtactgggagatttgcgggccgaaagcagagaacaggagaaagcgcttcttgctctgcaacagcagtgcgcagagcaagcccaggaacatgaggtggaaaccagggctctccaggacagttggctccaggctcaggcagtgcttaaagagagagaccaggaactggaagccttgcgcgcagagtcacagtctagccgccatcaagaggaggcagctcgggcaagggcagaagcgttgcaggaggccctcggtaaggcccacgcagctcttcagggaaaagagcagcatcttctcgagcaagccgagctttctaggagccttgaagcctcaactgctaccttgcaggcctctctggatgcctgtcaagcccactcccgccagctagaggaggctttgcggatccaggagggggaaatccaggaccaggacttgcgctaccaggaggatgtgcagcaactgcagcaggccttggcccagagagatgaagaactccggcatcagcaggagcgggaacagctcctggaaaaatccctcgctcagcgggttcaggagaacatgatccaggagaagcaaaatctcggccaggagagagaagaggaggaaattcgaggtctgcatcagagtgtgcgggaacttcaactcacactcgctcaaaaagagcaggagattcttgagctgcgagaaacccagcaaagaaacaatctggaggctctgcctcacagccataaaacaagtcctatggaagagcagagcttgaagctggattccctggagcccagactgcagagggagctagaacgactgcaggctgctctgagacagaccgaggctagagagattgaatggcgggagaaagcccaagatttagccttgtcccttgctcagaccaaggcatccgtctcatccctgcaagaggtcgcaatgttcttgcaagcttcagtgctggaaagagacagtgagcagcagcgcctgcaggacgagctggagctgacgcgcagggcccttgagaaagagcgcctccactctcccggtgcgaccagcacagctgaactgggctcgcgtggagagcagggagtgcagctgggtgaggtatcgggagtagaggccgagccgagtcctgatgggatggaaaaacagtcctggcggcagcgcctcgaacacctacagcaagccgtggcgcggcttgagatcgatcgctctcgactccagagacacaatgtgcaacttaggtcgacactagagcaggttgaacgcgaaaggaggaagctcaagagggaagcaatgagggcggcccaggccggatcactggagataagcaaggccactgctagctcccctacccagcaggacgggcgcggtcagaagaattctgatgccaagtgcgtggcagagctacagaaagaggttgtgttactccaggctcaactaaccctggagaggaagcagaagcaggattacatcactaggtcggcccaaacgagccgggagctcgccggtctgcaccactccttatctcacagcttgctggccgtggcccaggccccagaagccaccgttctagaagcagagactagacgcttagatgagtcgctgacacaaagcttgacctcgcccggtcctgtgctgctacatcccagtcccagtacaacccaagccgccagtcgctag

SEQ ID NO: 111672 - DNA, 1020 bp, Artificial Sequence
  Description of Artificial Sequence: Synthetic coding sequence
atggagactcggtccccaggccttaacaacatgaaaccacagtctctgcagcttgtgctggaagaacaggtcttagcactgcaacagcaaatggccgaaaatcaggcagcctcatggcgcaaactgaaaaatagccaggaggctcagcagcggcaagctacactcgtgcggaagctgcaggctaaggtgctacaatatagaagctggtgccaagagcttgagaaacgcctggaagccacgggcggaccgatcccccagcgctgggaaaatgtggaagaacccaacctcgatgaactgttggtgcgcctggaagaggagcagcaacgctgcgaatctctggccgaagtgaacactcagctaagattacacatggaaaaggctgacgtagtgaacaaggcgctcagggaagacgtggagaagctaactgtggattggtctcgggccagagatgagctcatgcgcaaggaatctcagtggcagatggagcaagaattcttcaagggatatttaaaaggcgagcatggtcggcttctcagcctctggcgggaggtggtaacgttccgtaggcacttcctggaaatgaaatcagcaaccgaccgcgacctcatggaattaaaggctgagcacgtgagactttctggctcattgttgacatgttgtcttaggctcacagttggagcacagagccgtgagccgaatggctcaggaaggatggacgggcgagaacccgctcaactcctgcttttgctcgctaaaacacaagagctagagaaggaggcccacgagcggagccaggagttgattcaacttaaatcccagggagatctcgagaaagccgagttgcaggatagagtgacagagctgtctgccctgctgactcaaagccagaaacagaatgaggactacgaaaagatgattaaagcactgcgtgagactgtcgagattttggtgcatgaccctctcttatggaaaggcgtggggcggggtctggtcggttcactctgtttcatggacaggtag

SEQ ID NO: 111673 - DNA, 7329 bp, Artificial Sequence
  Description of Artificial Sequence: Synthetic coding sequence
atggagacccgttctccgggcttgaacaacatgaaaccacagtccctgcaactggtactggaggaacaggtcctagcgttacaacagcagatggccgagaatcaggcggcatcatggcggaagctgaagaacagccaggaagcccagcagagacaagctaccttggtgcgaaagttgcaggccaaggtattgcaataccggagctggtgtcaagaactggagaaacgtttagaggccactggcggccctattccccaacgatgggagaacgtagaagagccgaatcttgacgagttactggtgcgtctagaagaagagcagcagaggtgtgagtcattggccgaggtgaatactcagctacggctgcatatggagaaagccgatgtggtgaataaagcacttagagaagatgtggagaaactcactgtggactggagtcgcgctagggatgagctgatgcgtaaagagtctcaatggcagatggagcaggagtttttcaaaggctacttgaagggtgaacacggtcgcctgctgtcactgtggagggaggtcgttacctttagaagacacttcctggagatgaagagcgctaccgatagggacctgatggagttaaaagctgagcacgtgcggctatccggatccctgctgacctgctgtctcaggttgactgtgggggcgcaaagcagggagcctaacggatcaggcaggatggacggtcgggagcctgctcagctgttgctactcctggccaagactcaggaacttgagaaggaagcccacgagaggagccaagagctcatccagctaaaaagtcagggagatctggaaaaagccgaactccaagaccgtgtcacagagttatctgccttactgacccaatcccagaaacagaatgaggactatgaaaagatgatcaaggccctgcgcgaaacagtggagatcctggagaccaaccatactgagctaatggaacatgaggctagcctatcgcgcaatgcccaggaggagaaattatcgttgcagcaggtgattaaggacattactcaggtgatggtggaggagggcgataatatagcacagggctcaggccatgaaaattcattggagctcgacagcagtatcttcagccaattcgactaccaagacgctgataaggccctgaccctcgtcagaagcgtactcacccggaggcgccaggccgttcaggacctccgtcagcagctcgctggctgtcaggaagctgtgaatttgctccagcagcagcacgaccagtgggaagaggagggtaaggccctgcgacaaaggctgcagaaactgactggcgagcgggacacattggcggggcagacagtcgacctccagggggaggtggacagcctctccaaggagagggagctgctgcagaaagccagagaagagctaagacagcagcttgaagtgctggaacaggaggcttggcgcttgcgcagagtgaacgtggagttgcagctgcagggtgattcggcacaaggacagaaggaggagcagcaggaagagctgcatctcgcagtgcgtgagcgagagcggctccaggaaatgcttatgggcctcgaagcgaagcagtctgagtctcttagtgagcttattacgctgcgcgaagcgctggagtctagtcatctggagggcgaactcctcaggcaagagcagaccgaagtcactgccgctttagccagggccgagcagagtattgccgagctctcgtccagtgaaaacaccctaaagactgaggtcgcagacttaagggccgccgctgtgaagttgtcagccctcaacgaggcgctcgcattagataaggtgggactgaatcagcagttattacagctcgaggaagagaatcaatcagtctgctctaggatggaggccgctgagcaagcccgcaatgccctccaggtggacttggctgaggccgaaaagaggagagaagccctctgggagaaaaacacacacctggaagcccagctgcaaaaagccgaggaagctggagctgaattgcaggctgatctgcgcgacatccaggaagagaaagaagagatacagaaaaagctgtcagagtcccgccaccaacaggaggctgctaccacccagctagaacagcttcaccaggaagctaagaggcaagaagaggtgttggccagagcagtgcaggagaaggaggcactcgtgagggaaaaagcggccctggaggtgcggttgcaggccgtcgagcgagataggcaggatctggcagagcagcttcaaggactttcatctgccaaagagctgctggaatcttcactgtttgaggctcagcaacaaaatagcgtgatcgaggtcacaaaggggcagctcgaagtccagatacagaccgtgacacaggctaaagaggttatccagggcgaggtgcgatgcctgaaactggaactcgacacggaacgctctcaagcagagcaggagcgcgacgctgccgcccgccagctcgcccaggctgagcaggagggcaagactgctttagaacagcagaaagcagcccatgagaaagaggtaaaccagcttagagaaaaatgggagaaagaaaggtcttggcatcagcaggaactggccaaagccctggaatcacttgaacgcgagaagatggaactcgaaatgaggctcaaggagcagcagaccgagatggaagccattcaggctcagcgagaggaagaaaggacgcaggccgagtccgccctctgccaaatgcaacttgaaacagagaaggagagggtgtctctcctggaaacacttcttcagacgcagaaagagttagccgacgcttcgcagcagttagagagactgcggcaggatatgaaggtccaaaagctgaaagaacaggaaaccacagggatcctgcagacccagttacaagaggctcagcgcgaacttaaagaggctgcgcgccaacacagggatgatcttgctgctttacaggaagaaagctctagcctgctgcaagataagatggacctacagaaacaagtggaagatctcaaatctcagctggtagctcaggacgacagccagcgcctcgtggagcaggaagttcaggaaaagctgcgcgagacacaagagtacaatcgcatacagaaagaattggagcgagagaaagcgagcctgacactaagcttgatggagaaggagcagcgactcctggttttgcaggaagccgacagtatccggcagcaggagctgagcgctctgcgacaggacatgcaggaggcacaaggtgagcagaaagagctctccgcccagatggaactgctacgacaggaggtgaaggagaaagaagcagatttcctggcacaggaagcccagctgcttgaggaactggaggccagtcacatcactgaacagcagttgagggccagcctatgggcccaagaagccaaggcagcccagctgcaactgagattgcggtcaactgagtcccagctggaagccctcgctgcagagcagcaaccggggaaccaggcccaagcgcaagcacagctagcgtccctctacagtgccctgcagcaggcccttgggtcagtctgcgagagtcgccccgaattgagcggggggggcgactctgctcccagcgtatggggtttggagcctgatcagaacggagcgcggtctctcttcaagcgtggcccattgctcaccgccctcagcgctgaggcagtggcgagtgccttgcataaactgcatcaagacttgtggaagacccagcaaacgcgcgatgttcttcgagaccaggtgcagaagctggaggagcgccttaccgatacagaagcagagaaatcccaagtccatacagagttgcaggacctgcagaggcaacttagtcagaatcaggaagagaaaagcaagtgggagggtaagcaaaatagcttggagagcgaattaatggaattgcacgaaacgatggcttcccttcagtcgagactgcgacgagctgaattacagcgtatggaagcacagggagagagggagctgttacaggctgctaaggaaaatctcaccgctcaggtggaacatcttcaggcagcagtggtggaggccagagcccaggcgagcgctgccggaattctggaagaggatctccgaaccgcacgatcagcattgaagctaaagaacgaggaagtggagtctgaacgtgagcgagctcaggctctgcaggagcagggcgaactgaaagttgctcaggggaaagcactgcaggaaaatctcgctctgcttacccaaacgctggctgagagggaggaagaggtggagacactccgcgggcaaatacaggaattggaaaagcagagggaaatgcagaaagcggctctagaacttctgagcctcgacctcaagaagagaaaccaggaagttgatctgcagcaggagcagatacaggagctggaaaagtgcaggtccgtgctggagcacctgcccatggcagttcaggagcgagagcagaagctgactgtgcagagagagcagatcagagagctggagaaggatcgcgaaacccagaggaacgttttggagcatcagctcttagaactggagaaaaaggaccaaatgatcgaaagccagcgcggccaggtccaagacctgaagaagcagctcgtgacgttggagtgcctggccctcgaattggaagaaaaccaccataaaatggagtgccagcagaagctaatcaaggaactcgaagggcaaagagagacacagagggttgctctgactcacttgacactggacctggaggagcggtcccaggagttgcaggcccagtctagtcagatccacgacttagagtcacattcaaccgtgttggcgagagaactgcaggaacgggatcaagaggtgaaatcccagagagagcagattgaggaactccagcgacagaaagaacacctgacccaggacttagagcgtagagaccaggagctgatgttgcagaaagagcgaattcaggttctagaggatcagcggacacggcagaccaagattctggaagaagacctcgagcagatcaagctttctctgagagaaagaggacgcgagctgaccactcaaaggcagctcatgcaggagcgagccgaagaggggaagggacccagcaaggcccagcgtggctcactggagcatatgaaactgatcctgcgagacaaggagaaagaggtggagtgccagcaggagcatatccacgagctgcaagagctaaaggaccagctggagcagcagctgcaagggctgcacaggaaagtgggggaaacttctctgttgctgagtcagcgagaacaagagatagtcgtacttcaacagcagctgcaggaagcacgagaacaaggcgaattaaaggagcaaagcctccagagtcagctcgatgaagctcagcgggccctggctcaacgtgaccaggaactcgaagcactgcagcaagagcagcagcaggctcaggggcaggaagagagggtgaaagagaaagccgacgcactgcagggggcactggagcaggcacacatgacactcaaggaacgccacggggaactgcaggaccacaaggagcaggcccgacggttagaagaggagctggcagtggagggaaggcgggttcaggccttggaggaagtgctgggggatctccgggcagagagtcgcgagcaagagaaggctctgctggcgctccagcagcagtgtgctgagcaggcccaggaacacgaagttgagactagagccttgcaggactcgtggctgcaggctcaggctgtgctgaaagagagggatcaggaattagaagcattaagagcagagagtcaatcttcaaggcaccaggaggaagcggccagggcgcgcgccgaagccctgcaggaagccttgggcaaagctcacgctgccctgcaggggaaggaacaacatctcctggagcaggctgaactgtcccgaagtctcgaagcttcgacagccacgttacaggctagcctcgatgcctgccaggcccactcccgccaactcgaggaagccttgagaattcaggaaggcgagatccaggatcaggacctgagatatcaggaggacgtacaacagctccaacaagcactcgcgcagagagacgaggagctgcgacaccagcaggagcgcgagcagctgctggagaaatctctcgctcagcgtgtgcaagagaatatgattcaggagaagcagaacctgggtcaagaacgggaggaagaggagattcgcggattgcaccagagcgtccgagaactgcagctgactctcgcccagaaagaacaggaaatacttgagcttcgagagacgcagcagagaaacaacctagaggcattgccacatagccacaaaacttcacccatggaggagcaaagtctcaaactcgactcactggaacctaggctgcagagggaattagaacggctgcaagctgcactcagacagactgaggcccgtgagattgaatggcgcgaaaaagcccaagatcttgctctctccctggcccaaaccaaagcttctgtgtcaagtctgcaagaggtcgcaatgtttctccaagcctctgtgctggagcgcgactctgagcagcagagactgcaggatgaacttgaactcacccggagagctttggagaaagaaagattacattcacctggggccacatccacagccgagttggggagcaggggggagcaaggggtccaactgggagaggtgagtggtgtggaggctgagccgtccccagacggtatggaaaagcagagctggcgccagcgcctggaacacctgcagcaggccgtggcgagactggaaatcgatcgcagccgtctgcaacggcacaacgttcagctcagatcgaccctggagcaggttgaacgcgagcgacggaagctcaaaagagaggctatgcgcgcagcccaggcagggtctctcgagatctctaaggctaccgcttcttcgccgacccagcaggacggacgcggccaaaagaatagcgacgctaaatgtgtggcagagctgcagaaggaggtggttttactgcaggcgcagctgacccttgaacgcaaacagaagcaggattatataacccggagtgctcagacatctcgggagctagccgggctccatcacagcttgagccattctcttttggctgtcgctcaagccccagaggctaccgtgctcgaggccgaaactcggcgcctggatgaatctctgacacagagcctgacctctcctggccctgtgcttctgcacccatcgcccagcacaacacaggctgcttcccgctag

SEQ ID NO: 111674 - DNA, 345 bp, Artificial Sequence
  Description of Artificial Sequence: Synthetic coding sequence
atggagacaagaagtccaggcctgaacaacatgaaacctcaaagccttcaactggtgctagaagagcaggtgctggctctgcagcagcagatggctgaaaatcaagctgccagctggagaaaactgaagaattctcaggaggctcagcagagacaagccactctagtgcgcaagcttcaggccaaagtccttcaataccgctcctggtgtcaggagcttgaaaaaaggcttgaggcaaccggcggcccgatcccccagagatgggagaatgtcgaagagcccaacttagacgagctcctggtgcgcctggaagaggaacaacagagatgcgaaagtttggcctag

SEQ ID NO: 111675 - DNA, 2055 bp, Artificial Sequence
  Description of Artificial Sequence: Synthetic coding sequence
atggaaactcgctctccaggcctgaataatatgaaacctcaatccctccagctcgtcctggaggagcaagtgctagctctgcagcaacagatggccgagaatcaagcggcaagttggcggaaactcaagaattcacaggaggcacaacagcgtcaggccacactggtgcggaaattgcaagctaaggtattacagtaccgcagttggtgtcaggagttggagaagcggctcgaggctaccgggggacctatcccacagagatgggagaatgtcgaagaacctaatctcgatgaattacttgtcagactggaggaagagcaacagcggtgtgaatcacttgctgaagttaacacacagctccgcctccacatggagaaagcggatgtggtaaataaagccctccgggaagatgtcgagaagttgactgtcgattggtccagagctcgcgacgagctgatgcgtaaggaatcacaatggcagatggaacaggaatttttcaaaggctacttgaaaggggaacacgggcggctcctgtcactgtggagagaggttgtgacatttcgaaggcatttccttgagatgaagtccgctactgaccgggatctgatggaattaaaagcggagcacgtgagattgagtggctccctgctgacatgctgcctgcggctgacagtcggcgctcagtctcgggagccaaacggcagtggcagaatggatggccgagagcccgcccagttattgctgctgttggccaagacacaagagcttgagaaggaggcccacgagcgcagccaagaactgatccagctcaagtctcagggtgacctagagaaagcggaattacaggacagggttacagagctgtccgctttgcttacccagtcccagaaacaaaatgaagactatgagaaaatgatcaaagcccttagagaaaccgtggagatactaactaatcacactgagctgatggagcacgaggcatccctttctcggaacgcccaggaagagaagcttagtctccaacaggttattaaggatatcacccaggtgatggtggaggaaggggacaacattgctcagggatcggggcacgagaactcgcttgagttggattcatcgatctttagccagttcgattaccaggacgcagacaaagcgttgacattggtgagatccgtgcttacgaggcggcgtcaggcagttcaggatctgcggcagcagcttgcagggtgccaggaggccgtgaatcttctgcagcagcaacacgaccagtgggaagaggagggaaaagcacttagacagcgactgcagaagctaaccggggagcgcgacaccctggccggacagacagtcgacctccagggagaagtcgatagtctgagtaaagaacgtgagctgctccagaaggcgagggaggaactccgccagcagcttgaagtgctcgagcaggaggcgtggagactgcggagggttaacgtcgagctccagctacagggcgacagcgctcagggacagaaagaggagcaacaagaggagctccatttggctgtgcgggagcgggaacgcttgcaagaaatgctaatgggcctcgaagctaagcagagcgagtctctgtccgagctaattaccctgagggaggcgctggagtcttctcacctggaaggcgagttgctgcgacaggagcagaccgaggtcaccgctgctctagcaagggccgaacagtcaatcgctgaactgtcaagctccgagaatacactaaagacagaggtggccgaccttcgcgcggccgctgttaaactgagtgcgttgaacgaggccttagcattagacaaggtgggcctcaatcagcagttactccagctcgaggaagagaatcagtctgtgtgtagccgaatggaggccgctgaacaggcacggaacgccttacaggtcgacctggctgaagctgagaaaagacgagaggccctctgggagaaaaacacccatctcgaggctcagctgcagaaggcagaggaggccggagctgagctacaagcagatttgagagatatttag

SEQ ID NO: 111676 - DNA, 495 bp, Artificial Sequence
  Description of Artificial Sequence: Synthetic coding sequence
atggagacaaggagtccaggtttgaataacatgaagccacagagccttcaattggtgctggaagaacaggtgctggcccttcagcagcaaatggctgagaaccaggcggcctcctggcgcaaacttaaaaactcacaagaggctcaacagcggcaggcaaccctcgtgagaaaactgcaggccaaagtgttgcagtatagatcatggtgccaggagcttgagaaaagactagaagccactggcggccctatcccgcagcgctgggaaaacgtggaagaacccaatctggacgaacttttggtgagactggaggaggagcaacagagatgtgaaagcctggctgaagtgaacacgcagctccgtctgcatatggagaaggcagatgtcgttaacaaagcgctaagagaggatgtggagaagttaacagtcgactggtccagggcacgcgatgagcttatgcgaaaggagagtcaatggcagatggaacaagagtag

SEQ ID NO: 111677 - DNA, 1617 bp, Artificial Sequence
  Description of Artificial Sequence: Synthetic coding sequence
atggaaacacgatcgcctggtctgaacaatatgaagcctcagtcattgcaacttgtgctggaggaacaggtgttagcactgcaacagcagatggccgaaaatcaagccgcatcctggagaaaactcaaaaactcacaggaggcccaacagcgccaagcgacactggttaggaagttacaggcaaaggtgctgcagtaccgaagttggtgtcaggaactcgagaaaagactcgaggcaaccggaggtcccatcccacagaggtgggagaacgttgaggaacctaacctggacgaactgctggtgaggctcgaagaagaacagcagcgttgcgaatctcttgccgaggtcaacactcagctgcggctacatatggagaaggcagatgtggttaataaagcgctgcgtgaggacgttgagaaactgacagtggactggtccagggctcgcgacgagctgatgcgcaaggagtcacagtggcaaatggaacaggaatttttcaaaggttacctcaagggggagcacgggcggctcctctccttatggcgcgaagtggttacctttcggcggcatttcctggaaatgaagagtgccaccgatagagacttaatggagttaaaggccgaacacgtgcgcctctccgggtcattactgacctgctgcctgagactgacggtaggcgcacagtcccgcgagccaaatgggtccggccgaatggatggaagggaacccgcacaattgctcctgctcctggcaaagacgcaagagttggagaaggaggcccatgagcgcagccaggagctgatccaactcaagtcacagggtgaccttgaaaaggccgagctacaggaccgggttactgagctctccgccctgctcactcagagccaaaagcaaaatgaagactacgaaaagatgataaaggccttgcgggagaccgtggagatcttggagactaatcacacggagctgatggaacacgaggccagtctctccaggaatgcacaggaggagaaacttagtctgcaacaggtgattaaagacatcacccaagtcatggtcgaagaaggggacaatattgctcagggttctggccatgaaaattcactcgaattggattcctcgattttttcacagtttgactatcaggacgcagacaaagcgctcacacttgtcagaagcgttctgacaagacgtcgccaagccgtacaagatttacgacagcagttggctgggtgtcaggaagccgtaaatctgctgcagcaacaacatgatcagtgggaggaggagggcaaggctttgagacagaggctccagaagctaaccggcgaacgggataccctcgctggccaaaccgtggacctgcagggcgaggtggacagcttaagcaaagagagggagttgttgcagaaggcccgggaggaactgaggcagcagcttgaggtgttggagcaggaggcatggcgcctcaggagggtgaacgtggaacttcagctgcaaggagacagcgcacagggacagaaggaggagcagcaggaagagcttcatctggcggtccgcgagagggaaaggctgcagtctagccagctacagtcatgtagggtcttaaagaccccttag

SEQ ID NO: 111678 - DNA, 7446 bp, Artificial Sequence
  Description of Artificial Sequence: Synthetic coding sequence
atgcctcctaatataaactggaaagagatcatgaaagtggaccccgacgatcttccacgacaggaggagctcgcagacaatttactgatttccctctccaaggtagaggtgaacgagctgaaatctgaaaagcaagaaaacgtgattcacctatttcggatcacccaaagccttatgaagatgaaggctcaggaggtggaactagctctggaagaagtggaaaaggccggtgaagaacaggcaaagtttgagaaccaactgaagactaaggttatgaagctcgagaatgaattagaaatggctcagcaaagcgcaggagggcgtgatacacggtttctccgtaatgagatatgtcagttggaaaagcagttggagcagaaagaccgcgagctggaagacatggaaaaggagctggagaaggaaaagaaagtgaacgagcagctggcactgcgcaacgaggaggccgagaatgaaaattctaaactgcggcgcgagaataaaaggctgaaaaagaaaaacgaacagctgtgtcaggatattatcgattaccagaagcagattgactctcagaaagagacacttctctcacgtagaggggaggactccgactatagatcacagttgtcaaaaaagaattatgagttgattcagtacctggatgaaattcagacactcacggaggcaaacgagaaaatcgaggtacagaaccaagagatgcgtaaaaacctggaagagagcgtgcaggagatggagaaaatgaccgacgagtacaaccgcatgaaggccattgtgcatcagactgacaatgtgattgatcaactaaagaaggagaacgaccattaccagctccaggtacaagagctaaccgatctgctcaagagcaagaatgaggaagatgaccctattatggtagccgtgaatgcaaaagtggaggagtggaagctgatcctttcgagcaaagacgatgaaatcattgagtaccagcagatgcttcataacctgcgcgaaaagctgaagaacgctcaactcgacgcagataagtctaacgtgatggcactgcagcagggtatccaggaacgtgacagtcagatcaaaatgctgaccgagcaagtggagcagtacaccaaggagatggaaaaaaatacctgcattatcgaggatctcaagaacgagctccagagaaacaagggagcctcaacgctgagccaacagacccatatgaagatacagagcacactagacatcctgaaagagaaaaccaaggaggctgaaagaaccgctgagctggcagaagctgatgcaagagaaaaagataaagagctggtcgaagccctcaagagactgaaggattatgagagcggggtgtatggcctggaggacgccgtggtggagatcaagaactgcaagaatcagattaagattcgcgatcgcgagatcgaaatactgacaaaagagatcaataagttagaattgaagatctcagatttcctggatgaaaacgaagccctccgtgaacgtgtgggcctcgaacccaagacgatgattgacctgactgaattccggaacagtaaacatctcaaacagcagcaataccgcgccgagaatcagatactactcaaagaagcatccatcgagtccttggaggaagagcgcttagacctgaagaagaaaataagacagatggcacaggagagggggaaacgaagtgccacaagtggattaaccaccgaggaccttaatctgacagagaatattagccagggcgatcgcataagcgagcggaagctagacctgttatcactgaagaatatgtccgaggctcaatccaagaatgagtttctgtctcgggagctgattgagaaggaaagagacctggaaaggtccagaaccgtgatagcaaagttccaaaacaagctaaaggagctggtagaggagaataagcaactggaggaggggatgaaagaaattctgcaggccattaaggaaatgcagaaggacccagacgtcaagggcggggagacttcccttattattcccagcctcgagcgcctagtaaacgctatcgagagcaaaaatgccgaggggatcttcgatgcaagcctccacttgaaagcccaggtcgatcagctcacaggtcgcaatgaggagttaagacaggagctgcgtgagtcacgaaaggaagctatcaactattcccagcaattggctaaagcaaacctaaaaattgaccacctggaaaaagagacctctctgctacggcagtcagaaggctcaaatgttgtgttcaagggcatcgaccttcccgatggcattgcacctagcagtgcttccataataaacagccaaaacgagtacctgatccacttgctgcaggagttggagaataaagagaaaaagcttaaaaatttggaagattcactcgaggactataacagaaaattcgccgtgatccgccatcaacaatcattactgtataaagagtacctgtctgagaaagagacctggaagactgaatccaagactattaaggaagaaaaacggaaacttgaggatcaggttcagcaggacgcaatcaaagtcaaggagtacaacaatcttctaaatgccctgcaaatggacagcgatgaaatgaaaaagattcttgccgagaactcccgaaagatcaccgtactccaggttaacgagaagagtctaattcgccagtatactaccctggtcgaattggaaaggcagctgcgtaaggagaatgaaaagcagaagaacgagctgctgagtatggaagcagaggtatgcgaaaagatcggctgcctgcagagattcaaggaaatggccatcttcaagattgcagcgctgcaaaaggtagtcgataactcggtctcactgagtgagcttgagctggccaacaaacagtacaacgaactcaccgccaaatacagagatattctccaaaaggacaatatgctagtgcagcggacaagcaatttagagcatctcgaatgcgagaatatatcactcaaagagcaagttgagtccatcaacaaagagcttgagattacaaaagaaaaactgcacacaattgaacaggcctgggagcaggaaacaaaactcggtaacgagtcaagtatggacaaggccaagaaaagtataacgaactctgatatagtgagtatcagtaagaaaattacaatgttggaaatgaaggagcttaatgaaagacaaagggctgagcactgtcagaagatgtatgagcacttgcgtacgtcccttaagcaaatggaggagcgcaacttcgagctggagaccaagttcgcagagctcaccaagataaaccttgacgcccaaaaagtcgaacaaatgcttcgcgatgagctcgccgacagtgtcagtaaagctgtttcggatgcagaccgccagcggattcttgagctcgagaaaaacgagatggagctaaaggtggaggtgtcaaagctccgcgaaatttccgatattgcccggcgacaggtggagattcttaatgcccagcagcaaagtagagacaaagaggtggaatcacttagaatgcagctgctggactatcaagcccaatctgatgagaagtcactgattgctaagctgcatcagcataatgtttccctccagctaagcgaggcgacagcactggggaagctcgagagcattacctccaaactgcagaaaatggaggcctacaatctgcgcctggagcagaagctggacgaaaaggaacaggcactgtactatgcccggctcgaaggaaggaatagggccaagcaccttcgacaaacgattcagagtctgaggaggcaatttagtggtgcccttcctctggcccagcaggaaaaatttagcaaaaccatgattcagctccagaacgataagctcaaaatcatgcaggaaatgaaaaactcccaacaggaacataggaatatggaaaataaaaccctggagatggaactgaagctcaaggggctggaggagctgatctctaccctcaaggacacgaaaggagcgcaaaaagtgatcaattggcacatgaaaatcgaggaactgcggctgcaggaactaaaactgaacagagagttagtcaaggataaggaggaaataaaatacctgaataacatcatctccgaatacgaacgaaccatatcttctctggaagaagagatcgtgcagcagaataaatttcacgaagagcggcagatggcatgggaccagagggaagtagacctagagagacagctcgatatttttgacagacagcaaaacgagatcttaaacgcagcacagaaattcgaagaagctactggctcaataccagatccatctctgccattgcctaaccagcttgagatcgcgctgcgaaaaatcaaagagaacatccgcatcattctggagacccgggccacatgtaaaagtttagaagagaagttgaaggaaaaggaatccgcgcttagactggctgaacagaatatcctctctcgcgacaaggtgatcaatgagctgcgattgagactacctgctactgcagagagggagaaacttattgctgagctaggccgcaaagagatggagcccaagtcgcatcacaccctgaaaatagcacaccagactatagccaatatgcaggccagacttaatcagaaggaggaggtgttaaagaagtaccagagactcctcgagaaggctcgggaagagcaaagggaaatcgtcaaaaagcacgaggaggatctccatatcttacaccatcgccttgaattacaagccgattcctctctgaacaaattcaaacagacagcgtgggacctaatgaaacaatctcccacgccagtgccaacgaataaacatttcatacggctggccgagatggaacagacggttgccgaacaagacgactctttgtcttccctgctggtgaagttgaaaaaggtaagtcaagacctggagcggcagcgtgagatcacggagttaaaggtgaaggaattcgagaacatcaagctgcagctgcaggaaaaccacgaagacgaagttaagaaggtgaaagctgaagttgaagacctaaagtatctgctggatcaatctcaaaaggagtcacagtgcctgaagagtgaactgcaggcccaaaaagaggcgaattcgcgcgcacccacgaccaccatgcgcaacctcgtggagcgtctgaagtcccaactggctttaaaagagaaacaacaaaaagctctgtcgagagctctgctggaactccgtgccgaaatgactgctgctgcggaagagaggatcatatccgccaccagccagaaggaggcgcacctgaacgttcaacagatcgttgatcgccacaccagggagctgaagactcaggtggaggatctaaacgagaaccttctgaagctgaaagaggctttgaagacctcaaaaaatagagagaactctttaaccgataatttgaacgatctcaacaacgagctccagaaaaagcagaaggcttataacaagatcctgagggagaaagaagaaattgatcaggagaacgatgaattaaagcggcagattaaacggctgacatctgggctacaaggcaaacccctgacggacaacaaacagtcgttgattgaagaactgcagaggaaggtgaaaaaactggagaaccagctggagggcaaggtggaagaggttgatctgaagcccatgaaagagaagaacgcaaaagaagaactgatcagatgggaggaggggaagaaatggcaagctaagatcgagggtatcagaaacaagcttaaagaaaaggaaggagaagtgtttaccctcaccaagcagttgaatacactcaaagatctgttcgctaaagccgacaaagaaaagttaacactccagagaaagctgaaaaccaccggaatgacagtcgatcaggtcctgggcatacgagcattagagtccgagaaggaattggaagagctcaagaaacgcaatctcgaccttgagaatgatatactgtacatgagagcccaccaagccctgcccagggatagtgtggtggaggacctgcatttgcaaaaccgatacttgcaagagaaactacacgctctcgaaaagcagttttcaaaggacacatatagcaagcctagtatctccggtattgaatcagacgaccactgtcagagagaacaggaattgcagaaagaaaacctgaagttgtcgagtgaaaacatcgagttgaaattccagttggaacaagccaacaaggatttgcctcgtctcaagaatcaggtaagggacctgaaagagatgtgtgaattcttgaaaaaggagaaagctgaggtgcagagaaagctggggcatgtccggggttctggccgaagtggaaagaccatccctgagttagaaaaaaccatcggcctgatgaagaaggtggtcgagaaggttcagcgggaaaacgagcagttaaaaaaagcttccggcattctgaccagcgagaagatggccaatattgaacaggagaacgaaaagcttaaagccgaactggaaaagcttaaagcccatttgggacatcagttgtctatgcactatgagtcaaaaaccaaggggaccgaaaagatcatagccgaaaatgaaaggctgaggaaggagctgaagaaagagaccgatgccgccgaaaagctgcggatcgccaaaaataacctcgaaatcctgaatgagaaaatgacagttcaattggaggagacaggcaagagactgcagttcgccgagtccaggggccctcagctcgaaggagctgattccaagtcctggaaatcaatagtggtgacccgcatgtacgaaacaaagcttaaagaactggaaaccgacattgccaagaaaaatcagtccatcacagacctcaaacagcttgtgaaggaggctacagaaagggaacaaaaagtgaacaagtataacgaggacttggagcaacagatcaaaatcctgaagcacgtccccgaaggggcagagacagagcagggtctgaagcgggaacttcaggtactgaggctggccaatcatcagctggacaaagaaaaggccgagcttatacaccagatcgaagccaacaaggaccagtctggtgccgagagtaccatccctgatgccgaccagctcaaggaaaaaattaaggatctggagacacaactgaagatgtcagatcttgagaaacaacatctgaaggaggaaattaagaagttgaaaaaggagctggagaactttgatcccagtttttttgaggaaatcgaggacttaaagtataattacaaagaagaagtgaaaaagaatatcctcttggaggagaaggtgaaaaaattgagcgaacagctgggagtcgaactgacgtcgccggttgctgcttccgaagagtttgaggatgaggaagagtcccctgtgaacttccctatttactag

SEQ ID NO: 111679 - DNA, 4620 bp, Artificial Sequence
  Description of Artificial Sequence: Synthetic coding sequence
atggccatttttaaaattgctgcactccaaaaggtggtcgacaatagcgtgtcactgagtgagctggagttggcgaataagcagtacaacgaattaactgcaaaatatcgagacattctgcagaaggataatatgcttgtccagagaacatctaatcttgaacacttggagtgcgaaaacatttccctcaaggagcaggttgagtccatcaataaagagttggagataactaaggagaagctgcatactatcgaacaggcatgggagcaggaaaccaagcttggaaatgagagcagcatggacaaagccaaaaagagtatcacaaattcagatattgtctccatttcaaagaaaattactatgctggaaatgaaggaactgaacgaacgtcagagagcggagcactgtcagaagatgtatgagcatctccgtacctcgctcaagcagatggaagagcggaattttgagcttgagactaagttcgccgaattgaccaagatcaatctggatgcacaaaaagtcgaacaaatgttgagggatgagctagcggattccgtctccaaagccgtcagtgatgctgaccgtcaaaggattctggagctggaaaagaacgagatggaactgaaagttgaggttagcaaactgcgggagatcagtgatatcgctcggcggcaggtggagatactgaacgcccagcagcagagcagagacaaggaggtcgaaagcctgcgaatgcagctgctggactatcaggctcaaagtgatgagaagagtctgatagcgaaattacaccagcacaatgtctccctgcaactttccgaagcaacggctttgggaaagttagagtccattacctccaaactgcagaagatggaggcttataacctccgcctcgagcagaagcttgatgagaaagaacaagcactctactacgcccggttggaggggcggaatcgggccaaacaccttagacagaccatccagtctctgcggaggcagttctccggcgcgctgcctcttgctcagcaggagaagttcagcaagacaatgattcaactgcagaacgacaaactgaagatcatgcaagaaatgaaaaatagtcagcaggagcatagaaacatggagaacaagacgctggaaatggaactgaagctcaaaggactggaggaactaatctctactctgaaggatactaaaggtgcacagaaagtcatcaattggcacatgaagattgaagagctcaggctgcaagagttaaagctgaatcgggaattagtgaaggataaagaggaaataaaatacttgaataatataattagcgaatatgagcgtactatttcctcactggaggaggagatagttcagcagaataagttccatgaagagcgccagatggcatgggatcaaagagaggtagacttagaaaggcagttagacattttcgacaggcagcagaatgagatcttaaatgctgcccagaaatttgaggaagccaccgggagcatccctgacccttctttacccctacccaaccagctcgaaatcgcactgcgaaagatcaaagagaacattcgaatcatccttgaaactagggctacttgtaaaagccttgaggaaaagctgaaggaaaaagaatcagcacttcggctggccgagcagaacatcctgagtcgggataaggtaattaacgagctcagactgcgcttacctgcaaccgctgagcgtgaaaagctcatcgctgaactggggcgtaaggagatggagccgaaatctcaccacaccctgaaaatcgcccaccagaccatagccaatatgcaggcccgtctcaaccagaaggaagaagtcctcaagaaataccaacggctgcttgagaaggcgagggaggagcaaagggagattgtgaagaagcatgaggaggaccttcatattctgcaccacagactggagcttcaggcagactcaagcctgaacaaattcaagcagaccgcatgggacctgatgaagcaaagccctacaccagtccctaccaataagcattttatccgcttagccgagatggagcaaaccgtggccgaacaggatgattctttgtcaagcttgttagtgaaacttaagaaagtctctcaggatctggagcgccagagagaaataaccgagctgaaagtgaaggaatttgagaacattaagctgcagctgcaggagaaccatgaagatgaagttaaaaaggtgaaagccgaagtggaagaccttaaataccttctggatcagagccaaaaggaatctcagtgcttgaagtcagaacttcaggcccaaaaggaagctaattctagagcacctactaccactatgcgcaacttggtagaacggctgaagtcccagctggccttaaaagaaaaacagcaaaaggctctgtccagggcccttctggaactcagggccgaaatgactgctgccgccgaggaaagaatcatatcggccaccagccagaaggaagcccatctcaatgttcaacaaatcgtggatcgacatacccgggaactcaagactcaggtggaggatttaaatgaaaacctgctcaagttaaaggaggcactgaaaaccagcaaaaatagggagaacagcctgacagacaacctgaacgacttgaataacgaactgcagaagaagcagaaggcatataataaaatactgcgggaaaaggaagagattgaccaggaaaatgatgaactaaagcggcagattaagaggttaacctccggactgcaagggaaacccctgacagataataaacagtctttaatcgaagaactccagcgaaaagtcaagaagctcgagaaccagcttgagggcaaggtggaggaggtggatctgaagcctatgaaagaaaagaacgccaaagaggaacttatacgttgggaagaaggtaagaaatggcaggctaagatcgaggggatccgaaacaaactgaaggagaaggagggcgaggtctttaccctcactaaacagctcaatactcttaaggaccttttcgccaaggcagataaggagaaacttaccttacagcggaagcttaagactacagggatgactgtagatcaggttttgggtattagggccctggaaagcgaaaaggaactggaagaacttaagaaaaggaatctggacctagagaatgacattctctatatgcgggctcatcaagcactgcccagggactccgtggtggaggacttgcatctgcagaataggtatctccaagagaagctgcacgctctcgagaagcaattctccaaggacacgtattctaaaccgagtatctccgggatagagagcgacgaccattgccaaagggagcaggagttacagaaggagaatctgaaactgtcatccgaaaacatcgagctgaagtttcagttggagcaggccaataaagacctaccacggctcaaaaatcaggttcgggacctgaaagaaatgtgcgagttcctaaaaaaggagaaagccgaagtgcagcggaagctcgggcacgtcagaggaagtggccgctccgggaaaacaattcctgaattggaaaaaaccatcggactgatgaaaaaagtggtggaaaaggtgcagcgcgaaaacgaacaactgaagaaggccagcgggatccttaccagcgaaaagatggccaatatagagcaggaaaacgaaaaactgaaagccgaactggagaagttaaaagcccatttgggccatcagttgagcatgcattacgagtcaaaaactaaggggaccgaaaaaatcatagccgaaaacgagcgcctgcgcaaggaattgaaaaaggagacagacgccgcagagaaactgagaatcgctaaaaacaacctggaaatcttaaacgagaagatgaccgtccagctcgaggagactggcaaacgtctgcaatttgccgagtcccgggggcctcagctggaaggcgctgattctaaaagttggaagtccatcgtggttacacggatgtatgaaacaaagttgaaggagcttgagactgatattgcaaaaaagaatcaaagtatcaccgatctgaaacaactagtgaaggaggcgaccgagcgagagcagaaggttaataaatataacgaggatctagaacagcagatcaagatcctcaagcatgtgcccgagggcgctgagacagagcagggactcaagagagagctccaggtactcagattggccaaccaccaactggataaagaaaaagctgaattaattcaccagattgaggcaaataaggaccagagcggggcagaatctacaatccctgacgctgaccagctcaaagaaaaaattaaggacttagagacccaactgaaaatgagcgatctcgaaaagcagcatttgaaagaagagatcaaaaagctgaaaaaggaactggagaatttcgatccaagttttttcgaggagattgaggaccttaagtataattacaaagaagaagtcaagaaaaatattctactggaggaaaaggtcaaaaaactttctgaacagctgggtgtcgagttaacttccccggttgcagcctctgaggagtttgaggatgaagaagaatccccagtgaatttccctatttattag

SEQ ID NO: 111680 - DNA, 2415 bp, Artificial Sequence
  Description of Artificial Sequence: Synthetic coding sequence
atgccacccaatattaactggaaggagattatgaaagtggaccctgatgatctgccgcggcaagaagagctggccgacaatctgctcatttctctgtcaaaggtcgaggttaatgagttgaagtccgaaaagcaggaaaacgtcattcacctgttcaggatcacacagtcactgatgaaaatgaaggcccaggaagtggagctcgctctggaagaagtggagaaagctggcgaagaacaggcgaagtttgagaatcagttaaagaccaaagtcatgaagctcgaaaatgaattggaaatggcgcagcagtcagccgggggtagagacacaagattcctgcgcaatgagatctgccagctggagaagcagcttgagcagaaagatagggagttagaggacatggaaaaagagctcgaaaaagagaagaaagtcaacgagcagctggcactcagaaatgaggaggccgaaaatgaaaacagtaaacttagaagggagaacaagcgtttaaaaaaaaaaaatgagcagctctgtcaggatatcattgactaccagaaacagatcgacagtcagaaggagaccctgttgtcccgacgtggtgaggatagcgattaccggtcacagcttagcaagaaaaattacgagctgatccagtacctggacgaaattcagacccttacagaggcgaacgaaaagatagaggtccagaatcaggaaatgcggaagaatctggaagagagcgtgcaggaaatggaaaagatgacagacgaatacaatcggatgaaagctattgtacaccagactgacaatgtaattgaccaacttaaaaaggagaacgatcattatcagttacaggttcaggaattgaccgatcttctcaagtccaagaatgaggaagacgatccaatcatggtcgcagtaaatgcgaaggtggaagagtggaaattaatactgtccagcaaagacgacgaaattatcgaataccagcagatgctccataacctccgggagaagctaaagaatgctcagctggacgctgacaaaagcaacgtaatggcactacaacagggaatccaggagagggactcccagatcaaaatgctcaccgaacaggtggagcagtatactaaagagatggaaaaaaacacttgcattattgaggatctcaagaacgaactgcagaggaacaagggggctagcaccctctctcagcagacccatatgaaaatccaatcgacattagacattctgaaggaaaaaactaaagaggcagaacgcacagcagagttagcagaggccgatgcgagggaaaaggataaggagctggtcgaggcgttaaagcgcctgaaggattacgagtctggggtgtacgggctggaagatgcagtcgtcgaaataaagaattgtaagaatcaaatcaaaatacgggatcgagagattgaaattctgaccaaggagatcaataagttggaactcaaaatttccgacttcctggatgagaacgaggctctcagggagcgcgttggactggaacctaagaccatgatcgacctcactgagttcaggaatagtaagcatctgaaacagcagcagtaccgcgcagagaaccaaatactcttaaaggagatcgagtctctcgaggaagagagattggatctcaaaaagaaaatcagacaaatggcacaagaaaggggcaaaaggtcagccacgtccggtttgactaccgaggatttgaatttaactgaaaacatttctcagggagaccgcatctcagaaagaaagctggatctcctgtctttaaaaaatatgtctgaagcccagagcaagaacgagttcttaagtagggagctgattgaaaaggagcgggacttggagcgcagcagaacggtcattgccaagtttcaaaacaaattaaaagagcttgtcgaggaaaataaacagctcgaggagggaatgaaagagatcctccaggccattaaggagatgcagaaggatcccgatgtgaagggaggtgagaccagcctgataatacccagccttgagcgactagtgaacgcaatcgagagtaaaaacgcagagggtatctttgatgcgtctctacatttgaaagcccaggtagaccagttgaccggacgcaatgaggaactccgccaagaacttagggagagcaggaaggaagctattaactatagccagcagctcgccaaagccaatttaaagatcgatcacctagagaaagagacctccctactccgacagtccgaaggaagcaatgtggtgttcaaaggtatcgatctgccggatggcattgccccttcttccgctagcataattaatagccagaacgaatacctcatccacttgctgcaggaactcgaaaataaggagaaggtgaaggagttcaggaggttctcctag

SEQ ID NO: 111681 - DNA, 1650 bp, Artificial Sequence
  Description of Artificial Sequence: Synthetic coding sequence
aagatggctcagcagagcgcaggcggccgcgacaccagattcctgaggaatgaaatttgccagttagagaaacaattagagcagaaggatcgggaattagaagacatggaaaaggaactcgaaaaggagaaaaaggttaatgaacagctcgctctgcggaacgaggaagctgaaaacgaaaatagcaaactccggcgggaaaacaagagattgaagaagaaaaatgagcagctatgccaggacattatcgactatcagaaacagatcgactcccagaaggagactttactctctaggagaggagaggacagcgactatcgctcgcaattgtcgaaaaagaattacgagctgatccagtatctagatgagatccaaacccttactgaggcgaacgagaaaattgaggtgcagaaccaggaaatgcgtaaaaatctcgaagaaagcgtgcaggaaatggagaagatgaccgacgaatacaatcgaatgaaagcaatcgtgcaccaaactgataacgtaattgatcagctgaagaaagaaaacgaccactatcagttgcaggtgcaggagctgaccgatctccttaagtcgaaaaatgaagaagatgaccctataatggtcgccgttaacgcaaaagtggaggaatggaaacttattttgtcctccaaggatgatgagattatagagtaccagcaaatgcttcataatctccgggagaagttgaagaacgcacagcttgacgcagacaagagtaatgttatggcccttcaacaggggatccaagagcgtgatagtcagatcaaaatgttgacagaacaagtagagcagtataccaaagagatggagaagaatacttgcattatagaggaccttaaaaatgaactgcagcggaataaaggcgcctccacgttgtcccagcagacacacatgaagatccagagcactctagatattttgaaagaaaaaaccaaagaggctgaaaggaccgcagaactcgcggaggccgatgcaagggaaaaagacaaggagctggtagaggcgttaaaaagactgaaggactacgagagtggcgtgtatggactggaggatgccgtggttgaaataaaaaactgcaaaaaccagattaaaattcgggacagggaaattgagattctcacaaaagagatcaataaactggagttgaagatctctgacttcttggacgaaaatgaagcactgcgggagcgggttggactggaacctaaaaccatgatagacctgacagagttcagaaacagcaagcacctgaaacaacagcagtacagggcagagaatcagatattgctaaaagagattgagtcgctggaagaggaaaggcttgatctgaagaagaagattcgccaaatggctcaggagagaggcaagcgaagtgccacctccggactaaccactgaggaccttaacctgactgagaatatcagccagggggacaggatttccgaacgaaagctcgacctcctctcattgaagaacatgtctgaggcccagagtaaaaatgagttcctctctcgggagctgattgagaaggagagagacctcgaacgctcccgcacagtgattgctaaatttcaaaacaaatgttatcgcattaaggagtgcagaagaaatctttag

SEQ ID NO: 111682 - DNA, 4620 bp, Artificial Sequence
  Description of Artificial Sequence: Synthetic coding sequence
atggctatcttcaagatcgctgccctgcagaaagtcgttgataatagcgtctcgctttctgagctggagctggcaaacaagcagtacaacgagcttaccgccaagtatagagacatcctgcaaaaagacaacatgctggtgcaaagaactagcaatcttgagcacttagaatgcgagaacatttctttgaaagagcaggtcgaatcaatcaataaagaactggagatcacaaaagagaagctgcatacaattgagcaggcctgggaacaggagaccaaactcggaaacgaaagctctatggacaaggctaagaaaagcatcactaattcggacattgtgtcaatcagcaaaaagattaccatgctagaaatgaaggagctaaatgaaagacagcgggctgaacactgtcagaaaatgtatgaacacctgaggaccagccttaagcaaatggaagaacggaactttgagctcgagacaaaattcgccgaactgactaagataaacctggatgctcagaaagtcgaacaaatgctgagagacgaactagccgactcggtttcaaaggccgtgtccgacgccgacaggcagcgtatccttgagttagaaaaaaatgagatggaactcaaagtggaggtatctaagctgagggaaatcagtgatattgcaaggcgccaagtagaaatcctgaatgcccagcagcagtctagagataaagaagtagagagtctcagaatgcaactgctggactaccaggctcagagcgatgagaagtctctgattgccaagctgcaccaacataacgtttcgctgcagctgtctgaggcaactgcactgggcaaactggaatctatcacaagcaaattgcagaagatggaggcatataacctaaggctagagcaaaaactggatgaaaaggagcaggctctatattacgcccggctggaagggagaaacagggctaagcatctgcgccaaactatccagtcccttcgccgtcaatttagcggggctctgccattggcacagcaggagaagttttcaaaaaccatgatccaattacaaaatgataaactgaagatcatgcaggagatgaaaaacagccaacaggagcatcggaacatggagaacaagactctggagatggagctgaaactgaaggggctggaggaactgatatcaactttgaaagacactaaaggtgcccagaaggttattaactggcacatgaagatagaagagttgcgactgcaggagctgaagcttaatcgcgaactggtgaaagacaaagaggagattaagtacctgaataacataatctctgaatacgagcggaccatctcctccctggaggaggagattgtccagcagaacaagtttcacgaggagcggcagatggcctgggaccagcgcgaggttgacctcgagcggcaacttgacatttttgaccgtcaacaaaacgagatcctgaacgctgcacagaaatttgaagaagcaaccggaagcatcccggatcccagcctccccctgcctaatcagctcgagattgccctgaggaagatcaaagaaaacatccgcatcatactcgagaccagagctacttgcaagagcctagaagagaaactcaaggaaaaagagagtgctttgcgcttggccgagcagaacatcttatctcgtgataaggttatcaatgaactgcgcctgaggcttcccgctaccgctgaacgcgagaagctgattgctgaattagggcggaaggagatggaaccgaagagtcatcatacgcttaagatcgcgcaccagacaatcgccaatatgcaggcccgcctgaatcaaaaggaggaagtgctcaagaaataccaacgtctgctggaaaaagcaagagaagagcagagagaaatagtaaaaaagcacgaggaggacctccatatcctccatcatagacttgagctgcaggccgatagttccctcaacaagtttaaacagacagcatgggaccttatgaaacagtctccgactcccgtgccaactaacaagcactttattcgactggcagagatggaacagacagtggccgaacaggacgattctctgtcttccctgctcgtgaaattgaagaaggttagtcaggatttggagcgccagcgagaaatcacagaactgaaagttaaggagtttgaaaatatcaaactccagctgcaggagaaccacgaggacgaagtcaagaaggttaaggccgaggtcgaggacctcaagtatctccttgaccaaagtcagaaggaatcccaatgccttaagtccgagctgcaggcacagaaagaggccaacagcagagctcccactacaacaatgcgaaatttagtcgaacggctcaagagtcaattggccttgaaagaaaaacagcagaaggctttgtcacgcgcacttctggagctgcgcgctgagatgactgcagctgccgaggagcggattattagcgctaccagccagaaagaagctcacttgaacgtccagcagatcgtcgataggcacaccagggagctgaagactcaggtggaagacctgaacgagaacctcctgaagctcaaggaggctctgaagacgtctaagaatagagagaatagcctgacggacaatcttaacgacctgaacaacgaactccagaagaaacagaaagcgtataataagatcctgagagaaaaagaggaaatcgatcaggagaacgacgagctgaaacggcagatcaaacggctcacctcgggccttcagggcaaaccgcttactgataacaagcagtctctgatagaagagctgcaaagaaaggtaaaaaagttggaaaatcagctcgagggtaaggtggaggaggttgatctgaagcccatgaaggaaaaaaatgccaaggaagagctgattcgctgggaggagggcaagaagtggcaggctaagattgagggcatcagaaataaactcaaggagaaagaaggggaagtcttcacactgacgaagcagctgaacactttgaaagacctgttcgccaaggcagacaaagaaaagctgactctccagagaaaattgaagacaactggcatgacagttgaccaggttcttggcattcgggctctggagtcagaaaaggagttggaggagctgaagaagcgtaacctggacttggagaacgacattctgtacatgcgggctcaccaagctctccccagggattcagtagttgaggacttgcacctgcagaaccgctacctgcaggaaaagctgcacgcgctggagaaacagttttcgaaagacacatatagtaaaccctccatctccggaattgagagcgacgaccattgccagcgggaacaggagttgcagaaggaaaatcttaaactgagctctgaaaacattgagctcaagttccagctcgaacaggccaacaaggacctgcctcgcttaaagaatcaggtgagagatctcaaagaaatgtgtgaatttctgaagaaagaaaaagctgaggtccagcgtaagctggggcacgtgagaggatccggccgctcgggaaagactatccctgaacttgagaagactatcgggttaatgaagaaagtggtggagaaggttcagagggaaaacgagcaacttaaaaaagcatccgggatcctgactagcgagaaaatggcaaacatcgaacaagagaatgagaaactgaaggcggagctcgaaaaactcaaggcccatctggggcaccagctgagcatgcattacgagtctaagaccaaaggcacagaaaagatcatagccgaaaacgaacgcctgcggaaagagctcaaaaaagaaacggacgcagctgaaaaactaagaattgccaaaaacaatctagagatattgaatgaaaagatgaccgtgcaactggaggagaccggcaaacgtcttcaattcgcagagtcacgaggcccccagctagagggagcagattccaaatcttggaaaagtatagtggttacccgcatgtacgaaacgaaactgaaggaattagaaactgacattgccaaaaaaaatcagtccatcactgatctgaaacagctggtcaaagaggcaacggaacgggaacagaaagtcaacaagtataacgaagacttagaacagcagatcaagatcctgaaacatgttcctgaaggcgctgaaaccgaacaagggcttaaacgtgaacttcaggttctgcggctggctaaccatcaactcgacaaggagaaagctgagctcatccatcagattgaagccaacaaagatcaaagcggagctgaatctacaattcctgatgccgatcagttaaaggaaaagatcaaggatttagaaacccagctgaagatgtcagatctagagaagcagcacctgaaagaagaaatcaagaagctgaagaaagaactagaaaacttcgatccctctttttttgaagagattgaagacttgaagtataattacaaagaggaagtcaagaagaatatcctcctggaggaaaaggtgaagaagctgtctgaacaattgggcgtggagttgacatcaccagtggctgccagtgaagagttcgaggatgaggaagaaagcccagtgaattttcccatctactag

SEQ ID NO: 111683 - DNA, 7440 bp, Artificial Sequence
  Description of Artificial Sequence: Synthetic coding sequence
atgcctccaaacattaattggaaagaaataatgaaagtggaccccgatgatctgcctaggcaggaggaattggccgataatctgctgattagcttatcaaaggtcgaggtgaatgaactgaagtctgagaaacaagagaatgtgatccacctgtttcgcataacacagtcactgatgaaaatgaaagctcaggaggtggaactggcactagaagaggtcgagaaagcaggggaagaacaggcaaaattcgagaatcagctcaagactaaagttatgaagttggagaacgagctggagatggctcaacaatccgctggtggtcgcgatacaagatttctacgcaacgaaatttgtcagctagagaaacagttagaacaaaaggacagagagttggaggacatggaaaaggaactcgaaaaagagaaaaaagtgaacgagcagcttgctctgcgcaatgaggaggcagagaacgaaaactcgaaattgaggagggagaacaagcgactaaagaaaaaaaacgaacagctgtgtcaagacatcatcgattatcaaaagcagattgattcgcagaaagagacccttctctctagacgcggtgaggattctgattaccgcagccagctttccaagaagaattacgaactgattcagtacctggatgagattcagaccttaacagaagctaatgaaaagattgaggtgcagaatcaagagatgcggaagaacttggaagagtccgtgcaggagatggagaagatgactgacgaatataacaggatgaaggccatcgtgcatcagactgataacgttattgatcagctgaagaaagaaaacgatcactaccagctccaggtccaggaacttacagacctacttaaatccaaaaacgaggaggacgatccgattatggtcgccgtgaacgccaaagtagaagagtggaagcttattctgtcctccaaagatgatgagatcattgagtaccagcaaatgctgcataacttgagagaaaagctgaagaatgcacagcttgatgcagacaaaagcaatgtaatggcactgcagcagggcatccaggaacgcgacagtcagatcaaaatgttaactgagcaggtcgaacagtacaccaaggagatggaaaaaaacacttgcatcattgaggatctcaaaaatgagctgcagaggaacaaaggcgcgtctacactaagtcagcagacccatatgaaaattcagtccactctggacatcctcaaggaaaagacaaaagaggccgaaaggacagcagagcttgccgaggccgatgctagagagaaggataaagagttggtcgaagccttgaagcgactgaaagactatgagtccggagtgtatgggttggaagacgctgttgtcgagattaagaattgtaagaaccagattaaaatcagggatcgggaaattgaaattctcacaaaggaaatcaataaactggagctgaagatcagtgatttcctagacgagaacgaagccctaagggaaagggttggtttggagcctaagaccatgatcgatcttacagagttccggaactctaaacacctgaaacagcagcagtacagagctgagaaccagatcctgctgaaggagatagaatccctcgaggaagaaaggctggatctcaaaaaaaagattaggcaaatggcccaggaacgagggaaacgatccgcgacgagtggcttgacaactgaagatctgaacttaaccgagaacatctctcaaggcgacagaatctccgagcgcaaactcgacctccttagcctcaagaatatgtctgaggcccagagtaagaatgagttcctaagccgtgagctgatcgaaaaggagcgggatttggagcgtagccggacagtgatcgccaaatttcagaataagctgaaggagttggtggaagaaaataagcagttagaggaagggatgaaggagatcctgcaggccatcaaagagatgcagaaggatcctgatgtcaagggcggggaaaccagcctgataattccatctctggagaggttagtgaacgcaatcgagtccaagaatgctgagggtatcttcgacgcctccctgcacctgaaggcccaggtggaccagttaaccggtaggaatgaggaactgcggcaggaattgcgagagtcaaggaaggaggccatcaattactcccaacaattggcgaaggcaaatctgaagattgatcatctggagaaggaaacttcattattgagacagtctgaagggtcgaacgtggtgtttaaagggattgatctgcctgacggcattgccccgagctcagcgtctattattaatagccagaacgaatatttgatccaccttctgcaggaactggaaaacaaggagaagaagttaaaaaatctggaagattccctcgaagactacaacaggaagttcgcggtgatccggcaccagcaatccctgctgtacaaagaatatttatcagagaaagagacatggaaaactgagagcaagacaattaaagaggagaaacgaaaactggaggatcaggtccagcaagatgcaatcaaggtgaaggagtataacaaccttttgaacgccttgcaaatggattcagatgaaatgaaaaaaatcctggccgagaattctcggaagatcaccgtgctccaggtgaatgagaagtctttgattcgccagtataccactctcgttgagctagaaaggcagctccggaaggagaacgagaaacagaagaatgagctgctcagcatggaggctgaagtgtgcgagaagatcggatgtctccagagatttaaagaaatggcaatctttaagatagccgccctccagaaggtggtggataacagtgtgtcactttctgaactggagttggccaacaagcagtataatgagctgactgctaaatatcgggacattctgcagaaagacaatatgttggtgcagaggaccagcaatcttgagcacctggaatgcgaaaatatctcccttaaggaacaagttgaatcgattaataaggaactagagataactaaagagaaactgcacacgatcgagcaggcctgggaacaagaaaccaagcttggcaacgaatccagtatggacaaagccaagaagagcatcactaactcagatatcgtttctatctcgaaaaagatcactatgttggagatgaaggagttgaatgaacgacagagagccgagcattgtcagaaaatgtacgagcacctccggactagtctgaagcagatggaggaacggaacttcgagctggaaaccaagtttgccgagctgactaagattaacctagacgcacagaaggtggagcaaatgctccgagatgagctggccgattccgtgtctaaagccgtttctgacgccgacagacaacgtatactggaacttgagaagaacgaaatggagctcaaggtggaagtgtcaaagcttcgagagataagcgatatcgcccgtagacaggtggagatcctcaacgcccagcagcagagtagagacaaggaagtcgaaagcttgaggatgcagcttctggattaccaagcacagtccgacgagaaatcccttatagctaaattgcaccagcataatgtcagtttgcagttatcggaagctactgctttaggtaagctcgagtctatcactagcaaactgcagaagatggaggcatacaacctgagactcgaacagaaacttgatgaaaaggaacaggcactatactatgcaaggcttgaggggcggaacagagccaaacacctcaggcagaccattcagagcctgcgtagacagttctctggagctctgcctttggcccaacaggagaaattttctaagaccatgatccaacttcagaatgacaagctgaagatcatgcaggaaatgaaaaatagccagcaggaacatagaaatatggaaaacaaaacattagagatggaactaaagctgaaaggcctggaggaactcatttctacattgaaagacaccaagggggcccagaaggtaatcaattggcacatgaagattgaagagttgcgtctacaggagctgaagttaaatcgggagctggtgaaggataaagaagagatcaagtatctgaataacattatatccgaatatgagcggactataagttcccttgaggaggaaattgtgcagcaaaataagttccacgaggagcggcagatggcgtgggatcaacgggaggtggatttagagcgccagctggatatatttgatcgccagcagaatgaaatcctcaatgccgcccagaagttcgaagaagccactggtagcattccagaccctagtctccctctgcccaatcagctggaaatcgctctgcgtaagatcaaagagaacatacgcatcatcttggagactagggcaacctgcaagtccctcgaggaaaagcttaaggaaaaagagagcgccttgaggttggcggaacaaaatatcttatcccgcgacaaggtgattaacgaattgcgactgaggcttccagcgacggctgagagagagaagttaatagctgagttggggcggaaagagatggaacctaagtcccaccacaccctcaaaatagcacaccagactatcgcgaatatgcaggcaagactgaatcagaaagaagaagtgctgaagaagtaccagcggctgctagagaaagcaagagaggagcagcgagagatcgtcaagaaacacgaagaggatctgcacatccttcaccacaggttggaattacaggctgattcaagcctcaacaagtttaaacagaccgcatgggacttaatgaagcagagcccaacccctgtcccaaccaacaagcacttcatcaggctcgccgaaatggaacagacggtggctgagcaggacgactccctttcctcactcctggtaaaactgaagaaggtgagccaggacctcgagcgacagcgggaaatcacggaattaaaggtcaaggaatttgagaatattaaactgcaacttcaggagaaccacgaggacgaggttaaaaaggttaaggccgaagtagaggatctcaagtatctcctggaccagtcccagaaagagtcccagtgtctgaagtccgagcttcaagcccagaaggaggcgaattccagggcaccaactaccacgatgaggaacctcgtggagaggctcaagtcccagcttgctctgaaagagaaacagcagaaggcactcagtagagcactgctcgagctgcgcgcggagatgaccgccgccgctgaagagcgaattattagcgccacatcccagaaagaagcacatttaaacgtgcaacagatcgtcgatcgccataccagagagctcaagacgcaggtggaggacctgaatgaaaatctgcttaagctcaaggaggctttaaagaccagcaaaaatcgtgagaattcactgaccgacaacctcaacgacctaaacaatgaacttcagaagaaacagaaagcctacaataagattcttcgggaaaaggaggagatagaccaggaaaacgacgagctcaagaggcagataaagcgcctgaccagcggcttacaggggaaacctctaaccgacaacaaacaatccttgattgaggagctccagagaaaagtgaaaaagttggaaaatcagctggaggggaaagtggaagaggtggacctcaagcctatgaaggagaagaatgctaaggaggagcttatccggtgggaagagggtaagaaatggcaggcaaagattgaagggatcagaaataagcttaaggaaaaggaaggggaggtatttaccttgacgaaacagctgaacactctgaaagacctctttgctaaagcagataaggagaaacttacgcttcaaaggaagctgaagaccacagggatgacagtggaccaggtccttggcattcgggccctcgagtctgagaaagagctggaagagctgaaaaaacgcaacttagatctggaaaatgacattctttacatgagggctcatcaagccctgccccgggacagcgttgtcgaggacttgcatctgcaaaaccggtaccttcaggaaaagttacacgctttagagaaacagtttagtaaagacacgtacagcaagccctcaattagcggtatcgagagcgatgatcattgtcagcgcgagcaggaactgcaaaaagaaaacctgaaactgtcatctgaaaacattgaactgaagttccagctggaacaggccaacaaggacctgccccggctcaagaatcaggtgcgcgatctgaaggagatgtgtgaattcttgaaaaaagagaaggccgaggtccagcgcaagctcggccatgtgagggggtccggtagatcggggaaaactatccccgaactggaaaagacaatcgggcttatgaagaaagtggtagagaaagtacagagagagaacgagcagctgaagaaagcgtcaggcatattgactagtgagaagatggccaacattgagcaggagaacgaaaagctcaaagccgaactcgaaaagctgaaggctcacttgggccatcaattatctatgcactatgagagcaaaactaaagggactgaaaaaatcatcgctgaaaacgaacgccttcgaaaagaacttaagaaagaaactgatgccgctgaaaagctgaggattgcaaaaaataacctcgaaatactcaacgagaaaatgactgtgcagcttgaagagaccggaaagagattgcagttcgcagagagccgtggaccccagcttgaaggcgcagatagcaagtcatggaagtccatcgttgtcacaagaatgtacgaaacgaagctgaaagaactcgagacagatattgccaagaaaaaccagtctattacagacctcaagcagctggtcaaagaagccactgagcgagagcaaaaggtcaataaatataatgaagatttggagcaacaaatcaagattctgaagcatgtccccgaaggcgccgagacagaacaggggctcaaaagggagctgcaggtcctgaggttagcaaatcaccagttggataaggaaaaggccgaactgatacatcagatcgaggctaacaaggaccagtcaggcgcagagtccacaatcccagatgcagaccagcttaaagagaagataaaggatctcgagacccagctaaagatgtcagatctcgagaagcagcatctgaaggaggaaattaagaagctgaaaaaggagctggagaatttcgatccaagcttcttcgaggagatcgaggacttgaaatataactacaaggaggaggtgaaaaaaaatatcctgctggaagagaaagtgaaaaaactgagcgagcagctcggtgtggagctgacaagtcctgtcgcagcctcagaagagttcgaggacgaagaagaatctcctgtaaattttcccatatactag

SEQ ID NO: 111684 - DNA, 1512 bp, Artificial Sequence
  Description of Artificial Sequence: Synthetic coding sequence
atggaagagcacggggtcactcagacagagcatatggccactattgaggctcacgcagtcgctcagcaggtgcagcaggttcacgtggccacctatacggaacattccatgttatcagcggatgaggactctccaagcagccctgaggatacaagctacgatgattccgatatcctgaactctacagccgctgacgaagtgactgcacaccttgctgcagccggacccgtgggtatggctgccgctgctgcagtagccacaggcaagaagcggaagcggccccatgtgttcgagagcaatcccagcatacgaaagaggcagcagacccggcttctgaggaaactccgcgccacactggatgagtacacgacccgcgtcgggcagcaggctattgttctttgcatcagcccaagcaagccaaaccccgtgttcaaggtcttcggcgctgccccgctggaaaacgtggtgcggaagtacaagagtatgattctagaggacctggagagcgccctggctgagcacgctccggccccacaggaggtgaactctgagttaccaccgctgacgattgatggaatccccgtttctgtggataagatgacacaggcgcagctcagagcttttatccccgagatgttgaaatacagcactggaagggggaagccgggctggggcaaagagagctgtaaaccaatatggtggcccgaagatatcccatgggcgaacgttcggagtgacgtccggaccgaggagcagaaacagcgggtgtcctggacacaggcgctgcgtaccatcgtgaagaactgctataaacagcatggtagagaagatctgctatacgcctttgaggatcagcaaacacagacacaggcaacggcaacacattccatagctcacctggtgccttcccaaacagttgtgcagactttttccaatcctgatggcaccgtcagtctgattcaagtcggtacaggcgctaccgtcgctacattagccgacgctagcgaactcccaacgacagtcaccgtcgctcaggtcaactactctgccgtcgccgacggtgaagtggagcagaactgggctactttgcaagggggggagatgaccatccaaaccacgcaggccagcgaggcgactcaggccgtggctagccttgccgaagccgctgtagctgcttctcaggagatgcaacagggtgctacagtcacgatggccctcaactctgaagccgcagcccacgctgtggcaaccctggctgaagccactttgcagggcggcggccagatcgtgctgagcggagagaccgcagcggcagtcggggccctaacaggtgtccaagacgccaatggtctggtacaaatccccgtgtcgatgtaccagacagtggtaaccagtctcgcccagggaaacggcccagtgcaggtcgctatggcccctgttacaactcgcatttccgactccgcagtgaccatggacggccaagctgtagaagtcgtgacactggaacagtag

SEQ ID NO: 111685 - DNA, 906 bp, Artificial Sequence
  Description of Artificial Sequence: Synthetic coding sequence
atgtctctacgtcggcatatcggaaatcctgagtacctgatgaagcgcatccctcagaaccctagataccagcacatcaagagtagactcgataccggaaattccatgacgaaatacaccgagaaactggaggaaattaaaaaaaactaccgctataagaaagatgagctgttcaagcgtcttaaggttacaacttttgcccagttaataatacaagtggcctctctgtctgaccagacgctagaagttactgccgaagagatccagcggctggaggacaacgatagtgccgcatctgatcctgatgcggagactacagccaggacaaacggaaaaggaaatcccggggagcaatcaccatccccagagcagttcataaataatgccggtgccggagattcttcaagatctacccttcaaagtgttatctcaggcgtcggcgagctggacctggacaaaggaccagtgaagaaggccgagccccacaccaaggataagccctaccccgattgcccctttctgctgctggacgtaagggaccgggactcataccagcagtgtcacattgtcggggcctactcttatcccatcgcaaccttgagtcgaacaatgaatccctattccaatgatattttggagtataagaatgcccacggcaagatcatcatcttgtacgacgatgacgagagacttgcctctcaggctgcaacaaccatgtgtgagagaggctttgaaaatttgttcatgctgtctggggggcggctgaaccaggctaattccagcggtcgcgaatcaaaggtgcctggggcccggagcgctcagaatctgcccgggggcggtcctgcctcacactctaatcctcgctcgttgtcctccggccacttacagggtaaaccttggaaatag

SEQ ID NO: 111686 - DNA, 165 bp, Artificial Sequence
  Description of Artificial Sequence: Synthetic coding sequence
atgagtctgaggagacatattggcaaccccgagtacttaatgaagagaattcctcagaaccccaggtatcagcacatcaagagccgccttgatacaggcgcctgcgtctatcttacaagcagcccagctttgcccgactgcgcgatgaatggtctctgcttttag

SEQ ID NO: 111687 - DNA, 858 bp, Artificial Sequence
  Description of Artificial Sequence: Synthetic coding sequence
atgtctctgcgccgccatatcggcaacccggagtatctaatgaagcgcatcccgcaaaacccccgctaccaacacatcaaaagccgtctagacaccgactaccgatacaagaaagatgaactcttcaaacgacttaaggtgaccacttttgctcagctcatcatacaggttgcatccctttccgatcagactctggaggtaacggccgaggagatccagagactggaagacaacgattctgctgcctctgaccccgatgccgagaccaccgcgagaacaaacggaaaaggcaacccgggagagcagagcccatccccagagcagtttatcaacaacgccggggccggcgattcctctcggtccaccttgcagtccgttatctcaggcgtgggagagctggatcttgacaagggcccagtgaagaaagctgagccccatactaaagacaagccatatccggattgccctttcctgctgctagacgttagggacagggacagctaccagcagtgtcacattgttggcgcttattcttaccccattgcaaccctgtctcgaactatgaacccatactcaaacgacattctggaatacaagaatgcccatgggaaaattattatcctctacgatgacgacgagaggctcgcttcccaagccgccactacgatgtgtgaaaggggtttcgagaatctgtttatgctgtcaggcgggcggctgaaccaggccaattcttcaggcagggagtccaaggttccaggcgctcgcagcgcacagaacctgccaggtggaggccctgcgtctcacagcaacccgagatccctgagcagtggtcacctacaggggaagccttggaagtag

SEQ ID NO: 111688 - DNA, 1200 bp, Artificial Sequence
  Description of Artificial Sequence: Synthetic coding sequence
atgtccagcaggagcactaaggacctgattaaaagcaagtggggctccaaaccctccaatagcaagtccgaaactacactcgaaaagctgaaaggagaaatcgcacacctgaagacttctgtggacgagataacttccggaaaggggaaattgaccgataaggagcggcatcgcctgctcgaaaagatccgggtactggaagctgagaaggaaaaaaacgcataccagctcacagagaaggataaagaaatccagcgccttcgcgatcagctgaaagcccgatatagcacaactacattgcttgagcaacttgaagagacaaccagagagggagagcggcgggagcaagtgcttaaggctttgagcgaagagaaggatgtgctgaagcaacagttgagtgccgcaacgtcgagaattgccgaactggaatcaaagaccaacacacttcgcctctcccaaaccgttgcccccaactgttttaactcttccattaacaatatccacgaaatggagattcagctgaaggacgcgcttgaaaagaaccaacaatggttagtatacgaccaacagcgagaggtttacgtgaagggcctgctggcaaagatctttgaactagagaagaagactgagaccgcagcacacagtctgcctcagcagacaaaaaagccagagtctgagggttacctacaggaagagaagcagaagtgttataacgacctgctggctagcgcaaagaaagatcttgaggtggagcgccagaccatcactcagctgtctttcgagttgagtgagttccgccgtaaatatgaggaaacacagaaggaagtccataacctcaaccaattgctctattcccagagaagggcagacgttcaacatctggaagacgataggcacaagactgaaaagattcaaaagttaagagaggagaacgacatcgcgaggggaaaactcgaggaggagaagaagaggtcagaggagcttctgagtcaggttcagtttctgtatacaagtttgctcaaacaacaggaggaacagacaagggtagctttgctggagcagcaaatgcaggcttgtaccctggattttgagaatgaaaaattggacagacaacatgtccaacatcagctgcatgtcattctgaaggaactgcgtaaggctagaaacaataccgtggggatcctggatactaagagctag

SEQ ID NO: 111689 - DNA, 1395 bp, Artificial Sequence
  Description of Artificial Sequence: Synthetic coding sequence
atgtcatccagatcaaccaaagacctcataaagtctaagtggggatccaagccttccaattccaaatcagaaactactctggagaagctgaagggggagatagcacatctgaagacgagcgtggacgagattacttccggtaaggggaagctgaccgacaaggagaggcaccgcctgctggaaaagatccgtgtgcttgaggccgagaaggaaaaaaatgcttatcagctgaccgagaaggacaaggagatccagcggcttcgcgatcagctcaaggctcggtactcaaccactaccttactcgagcagctggaggaaactaccagggagggcgagcggcgcgagcaggtccttaaagctctgagcgaagaaaaggacgtgctgaagcaacagctgtctgccgctacctctcgaatcgcagagcttgaatctaagacaaacaccttgagactcagccagactgtggctcccaactgctttaactcatcaatcaacaacatccacgagatggaaatccagctcaaagacgctctggagaaaaatcagcagtggttggtgtacgatcagcagcgcgaagtgtacgtaaaagggcttcttgcaaaaatctttgagcttgagaagaaaacagagaccgcagcccatagcctgccccagcaaactaaaaagcccgaatcagaagggtacctccaagaggaaaagcaaaagtgctacaatgaccttctggctagcgctaaaaaagatctggaagtggaacgccagactatcactcagttgtcgtttgaactgtcagaatttcggaggaagtacgaggaaactcagaaagaggtacataatctgaatcaactcctctatagccaaaggagagcagacgtgcagcatctggaagatgataggcacaagacagagaagatccagaagctgagagaggaaaatgatatcgcacggggtaagctcgaggaggaaaagaaaaggagtgaagaattgctttctcaggtgcagtttttatataccagcttgcttaagcagcaggaagaacagacaagagtcgctctgcttgagcaacagatgcaggcatgcactttggattttgagaatgagaaactggaccgccagcatgtccagcaccagctccatgtaatcttaaaggaactgcggaaagctcgaaatcagattacccaactggagagccttaagcaactgcatgaatttgcaatcacagaaccactggtgacctttcagggagaaactgagaacagggagaaagtggccgccagtcctaaaagcccaactgcggccctaaacgagagtctggttgagtgccctaaatgtaacatccagtatcctgctactgagcatcgagacctgctggtgcacgtagaatactgctctaaatag

SEQ ID NO: 111690 - DNA, 627 bp, Artificial Sequence
  Description of Artificial Sequence: Synthetic coding sequence
taatcttcaatcaacaacattcatgagatggaaatacagcttaaggacgcactggaaaaaaatcagcagtggcttgtttatgaccagcagcgcgaggtctatgtgaagggcctgctggcaaaaattttcgaactagagaaaaagacagagaccgcggcccatagccttccccagcaaaccaagaaaccagagtctgagggatatttgcaagaagaaaagcagaagtgctacaatgatttgttggcatctgccaagaaagatctcgaagtagagcgtcagacaatcactcagctgtcctttgagcttagcgagtttcggagaaagtacgaagagacacagaaagaggttcacaacctgaaccagctgctttactcgcaaaggcgcgccgacgtgcaacacctggaagatgacagacacaagacagagaaaatacagaaacttagagaggaaaatgacatcgctcgagggaagctggaggaagaaaaaaaacgcagcgaggagctcctgagccaggttcagttcctctatacgagcttgctcaagcagcaggaggagcaaacacgcgtggcgctgctcgagcagcaggtgttgattagggtggcttccaagtttaacagcgcgtgctag

SEQ ID NO: 111691 - DNA, 1425 bp, Artificial Sequence
  Description of Artificial Sequence: Synthetic coding sequence
atggccgcagcctctgtgagcgctgccagcggttcccatctttctaattcctttgctgaaccatcccggtctaatggatcaatggttagacattcttcctccccttacgtcgtttacccctccgataaaccattcttaaattcagacctcaggaggtctccctctaagcctactctagcatacccagagtctaatagtagggccattttctctgctcttaagaacctccaagacaagatcaggcggctcgaacttgagcgcattcaggccgaagaaagtgttaaaacacttagtagggagaccatcgagtacaagaaagtgctggatgaacagatccaagagagggagaacagcaagaacgaggagagtaagcataaccaagagctgactagccaactgctcgccgccgaaaacaagtgcaatttactggagaagcagttagaatatatgaggaacatgataaaacatgcggagatggaaaggacaagtgtgcttgagaagcaggtcagccttgagcgcgagagacaacatgaccagacacacgtccagagccagcttgaaaaactagacttgttagagcaggagtacaacaagctgaccaccatgcaggcgctggccgagaagaagatgcaggagctcgaagccaaactgcacgaggaggagcaagaaagaaagcgcatgcaggcgaaggctgccgagctgcagacaggcctggaaactaacagattaatttttgaagataaggccaccccttgtgtgcctaatgctagaagaatcaagaagaaaaaatctaagccaccggagaaatccacaagtccatctcatgccgtggttgctaatgtccagcttgtgctccacctcatgaagcagcactcgaaggcgttatgcaatgatagggtgatcaacagcatccccctggcaaagcaggtgtctagtcggggcgggaagagcaagaaactgtccgtgactccaccttcatctaatggcattaatgaagagttgagcgaagtcctccagactctgcaggacgagttcggccagatgagctttgaccatcaacagctggctaaactgatccaggagagccccacggtggaactgaaggacaaactggagtgtgagctggaagcacttgtgggaagaatggaagccaaagctaaccaaatcactaaggtgcgcaagtatcaagcgcagctcgagaagcagaaactcgagaaacagaaaaaagagttgaaggccacaaagaagacccttgacgaggaacgcaactcaagttcgcggagtggaataacaggcacaacgaacaagaaagatttcatgaaactgcgccccggcgagaagcgaagaaaaaatctccagctcctcaaagatatgcagtccatccagaacagcctacaatcctcctcactgtgttgggattactag

SEQ ID NO: 111692 - DNA, 1503 bp, Artificial Sequence
  Description of Artificial Sequence: Synthetic coding sequence
atggcagccgcatctgtttctgcggcatcaggcagtcacctgtcaaactctttcgctgaaccctctcggtccaacggatccatggtacggcattcatcctccccatatgttgtctatccttccgataaacctttcctcaactccgatctgcgcagaagcccatccaaacccacccttgcatatcccgagagcaatagccgggctatatttagcgcgcttaagaacctgcaggacaaaattaggcgtctggaactagagagaatccaggctgaagagtctgtgaaaacactgagtcgggagacaatagagtacaaaaaggtgctggatgaacagatacaggagcgcgaaaacagtaaaaacgaagagtccaaacataaccaagagcttacatctcagttattggccgccgagaacaaatgcaatctcctcgaaaaacagctggagtatatgaggaacatgattaagcatgccgagatggaacggacttctgtcttagaaaagcaggtgtcgctggagcgggagagacagcacgatcagactcacgtacagagccagttggagaaactggatctcttggagcaggagtacaataagctcacgacaatgcaagcacttgctgagaagaagatgcaggaactggaggcaaaactacacgaagaagagcaagagagaaagcgaatgcaggcaaaggccgctgagttgcagaccggcctggagacaaacagactgatatttgaagacaaagctactccatgtgttccgaacgccaggagaatcaagaagaagaaatctaagcctcctgaaaaaaagtcttcccggaactattttggagcccagccccactatcgcctctgcctcggggatatgccatttgtggctggaaaaagcacctccccaagtcacgcggtggttgccaatgtgcagctcgtgttgcatctaatgaaacagcatagcaaggcattatgcaatgatcgcgtcatcaactcaatcccactggctaagcaggtgtcctcaagaggaggtaagagcaagaagctcagtgtaactcccccaagcagcaatgggattaatgaagaactgagcgaggtgctgcagacgctgcaggacgagtttggccagatgagtttcgaccatcagcagctggccaaactgatccaggagtctcctaccgtggagttaaaggataagctggaatgtgaactggaggctcttgtgggacgcatggaagccaaggcaaatcagataaccaaagtacgcaaatatcaggcccaactggaaaagcagaaactagagaaacagaagaaggaattgaaggccacgaagaagaccttggacgaagaacggaacagtagctctcgcagcggcatcactggaactacaaataagaaggactttatgaagctgaggcccggtgagaagagaaggaagaatttgcagctgctgaaggacatgcagagcatccagaattccctccaatccagctccctgtgttgggattactag

SEQ ID NO: 111693 - DNA, 813 bp, Artificial Sequence
  Description of Artificial Sequence: Synthetic coding sequence
atggccgccgctagcgtatccgcagcttccgggtcccatcttagtaattcctttgctgagccaagccgcagcaacggaagcatggtcagacatagttcatctccgtacgtggtgtacccatccgacaagccattcctgaattcagacctgcggagatctcctagcaagccaacccttgcctacccagagagcaactccagagcaattttttcagctctcaagaatctgcaggataagatcagacgcctggagctggaacggattcaagccgaagagtctgtcaaaacactcagtagagagacgatcgaatacaaaaaagtcttggacgaacagatccaggagcgagaaaactctaagaatgaagaatctaagcacaaccaggaactgaccagccagctcctggccgcggagaacaaatgtaacttgctggaaaagcagctggagtacatgaggaatatgatcaaacacgctgagatggaacggacgagcgtccttgagaagcaggtgtccctggaacgtgagagacagcacgaccagactcatgtacagagccagctggagaagctggatttactggagcaggaatacaacaaactcacgacaatgcaggcactcgccgaaaagaagatgcaggaattggaggcaaagcttcatgaagaggagcaggagaggaagagaatgcaagcaaaggctgccgaactgcagacaggcctggagactaacagactgatcttcgaggacaaggctactccatgtgtgcctaatgcacggcgaataaagaagaaaaaaagtaaacctcctgagaaagtctag

SEQ ID NO: 111694 - DNA, 1476 bp, Artificial Sequence
  Description of Artificial Sequence: Synthetic coding sequence
atgctcacacgcatcgataattcgtttgccgagccgagccgttccaacggcagcatggtgcgtcattccagttccccatacgtagtctatcctagtgacaagccgttccttaactcagacctcaggagatcgcctagcaagcccaccctggcataccccgagtcaaattcacgtgctattttctccgccctaaaaaatctgcaggacaagattcggaggctcgagctggagcggatacaggcagaggaatccgtcaaaacgctgagcagggagactatcgagtacaaaaaggtgttggatgagcagattcaggaacgcgagaactctaaaaacgaggagagcaaacataatcaggagctcacttcccagctattagctgctgagaacaaatgtaatctgctggagaagcagctggagtacatgcgtaacatgataaaacacgcagagatggaaaggacctccgtcctggaaaagcaagttagtctggagagagagcggcaacacgaccaaacccacgttcagtcgcagcttgaaaagctcgatctgcttgagcaggaatataacaagttgaccaccatgcaggcgcttgcagagaagaaaatgcaggagctggaggcaaagttgcacgaggaggaacaggagagaaaaagaatgcaggcgaaggccgcggagctacagacaggcctggagaccaatcggcttattttcgaagacaaggccaccccttgcgtgccaaatgccaggcgaattaagaagaaaaaaagcaagcccccggagaagaaatcctcccgcaattatttcggtgcccagccccattatcggttatgtttgggggacatgcccttcgttgcaggcaaatccacctccccttcccacgccgtggtggcgaacgtacagctggtgcttcacctcatgaaacaacatagcaaggccctctgcaatgacagagtaatcaatagcattccactggccaagcaggttagttctcggggcggaaagtctaaaaagctgtcggtgacccccccttcttcaaacgggattaatgaggagctctctgaagtcctgcagacgcttcaggatgaatttggccagatgtccttcgatcatcaacagctagccaaacttatccaggaaagccccaccgtcgagcttaaagataagctagaatgcgaactagaggctctcgtcggcagaatggaggcgaaagccaaccaaattaccaaagtgaggaagtatcaagcccaacttgaaaagcaaaagcttgagaagcagaagaaggagctgaaagcgacaaaaaaaaccctggatgaggaaagaaatagttccagccgtagcggcatcaccggcacaacaaacaagaaggactttatgaagcttagacccggggagaagcgcagaaaaaacctacaactgctgaaagatatgcagtcaatacaaaacagcctgcagagttcttctctgtgctgggattattag

SEQ ID NO: 111695 - DNA, 1794 bp, Artificial Sequence
  Description of Artificial Sequence: Synthetic coding sequence
atgtttccagtagcgcccaagccgcaggactccagtcagccctccgatagattaatgaccgagaaacagcaggaggaggccgagtgggagagcataaacgtattgttgatgatgcatggcctgaaacccttgtctctggtcaagaggacagacctgaaagatctcattattttcgataagcagtcaagtcaacggatgaggcagaatctgaagctgctagtggaagaaacaagttgccagcagaacatgatccaggagttgatagagacgaaccagcagttgaggaacgaattacagctggagcaaagtcgggccgcaaaccaggagcagagagcaaacgacctagagcaaattatggagagcgtgaagtctaagatcggcgagcttgaagatgaatcactctctcgcgcctgccatcagcagaacaagattaaggatctccagaaagaacagaaaactctccaagttaagtgccagcattacaagaaaaagcggactgaacaggaagagactattgcttcactacaaatggaggtatgccggctaaagaaggaggaagaggacaggatagtcacacagaatagagtgttcgcttacctttgtaagagggtgccccacacagtgctggatagacaactgctgtgtctgatcgattattacgagtcgaagattaggaagatccacacgcagagacaatacaaggaggacgaatcgcagagcgaggaggaaaatgactaccgcaacttggacgcctcaccgacatacaagggcctcctcatgtccctacagaaccagctcaaagagagcaaatcaaagatagacgcccttagttctgagaagctgaacctgcagaaggacttagaaacgagaccgacacagcatgagctcaggttgtataaacaacaggtgaagaagctcgagaaggctctgaaaaaaaacgtgaagctgcaagagcttatcaaccataagaaagcggaggacaccgaaaaaaaagatgagcccagcaagtacaatcagcaacaggctctgatcgaccagaggtacttccaggtcctgtgttccataaactctattatacataatcctcgtgctccagtaatcatctacaagcagactaagggtggagtccagaattttaacaaggacttagtgcaggactgtgggttcgagcatctggtacctgtgatcgaaatgtgggctgaccagctgacaagcctcaaagacctgtacaaatccctgaagactctctcagccgagctggtcccctggctaaacttaaagaaacaggatgagaacgaggggattaaggtggaagacctgctgttcattgtggacaccatgctggaagaagtggaaaacaaagagaaagacagcaacatgccacactttcaaactctccaggcaatcgtgagccatttccagaagctgttcgatgttccctctcttaatggcgtgtaccctcgcatgaacgaagtatatactcgcctgggagagatgaacaatgctgtgagaaatctgcaagaactcctggagctggatagcagctctagcctctgtgtgctcgtttctacagtgggcaagttgtgtagactgatcaacgaggatgtaaatgaacaggtgatgcaggtcctagggcctgaagacctgcagagtataatctacaagcttgaggagcacgaggaattcttcccggcctttcaggccttcactaacgatttgctggagattttggagatcgacgacttagatgcaatcgtacctgccgttaagaagctgaaagtcctgtcatactag

SEQ ID NO: 111696 - DNA, 639 bp, Artificial Sequence
  Description of Artificial Sequence: Synthetic coding sequence
atgttcccagtcgctccgaagccacaggactcatcgcagccctctgatcgcctgatgaccgagaagcagcaggaagaagctgagtgggaaagcatcaacgtgttactgatgatgcatggactgaagcccctctcactggtaaagcgaacagatctgaaagatctgattattttcgataaacagtcttcccaacgaatgagacagaatcttaagctgttagtcgaggagacgtcctgccagcagaatatgatccaggagctgatcgaaacaaaccagcagctccggaacgagttgcaattggaacagtcccgcgccgccaatcaagagcagcgcgccaatgacctggaacagattatggagtccgtgaagtccaaaatcggtgaactggaagacgagagtctctctagggcttgccatcagcagaataaaatcaaagacttgcagaaagagcagaagacgctccaggttaaatgccagcactataaaaagaagcggacagaacaggaagaaacaatcgccagccttcagatggaagtgtgtcgtctaaaaaaggaggaagaggatcggatcgtgactcagaaccgggtgttcgcctacctttgcaaacgggtgccccacacagtgctagaccgccagtag

SEQ ID NO: 111697 - DNA, 351 bp, Artificial Sequence
  Description of Artificial Sequence: Synthetic coding sequence
atgtttcccgtagcccccaagcctcaggacagttcacagcccagcgatagactgatgacagaaaaacagcaagaggaggctgagtgggagtcaatcaatgtgttactgatgatgcacggtcttaagcccctgtccttagtcaaacggacagatctaaaagacctgataatcttcgacaaacaatccagccagcgcatgcgccagaatctgaaactgctcgttgaggagacatcctgccagcaaaacatgattcaggagcttatcgaaacaaatcagcaactccgtaatgagctgcagctcgagcagagtcgtgcagcaaaccaggagcagagggcaaatgacctggagtag

SEQ ID NO: 111698 - DNA, 1665 bp, Artificial Sequence
  Description of Artificial Sequence: Synthetic coding sequence
atgtttcctgtggcaccgaagcctcaggactctagccagcctagcgaccgcctgatgacagaaaaacaacaggaagaagcagagtgggagtcgattaatgtgctccttatgatgcatgggctcaagccactgtctttggtgaagcgtactgacctgaaagaccttattatctttgataagcaatctagccaaagaatgaggcagaacctgaaactgctggtggaggagacttcatgccagcagaatatgatccaggagcttattgagacaaatcagcagctgcgaaacgaactccagctcgagcagtcacgagcagcgaaccaggagcaacgggctaatgacctggagcagatcatggagtcagtcaagagtaaaataggcgagttggaagatgaatctctcagcagggcctgtcaccagcaaaacaaaatcaaggatcttcaaaaagagcagaagaccctgcaggtgaagtgccaacactataaaaagaaacggaccgaacaggaagagactattgcctccctccagatggaggtgtgtaggctcaaaaaggaggaggaggaccgcatagttacccagaatagggtcttcgcttatttgtgtaaaagggttccccataccgtgctcgaccggcagctgctttgcctgattgactattatgaatctaagattcgtaaaattcacactcagaggcaatataaggaggacgaaagccagagcgaggaggaaaatgactataggaacctcgatgcttccccaacgtataagggtcttcttatgtcactacagaaccagctcaaggagtctaagtctaaaatcgatgctctgtcttccgagaagttgaacctgcagaaagatcttgagaccagacccacccaacatgagctgaggctctataagcagcaggtcaagaagttggaaaaagcccttaagaagaacgtcaaactgcaggagctcattaatcataagaaggctgaagacaccgaaaaaaaagacgaaccctcaaaatacaatcagcagcaggccctcatcgaccagcgctacttccaggtgctttgcagcattaacagcatcatccacaaccccagggcgcctgtgattatttacaaacagacaaagggtggcgtacagaactttaacaaggatctggtacaggactgtggcttcgagcatctggtgccggtgatcgagatgtgggccgatcaattaacctccctaaaggatctttataaatctcttaaaaccttgtctgcagagctggttccctggcttaacctcaagaagcaagacgagaatgaaggaattaaggtcgaagatttgctgtttatagtggacaccatgctggaggaagtcgaaaataaggaaaaagactccaatatgccgcactttcagactcttcaagccatagtgtcacatttccagaaattgttcgacgtgccatctctcaacggagtttatcctagaatgaacgaggtctatacacgcctgggggaaatgaataacgctgtccggaacctccaggagctgctcgagctagacagttctagcagtctgtgtgtcctggtcagcactgtagggaagctatgtcggctcattaatgaggacgttaatgagcaggtgatgcaggttctagggccagaagacctgcagcgatacttattctag

SEQ ID NO: 111699 - DNA, 1794 bp, Artificial Sequence
  Description of Artificial Sequence: Synthetic coding sequence
atgtttccagtggctccgaagcctcaggattcttcccagccttctgatcggcttatgacggagaaacaacaggaggaagccgaatgggagagcatcaatgttctgctgatgatgcacggactgaagcccctttccctggtaaagagaaccgacttgaaagacctcattatctttgataagcagtcatcccagcgcatgaggcaaaacctcaagctgctcgtagaggaaacttcttgccagcagaacatgattcaggaacttatcgaaacaaatcaacagctgaggaatgaactccagctggagcaaagtagagcagccaaccaggagcagcgagccaacgacctggagcagatcatggagagcgtcaaaagtaagataggggagctcgaggatgaaagtctgtctcgagcatgccatcaacagaataaaatcaaagacctccaaaaggaacagaaaaccctccaggtcaagtgccaacattacaaaaagaagaggaccgagcaggaggagacaattgctagcttgcaaatggaggtgtgcaggctcaagaaggaagaggaggataggatcgtgacgcaaaatcgcgtttttgcatatctttgcaaacgggtccctcacacagttcttgaccggcagctcttgtgtctgatcgactactatgaatctaagattaggaagatacatacacaacgccaatacaaggaggacgaatctcagtctgaggaggagaacgactatcggaacctcgacgcctcccctacttacaaaggcctgttaatgagcctgcagaaccagttgaaggagagcaaaagtaagatcgacgctctcagcagcgaaaaattgaacctgcagaaagatttggaaacacgcccaactcagcacgagttacgtctgtacaagcagcaggtgaagaagctggaaaaagctcttaaaaaaaacgttaagctgcaagaactgatcaatcataaaaaggcagaggatactgagaagaaagatgaaccttctaagtataatcagcaacaggccctgatcgatcagcgctacttccaggttttgtgcagtataaacagcattatccacaatccacgcgcgcctgtgattatttacaagcagacaaagggaggggttcaaaattttaacaaagatctggtgcaggactgcgggtttgagcatctggtgcctgtcatcgaaatgtgggcggatcaactgacaagccttaaggatctgtacaaatcccttaagaccctttcagccgagttagtaccatggctgaatctgaagaagcaggatgagaatgaggggatcaaggttgaggacttgctgttcattgtggacaccatgttagaagaagtcgagaacaaagagaaggatagcaatatgccccactttcagacacttcaggctatagtctcccactttcagaagctgtttgacgtgccaagcctcaatggcgtgtacccaaggatgaatgaggtttacaccagactcggcgagatgaataacgctgttaggaacttgcaagagctgctggaactggatagcagtagttcgctgtgtgtacttgtctcaactgtgggaaagttgtgtaggcttatcaatgaagatgtgaatgaacaggtgatgcaagtgctggggcccgaggatttgcagagcatcatttacaaactggaggaacacgaagaattcttccccgcattccaggcttttaccaacgacctcctcgagatcctggaaattgatgacctggacgcgatagtacccgccgttaagaagctgaaggtgctctcttattag

SEQ ID NO: 111700 - DNA, 72 bp, Artificial Sequence
  Description of Artificial Sequence: Synthetic coding sequence
atgtttcctgtagccccgaagccacaggattcaagccagccttccgacagactcatgaccgaaaagcagtag

SEQ ID NO: 111701 - DNA, 1734 bp, Artificial Sequence
  Description of Artificial Sequence: Synthetic coding sequence
atgaccgagcaggaggaggcggaatgggaatcaatcaatgtgctgcttatgatgcacggcctgaagcccctgtccctggtgaagcggacagatctgaaggatttgatcatttttgataagcaaagcagccagcggatgaggcagaacttgaagctgttggtggaggagacttcttgccagcagaatatgatccaggaactgatcgagacaaatcagcagctacgaaatgaactccagcttgaacagtcgagagcagcaaaccaggagcagcgagctaatgacctggagcagattatggagagcgttaagagcaaaatcggagaacttgaggatgagagtctgagcagggcatgccatcaacagaataaaatcaaagacctgcagaaagagcaaaagaccttgcaggtaaaatgccaacattataagaaaaaacgtacggagcaggaggagaccatagccagccttcagatggaagtttgtaggttgaagaaagaagaagaagaccgaatcgtgacccagaacagagtgtttgcctacttgtgcaagcgcgtcccacacaccgttttggacagacagttgctgtgcctgattgactactacgaatctaaaattcggaagatccacacacagaggcaatacaaagaggatgaatcccagtctgaggaagagaacgactacaggaacctcgacgcatcacctacttataaaggcctgctcatgtcactgcagaaccagctgaaggagagcaagtcgaaaatagatgccctttcaagcgagaagcttaatttacagaaggacctggagacacggccaacacagcacgaactgcgcctgtataaacagcaggtcaaaaagctggagaaggcacttaagaaaaatgttaagctccaagagctgatcaaccacaaaaaggcagaggacaccgagaaaaaagatgagccatcaaagtataaccaacagcaggctttaatcgatcaacggtactttcaggtgttgtgcagcatcaattctatcatacataatcctcgcgcaccagtcattatttacaaacagactaaggggggcgtgcagaacttcaataaagacttggtccaggattgtggatttgaacacttagtaccagtgatcgagatgtgggctgaccagttgacatctcttaaggacctgtataaaagtctgaagacactgtccgccgaactggtcccatggctcaacctcaaaaagcaagatgaaaacgagggcattaaagtggaggatctgctgtttatcgtggacaccatgttggaggaggtcgagaataaggagaaggattctaatatgccccattttcagacattacaggcaatcgtctcccatttccagaaactttttgacgtcccttccttaaatggcgtttatccgaggatgaacgaggtttacacccgtcttggcgagatgaacaatgccgtacgcaatctccaggaactgttagagctggatagttcaagcagcctgtgcgtcctggtgtcgacagtgggaaaactctgccgtctcattaacgaggacgtcaacgagcaggtcatgcaggtgctcggtccggaggacctgcagtcaattatttacaaacttgaagaacacgaggaattcttccccgctttccaagcgtttacaaacgatttacttgagattctcgagatcgacgacttagacgcaattgtcccggctgtaaagaaactcaaggtactcagttactag

SEQ ID NO: 111702 - DNA, 3666 bp, Artificial Sequence
  Description of Artificial Sequence: Synthetic coding sequence
atgctgtttccgttacaagtcgcagctgttactagctctgtccgagacgatccactggagcactgcgtcagtcctcgtacacgggcccggtcaccggagatctgcaaaatggctgataacttggacgagtttatcgaagagcaaaaagccaggctggcagaggataaggcagagctggaaagcgacccaccatacatggagatgaaggggaaactcagcgccaaactcagtgagaatagcaagatcctgattagcatggccaaggaaaatattcctcccaattcacaacagacacgcggcagcttgggcatagactacggacttagcctgcctctgggggaagactacgagaggaagaaacacaagctgaaggaggaactgcgccaggattatcgccgatacttaacgcaggaacggctgaaactggagcgcaacaaagagtacaaccaattcttgagaggtaaagaagagtcgtcagagaaatttaggcaagtcgagaaatccacagaacctaagtcacagcgaaacaagaagcccattggccaggttaagcccgatttgacctcccaaattcaaacgagttgcgaaaattctgaagggcccaggaaggatgtccttaccccttccgaagcatatgaagagctcctcaatcaacggcgcctcgaggaagatagatataggcagctggatgatgagatcgaactgaggaacagacgaattattaaaaaggccaacgaggaagtgggcatctcaaacttgaaacatcaaagattcgcatctaaggctggaatcccggacaggaggttccatcgcttcaacgaggaccgggtcttcgatcgccggtaccaccgacccgaccaggatcctgaggtgagcgaggagatggatgaacggttccgatacgagagcgacttcgatcgacgactcagcagagtgtacaccaatgatagaatgcatcgcaacaagcgaggcaatatgcctccaatggaacacgacggggacgtaatcgaacagtctaatatccgcatctcctccgcagagaataagagtgcgcctgataacgaaacaagtaagtctgcgaaccaggatacatgcagcccattcgctggcatgttattcggcggtgaggacagggagcttatccaaagaagaaaggaaaaatacagactagaacttcttgagcagatggccgaacagcagagaaataaacgaagagagaaggatctggaactgcgcgtggctgcatctggggcccaggaccccgaaaagtcacctgaccgcctgaaacagttctcagtcgccccgcgtcattttgaggagatgatcccacctgaaagacctcggattgcattccagactccgctcccacctttgtctgccccctccgtgccccctattcctagtgttcaccccgtcccttctcagaatgaagatcttcggagcggtctgagcagcgccctgggcgagatggtgtcccctcgaattgcccctctccctcctccacccctgctgccccctttggccacaaactatagaacaccctatgacgatgcctactacttctacggatctcggaacacttttgatccttcccttgcatactacggctccggcatgatgggcgttcagccggctgcgtacgtgtcagcacctgtcacacaccaattggcacagcccgtcgttaatactgtaggacagaatgaattgaagattacctctgaccaggttatcaactccggcctcattttcgaggataagccaaaaccatcgaagcagagtctgcaaagctatcaggaggccttgcagcaacagatcagggagagagaggagcgccggaagaaggaacgggaagagaaggaagagtatgaagccaaacttgaagcggaaatgagaacttacaatccctggggcaaaggcggaggcggtgcccccctgagagacgccaagggcaatctgattaccgatctaaatcggatgcatagacagaatatcgatgcttaccataaccccgatgctcgaacatatgaggataagcgagccgttgtgtcgctggaccccaatttagctaccagcaacgctgagaatctagaggatgcagccaacaagtcgtcggggcacatgcagacccagtcttccccgtttgcccgcgggaatgtattcggagagcctccaaccgagctccagatcaaacagcaggaattgtacaaaaatttcctcaggtttcagattgaagagaagaaacagcgggaggaggcggagagagagcggctcaggatcgccgaagagaaagaggagcgcagactggcagagcagcgagctagaatccaacaggaatatgaggaagaacaagaaaaaaaacgggagaaggaggaggaacaacgtctgaaaaatgaagagcacatacgacttgccgaggagcgtcaaaaggaggccgagcggaagaaaaaggaagaagaagagaagtataacctacagctccagcactattgcgagcgtgataatttgatcggagaggaaaccaaacacatgagacaacccagtccaattgtaccagcgttgcaaaacaagattgctagtaagctccagaggccgcctagtgtggacagtatcattcgatctttcattcatgaaagttccatgagtagggctcagtcccccccagtgccggctagaaagaatcagctacgggcagaagaagaaaaaaagaatgtgatcatggagcttagcgaaatgcgcaagcaattacgctctgaggaaaggaggctgcaggaacgattactgcatatggactccgatgacgagattcccatccggaaaaaagaaagaaatccaatggacatattcgacatggcccggcacagactgcaggcccctgttagacggcagagccccaagggtctggatgctgccacgtttcagaatgttcatgattttaatgaactaaaagatcgggacagtgagactcgggtagacctcaagttcatgtacctcgatccccctagagatcaccatactctcgagatccagcagcaagccctgctgcgcgaacagcagaaaaggcttaataggattaagatgcaggagggtgccaaggtcgatctggacgctatccctagtgctaaagtaagggagcagcggatgcccagagacgacaccagtgacttcctcaagaattcgctcctggaaagcgatagcgccttcataggtgcgtatggagaaacctaccccgccattgaggatgatgtgctgcccccaccgtcgcagctcccatccgcaagagagcgacgccgtaacaagtggaaaggtctagacatcgactcatccaggccaaacgttgcccctgacggtctgtccctcaagagtatctcgtccgtaaatgtcgacgaactgagggtgaggaatgaggaaagaatgcgcagacttaacgaattccacaataagcccatcaataccgatgatgagtcttccctggttgaccccgatgacataatgaagcatatcggcgatgatgggtccaattcagtcgccaccgagccatggctccgacctggcaccagcgagacgttgaagaggttcatggcagagcagttgaaccaggagcagcagcagatacctgggaaaccaggtacctttacttggcagggtctgagcactgcacacggctag

SEQ ID NO: 111703 - DNA, 3771 bp, Artificial Sequence
  Description of Artificial Sequence: Synthetic coding sequence
atgctgtttcccttgcaagtggccgcagtgaccagctcagttcgagacgatcctctggagcactgtgtatctcctaggacacgtgcgagatctcccgagatctgtaaaatggccgataacctcgatgagtttattgaagagcagaaagcgcgcctggctgaggacaaagccgagctggagagcgatcctccttatatggagatgaaggggaaactgtccgctaagctctctgagaactcaaaaatcctcatctccatggccaaagagaatattccgcctaatagtcagcagactagagggagcttgggcattgattatgggctctcactcccattaggcgaagattacgaacgcaagaagcacaaattaaaggaggagttacgacaggactataggcgctacctgactcaaaaagtgttttcaggtacatccaaaaaaaactttctaagcacctccgagaccgatccaagcaccttgggcgtttctcttccaattggtgagcgcctgtctgcaaaagagcgtttgaagttagagcggaataaggaatacaaccaatttttgcgagggaaggaggaatccagcgagaaatttagacaggtagagaagagtactgagcctaagagccagcgtaacaaaaagcctattggacaggtaaagcctgacctgaccagccagatccaaacctcttgcgaaaacagtgagggacccaggaaagacgtgctgacaccctcggaagcatacgaagagctgctcaatcagcgcaggcttgaagaggaccgctatagacagttggacgatgagatagaactgcgcaatcgccgaataattaagaaggccaacgaggaggtgggtatatccaacctgaagcaccagcgctttgcatctaaggctggcattcctgacagacgctttcatcgtttcaatgaggaccgcgtatttgacaggaggtaccaccgcccggatcaggatcctgaggtcagcgaagaaatggacgagagatttcgttacgaaagcgactttgacagacggctgtctcgagtctacactaacgacaggatgcacagaaataagcgcggcaacatgccacctatggagcacgacggtgatgtcatagagcagtctaacattaggatctccagcgcagaaaataaaagcgcccctgacaacgagactagcaagtccgcaaatcaggatacgtgttcgccattcgcgggcatgctcttcggtggggaggacagggagctgatccaacgccggaaggaaaaataccgactggagctgctggagcagatggctgaacagcaacggaacaaaagacgagagaaggacttggagctgcgcgtggcagcgagtggggcacaggatcccgagaagtctcccgacagacttaaacagtttagtgtggcacctcggcactttgaggagatgattcctccggagcgccctcgtatcgccttccagactccactgccccctctaagtgccccttccgtgccacctattccctctgtgcatcctgtgccttcacagaacgaggaccttcgttcaggtctgtcttctgctctaggagaaatggtgtctcctcgtatcgcccctctcccaccacctccactgttaccaccattggccacgaattacaggacgccttacgacgatgcttactatttctacgggtcaaggaacaccttcgacccctcccttgcctattacggctccgggatgatgggagtccaacccgccgcatatgtctctgctcctgttacacatcagctagcccaacccgtcgtgaatactgtgggccagaacgaactcaagatcacttcagaccaggtgattaattctggcttgatcttcgaagacaaaccgaaaccttcaaaacaaagcctgcagtcttaccaggaggccctccagcagcagattcgagagagggaggagcggagaaaaaaagagcgcgaagagaaagaagaatatgaggcgaaactggaggccgagatgaggacctataatccgtgggggaagggcggggggggggcacctctcagagatgccaaaggcaacttaattaccgatttgaatcggatgcaccgtcagaacatcgacgcttaccacaatcctgatgcacggacgtacgaggacaagcgtgccgtggtgtcgttagatccgaatctggcgacatctaacgcggaaaatctcgaggacgctgctaataaatcatcaggacatatgcaaacacagtcttcaccatttgcgcgagggaatgtgttcggcgagcctccaacagaactacagattaaacagcaggagctctataagaattttttgcgattccagatcgaggagaaaaaacagagagaggaggctgagcgtgagcggttgagaatcgctgaggaaaaggaagagcgacgcctagccgagcagcgcgctagaatccagcaggagtacgaagaagagcaagagaagaaaagggagaaggaggaggagcagagattgaagaatgaagaacacatcaggctagctgaggagaggcagaaggaggccgagcggaaaaaaaaagaagaagaagaaaagtacaacctgcagctccagcactattgtgagagggataacctgattggggaggaaaccaaacatatgcgacagccttccccaatcgtgcccgccctgcagaacaagatcgcatctaagctccagcgtccaccctcggtcgactccattattaggtcgttcatccatgagtccagtatgtcgagggctcagtccccgccagtgccagccagaaagaatcagctgagggctgaggaggaaaaaaaaaacgtgataatggaactctcagaaatgagaaagcaattgaggagcgaggagcggcgtctgcaggagaggctcttgcatatggacagcgatgatgaaatacctatccgcaagaaggagcggaatcctatggacatttttgacatggctcgacatcgtctgcaggcccctgtgcggcgacagagccccaaaggcctggatgccgccacattccaaaacgtacacgacttcaacgaattaaaagatagagacagcgaaacaagagtggatctcaagttcatgtatctggaccctccaagagatcaccatacactcgaaatccagcagcaggcactgcttcgcgaacagcagaagagacttaatagaatcaagatgcaagagggggctaaagttgatctcgatgcgatcccctccgcaaaggttcgagagcagaggatgcctcgggacgacacgtctgatttcctgaagaattccctactggaatcagattctgccttcatcggcgcttacggcgagacttatccggccattgaggatgacgtgctgccccccccttctcagctcccaagcgcgcgggagcgtagacgcaacaagtggaaagggctggacattgatagttctcgccctaacgtggcccccgatggcctgtctctgaagtccatatcttccgttaacgtcgatgagcttcgtgtcagaaacgaggagcgaatgaggcggctaaacgagtttcataataaaccaataaatacagatgacgagtcatccttggtggacccggacgatataatgaagcatatcggcgacgacggttccaactcagtcgccaccgaaccctggctaaggcctggcactagcgagacgctaaaaagattcatggccgagcagctcaatcaggagcaacagcagatccccggtaagccaggaaccttcacatggcagggcctttcgaccgcccatgggtag

SEQ ID NO: 111704 - DNA, 2631 bp, Artificial Sequence
  Description of Artificial Sequence: Synthetic coding sequence
atggatgagcgatttaggtacgaatcggacttcgacaggagactgtcccgcgtatacacaaacgaccgcatgcaccggaacaaaaggggaaacatgcccccaatggagcatgatggcgacgtgattgaacagagcaatataaggatctcaagcgcggagaataaatccgcacccgacaatgagactagcaaatcagcaaatcaggacacatgcagtccgttcgcaggaatgctttttggcggagaggacagagaactgatccagcgccgtaaagagaagtaccgactcgaactgctggagcaaatggctgagcagcagcgtaataaacgtagggaaaaagatctcgaactgagagtagcggccagtggcgcccaggaccctgaaaaatccccggatcgcctgaagcagttttctgtggcaccacggcactttgaggagatgattccgccagagcgtccacggattgcctttcaaacccctctccctccactgtcagccccctccgtccctccaataccgagcgtgcaccccgttccctcccaaaacgaagatttgaggtcaggcctgagtagtgccttgggtgagatggtttccccaagaattgcacccttgccgccacctcctttattaccaccactcgccacaaattatcgcacaccctatgatgacgcttattatttctatggaagtaggaatacatttgaccccagtctcgcttactacggctccggcatgatgggcgtgcagcctgccgcctacgtttctgctcctgttacacaccagctcgcccaacccgtggtcaacactgtgggccagaacgaactgaagataacttctgaccaggtgatcaatagtggcctaatctttgaagacaagccaaagcctagcaagcagtctctgcagtcatatcaggaggctctccagcagcagataagggagcgcgaggagagacgaaagaaggaacgggaggaaaaggaggagtatgaggcgaagctggaagccgagatgcggacctataacccctgggggaagggcggaggcggtgccccactccgcgatgccaagggcaacctcatcagccacatgcaaacccagtccagccccttcgcaaggggcaacgtgtttggtgagccgcccactgaactgcaaataaagcagcaggaactgtacaagaactttctgcgcttccaaatagaggagaagaagcagcgagaggaagcagagagagaacgtctgcgcattgctgaggagaaagaagagagaagactggccgagcagcgcgcacgaattcagcaagaatacgaggaggaacaggagaagaagagggagaaggaggaggagcaacggttaaaaaatgaggagcacatacgactagccgaggagcgtcagaaggaagcagagcggaagaaaaaggaggaagaggaaaagtacaacctgcaactccagcattattgcgagcgcgataatctgatcggtgaagagactaagcatatgcgccagccgagccctatcgtgcccgccctgcaaaacaaaatcgccagcaaactgcagcggccaccaagcgtcgactcgattatccgatcctttatacacgaatcatctatgagtcgtgcacagagtccaccagtgcctgctcgaaagaaccagctgagagcagaggaagaaaaaaagaacgttattatggaactgtctgagatgcgcaagcagctgagaagcgaggaacgcagacttcaggagcggttgctccacatggacagcgacgatgaaattccgatccgtaagaaggagcgcaatcccatggacatctttgacatggctcgtcaccggctgcaagcccctgtcagaaggcaatcccccaagggattggatgcggccacatttcagaatgtgcatgattttaacgagctcaaagatcgagattctgagactagggtcgatctcaaattcatgtacctcgatccaccacgtgaccaccacaccttggagatacaacaacaagctttgcttcgcgagcaacaaaaaaggcttaacagaattaaaatgcaggaaggcgcaaaagttgatcttgacgcgattcccagcgcaaaggtacgcgaacagcgtatgccccgagatgacacctcagattttctcaaaaatagtctccttgagagtgacagtgccttcatcggggcatacggtgagacctatcccgccatagaagatgatgttctgccgccgccgtcccagctgccctccgccagggagaggcgccgcaacaaatggaaaggcttggacattgacagttctagaccaaatgtcgccccagatggcctgtcactgaagagcatctctagcgtcaatgtcgatgagctcagagtccggaatgaagagagaatgcgcagactgaatgaatttcacaacaaacccatcaatactgacgacgagtccagtctcgtcgaccccgacgacattatgaaacacatcggggatgacggctctaactcagtcgctacagagccctggctacggcccggcaccagcgagactctgaagcgcttcatggccgaacagttaaaccaagagcaacagcaaattcctggtaagcccgggacattcacctggcagggccttagcacagcgcacggatag

SEQ ID NO: 111705 - DNA, 2631 bp, Artificial Sequence
  Description of Artificial Sequence: Synthetic coding sequence
atggatgagcggtttaggtacgagtccgatttcgatcgccgtttgagtcgtgtgtacacgaacgaccgaatgcaccgtaacaagcggggcaacatgccccctatggagcatgacggcgatgtcattgagcaatcaaacatccgtatctcatcagctgagaataaaagtgcccccgataatgaaacttccaagtctgctaatcaggacacctgttcccctttcgccggtatgctgtttggtggggaagaccgggagctcatccagcgcaggaaggaaaaatataggctcgaactgctggaacagatggcggagcagcagcgaaacaaacggcgcgagaaggaccttgagctgagggtggccgctagcggggcacaggatcctgagaagagcccagatcgactaaagcaatttagcgtggcgccccgacactttgaagagatgatccccccggaacggcctagaattgcatttcaaaccccgctcccccccctgagcgccccaagcgttccaccgattccatccgttcatccagtgccatctcagaacgaggatctccgatcaggtctcagctccgctttgggtgagatggtctctccaagaatcgcacccctgcccccacccccgttattgccaccgttagccactaattataggacgccctacgacgatgcttactatttttacggttctcggaacacctttgaccccagcctggcctactatgggtctggcatgatgggcgtccaacccgctgcatacgtctccgcaccagtgacgcatcagttagctcagccagtggtaaataccgtcggacagaatgagctcaagatcactagtgaccaggtgatcaatagcggattaatctttgaagacaaaccaaaaccatccaaacaaagccttcaatcgtatcaggaagctttacaacagcaaattagggagagggaagagagaaggaagaaggaacgcgaggagaaggaggagtatgaagcaaagttagaagcggagatgaggacctacaatccctggggaaaaggcggaggtggcgcaccccttcgggacgcaaaaggcaacctgatcagccacatgcagacccagtccagcccttttgcccgcgggaacgtgtttggagaacccccaaccgaactccagatcaagcagcaggagttgtacaagaactttctgcgattccagattgaggaaaagaagcagcgggaggaagcagaacgcgaacgcctccgaatagcggaggagaaggaagagagacgcctggctgagcagcgcgcacgaatccagcaagagtacgaggaggaacaagagaagaagcgggaaaaggaggaagaacaacggctgaaaaatgaggagcatattcggctagcggaggaacgacagaaggaggcagagcgcaagaaaaaggaggaagaggagaaatacaacctgcagctgcagcattactgtgaacgggacaacctgatcggcgaggaaaccaaacacatgaggcagccctctccgatcgtaccggctttgcagaataagatagcaagtaaactgcagagacccccttccgtggactcaatcatacggtcttttatccatgaaagctccatgtctcgtgcccagagtccacccgtgccagctcgtaaaaaccagttacgcgctgaggaggagaagaaaaacgtgattatggaactgtccgaaatgcggaaacagctgcgctctgaggagagaaggcttcaggagaggctgctgcacatggacagcgatgatgagatcccaatacgaaagaaggaacgaaaccccatggacatcttcgatatggcacgccaccgccttcaggcacccgttcgcagacaatcaccaaagggcctggacgcggctacattccagaacgtacatgacttcaatgaactgaaggatagagactcagaaaccagggtagacctaaaatttatgtacctggacccaccgcgggatcaccatactctcgagatccaacagcaggccctgttacgagagcagcagaagaggctcaatagaatcaagatgcaggaaggagccaaagtcgaccttgacgccatcccaagtgccaaggtgagagagcagaggatgcctagagacgacacttcagactttctaaagaatagcttactggagagcgacagcgcatttatcggagcttatggcgaaacatatcccgcgatcgaggacgacgtcctgcccccaccttcccagctgcctagcgcgcgcgagcgccgccgtaacaagtggaaggggctggatattgacagcagccggccaaatgtggcccccgatggactgagcctgaagagcatcagtagtgtgaacgtcgatgaactgcgggtgcgcaacgaggaaagaatgcggagactgaatgagttccataacaaaccgattaataccgacgacgaatcaagtctggtggaccccgatgatatcatgaaacatattggtgacgacggctctaattcagtcgcgactgaaccctggctgcggcccggtacctcagagacattaaaaaggtttatggccgaacagctgaaccaggaacagcaacagattcctggcaagcctggcacctttacatggcaggggctctccaccgcccatggctag

SEQ ID NO: 111706 - DNA, 1677 bp, Artificial Sequence
  Description of Artificial Sequence: Synthetic coding sequence
atgccatggcggcggaggcgcaacagagtgagtgccctggaagggggaagagaggaggaggcacctcccgaagcagccgccgttccccccgccttactcactagcccacaacagaccgaggccgcagcggaaaggatactgctgagaggaattttcgaaattggccgagactcctgcgacgttgtccttagtgaacgagctctgcgatggcgacccattcaacccgaaagaccagctggtgattccaagtacgacctcttgtgcaaggaggaattcattgagctcaaagatatcttcagcgtgaaattgaagagacgctgctcagtcaaacagcaacgctctggcacactgctcggcatcacgctgttcatctgtttaaagaaagagcaaaataaactgaaaaatagcactttggatttgatcaacttgagcgaggatcactgtgatatatggttcagacaatttaagaaaatacttgcaggatttcctaaccgccctaagtctctaaaaattctattaaacccacaaagccataaaaaggaggccacccaggtgtactatgagaaggtggagcccttactgaaactagccgggataaagaccgacgtcactataatggaatatgaggggcacgcactctccttactgaaagagtgcgaactgcagggcttcgatgggggacaccgcaagcctctgttcgcgatacattggtctgttcagcggttattcacaggaatgcagaccctggagcccagcgtcgtgtgcgtcggaggcgacggttccgcctccgaagtggcacatgccctcctgttgcgcgctcagaagaacgctggaatggaaacagacagaattctcaccccagtccgggcccagctccccctcggtcttatccccgcaggcagcactaacgttctagcacattccctgcacggggtgccccacgtcatcactgccaccttgcacataatcatgggccacgtacagcttgtggacgtgtgcaccttcagtactgctggcaagctgctccgttttggcttcagcgcgatgtttggcttcgggggccgcaccctagccctggcggagaaatataggtggatgagccctaatcaacgccgggattttgccgtcgtgaaggcgctggcaaaactgaaagccgaggactgtgagatcagcttcctgccttttaattctagtgacgacgtgcaggaaagacgagcccaagggagtccgaaatccgattgtaatgaccagtggcaaatgatacagggacagttccttaacgtgagcattatggcaatcccttgtctttgtagcgtcgctccccgggggttggcgcccaacactaggctgaacaatggctccatggctctgatcatagctcggaacacctctcgtcccgaattcattaaacatctcaaacgctacgcgagcgttaagaatcaattcaatttcccatttgtggaaacctacaccgtggaggaagtcaaggtgcacccccgcaataatacgggaggctataacccagaggaggaggaggacgaaaccgccagcgagaattgttttccttggaacgtagacggcgacttgatggaggtggcttctgaggtgcatattagacttcaccctcggctgatttcgttatacggtggatccatggaagaaatgattccaaagtag

SEQ ID NO: 111707 - DNA, 1260 bp, Artificial Sequence
  Description of Artificial Sequence: Synthetic coding sequence
atgccctggcgtcggaggcggaatagagtctctgcgttggagggtgggagagaagaggaggctccccctgaggcagcagcagtcccacctgcactgcttacctcaccccagcagacagaagccgccgcagagcggattctgttaagggggatcttcgaaatcgggcgagacagttgtgatgtcgtcctgtcggaacgggcccttcggtggagacccattcagccggaacgccctgccggcgactccaagtacgacctgctttgcaaagaggagttcattgaactgaaggacatcttctcagtgaagctaaagcgcagatgctctgtgaaacagcagaggagcggcacgttgctcgggattactctgtttatttgcctgaaaaaggaacagaacaagctgaagaacagtactctcgaccttatcaacttatctgaggaccattgtgatatctggtttcgccagtttaaaaagatattggcgggatctacaaacgtactagcccactcgctgcatggggtacctcacgttattaccgccacactccacataatcatggggcatgtgcaacttgttgatgtgtgcacgttttcaaccgccggcaagttgttgagattcggttttagcgctatgttcggttttgggggacggacactcgctctggccgaaaagtaccggtggatgtcccccaaccagcgacgcgactttgccgttgtcaaagctttggctaagctgaaagccgaggattgcgagatatcattcctgcccttcaatagtagcgatgacgtgcaggagaggcgtgcccaaggatccccgaagtcggactgtaacgatcagtggcaaatgatccagggccaattcctgaacgtgtccatcatggccatcccttgtctgtgttccgtggccccacgaggactcgccccaaatacaaggttgaacaatggcagcatggccctgatcattgcgaggaatacctcacgcccagagtttatcaaacatcttaagcgctacgcgagcgtgaaaaaccaattcaacttcccgttcgtggaaacctacacggttgaggaggtgaaggttcatccccgcaataataccggcgggtacaatccagaggaggaggaagatgagacagccagcgaaaattgctttccatggaacgtcgatggcgaccttatggaagtcgcttccgaagtccacatacgactccatcctcggctaatcagcttgtatgggggctcgatggaagagatgatcccaaagtag

SEQ ID NO: 111708 - DNA, 1392 bp, Artificial Sequence
  Description of Artificial Sequence: Synthetic coding sequence
atgccctggcgcagacggagaaacagagtgagcgccctggagggtggacgggaagaagaggctcccccggaggccgccgcagttcctcccgcgcttttgaccagccctcagcaaactgaagccgcagccgagagaattctgttgagaggcatttttgaaatcggtcgcgactcctgtgatgtcgtcctcagtgagagagccttgagatggaggcccatacagcctgaacgcccagctggcgactccaaatatgaccttctctgcaaagaagagtttatcgaattgaaagacatcttctcagtgaaactgaaaaggaggtgcagtgtgaaacagcagcgtagcggcacgctgctagggatcactctcttcatatgcttgaaaaaggaacagaacaaactcaaaaacagtacactcgatctgatcaacctgtcggaagatcattgtgatatttggttccgccagttcaaaaaaatcttggccggctttccaaaccgccccaaatccctgaagatcctacttaacccccagtcccacaagaaggaagcgacacaggtgtactacgagaaggtggagcccctcttgaagctggcgggcattaaaacagatgtcacgcgcagcactaatgtgctggcccatagcttgcatggcgttccccacgtgataactgccacacttcacattattatgggccacgtacaactggtcgatgtgtgcacattcagcaccgcagggaagttgttaaggtttggctttagtgccatgtttgggttcggagggcgcacactggcccttgccgagaaataccgttggatgtctcccaaccagaggcgcgacttcgctgtcgtcaaggcgctggcaaaactcaaggctgaggattgcgagatttccttcctgccattcaattcgtctgacgacgtgcaggagcgtcgtgctcaggggtctccaaaaagcgattgcaacgaccagtggcaaatgatccagggccaatttctgaacgtcagtatcatggccatcccgtgtctttgttctgtcgcaccgcgaggcctcgcacctaacacaagacttaacaacgggtctatggcattaataatcgcccggaataccagtcgtccagaattcattaagcacctgaagaggtatgccagcgtgaagaatcaatttaattttccgtttgtcgaaacttacacggtcgaggaggttaaagttcacccacgaaacaacacaggagggtacaatccagaagaggaagaggatgagaccgcctccgaaaattgcttcccatggaatgtggacggggatcttatggaagtcgccagcgaggtgcacatcaggctgcacccccggctgatttccctttatggtgggtccatggaggaaatgatcccaaaatag

SEQ ID NO: 111709 - DNA, 1599 bp, Artificial Sequence
  Description of Artificial Sequence: Synthetic coding sequence
atgccttggcgacggagacgtaatcgagtgagcgctctagagggcgggagagaggaggaagcacctcccgaggccgcagctgttccgcccgccctgcttacaagtccacagcagacagaagcagctgcagaacgcattctgcttcgggggatctttgaaatcgggcgcgattcttgcgatgtggttctctctgagcgcgcactgcgctggagacccatccaacctgagcgccctgcgggcgacagcaagtatgacttgctttgcaaggaagagttcatcgagttaaaggatatcttctccgttaagcttaagaggaggtgctctgtgaaacagcagcgatcaggcacgctgctcggtattacactattcatttgcctgaagaaagaacagaacaagctgaagaattctacgttggatttgataaacttgagcgaggaccattgcgatatatggtttagacagtttaagaagattctcgcaggctttcccaatcgaccaaagtcgttgaagattttgctgaaccctcaatcccacaagaaagaagcaacacaagtgtactacgaaaaggtcgagccactgcttaaacttgcagggatcaagaccgacgtgaccatcatggaatatgagggtcacgccctgagcctgctgaaagagtgtgagttgcagggctttgatggtgttgtgtgtgttgggggcgatgggagtgcttcagaggtggcccatgccctcctgttgcgggcccaaaaaaacgctggaatggagaccgacaggattctgacccccgtccgtgcacagctgcccctgggcctgatcccagcaggctctacgaatgttctggcacatagcctgcatggcgtaccccatgtcatcacagcgactctgcacatcatcatgggtcacgtgcaactggtggatgtttgcactttcagtacagctggcaagcttcttaggtttggtttttccgctatgtttggcttcggcggccggaccctcgctcttgctgagaaatacagatggatgtctccgaatcagagacgggattttgcagtggttaaagccctggcaaaactcaaggctgaggattgcgaaatatccttcttaccctttaacagcagcgacgatgtacaagagagaagggctcagggttcacccaagagtgactgcaacgaccagtggcagatgatacagggacagtttttgaacgtgagtataatggccattccctgtctgtgtagtgtcgcaccacggggcctggctcctaataccagacttaacaatgggagcatggcgctgatcatcgctcggaataccagtcgtcccgagttcatcaaacatcttaaacgctacgcatcagtaaaaaatcagtttaatttccccttcgtcgagacttatacagtcgaagaagtcaaggtgcaccctaggaataatacagggggctacaaccctgaggaagaagaggatgaaacggcctccgagaactgcttcccatggaatgtggatggcgatctgatggaagtggccagcgaagttcacataagattacaccctagacttatatccctgtatggggggtcaatggaagaaatgattccaaaatag

SEQ ID NO: 111710 - DNA, 1545 bp, Artificial Sequence
  Description of Artificial Sequence: Synthetic coding sequence
atgccttggcggcgtcgccgcaatagggtttccgctcttgaggggggcagagaagaagaggccccccccgaggccgctgcggtccctcccgctcttttgacctctccccaacaaactgaggctgccgccgaaaggatacttcttagggggatatttgaaattggccgtgattcatgcgatgtcgtgctgtccgagagagctttgcgctggaggcctatccagcccgaacgcccggccggagattccaaatacgaccttctgtgtaaggaggagttcattgaactgaaagacatcttttccgttaagctcaaacggaggtgttctgtcaaacagcagcgaagcggcaccctcctgggcatcaccttgttcatttgccttaaaaaggaacagaataagctgaaaaactcgactctggacttgattaacctctccgaagatcattgcgacatttggttccggcagtttaagaaaatcttggccgtcatggagtacgaagggcacgccctgagcctgctgaaagaatgcgagctgcaaggattcgatgggggtcatagaaagcctctgttcgcaattcactggagcgtgcagcgattgttcaccggcatgcagactctagaacctagcgtggtgtgtgtagggggagacggtagtgcgagcgaggtggcccatgctctcctgttgagagctcagaagaacgctggaatggaaaccgatcgaattctgacccccgtgcgcgctcagctgcctctggggctcatcccggccggaagcactaatgtgctagctcattccctccatggggtgccacatgtcattacagcgactctccatataattatggggcatgtgcagcttgtggatgtttgcaccttttctacagccgggaagctgctgcgttttgggttctccgctatgttcggatttggaggccgcaccctggccctggccgagaagtaccgttggatgtctcctaaccaacgtcgcgattttgcggtcgtgaaagctctggccaaactgaaggcggaggattgtgaaattagctttctgcctttcaactcgtctgacgatgtccaggagcgcagggcacagggcagtcctaagagtgactgcaatgatcaatggcaaatgattcaggggcagttcctgaatgtgtccattatggccataccgtgcctgtgctctgtggccccccgcggcctggccccaaacacacgcctgaataatggcagcatggcattgattatcgcccggaatacttcgcgaccagaattcattaagcaccttaaacggtatgcatcggtaaagaatcaatttaatttccccttcgtggaaacatataccgtggaggaagtgaaagttcacccacggaacaatacaggcggatacaatccagaggaggaagaggatgaaaccgcatcagaaaactgcttcccatggaatgtggacggcgatctaatggaggtggccagcgaggttcatatccgtctgcacccccggctcattagcctgtacggagggtcaatggaggaaatgattccaaagtag

SEQ ID NO: 111711 - DNA, 804 bp, Artificial Sequence
  Description of Artificial Sequence: Synthetic coding sequence
atgcacctgttgctgttccagctcctcgtgctgctccctctgggcaagacaacccgtcaccaggacgggagacagaaccagagctcactgagcccagtgctgcttcccagaaaccagcgagagctgccaactgggaatcacgaggaggcagaagagaagcctgatctgttcgtagcggtcccacacttagttgccacatccccggccggagaaggacaacgtcaaagagaaaaaatgctgtcccgttttggcaggttctggaagaaacccgaacgagagatgcacccgtcgagggacagtgactctgagccctttccacccggaacccagtctttgatccagcccatcgacggtatgaagatggagaagagccctctacgcgaggaggcaaaaaaattctggcatcacttcatgttcaggaagaccccagcgagccagggtgtcatcctacccattaagtcccacgaggttcactgggaaacctgtaggacggtacccttctcccagacaatcacccacgaagggtgtgaaaaggtcgtggtgcagaacaacctgtgtttcggcaagtgtggctcggtccacttccccggtgctgcacagcacagccacacttcctgttcccactgcttacccgcgaaatttacaacgatgcatcttcctctgaactgtaccgagctgagttctgtgatcaaggtggtgatgctggtggaggagtgtcagtgcaaggtgaaaacagaacatgaagacgggcatatcctacacgctggctcacaggactcctttatccccggcgtgtccgcatag

SEQ ID NO: 111712 - DNA, 789 bp, Artificial Sequence
  Description of Artificial Sequence: Synthetic coding sequence
atggcatggcttgaagatgtcgactttcttgaagatgtccctctgctcgaggacatcccactcctcgaagacgtgccactgcttgaagatgtcccattactagaggatacatctaggctggaggacataaacttgatggaggatatggccctgctcgaggatgtggacctactggaggacacagactttctcgaggatcttgacttctcggaagccatggacctgcgagaagataaagatttcttagaagacatggattcacttgaagacatggctttgctggaagatgttgacctgttagaagacactgactttctggaggatcctgacttcctcgaggccattgacctgagagaggataaagatttcctcgaagacatggatagcttggaggatctcgaggccatcggccggtgtggcttctctggcagacatggattttttgggcggcgccgcttctcagggagaccaaagttatcaggaagacttgggctactaggtaggagaggattttccggccgcctgggaggatattggaaaacctggatattctggaagacttggattttttggaaaacttggatcttccggaagacttatattgggtggaaaacatggatatttagcgggcggtgcggccttaccggccgacctggctttggaggtcgtaggagattcttttggaaaacactaaccgattggaagacatggatttccttctggaaaacattaatagactggaaaacttggatctctttttggaagacactgattgattggaaaatatag

SEQ ID NO: 111713 - DNA, 1365 bp, Artificial Sequence
  Description of Artificial Sequence: Synthetic coding sequence
atgctggctgagaatcttgtggaggagtttgaaatgaaagaggacgagccctggtacgatcaccaggacttgcagcaggacctgcagctggccgccgagctgggcaagacactcttagatcgcaatacggaactggaggacagtgtccagcaaatgtataccaccaatcaagaacaactacaggagatcgaatacctgacgaagcaggttgaattgctgagacagatgaatgagcagcacgcgaaagtgtatgaacagctggacgtgacagcccgagaactagaggaaacaaatcagaagcttgttgccgactccaaggcctctcaacagaaaatcttgtccctaaccgagaccattgagtgcctccagacaaacatcgaccacctgcaatcacaggtcgaagaactcaagtcgtctggacaggggagacgttcacctgggaaatgcgatcaggagaagcctgctccctcattcgcatgtctcaaggagctgtatgatttaaggcagcatttcgtttacgatcacgtcttcgcagaaaagataacttcgcttcaaggacagccctcacccgacgaggaggaaaatgaacacctcaaaaaaacagtgactatgctccaagcgcagttgagcctggaacgccagaaaagagtgacaatggaggaggagtacggccttgtgctcaaggaaaattccgagctagagcaacaattgggggctaccggcgcctaccgcgctcgggccttggaactggaggctgaagtggccgaaatgagacagatgttgcaaagcgaacatccatttgtgaatggggtcgaaaagctcgtgcccgactccctttatgtgccattcaaggaacctagccagagcttgctcgaagagatgttcctcacggtgcccgagagccaccgtaagccactcaaacggagttcctctgaaaccatattatcttccttggccggttctgacatcgttaaaggccacgaagaaacatgtattcgacgagctaaggcagtaaagcagcgtggtatcagtttgttgcacgaggtggatacacagtatagtgcactgaaggtaaaatacgaggagcttctgaaaaaatgccaagaagagcaggacagtctgagccacaaggccgtccaaacctccagagccgcagccaaagacctgaccggcgtcaatgcacagtccgagcccgtggccagcggctgggaacttgcctcagtcaatcctgaaccagtgtcctctcccacaacaccaccagagtacaaggcgctcttcaaggagatcttctcgtgcattaagaagacaaaacaggagatagacgagcagaggaccaaataccgctctctatcctcccacagctag

SEQ ID NO: 111714 - DNA, 618 bp, Artificial Sequence
  Description of Artificial Sequence: Synthetic coding sequence
atgctcggggccaagcctcattggctccctggccccctgcacagtccgggtctacccctcgtcctggtccttctggccctgggtgctgggtgggctcaggagggctcagagcccgtgctcctggaaggcgaatgcctcgtggtatgcgaacccggaagagccgccgcaggtggtcccgggggcgccgccttaggcgaagcaccacccggtagagtggctttcgccgccgtgcggagccaccaccacgaaccggccggcgagaccggcaacgggacatcaggggccatatacttcgaccaagtattagtcaatgagggaggcgggtttgacagggcctcaggtagtttcgttgcccccgtgcggggcgtatacagctttaggttccacgtggtgaaggtctacaatcgacagaccgtgcaagtgagtttaatgctgaacacctggcccgtgatctcagcctttgctaatgatccagacgttactcgagaggccgcaacatcatccgtgctgctgccacttgaccccggtgacagggtcagcctgcggctgaggcgcgggaacctcctggggggctggaaatacagctccttttccggattcttgatcttccctctgtag

SEQ ID NO: 111715 - DNA, 990 bp, Artificial Sequence
  Description of Artificial Sequence: Synthetic coding sequence
atgatccttatgaaaatgggcttcagcggcattgtggtgcaccaggaatcggtgtgcgctacttatggttctggattgtcgtctacctgcatcgtcgacgttggtgatcagaagacatccgtctgctgcgtggaagacggagtctcacacaggaataccaggatcttcagctggaatcaggacatctcagggctgcaagaccatgaatttcagattcgccatccagacagtccagccctgctctaccagtttaggctgggagacgagaaactgcaggctcccatggctctgttctatccagcgactttcggcatcgtgggccaaaaaatgactaccctgcaacatcggtcccaaggagaccccgaagatccccacgatgagcattacttattggccacacagtctaaacaggagcaaagtgccaaagccaccgccgatagaaagagcgcgagcaagccaataggattcgagggagacctgaggggacagtcaagcgatctccccgagcggcttcactcccaagaggtggacttaggctccgcacagggtgatggcctgatggcgggtaacgacagtgaggaggcattgaccgctctgatgtctaggaaaactgccatctcgctctttgaggggaaggcgctggggctggataaggctattcttcacagcatcgattgttgttctagcgacgacacaaagaaaaagatgtactcatccatcctcgtagtgggaggcggacttatgttccataaggcccaggagtttcttcagcatagaattctgaataagatgccgccttcattcaggcgaatcattgaaaatgtcgacgtgataactcgacccaaagatatggacccaagactcatcgcctggaagggcggcgccgtcctggcttgcctggacacgacgcaggagctgtggatatatcaacgagaatggcagcgttttggcgtgaggatgctccgagaacgggcagctttcgtttggtag

SEQ ID NO: 111716 - DNA, 1131 bp, Artificial Sequence
  Description of Artificial Sequence: Synthetic coding sequence
atggaggagttccacggacgcacactgcatgacgatgatagctgtcaagtgattccggtgctcccgcaggtcatgatgatactgattccaggacagaccctgcctctgcagctgttccacccgcaggaggtctctatggtgagaaacctgatacagaaagaccggacatttgccgtgctcgcatactctaatgtgcaagaaagggaggcacaattcggaactacagcggagatatatgcctacagagaagagcaagattttggtatagagatagttaaagttaaagcgattggaaggcaacgcttcaaggtccttgaactcaggacacagagtgatggaatacagcaggcaaaagtgcagatcctgccagagtgcgttttaccaagtaccatgtccgccgttcaactcgaatctcttaacaagtgtcaaatttttccctccaaaccagtaagccgtgaggaccagtgttcatacaagtggtggcaaaagtaccagaaaaggaaatttcactgcgcgaacctcacaagttggccccgctggctgtatagcctctatgacgccgaaacattaatggacagaattaagaagcagctccgcgagtgggatgaaaacctcaaagacgactcccttccttccaacttctcctatcgcgtcgccgcatgcctaccaatagacgatgtgcttagaatccagctgctcaaaattggcagtgccattcagcggctccgctgcgagttggatatcatgaacaagtgcacaagtctgtgctgtaagcagtgtcaggagacagagattacaaccaagaacgagattttctcactcagtctctgcgggcccatggccgcgtacgttaacccacacggctatgtccacgaaacccttaccgtctacaaagcctgcaacctaaacctgataggcaggccttccacagagcatagctggtttccgggctacgcttggaccgtggcccaatgcaagatctgcgccagccacatcgggtggaagttcactgccaccaagaaagacatgtcaccacagaaattttgggggctgactaggtcagccctgctccctacgatcccagatacggaagatgagatatcacctgataaggtcatactgtgcctgtag

SEQ ID NO: 111717 - DNA, 1326 bp, Artificial Sequence
  Description of Artificial Sequence: Synthetic coding sequence
atggctggagagggtgaccagcaggacgcagcccataacatgggcaaccacttgcccctcttacctgaaagcgaggaagaggacgagatggaagtggaagatcaggactctaaggaggctaagaaacccaacattatcaacttcgacactagcttgcccacttcccatacttacctcggcgcagatatggaggagtttcacgggcgcaccttgcatgatgacgattcgtgccaggtcattcctgtgttaccacaggtgatgatgattctgatccccgggcaaaccctgcccctacaactcttccacccccaggaggttagcatggtccggaacctgatccagaaggaccggacctttgctgtgctggcgtatagtaacgtacaagagagggaggcccagtttggaacgactgctgagatatacgcatatcgtgaggaacaagattttgggattgagattgtgaaggtcaaagctataggaaggcagcgcttcaaagtgttagagctgagaacccagtcagatgggattcagcaagccaaagtgcagatcctgcctgagtgtgtcctaccaagcactatgagcgcggtccagctggagagtcttaacaagtgtcaaattttcccctctaaacctgtgagtagggaggatcagtgctcatataagtggtggcagaaatatcagaagagaaagtttcactgtgccaacttaactagctggccccggtggctgtacagtctttacgacgctgaaacgcttatggatagaatcaaaaaacagctgagagagtgggacgagaacctgaaggacgatagcttacccagcaaccctatagacttttcctatcgtgtggccgcctgcctgccaattgatgatgtcctgcgcatacagcttctgaagatcggatctgccatccagcggctgagatgcgagctggatatcatgaacaaatgtacttccttatgctgtaagcagtgccaggagacagaaatcactacaaagaatgagattttctcacttagcctgtgcggtccgatggctgcttacgttaatccacacgggtatgtccacgagacccttaccgtatacaaagcctgcaatttgaaccttatcgggcgcccttcaaccgagcactcgtggttccctggttatgcttggaccgtggctcaatgtaaaatctgcgcctcccatatagggtggaaattcaccgcaactaagaaagatatgtccccccagaagttttggggtctgactcgatccgcactccttccgacgatccccgatacagaggacgagatctcacccgacaaggttattctttgtctatag

SEQ ID NO: 111718 - DNA, 1335 bp, Artificial Sequence
  Description of Artificial Sequence: Synthetic coding sequence
atggaggaagaagggaagaagggcaaaaaacccgggattgtaagcccattcaaacgcgtttttcttaaaggcgagaagtcccgggataagaaggctcacgagaaggtcacagagagaaggccactacatacagtagtccttagcctccctgaacgcgtggagccagatagactgctgagtgactacatcgagaaggaagtaaagtaccttggccaactaaccagtatcccagggtacctgaatccttccagtcggaccgaaatccttcacttcattgataacgcaaaaagagcccaccaactgccgggacatctcacccaggagcacgatgccgtcctgtcactgtcggcctacaacgtgaaacttgcctggagagatggtgaggacatcatactgagggtccccatccacgacatcgctgctgtgtcctatgtcagggacgatgctgcccacctggtggtactgaagaccgcacaggatcctgggatcagcccatcccaatcactgtgcgccgagagcagccgtggactgtctgctggtagtctgtccgagagcgctgtgggcccagtcgaagcctgttgcctggtcattctggcagcagagtccaaggtggcagcagaggaactctgttgtctgctgggacaggtgttccaggtggtgtataccgaatccacaattgacttccttgaccgcgcaatctttgatggcgctagcacccctacacatcacctatccttacactcggatgacagctcgacaaaggtggatattaaggaaacatatgaagttgaggcaagtaccttttgctttcccgagtctgtagacgttgggggtgctagcccccatagcaaaaccatttcagaaagcgagctgagcgcatcagcaaccgagctcctccaggattatatgctcacactccgaaccaaactatctagtcaggagattcagcaattcgccgccctactccatgagtatcggaacggagcctccatccacgaattctgcatcaacttgcggcagttatacggcgattcccgcaaatttttactgctgggattaagacccttcatccccgaaaaggacagtcagcactttgaaaactttttggagactatcggggtcaaagacggaaggggaatcattactgattccttcggcagacatcgcagagcattaagtactaccagttctagcacaacaaacggcaaccgagctactggttcctctgatgaccggtccgccccatccgaaggggacgagtgggatcggatgattagtgacattagttcagatatcgaggccctcggttgcagcatggaccaggattctgcctag

SEQ ID NO: 111719 - DNA, 1398 bp, Artificial Sequence
  Description of Artificial Sequence: Synthetic coding sequence
atgcacagctcctgtaggcagcggagaaatcaaaatctctcaaaagagatcccccagacggagtttcacactggttattctatggagaacgagcccggcattgtgtctccattcaagcgggtgtttcttaagggggaaaagtcccgcgataagaaagcccatgagaaggtaactgaaagaaggccactgcacacagtcgtgcttagcctccccgagcgggttgagccagaccggctactgtccgactacattgagaaggaggtaaaatatctggggcaactcacaagcataccgggctacttgaacccctcatctcggaccgaaatcctccactttattgacaatgccaaaagggcccaccaactgcccggacatctaacacaggaacatgatgccgtgctgagcctttccgcatacaacgttaaactggcatggcgggatggggaagacatcattttgcgagtccctatccacgacattgccgccgtctcatatgtccgtgatgacgctgcccacctagtggtcctaaagactgctcaagatcctgggatctccccaagtcagagtctgtgtgctgaatccagccgcggactgtctgcgggctcactgagtgagagtgccgttggtccggtggaggcatgttgcctcgtcatattagccgcggaatctaaggtcgccgctgaagaactctgctgcctccttggacaggtctttcaggtggtgtatacggaaagtactatcgatttcctggacagggcgatctttgacggcgcttcaacacccacgcaccacttatctctacatagtgatgacagcagtactaaggttgatattaaagagacctacgaggtcgaggcttcaaccttctgcttccccgaatccgtagatgttggaggcgcgtctcctcactcaaagaccatctctgaatctgaactctcggcctcagcaaccgagttactccaagactatatgctcacgttaagaacaaagctgagcagtcaggagatccagcagtttgccgcactgctgcacgagtataggaatggtgcatccatacatgaattttgtataaatctccgccagctctacggcgattcacggaagtttctgctgctgggcctacggccttttataccagagaaagacagtcaacatttcgagaattttctggagaccattggggtgaaggacggaagggggatcataaccgatagctttggcagacacaggcgggccctgtcaactaccagtagttctacaacaaatgggaaccgcgctaccggctcaagcgatgatagatctgcccctagcgagggagacgagtgggaccggatgatctccgacatatcttctgatatcgaagcactgggctgttccatggaccaggactctgcttag

SEQ ID NO: 111720 - DNA, 1317 bp, Artificial Sequence
  Description of Artificial Sequence: Synthetic coding sequence
atggaaaatgaacccgggatcgtgtccccgttcaagagggttttcctgaagggagaaaagtccagagacaaaaaggcccatgagaaagtgaccgagcgacgccccctgcatactgtggtactctcattgcctgagcgcgtggagcccgaccggttgctgtcagattatatagagaaagaggtcaagtacctcggacagctcacctcaattccggggtacctgaatcctagctccaggaccgagatcctccatttcattgataatgccaaacgggcacatcaactcccaggtcacttgacccaagaacatgacgccgtcctgagtttatcagcttataatgttaagttggcttggagagacggggaggatatcatactaagggtcccaattcatgacatagcagccgtgagctacgtgagggatgacgcagctcacctcgtggtgttgaaaacagctcaggacccaggcatcagccccagtcagtctctgtgtgccgagagttcccggggtctttccgccggctcccttagtgagtctgccgtgggtcccgtggaagcctgctgcctggtgatacttgcagccgagtctaaagtagccgcagaggagctatgctgtttactaggtcaagtgtttcaggttgtgtacactgagtctacgatagatttcctggaccgggcgatctttgatggtgccagtacgccaacccaccacctgagcctccatagcgacgactctagcaccaaagtagacattaaggagacatatgaggttgaagcatcaaccttctgttttcctgagagcgtggacgtgggcggcgcaagccctcacagtaagactattagcgagtctgaactgtccgccagtgccacagagctgctacaggactatatgctgactctaaggacgaagcttagcagtcaagaaatacagcagttcgcggcactgctacatgaatacagaaatggtgcaagcatccacgaattttgcatcaatctgagacaactgtacggagatagtaggaagttcttactgctcgggttgagacctttcatccccgagaaggattcccaacactttgaaaactttctagagacaattggcgtaaaggatgggagaggcattattacggattctttcgggcgccaccggcgcgccttgtcaactacttcaagctctaccactaacggaaaccgcgctacagggtctagcgacgatcgcagcgccccgtcggagggtgacgaatgggacaggatgatctcggacatttcaagtgacattgaggctctcggctgctcaatggaccaagatagcgcttag

SEQ ID NO: 111721 - DNA, 1161 bp, Artificial Sequence
  Description of Artificial Sequence: Synthetic coding sequence
atggaagaggagggcaaaaaagggaaaaagtacctaggccagctgacatcaattccgggctacttgaatccctcctcgcgaaccgagatactgcacttcattgataacgccaagcgcgcccatcagctgccaggccacctgacacaagaacacgacgccgttctgtcattgtccgcgtataatgttaaactggcctggagagatggcgaagacataatcctccgcgtcccgattcatgacattgctgccgtgagctacgttagggatgacgcagctcacctggtggtcttgaagacggcccaggaccccggcatttcacccagtcagtccctctgcgctgaaagctcaagggggcttagcgcaggttccctgagcgaatcggcagtgggcccagtggaggcatgttgcctagtgatccttgccgccgagtccaaagtggccgccgaggagctttgctgcctgcttggtcaggttttccaggtggtctataccgaatcaaccatcgactttcttgatcgcgccatctttgacggggctagcacccccacccaccacctatcactccactctgatgactcaagtacaaaagtggatattaaagagacttatgaagtggaggcctcaacattttgcttccccgagtcagtggacgtgggcggtgccagtccacatagcaagacgatcagcgaatctgagctgagcgcatcggcaacagagctcctgcaggactatatgctgactttgagaacaaagttgagctcccaagaaatccaacaattcgccgctctgctccacgaatataggaacggcgcgtcgatccatgagttctgtataaacctgagacagttgtatggcgacagcagaaaatttctgcttctgggccttaggccgtttatcccagagaaggattcccagcattttgaaaacttcctagagacaattggagtcaaggacggcagaggtattattacggatagcttcggtcgtcatagacgggctctctctacaacatcgtcctccacaacaaacggcaatcgcgctacgggttcaagtgacgaccggtccgctccgtctgaaggtgacgagtgggaccgaatgatctctgacatctcgtctgacatcgaagcactgggatgttctatggaccaggactctgcttag

SEQ ID NO: 111722 - DNA, 216 bp, Artificial Sequence
  Description of Artificial Sequence: Synthetic coding sequence
atggaagaggagggcaagaaaggcaaaaagcctggcatcgtgagtccctttaaacgcgtgtttctcaagggagagaaaagtcgcgacaagaaggcccatgagaaggtaaccgaacgcaggcctctgcacactgtggttcttagcctgccggagcgcgtggaaccagatcgactgctgagtgattacatcgaaaaggaggtgaaaggcagccactag

SEQ ID NO: 111723 - DNA, 1062 bp, Artificial Sequence
  Description of Artificial Sequence: Synthetic coding sequence
atggaagaggagggaaagaagggtaaaaaaccaggcattgtttcaccatttaaaagggtcttccttaagggagagaagagtagggacaaaaaagcacatgaaaaggtcacggagagacggcccctccacaccgttgtcctctcacttcctgagagggtggaacccgatcgattacttagcgactacattgaaaaagaagtgaagtatctaggccagctcaccagcattcctggctatctcaatcctagctcccggacggagatcctgcattttattgacaatgcaaagcgggcccatcagttacccggccacttgacacaagagcacgacgcagtcctctccttgagcgcctacaacgtgaaactggcatggcgcgacggtgaggatattattctgcgcgtgcctattcatgacattgccgccgtgtcttacgtgcgcgatgacgctgcccacctggtcgtgctcaaaactgatgattcctcaaccaaggtggacatcaaagaaacctacgaggtcgaggcttcaactttttgctttcccgaatccgtggacgtggggggggcctcaccacatagtaagaccatctccgagtctgaactctccgccagtgccactgagctgttacaggattatatgctcacgctgcgtaccaagctgtcatcacaggagatccagcagtttgccgccctgctgcatgagtaccgtaatggagccagcattcacgaattctgtattaacctcagacagttgtacggtgacagccgcaagtttctgttactgggactacgtccatttatccctgaaaaggactcacagcattttgaaaacttcctcgaaacaattggggtgaaagatggcaggggcattatcacagattcgtttggccgccacagacgagcccttagcacgactagctcctctacaaccaatggaaatagggctaccggaagcagtgacgacaggtctgctccctcagaaggggatgagtgggaccgcatgattagcgacataagcagtgacattgaagccctgggttgttcgatggaccaagacagcgcatag

SEQ ID NO: 111724 - DNA, 1224 bp, Artificial Sequence
  Description of Artificial Sequence: Synthetic coding sequence
atgcggaggaatctgaggctgggcccctcctctggagccgacgcacaaggacagggcgcccccagacctggactggctgcgccacgtatgctgctcccccccgcgtctcaggcatcccgcggtagtggatcaactgggtgtagcctcatggcccaggaagtcgacacagctcagggtgcggaaatgagacgaggagctggagccgcccggggcagggccagctggtgttgggcattggccctcctgtggctagccgttgtgcctggctggagtcgcgtgtccgggatcccctctcgacggcactggccagtgccctataaaagattcgacttccggcccaagcccgatccatattgccaggcaaagtacaccttctgccctactgggtcacccataccggtgatggagggagacgatgacattgaggtcttccgtctacaggcccccgtgtgggaatttaagtatggggacttgctcggacacctgaagatcatgcacgacgccattgggttcaggagcaccctaacaggtaagaattatacaatggaatggtatgagctgttccagttgggcaattgcactttcccacacttgagacccgaaatggacgctccattctggtgtaaccaaggggctgcctgttttttcgaggggattgatgacgtccactggaaggaaaatggcacactggttcaggtggcaactatcagcgggaatatgtttaaccagatggccaagtgggtaaagcaggacaatgaaaccggaatttattatgagacttggaacgtgaaggcatctcccgagaagggcgctgaaacctggtttgattcttacgactgcagtaagttcgtgctgcgcacttttaacaaactcgctgagttcggggccgaatttaaaaacattgagacgaactacacacgcatcttcctgtattctggagaaccaacctaccttggtaacgagacatctgtgtttgggccaacagggaataagaccctgggactcgctatcaaacggttctactatccttttaagccacacctccccactaaagagtttctcctcagcctcctgcagatcttcgacgccgtaatcgtgcacaagcagttctatctgttttacaattttgaatactggtttctgccaatgaaattcccttttatcaagataacgtacgaagaaattcctctcccaatcagaaacaagacactcagcggcttatag

SEQ ID NO: 111725 - DNA, 822 bp, Artificial Sequence
  Description of Artificial Sequence: Synthetic coding sequence
atggagggcgacgatgacatcgaagtctttcgcttacaggcccccgtctgggaatttaagtacggggaccttctgggacatctgaaaattatgcatgatgctattggctttcggtccaccctcactgggaagaattatactatggagtggtatgagctgtttcagctcggaaactgcacttttccccacctgaggcccgaaatggacgcccctttctggtgtaatcaaggcgcagcatgcttcttcgagggtattgacgatgtacattggaaggagaacggaaccctggtgcaggttgctacaatctccggtaatatgttcaatcagatggcgaaatgggtgaagcaggataatgagaccgggatctattacgaaacctggaacgttaaggccagccccgaaaagggcgctgagacctggttcgatagttacgactgctccaaattcgtgttacgcacctttaacaagttagccgaatttggagccgagttcaagaacatagagaccaactataccagaatctttctctactcaggcgagcctacatacctaggcaacgagacatctgtgtttggacccacgggcaacaaaactcttggactggctattaaacgcttttattacccgtttaagccgcatctcccgacaaaagagttcctgctgtccttgctccagatcttcgatgccgtcatcgttcacaaacagttctacctgttttacaactttgaatactggtttctgcctatgaagttcccattcatcaaaataacgtatgaggaaatccccctgcctataagaaacaaaacactgtccgggctgtag

SEQ ID NO: 111726 - DNA, 1077 bp, Artificial Sequence
  Description of Artificial Sequence: Synthetic coding sequence
atggcccaggaagttgacaccgctcagggtgccgagatgcggagaggggccggagcggctcgagggagggctagctggtgctgggctctcgcactgctctggctcgctgtggtgcccggatggtcacgggtttcaggaatcccaagtaggcgccactggcctgttccatacaagagattcgactttaggccgaaacccgacccgtactgccaggctaaatacaccttctgtccaacaggtagcccaatcccggtgatggagggtgacgacgatatcgaagtattccgtcttcaggctccagtctgggagttcaaatatggagacctactcggtcaccttaaaataatgcatgacgctattggttttagaagcaccctgaccgggaagaactatacgatggaatggtacgagctgttccagctggggaactgcacctttccacatttgcggcccgaaatggacgcccctttttggtgcaatcagggagctgcctgtttcttcgagggcattgatgacgtgcattggaaggaaaacggaactttagtgcaagtcgctaccatttccggaaatatgttcaatcaaatggccaaatgggttaaacaggacaacgaaacaggaatctactacgaaacttggaacgttaaggcgtcaccggagaagggcgctgaaacttggttcgactcttacgactgctctaagttcgtgttaagaacctttaacaaactcgcggagttcggcgcagagttcaagaacattgaaaccaactatacccggatcttcctctattccggcgaacccacctatctgggtaacgagacaagcgtcttcgggcccaccggtaacaaaacgctgggccttgctattaaacgattctactatccctttaagccccacctccctacaaaagagtttctgctctcactgcttcagatcttcgacgctgtcatcgtacacaagcagttttatctgttctacaacttcgagtactggttcttgcccatgaaattcccgtttatcaagatcacttacgaggagatacccctacccatcaggaataaaactctttctgggttgtag

SEQ ID NO: 111727 - DNA, 936 bp, Artificial Sequence
  Description of Artificial Sequence: Synthetic coding sequence
atggaggcaactcggagacggcagcacctgggggccactggaggtcccggtgctcagctgggggcttccttcctgcaggcaaggcacggcagtgtttcagccgacgaggcagctcgcacggcaccgttccacctcgatctgtggttttacttcacccttcaaaactgggtgcttgatttcgggcgacctatcgccatgttggtgttcccccttgaatggttccctctcaacaaacccagcgtcggcgattacttccacatggcctacaacgtgataactccatttctgctgctcaaattaatagaacggtcccctcggaccctgccaagaagtattacttatgtcagtatcattattttcattatgggcgccagcatccatcttgtcggagactccgtgaatcatcgacttctgttttcagggtaccaacaccacctctccgtcagggaaaatcccataataaagaacctgaagcccgagaccctgatcgactctttcgagctcctctactactacgatgaatatctgggacactgcatgtggtacatcccattctttctcatcctattcatgtacttttcagggtgttttactgccagtaaagccgaatcccttatcccggggcctgccctactacttgttgccccctctggcctctactattggtatctggtaactgaaggccagattttcatactgttcatctttacgttcttcgcaatgctcgccctcgttctgcaccagaaaaggaaaaggctcttcctggacagcaacggcctcttcttattctccagcttcgctctcactctgctgttggttgccctgtgggtggcctggctgtggaacgaccctgtccttaggaaaaaataccctggtgtcatctacgtgccagagccatgggccttctacacactgcatgtgtcttcccgccactag

SEQ ID NO: 111728 - DNA, 549 bp, Artificial Sequence
  Description of Artificial Sequence: Synthetic coding sequence
atgaggttacccgcgagattgcccagcaccagtacgagtggaagcacctctcactgtaggactggattctggaccctgggagttccgctcccgtgctggtatagcttgtcaagtggcttccatagcacctcgcccgtgctaggaacgacaagtacgtggccaactacatcatcaaggccatttagctgtagctcggggtgcttcaccgcatcaaaagccgaatctctgattcccggacccgcccttctcctggttgcccctagcggtttatattattggtacctggttacagaaggccaaattttcatcttgttcattttcacgttcttcgccatgctggctctggtacttcaccaaaagcgaaagaggctctttctggacagcaatggactgttcttgttctcctcatttgccctgaccctgttgctggtcgccctctgggtggcttggttatggaatgacccggtgctgagaaagaagtatcccggggtgatttatgttcctgaaccatgggcattttataccttacacgtaagttcccgacactag

SEQ ID NO: 111729 - DNA, 1032 bp, Artificial Sequence
  Description of Artificial Sequence: Synthetic coding sequence
atggcggcggtggccggaaaggaaaggagggcacgaggtcgtccgcggcccgaaacactaggggccatcccacggagggagggaggggaagctgggctgagtcgagctttcaagcctctggcccaggcgccactgtcctgcgaaacatctttgaggaagctgaagttcaagggcaagaagcacgggtcagtttcagctgacgaggctgcaagaacagcacccttccacctcgacctgtggttttatttcaccctgcaaaattgggttttggattttggaaggccaatagcaatgctggtgtttcctctggaatggttccccctcaacaagcccagcgtaggagactacttccacatggcttacaacgtgattacccccttccttctcctcaagctgattgagaggtctccacggaccctgccccggagcattacatacgtaagcataattatcttcattatgggtgcatctattcacctcgtgggcgacagcgtgaatcaccgactcctattcagcggataccagcatcacctctccgtccgggagaaccctattattaagaatttaaagcccgaaaccctgatcgacagcttcgaattgctgtattattatgacgagtacctcggccattgtatgtggtacattccattcttcctgatccttttcatgtacttctccggatgcttcaccgcttcaaaagccgaatccttgatccccggccccgccttgttgctggtggccccttccggtctttattactggtatctagtcactgagggacagatcttcattctgttcatatttaccttttttgctatgctggcattggttctccatcagaagcgtaagagactttttcttgacagtaacggcctcttcctgttctcgtcattcgcgttaacccttctcctggtcgccctgtgggtggcatggctgtggaacgatcccgtcctccgaaaaaaataccccggcgtcatatacgtccccgagccttgggctttttacacacttcatgtctctagtcgccattag

SEQ ID NO: 111730 - DNA, 861 bp, Artificial Sequence
  Description of Artificial Sequence: Synthetic coding sequence
atgaatcctgcttccgatggcgggacgtcagaaagcatattcgacttagactatgccagttgggggataaggtccactcttatggtggcagggttcgtcttctatcttggagttttcgtggtctgtcaccagctgagttcctctttaaatgcaacatatcgcagtctggtcgccagggagaaggtattctgggacctcgctgccacccgcgctgtcttcggggtccagtctaccgccgcgggcctgtgggctcttctgggcgatccagttctgcacgcagacaaggcacgcggccaacagaactggtgttggtttcacatcactaccgcgaccggattcttttgtttcgaaaatgtggccgtgcatctgagcaacctgatctttcggactttcgacttgtttctggttatccatcacttgttcgcctttctgggctttctgggctgtctggtgaacctacaggcagggcattaccttgctatgacaactctgctcctcgagatgagtacacctttcacatgtgtgtcctggatgctactgaaggctggctggtcagaaagtttgttttggaagcttaaccagtggctcatgatccatatgtttcactgccgaatggtgctgacctaccacatgtggtgggtgtgcttctggcattgggatggcctggtttcatcgttgtacctcccccacttaactctgttcctggtgggcctggcactcctgacgttaatcattaatccttattggacacacaaaaaaacccagcagctgctgaacccagtcgattggaacttcgcacaacctgaggcgaagtcccgcccagagggaaacgggcagctgctccggaaaaaacggccttag

SEQ ID NO: 111731 - DNA, 1065 bp, Artificial Sequence
  Description of Artificial Sequence: Synthetic coding sequence
atgtacagagagtgggtggtggtgaacgtgtttatgatgctgtatgtgcagttggtccagggcagtagtaatgagcacggaccagtgaagaggagcagccagagcactctggaaagatcagagcaacaaatcagagccgctagtagcctagaagaacttttgaggattacccactccgaggattggaagctgtggagatgcaggctgagactcaaaagcttcaccagcatggatagtcgatcagccagccatagaagcaccaggtttgcagccactttttatgatatcgaaacactgaaagtaattgacgaagagtggcagagaactcaatgcagcccgcgggaaacctgcgtggaggtggcatcggagctcggaaagtctacgaatactttcttcaagccaccctgtgtaaacgtgtttagatgcggcggctgctgtaacgaggaaagtctgatttgtatgaatactagcacaagttacatctctaagcagttgtttgagatctctgtaccgctcacctcagttccagagctggtccccgtgaaagtggccaaccacactggatgcaagtgtctgcctactgcacctcgtcacccatatagcattatccgccgaagcatccaaatcccagaagaagacagatgctcccatagtaaaaaactttgtccgatcgacatgttatgggactcgaacaaatgcaagtgtgttctgcaagaggagaacccgttagccggtactgaggatcactcacacctgcaagaacctgcattatgtgggccacacatgatgttcgacgaagacagatgcgaatgtgtgtgtaagacgccttgccccaaagatcttatccagcacccaaaaaactgttcatgcttcgagtgcaaggaaagcctcgagacttgctgccagaaacacaaactgtttcaccctgacacctgttcatgcgaggacaggtgcccatttcataccagaccgtgtgcctccgggaaaaccgcgtgtgccaaacactgccgtttccccaaggagaaacgggctgcgcagggccctcatagcaggaagaacccctag

SEQ ID NO: 111732 - DNA, 504 bp, Artificial Sequence
  Description of Artificial Sequence: Synthetic coding sequence
atggagcgttttgttgtaactgctccgcctgcccggaaccgtagcaaaacagctctctacgtcactcctctggaccgtgttaccgaatttgggggggaactacacgaagacggcgggaaacttttctgtactagttgcaatgtcgtgctcaatcacgtgcgaaaaagtgctatttcagaccatttaaagtcaaagacacacacaaagcgcaaggctgaatttgaagagcagaacgttaggaagaaacagcgaccgttgactgcgagcctgcagtgcaattccacggcacagacagagaaggtgagcgtcatacaggactttgttaaaatgtgcctggaagcgaacatccccctggagaaggccgaccaccctgccgtgcgtgcttttctgagccgacacgtcaaaaatggtggaagcatccccaagtcagaccagctgagaagagcgtatttgccagatggatatgagaacgaaaaccaactgctgaacagtcaggactgttag

SEQ ID NO: 111733 - DNA, 504 bp, Artificial Sequence
  Description of Artificial Sequence: Synthetic coding sequence
atggaaagatttgtggtgacggcccctccggcacgtaaccgaagtaaaacagctctatatgtgacgcctctcgatagggtgacagaatttgggggcgagctgcacgaagatgggggaaaactcttctgtacaagctgcaacgtggttttaaatcacgtgaggaaatccgctatcagcgaccatttaaaatcgaagacacacactaagaggaaggccgagttcgaggaacagaacgtgaggaagaaacagagacctctaaccgcatccctgcagtgtaacagcaccgctcagacagaaaaggtttcagtgatacaggacttcgtaaaaatgtgtctggaggccaatatccctttggaaaaggccgaccacccggctgtccgcgccttcctctcccggcacgtaaagaacggcggaagcattccaaagtcagatcaactacgcagagcttacttgcctgatggctacgaaaatgagaatcagcttttgaacagccaggattgctag

SEQ ID NO: 111734 - DNA, 504 bp, Artificial Sequence
  Description of Artificial Sequence: Synthetic coding sequence
atggaaaggttcgtggttaccgccccccctgcccgcaacaggtccaagacagccctctatgttactcccctggatcgtgttactgagttcggcggcgagcttcatgaggatggtggtaagctgttctgcacatcttgtaacgtcgttctgaatcatgtgaggaagagtgcaatatccgatcacctgaagtctaagacccacacaaagcggaaggccgaattcgaagagcagaatgtgagaaagaaacagcgccctcttaccgcatccctacagtgcaactccaccgcgcaaaccgagaaggtcagtgtgatacaggactttgtgaaaatgtgcttggaggctaacatacctctggagaaggcagatcaccccgcggtccgggcctttctgtcccgtcacgtgaaaaacgggggttcaattcctaaatctgaccagctgaggagagcctacctgccagacggctacgaaaatgaaaaccagctgctcaacagccaggactgttag

SEQ ID NO: 111735 - DNA, 321 bp, Artificial Sequence
  Description of Artificial Sequence: Synthetic coding sequence
atggagcgcttcgttgtaaccgcaccaccagcccgcaatagatccaagactgctttatatgtgacaccattagaccgcgtgactgagtttggcggggagctgcacgaggacggaggcaaattattctgcacatcctgcaatgttgtgctcaatcacgtacgcaagagtgctatatctgaccacctaaagagtaagacacatacgaagcgcaaggccgagttcgaggagcagaacgtgcgaaaaaagcagcggccccttacagcctccctccaatgtaatagcacagcgcagactgagaaggtttcggtgatccaggactag

SEQ ID NO: 111736 - DNA, 504 bp, Artificial Sequence
  Description of Artificial Sequence: Synthetic coding sequence
atggaacggttcgtggtcacggccccacctgcgaggaaccgatctaagactgcgctttatgtgactcccttggatagggtgacggagtttggcggggaactgcacgaagatggcggaaaactcttctgcacgtcttgcaacgttgtattgaatcatgtgaggaagagcgcaatttctgatcatctcaaatcgaagactcacaccaagcgtaaggccgagttcgaggaacaaaatgtgaggaagaagcagcgacccctgactgccagcctccagtgtaattccacggcgcagaccgaaaaggtctccgttatccaggacttcgtgaaaatgtgcttggaggcgaacattccacttgaaaaagccgaccaccctgctgtgagagcttttctctctaggcacgtgaagaatggtggatctatacctaagagcgatcagcttagacgggcctacctgccagatggctatgagaacgagaaccaacttctcaactctcaggactgttag

SEQ ID NO: 111737 - DNA, 1608 bp, Artificial Sequence
  Description of Artificial Sequence: Synthetic coding sequence
atggctagccttagcctggctccagtaaacatcttcaaggcaggtgccgatgaggagagggcagagacagcacgactgacctcgttcataggtgccatagcgattggcgatttggtgaaaagcacgttggggcccaaagggatggacaaaatactcttgtcttccggcagagacgcatccctaatggtgacaaatgatggagctaccatcctgaagaacatcggagtggacaacccggccgcgaaggtgttggtggatatgagccgcgtgcaggacgatgaggttggcgatggtacgacgtccgtgacagtgttggccgctgaactgttgagagaggctgaaagcctgatcgccaagaagattcaccctcagacaattatagcaggctggcgggaggctactaaggcagctcgagaagcactactgtctagtgctgtagaccatggcagcgacgaggtaaaatttaggcaggacctgatgaacattgcggggactactctttctagtaaactactcactcaccataaagaccatttcaccaaattagctgttgaggctgtgctgcgtctgaagggatccgggaacttggaggccatacacatcataaagaaacttggtggtagcttggccgatagctatctggacgagggttttctgttggataaaaaaattggcgtgaaccagcccaaaaggatcgaaaacgctaagatcctgattgcaaacactggcatggacactgacaaaattaagatctttgggtcccgggtgagagttgattccactgccaaggtggcggagatcgagcacgccgagaaagagaaaatgaaggagaaagttgaaaggatccttaaacacggcatcaattgctttataaacaggcagcttatttataattacccggaacagctatttggcgcagctggagtaatggccatcgagcacgccgacttcgcaggggttgaacgcttggcactggttaccggaggcgagattgcttctacctttgatcatccagaactagtgaagctcggttcgtgtaaacttattgaagaagtaatgatcggagaagacaagctgatacacttctctggcgtcgccctgggcgaagcctgcaccatcgttctgcggggcgccacccagcagatcttggatgaggcggaaagatcgctacacgacgccctgtgcgtactagcccaaaccgtcaaagactctcggaccgtctacgggggaggctgttctgaaatgctgatggctcacgcggtgacccagcttgccaacaggacacccggaaaggaagcagtagctatggagtcgtatgccaaagcgctcagaatgctccctaccattattgccgataacgccggatatgatagtgcagatctggtagcccagctccgtgcagcgcattctgaaggtaacactactgctgggttagacatgcgggagggcaccatcggagacatggccatacttggaattaccgagtcattccaagtgaagagacaggtcttgctcagcgccgccgaggctgccgaggtcatattgcgtgtggacaacataatcaaggcagcacccaggaagcgggtccctgaccatcacccgtgctag

SEQ ID NO: 111738 - DNA, 1467 bp, Artificial Sequence
  Description of Artificial Sequence: Synthetic coding sequence
atggataagattctcctctcttctggccgagacgcttcgctcatggtgaccaatgatggggcaacaatcctgaagaacataggtgtagataaccccgcagcaaaagttttagttgacatgagtagagtacaggatgatgaggtaggtgatggaacaacaagtgtcaccgtgctggccgcagagttgcttcgcgaagccgaatctttaatcgccaagaaaattcatccacaaaccattatcgctggctggagggaggctactaaggctgctcgtgaagccttgctgagctccgctgtggaccacgggagcgacgaggtgaaattccgccaggaccttatgaatatagcaggcacaaccctgtctagcaagttactgacacatcataaagaccatttcaccaagctcgccgtagaggccgtgctgcgccttaaagggtccggcaacttggaggctatccacataatcaaaaagctcggaggaagtctggctgattcttacttggatgagggcttccttcttgacaaaaaaatcggggtcaaccaacccaaacgcattgagaatgccaagatcctgatagcgaacacggggatggatactgataagattaagatctttgggtcgagagtccgggtggatagcacggcgaaggtggctgaaatcgagcacgcggagaaggaaaaaatgaaagagaaagtggaaaggattctgaaacacggcataaattgctttatcaatcgtcagctgatatataactacccggagcagctcttcggcgccgccggagtcatggctatagagcatgcagactttgctggcgtggagcggcttgctctggtcaccggaggggagatcgcatccacatttgaccatcctgagctggtgaaactcggtagttgtaaattaatcgaggaagtgatgataggggaagataagcttatccacttttcgggagttgctctcggcgaggcttgcactatagtgcttcgtggagccacccaacaaattctcgatgaagcagaacgctcattacacgacgcactatgtgtcctcgcccaaaccgtcaaggacagtcggacggtgtacgggggcggctgcagcgagatgctcatggctcacgctgtgacacagctggccaacaggacaccagggaaagaagccgtggcaatggagtcatacgcgaaggccctccgtatgctccctactatcatcgccgacaacgctggttacgacagcgccgacctggtggcccaactgcgtgcggcccacagtgagggcaatacgacggctggtctggatatgagggaaggcaccataggagacatggccatcctgggtatcactgaatcatttcaggtaaagaggcaggtgctgttatctgccgccgaagccgctgaggtgatcctgagagtcgacaatattataaaggccgctcctcgcaagcgcgtccccgaccaccatccatgctag

SEQ ID NO: 111739 - DNA, 1638 bp, Artificial Sequence
  Description of Artificial Sequence: Synthetic coding sequence
atgatggggcaccggcctgttcttgtgctatcccagaatacaaaaagggagtccgggcgaaaggtccagtccgggaacataaacgctgctaagactatcgctgatattattcgcacctgtctgggccccaagtccatgatgaaaatgctgctcgatccgatgggcggaatagtgatgactaacgacggtaatgctatcttgcgggaaattcaggtacagcatcccgctgcgaagtctatgatcgagatcagccgcacacaagatgaggaggtgggtgatggaacgacgagtgttattattctagcgggagagatgttgagtgtggccgaacactttctagaacaacagatgcatcctaccgtcgtgatttccgcataccggaaggcgctcgacgacatgattagcactttgaagaagatttccattccagtggatatcagcgatagtgatatgatgctcaacataattaacagttccataacaaccaaggctatcagtagatggagttccctcgcatgtaatatagcccttgatgctgtgaagatggtccagttcgaggaaaacggtcgaaaggagatcgacatcaagaaatacgccagagtggaaaagattcctggtggaattatagaagattcctgtgttctccggggtgtgatgatcaataaggacgtcacccatccaagaatgaggcggtatataaagaatccacggatagtgctgctggactctagcctggaatataagaagggggaatctcagaccgatatcgagatcactcgtgaagaagatttcacacggatcctgcagatggaagaggagtatattcagcagttgtgcgaagacatcatccagctcaaacctgatgtagttataacggagaaggggattagtgacctggcccaacattacctcatgcgagctaatatcacagcaatccggcgcgttcgaaagacagataataataggattgcacgtgcctgcggagctcgaatcgtgtcacgaccagaggagttgcgcgaggacgatgtcggcacaggcgccggccttctagaaatcaagaagataggtgatgaatattttaccttcatcaccgattgtaaggaccccaaggcctgtaccatacttctccgcggtgccagtaaagaaatcctgagcgaagtggaacggaaccttcaggacgctatgcaagtgtgccgtaacgtactcctcgaccctcagcttgtcccaggtgggggagctagcgaaatggccgtagcacacgcactcacagaaaaaagtaaagccatgacaggagttgagcagtggccttaccgggcggtggcgcaggctttggaggttatccctcgcacattgattcagaattgtggggctagcaccattaggcttttaacttcccttcgcgctaagcacacacaagagaattgcgaaacctggggtgtcaacggtgaaaccggcaccctggtcgacatgaaggaattgggcatctgggagccactcgcagtcaaattgcagacatacaagaccgccgtggagaccgctgttctgctgctgcgcatcgatgatattgtgtcaggccacaaaaaaaagggcgacgatcagagtaggcagggtggtgcacccgatgccggccaggaatag

SEQ ID NO: 111740 - DNA, 1524 bp, Artificial Sequence
  Description of Artificial Sequence: Synthetic coding sequence
atgatgggacataggcccgttcttgttttaagtcaaaataccaagagggagtcgggacgcaaagtgcagagtgggaacattaatgccgcaaaaatacaagttcagcacccagccgcaaagagcatgatcgagatctcccggacacaggacgaggaagtcggggatggaaccacgagcgtgatcatcctcgccggggaaatgttgagcgtcgccgagcacttcctggagcagcagatgcaccctacagttgtaattagcgcttataggaaagctctggatgatatgatctctactctaaagaaaatttctatccctgtcgacatatcagactccgacatgatgttgaatatcatcaactcctctattaccacaaaagcaattagcaggtggagctcattggcttgtaatattgcactcgatgcagtgaagatggtgcagttcgaggaaaacggacgcaaagagatcgacattaagaagtacgcacgggtggagaagatcccaggcggtataatagaggacagctgcgtgctccgtggtgtgatgataaacaaggatgtgactcacccccgaatgaggaggtatattaagaacccccgtattgtgttattggactcatccctggagtacaagaaaggggagagccaaaccgacatcgagataacacgtgaagaagacttcaccaggattttgcagatggaggaagaatacattcagcaactgtgcgaggatataatccagttgaagcccgacgttgtaatcaccgaaaagggtatcagcgaccttgctcaacattacctcatgcgggccaacatcacagctattaggcgagttagaaagacagataataacaggattgctcgcgcctgcggtgcacgcatcgtgtcccgtccagaagaactgcgcgaggacgatgtaggcactggggccggcttgctggaaatcaagaaaatcggagatgaatacttcacttttattaccgactgcaaggaccccaaagcgtgcaccatcctcctgcgcggtgcctcaaaggaaattctatccgaagtcgagagaaacctgcaggacgcaatgcaggtctgcagaaatgttctcttagacccacagcttgtccctggtggaggcgctagcgagatggcagttgcccatgctttgaccgaaaaatcaaaggccatgaccggcgtcgaacagtggccgtacagggccgtcgcccaagctttagaagttattcctagaacactgatccagaactgtggggcatctaccataaggttgttgaccagtctgagggctaagcacactcaggagaactgcgagacctggggtgtaaatggagaaaccggcaccctcgttgacatgaaggaattgggtatttgggagcccttggccgtgaaactgcagacgtataaaacggccgttgagacggccgtactgctcctccgcatcgatgatatagtgtccggccataaaaaaaagggtgacgatcaaagccgccaagggggagcccctgacgctgggcaggaatag

SEQ ID NO: 111741 - DNA, 1503 bp, Artificial Sequence
  Description of Artificial Sequence: Synthetic coding sequence
atgatgaagatgttgctggaccctatgggcggcattgtaatgaccaatgacggaaacgcaatacttagagagatccaggtgcaacatcctgctgcaaaaagcatgatagaaatctctcgcacgcaggacgaggaagtgggagacgggactacatctgtcataatcttggccggggagatgctgtccgttgctgagcatttcttagaacagcagatgcacccgacagtggtgatctcagcctatagaaaagcgctcgatgatatgatttccaccctgaagaaaatcagcataccggtggatatcagtgacagcgacatgatgttaaacatcattaacagctctattaccacgaaagcaatcagcaggtggtccagcttagcctgcaacatcgccctggacgctgtgaagatggtgcaatttgaagaaaatggtaggaaagaaatcgatattaagaaatacgcacgcgtggaaaaaattccaggcggcattatcgaagacagctgtgtcctccggggcgtcatgattaacaaggacgtgacccacccccggatgagaaggtacatcaaaaatccacgcatcgtattactcgactccagccttgagtataagaagggagagagtcaaacagacatcgagattacaagggaagaagactttaccagaatacttcagatggaggaggagtacatacagcagctgtgcgaggacattattcaactcaaacccgacgtggtgatcacagagaagggcatctcggatttggctcagcactacttgatgcgcgctaacattactgctatcagacgggtgcgcaagaccgacaacaacagaatagccagagcatgcggggctaggatcgtatctcggccggaagagctgcgcgaagacgatgttgggacgggagcaggcttgctcgagatcaagaagataggggacgaatattttacatttatcacagactgtaaggatcctaaagcgtgcactatcttgcttaggggtgcctcaaaggagatattaagcgaagttgaacgcaacctacaggacgccatgcaggtttgccgcaacgtgctgttggacccccagcttgtaccgggaggaggtgcctcagagatggcggtggcccacgccctcaccgaaaaatcaaaagctatgaccggggtagagcagtggccatacagagccgtggcccaggctctggaagtaatcccaaggaccctaatccagaattgcggagctagcaccatacggctgctaacttccttgagggctaagcatacccaagagaactgtgagacctggggggtcaacggcgagaccggtactctggtggacatgaaggagctgggcatatgggaacctctggctgtgaagctacagacctataagactgccgtggagacagctgtgctattgctgcgaattgacgatatcgtatccggtcataagaagaaaggcgatgatcaatcgagacaggggggtgccccagatgccggccaggagtag

SEQ ID NO: 111742 - DNA, 831 bp, Artificial Sequence
  Description of Artificial Sequence: Synthetic coding sequence
atgtacgaaggcgatttagagggtcagagtatgaattggactagcgaagaagggagaggggatatcattcgttcaggaactaatatcgatcgtgcctggcaatgccaaaatacaaaaagagaatcaggccggaaggtgcaaagcggcaatatcaacgccgccaagacgattgctgacatcatcaggacatgtttaggtcccaaaagcatgatgaaaatgctgcttgatccgatgggcggcattgtgatgacaaatgacgggaacgcgattctgagggagatccaagtacagcacccagctgctaagtcaatgatagagatctcccgcacacaggatgaagaggtgggcgatggaactactagcgtcataatcctagctggggaaatgctgtccgtagcggaacattttctcgagcagcaaatgcaccccaccgtcgtgatttccgcataccggaaggctctagatgacatgatttccacccttaaaaaaattagcattccagtggatatctcggattccgacatgatgttgaacattatcaattcgagcatcactacaaaagcaatatccagatggagtagtttggcttgtaatatcgccctggacgccgttaaaatggttcaattcgaagaaaacgggcggaaagagattgacatcaaaaaatatgctcgggtcgaaaagatccctggtggcatcatagaggacagctgcgtactgaggggagtgatgatcaataaagacgttactcatcccagaatgcgccgctacattaagaatccgcgcatcgtgctattagattcctcgttggaatataagaagggagagtcatag

SEQ ID NO: 111743 - DNA, 486 bp, Artificial Sequence
  Description of Artificial Sequence: Synthetic coding sequence
atgatggggcaccgaccagtgctggttctaagccagaatacaaaaagggaaagtggacgcaaggtgcagtctggtaacatcaatgccgccaagactattgccgacatcattcggacatgtctgggtcctaaatcaatgatgaaaatgttgctggaccctatgggagggatcgtgatgacaaatgacgggaatgcaatcctgcgggagattcaggtgcagcaccccgcagccaaatccatgattgagatatccaggactcaggatgaggaggtgggcgacggcaccacttccgtcattattctagagagtcatagcgtcacaatgctcgagtgcggaggtgccatacttgcgcactgtaacctatgcctgcccgcaggcgagatgctgtcagtggcagaacacttcctcgagcagcagatgcatcccaccgtggtaataagtgcttacagaaaggcattagatgacatgatcagcacattgaagtag

SEQ ID NO: 111744 - DNA, 567 bp, Artificial Sequence
  Description of Artificial Sequence: Synthetic coding sequence
atgtacgaaggagacctcgagggtcagagtatgaactggacctcagaggaagggaggggcgatataattagatctggtacaaacatcgaccgagcctggcagtgccagaatacgaagagagagtccgggcgaaaggtacagtccggtaatattaatgccgctaagattcaggtgcagcaccccgccgcaaagagcatgatcgaaatctccaggactcaggatgaagaagtgggggacgggactaccagtgtgattatcctggccggcgagatgctgtctgtggctgagcacttcctggaacaacaaatgcatcccaccgttgtaatctccgcatatcgaaaagccttggatgacatgatatcaactctgaaaaaaatttccattcccgtggatattagcgactcggatatgatgctgaatatcatcaactcctcaataactacaaaagctatttctcgctggtccagtctcgcgtgtaacatcgctctcgatgctgttaaaatggtgcaatttgaagaaaatggccggaaagagattgatatcaaaaagtatgcacgagttgagtag

SEQ ID NO: 111745 - DNA, 1503 bp, Artificial Sequence
  Description of Artificial Sequence: Synthetic coding sequence
atgatgaaaatgcttctcgaccccatgggggggatcgtgatgactaatgatggcaatgccattctgagggagattcaggtgcaacaccctgccgctaaatctatgattgagatttccaggacccaggatgaagaagtgggagacggtacaaccagtgtaatcattctcgcaggcgagatgttgagcgtggcagagcattttctggaacagcagatgcaccctaccgtcgttatttcagcatatcgcaaggcgcttgacgatatgatcagtacgctgaaaaaaattagcatcccagtagacatctccgacagcgacatgatgttaaacatcattaacagctccatcaccaccaaggccattagcagatggtcttccctcgcctgcaatattgcattggacgcagtgaagatggttcagttcgaggaaaacgggcggaaggagattgacatcaaaaaatatgcccgtgttgaaaaaatcccaggtggaattattgaagactcatgcgtgctgaggggcgtcatgatcaataaggatgtaactcacccccgcatgcgacggtacattaaaaaccctcgcattgttctcctcgacagtagtctcgagtacaaaaagggcgaatcccagactgacattgaaatcacacgcgaggaggatttcacgcggatcctgcaaatggaagaggagtatattcagcagctctgcgaagatatcatacagctcaaaccggacgtcgtgattaccgaaaaaggaatctccgacctggctcagcattacctgatgagagccaatataaccgcgatcagaagggtcagaaaaaccgataataatcgcattgcacgtgcttgtggggcccgcatcgtatctagacctgaagaactgcgggaagatgatgtagggaccggcgctggcctattggaaatcaagaagattggagacgagtacttcactttcatcacagattgcaaagatcccaaagcttgtacgatcttgctcagaggagcgagtaaagagatcctttccgaggtggagaggaatctacaggatgctatgcaggtgtgtcgtaatgtcttgcttgaccctcagttggtgccaggagggggagccagcgagatggcagtggctcacgccctgactgagaagtccaaagccatgaccggagttgaacagtggccctacagggctgtcgcacaggcccttgaggtgattccacgtacccttattcagaactgcggcgcctccactatccggctcctcacaagcctcagggccaagcacacccaggaaaattgtgaaacctggggcgtgaacggcgaaaccggcaccctggtcgatatgaaggaactgggaatttgggaacccctcgcagtaaaacttcagacatataaaacggcagtcgaaacagccgtgcttctgcttcggatagatgatattgtgagcggtcataaaaagaagggagatgatcagtctcgccaggggggtgctccagacgctggccaggagtag

SEQ ID NO: 111746 - DNA, 1620 bp, Artificial Sequence
  Description of Artificial Sequence: Synthetic coding sequence
atgcctgagaatgtggcccctcggtcgggcgccacagcaggcgccgctggaggccgagggaagggagcttaccaagatcgcgataagccagcacagattcgcttcagtaacatctctgctgccaaagctgtggccgatgcaatccggacttcgttagggccgaaggggatggataagatgattcaggacggtaaaggggacgtgacaatcaccaatgatggggcgaccattctaaaacaaatgcaggtgcttcacccagccgctagaatgcttgtggagttgtcaaaggcgcaggacattgaggcaggcgatggcaccaccagcgtggttattatagctggctccttacttgattcatgcaccaagctgctacagaaaggcatacacccgaccatcattagcgagtcgttccagaaggcacttgagaagggcatcgagattttgaccgacatgtctcgcccagttgaactgagcgatagggaaactctgctgaacagcgcaacgaccagcctcaactcaaaggtcgtgagccagtattccagcttgttgtctcctatgagcgtaaacgcagtgatgaaagttatcgaccccgccacagccacaagcgtagacctgagggacatcaaaattgttaaaaagcttggaggcactatcgatgattgtgaactggtggagggcctggttctgacccaaaaggttagtaatagtggtattactagggttgagaaagcaaagattgggcttatacaattttgtttgtcagcaccaaagaccgacatggacaaccagatcgtggtgagcgattacgctcaaatggatagggtgttgagggaggagcgagcttatatactgaacttagttaagcagataaaaaagaccggctgcaacgtcctcctgattcagaaatcaatccttagggacgccctctccgacctggctctccatttcctgaataaaatgaaaatcatggtcataaaagacattgagagggaagatatcgaatttatctgcaagacaatcgggaccaagcccgtggcccacatcgaccaattcacagctgacatgcttggaagcgccgagctggctgaggaagtcaaccttaacgggtctgggaagctactcaaaatcacaggctgcgcgtctccgggaaaaactgtgactattgtggtgcggggtagtaacaaactagtcatcgaggaggccgagagaagtattcacgatgccctctgtgtgattcggtgccttgttaagaaacgggctctaatcgcaggggggggagcgcccgagattgaactggcgctgagactcaccgagtacagcaggactctcagcggcatggaatcttactgtgtgcgagcatttgccgacgcgatggaagtgattccctctaccctggcagagaatgccggactcaaccctatctccacagtaactgaactgaggaataggcatgcgcagggggaaaagactgcggggatcaatgtccgcaaaggcggaatatctaacatccttgaggaattagttgtgcaaccgctacttgtcagtgtctctgccctgactctggccacagagactgtccgctcgattctcaaaatcgatgatgttgtcaatacacgatag

SEQ ID NO: 111747 - DNA, 1452 bp, Artificial Sequence
  Description of Artificial Sequence: Synthetic coding sequence
atggacaaaatgattcaagacgggaagggtgatgttactatcacaaatgacggagccaccatcctgaagcagatgcaggtgcttcacccagcagcccggatgttggtcgagctgtccaaggcccaggatatagaggcaggtgacggaacaacgtccgtagtcatcatagccggttccctgttagactcttgtaccaagctgctacagaaaggtattcacccgaccataatttcagagagcttccagaaggcgctggagaagggtatcgaaatcctgacggacatgtccaggcccgtggaactctccgatagagagaccctgttaaattcagccacaactagcttaaactcgaaagttgtgtctcagtattcgagcctactttccccaatgtccgtgaatgcggtcatgaaagtgatcgatccagctaccgccacctccgtcgacctcagagacattaagatcgtgaagaaactcggagggaccattgatgattgtgagctggtcgaggggttggtgctgacccagaaagtcagcaactcagggattacacgggtggagaaggctaagatcggactcatccagttctgcctttcggcaccaaagactgacatggataaccaaatagtcgttagtgattatgctcagatggaccgtgtgctcagagaggaaagggcctacatcctgaacctggttaaacagattaagaaaaccggatgtaatgttttgctgattcagaagtccatcctgcgggatgcactctccgacttagccctgcattttctgaataagatgaagataatggtgatcaaagatatcgaacgggaggatattgaatttatttgcaaaaccatcggcactaaacctgttgcgcacattgatcagttcacagctgatatgctggggtccgctgagcttgctgaagaggtaaatttaaatgggagcggaaagctgctgaagatcaccggctgtgcgtcacccggcaagacagtgactattgtggtgagaggatctaacaaattggttatcgaggaagccgagaggtccattcatgacgcactgtgtgtgattagatgcctggtcaagaagagagcgctgattgcaggcgggggggcgccagagatcgagctggcactgagactgacagaatatagccggacgctgagcgggatggaaagttactgcgtcagggcatttgccgacgctatggaagtgattccctctaccctagctgagaacgccggactgaacccaatctccaccgtgaccgaactgcgaaatcgccacgcccaaggagagaagaccgctggcatcaatgtccgtaagggcggcatatccaacattctggaagagctggtcgtccagccccttttggtgtccgtatctgcattgactctggcaaccgagactgtgcgcagtatccttaaaatagacgacgtggtgaatactcgctag

SEQ ID NO: 111748 - DNA, 1530 bp, Artificial Sequence
  Description of Artificial Sequence: Synthetic coding sequence
atgcctgagaatgtggcgccccgcagtggagccaccgcgggagccgctggaggacgtggtaaaggggcttatcaagacagggacaagcccgctcagatcaggttcagcaatatatctgccgcaaaagccgtcgctgatgccatacgcacgagcctcgggccgaaaggcatggacaagatgctggtagaactctccaaggctcaagacatcgaagcaggcgacgggacaaccagtgtcgttatcatagcaggatccttgctggattcatgcactaagttgttacaaaaggggattcaccctactattatctctgagagtttccagaaggctcttgagaagggcattgagattttgactgacatgagtaggcctgtggaactgagcgatagagagaccctgcttaacagcgccacaacctctctgaacagcaaagtggtctctcagtactcgagtctccttagtcccatgtccgtgaatgccgtcatgaaggttatcgacccagcaaccgccacttccgtggatctgagagatattaagatcgtcaagaagttaggcggaacaatcgacgactgcgagttggtggaaggcctggtgcttacacagaaggtcagtaactcgggaataacccgggtcgagaaggccaaaatcggtctgattcaattttgtctatccgcccccaagacagatatggataaccagatcgttgtcagtgactatgcacagatggatcgggtgctccgggaagagcgcgcctacatacttaacctcgtcaagcaaatcaaaaagaccggatgcaacgttctgctgatccagaaatcaatcttaagggatgccctttccgatctggctctccactttttgaataagatgaaaatcatggtcatcaaagacattgaacgggaagatatcgagttcatctgtaaaactataggaactaagcccgtagctcacattgaccagtttaccgccgacatgctgggctctgctgagctcgccgaggaggtgaatctgaatggaagcgggaagctgctcaaaatcaccggctgcgcctcacctggaaagacggtcaccattgtggtgagggggtctaacaaattggtcatcgaggaggccgagcggagcattcatgatgcgctttgcgtgataagatgtctggtcaaaaaacgagcactgatcgccggaggtggcgcacctgaaatcgagctcgccctgcgcttgaccgagtactcccgtaccctaagtggcatggagtcttattgcgtccgcgcctttgctgatgccatggaggtgataccatctactttagcagagaatgctgggctcaatcccattagtactgttacagagctccggaatcggcatgcgcaaggggaaaagacggctggtatcaatgtgagaaagggtgggatctctaatatactggaggagctggtagtgcagcccctgttggtgtctgttagcgctctgacactcgccaccgagacagtgaggagcatccttaagattgacgacgtggtgaatacccggtag

SEQ ID NO: 111749 - DNA, 1170 bp, Artificial Sequence
  Description of Artificial Sequence: Synthetic coding sequence
atgtctcggccagtcgagctgagtgacagggagaccctgctgaactcggcgacgactagcctcaacagcaaggtggtcagccagtactcttccttattgagccccatgagcgtgaatgcagtgatgaaagtgatcgatcctgctacagccacctctgtggacctgcgagacatcaagatcgtgaagaaactgggaggtactattgatgattgcgagttggtggagggtctcgtcttgacgcagaaggttagtaatagcggcatcactcgggttgagaaggcgaaaataggcctcatacagttctgcctcagcgcgcccaaaacagacatggataaccagattgtggtgtcagactatgcccagatggacagggtgctcagagaggagcgggcatacatccttaatctcgtgaagcagatcaagaagacgggctgtaatgtgcttcttatccagaaaagcattctccgcgacgctcttagtgacctggccctccactttctcaataaaatgaaaatcatggtgattaaagacatagagagggaggacatcgagttcatttgcaagaccatcggcactaagcctgtggcccacatcgaccaattcaccgccgacatgctgggatctgcagagctcgcggaagaagttaacctcaatgggtcaggtaagcttctgaagattactggctgcgcgagtcctggcaaaaccgtcacaatcgtggtccgcggctccaacaaactggtcatcgaagaagcggaaaggtcgatccatgatgctctctgtgtgattcgatgcttggttaagaaacgggcccttatcgccggcggaggcgctcccgagattgagctcgccctgcggctgacagagtactctcgaactctctctggaatggaaagctattgtgtaagggcctttgccgacgcaatggaagtcatcccctcaacacttgccgaaaatgccggtctcaacccaatctccacagttaccgaattgaggaataggcacgctcagggagagaagactgcggggattaatgtgcggaaaggtgggatctcgaacatactggaagagctggtcgtgcagcctctgctagtgtctgtgagcgcattaacactcgccaccgagactgtacgttcaattctgaaaattgacgatgtcgttaacacaaggtag

SEQ ID NO: 111750 - DNA, 1626 bp, Artificial Sequence
  Description of Artificial Sequence: Synthetic coding sequence
atggcatcaatgggaactttagcctttgacgagtacggaagaccttttctcattatcaaggaccaagatcgtaagtctcgtctgatgggattggaggctctcaagtctcacattatggctgcgaaagcagtagctaacactatgcgcacatccctggggcccaacggtctggacaagatgatggttgacaaggacggagacgtcaccgtgaccaacgacggagcaacgattctaagcatgatggatgtcgatcatcagatagcaaaacttatggtcgagctatccaaaagtcaggacgatgaaataggcgacggaacaacaggcgtagtcgtgctggcgggggccctgctggaagaggccgaacagctcctcgatcgaggaatccaccctatacgcatcgccgacgggtacgaacaggctgcacgcgttgcgatcgagcatctggataagattagcgattccgtgcttgtagacattaaggatactgaacctctgatccaaaccgctaagactacacttggctccaaagtggtaaatagctgccataggcagatggccgaaattgccgtcaacgccgtactcactgtcgcagacatggaaagaagggacgtggatttcgagctgatcaaggtggaggggaaagtcggtggacggctggaggacacaaagctgatcaaaggggtgattgttgataaagatttttcgcatcctcagatgccgaagaaagtagaggacgccaagatcgcaatccttacttgtcccttcgagcctccaaaacctaaaaccaaacacaagctggacgtgacttccgtcgaggattataaggccctgcaaaaatatgaaaaggaaaagttcgaggagatgattcagcagattaaggagaccggcgctaacctggccatctgtcagtggggatttgacgatgaagccaatcaccttttgctgcaaaataacttgcccgctgtgcgctgggttggtggcccagagattgagctgatagcaattgcaaccggggggaggatagtgcccagattctccgaactgaccgctgagaagcttgggtttgccggtctggtgcaagagattagcttcggcacaaccaaagacaaaatgttagtgatcgaacaatgtaaaaactcacgtgctgtcactatcttcatcagagggggcaacaagatgatcattgaagaggccaaacggtccctgcacgatgccttgtgtgtgataaggaacctaatccgggataatagagttgtgtatggaggtggagctgctgagatcagctgcgccctggccgtttcacaggaagctgacaagtgtcctaccctcgagcagtatgccatgcgcgctttcgccgacgccctagaagtgattccgatggcattatcagagaactctggcatgaacccaatccaaacgatgaccgaggttagagctcgacaagtcaaagagatgaaccccgctctgggtatcgactgcctccacaagggcaccaatgatatgaaacagcaacacgtgatagaaactcttatcgggaaaaagcagcagattagcctcgccactcaaatggtgcgaatgattctgaaaatagatgatatcagaaagcccggcgagagcgaagagtag

SEQ ID NO: 111751 - DNA, 1545 bp, Artificial Sequence
  Description of Artificial Sequence: Synthetic coding sequence
atggcaagtatgggcaccctcgctttcgacgagtacgggaggcctttccttattattaaagaccaggaccgcaaaagccgactgatggggctcgaggccttgaaaagccatattatggctgccaaggccgttgcaaacaccatgcggacatctctcgggccaaacggtctggacaagatgatggttgacaaggacggggacgtcacagtgactaacgatgagataggagatggcaccactggcgttgtggtcttggccggtgccctgttagaggaagccgaacaattgctagaccgtgggatacatcctattaggattgctgatggatatgaacaggccgcacgggtcgcgattgagcatcttgataaaatctctgatagtgtcctggtggacataaaggacaccgagcctctgattcagaccgctaaaactactttgggctccaaagtcgttaatagttgtcaccgacagatggccgagattgccgttaacgcagtgctcaccgtggctgatatggagcgcagggatgtcgatttcgagttaatcaaagtggaaggtaaagtgggtggccgcctagaagacaccaagctgatcaagggggtaatcgtggataaagacttttcccatccacagatgccaaagaaagtggaagatgctaagattgccatcctcacttgccctttcgagccacccaagccaaaaactaaacataagctggacgtaacatcagtcgaggactacaaggcgctgcagaaatacgagaaagagaaatttgaagaaatgatccagcagatcaaggagaccggagctaatctggcaatctgccagtggggcttcgatgacgaggccaaccaccttctgcttcagaataatcttcccgccgtgaggtgggttggaggcccagagatcgagctgattgcaatcgcgaccggggggaggattgtgcctagatttagcgagttgaccgctgagaagctgggttttgccggtctcgtccaggaaatatcgtttggcactaccaaagacaagatgctagtgatagagcaatgcaaaaatagcagagctgtgactatcttcattcgcggcggaaataagatgattatcgaagaggccaagagaagcctgcatgacgcattgtgtgtgatccggaatcttatccgcgacaaccgagtcgtctatggcggtggagctgccgagataagctgcgctctggctgtttcccaggaggccgacaagtgcccaacccttgagcaatatgcaatgagagccttcgccgacgctcttgaagtgattcccatggcgctctctgagaattccggcatgaatcctatccaaactatgaccgaagtccgagcccgccaggttaaggagatgaatccagccctcgggatcgattgtctgcacaaaggcacaaatgacatgaagcagcagcacgtcatcgaaaccctcattggaaagaaacagcagatatctcttgcaacccaaatggtcaggatgattttaaagatcgacgatattagaaaacctggggagtccgaagaatag

SEQ ID NO: 111752 - DNA, 1563 bp, Artificial Sequence
  Description of Artificial Sequence: Synthetic coding sequence
atgaactcttcgctgggccccactattgaaaagcttagtgttagccacatcatggcagctaaggctgtggccaatactatgcgcacatccctggggccaaacggtctggacaaaatgatggtggataaggatggagatgtcaccgtcaccaatgacggcgcaacaattctgagcatgatggatgtggatcatcaaattgccaaactaatggtcgaactgagcaaaagccaggacgatgagattggagacggtacaacaggcgtggtggtgttggcaggggcactgctggaggaggcagaacaactcctggatcggggaattcatccaatccgaattgccgacgggtatgaacaggcggctcgcgtggcaatcgaacatttggacaaaatttcggattccgtgttggttgacattaaggacacagagcctctcatacagaccgccaagactaccctgggctctaaggtcgtgaactcttgccacagacagatggcagagattgccgtcaacgccgtcctgaccgtggcagatatggagaggcgggacgttgacttcgaacttattaaggtggagggtaaggtagggggaaggcttgaggacactaagctgattaagggcgtgatcgtggacaaggatttctcccacccgcaaatgcccaagaaagttgaagacgcgaaaatcgcgattctgacatgtccctttgagccgcccaaacccaagacgaaacataaactagacgtgacaagtgttgaggattacaaggcactgcaaaagtacgaaaaagaaaagttcgaagagatgattcagcagattaaggagacaggcgcgaatctggcaatctgtcagtgggggttcgacgatgaagcaaatcacttactcttgcagaataatttacccgctgtacgctgggttggaggacccgagatagaattgatcgccatcgcgactggcggtagaatcgtgccacggttttctgagctgaccgctgagaagttggggtttgctggtcttgtgcaggagatctcttttgggacaacaaaggacaagatgctggtgatcgaacagtgcaaaaatagccgagccgtcaccatttttattagaggaggaaacaaaatgattattgaggaggcgaagcgctccctacacgacgccctttgcgtgatccgaaatctaataagagataaccgcgtcgtgtatggaggcggagctgctgagatttcatgcgctctggctgtgtcccaggaggcagataaatgtccgactctggagcagtatgcgatgcgggcattcgctgacgcgcttgaggttatacccatggcacttagcgagaattctggaatgaatccaattcagactatgacggaggtgcgagctagacaggtgaaggaaatgaaccccgcgctgggcatagattgcctgcacaagggtacgaacgacatgaaacagcagcatgtcattgagacgctgattggcaagaaacagcagatctcgctggcaacgcagatggtgcggatgatcctgaagatcgacgacataaggaagcctggggaaagcgaagagtag

SEQ ID NO: 111753 - DNA, 1347 bp, Artificial Sequence
  Description of Artificial Sequence: Synthetic coding sequence
atggccgccaaggcagtggccaataccatgcgcaccagcttgggaccaaacgtgcttgccggggccttgctggaggaagcggaacagctgctggaccgaggcattcaccccataagaatcgctgacggttatgagcaagctgcacgagtggctatcgagcacctcgataaaatcagtgacagtgtactggtcgatattaaggataccgagccccttatccagacagctaaaactactcttgggtctaaagtagtgaattcttgccatcggcaaatggctgagatagccgttaacgccgtgctgactgtggcggatatggaacgcagggacgttgattttgaacttattaaggttgagggaaaagttggaggaaggttggaggacacaaaacttatcaaaggcgtcatagtggacaaagacttttcccatccacaaatgcctaagaaagttgaggatgccaaaattgccatcctcacttgccctttcgagcctccaaagccgaagaccaagcacaagttggacgttacgtctgtcgaggactacaaggctctgcagaaatatgagaaagagaagtttgaggagatgatccagcagatcaaagaaacgggtgcaaacctcgctatatgccagtgggggttcgatgacgaggcaaaccacttactgctacaaaacaatttgccagccgtgagatgggtgggaggccctgagatagagcttatcgcaatagcaacaggtgggaggatcgtccccaggttctccgaactcaccgctgagaaattgggttttgccggacttgtccaggagatctcctttggaaccaccaaggacaagatgctcgtaatcgaacaatgtaagaattcacgcgcagtgacaattttcattagaggaggaaacaagatgataattgaggaggccaagcgatcactgcatgatgccctttgtgtgatccggaatctcattcgtgacaaccgggttgtatacgggggaggcgctgcagagatctcatgtgccctggcagtcagccaagaagcagacaagtgcccaaccctcgagcagtacgctatgcgtgccttcgcggatgctctcgaagtcatccctatggcgttgtccgaaaactctggcatgaaccctattcagacaatgaccgaggtgcgcgcccggcaggtcaaggaaatgaatcctgccttaggcatcgattgcttgcataaaggcaccaacgatatgaagcagcaacacgttatcgaaactctgatcgggaagaagcagcagatttccctcgcaacacagatggtgagaatgatcctcaaaatcgatgacatacggaaacccggagaatctgaggaatag

SEQ ID NO: 111754 - DNA, 1461 bp, Artificial Sequence
  Description of Artificial Sequence: Synthetic coding sequence
atggcctccatggggacgctggcctttgatgaatatgggaggccctttcttatcattaaggatcaggaccgtaaaagcaggttgatgggtttggaggctcttaaatcccatatcatggccgctaaggccgtcgctaatacaatgagaacatcactgggccctaacgtcctggccggagcactgcttgaagaagctgaacagcttctggaccggggaattcatcctataagaatcgcggatggctacgaacaggccgcccgcgtcgcaatcgagcacctggacaaaatctccgacagcgtcctcgtggatatcaaagacaccgaacccctgatacaaacagccaaaacaactctgggttccaaggtggtcaattcctgccaccgccaaatggccgagattgccgtcaatgctgtgctcaccgtggccgatatggaaaggagggacgtggattttgagttgattaaagttgaggggaaggtaggggggagattggaggataccaagctcatcaaaggcgtgatcgtagataaggacttctcacacccacagatgcctaaaaaagtcgaagacgccaagattgctattcttacctgccctttcgagcctcctaaaccaaaaaccaagcataagctggacgttacgagcgtcgaggattacaaggccctgcagaagtacgagaaggaaaagttcgaggagatgattcagcagatcaaggagaccggagctaacctcgcaatatgtcaatggggttttgacgatgaggccaatcacttgctgctgcagaacaatcttccggctgtacggtgggtcggcggccccgagatcgagctgattgctattgcgacaggtggaagaattgtccctcggttttctgaactgaccgccgagaaattggggtttgcaggcctggtccaggaaatttccttcggaaccaccaaagacaaaatgctcgtcattgagcagtgtaagaacagtcgagcagtcactatctttataaggggtggcaacaagatgataatcgaagaggccaagcgcagccttcacgacgcactgtgtgtgattcgtaacctgatccgagataaccgggtggtatatggcggcggcgctgctgagattagttgcgctcttgccgtcagccaggaagccgataaatgtcccacacttgagcagtatgccatgcgcgccttcgccgacgccctggaagttatccccatggccctaagcgagaacagtgggatgaaccccatccagacaatgaccgaggtccgggcgcgccaggtaaaggagatgaaccctgccctggggatcgattgccttcataaagggaccaatgatatgaaacagcaacatgtgattgaaactctgataggtaaaaaacagcagatctcgctagctacccagatggtgagaatgatcttgaaaattgacgatatcaggaaaccaggcgaaagcgaggagtag

SEQ ID NO: 111755 - DNA, 1512 bp, Artificial Sequence
  Description of Artificial Sequence: Synthetic coding sequence
atggcagccaaagctgtggcaaacacaatgcgaacatcacttggacctaacgggcttgacaagatgatggttgacaaagacggcgatgtgacagtgaccaatgatggagctacaatcctgagcatgatggatgtggatcaccagattgcaaaactcatggttgagctgtccaagtcccaggacgacgaaataggtgacggaacaacaggggtggtcgtcctcgcaggcgcgctgttggaggaggccgaacagctccttgatcggggcattcatcccatccgcatcgccgatggatatgaacaggcggctcgcgtcgccatagagcacttggataagatctctgacagcgttctggtcgacattaaggatacggagccgctcattcagaccgccaaaaccaccctgggcagcaaagtggtcaatagctgccaccggcaaatggcggagattgcagtgaacgcagtcctgacagtagcagacatggagaggagagacgtggattttgaactcattaaggtggagggaaaagtggggggcaggctggaggatactaaactgattaagggagtcattgttgataaggacttctcccacccacagatgcctaagaaggtggaagacgcgaagattgctattctcacatgtcccttcgagcctcccaagcctaagacaaaacacaagctcgacgtgacgtctgtggaggactacaaggccctacagaagtacgagaaggagaagttcgaagaaatgattcagcaaatcaaggagaccggcgcaaatctcgcaatatgtcaatggggcttcgacgatgaagcaaaccacctcttactccagaataacttgccagccgtgcgatgggtgggggggcctgagatcgagctcatcgccattgccacgggcgggaggattgtgccgcgattctctgagctgactgctgagaagctgggatttgcaggtctggtccaagagatttccttcggcacaactaaagataagatgctcgtgatcgaacaatgcaaaaattctcgcgctgtgacaatcttcatacgcggaggaaataaaatgattatcgaggaggcgaaacgcagtctgcacgatgcactgtgtgtcattaggaatctaatcagagacaacagagtggtatacggagggggcgccgcggaaatctcctgtgcactggctgtgtctcaggaagccgataagtgccccactctcgagcaatacgcgatgagggcttttgccgatgccctggaagtgatcccaatggcgctgagtgagaacagcggtatgaatcctattcagaccatgacggaagtgcgagcacgtcaggttaaagaaatgaatcccgccctgggcattgattgtctgcacaaagggacaaacgacatgaaacagcaacatgtgatagaaacactgatcggtaaaaaacagcaaatctccctcgccacccagatggtgcggatgatcctaaagatcgatgacatcagaaaaccgggcgaaagcgaagaatag

SEQ ID NO: 111756 - DNA, 1593 bp, Artificial Sequence
  Description of Artificial Sequence: Synthetic coding sequence
atggccgctatcaaagctgtgaactcgaaggctgaggtggcgcgtgctcgagctgctttggccgtgaacatttgtgctgcccgggggctgcaggatgttcttcgaacgaatttaggccccaagggcaccatgaagatgcttgtctcaggagcgggcgacatcaaactgactaaggacgggaatgttctgctggacgagatgcagattcagcacccaacagcatcattgatcgccaaggttgctacggcgcaagatgacgtgacgggggacgggactacctctaacgtactgattatcggagaactgcttaaacaggccgacctatacatctccgaaggccttcacccccgcatcatcgccgaaggcttcgaagccgcgaagataaaggctctggaggtcttggaagaagtaaaggttaccaaggagatgaagcgtaagatcctgctggatgtagcccgcacatcactccagactaaggtgcatgcagaattagctgacgttctgactgaggtcgtggtcgatagcgtcctcgccgtgagacgccccggttatccgatcgaccttttcatggtggagattatggagatgaagcacaagctcggcacagatactaaactgatccagggtctagtccttgatcacggtgcccgacaccctgatatgaagaaacgggtggaggatgcattcatacttatttgtaacgtatctttggaatatgagaagactgaggtgaactcggggtttttttataaaacggcagaagagaaggagaagttagtcaaagccgaaaggaagtttattgaggatcgtgtccaaaagattatcgatctcaaagacaaagtttgtgcacagtccaacaaggggttcgtggtgattaatcagaaaggaatagatcccttctccttagattctttggcaaaacacggcatagttgcactgcggcgggcaaagcgcagaaatatggagagactgtcattagcctgtggcggcatggccgtcaactcattcgaagacctgaccgtggattgtctgggtcacgcaggactggtttacgagtacaccctgggcgaggaaaagtttacctttatcgaggagtgtgtgaacccatgcagtgtcactcttctggtgaaagggcccaataagcatacactgacccaggtgaaggatgccatcagggacggtctgagagcgattaagaacgccattgaggatggctgtatggttcccggcgctggggcaatcgaagtagcaatggctgaggcccttgtgacctacaagaattccatcaaaggaagggcgagactgggcgttcaggcgtttgccgacgccctgttaattataccaaaagtattggcacaaaacgcgggctatgacccacaggagaccctcgtaaaggtgcaggctgaacatgtggaaagcaagcagctagtcggtgtcgacctgaataccggcgaaccaatggtggcagcagacgcaggcgtgtgggacaattattgcgtgaaaaagcaacttttacacagctgcaccgtaatcgccaccaacatcttactcgtggatgagattatgagggccggcatgagctccctgaagtag

SEQ ID NO: 111757 - DNA, 1482 bp, Artificial Sequence
  Description of Artificial Sequence: Synthetic coding sequence
atggcggcaattaaggccgttaattccaaagccgaggtcgccagagcccgcgctgccctggcagtgaatatctgcgctgcacggggcctccaagacgtcctgaggaccaatcttggccccaagggcaccatgaaaatgctcgtgagcggggcaggagacattaaattaacgaaggacggcaatgttcttctagacgagatgcagatccagcacccaacagccagcttaatagcgaaagtggcgacagcacaggatgacgtgacgggagatgggaccacaagcaatgtgcttatcatcggcgagctcttaaaacaagcagatctgtacatctccgaggggctacatccccggattatagctgaaggcttcgaggcagctaagatcaaggccctggaagtgctcgaggaggtcaaggtcaccaaggaaatgaagaggaagatcttactggatgtcgccagaacctcattgcagacaaaggtgcatgccgagctggctgatgtcttgactgaggtggtggtggattctgtgttggctgtaagaaggcctggttatcctatagacctgttcatggtcgagattatggagatgaaacacaagctgggaaccgacaccaaggaggtgaactcaggatttttctataagaccgcggaggagaaagagaagctagttaaggccgaacgcaagtttatagaagacagggttcagaaaattattgatttaaaagacaaagtgtgtgctcagagcaacaaaggcttcgtggtgatcaaccagaaaggaatcgatcctttttctctggacagcctcgctaaacatggcattgtggccttgcgccgagccaagcgccgcaatatggagaggctatcactcgcgtgcggtgggatggccgttaattcttttgaggaccttactgtggactgcctggggcacgccggtctggtatatgaatacactctgggagaggagaaatttacattcatcgaggaatgcgtcaatccatgcagcgtgacactgttagtgaaggggcccaataaacacacgctgacacaggtgaaggatgctatcagagatgggctgagggcaatcaagaatgccattgaggatggctgcatggtaccaggtgccggtgcaatcgaggtggccatggctgaagcactggtgacatacaagaacagcatcaaggggcgcgccaggctgggggtccaggcttttgcagacgctctattaatcattccaaaggtactggcccagaatgcgggctacgatccccaggagaccctggtgaaggtccaggctgaacatgtcgaaagcaaacagcttgtgggagtagaccttaacaccggtgagcctatggtcgctgcagatgcaggggtctgggacaattattgcgttaaaaagcagctgcttcacagctgcacggtgattgcaactaatattctcctggtggatgagatcatgagagcgggcatgtcaagcttgaagtag

SEQ ID NO: 111758 - DNA, 1458 bp, Artificial Sequence
  Description of Artificial Sequence: Synthetic coding sequence
atggcagcaatcaaagccgtgaacagcaaagccgaggtggcccgtgcacgcgccgcactggctgtcaatatctgtgcagctcggggactccaagacgtgctccggactaacctaggacctaagggtacaatgaaaatgctggtctcgggcgctggcgatattaagctgacaaaggacggcaatgtgttgttggatgagatgggcctacacccacgtattatcgctgaaggatttgaggcggctaagatcaaggcactggaggtgctggaggaggtaaaagtcacaaaggagatgaaacggaaaatactgctcgacgtagccaggacgtccctgcagactaaagtgcacgcagaactggctgatgtgctcacagaggtcgtggttgactctgttctagctgtaaggcggcccgggtaccctatcgatctgtttatggtagagataatggaaatgaaacataaactcgggactgatacaaagttgattcagggactggtgctggaccacggcgctaggcacccagatatgaaaaagcgcgtagaggatgcattcattttgatttgtaatgtctctctggaatatgagaaaacagaagtcaactcaggtttcttttacaaaacagccgaggagaaggagaagctcgtgaaagctgagcgaaagtttattgaggatcgggtccagaagatcattgacttaaaggataaggtgtgcgcccagtccaataaagggtttgttgtaattaaccagaaagggatcgacccattctccttggactcattagctaaacacgggattgttgcccttcgaagggccaagcgtcggaacatggagcgcctgtcactggcttgcggcggtatggcagtcaactccttcgaggacctgactgtagattgcctgggccacgccgggttagtttatgaatacacactcggagaagagaagtttaccttcattgaagagtgcgtgaatccatgctcggtcactctcttggtgaagggcccaaacaagcacacgcttactcaggtcaaagatgcaattagggacggtctgagggccattaagaacgcaatcgaagatgggtgtatggtgccaggagccggcgccatcgaggtggccatggcagaggcactggttacgtataagaactctataaaggggagagcccgacttggcgtacaggccttcgcggacgcattattgatcatccccaaggtgcttgcccagaatgccggctacgatccacaggagactttggtcaaagtccaagctgagcatgtcgagagtaagcaacttgttggcgtggacctcaacactggagagccaatggttgccgccgatgccggcgtatgggataactactgcgtaaaaaaacagctgctccacagttgtaccgtcatagctactaatatcctgttggtagacgaaattatgcgagcgggcatgagtagtctgaagtag

SEQ ID NO: 111759 - DNA, 966 bp, Artificial Sequence
  Description of Artificial Sequence: Synthetic coding sequence
atgaaaccaggattttctcccagaggcggtggctttggagggaggggaggcttcggagaccgagggggacggggcggccgaggtggatttgggggcggcaggggcaggggcgggggatttcgagggcggggcagagggggtggggggggcggcgggggcggagggggtggcggcaggggaggaggaggattccattcaggtggaaaccggggtcgcggtaggggaggcaagcgggggaaccaaagtggtaagaatgttatggttgaaccccatcgacacgagggggtgtttatctgcagaggcaaagaagacgccctcgtgactaagaaccttgttcccggggagtcagtctacggggagaaacgggtatcaattagcgaaggcgacgataagattgagtatagggcatggaatccttttcggagtaagctggctgccgctatattaggaggggtggatcagatccacatcaagcccggagccaaggtgttgtacctgggtgctgcttccgggacaacggtcagtcatgtttcggatatcgtgggccccgatggcctggtgtacgctgtcgaattcagtcacagaagcggcagagacctcatcaacttagccaagaagcggaccaacattatcccagtcatagaggacgctcggcatccccacaaatacagaatgctgatagctatggtcgacgttatttttgccgacgttgcacagcctgatcaaacaaggatcgtcgcgttgaatgctcatacattcttgcggaatgggggccactttgtgatcagtatcaaggccaattgtatcgacagcaccgcctctgcagaggctgtgtttgccagcgaggtgaaaaaaatgcagcaggaaaatatgaagccacaagaacagctcacactagagccctatgagcgcgaccacgccgtcgtcgtgggcgtgtatcgcccacctcccaaagtgaaaaattag

SEQ ID NO: 111760 - DNA, 723 bp, Artificial Sequence
  Description of Artificial Sequence: Synthetic coding sequence
atggatgttcatggagaggctgccggggaggccggccaggaagggggcgagggcctccaggggggagccggacaatcagaggagggcccatctgctgagaaatgcagagtgtgtccctgcgtctgcagggagcggcatccacaggaggagcgacggtgcgaacttgccagtgacggtgtgccaaggcggaggtctggactgcagggcgcagattcctgtgattatgaggggggtgatcaggagtatggacctggagatcagtcccctgggcaggggccggaacatcatggcccggcagagggtctcctatcagatggacaagttcgggccgctggggctgaaccagggaggccttacatcggggacggggggctgcacgaactcggacaccacccagaccacgcagccggcgcaggcggccagccccatcatgccgaccggaggggcgagtggcctggcggggccggacctgcccaacctgcagcccgaggcaggctttgtcggggtcgagaactgtgcgcccagccaggaggacccgccgtgaccgaggtgggaagacttgaggaactagctgtcccgaggcgctgcgcaccaccacttccccgagatgtccttgagggaagctgtcctctcccgacggccagttgcctctgtgctgatccggccgggctgcgccctgccgcgactctgcgcctttcccctgcaagacccgcatggccctag

SEQ ID NO: 111761 - DNA, 591 bp, Artificial Sequence
  Description of Artificial Sequence: Synthetic coding sequence
atggacgatacactcttccagctcaagtttacggccaagcagctagagaagttagccaagaaggcggaaaaggacagcaaggcagagcaggccaaagtgaagaaggcgttgctgcagaaaaatgtcgaatgtgccagggtttatgcagagaatgccataagaaaaaaaaacgagggggtcaactggctaagaatggcgtcaagagtggatgccgttgcttctaaagtgcagacagctgtgactatgaaaggagtcacgaagaatatggctcaggtaacaaaggctctagataaagcgttaagtaccatggacttgcaaaaggtctcaagcgttatggatcgcttcgagcagcaggtgcagaatctggatgtgcacacttcagtcatggaggatagcatgagtagcgctacaactcttacaacaccccaggaacaggtggatagcctgatcatgcagattgccgaggagaatggactggaggttctcgatcagctgtctcagctgccagaaggcgcatcagctgtgggcgaatccagcgtacgcagccaggaagaccagttgagccgacgcctggctgcactgaggaactag

SEQ ID NO: 111762 - DNA, 600 bp, Artificial Sequence
  Description of Artificial Sequence: Synthetic coding sequence
atgtcgaacatggagaagcacctatttaatttgaaatttgctgctaaagaactctctcggtctgctaagaagtgcgacaaggaggaaaaggctgaaaaggctaaaattaagaaggccatacagaaggggaacatggaagttgcccggattcacgccgagaacgctatccggcagaagaatcaagccgtgaatttcctgcgaatgtctgcaagagttgatgcagtcgcagctcgggtccagaccgccgtcacaatgggtaaagtcactaagagtatggcaggagtagttaagtctatggacgccactctgaaaacaatgaatcttgaaaaaatttccgcgctgatggataaatttgagcaccaattcgaaaccctagatgtgcagacccagcagatggaggacactatgagtagcacaaccactctgaccactcctcagaatcaggtggatatgcttttacaggaaatggccgacgaggctgggcttgacctgaacatggagttgccccaggggcagactggctcagtgggtactagtgttgcgtctgccgagcaggatgaactgtcccagcgactcgccaggctgagagaccaggtgtag

SEQ ID NO: 111763 - DNA, 669 bp, Artificial Sequence
  Description of Artificial Sequence: Synthetic coding sequence
atggacctgttgtttggaagaagaaagactccagaagagttgttacgtcagaaccagcgtgccttaaatagagccatgcgggaattggatagggaaagacagaagctcgagacccaggaaaagaaaataatcgcagacatcaagaagatggccaaacagggccagatggatgcagtgaggatcatggcgaaagatttggtgcggacccgccggtacgtccggaaatttgtgctgatgagagcaaacattcaggccgtctcactcaagatacagactctcaaaagcaacaatagcatggcccaagcgatgaagggagtgactaaggctatgggaacgatgaaccgccagctcaagctacctcagatccagaagataatgatggagttcgaaaggcaggctgagattatggatatgaaggaggaaatgatgaacgacgcaatagacgatgctatgggagacgaggaagacgaggaagagtccgacgctgtggtcagccaggttctggacgaactcggcctatcattgacagatgagttaagtaacctgccatctaccggagggagcctgtccgtagcggctggggggaagaaagccgaagccgcagcctccgccctggcagacgctgatgccgatctagaggagcgtctgaaaaacctcaggagggattag

SEQ ID NO: 111764 - DNA, 669 bp, Artificial Sequence
  Description of Artificial Sequence: Synthetic coding sequence
atggatcttctgttcggcagaaggaaaacccccgaggaacttctgagacagaatcagcgagcactgaatagagccatgcgggaactagatcgcgaaaggcagaagcttgagacacaggagaagaagatcattgcggacatcaagaagatggctaagcagggccaaatggacgccgttcgcatcatggcgaaggatttggttcgcactcgtaggtatgtcagaaagtttgtcctgatgagggcaaacatccaggcagtaagtcttaagatccagaccctgaaatcgaacaactcgatggcccaggcgatgaagggcgtcacaaaagcaatgggaacaatgaaccgccaactgaaattaccacagatccagaagattatgatggagtttgaaaggcaagccgagattatggatatgaaggaggagatgatgaacgacgcaattgatgacgccatgggcgacgaggaggatgaagaagaatccgacgctgtggtgagccaggtgctagatgaacttggtctctctcttacagacgagctatccaacctgcctagtaccggcggcagtctgagcgtggcagctggaggcaaaaaagcagaggccgcggcgtctgctctggcagacgccgacgcagatctggaggagcggctgaagaatttacggcgggattag

SEQ ID NO: 111765 - DNA, 642 bp, Artificial Sequence
  Description of Artificial Sequence: Synthetic coding sequence
atggcttccctgttcaaaaagaagaccgtcgacgatgtgataaaagaacagaaccgtgagttgagagggacacagagggccatcattcgggatcgcgccgcccttgaaaaacaggaaaagcaactggaactcgagattaaaaaaatggccaagatcggtaacaaggaagcctgtaaagtgcttgccaagcagctagtgcacctcaggaaacagaaaacccgcacgtttgctgtctcaagtaaggtgacctctatgtccactcagactaaagtgatgaactctcagatgaagatggcgggcgcaatgtccacaacggccaaaacaatgcaggctgtgaacaaaaaaatggaccctcagaagactctgcagactatgcagaattttcaaaaagagaacatgaaaatggaaatgacagaggagatgatcaatgacaccctggacgatattttcgatggaagcgatgacgaagaggagtctcaggacatcgtcaaccaggtgttggatgagataggaatagaaatctccggcaaaatggccaaggccccatccgccgccagatccttgcctagcgcctcgacatccaaagccaccatctctgacgaggagatcgagaggcaactcaaagcactcggagttgattag

SEQ ID NO: 111766 - DNA, 519 bp, Artificial Sequence
  Description of Artificial Sequence: Synthetic coding sequence
atggagctggaaataaagaagatggctaagattggaaataaagaggcttgcaaggtgctcgccaagcagttagtgcacctccgaaaacaaaaaacccggacatttgctgtcagttccaaagtcactagtatgtctactcagaccaaagtgatgaactcacagatgaagatggccggagcaatgagtactactgcaaagactatgcaggcggtaaataagaagatggacccccagaaaacactgcaaaccatgcagaactttcaaaaggaaaacatgaaaatggaaatgacggaagagatgattaatgacacactcgatgacatcttcgacggaagcgacgacgaagaggagagtcaggacatcgtgaatcaggtcttagacgaaataggaattgaaatttcaggtaagatggctaaagctcccagcgctgcccgatctctcccttcagcttcaacgtccaaggccaccatttctgacgaagagattgagaggcagctcaaagctctcggagtggattag

SEQ ID NO: 111767 - DNA, 669 bp, Artificial Sequence
  Description of Artificial Sequence: Synthetic coding sequence
atgggcctcttcgggaagacacaggaaaaaccgccaaaggaactggtgaacgagtggtctttgaaaataaggaaagaaatgagagtagttgatagacaaattagggacatccaacgagaggaagaaaaagtgaagcggtcagtgaaggacgccgccaaaaagggccagaaggacgtttgcattgttctggctaaagaaatgatcaggagtcgaaaagcggtttcaaagttatatgcctcgaaggcccacatgaacagtgtcctcatgggcatgaaaaaccagctggcggtcctcagggtggccggatcactccaaaagagtacagaagtgatgaaggcaatgcaaagtctcgtcaagattcccgagatccaggccaccatgcgcgagctgagtaaagaaatgatgaaggccggcatcatcgaagaaatgctcgaggataccttcgagtcgatggatgaccaggaggaaatggaggaggaagctgaaatggagattgatagaatcttgtttgagattaccgcaggtgcgctcggaaaagccccctccaaggtcaccgacgccctgcctgaacccgagcccccaggagccatggccgcgagcgaagacgaggaagaggaggaagaagcactggaggcaatgcagtcccgcctagccacactgcggtcctag

SEQ ID NO: 111768 - DNA, 471 bp, Artificial Sequence
  Description of Artificial Sequence: Synthetic coding sequence
atgattagatcccgcaaggctgtctccaagctttatgccagcaaagcccacatgaacagcgtactgatgggcatgaagaaccagctggctgtgctgagagtggctggaagtttacagaagtccactgaggtgatgaaagccatgcagtctttggtaaagatacctgagatccaggccacaatgagagagctgtcaaaggagatgatgaaggctgggattatagaggagatgctcgaagacacttttgaatccatggatgatcaagaggagatggaggaggaagccgagatggaaatcgaccgcattctctttgagattactgccggcgcattgggtaaggcccctagcaaggttaccgacgctctgcccgagcctgagccacccggagccatggccgccagcgaggatgaggaggaggaggaagaggccttagaagctatgcagagcagactggcaacactgcgaagctag

SEQ ID NO: 111769 - DNA, 756 bp, Artificial Sequence
  Description of Artificial Sequence: Synthetic coding sequence
atggaaggggaactttatagcgccctgaaggaggaagaggcaagcgagtccgtgagttctacaaacttctcgggcgaaatgcatttttatgaattggtcgaagacacaaaggacggaatttggctcgtgcaagttaacgagtggtcactgaagattcgaaaagaaatgagagtggtggaccgacagattagggatatccagagagaggaggagaaagtcaaaaggtcagtaaaggatgctgcgaaaaagggccagaaggatgtttgcatcgtgctcgcaaaggaaatgatacgtagccgaaaggcagtcagcaagttatacgcctccaaggcccacatgaacagtgttttgatgggtatgaaaaaccagttagctgtattaagagtggccgggagcttgcagaaaagcacagaggtaatgaaggcaatgcaaagtctggttaagatacccgaaattcaagcgacgatgagggagctgtccaaagaaatgatgaaggcaggcattatagaggagatgcttgaggacacttttgaatcaatggatgaccaggaggaaatggaagaggaagccgagatggagattgaccgtatcttgttcgagattactgccggggccctcggtaaggccccttccaaggtcacagatgcactgcccgaaccggagcccccgggcgctatggccgcctccgaggatgaggaggaggaagaggaagcgctggaagccatgcaatcgcgacttgccaccctccggtcctag

SEQ ID NO: 111770 - DNA, 549 bp, Artificial Sequence
  Description of Artificial Sequence: Synthetic coding sequence
atgggcctgtttgggaaaacgcaagagaaaccccccaaggaacttgtcaatgagtggagtcttaaaatccggaaagagatgcgagtagtggatcggcaaattagagatatacagcgagaagaggagaaggtgaaacgcagtgtgaaagatgcagctaaaaagggacagaaagatgtgtgcatcgttctcgcaaaggagatgatccggagccgaaaggcgatgcagtccttagtcaaaattcccgaaatccaggccacgatgagagaactcagtaaggagatgatgaaagctggtatcattgaagagatgctagaggatactttcgaaagcatggacgaccaggaggagatggaggaagaagctgaaatggaaatagaccgaatactgttcgagattaccgcgggagctttagggaaagcgcccagcaaagtgactgacgcattacctgagccagaacccccaggggcaatggccgcttcggaagacgaggaagaggaagaggaggccctggaagccatgcagtcccgcctcgctactctacggtcgtag

SEQ ID NO: 111771 - DNA, 798 bp, Artificial Sequence
  Description of Artificial Sequence: Synthetic coding sequence
atgtccagaaggagacctgaagatggactcggtaaagctgggccttgcgtcatgcgccaccaccctccacgctcaaaagcggaagtatggcggaccctgcgtggggggggcggcagaggcgagctcgccatgtccggcctgggccgattgttcggcaagggaaaaaaggagaagggcccaactccggaggaggccatccagaagctcaaggagactgaaaaaattctcatcaaaaagcaggagtttctggaacagaaaatacagcaggaattacagacagccaagaaatacgggaccaagaataagcgagccgccctgcaggccctgcggagaaaaaaacggttcgaacagcaactggctcagacagatggcacattgtctaccttggagttccagcgcgaggcaattgaaaacgctaccacgaacgccgaagtcctgcggactatggaattagcggctcaatcgatgaaaaaggcataccaagatatggacatagataaagtcgatgagctaatgaccgatatcacagagcagcaggaggtggcgcagcagattagtgatgcgatctccagacccatgggcttcggagatgatgtggacgaggacgagcttcttgaggagctggaagagctggagcaagaagaactcgcacaagagctgttaaatgtgggggacaaggaggaagagccttccgttaagctcccgtctgtgcccagcacccacttgcccgctggaccagctccaaaggttgatgaggacgaagaggctctgaaacagctggccgagtgggtgtcttag

SEQ ID NO: 111772 - DNA, 378 bp, Artificial Sequence
  Description of Artificial Sequence: Synthetic coding sequence
atggccggcccgtctctggcatgttgcctcctgggactactcgccctgacctcagcgtgttatatacaaaactgccccctgggggggaagagagctgctccagacctggatgtgagaaaatgtctgccttgtgggccaggaggaaagggccggtgctttggccccaacatttgttgcgccgaggaactggggtgtttcgtgggaacggccgaggccctcagatgccaagaagaaaactacctcccctctccctgccagagtggccagaaggcttgcggatcaggtggcaggtgtgcggtcctggggctgtgctgtagccccgatggttgccacgctgatcccgcttgcgatgcggaagccacgttctctcagcgttag

SEQ ID NO: 111773 - DNA, 831 bp, Artificial Sequence
  Description of Artificial Sequence: Synthetic coding sequence
atggcccccccccccgcaccgcttttagccccgcgccctggcgaaaccagaccaggctgcagaaaacctggaaccgtgtcctttgcggacgtggctgtctacttctcacccgaggagtggggatgtttaagaccggcgcagcgcgccctgtatcgggacgttatgcaggagacatacggccacttaggcgctttgggattcccaggtccaaaaccagcgctgatttcctggatggaacaagagtccgaagcgtggtcacccgctgcccaggaccctgagaagggggaaagacttggaggagccaggagaggcgacgtacccaacagaaaggaagaggagccagaggaggttcctcgagcaaaagggccacggaaggcaccagtcaaggagtcacccgaagtgctggtcgagcgcaatccagacccagcaatatccgtggcaccggccagagcgcaaccgcctaaaaatgcagcatgggatccaacaactggtgcccaaccacctgcacccataccctctatggatgctcaggctggccagagacgacatgtttgtaccgactgcgggcgccgtttcacatatccatctttgctcgtatctcatcgtcgcatgcattcgggagaacgacccttcccatgcccagagtgtggcatgcgatttaaaaggaagtttgcagttgaagcccaccaatggatccacaggtcctgcagtggagggaggagaggtcggcggccaggaatccgagccgttcctagggcgcctgtgcgcggcgacagggacccccctgtgctatttcggcactaccccgacatctttgaggaatgcgggtag

SEQ ID NO: 111774 - DNA, 516 bp, Artificial Sequence
  Description of Artificial Sequence: Synthetic coding sequence
atgaaccgcctgttcggcaaagcaaaacccaaagcccctcccccatctttaaccgattgtatcggcaccgtcgactctcgagccgaatctatcgataaaaaaatttcacgactcgacgccgaactagtaaaatataaggaccaaattaagaaaatgagagaaggaccagcgaagaatatggtgaagcagaaggcacttcgagtgttaaaacagaaacgaatgtacgagcagcagcgggacaacctcgcacagcagtcattcaacatggaacaggccaattacactatccagtccctgaaagatactaagaccactgtggatgctatgaagctgggtgtaaaggaaatgaaaaaagcctataaacaagtgaaaatcgaccaaatcgaagatcttcaagaccagctggaggacatgatggaagatgccaacgagattcaggaggctctgtcccggtcatacggcactccggaactggacgaagatgacttggaggcggggtggtcttccggaggctag

SEQ ID NO: 111775 - DNA, 606 bp, Artificial Sequence
  Description of Artificial Sequence: Synthetic coding sequence
atgggcaacctgttcggccgtaagaaacagtcccgggtcacagagcaggacaaggcaattctgcagctgaaacagcagagagataaattgagacagtaccagaagcggatcgcacagcagctcgaaagagagcgggccctggctcgccaactgttgagagacggccgaaaggaaagggcaaaacttctgctgaagaagaaacgataccaagaacagttgttagaccgtaccgagaaccaaatctccagcctggaagctatggtgcagtccatagagttcacgcaaatagagatgaaagtgatggagggtctccaatttgggaacgagtgcctcaacaagatgcatcaggttatgtccatcgaagaggtggagagaattctggacgagactcaggaggcagtagaatatcaacgccagattgatgaactgctcgccgggtcatttactcaagaggacgaagacgcaatcctcgaggagctctcggcaattacgcaggaacaaattgagcttccggaggttccaagcgagcctctgcctgagaaaattccagaaaatgtgcctgtcaaagcacgccctcgacaagccgagctggtcgccgcatcatag

SEQ ID NO: 111776 - DNA, 1362 bp, Artificial Sequence
  Description of Artificial Sequence: Synthetic coding sequence
atgtggagtccggaaagggaggccgaggcgccagcagggggggatcctgccggtctattaccacccgaatgggaggaggatgaggaaaggatgtctttcctattctccgcctttaaacgttcccgagaagtgaacagcacagactgggattccaagatgggattttgggcgcctctggtactttcacactcccgaaggcagggcgtggtgcggctgaggctcagagacctgcaagaagcttttcagagaaaaggatcagtgccactggggcttgctactgttctccaagatttactcagacgcggggaactccagcgggaatctgactttatggcttcagtggattcatcttggataagctggggcgtgggcgtgttccttctgaaaccactcaaatggaccctgtctaacatgttgggagacaacaaagtcccagccgaagaggtgctggtggccgtcgaactgctaaaagaaaaagcagaggaagtgtacagattgtatcaaaattcaccacttagcagccatccagtggtcgccctcagcgaactctcaaccctgtgtgccaacagttgtccagatgaacgaactttctacctggtgctgctgcagctgcagaaggagaagcgagttaccgttctggagcaaaacggcgaaaagatcgtaaagtttgcgcggggaccccgggccaaggtctcaccagtcaatgatgttgacgttggcgtgtaccagctgatgcaatcagagcagctgttatctagaaaagtcgagtcactctcacaggaggcagaacgctgcaaggaggaggcccgacgcgcgtgccgcgccggcaagaagcagctggcactgaggtcactgaaggctaagcaacgcaccgagaaaagaatagaagccctgcatgccaaattagacaccgtgcagggcatcctcgacaggatctatgcctcacagactgaccagatggtgttcaatgcataccaagcaggtgttggagccctcaaactgagcatgaaggatgtcacagtcgagaaagcagagagcctggtggatcagattcaggaactttgcgacacacaggacgaagtgtcccagactctggccggtggcgtcaccaatggtctcgatttcgactcagaggagctggaaaaggagctcgatattctgttgcaggacaccactaaagaacctcttgacctccccgataacccaaggaatcgccattttacaaattccgtgcccaaccctcgcatctccgatgccgagctggaagccgaactcgagaaattgtctctctcagaaggaggcttggtgccttctagtaagtcccctaagaggcagttagaacctactctgaagccactgtag

SEQ ID NO: 111777 - DNA, 1362 bp, Artificial Sequence
  Description of Artificial Sequence: Synthetic coding sequence
atgtggtccccagaacgtgaggctgaagcgccggctggcggagatccagcagggctccttccacctgagtgggaagaagacgaggaaagaatgtctttcttattctctgcttttaagagatcccgcgaggtaaactccactgactgggactccaagatgggcttttgggcccccctggtgctgtctcacagccggcggcagggcgtggtccggctacggctgcgcgatttgcaggaagcgttccagcgcaaaggaagtgtacctctgggcctggccaccgtgctccaggacctgttgaggagaggagaactgcagcgcgagagtgacttcatggcttcggttgacagcagctggatatcttggggtgtgggagttttcctcctaaagccattaaagtggaccctgtcaaacatgttgggggacaacaaagttccggcggaagaggtgttggtcgcagtcgagctgcttaaggaaaaagcagaggaggtgtaccgcctgtatcagaactctcctctcagttctcacccagtggtggccctctcagaactctcgactttatgtgcgaattcttgtccagacgagcggactttctatctggttcttctgcagctccagaaagagaaaagagtgacagttctggaacagaacggagagaaaatcgttaaattcgcgcgagggccgagagccaaagtgagcccagtcaatgatgtggacgtaggcgtgtatcagctgatgcagagtgagcaacttctgagccgcaaggtggaatccctatcccaggaggctgaaagatgtaaggaagaagctcgcagggcttgccgcgccggcaagaagcagctggctttgagatccctgaaggccaaacagagaacagaaaagagaatcgaagctttgcatgctaaactcgacactgtgcagggcatacttgatcgtatctatgcttcgcagaccgaccaaatggtgttcaacgcctatcaagcaggggttggggcactgaagttaagcatgaaagacgttacagttgagaaagccgaatctctggtggatcagatccaagaactgtgtgacactcaggacgaggttagtcagacactggcaggcggtgttacaaacggcttggactttgatagcgaagaactggaaaaggaacttgacatactgctgcaggatacgactaaagagcccttggacttacccgataaccccagaaacagacactttactaacagcgtgcccaacccacgcatctcagatgcagaactggaagctgagctggaaaaactgtccctaagtgagggcggactggtcccatctagcaaatcccccaagcggcagcttgaacccacactcaagccactatag

SEQ ID NO: 111778 - DNA, 1992 bp, Artificial Sequence
  Description of Artificial Sequence: Synthetic coding sequence
atggaacgacccgaggaaggtaagcagtcaccacctccccagccttggggaagactgttgagattaggcgctgaggagggcgaacctcacgttctgctaaggaagagggaatggactatcggccggcgcagggggtgcgacctgtccttcccttcaaacaagctggtgtccggtgaccattgtcgaattgtggtggatgagaaatcggggcaggtgaccctcgaggatacatccacttccggtacggtgataaacaagctcaaagtcgtgaaaaaacagacatgtcccctgcagacgggcgatgttatttatctggtgtatagaaagaatgagccagaacacaacgtcgcctatttgtatgaatcactcagtgaaaagcagggaatgacccaagaatctttcgaagctaataaggagaacgtgtttcacggcaccaaagatacctccggggccggagccggtcgtggtgccgacccccgggttccaccatccagcccggctacccaggtgtgctttgaggagccacagccctccacatctacgagcgacctgtttcccactgctagtgcatcaagtaccgagccctccccggccggccgggaaagatctagttcttgcggttccggtggtggggggatctctcctaagggcagcggcccctcagtggcttcagacgaagtttcgagtttcgcatcagcactgcccgatcggaaaactgcaagtttttccagcctggagccccaggaccaggaagatctggagccagttaagaagaagatgagaggggacggggacctggacctgaacggccagttactggtggcacaaccccgacggaatgctcagaccgtgcacgaagatgtccgggccgccgctggtaagcctgacaagatggaggaaactctgacatgcattatttgccaggatcttttacacgactgcgtgtctctccagccctgcatgcatactttttgcgctgcatgttattccgggtggatggaaaggtcaagtctctgcccaacttgcaggtgcccggtggaacgaatctgcaagaatcatattcttaacaacctggtcgaagcgtacttgatccagcacccgggaaatagtaggagcgaggaggatgtgcagtcaatggatgcaaggaataaaattacacaggacatgctccagcccaaggtccggcgcagcttctccgacgaagagggaagctcagaagatttgctggagctgagcgacgtggatagtgaaagcagcgacatctctcagccatacgtagtgtgtaggcagtgtccagagtaccgcaggcaggcggcacagcctccccactgcccggctccagaaggagagcctggagcaccccaagcactgggtgatgcacccagtacatctgtatctttgacaactgtgcaagattacgtgtgtcccttacagggcagccacgccctgtgcacctgttgttttcagcccatgccagataggagggccgagagagaacaagacccaagagtggctccccagcagtgcgccgtctgcctccagcccttctgccacctgtactggggatgcacgcgcaccggctgctacgggtgcctcgctcccttctgcgaactcaacctcggggataagtgcctggacggagttctcaacaacaactcgtacgagagtgacatccttaagaattatctcgccacccggggcttgacttggaagaacatgctgacagaaagtttagtcgccctgcagcgtggcgttttcttactctccgattaccgggttactggcgatacagtattgtgctattgttgtggactgcgtagctttcgcgagcttacctatcagtaccgtcagaacatcccagccagcgaactgcctgtggccgtcacctcaagaccagattgctactggggacgtaactgccgaactcaagtaaaggcccaccatgcaatgaaatttaatcatatctgcgagcagacccggttcaaaaattag

SEQ ID NO: 111779 - DNA, 1872 bp, Artificial Sequence
  Description of Artificial Sequence: Synthetic coding sequence
atggaaagaccagaggagggtaaacagtctccccctcctcaaccctggggaagactgttgcggttaggcgcagaagagggggagccccacgtgctgcttcgcaagagggagtggacgatcgggcggcggagaggttgtgacctgagcttcccatccaacaagttggtgtctggagaccattgtagaattgtggtggacgagaagagtgggcaagtgactctcgaggacacatcaacctctggtactgtgattaacaaactaaaggtggttaagaagcagacttgcccactgcaaaccggcgatgttatttacctggtgtaccgaaagaacgaacctgagcataatgttgcgtatctgtacgagtctctctctgaaaaacaagggatgacccaagagagttttgaaatggtgccttgctgcgtcgctcaagctggcctaaaactgctcgggagcagcgatccccctaccctggcctcccaaagcatagtgattaccgggtctggaggcggcggaatcagccccaaagggtctggaccgtctgtggcgagcgacgaagtcagctcatttgcctctgctttgcctgatcgcaagacggcaagcttcagctccctggagccgcaggaccaagaagatctcgaacccgtgaaaaaaaagatgcggggggatggagacctggacttgaatggccagctgcttgttgcacagcctcgacggaacgcacagactgttcacgaggatgttagagctgccgcaggcaaacctgacaagatggaggagaccttaacatgtataatctgccaggatctcctgcatgattgtgtgagcttacagccatgcatgcacactttctgtgccgcctgctattccgggtggatggagaggagctccctctgtccaacatgcaggtgccccgttgagcgaatctgtaaaaaccacattcttaataacttggtggaggcatatctgatccagcatccagacaagtccagatcagaggaggacgtccagagcatggacgctaggaataagataactcaagatatgttgcagcctaaggtgcgccgctctttttccgatgaagaaggtagctccgaggacctcctcgagctgagcgacgtcgattctgagagtagtgatatctctcaaccttatgtggtctgcaggcagtgtcccgaatacagacgacaagcggctcagccacctcattgccccgctcccgagggcgagccaggcgctccccaggcactgggcgacgctccatcaacatcagtgtctctgacaaccgccgtgcaggattacgtgtgtcccctgcaaggaagccatgccttgtgtacctgctgctttcagcccatgccggaccgcagagcggagagggagcaggatcccagggtggcgccgcagcaatgcgccgtgtgcttacagcccttctgccatctgtactggggatgcacccgaactgggtgctacggctgtctagcacccttctgtgaactgaaccttggggacaagtgtctggatggcgtgttgaacaacaacagctatgagtcagacatcttaaaaaactatctcgctactagggggctgacgtggaaaaacatgctcactgagagcctggtcgccttgcagagaggcgtcttcctgctctccgactacagggtgaccggcgatacagtgttgtgctattgttgcggcctgcgttcctttcgagaacttacatatcagtacagacaaaacatcccagcttccgaactgcctgtagccgtgacatctagacccgactgctactggggacggaactgcagaactcaggttaaggcacatcatgcgatgaagtttaatcatatctgtgagcagacaagattcaagaactag

SEQ ID NO: 111780 - DNA, 1995 bp, Artificial Sequence
  Description of Artificial Sequence: Synthetic coding sequence
atggaacggcctgaggagggaaaacaaagccctccccctcagccgtggggtcgtctgctgcggttgggcgccgaagaaggggaacctcatgtgctcctccgcaaaagagagtggacaatcggtaggaggcgcggctgtgacctgtcttttccttcaaataaactggtgtctggggatcactgcagaatcgtggtggatgaaaagagcggccaggtgactcttgaggataccagtacgagcgggacggtgattaataagctgaaggtggtaaagaagcagacttgtcctctgcagacaggcgacgtcatctacctggtctacaggaagaacgagccagaacataacgtcgcttatctatacgagtcactatccgaaaagcagggtatgacccaggagagcttcgaagcgaataaagagaacgtttttcacggaaccaaggacacctcaggagctggagcggggcgaggcgcagacccacgagtaccaccctccagtcccgctacccaggtgtgttttgaggagccccaacccagtacatcgactagcgacctgttcccaacagcttccgcgtcttcgacggagccctcacctgctgggcgagaacgcagcagctcatgtggatcaggagggggggggatttctcccaaagggagcggcccttccgtcgcctcggatgaagtcagcagctttgcttccgcattaccggataggaagacagcgtcgttttctagcctggagccgcaagatcaggaggatctggagcctgtaaagaagaaaatgagaggagatggggatttagacctcaacggacagcttcttgtggcccagcctaggagaaatgctcaaaccgttcatgaagatgttagggcagccgctggcaaaccagacaagatggaagagactctgacctgcatcatatgccaggacctgttgcatgactgcgtgtctcttcagccgtgtatgcacacattctgtgccgcctgttacagcggctggatggagcgttcttccctctgtcctacatgccgttgcccggtcgaaagaatttgtaagaaccacatccttaacaacttagtggaggcgtatttgattcagcacccggataaaagccgatcagaggaggacgttcagagcatggatgcccggaataaaattactcaggatatgctgcagcccaaggttaggcgctcattctctgatgaagagggatcttcggaagatcttttagagcttagcgatgtcgacagtgagtcttctgatattagtcagccttacgtagtttgccggcaatgtcccgagtacagaagacaggccgcccagccgccccattgcccagcccctgagggagagccaggcgccccacaggctctcggcgacgcccccagcacttctgtttccctgaccacagccgtgcaggactatgtgtgccctttacagggcagccatgcactatgtacttgttgctttcagccaatgccagatcgacgcgcagaacgcgagcaggacccacgcgttgcgccacaacagtgcgcagtctgcctacagccattttgccatctatactggggctgcacgagaacaggatgctatgggtgcctcgcgcctttttgcgagttgaatctcggcgataaatgtctggacggagtgttgaacaacaactcctacgaatctgacatcctcaaaaactacctggctaccaggggtctgacctggaaaaatatgctgaccgaaagccttgtagctctccagaggggtgtatttcttcttagcgattatcgcgtaactggggacaccgtgctttgttattgttgcggcctcagatcttttcgcgaactcacatatcagtatagacagaatatccctgcctctgagctgcccgttgcagtcacctctcgtcctgattgctactggggacgcaattgtcggactcaagtgaaggcgcatcatgcaatgaagtttaatcatatctgtgagcagactcgtttcaaaaactag

SEQ ID NO: 111781 - DNA, 1959 bp, Artificial Sequence
  Description of Artificial Sequence: Synthetic coding sequence
atggagcgacctgaagagggcaagcaatctccgcctccgcaaccttggggacgtctcctccgtttgggcgcagaagagggcgagccccatgtgctgctgcgaaaacgggagtggacgatcgggaggcggagggggtgcgatctctcttttccaagtaataaacttgtttcaggggaccattgccggatcgtcgtcgacgaaaagtccgggcaagtgacactggaggatacgtctacatctggtactgtcatcaacaaacttaaggtggtgaagaagcagacttgtcctctgcagacaggagacgtgatttacctggtgtacagaaagaatgagccagaacacaatgtcgcatacctgtacgagtcgctatctgagaagcaaggaatgacccaggaaagctttgacaccagcggtgccggcgccggccggggagctgaccctcgggtgcccccgtcgagtcctgccactcaagtgtgctttgaggaaccccagccatcaacatctaccagtgaccttttccccactgcttctgcttcatctacagagcctagccccgctggcagagagagaagttcgagctgcggctccggtggggggggaatatcgcccaagggatcagggccttccgtggcgtccgacgaagtgtctagttttgcatccgcgctacccgacagaaagacagcatcctttagctcacttgagccacaagaccaggaggacttggaacccgtcaaaaagaagatgcggggcgacggtgatctcgacctaaacggacagctactcgtagctcagcctcggagaaatgctcagactgtccatgaggacgtccgtgccgccgccggaaaacctgataagatggaggagaccctgacttgcatcatctgccaggaccttctccacgactgcgtatcactgcaaccctgcatgcacacattttgtgccgcttgttattctggatggatggagcgctcttccctgtgtcccacatgcaggtgtccagtagagcgtatttgtaagaaccatatcttaaacaaccttgttgaggcctatctgatacagcaccccgataaatctcggagcgaggaggacgtgcagtcgatggacgcccgcaacaaaataacacaggacatgctgcagccaaaggtgcggaggagtttctccgatgaggaagggtcctcagaggatctcttggagctttcggacgtggactccgagtcctccgatatctctcaaccttatgtggtgtgtagacagtgccctgaatatagaagacaggctgcgcagcctccacattgccccgcacccgagggcgagccaggggctccccaagcgttaggcgatgcaccttcaaccagcgtgtccctcacaaccgccgtccaggattatgtgtgccccctgcaaggatcccacgctctctgcacctgctgcttccagccaatgcctgaccgccgggcagagcgggagcaggacccaagggttgccccccaacagtgtgccgtgtgtttacaaccattctgtcatctgtactggggatgtacgcgtacaggctgttacgggtgcctggcccccttttgcgaactaaaccttggcgataagtgcttagatggcgtgctgaacaataattcatacgaatctgacatcctcaaaaattatctagccaccagagggctcacgtggaagaacatgctcacagaaagtttggtggcactacagaggggagtctttctgctctcagactaccgggtcactggggatacagtgttatgttattgttgtgggctgaggtccttccgtgaactgacgtaccaataccgtcaaaatattcctgcatctgagctgccagtcgctgtaacgagccgccctgactgttattggggacggaactgccgcacccaggttaaggcccatcacgccatgaaatttaaccatatatgcgaacaaactagattcaaaaactag

SEQ ID NO: 111782 - DNA, 672 bp, Artificial Sequence
  Description of Artificial Sequence: Synthetic coding sequence
atggaacgccccgaggagggaaagcaatctccaccacctcagccatggggccgcctcctccggcttggggccgaagaaggcgaacctcacgtgttgctgagaaaaagggagtggactatcggacggcggagaggttgcgaccttagctttccaagcaataaactggtatccggtgatcattgcaggattgtggtggacgagaagtctggtcaggttaccttagaggatacctccacctcgggaactgtgatcaacaagctcaaggtggtgaagaaacagacttgtccattgcagaccggagacgtgatatacctggtgtatcgcaagaacgagcctgagcacaatgttgcttacctgtatgaaagcctctccgagaagcaggggatgacacaagaatcctttgacacttctggcgctggcgctgggcgcggcgccgatccacgcgttccaccatcgagtccagccactcaggtttgcttcgaagagccacagccctcgacctccaccagtgatttgtttcccaccgcttctgcgtctagcaccgagccctctcccgccggccgggagcgcagttcctcatgtggctcgggcggggggggcatatctcccaaaggctcaggcccctctgtcgcatcagacgaggtgtctagttttgctagcgccctcccttag

SEQ ID NO: 111783 - DNA, 1050 bp, Artificial Sequence
  Description of Artificial Sequence: Synthetic coding sequence
atgacccaggagagcttcggttccggaggcggcggcatctcgcccaaaggaagcggtccttccgtagccagtgacgaagtcagcagctttgcgtccgccttgcctgatcgaaaaacagccagtttctcttcgctggaacctcaggatcaggaggatctggagcccgtgaagaagaaaatgcgcggggacggggacctcgatctgaatggacagctattggtcgcacaacctaggagaaacgcccaaaccgtccatgaggacgtacgagcagccgcgggcaaacctgacaaaatggaggagactctgacctgcattatttgtcaagacctgcttcacgattgcgtatccctgcaaccctgcatgcacaccttttgtgccgcctgctactcgggatggatggaaaggtcaagcctgtgtcccacatgtagatgtcccgtggaacgcatttgtaagaatcatatactcaataatctggttgaagcttacttgatacagcatcctgacaagtcccggtccgaggaggatgtacaaagcatggacgcacgtaacaaaataactcaggacatgctccaacctaaggtccgacgttccttttccgatgaagagggcagctccgaagatcttctcgaactgtccgacgtggactctgagtccagtgacatctcgcagccttacgtcgtgtgtcgccagtgcccagagtacagaagacaggcagcgcaaccaccgcattgccccgcaccagaaggcgagcctggtgcccctcaggctctaggagacgccccctcaacctccgttagcctcaccactgcagtacaggactacgtctgtccattgcagggctcgcatgccttgtgcacttgttgctttcagcctatgcctgatcgaagggcagagcgcgaacaggaccctcgcgtcgccccgcagcaatgcgccgtatgcctgcagcccttctgccacctatattggggctgtacccgaacagggtgttatgggtgtctggcacccttttgtgtctccggaagacagtgcttcccagccacctctttgtag

SEQ ID NO: 111784 - DNA, 1719 bp, Artificial Sequence
  Description of Artificial Sequence: Synthetic coding sequence
atggaacgccccgaggagggaaaacaaagtcctccaccacaaccttggggcaggctcttgcgcttaggggccgaggagggagagccccatgtcttgctcagaaaacgggagtggacgatagggagacggagaggatgtgacttgagtttcccgagcaataagctggttagcggggatcattgcagaatcgtcgtagacgagaaatccggacaagttacactggaggacactagtaccagcggaacagtgattaataagctcaaagtggttaagaagcaaacttgtccgctgcagactggggatgtaatctacctcgtatatagaaaaaatgagcccgagcaccgttccgggggtggcgggattagccctaaggggagcggaccttctgtcgcatctgacgaggtgtcctccttcgcgagtgctctgccggaccggaagacagcctcattctcaagcctggagcctcaggaccaggaggatctcgagcctgtgaagaaaaagatgagaggcgacggtgatctcgacctcaatggtcaacttctcgtggctcagccaagaagaaatgcccagacagtgcacgaagatgttcgcgctgcagccgggaaacccgacaagatggaggagacactgacctgcattatttgccaagacctgctccatgactgtgtaagcctccagccatgtatgcacactttttgcgccgcttgctactcgggttggatggaaaggtcgtctctatgcccgacttgccggtgcccggtcgagcgaatctgtaagaaccatatccttaataatctcgttgaagcctacctgattcagcaccccgacaaatctcggtccgaggaggacgtacaaagcatggacgccaggaacaagatcacccaggacatgctgcagcccaaggtgaggcgcagtttcagcgacgaagagggatcctctgaagatctgctagagctgagtgacgtcgattccgaatcctccgatatctcacaaccttacgtggtctgcagacagtgcccagagtaccggagacaggccgcccaacctccccactgtcccgctcctgagggagaacctggagccccccaggctctgggcgacgccccttcaacctctgtgagcctgaccacagctgtccaggattatgtttgcccactacagggctcgcacgcactgtgcacgtgctgctttcaacccatgccagaccgcagagcagagagggaacaggacccacgtgtggcgcctcagcagtgtgccgtctgccttcaacctttctgtcacctctactgggggtgcacacgtacggggtgctacggttgccttgcaccattttgtgaattgaatttgggagacaagtgcttagatggagtcctgaataataactcctacgagagcgatatcctgaagaactacctggctacacggggactgacatggaagaacatgctgacagaaagtttggtcgcattacagagaggggttttcctattgtcagattatagagtgacaggagacaccgtgctgtgctattgctgtggactgcgttcattcagagaactgacgtaccaatatcgccagaatatcccggcgtctgagctgcctgtcgcagtgacaagccgccccgactgctactggggacggaattgccggacccaggtgaaggcccatcatgctatgaaattcaatcacatttgcgagcaaacgcggtttaaaaattag

SEQ ID NO: 111785 - DNA, 345 bp, Artificial Sequence
  Description of Artificial Sequence: Synthetic coding sequence
atgagactgttaattctcgccctgctggggatatgctcacttaccgcgtatattgtcgagggtgtgggttcagaggtgagcgataagagaacgtgcgtgtctctgactactcagcggctgcctgtatcccgaatcaagacttacactatcaccgaagggtccctccgcgctgtcatattcatcactaagagaggattaaaggtgtgtgctgatcctcaggccacgtgggttcgggacgtggtgaggtcaatggatcgcaagagcaatacaagaaacaatatgattcagaccaaaccaaccggcacacagcagagcaccaacaccgccgtgaccctcaccggctag

SEQ ID NO: 111786 - DNA, 345 bp, Artificial Sequence
  Description of Artificial Sequence: Synthetic coding sequence
atgagactgctgatacttgccttactgggtatctgttccctgactgcctatatcgttgagggggtaggtagcgaggtaagtcatcgacgaacgtgcgttagcctcactacacagaggttgccagtctcacggatcaagacatacaccatcacagagggaagcctcagggctgtaatctttattaccaagcgggggcttaaggtgtgcgctgatccccaggccacgtgggtgagagacgtggttagaagtatggatcgtaaatctaacacaaggaataatatgatccagactaaacctaccggcacgcaacaatcgacaaatacagcagtgacgctcaccggatag

SEQ ID NO: 111787 - DNA, 1002 bp, Artificial Sequence
  Description of Artificial Sequence: Synthetic coding sequence
atggagtcttcaggtaatcccgagtccactaccttcttctattatgatctccagtcacaaccctgtgaaaaccaggcttgggtgtttgcaacactggccaccaccgtattgtattgccttgtgttcctgctgagtctcgtaggcaactccctggttctgtgggtactggttaaatacgagtcccttgagtctcttaccaacatctttatcctgaacctatgcctctcagatctcgtcttcgcttgcttacttccagtgtggatctctccataccattggggatgggttctgggggatttcctgtgcaaactgctgaacatgattttttccattagtttatattctagcatattttttctgaccattatgactatacatagatacctgtcagtggtatcccccctgtctactctgagagtgcctaccctgcgctgccgggtgctcgtcaccatggccgtgtgggtagcctcaatcctctcaagcattttggacactatcttccacaaggtgctgtcctctgggtgtgattacagcgagttaacctggtatctcacaagcgtctaccaacacaacctttttttcctgctgtcactcggtattatcttgttctgttatgtcgaaatactccgcaccctgttccgcagcagaagtaaacgcagacacagaaccgtgaagctgatttttgctattgttgtggcctactttctcagctggggtccgtataatttcacattgtttttgcaaacgctcttccggactcagattatccggagctgtgaggctaagcagcagctagaatatgcactcctgatctgcagaaatctggccttttcccactgctgttttaatcccgtcctctacgtcttcgtgggcgtcaagttccgcacgcacttaaaacatgtgctcagacaattctggttttgtcgcctacaggccccgagccctgctagcattcctcactctcctggggcttttgcctatgaaggggcttcattctattag

SEQ ID NO: 111788 - DNA, 111 bp, Artificial Sequence
  Description of Artificial Sequence: Synthetic coding sequence
atggagagcagcggtaatcctgagagcaccacgttcttttattatgatctgcaatcacaaccgtgtgaaaatcaagcctgggtgtttgctacacttgccacaacagtgtag

SEQ ID NO: 111789 - DNA, 1002 bp, Artificial Sequence
  Description of Artificial Sequence: Synthetic coding sequence
atggaatcttccggtaatcctgagagcaccactttcttctactacgacctgcagtctcagccatgcgaaaatcaggcctgggtcttcgcaaccctggccaccacagtcctgtactgcctggtgttcctgctcagtctggtgggtaactccttagtgttgtgggtgctggtgaaatacgagtcgctcgaatcactcactaatatattcattctgaacctttgcttgagtgacttggtgttcgcctgtctccttcccgtttggataagtccctaccattgggggtgggtccttggtgattttctatgcaagttgttgaacatgattttttccatcagtctgtacagctccatcttctttctcactatcatgactatccaccgctacttgtccgtcgtttcacctctaagcacactgcgggtgccaactctgcgttgccgcgtgctggtaactatggcggtgtgggtcgccagcatcctgagcagcatcttggatacaattttccacaaggtgctgagcagcgggtgcgattactcagaattaacctggtatctcacttctgtataccagcataacctgttcttcctgttaagcctcggcattattctcttttgctacgtcgagatactaagaaccctgttccgatcccgctcaaaaagaagacaccggactgttaaactgatcttcgcgatcgtggtcgcgtacttcctctcctggggtccatacaactttaccctgtttctccagacactctttaggacccagattatcaggtcctgcgaggccaaacagcagctcgagtatgcccttttgatctgccgcaatctggcctttagccattgttgctttaatccggttttatatgtgttcgtgggcgtgaagtttagaacacatctgaagcatgttttgaggcaattctggttttgccgacttcaggcaccttctcccgccagtattccgcattcgccaggtgcctttgcctacgaaggggcctcattttattag

SEQ ID NO: 111790 - DNA, 300 bp, Artificial Sequence
  Description of Artificial Sequence: Synthetic coding sequence
atgaaggtttccgcggccctgttgtgtttgcttctgatggccgctactttctctcctcagggcctggcccagcccgacagcgtgtctattcctattacctgctgcttcaacgtcattaatagaaaaataccaattcaacgattggaatcttacacccgcattacaaatatacagtgcccaaaagaggccgtaatcttcaagaccaaacgagggaaggaggtgtgcgcagaccccaaggagcgctgggtgagagacagcatgaaacaccttgatcaaatttttcagaacctcaagccctag

SEQ ID NO: 111791 - DNA, 291 bp, Artificial Sequence
  Description of Artificial Sequence: Synthetic coding sequence
atgcagattatcaccacagcacttgtgtgtctgctactcgcaggcatgtggccggaagacgtggattccaagtccatgcaggtgccatttagtcggtgctgcttcagcttcgcagaacaggaaatccccctaagggccattctttgctacaggaatacatcatctatttgctctaatgaagggctcattttcaagttgaagagaggcaaggaagcttgcgcccttgacacggtgggatgggtgcagcggcaccgtaagatgcttcgacattgccctagcaagaggaagtag

SEQ ID NO: 111792 - DNA, 282 bp, Artificial Sequence
  Description of Artificial Sequence: Synthetic coding sequence
atgaagatttctgtagcggccattccttttttcctactgatcacaattgcacttggaaccaaaaccgagtcatcaagccggggtccctatcacccatctgaatgttgtttcacctatacgacgtacaagatacctagacagcgcattatggactactatgaaacaaactcacagtgtagcaagcccggaatcgtgttcatcaccaaacggggccactcggtgtgcacaaacccaagcgacaagtgggttcaggactacatcaaagacatgaaggagaattag

SEQ ID NO: 111793 - DNA, 330 bp, Artificial Sequence
  Description of Artificial Sequence: Synthetic coding sequence
atgaaaatttctgtggccgcaatacccttcttcctcctgattactatagccctgggtaccaagactgagtccagcagccagaccggaggcaagcccaaggtggtcaagattcagttgaaattagttggtggcccctaccacccgtccgagtgttgtttcacctacacaacatacaagataccccggcagagaattatggactactacgagaccaactctcaatgtagcaaacccggtatcgtatttatcaccaaacgaggccatagcgtgtgcacaaacccctcagacaagtgggtgcaggactatatcaaggacatgaaagaaaattag

SEQ ID NO: 111794 - DNA, 330 bp, Artificial Sequence
  Description of Artificial Sequence: Synthetic coding sequence
atgaaaataagtgtggccgcaattccgtttttcctgctgatcaccattgcactcggaaccaagacagagagctcaagccaaaccgggggtaagcccaaagtcgttaagatccaactgaagctggtgggcggcccataccaccctagtgagtgctgctttacctataccacttataagataccccggcagcgcatcatggactattacgagaccaactcccagtgttcaaagcctggaatcgtgtttatcacgaaacgcggacatagcgtgtgcactaatccgtctgataagtgggtgcaggattatatcaaagatatgaaggagaattag

SEQ ID NO: 111795 - DNA, 342 bp, Artificial Sequence
  Description of Artificial Sequence: Synthetic coding sequence
atgaaggttagcgtggcggccctgtcctgtttgatgcttgtcgctgtgctcggctctcaggcccaattcattaacgatgccgaaacagagttgatgatgtcgaaactcccattggagaacccagtggtactgaacagctttcatttcgcagccgactgttgcacgtcttacatttctcagagcatcccatgttctctgatgaagtcatactttgagacaagctccgagtgctcaaagcccggagttatcttcttaacaaaaaaaggccgacaagtctgtgctaagcctagtggacccggcgtccaagactgcatgaagaaattgaagccatacagtatatag

SEQ ID NO: 111796 - DNA, 186 bp, Artificial Sequence
  Description of Artificial Sequence: Synthetic coding sequence
tgatgtacatcttatatctcacaatccattccttgcagccttatgaaatcttattttgagacatcctctgagtgctctaaacctggggttatcttcctgacaaaaaagggaagacaggtgtgcgcaaaacccagcggacccggagtacaagattgtatgaagaaactgaagccctactctatctag

SEQ ID NO: 111797 - DNA, 342 bp, Artificial Sequence
  Description of Artificial Sequence: Synthetic coding sequence
atgaaagtctcagtggccgcgctgagctgcctgatgctggtagccgtgctggggtcccaggcacagttcataaacgatgctgaaaccgagctgatgatgtcgaaactgccactagaaaatcccgtcgtgttaaacagctttcattttgccgcggattgttgtaccagctacatcagccagtcaatcccatgcagtttgatgaagagttatttcgaaacatcttcagagtgcagcaagccgggcgtcattttcctaaccaaaaagggccgacaggtctgtgctaagccttccggtcctggcgtccaggactgcatgaaaaagctaaagccttactcgatctag

SEQ ID NO: 111798 - DNA, 342 bp, Artificial Sequence
  Description of Artificial Sequence: Synthetic coding sequence
atgaaggtctctgtcgcagccttatcgtgccttatgctcgtagccgtgcttggttctcaggcacagtttattaatgacgccgagaccgagctaatgatgtcaaagttacccctggagaatcctgtcgtgctgaactcattccactttgcggccgactgttgcacatcttacatctctcagtcaatcccttgctctcttatgaaatcttatttcgagacgagttcagaatgctccaaaccaggcgtaattttcctgacgaaaaagggcagacaagtgtgtgccaagcccagtgggccaggcgtgcaggattgcatgaagaaactcaaaccctattccatctag

SEQ ID NO: 111799 - DNA, 363 bp, Artificial Sequence
  Description of Artificial Sequence: Synthetic coding sequence
atgaaggtctctgaagcagccttgagtcttctggtacttatattaatcattacttccgcgagccgatctcagccaaaagtgcctgagtgggtgaataccccctcaacatgttgtctcaaatactatgagaaggttttaccaagacggctggttgttggctataggaaagccctcaattgccatctccctgcaatcattttcgtcaccaaacgtaatcgcgaggtctgcacaaacccgaacgacgactgggttcaggagtatatcaaagaccccaacctgcctttactgccaacacgcaacctctccacagtgaagattatcactgcaaagaatggacaaccccagttacttaacagccagtag

SEQ ID NO: 111800 - DNA, 1188 bp, Artificial Sequence
  Description of Artificial Sequence: Synthetic coding sequence
atggcctggagacaccttaagaaacgggcccaggatgctgttatcatactgggaggaggcggactgctgttcgcaagctacctgatggccaccggtgatgagcgcttctacgccgaacatcttatgcccacactgcaaggccttttagacccggagagtgcccacaggctcgcagtccgtttcactagcctcggactgcttcccagggcccgcttccaagacagcgacatgctggaagttcgggttctgggccataaattcaggaatcctgtaggcatagctgctggctttgacaaacacggcgaggcagtggatggtctgtataaaatgggattcggattcgtcgagatcggttctgtcacccccaagccccaggagggcaatccccgcccaagagtctttcggctccctgaggatcaagcagtcatcaatagatatggcttcaattcacatggcctgagcgtggtggaacatcggctgcgcgctcgccagcagaaacaggccaagttgacagaggatggcctgcctctcggcgtgaatttgggaaagaataagacctcagtggacgcggcagaagattacgccgagggcgtacgggtattggggccactggctgactatctcgtcgtgaacgtgtcttcacccaacacagccgggctcaggtccctgcaaggaaaggctgagctccggcgactgctgaccaaggtgctgcaggaaagagacggcctccgaagggtgcacaggccagccgtactcgtaaaaattgctcccgacctgacctcccaagataaggaagatattgcttctgtcgtaaaggaacttggaattgacggcttgattgttacgaatactacagtctcccggccagcaggacttcagggtgctctgcgcagtgagacgggaggcttatccggcaagcctttaagggacctgtccacccagaccatcagagagatgtacgccctgacacagggtagagtgcctattattggcgtggggggggtttcctccggccaggatgctctcgagaaaatcagggccggcgcctccctcgtgcagctctacactgccttaactttctgggggccccccgtggttggaaaggttaaacgcgaactggaggccctactcaaggagcaggggttcggcggcgtgaccgacgctatcggggctgaccacaggaggtag

SEQ ID NO: 111801 - DNA, 270 bp, Artificial Sequence
  Description of Artificial Sequence: Synthetic coding sequence
atgaaggggctggccgccgcccttttggtcctggtgtgcaccatggctctttgctcatgtgcccaggtcggcaccaacaaggaactgtgctgcctggtgtacacgtcctggcaaattcctcagaagttcatcgttgactacagtgaaaccagtccgcagtgccccaaacccggggtgatcctgctgacaaaacgcggacgtcaaatttgcgccgacccaaacaaaaagtgggtgcagaagtacattagtgatctcaaactgaatgcctag

SEQ ID NO: 111802 - DNA, 297 bp, Artificial Sequence
  Description of Artificial Sequence: Synthetic coding sequence
atggcactcctgctcgctttgtccctgttggttctgtggacatctccggctcctactttgtcgggcaccaatgatgccgaagattgctgtctcagcgtgacccagaagccgataccaggctacatcgtccgtaattttcattaccttctgatcaaagacgggtgccgggtgcccgccgtagtatttaccacactgagggggcggcaactctgtgcacctcctgatcagccatgggtggagcgaatcattcagagactccaacggacctccgcaaaaatgaagcgtcgcagttcatag

SEQ ID NO: 111803 - DNA, 315 bp, Artificial Sequence
  Description of Artificial Sequence: Synthetic coding sequence
atggccctgctcctcgccctgtctttactagtgctttggactagccccgctccgaccctctctgggaccaacgatgctgaggattgctgtctgagcgtcactcagaaacccatacctggatacatagtcagaaatttccactaccttcttattaaagatgggtgtagggtgccagctgtcgttttcactactctgcgtgggcgccagctttgtgcccctccggatcagccctgggtggaacgaattattcagcggctacaaagaacatccgccaaggcatctttggctctgcctggtcctgtaagttccctgtag

SEQ ID NO: 111804 - DNA, 291 bp, Artificial Sequence
  Description of Artificial Sequence: Synthetic coding sequence
atgtgctgcactaagtccctcctgttggccgcactcatgagtgtgctcctcctgcacttgtgcggagaaagcgaagcagcctccaactttgattgttgtctagggtataccgatcgaatactccaccctaaattcatcgtgggattcactcgtcagctagccaacgagggttgtgacatcaacgccattatcttccatactaaaaaaaaactgagtgtatgtgctaacccaaagcagacctgggtgaagtatattgttcgtctgctgagtaagaaagtaaagaacatgtag

SEQ ID NO: 111805 - DNA, 288 bp, Artificial Sequence
  Description of Artificial Sequence: Synthetic coding sequence
atgtgttgtacgaagtctctcctgctcgcagccctgatgagcgtccttctgctgcacttgtgtggcgagtctgaagcctcaaatttcgactgctgcctgggttacacagatcggatccttcatccaaaatttatagtcggcttcactaggcagttagcaaacgaaggatgtgatataaatgccatcatcttccatacaaaaaagaaactgtctgtgtgtgcaaacccaaagcagacgtgggtcaaatatatcgtgaggctgctctccaagaaagttaaaaatatgtag

SEQ ID NO: 111806 - DNA, 405 bp, Artificial Sequence
  Description of Artificial Sequence: Synthetic coding sequence
atggcccaaagcttagccttgtctttgctgattctggtgcttgccttcggcatccctagaacacagggctccgacggcggagcgcaggattgttgcctgaagtactcacaaagaaagattccagccaaggttgtccggtcctatcgaaagcaagaaccatcacttgggtgtagcatcccagccatcctttttcttccgcggaagcggtcacaggccgaactgtgtgccgacccgaaggagttgtgggttcagcaactgatgcaacacttggacaagaccccttcaccccagaaacccgcccaaggttgccgtaaagatagaggcgcttcaaagacgggcaaaaagggcaagggatccaagggctgcaagaggacagagaggagccaaacgccaaaaggaccctag

SEQ ID NO: 111807 - DNA, 375 bp, Artificial Sequence
  Description of Artificial Sequence: Synthetic coding sequence
atggctcaatcccttgccctgtcactgctcattctggttctcgcctttggcattccaagaactcagggctcggacggaggcgcccaggattgttgcttaaagtactcacagaggaagatccctgctaaggtcgtccgatcatatcgcaaacaggagccttcactcggatgcagtattcccgcgattctgttcctgccgaggaagaggagtcaggcagaactgtgcgccgatcctaaagagctctgggttcaacagcttatgcagcatctcgataaaaccccctcacctcaaaaaccagcacagggctgccgcaaggaccgaggcgcgagtaagacggggaagaagggaaagggctctaagggctgcaaacgctag

SEQ ID NO: 111808 - DNA, 549 bp, Artificial Sequence
  Description of Artificial Sequence: Synthetic coding sequence
atggctgaattcccatcaaaggtgtccacacggacaagttctccggcccagggcgccgaggcgtcagtgtcagcactcagaccagatttgggtttcgtaaggtctcgattgggcgctctgatgctgctgcaactggtgctggggcttcttgtctgggctttaatcgcagacaccccttaccacctctaccccgcatatggatgggttatgtttgtggcggtgttcctgtggcttgtaaccatagtgctgttcaacctgtatctctttcagctgcatatgaaactgtatatggtaccctggcccctggtgcttatgatcttcaacatcagtgccaccgttttgtacattaccgcctttattgcatgttccgccgccgtggacctgacctcactccgaggcactaggccatacaatcagcgggccgccgcttctttttttgcatgtctggtgatgattgcctacggcgtttctgccttcttttcctaccaggcttggcgcggagtgggatctaacgccgccacatcgcaaatggctggcggctatgcctag

SEQ ID NO: 111809 - DNA, 414 bp, Artificial Sequence
  Description of Artificial Sequence: Synthetic coding sequence
atgaaagtgagcgtggctgccctcagttgtctgatgcttgtgaccgctctaggttcacaggcccgggttactaaagacgcagagactgagtttatgatgtccaagcttccgttggagaatcccgtgcttcttgatatgctgtggcgccggaagatcgggcctcagatgacgctctcccacgccgccgggtttcatgccactagcgcagactgctgcatttcctacaccccccgctctatcccctgcagtctcttagagtcatactttgaaactaattctgaatgttcaaagccaggagtgatatttttgaccaaaaaaggcaggaggttttgcgctaacccttctgacaaacaggtccaggtctgtgtgaggatgctgaagctcgatactcggatcaagacccgcaaaaactag

SEQ ID NO: 111810 - DNA, 363 bp, Artificial Sequence
  Description of Artificial Sequence: Synthetic coding sequence
atgaaggtgtccgtggctgcactgtcatgcttgatgcttgtaactgccctgggatcccaggccagggtgactaaagatgccgaaacggagtttatgatgagtaagttgcccttggagaacccagtgctgttagacagatttcatgctacctccgcagactgttgcatttcttacacgccaagatctatcccgtgttcactcttggagtcttatttcgagaccaactcagagtgtagcaaacccggcgtgatcttccttaccaagaagggtcggagattctgcgctaatccctccgacaaacaggtgcaggtttgcgttcgtatgctcaagttagacacaaggatcaaaaccagaaaaaactag

SEQ ID NO: 111811 - DNA, 2862 bp, Artificial Sequence
  Description of Artificial Sequence: Synthetic coding sequence
atggaggagcaaggacattctgagatggaaataattccttccgagtcccacccccacattcagcttctcaagtccaaccgagaactgttagtgacgcacatacgtaatacccaatgtctagtggataacctgctcaagaacgactattttagtgcagaggacgccgagatcgtgtgtgcatgccctacgcagcccgacaaggtgagaaagattctagacctggtccaatccaaaggagaagaagtatcagagttctttctgtatctgctgcagcaattagcagatgcttacgtcgacctaaggccatggctgctggaaatcggcttctcaccctccctgttgacacagagcaaggtggtcgtgaacaccgaccccgtcagtagatacactcagcagctcaggcaccacctaggtcgcgactctaaattcgtgctgtgctatgctcagaaggaggaactgttgcttgaagagatctacatggataccattatggagctggtgggattttccaacgaatctctgggtagcttgaattcgctagcatgtctgcttgatcacacgacagggattctgaatgaacagggtgagacaatcttcatccttggcgacgccggggtgggaaaatccatgctgctgcaacgtttgcagtccctgtgggctaccggccgcttggacgcgggcgtgaagtttttctttcactttagatgcagaatgttctcttgcttcaaggagtccgaccgactttgtcttcaggatctgctgtttaagcattactgctatcctgaaagagatccagaagaagtcttcgcattcttacttcggttccctcacgtggcgctgttcacttttgacgggctcgatgagctgcactctgatctggatttatctagagtacccgactctagctgtccctgggagccggctcatccactggttctgttggccaatcttctcagtgggaagctgctcaagggggcttctaagttactaacggccaggacgggtattgaggttcccaggcagttcttgcgcaagaaggttttactaagaggattttcaccaagtcatctgcgcgcctacgcccggcgcatgttccccgagcgcgctctgcaagaccgactcctgagccaactagaggccaacccaaatctatgcagcctgtgtagtgtgccccttttctgctggataatatttaggtgcttccagcacttccgcgccgcgtttgaaggaagcccacaactgcccgattgcaccatgaccctgacggatgtgtttctgctcgtgacagaggtccatctcaaccgaatgcaaccttcgtctttggtgcagcgtaatacgaggagccccgtagaaaccttgcacgcaggacgggataccctctgttctctgggccaggtagctcatcgtggcatggaaaaatccctattcgtctttacccaggaggaagtgcaggcaagcgggcttcaggagcgagatatgcagctaggttttctcagggctttgcccgagttgggcccagggggagatcagcagtcctacgaattcttccacttaacactccaggcgttttttactgcatttttccttgtcctagatgatagggtgggcactcaggaactcctgcgattttttcaggagtggatgccaccagcaggcgccgccacaacctcctgctatccaccatttctccccttccagtgcctgcagggctccggtcctgctcgggaggacctgtttaaaaataaagatcatttccagttcaccaacctgttcctctgcggactgctatcgaaggccaagcagaagttactcagacatttggtgccggcggcagccctcaggagaaagagaaaggcactctgggcgcacctgttcagcagtttgcgggggtacttgaagagcttaccgagggtgcaggtggaaagttttaatcaggtgcaggctatgcccacctttatttggatgttacgatgcatatacgagacccagagtcaaaaggtgggccagctggccgcccggggaatatgcgctaactatctgaagttgacctattgcaacgcatgttcggctgactgcagcgcgctcagctttgttctgcatcactttccaaaacggttggccctggatctggataataataatttgaacgactacggcgtacgcgagttgcagccctgtttctcacgtctcaccgtacttcgactttcagtgaaccagattacagacggcggtgtgaaagtgttgagtgaggaattaacaaagtacaagattgttacatacctgggtctctacaataatcagatcactgacgtcggcgctcgatacgtgaccaaaatactggacgagtgcaaggggctgacccacctcaagctggggaaaaataagataacctcagaggggggcaagtacctcgcattggcggtcaaaaacagcaaaagcataagcgaggttggaatgtggggaaatcaagtgggcgacgagggagccaaagccttcgccgaggctctgagaaaccacccaagtctgaccaccttatccttagccagtaacggcatcagcaccgagggggggaaatccctggctcgggcgctgcagcagaacacatccctcgagattctatggctgactcaaaatgaattgaacgatgaggtagcggagagcctcgccgaaatgctcaaggtgaatcagactctgaaacacctttggcttatccagaaccagattactgctaaaggtacagcgcaattagccgacgctttacaatctaataccggtatcaccgaaatctgcctcaacgggaatctgattaaacctgaagaagctaaggtctacgaagatgagaagcggatcatttgcttctag

SEQ ID NO: 111812 - DNA, 360 bp, Artificial Sequence
  Description of Artificial Sequence: Synthetic coding sequence
atggctgggctgatgacgatcgtgacctctctcctgttcttaggagtgtgcgcccatcatatcatcccaacaggtagcgttgttatcccctctccttgttgcatgtttttcgtcagcaaacggatcccagaaaaccgcgtcgtgtcttaccagctctcgtcgaggagcacttgtctgaaggcaggcgtaatttttactaccaagaagggccagcaattctgtggagaccctaaacaggaatgggtccagaggtacatgaagaacctcgacgctaaacaaaagaaggcttctccacgcgccagagcggtcgccgtgaagggacccgttcagaggtacccaggtaatcaaacgacgtgttag

SEQ ID NO: 111813 - DNA, 450 bp, Artificial Sequence
  Description of Artificial Sequence: Synthetic coding sequence
atgaatctctggctcctggcttgtctggtggcaggcttcctcggtgcctgggcccctgccgtgcacacacaaggcgtctttgaggattgttgcctggcatatcattatcccattgggtgggcagtcctgcgacgtgcgtggacatacaggatccaggaagttagtggatcatgcaaccttcctgccgcaatcttttacctgccaaagaggcacagaaaggtgtgcgggaaccccaaatcccgcgaggtgcagcgcgctatgaaattgttagacgctaggaataaggtgttcgcgaagctccatcataatactcagacattccagggaccacatgccgttaagaagctgtcgtctggcaacagcaaactcagctcttcaaaattttcgaaccccataagtagctccaagcgaaacgtctcactcctgatctctgcaaactccggcctgtag

SEQ ID NO: 111814 - DNA, 255 bp, Artificial Sequence
  Description of Artificial Sequence: Synthetic coding sequence
atgaacctgtggttgctcgcatgcctggtggcgggttttctcggggcttgggcacctgcagtccatacacagggagtctttgaggattgttgtctggcctatcattaccccatcgggtgggccgtgctcaggcgcgcctggacatatagaatccaggaagtctcaggaagttgtaatctcccagccgctattcgaccaagctgctgtaaggaggtagaattttggaaattacaggttatcatcgtccaggtatag

SEQ ID NO: 111815 - DNA, 453 bp, Artificial Sequence
  Description of Artificial Sequence: Synthetic coding sequence
atgaatctgtggctcctagcctgcctggttgccggcttcctgggcgcctgggccccagccgtccacacacagggcgtcttcgaagattgctgcctagcctaccattatcccatcggctgggctgtgctacgccgcgcatggacctaccgaatccaagaggtcagcggctcttgtaatctgccagctgctattttttacctccctaagcgacaccgcaaggtgtgcggcaatcctaagagtcgtgaggttcagagggcgatgaagttgttggatgctcgtaataaggtgttcgcgaagctccaccacaacactcagacttttcaggctggaccccatgcggtgaagaaactgtccagcggcaattccaagctgtcctcctccaagttttccaatcctattagttcttcaaagcgaaatgtgtctctgctaataagtgcaaactctgggctgtag

SEQ ID NO: 111816 - DNA, 285 bp, Artificial Sequence
  Description of Artificial Sequence: Synthetic coding sequence
atgatgggactgtccttagccagcgctgttctcctggcgagcttgctttccctgcacctgggcaccgccactagagggtccgatatttccaagacctgctgctttcagtactcccacaagccactaccctggacttgggtgaggagctacgaatttacatctaatagctgctctcagagagctgtgatctttaccaccaagagggggaaaaaggtgtgcactcatcctcgtaagaagtgggttcagaaatacatctcactgctgaagacacccaaacagctatag

SEQ ID NO: 111817 - DNA, 285 bp, Artificial Sequence
  Description of Artificial Sequence: Synthetic coding sequence
atgatggggcttagcctggcatcggctgtactgcttgcaagccttctgtctctgcatctcggtacagctaccagaggctcagacatatctaaaacatgctgcttccagtacagtcataagccactgccctggacatgggtgagatcttacgaatttacctccaatagttgctcacaacgagcagtgatttttaccacaaaacgaggtaaaaaagtgtgtacacatccacgtaagaaatgggtgcaaaagtacatctcactcctgaagactcctaaacagctctag

SEQ ID NO: 111818 - DNA, 339 bp, Artificial Sequence
  Description of Artificial Sequence: Synthetic coding sequence
atgaagggcccacccactttctgtagtttgctcctgctaagcttgcttctgtcacccgatcccacggccgccttcctgctgcctccctctaccgcttgctgcactcaactctatcgaaagccactctccgacaagttactgcggaaggttatccaggtcgaactccaagaggctgacggcgattgccacctgcaggcctttgtccttcatctggcccaacgctctatatgtatccatccccaaaatccttccctgtcacagtggtttgagcaccaagagaggaaactgcacgggactttgcccaagctgaacttcggcatgcttcggaagatgggatag

SEQ ID NO: 111819 - DNA, 384 bp, Artificial Sequence
  Description of Artificial Sequence: Synthetic coding sequence
atgcaacagaggggcctggctattgtggcgctcgccgtatgcgccgcactccatgcatccgaggctatccttccgattgcaagctcgtgttgtacggaggtgagccaccacatctcccggaggttactggagcgcgtaaatatgtgcagaatccaacgagcggacggagattgcgatctggccgccgtcatactgcacgttaagcgacgtagaatttgtgtgagtccccataaccacaccgtgaagcaatggatgaaggtgcaggccgctaagaaaaacggaaaaggcaacgtgtgccatcgcaagaagcaccatggaaagagaaattcgaaccgtgcacaccagggaaaacatgaaacatacggacacaaaacaccatattag

SEQ ID NO: 111820 - DNA, 384 bp, Artificial Sequence
  Description of Artificial Sequence: Synthetic coding sequence
atgcaacagaggggcctagcgatcgtcgcactggcagtctgtgccgccctccacgcttctgaagccatcctgcctatcgcctcctcctgttgcacagaggtctcacaccatataagcaggagactgctggagcgggtcaatatgtgcaggatccagagagcagacggcgattgtgatctggccgcggtgatcctacacgtcaaacgcagaaggatttgtgtgtcaccccataaccataccgtcaaacaatggatgaaagtgcaggccgcgaaaaaaaacgggaagggcaacgtctgccaccgtaagaagcatcatggaaagaggaacagcaatcgcgcgcaccagggcaagcatgagacttatggccataaaactccttactag

SEQ ID NO: 111821 - DNA, 243 bp, Artificial Sequence
  Description of Artificial Sequence: Synthetic coding sequence
atgtgtcgcatacagcgggccgacggggattgcgacctagctgctgtgatactgcatgtgaaaagaaggagaatttgtgtttccccacacaatcacacggtaaagcagtggatgaaagtccaggccgccaaaaaaaacggaaaaggcaatgtgtgccataggaaaaagcatcacggaaagcgtaattctaatcgagctcatcaggggaaacacgagacctatggacacaagacgccttactag

SEQ ID NO: 111822 - DNA, 354 bp, Artificial Sequence
  Description of Artificial Sequence: Synthetic coding sequence
atgcagcagaggggcttggccatagtggccctggcggtgtgcgcagccttgcacgctagtgaggcaatcttacccatcgcctcctcttgctgtacggaagtttcacaccatatctctcggcgcctgctggagagggttaatatgtgtcgcatccagcgtgcggacggagattgcgacctggccgcggtaatgctggagtgttccgacatgataagcgcccattacaacctccacctgcctggtagcaacgattccccaaccagtgcattccaggtcgccggtatcacagcttttatgtcttccgccgaagagtctgtttctgcacgtacaacaatcctgctgtcatccggatag

SEQ ID NO: 111823 - DNA, 282 bp, Artificial Sequence
  Description of Artificial Sequence: Synthetic coding sequence
atgcaggtgagcaccgctgctctcgctgtgcttctttgcaccatggcgctgtgcaatcaagtgctgagtgccccacttgctgccgacaccccaactgcatgttgtttctcctacaccagtagacagattcctcagaatttcatagccgactattttgaaacttcgtcccagtgtagcaagccatctgtgatatttctgaccaaacgaggacggcaggtatgtgctgaccccagcgaggagtgggttcagaagtatgtctcagacctagaactctcagcctag

SEQ ID NO: 111824 - DNA, 159 bp, Artificial Sequence
  Description of Artificial Sequence: Synthetic coding sequence
atgcaagtgtcaaccgctgccctggctgttcttctatgcacgatggctttatgtaaccaggttctgagcgcgcctctctctaggccacgcgaagccggtcgaagcgtcctgactcccgtgcgttcaggttcacgcaacaccagtgtcacatggtcctag

SEQ ID NO: 111825 - DNA, 144 bp, Artificial Sequence
  Description of Artificial Sequence: Synthetic coding sequence
atgcaggtgtccaccgccgcgcttgcagtactgctgtgtacaatggccctgtgcaaccaggtccttagtgcgcctcaggccgggcgtagtgttctcacccctgttcgatctggttcgcggaacacgagcgtgacttggtcttag

SEQ ID NO: 111826 - DNA, 279 bp, Artificial Sequence
  Description of Artificial Sequence: Synthetic coding sequence
atgaagctctgcgtcacagttctgtccctgcttatgttggttgccgctttctgctctcccgcactgtcggctcccatgggaagtgacccacctaccgcatgttgtttctcttacaccgcccgaaaactgccgcggaattttgtagtagattattatgagacctccagtctgtgctcgcaaccagcagtggtgtttcagactaagaggagcaagcaggtgtgcgccgacccatcagaatcctgggtacaggagtatgtttacgaccttgagctaaactag

SEQ ID NO: 111827 - DNA, 159 bp, Artificial Sequence
  Description of Artificial Sequence: Synthetic coding sequence
atgaagctgtgcgtcacggttctgtctttactgatgctcgtggctgccttctgcagcccagccttatccgctccaaactccaagcccaaggaggcttctaagagcgtcctcatacccgtcaacccagggagccggtcaacttgcatgacatggaattag

SEQ ID NO: 111828 - DNA, 159 bp, Artificial Sequence
  Description of Artificial Sequence: Synthetic coding sequence
atgaaactgtgtgtcacagtcctctctctgctcgtgttggtggccgcattttgctccctggcactgagtgcccccaacagtaagcctaaggaggcgtcgaagagcgcgctaacacctgttagccccggaagcagatctacatgtatgacctggaactag

SEQ ID NO: 111829 - DNA, 207 bp, Artificial Sequence
  Description of Artificial Sequence: Synthetic coding sequence
atgaagctctgcgtgactgtgctgagtctgctagtactagtcgcagcattctgctctctagctctgagcgcaccaaccaaatcttctgagtggaagctgcaaggggtatgcttccaatgctgctccaggaaagatccgatccatcagagctgtccaacctggacgatggtgagacagcggaagatgccgactactggcaaaggctag

SEQ ID NO: 111830 - DNA, 261 bp, Artificial Sequence
  Description of Artificial Sequence: Synthetic coding sequence
atgaagctgtgcgtaacagtgctgtcccttctggtgctggtggccgctttctgctcactggccctaagtgcccccatgggatctgatcctcctacagcatgctgcttctcgtatactgctcggaagttgcctcgcaatttcgtggtggactattatgagacaagcagcctctgctctcaaccagcagtcgttgccgcgccgcacggaccatggtcagggagaggccggtgtcttccacaggcccgggacaaggcgcgttag

SEQ ID NO: 111831 - DNA, 279 bp, Artificial Sequence
  Description of Artificial Sequence: Synthetic coding sequence
atgaaactgtgcgtgaccgtgttatccctgctcgttcttgttgccgcgttctgttctctggcactgtccgctcccatgggcagtgatcctccaactgcctgctgtttctcgtatacagctaggaaactgccccgcaatttcgtggtggactattatgaaaccagttccctttgcagccagccagcagtggtcttccagacaaagcggggaaagcaagtgtgcgcggatccaagtgaatcctgggtgcaggaatacgtctacgacctcgagctgaactag

SEQ ID NO: 111832 - DNA, 300 bp, Artificial Sequence
  Description of Artificial Sequence: Synthetic coding sequence
atgaaagtgtcggcggcactcctatgtctcctgctaatcgctgccaccttcatcccccaaggtctcgctcaaccagatgccattaacgcccctgttacctgttgctacaatttcacaaaccggaaaatcagcgttcagaggctcgcttcttacagacgcatcacatcttccaaatgccccaaggaagcagttatctttaaaacgatcgttgccaaagaaatctgtgcagatccgaagcagaaatgggtgcaggatagcatggaccatcttgacaaacagactcagacacccaagacatag

SEQ ID NO: 111833 - DNA, 330 bp, Artificial Sequence
  Description of Artificial Sequence: Synthetic coding sequence
atgttaaagctgacccctctgccaagcaaaatgaaagtctctgctgctcttctgtgcctattgctgatggccgctaccttcagcccccaaggattggcccagcctgatagcgtgagtattcctattacatgctgctttaacgtcatcaatagaaaaattcctatccaacgcctggagtcatatacaaggatcaccaatattcagtgtcccaaagaggccgtcatctttaagaccaagagaggtaaggaggtgtgcgccgaccccaaagaacgatgggtacgcgactccatgaagcacctcgaccagattttccagaacctcaaaccatag

SEQ ID NO: 111834 - DNA, 1068 bp, Artificial Sequence
  Description of Artificial Sequence: Synthetic coding sequence
atggaaacccccaatactactgaggactatgatactactactgagtttgattacggcgacgccaccccgtgccagaaggtaaacgaacgtgcttttggggctcaactcttgccaccattatattctctcgtctttgtgataggcctcgtgggcaacattttagttgtgctcgtgctggtgcagtacaaacgattaaagaacatgacttccatttatcttctaaatctggcaattagtgacctcctattccttttcactcttcctttttggatcgactacaagctgaaggacgactgggtctttggcgatgctatgtgcaaaatactcagcggattctactacactggactgtatagtgagatattcttcataattctgctcactattgatcgatatcttgccatcgtgcatgctgttttcgcactcagagccaggacagtgacattcggggtgattacttctattatcatttgggcccttgctatcctggcatctatgccagggttgtatttcagtaagacacagtgggagttcacacaccacacttgtagtcttcatttcccacacgaaagcctccgcgagtggaaactttttcaggctttgaagttgaatctcttcggtctagtcttaccactgcttgtgatgataatctgctacacagggatcatcaaaatcctcctgagacgccctaatgagaagaaaagcaaggccgtccgattgatcttcgtgatcatgattatcttcttccttttttggactccatacaatttaactatccttatcagcgttttccaggactttctttttacccacgaatgtgagcagagtaggcacctcgacttagctgtacaggtgacagaggtgattgcttacacgcactgttgtgtgaatcctgtgatctacgcgttcgttggggaacggtttcggaagtatctccgccagctctttcaccgaagggtggcggtacatctcgtgaagtggctgccgttcctgtcagttgaccgcctagagagggtctctagtactagccccagtactggggaacatgaattatctgctggcttttag

SEQ ID NO: 111835 - DNA, 1089 bp, Artificial Sequence
  Description of Artificial Sequence: Synthetic coding sequence
atggggacagaggctacagaacaggtgtcatggggtcactatagcggggatgaggaggatgcctatagcgctgagccactgccggaactctgttacaaagctgacgtacaggcgttctcacgggccttccagccctctgtctccctgacagtcgcggcgctggggttggctggaaatggattggtgctcgctacccacctagctgctaggagagcagcaaggtcccccacaagcgctcatctactacaactggctctggcagatctcttgctagccttgacactgcctttcgcggccgcgggcgcactacaaggctggtctttgggttccgccacatgccgcaccatttccggtctttacagtgccagctttcatgccggattcttattcctggcctgcatctcagctgacagatacgtggctattgccagggccctgccagcaggcccacggcccagcactcccggccgagcccacttggtctccgttatagtctggttgctgagcctactcctcgccctgccagcgctactgttcagccaagatgggcagcgggaaggacaacgacggtgtcgtctaatcttcccagaagggcttacccaaactgtcaaaggcgccagtgcagttgcacaagttgccctcggctttgccctccctctgggcgtcatggtggcttgttacgccttactgggccgcacacttctcgccgccagagggcctgaacgtagaagggcgctgagagtcgtggtggccctggtcgccgcttttgtggtgctgcagctgccctattctctggccctgctccttgatactgctgatctgctcgcggcccgagaaaggagctgccctgccagcaagagaaaggacgtcgcattactcgtgacaagcgggcttgcactcgctcgctgcggactcaatccagtgctgtatgcttttttggggcttcgatttaggcaggatctgcgtcggctcttgcgaggcggatcctgtccatctggcccccagccccggagaggctgcccaaggagaccaagattgtcctcctgttccgcacctacagaaacccactccctcagctgggataattag

SEQ ID NO: 111836 - DNA, 1125 bp, Artificial Sequence
  Description of Artificial Sequence: Synthetic coding sequence
atgctgagcacttcccggtcaaggttcattcgcaatactaatgaatctggcgaggaggtgactaccttcttcgattacgactacggggccccgtgccacaagttcgacgttaaacagattggcgcacagctgcttccccccttatacagcctggtctttatattcggattcgtgggaaacatgctggtggttctgattctgatcaattgtaaaaaactgaaatgcttaacagacatctacctgttgaatttggcaatttcggacctgctgttccttattactctgcccctctgggcccactctgccgccaatgaatgggtgtttggcaatgcaatgtgtaagctgtttacaggcctataccacattgggtacttcggggggatcttttttatcatccttctgactattgatagatatctggcaattgtgcatgccgtgttcgccctcaaggctagaacagtgacgtttggcgtagtgactagcgtgatcacctggctcgtggccgtgtttgctagcgtcccgggaatcatcttcacgaaatgccaaaaagaggacagcgtgtacgtgtgtggcccgtattttccccgaggctggaataacttccacactatcatgcgcaatattttggggctagttctgcccctgctgatcatggtcatctgttacagtggtatacttaagaccctcctccgttgccgcaatgagaagaaaagacatagagcagttagagtgatctttacaatcatgatcgtgtattttctattctggacaccttataatatcgtcatcttacttaataccttccaggagttctttggcctaagcaattgcgaatcaactagtcagttggaccaggccacacaggtcactgagacgctgggtatgacccactgttgcattaaccccatcatatacgcctttgtgggggaaaagttcaggtctttatttcatattgccctgggttgcaggatcgcccccctgcagaaaccagtctgcggtgggcccggagttaggcccggcaaaaatgtgaaggtaacgacacaggggttgctggatggccgcggaaagggtaaaagcatcggtagggctccagaggcttccctgcaggataaggagggggcatag

SEQ ID NO: 111837 - DNA, 1125 bp, Artificial Sequence
  Description of Artificial Sequence: Synthetic coding sequence
atgctctctacctcaagatcccgctttatccggaatacaaatgaaagcggcgaggaagttacaaccttctttgactacgattacggagcaccttgccacaaattcgatgtgaagcagattggcgctcagctcctgcccccgctgtactcgttggtgttcattttcggtttcgtgggaaacatgctggtggtcctaattcttatcaattgtaagaagctcaaatgtctgactgacatctacttactgaacctcgctatctctgatcttctctttctgatcaccctccctctctgggcccatagcgccgctaacgaatgggtgttcgggaacgccatgtgtaaattatttacggggctctaccatatcggctattttggcggcattttcttcattatccttttaacaatagatagatacctggctatcgtacatgccgtattcgctctgaaggcaagaacggttacattcggcgtcgtgacgagcgtcatcacatggctggtggctgttttcgcttccgtgcctggaataatttttactaaatgccagaaggaggattctgtgtacgtgtgcgggccttacttcccaagaggttggaacaacttccacacaatcatgcgaaacatccttgggttggtgttacctctgctcatcatggtcatctgctacagcggtattctgaagacactgcttagatgcagaaatgagaaaaagaggcatagagcagttcgcgtgatatttacaatcatgattgtgtatttcctcttctggaccccctataacatagtgattcttctcaacaccttccaggagttctttgggctctcaaactgtgagtcaactagccagcttgaccaagcaacacaggtcacagagactctaggaatgacccattgctgtattaaccccattatttatgctttcgtcggtgagaagttcagaagcttattccacattgctctcgggtgtcggatcgctcccttgcagaagcccgtctgtggggggcctggcgtcaggcctggcaagaacgtgaaggtgaccacgcaagggctgctcgacgggagaggtaaaggcaagagtattggaagagctccagaagcaagcctgcaagataaagagggggcgtag

SEQ ID NO: 111838 - DNA, 366 bp, Artificial Sequence
  Description of Artificial Sequence: Synthetic coding sequence
atgttgagtacctctcgctcaaggtttatcaggaatactaatgagagtggggaagaggtgactacttttttcgattatgattacggcgccccctgccataagttcgacgtcaagcaaattggcgcacagctgctaccccctttatactccttggtattcatcttcgggtttgttgggaacatgctcgttgtcttaatactcatcaactgcaagaaactcaagtgcctcaccgacatctatctactcaacctcgcaatctcggatctgttattcctaattaccttgcctctgtgggcccattccgcggccaacgagtgggtctttgggaacgctatgtgcaaactcttcactggcctgtaccactag

SEQ ID NO: 111839 - DNA, 1083 bp, Artificial Sequence
  Description of Artificial Sequence: Synthetic coding sequence
atgctgagcacgtcccggagtcggtttataagaaataccaatgaaagcggggaggaagttaccacattttttgactatgactatggcgcaccctgccacaaatttgatgtcaaacagataggggctcaattactgccccctctctacagcctcgtgttcatctttgggtttgtcggaaacatgttagtggttctcatcctcattaactgtaagaaactcaagtgtctgaccgacatttatcttctgaatctcgcaatctccgatctactcttcctgattactctacctttgtgggctcatagcgccgcaaatgagtgggtgttcggtaacgccatgtgtaagcttttcacaggcctgtaccatattggctatttcggcggcatctttttcataattttgctgacaattgaccggtatttagcgattgtgcacgctgtgtttgctctaaaggcccggacagtgacattcggagtggtgacatcggtcataacatggctagtcgccgtgtttgcgagtgtacctggcattatcttcaccaagtgtcagaaagaagattctgtctacgtttgcggaccgtatttccctagaggttggaataactttcataccatcatgagaaatatcctgggcttggtgcttccattgttgatcatggtgatttgctactccggcatcctgaaaacactcttaaggtgtagaaatgagaaaaagcgacacagagctgttagggtaatattcaccatcatgatcgtgtattttctattttggactccttacaatatcgtcattctgctgaacaccttccaagagttcttcggcttgagcaactgtgagagcacctcacaattagaccaggcaacgcaggtgactgagacacttggaatgacacactgctgtattaatccgataatctatgcgttcgtgggcgagaagtttcgcaggtatctgagcgttttcttcaggaagcatatcaccaaaagattttgcaagcagtgtcctgtcttctatcgggagactgtagacggtgtaacctcaactaacaccccttcaacaggagagcaggaggtgagcgctggattgtag

SEQ ID NO: 111840 - DNA, 1068 bp, Artificial Sequence
  Description of Artificial Sequence: Synthetic coding sequence
atgacgaccagcctggatacagtggaaaccttcggaacaacctcttattacgatgatgtgggcttgctttgcgaaaaggccgatactcgagccctcatggcccagttcgttccacctctctatagcctggtgttcactgtcggactcttaggcaatgtcgtggttgtgatgattctcataaagtatcggcggctgaggattatgacaaatatctacctgctgaatctagctatctcggacttgttatttctggtcactttacccttttggattcactacgtccgggggcacaattgggtgttcgggcatggaatgtgcaaattgctgtccggattctatcacactggcctctactcagagatcttcttcataatcttgctcacaatcgatcggtatcttgccattgttcacgccgtgtttgccttgagggctagaacagtaacattcggcgtcatcacatcaatagtgacctggggcttggcggtgttggccgcactgccagagttcatcttctatgagacagaagagctgttcgaggagaccctttgctctgccttgtatcccgaggacacagtgtactcttggaggcattttcatacgctccgtatgaccatcttctgcctcgtgctccctcttctggtaatggccatctgctacacaggaattattaaaactcttcttcgctgtccatcaaagaaaaaatacaaagccattaggttgatttttgtcataatggctgtattctttatcttctggacaccatataacgttgccattctactgtcttcatatcagtctatattgttcggaaacgactgtgaacgttctaagcacctggacttggtgatgctggtgacagaagttatcgcctattcccattgttgcatgaatcctgtgatctatgcatttgtgggcgaaaggtttcgtaaatacctgcgccacttctttcatcgccacctccttatgcacctgggcagatacataccatttctcccttccgaaaagctggagcgtacgagtagcgtgtcgccttccaccgcagagcccgagctgtctatcgttttctag

SEQ ID NO: 111841 - DNA, 1068 bp, Artificial Sequence
  Description of Artificial Sequence: Synthetic coding sequence
atgaccaccagtctggataccgtagaaaccttcggtactacaagctattacgatgacgttggactcctctgtgagaaggccgacacccgagctcttatggcacagtttgttcctccgctttattcactcgtcttcacagtggggctgttagggaacgtggttgttgtgatgatccttatcaagtacaggaggttacgtatcatgaccaacatatatctcctgaacctcgcgatctcagatttgctcttcctcgtgactctgcccttctggatacactatgttagaggacataactgggtgttcggccacggaatgtgcaaactgctgtctgggttttaccacactggactgtacagcgaaattttcttcatcatcctgctgaccattgaccgctacctggccatcgtgcatgccgtgttcgctctgcgggccagaaccgtgaccttcggggtgatcacaagcatcgttacatggggcttggctgtgttggcggcacttcccgaatttatcttctatgaaacagaggaattgtttgaagaaaccctgtgcagcgccctctaccccgaggatactgtctatagttggaggcactttcacactctgagaatgactattttctgtctggtgcttccactcttggtgatggctatatgctatactgggattatcaaaaccctgctgagatgtccatccaaaaagaaatacaaagccatccgtctgattttcgttatcatggcagtgttttttatattctggactccgtataatgtggcgatactgctaagtagctaccaatccattttatttggcaacgactgcgagagatctaagcacctggatctggtgatgcttgtgacagaagtgattgcttacagccactgttgcatgaatcccgttatctatgctttcgtcggcgaaagatttcggaagtacctcagacattttttccatagacacctgctgatgcacctaggcagatatattccgttcctgccctcagaaaaactggaacggacaagcagtgtttctccctctactgcggagcccgagcttagcatcgtattttag

SEQ ID NO: 111842 - DNA, 1068 bp, Artificial Sequence
  Description of Artificial Sequence: Synthetic coding sequence
atgactacgagtttagacacggtcgaaacattcggaactaccagctactacgatgacgtaggcctgctctgcgagaaggccgacactcgagccttaatggcacagtttgtgccccctctttattcactggtgtttactgttgggcttctgggcaacgtggtggttgtgatgattcttattaagtaccggcgcctccgcattatgacgaatatttacctgttgaaccttgccatctcggacctgctgttcctggtcacgctcccattctggatccattacgttaggggccataattgggtctttggacacggcatgtgcaaactcttatcaggcttttatcatacggggctgtactccgaaattttcttcattatcctgcttacaatagatagatatctagccattgtacatgcagtattcgccctgcgcgcccgaaccgtcacattcggagttatcacctccattgtgacttggggtttagccgtgctcgctgccctccctgagttcatcttctacgagacggaagaactctttgaggaaaccttgtgttcagccttgtaccctgaggacactgtttactcatggcggcatttccacaccctccggatgacaatattttgcctggtcctgccccttctggtcatggccatttgttataccgggattataaaaacactcctcagatgcccttccaagaagaagtataaggcgatccgacttatcttcgtaatcatggccgtcttttttatattttggacaccctacaacgtcgccatccttctgagctcgtaccagagcatcctgtttgggaacgattgcgagcggtcaaaacatctggacctggtcatgctggtaaccgaggtgatcgcttactcccactgctgcatgaatcccgttatatatgcctttgtaggagaaagatttcgcaaatatctgcgccacttctttcacagacacctactcatgcatctgggccggtacatcccgttcctaccatccgaaaagttagaaagaaccagttcagtgtccccttcaaccgcggaacccgaattgtcgattgtgttctag

SEQ ID NO: 111843 - DNA, 243 bp, Artificial Sequence
  Description of Artificial Sequence: Synthetic coding sequence
atgactacaagcttggatacagtggagacattcggaacgacctcttattacgacgatgtagggctgctttgcgagaaggctgatacacgcgctctcatggctcagttcgtgccacccctgtattcgctcgtgttcaccgttgggctcttgggaaatgtggtggttgttatgatcctgatcaagtatcgaaggctccgtatcatgactaatatctatctgctcaaccttgcaatctccgactag

SEQ ID NO: 111844 - DNA, 66 bp, Artificial Sequence
  Description of Artificial Sequence: Synthetic coding sequence
atgaccacaagcttggatacagtggaaacgttcggcactacaagctactacgacgacgtcggctag

SEQ ID NO: 111845 - DNA, 1068 bp, Artificial Sequence
  Description of Artificial Sequence: Synthetic coding sequence
atgacaacctcccttgacactgtggagacattcggtaccactagctattatgacgatgtcggcctgctctgcgaaaaggccgacacaagagccctcatggcccagtttgtgcctcccctttattctctggtgttcactgtgggcttgctggggaacgtggttgtagtaatgatattgatcaaataccgccggcttcgtattatgacaaacatataccttcttaacctggccataagtgacctcttgtttttggtgaccttacctttctggattcactatgtgaggggacacaactgggtctttgggcatggaatgtgcaaactgctgtctgggttttatcatacaggactctattccgaaatctttttcattattctcttgaccatcgacagatatctggccatcgttcatgctgtctttgccctaagggctagaacagtgaccttcggagtcatcacaagtattgttacctggggcttggccgtattggccgcacttcctgagtttatcttttatgaaactgaggagttgttcgaagaaaccctttgctctgcactgtaccctgaagacacagtatacagctggaggcacttccacactctgaggatgaccatcttttgtctggtactgcctttgctggtgatggctatctgctatacgggtatcattaaaaccttactccgctgtccctctaaaaagaagtacaaagctattcgcttgatcttcgtcatcatggctgtgttctttatattctggacaccctacaacgtcgccattctactcagctcttaccagtccatcttattcggtaatgattgtgagaggtctaagcacttggatctggtcatgcttgttacagaggtgatagcatactcgcactgttgcatgaatcccgtgatctatgcctttgtgggagagagatttcgaaagtatctgaggcacttcttccaccggcacttactaatgcacctggggcgctatattccttttctcccctctgagaagctcgagcgcacaagcagtgtgagcccttctacggctgaacccgaactttccattgtgttctag

SEQ ID NO: 111846 - DNA, 1131 bp, Artificial Sequence
  Description of Artificial Sequence: Synthetic coding sequence
atgccgtttgggatcaggatgttgttgcgggcccataaacccggatcctcccgacgaagtgagatgactacatctctggacaccgtcgaaaccttcggcactaccagctactacgacgacgtcggcctgctgtgcgaaaaggctgacacacgagccctgatggcccagttcgtacccccactgtatagcctcgtatttacagtagggctcctggggaacgtggttgtggtgatgattctcattaaatatcgacgcctgcgaattatgaccaacatttacctgcttaacctcgcgatctctgaccttctctttttggtgacactgccattttggattcattacgtgagaggacataactgggtattcgggcacggcatgtgcaagctcctgagtggattttatcacactggcttgtactcagagatattttttataatcctcttgactattgaccgctacctggctattgtccacgccgtatttgccctgcgggctcgcaccgtcaccttcggagtaatcacctccattgttacctggggcttggcagttctggctgctttgccagaatttatcttttacgaaacagaggagctgtttgaagaaacactgtgctcggccttgtatccggaagacacagtgtactcctggcgtcacttccataccctcaggatgactatcttctgtctagtcctccctttgctggtgatggcaatttgctacacagggattattaaaacgctcctcaggtgtccttccaaaaagaagtacaaggcaatcagactgatctttgtgataatggccgtgttttttatcttctggactccatataacgttgctatcctgctctcatcctaccagagtatcctctttggcaatgattgcgaaaggtccaagcatctggacttggttatgcttgtgacagaggtgattgcctactctcactgttgcatgaatccagtgatctatgccttcgtgggtgagagattcagaaaatacctcaggcatttctttcaccggcacctgttaatgcatctgggtcggtacatccccttcctgccgagtgagaaacttgagaggacgtcgtctgtgtctccaagcactgctgagccagaactgtctatcgtgttctag

SEQ ID NO: 111847 - DNA, 1083 bp, Artificial Sequence
  Description of Artificial Sequence: Synthetic coding sequence
atgaatcccacagacattgccgatacgaccctcgatgagtcaatttattctaactactacctatatgagagcattcccaagccatgcacgaaagaggggatcaaagcatttggcgagctgttcctgcccccattgtattctctggttttcgtttttggactgctcggaaatagcgtagtagttttggtgctctttaaatataaacgcttacggagcatgactgatgtgtatctgctgaaccttgcaattagtgaccttctttttgttttcagcctccccttttggggctactatgctgccgatcagtgggtctttggcttgggtctgtgtaagatgattagttggatgtacttggtggggttctacagcgggattttttttgttatgctgatgtcaattgacagatacttagcgatcgtgcacgcagttttcagtcttcgcgcacgcacactgacgtacggggtaatcacttccctggccacttggtcagtagccgtattcgccagcctgcctggattcctgttctccacctgttacacggagcgtaatcatacctattgtaagaccaaatattctctgaattccactacctggaaagttctctcaagccttgaaataaacatcctgggactggtcatcccactcggcatcatgctcttctgctactccatgattattcggactttgcaacactgtaagaacgagaaaaagaacaaggcagtaaagatgatatttgctgtcgttgtcttattcctgggattttggactccctacaatatcgtgctgttcctggagacactcgtcgaactggaggtgttacaggactgcacatttgaaaggtacctggactacgctatccaggcaaccgaaaccctcgcttttgtgcactgctgtctaaatccaatcatctactttttcctcggggaaaaatttagaaaatatatcctgcagttgttcaagacttgtcgggggctctttgtgctgtgtcagtactgtggtctgctacagatatacagtgctgataccccctcttcctcatatacacagtcaaccatggaccatgacctgcacgacgctctctag

SEQ ID NO: 111848 - DNA, 1059 bp, Artificial Sequence
  Description of Artificial Sequence: Synthetic coding sequence
atggactaccaggttagcagtcccatatacgacatcaactattatacctcagaaccctgtcagaaaattaatgtgaagcagattgctgcgcggctcctccctcctctgtattctcttgttttcattttcggatttgtagggaacatgctcgtcatccttattctaattaactgcaaacgcctgaagtctatgaccgacatctatctgctaaacctggccatttcagacctgtttttcctgttgactgtgccattctgggcccactacgcagctgcacagtgggattttggcaatacaatgtgtcagctcctgacggggctgtattttatcggctttttttccggcatcttttttatcatcctattgacgatagatcgatacctcgctgtcgttcacgctgtgtttgctctgaaggccagaaccgtaacattcggcgtggtcacgagtgtaattacatgggttgtggcggtgtttgctagcctgcccggcatcattttcactaggagccaaaaggagggtcttcactatacttgtagcagtcactttccttacagccagtatcaattttggaagaattttcagaccctgaaaatagtcattctggggctggttctacctctgctggtgatggtgatatgttattccggcatcctcaaaacgctgctgaggtgtagaaacgagaaaaaaagacaccgggctgtcagactgatctttacaatcatgatagtatatttcctcttttgggccccgtataatatcgtgctgttgttaaacacctttcaggagttctttggcctcaataactgcagcagctccaatcgtctagaccaggccatgcaggttaccgaaactctgggaatgacgcactgctgcattaatccaattatatacgcgtttgttggagaaaagtttaggaattacctgcttgtgttctttcagaagcacatcgccaagcgtttttgcaagtgctgcagcatatttcagcaggaggcccccgaaagggcctccagtgtctacactaggagcaccggtgaacaggagatcagcgtgggtctgtag

SEQ ID NO: 111849 - DNA, 1059 bp, Artificial Sequence
  Description of Artificial Sequence: Synthetic coding sequence
atggactatcaggtctcatctccaatctacgacattaactattacacgtcagagccctgccaaaaaatcaatgttaagcagatcgccgcgaggttgctgcctcccctgtactccctggtgtttatctttggcttcgtgggtaatatgctagtgatactgattctgataaactgcaagcgccttaagagcatgacagacatttatttgctgaacttagctatatccgatctctttttccttctaaccgtgcccttttgggctcattacgccgcggcccagtgggacttcggaaacacaatgtgccaactgttaaccggcttgtactttattggatttttttctgggatcttcttcatcatactcctcaccatagatcgatatctggccgtcgtacatgcagtcttcgccctcaaggcccgtactgtaacgtttggagtcgtgacgagtgtgataacctgggtagtagccgtttttgcgagcctgcctggaatcatctttactcggagccagaaggagggactgcactacacctgtagcagccacttcccatacagccagtaccaattctggaaaaactttcaaaccttgaaaattgtgatccttggactcgtgttgcctctgttggtgatggttatttgttacagtggcatcctgaagacccttctgagatgtcgaaatgaaaaaaaacgccaccgtgctgttcgtttgatattcaccatcatgatagtatactttctgttttgggctccatacaacattgtgctgttgctgaacaccttccaggagttctttggtctaaataactgcagctccagtaaccgactcgatcaggcaatgcaggtgaccgagacactggggatgacgcactgttgtatcaacccaatcatttatgccttcgtgggagaaaagtttcggaactacttacttgtttttttccaaaaacatattgcgaaacgtttttgcaaatgttgttctatcttccagcaggaggcccccgaacgggcttcaagcgtctatactcgctcaactggcgaacaggagatcagcgtaggattgtag

SEQ ID NO: 111850 - DNA, 999 bp, Artificial Sequence
  Description of Artificial Sequence: Synthetic coding sequence
ctgcctaagaatcagtgtgaggccaacagaagccctcccccggctagcgcactgctcaccggcgtacacctgtggttttgcaacatgttagttattctgatccttattaactgcaagaggcttaaatcgatgactgacatatatctgttgaatcttgcaatcagcgatctgttcttcttactgaccgtccctttttgggcacattacgcagccgcccagtgggactttggcaacacaatgtgtcagctgctaaccggactgtattttataggattctttagtgggatcttcttcattatcctcctcaccattgataggtatctggccgtggtgcacgccgttttcgccttgaaggcccgcacagtcactttcggggtagtaacgtctgtgatcacttgggttgttgcagtgtttgccagtctcccaggcattatctttactagaagtcaaaaagagggccttcattatacttgcagctcacatttcccctattctcagtaccagttctggaaaaactttcagaccttgaagattgtgatcctgggactagtgctgcctctgctcgttatggttatatgttattccggcatcctgaaaactctcctacgatgccggaatgaaaagaagcgccatcgggcagtccggctgatcttcaccatcatgatcgtgtacttcttgttctgggctccttacaacatcgtgctcttactcaatacattccaagagttcttcgggctcaacaattgctcttctagtaacaggctggatcaggccatgcaggtcacagagactttgggaatgacccactgttgtatcaatccaatcatttatgcctttgttggagaaaagttccggaactacctgctggtgttctttcagaaacatatcgcaaagcgcttttgcaaatgttgctctatcttccaacaggaggctccagagagagcgagttcagtttacacgcgtagtacgggtgagcaggaaatcagtgttggactgtag

SEQ ID NO: 111851 - DNA, 1059 bp, Artificial Sequence
  Description of Artificial Sequence: Synthetic coding sequence
atggattaccaagtgagctctccgatttacgatatcaattattacacaagcgagccctgccagaaaatcaatgtgaagcagattgctgctcgtctgctcccccccctttactctctggtttttatatttgggtttgtgggcaatatgctggtgatccttatactgataaattgcaaacgactgaaaagtatgactgacatctatctgttgaacctcgctattagcgatctgtttttcctgcttacagtcccattttgggcccactacgccgccgctcagtgggattttggcaacactatgtgtcagctgctgacaggcctttactttattggattcttttccgggatcttcttcattattctcctcacaatagacagatacttagcggtagttcatgctgtgttcgcgttgaaagctcgcacagttacatttggcgtggtcacctccgttataacctgggttgtcgccgttttcgcaagtttgccaggtattatctttacgaggagtcagaaggaagggctccactacacttgtagctctcacttcccatactctcagtaccagttctggaagaactttcaaaccctcaagattgtgattttgggacttgtgttgcccctacttgttatggtgatctgctactctggcatcctaaagactctcctcagatgccggaatgagaaaaagaggcatagggctgtgcgactcatttttacgatcatgatcgtctactttctcttctgggccccctataatatagttcttttactgaacacgtttcaagagttctttggtctgaacaattgcagctcttctaatcgcctcgatcaggcaatgcaggtaacagaaacattggggatgacacattgttgcatcaatcctataatctacgccttcgtgggggagaagttcagaaactatttgttggtgttctttcagaagcacatcgctaagaggttctgtaagtgctgtagcatctttcagcaagaagcacctgagagggccagttcagtgtacacacggtcgacaggtgagcaggagattagtgtaggcttgtag

SEQ ID NO: 111852 - DNA, 1125 bp, Artificial Sequence
  Description of Artificial Sequence: Synthetic coding sequence
atgagcggagaaagtatgaacttttctgacgttttcgactctagcgaagattacttcgtcagcgtgaataccagttattactcagtggacagcgaaatgttgctgtgcagtctccaagaggtgagacagtttagccggttgtttgtccccattgcatactcactcatctgtgtttttgggttactgggcaatatcttggttgtcataacctttgccttctataagaaagcccgttcaatgaccgacgtgtatctgctgaatatggctatcgctgatattctttttgtactcaccctgcctttctgggcagtttcccacgctaccggcgcgtgggtgttctctaacgccacctgtaagctgctgaagggcatttacgccattaattttaactgtggcatgttacttctgacctgcatctcaatggaccgctatatcgcaattgtgcaggctactaaaagcttccgcctgaggagtagaactctcccacgtagtaagattatctgtttggtggtctggggcctgtccgtgatcatatcttcctccactttcgtgttcaatcagaagtacaacactcagggatccgatgtgtgtgaaccgaagtatcaaaccgtcagcgagcccatccgatggaagctgttaatgcttggactcgagttactattcggattttttatccctctgatgttcatgatattttgctacactttcatcgtgaaaacacttgtgcaggctcaaaatagcaagcggcacaaagccattcgtgtaattatcgctgtggtcctcgttttcttggcttgccagattccgcacaacatggtgctgctagtgaccgcagccaatctaggcaagatgaatcggagctgccagtcagagaagctcattggttacactaaaaccgttaccgaggtccttgcttttttgcactgctgcctgaatcccgtcctgtatgcttttatcgggcagaaattccgcaactatttcctaaagattctgaaagatctctggtgcgtgagaagaaagtacaagtcatcaggcttcagctgtgccgggcgatattccgagaatatcagccgccagaccagtgagacagcagataatgataatgcaagcagtttcacgatgtag

SEQ ID NO: 111853 - DNA, 1125 bp, Artificial Sequence
  Description of Artificial Sequence: Synthetic coding sequence
atgagtggagagtccatgaacttttccgacgttttcgactcatctgaggattacttcgtgtctgttaacacgagttactacagcgttgactcagaaatgcttttgtgctcactccaggaggttagacagttttcacgactgtttgttcctatagcctattccctgatttgcgtgttcggactgctgggcaacatactggtggtgatcactttcgccttttataagaaagctcgcagcatgaccgacgtgtatctcctgaatatggcaatcgcagacatcctgttcgttctgaccctgcccttctgggccgtgagtcatgccaccggtgcatgggtgttctccaacgctacatgtaaactgctcaaagggatttacgctatcaatttcaactgtgggatgctgctgttaacgtgtatctccatggaccgatacattgccatagtgcaggcgacaaaaagtttccgcctgcgctctagaactctcccccgaagcaaaataatctgtctggtcgtctgggggctctccgtgattatttcaagtagcacgtttgtcttcaaccagaagtataacacccagggctctgatgtgtgtgaacctaagtaccaaaccgtgtctgaaccaatccgatggaaactgctcatgctgggcctggaattgctgttcggctttttcatcccactaatgttcatgatcttctgctacacttttattgtcaaaacccttgtgcaggcacaaaactctaaaaggcacaaggccatccgggtcatcatcgcagtggtcctcgtgttccttgcatgccagattcctcacaatatggttctgctggtaacggccgctaatctaggcaagatgaataggagctgtcaatcggaaaagctaattgggtacacgaaaacggtgacagaagtgttagccttcctccactgttgcctgaatcccgtgctgtacgcctttatcgggcaaaaattccgtaattattttctgaagattctaaaagacctctggtgtgtacgcaggaagtacaagagtagtggtttctcttgtgcagggcgctatagcgagaacatctcccgtcaaacgtcggaaactgcggataatgataacgcgtcctctttcactatgtag

SEQ ID NO: 111854 - DNA, 1125 bp, Artificial Sequence
  Description of Artificial Sequence: Synthetic coding sequence
atgtcaggagagtcaatgaactttagcgatgtatttgactcctcagaagactacttcgtttccgtcaacacgtcatattacagcgtcgatagcgaaatgctgctgtgttctctgcaggaggtaagacagttctcccgacttttcgtcccaattgcttacagcctgatctgtgtattcggcctactcggcaacatcttggtggtcattaccttcgctttttacaaaaaagccagatcaatgacggacgtctacttactcaacatggccatcgccgacatactgttcgtcttaaccctccctttctgggccgtgtcgcacgcaacaggagcatgggtctttagcaatgctacctgtaaattattgaaaggtatctacgccatcaattttaattgtggtatgcttcttctgacctgcatttcaatggaccgctacatcgccatcgtgcaagccacaaaatcctttcgactcagatctcgcactctgccccgtagcaaaattatttgtctagtagtttggggtctgtctgtgatcatctcttcttctacatttgttttcaatcagaaatacaatacccagggatcagacgtgtgtgaacccaaataccagaccgtcagcgaacccatacggtggaagttactgatgctgggcctggagcttctttttggtttcttcatccctcttatgtttatgattttttgttacacttttattgtcaagacgttggttcaggcacagaacagtaagaggcacaaagctattagggtgattattgctgttgtgctcgtgtttttggcatgccagatcccccacaacatggttctactggtcacagccgccaacctcggcaagatgaaccggtcctgccagagtgaaaaattgatcggctacacaaagacagtgaccgaagtactggcctttcttcattgctgtctcaacccagttctctacgcgtttatcgggcagaaatttcgaaattactttctgaagatcttgaaagatctctggtgtgtgagaagaaaatacaagtcatctggcttttcctgcgcaggccgctactcggagaacatctctaggcaaacttccgagacagccgataatgataatgcatcttctttcactatgtag

SEQ ID NO: 111855 - DNA, 1137 bp, Artificial Sequence
  Description of Artificial Sequence: Synthetic coding sequence
atggacctcggcaaaccaatgaaaagtgtgctcgtggtggcgctattggtgatctttcaggtgtgtctgtgtcaggatgaagtgaccgacgattatataggtgacaataccaccgtcgactacaccctgtttgaatcactctgcagtaaaaaggatgtgcggaactttaaggcctggttccttcctattatgtatagcatcatctgctttgtggggctcttaggcaatggcctggtggttttaacttatatctacttcaaaagattgaaaactatgacagacacatacctgctcaacctggctgtggccgacattttattcctccttaccctacctttctgggcctatagcgccgctaaatcttgggtgttcggggttcacttttgcaaattaatcttcgccatttataaaatgtcttttttctccggaatgctactcctgctgtgcatcagcattgatcgttatgttgctatagttcaagccgtctccgcccatcgccaccgagctcgcgtccttttaatctccaaattatcatgtgtgggaatttggattctggcgaccgtgctatctattccggaactgctttattccgaccttcagcggtcgagctctgagcaggctatgcgctgctccctgatcacagagcatgtagaagcttttatcacaattcaggttgcccagatggttattggttttctggtgcccttgctcgctatgtcattttgctacctggttatcatcaggaccctgcttcaagctcgaaatttcgagcgtaacaaggccatcaaagtaatcattgccgtcgtcgtcgtgttcatcgtatttcagttgccttacaacggagtggtgctggcccagaccgttgccaactttaatataacttcctctacatgcgaattgagcaaacaactgaacattgcttacgacgttacttattcactagcgtgtgtacggtgctgcgtcaatccatttctgtacgcctttatcggcgttaaatttaggaatgacctctttaaacttttcaaggaccttggctgtctgtcacaagaacagctgcggcagtggtcaagttgtcgacatatccggcgctcatctatgagtgtcgaagccgaaaccaccaccactttctcaccctag

SEQ ID NO: 111856 - DNA, 1068 bp, Artificial Sequence
  Description of Artificial Sequence: Synthetic coding sequence
atggattacacgctggatctgtctgtcacaacggtaacagactactactatcctgacatcttttcttctccctgcgatgcggagttgatccagactaacggcaaactgttgcttgccgtgttttactgcctcttatttgtgttttcgctccttgggaactccctggtgatattagtgttagtggtatgtaagaaactgcgatccattaccgacgtgtacttattaaaccttgctctgagtgatcttctcttcgtcttttctttcccttttcagacctactacttgctcgatcagtgggtctttggcacagtgatgtgtaaggtggtctcaggtttttactatatcgggttttatagttcaatgttttttatcaccttgatgagtgtcgaccggtatctcgctgtggtccatgcggtctacgcgctaaaggtcaggactatacggatgggcacaacactgtgcttggctgtgtggctgaccgccattatggcaaccattcccctgctcgtcttttatcaggtcgccagcgaggacggtgtactccaatgttactcgttttataaccaacagaccttaaaatggaagatcttcaccaactttaagatgaatatcctcggtctgctgattcccttcactattttcatgttttgttatattaagatactccatcagttaaagcgatgtcagaaccataacaagaccaaagcaattcgactggtcttaattgtggttatagcatcccttttgttctgggttccgttcaatgttgtgctgttcttgactagcctgcatagtatgcacatcttggacggatgttccatttcacagcagctcacgtatgcgactcatgtcacggaaattatttcctttacacattgttgcgtcaatcccgtcatctatgccttcgtcggcgagaaattcaagaagcatctgtctgagatctttcagaaatcctgctcacagatctttaattacctcggccgccagatgccccgtgagagttgtgaaaagagcagttcatgccagcagcattcgtcaagatctagctcagtagattacattctttag

SEQ ID NO: 111857 - DNA, 819 bp, Artificial Sequence
  Description of Artificial Sequence: Synthetic coding sequence
atgaggaacttattcagacaaatgacgtattacctgcttgatcagtgggttttcggcacagtgatgtgtaaagtagtgtcgggattttactatatagggttctatagcagcatgttcttcattactctaatgtctgtcgaccgctatctggccgtcgtgcacgccgtatacgctctgaaggtgcgtaccatccgaatgggaactactctgtgtctcgccgtgtggctgaccgccataatggctaccatccctttgctagtgttttaccaagtcgctagcgaagacggcgtcttgcagtgctactccttttacaaccagcagaccctcaagtggaaaatcttcaccaactttaagatgaatatcttagggctgttgatcccgttcaccattttcatgttttgttacataaagatcttacaccaactgaagaggtgtcagaaccataataaaacaaaagccatccggctggtactaatagtagtgatcgcctctctgttgttttgggtaccttttaatgtggtgctgtttctcacaagtctgcactccatgcatatcctcgatggatgtagtatatctcaacagctgacgtacgccacccacgtaactgagattatttccttcactcattgctgcgttaatcccgtcatctacgcgttcgtaggcgaaaaattcaagaagcacttatctgaaatctttcaaaaatcttgctctcagattttcaactacctcgggcgtcaaatgccacgcgagagttgtgaaaaatcttctagctgccaacagcattcctctagatcttcaagtgtggactacatcctctag

SEQ ID NO: 111858 - DNA, 1074 bp, Artificial Sequence
  Description of Artificial Sequence: Synthetic coding sequence
atggcagacgactatggatcggaatccacctccagcatggaggattacgtgaacttcaacttcactgatttttattgtgagaaaaacaatgtgagacaatttgcctctcacttcctgcctccactctattggctcgtgtttattgtgggagcgctgggaaactctctggtgattctcgtgtattggtattgtactcgggtgaagaccatgaccgacatgtttctattgaatttggctattgctgatttgcttttcttggttaccctgcccttttgggcaatcgccgccgctgatcaatggaagttccagacctttatgtgcaaggtggtgaatagtatgtacaaaatgaacttctatagttgtgttctgcttatcatgtgcatctccgtggatcgatatattgctattgcccaggccatgagggcccatacctggcgggaaaaacggttactatactcaaaaatggtatgcttcaccatctgggtcctggcggcagccttgtgcatccctgagatcctctacagccagatcaaagaagaatctgggatcgcaatttgtacaatggtataccccagcgatgagtccaccaaacttaagtctgcggtactgacccttaaggttatcctgggattctttctgcccttcgtcgtaatggcttgttgttatacaattataattcacactcttattcaggcaaagaagagcagcaaacataaagctcttaaggtaacgattacagttctcacagtgtttgtgctgtcacagttcccatacaattgcatcctactggtccaaactatcgacgcttacgcaatgtttatttccaactgcgccgtaagcactaacatcgacatctgtttccaggtgacgcagacaattgcattctttcattcatgcctgaaccccgtcctatacgttttcgtgggtgagcgcttccggcgagacctggtgaagaccctcaaaaaccttggatgcatcagccaagctcagtgggtaagctttacccggcgtgaggggagtctgaaactgagctcaatgctgttagagaccacttccggcgctctgtctttatag

SEQ ID NO: 111859 - DNA, 1110 bp, Artificial Sequence
  Description of Artificial Sequence: Synthetic coding sequence
atgactccgaccgattttacaagtccaattcctaacatggccgacgattatggctccgaatcaaccagctctatggaggattacgtaaacttcaacttcaccgatttttactgtgagaaaaataatgtgagacagttcgctagccactttttaccaccattatattggttggtcttcatagtaggagcgctgggaaatagtcttgttattctcgtgtactggtactgcacaagggtgaagacaatgacagacatgtttctgttgaacctcgctatcgccgacttattattcttggtgaccctcccattctgggcgattgccgccgcagaccagtggaaattccaaacttttatgtgtaaagtcgtgaacagcatgtataagatgaacttttactcatgcgtgctgctgattatgtgcatttcagtggatcgatacattgccattgcacaggccatgagggcccacacctggcgcgagaagcggctgctgtacagtaaaatggtctgttttaccatttgggtactcgccgctgccttatgtatcccagagattctctattcccagattaaggaggagagtgggatcgcgatctgcacaatggtctatccgtcggatgagagcacaaaactaaagagcgctgtattgaccctgaaagtcattctgggctttttcttgccctttgtggtgatggcctgttgttacacgattataatccataccctgattcaggcgaagaaaagctccaaacacaaggccctgaaggtaacgatcaccgtgttaactgtttttgtcctcagtcagttcccttataactgcatcctcctggtgcagactattgacgcatacgccatgttcatttccaattgtgcagtctctaccaacatcgacatatgcttccaggtaacccaaacgatcgcattcttccactcttgcctcaacccagtgttatatgtgtttgtcggcgaacggttcagaagagatttggtgaaaaccctcaagaatctaggctgcatctcacaagcgcagtgggtgtcattcacccggcgagagggctctctgaaactttcaagtatgctccttgaaacgacatccggggctctctccctttag

SEQ ID NO: 111860 - DNA, 1074 bp, Artificial Sequence
  Description of Artificial Sequence: Synthetic coding sequence
atggccgatgactacggttcggagtcgacatcctctatggaggactatgtgaattttaatttcaccgatttctactgcgaaaagaacaatgtcagacagttcgcctcccactttctcccccccttatactggctcgtctttatcgtgggggccctcggcaacagtcttgtgattctggtgtactggtattgtacccgcgtaaaaactatgactgatatgtttcttttaaacctggctattgccgacctcctgttcctggtgacactccctttttgggctatcgccgctgctgatcagtggaaatttcaaacgtttatgtgcaaagttgttaactccatgtacaaaatgaacttttattcttgtgtgctcctcataatgtgtatttctgttgacagatatattgctattgcccaggcgatgcgggctcacacgtggcgcgagaaaaggctgctgtactccaagatggtgtgttttaccatctgggtccttgcagcggccttgtgtatccccgaaatcctctattcacagattaaagaagaaagtggtatcgccatttgcaccatggtgtatcccagcgatgagagcaccaaactgaagtccgcggttttaactctcaaggtgattctgggtttcttcctgccattcgtcgttatggcatgctgctatacaattatcatccacacactgatccaggcaaagaaaagctcgaagcacaaagcactcaaagttactataacagtgctgacagtgttcgtgctgagtcagtttccatacaactgcatcctactcgtccaaactattgatgcctatgctatgttcatatccaattgcgccgtcagcaccaacatcgacatatgcttccaggtcacgcaaacaattgccttttttcactcctgcctgaacccagtgctatatgtgtttgtgggcgaacgatttagaagagacctggtgaaaacactaaaaaatctaggctgcatctcacaggctcagtgggtcagtttcaccagacgagagggatccctgaagcttagctctatgctgctagagacaacttctggggccctgagcctgtag

SEQ ID NO: 111861 - DNA, 1053 bp, Artificial Sequence
  Description of Artificial Sequence: Synthetic coding sequence
atggccctggaacagaatcagagtactgattactactatgaagagaacgagatgaatggcacctacgattactctcaatatgagctcatctgcattaaggaggacgtgcgagagtttgctaaggtgtttctccccgtctttctcacaatcgtattcgtgatcggcctggcaggcaattctatggtggtagcaatttacgcctattacaaaaaacagcggacaaaaaccgatgtatacatcctcaatctcgcagtggccgatctgctactgttgtttactctgccattttgggcagtgaacgcagtgcacggttgggtgctagggaagatcatgtgtaagataacttcagctttatacacactgaatttcgtcagcggtatgcagtttctagcatgcattagcatcgatcgctacgtggcagtaaccaaggtgcccagtcagtccggagtcggcaagccatgttggataatatgtttctgcgtatggatggcggctattctgttgtctattcctcagctggtgttttataccgtcaacgacaatgcgaggtgtatccctatctttcccagatacctaggcaccagcatgaaggctctcatccagatgctggagatttgtattgggtttgttgtcccctttctgattatgggggtctgctatttcataaccgccagaacgctgatgaaaatgccaaatatcaagattagcagacccttgaaggtactgctgacagtggttatcgtgttcatcgtgacacagctcccatacaatatagtaaaattctgccgggctatcgacattatctattccctgattaccagttgtaatatgagcaagaggatggacattgccatacaagtaactgagtcaattgctttattccactcttgtctcaatccgatcttgtatgtgtttatgggtgcttccttcaagaattacgtgatgaaagttgcaaaaaaatatgggtcatggcgccgacaaagacagagcgtcgaagagttcccatttgattcggaggggccgactgaacctacctcaacgttcagcatctag

SEQ ID NO: 111862 - DNA, 825 bp, Artificial Sequence
  Description of Artificial Sequence: Synthetic coding sequence
atggccttggagcagaatcagagtaccgactactattacgaagagaatgagatgaacgggacttacgactatagccaatatgagctgatttgtatcaaggaagacgtgcgtgagttcgcaaaggtctttctgccggtgttcctaactatcgttttcgtgattggcctcgcaggtaactcaatggtggtcgcaatttacgcctactacaaaaaacaaaggaccaagacagacgtgtacatcctgaacctggccgtggctgacctgctgctgctgtttactctgcccttttgggccgttaacgctgtgcatggatgggtgctcggcaagattatgtgcaagatcacatccgccctgtacactttgaacttcgtgtctgggatgcagttcctggcctgcatatctattgacagatatgtggctgtgacaaaggttccgtcccaatctggcgtcggtaagccttgttggataatctgcttttgcgtatggatggctgctatactgctctctatccctcagctggtgttttacacggtgaatgacaatgctagatgtattccgattttcccacgttacctcggcacttcaatgaaggccctcatccagatgttggaaatttgcatcggtttcgtggtgccattcttgatcatgggcgtatgctattttattactgcacgcacactcatgaaaatgcctaacatcaaaatctcacgaccgctgaaagtgctcctgactgtggttatcgtgtttatcgtgactcagctcccatttgcttggatccacatgaatgacgcctttccgagtaacaagaccagcgcccttttctag

SEQ ID NO: 111863 - DNA, 1071 bp, Artificial Sequence
  Description of Artificial Sequence: Synthetic coding sequence
atgatctacactagatttctcaaaggaagccttaaaatggcgaattacaccctggctccagaggacgagtacgatgtgcttatcgaaggagagctggagagcgacgaggcggagcaatgtgataagtacgacgcccaggcattgtcggctcagctggttccgagcctttgttcagccgtcttcgttataggagtgctggataatcttctagtggtgctcattctcgtgaaatataaggggctgaagagagtagaaaatatttacctgttaaacctagcagtgagcaatctctgttttttgctaactctgccattctgggcgcatgctggaggcgatcccatgtgtaagatccttattgggttatattttgtggggctgtattctgagacctttttcaattgcctgctaacagtgcagcgctatctggtgtttctacacaaaggaaattttttctcagctagaaggagagtgccctgtgggatcatcaccagcgtgctggcgtgggttaccgccatcttggccaccctgcccgagttcgtcgtgtacaaacctcagatggaagaccagaagtataaatgcgccttcagcaggacaccctttttgcctgcggacgagaccttttggaagcacttccttaccctcaagatgaatatcagtgtgctcgtgctgccgctctttatcttcacatttctctatgttcagatgcggaagacccttagatttagggaacagcgttactccctgttcaaactggtgtttgcaatcatggtggtttttctgctgatgtgggctccctataatatcgccttctttctttcaacatttaaagagcacttctccttgagcgattgcaagtcaagctataatctcgacaaatccgtgcacattaccaagttgatcgccactactcattgttgtataaatcctcttctctacgcctttctggatgggactttctctaaatacctgtgccggtgcttccatctgagaagcaacacaccactgcagcctcggggtcagagcgcacaggggacatctcgagaggagcctgaccacagcacggaggtgtag

SEQ ID NO: 111864 - DNA, 1035 bp, Artificial Sequence
  Description of Artificial Sequence: Synthetic coding sequence
atggccaattatacgctcgctcctgaggatgaatatgatgtgctcatcgagggcgagcttgaatcagacgaggccgaacagtgcgacaagtatgacgctcaggctctgagtgctcaactcgtacctagcctgtgctctgcagtgtttgtcatcggagtgcttgataatctgctcgtggtgctcatactcgtgaaatacaaggggctgaagagagttgaaaatatatacttgttgaacctggcagtcagcaacctgtgcttcttattgactctgcccttctgggcacacgctggcggtgaccctatgtgcaaaatcttaattgggctttactttgtcggtttgtattctgagaccttttttaattgcctcctgactgtgcagagatacctggtatttctccacaaaggcaatttcttcagcgcccggagacgagtaccctgcgggatcatcaccagcgttttagcatgggttaccgcaatcctagcaactctgccagagtttgtggtctacaaaccacagatggaagatcaaaaatataaatgtgctttctcacgcacacctttcctgcccgcggatgaaacattctggaagcacttcctgacactcaagatgaacatcagcgttctggttctgccactcttcattttcaccttcctgtacgtccagatgaggaagaccctgagatttagagagcaacggtacagcttatttaaactagtttttgcaatcatggtggtcttcctacttatgtgggcaccttacaacatagctttctttctgtccacctttaaagaacacttctccctaagcgattgcaagtcctcatacaacctcgacaaaagcgtgcatataactaagctgatagcaaccacccattgctgcattaatccactgctgtacgccttcttggacggtactttcagcaagtacttgtgcagatgcttccacctccgtagtaacacccctctacagccgagaggtcaatcagcacaagggacatcccgagaggaacctgaccattccactgaagtctag

SEQ ID NO: 111865 - DNA, 1035 bp, Artificial Sequence
  Description of Artificial Sequence: Synthetic coding sequence
atggctaattacaccctggcgcccgaggacgagtacgacgttctcatcgaaggagaactggagtccgacgaggccgagcagtgtgacaagtacgacgcccaggcactgtcagcccagctcgttccttccctctgctccgccgtgtttgtaatcggggtgctagacaatcttctggtggttctgattctagtgaagtacaagggattgaagcgagtggaaaacatatacctgctgaatctcgccgtgtctaacctctgtttcctgctgactctgccattctgggctcacgcaggcggtgatcccatgtgtaaaattctgatcggtctttatttcgtggggttgtatagtgagacattctttaattgcttgcttaccgtgcagcggtatctcgtgtttctgcacaaggggaactttttcagcgcgagaagacgggtgccatgtggtatcattacgtccgttttggcttgggtgaccgcaatcttagcaactttaccagaattcgtggtatacaagccccagatggaagatcagaagtataaatgcgccttttccagaacacctttcttgccggccgatgagacgttttggaagcattttctcaccctgaagatgaatattagcgtgctggtgttgcccctgttcattttcacttttctgtacgtgcagatgcgaaagacactcaggttcagagagcagcggtatagtcttttcaagttagtgtttgcaatcatggtggtgtttctcttaatgtgggcaccgtacaacatcgcatttttccttagtacattcaaagaacatttcagcctttctgattgcaaatcctcatacaacctcgacaagtcagtgcacataacaaagcttatcgccactacccattgctgcataaatccactgctctatgcgttcctggatggtactttctctaagtacctctgcaggtgctttcatctgagaagcaacactcctcttcagccccgcggacagtcagcccaggggacaagcagagaagagcctgaccattctaccgaggtgtag

SEQ ID NO: 111866 - DNA, 1035 bp, Artificial Sequence
  Description of Artificial Sequence: Synthetic coding sequence
atggcaaattataccctggcccccgaggatgaatatgatgtgctcatagagggggagctagaaagtgacgaggccgagcagtgcgataagtatgacgcccaagcgctgagcgcccagttagtcccttccctttgcagcgcggtgttcgtaattggcgtactggacaacttgcttgtggtgctcattctagtgaaatacaagggcttaaagagagtggagaatatatacttgctgaacctagcagtctctaatctgtgctttctgctaacccttccattttgggcccacgcgggcggtgatcccatgtgcaaaatactgatcggcctatatttcgtcggactctatagcgagacatttttcaactgcctcctaaccgtccagcggtatctggtatttctgcataagggcaacttcttctcggcccgacgccgggtgccgtgcgggatcataacaagtgttctggcttgggtcaccgccattcttgctaccctccccgagttcgtagtctataaaccccagatggaagatcagaagtacaaatgtgctttcagtcgaactcccttcttgcccgccgacgaaaccttctggaaacatttcctcaccctgaagatgaatatcagtgtgctcgtcttgcccttatttatatttacctttttatatgtgcaaatgagaaagactcttagattccgtgagcagcgatatagcttatttaaactcgtgtttgccatcatggtggtcttcctgctcatgtgggccccatataacatcgcattttttcttagcaccttcaaagaacatttcagcctgtccgactgtaagagttcctacaatctggataaatccgtccacataaccaagcttatcgccaccacccactgctgcattaaccccctactttacgctttcctggacggaacattttccaaatatctatgcaggtgctttcacctcaggagcaacaccccactgcagcccagagggcaatctgcccagggtacaagccgggaagagcccgaccattcaactgaagtttag

SEQ ID NO: 111867 - DNA, 654 bp, Artificial Sequence
  Description of Artificial Sequence: Synthetic coding sequence
atggcgaactataccttggccccggaggatgagtacgacgtgctgatcgaaggggaacttgagtccgatgaggcagagcagtgcgacaaatacgatgcacaggcgctatctgctcaactggtcccatctctgtgctccgccgtattcgtaataggcgttctggacaatctgctcgtggtgctgattctcgtgaagtataaaggtctgaagcgggtcgaaaatatctacctgctgaacctcgcagtatcaaacctgtgctttcttcttactttaccgttctgggctcatgctggaggagaccccatgtgtaagatactgataggtctctatttcgtcggactgtattctgagacattctttaactgcctgctgactgtgcagcgctatctggtgttcctgcataaggggaacttctttagcgccagacgacgggtcccgtgcgggatcatcacaagtgtgcttgcatgggtgaccgcaatccttgccacattgccagagttcgtggtgtataaaccgcagatggaggaccagaagtataaatgcgcctttagccgtacgccatttctccctgctgacgagactttttggaaacactttctgaccttaaagatgaatataagcgtgcttgtgctgcctctcttcatctttacttag

SEQ ID NO: 111868 - DNA, 1194 bp, Artificial Sequence
  Description of Artificial Sequence: Synthetic coding sequence
atggccccaataagtctgagttggctgctgcggctggccactttctgccacttgaccgttctgctcgcgggtcagcatcatggtgtcaccaagtgcaatatcacatgttctaagatgacaagtaaaatccccgtggcacttctgatacattaccagcagaatcaagccagctgtggaaagcgtgccattatattagaaaccagacagcacaggctgttctgcgctgaccctaaagaacagtgggtcaaggatgccatgcagcatctcgatcgccaggccgccgccctgactaggaacggaggtacattcgagaagcagatcggcgaagttaagccccgaaccacaccagctgccggggggatggatgaaagtgtcgtcctggagccggaggctaccggtgagagcagcagccttgaacctacaccaagctcccaggaggcccaaagggctttgggaacatcaccagagctgccaacgggcgtgacaggtagcagcggcacgaggctacctcctacccctaaagcccaggacgggggccccgtggggacagaactcttccgggtgccgccggtctcaactgctgcgacctggcagagtagcgctcctcaccagcccggcccaagcctgtgggccgaggcaaagacatcggaggcgcctagcacacaggatcctagtacccaggctagcactgcttcttcacccgccccagaggagaatgccccctctgaggggcagagggtctgggggcagggccagagcccccgtcccgaaaattcgctcgagcgggaagaaatgggccccgtgccggcccatactgatgcattccaggattgggggcccgggagtatggctcacgtgagtgttgtgcctgtctccagtgaaggtactccttctagagagccggtagcaagcggatcctggacccccaaagcagaagagcctattcacgccaccatggaccctcagcggctgggtgtgcttatcacacccgtgccggacgctcaagccgccacacgccggcaggctgtagggcttcttgcattcctcggcttgctgttttgcctaggagtggctatgttcacctatcagtctctgcaagggtgcccacgcaagatggcaggcgaaatggctgaaggactacgctacattccaagatcctgtgggtcaaactcttacgtattggtgccagtatag

SEQ ID NO: 111869 - DNA, 1164 bp, Artificial Sequence
  Description of Artificial Sequence: Synthetic coding sequence
atgcgggaacccctggaggcattcaaactggccgatctggactttaggaaatcttctctggcctctggatggaggatggcaagcggtgccttcacaatggatcagttccccgagtctgtcactgagaactttgaatacgacgatctggccgaagcgtgctacatcggagacatcgtggtgtttggcacagtcttcctttcaatcttttattccgtgatattcgccatcggcctggtgggcaacctgctggtggtgtttgcattaactaactctaaaaagccaaagtctgttacagatatataccttcttaatttggccctgtctgaccttctcttcgttgccacgttgccattctggactcattatcttatcaacgagaagggcctgcataacgctatgtgcaagtttaccaccgcatttttttttatcggttttttcgggagtattttcttcataaccgtcatctcgatcgataggtatttagcgatcgtgctggcagccaattcaatgaataatcgcactgttcaacacggcgtgaccatttcgctgggcgtatgggcagccgccattttagtagccgcaccacagtttatgtttactaagcagaaagaaaacgagtgtctaggtgattatcccgaggtgctgcaggagatctggccggtccttcggaacgtggagactaattttctcggcttcctcctcccacttctaataatgagttattgttatttcaggataattcagacattattctcttgcaaaaaccacaagaaagctaaggcaataaaactgatcctcttggtagtgattgtattttttctgttctggaccccttacaatgttatgatctttctggaaaccttaaaactttatgacttctttccctcatgtgacatgcggaaagatctgcgattggcgctgtcagtcacagaaaccgtagctttttcgcattgctgcctgaacccactaatttacgcattcgccggcgagaagtttaggagatacctgtaccacttgtacggtaaatgcctcgctgtgctatgtgggaggagcgtgcacgtggattttagttcctccgagagccagagatctaggcatggatccgtactgtcctcgaacttcacgtatcatacgtcagatggggacgctctcctgctgttatag

SEQ ID NO: 111870 - DNA, 1068 bp, Artificial Sequence
  Description of Artificial Sequence: Synthetic coding sequence
atggatcagttccccgagtcagtcaccgagaacttcgagtacgatgacctggccgaggcttgctatattggagacatcgtcgtttttgggaccgtgttcttatctatattctactccgtgattttcgccattggcctagtgggcaacttgctcgttgtgtttgcgttgactaatagcaaaaaacccaaatccgtcacagacatatacctgttgaacttagctctctccgatctcctcttcgtcgccaccttgcctttctggactcactacttgatcaacgaaaaagggcttcataacgcaatgtgcaaattcaccactgcttttttctttattggcttcttcggttctatctttttcataaccgtcatttcaatcgacagatatctggctattgtcctggccgctaattctatgaacaacaggaccgtacagcacggggtgaccatcagcttgggagtttgggcagcagccatcctggtcgccgcgcctcagttcatgtttacaaaacaaaaagaaaacgaatgtctcggcgattaccctgaggttttgcaggaaatctggcccgttctgcggaacgtagagaccaactttttgggctttctgttacccctgctgatcatgagttactgctattttcggatcattcagactctgttttcatgcaaaaatcataaaaaggccaaggcaataaagctgatcctgctggtagtcatagtcttcttcctgttctggaccccttataatgtcatgatattcctcgagactctgaaattatacgacttcttcccaagctgcgatatgcgaaaggatcttcggctggcgctctcagtgaccgagactgtggcttttagccactgctgtctgaaccctctgatctacgcgtttgccggcgagaagttccgcagatacctgtatcatctgtacggcaaatgtttggctgttctctgcgggagatctgtacacgtggatttttcttcttcagaaagtcaaagatcacgacacggttccgttctgagctcgaactttacttaccatacatcagacggcgatgccctcctcctcctgtag

SEQ ID NO: 111871 - DNA, 321 bp, Artificial Sequence
  Description of Artificial Sequence: Synthetic coding sequence
atggatcagtttcctgaaagcgtcacagagaacttcgagtacgacgacctggctgaggcttgctatatcggtgatattgtggtttttgggaccgttttcctgtcaattttttactcagttatctttgcaattggtttagtgggcaatttgctcgttgtctttgctctgaccaattccaaaaagcccaagtcagttaccgacatatacctgctgaacctggccctgtctgacctgctcttcgttgcaactttaccgttctggacccactaccttataaatgagaaaggacttcacaacgccatgtgcaagttcacaacttag

SEQ ID NO: 111872 - DNA, 501 bp, Artificial Sequence
  Description of Artificial Sequence: Synthetic coding sequence
atggaccagtttcctgagagtgtgacagagaattttgaatatgatgatctcgcagaggcttgctacattggagacatcgttgtctttgggactgttttcctgtccatattttactccgtgatcttcgccattgggctggtcgggaacctgctagtggtcttcgctctgactaatagcaaaaagccaaagtctgtgaccgacatttatcttctgaatctcgccctgtcagatttactcttcgtggcaacacttcctttttggactcactacctgattaacgaaaagggcttacacaatgcaatgtgtaagttcaccaccgccttcttcttcatcggtttcttcggctccatcttttttattacggtcattagcatcgatcgatatctggctatcgtcttggctgccaatagcatgaacaaccggaccgtgcagcacggagtgacaatcagcctgggcgtctgggccgccgccatcttagttgctgcgccccaattcatgtag

SEQ ID NO: 111873 - DNA, 1092 bp, Artificial Sequence
  Description of Artificial Sequence: Synthetic coding sequence
atggcatccggcaaagcttttactatggaccagttcccagagagtgtgacggagaacttcgagtacgacgacctggcggaagcttgctatataggggacatcgtggtctttggtaccgtctttctgtctattttttactctgtaatattcgcaataggtctcgtggggaatctcctagtcgtctttgcgttgaccaactcgaaaaagccaaaatccgtgacagacatctatctgctaaatctggccctcagtgatttgttgttcgttgccacattgccgttttggactcactatcttatcaatgagaaaggactccacaacgccatgtgtaagttcacaaccgcttttttctttattgggtttttcgggagcatttttttcattacagtaatctcgattgaccgatatctcgcaatcgtgcttgcagccaatagcatgaacaaccgcaccgtgcagcacggagtaacgatctctctgggggtgtgggctgctgcaatactcgttgccgcacctcagtttatgtttactaagcaaaaggagaatgagtgtctgggcgactaccccgaggtactgcaggaaatctggccagtacttcgcaatgttgaaaccaactttcttggcttcctgctgccccttctgataatgtcttactgttattttaggattatacagacactgttctcttgtaaaaaccataaaaaagccaaggctataaaactgatactgttggtggttatcgttttcttcctgttctggactccttacaacgtgatgatcttcctcgaaactctaaaactgtatgactttttcccaagctgtgacatgcgcaaagacctcaggttagctctgtccgtgaccgagactgtggctttctctcactgctgccttaaccccctgatttacgctttcgctggggaaaagtttcggcgctacctctatcacttgtatggtaaatgcctggccgtactgtgcggaagatctgttcacgttgacttctcttcgagcgagtcgcaaaggtcacgccatggctctgtcctgtcctcgaattttacctaccatacttcggacggcgacgctctgctactgctctag

SEQ ID NO: 111874 - DNA, 1068 bp, Artificial Sequence
  Description of Artificial Sequence: Synthetic coding sequence
atggaccagttccctgagagtgtcacagagaatttcgaatacgacgacctcgctgaagcctgctacattggcgacatcgttgtgtttgggacggttttcctgtccattttttactcagttatcttcgctattggactcgtggggaacttgcttgttgttttcgctttaacaaattccaaaaagccaaagagcgtgaccgatatctatctactcaaccttgctctaagcgatctccttttcgtcgccacacttccattctggacacattacttaattaatgaaaagggcctccacaatgccatgtgcaagttcactacagccttcttctttattggcttttttggatctatattcttcattaccgtgatttctatagaccggtatctggctatcgttctcgcagccaactccatgaacaataggactgttcagcacggcgtgacaattagcctcggtgtctgggccgctgcaatcctagtggctgcgccacagtttatgttcacaaagcagaaggaaaacgaatgtctaggcgattatcctgaggttcttcaggaaatttggcctgtcctgcgtaatgttgagaccaactttctcgggtttttgctgccgttactgattatgtcctattgttactttagaattatccagactctatttagctgtaagaatcacaagaaggctaaagccatcaaactgatcctcctcgtggtgatcgtcttctttttgttctggaccccttacaacgtaatgatcttcctcgaaacgctgaaactgtacgatttcttcccttcctgcgatatgcgcaaggacctgcgcctggccctgagcgtcactgagaccgtcgccttttcccactgctgcctcaacccactcatttatgcattcgccggggagaagtttaggcgatatctgtaccacctgtatggaaagtgcttagctgtattatgtggacggtcagtgcacgtggatttttcctctagcgagagccagcgtagccgacacggctccgtgttgtctagtaacttcacgtatcatacttccgacggggatgcactccttttgctatag

SEQ ID NO: 111875 - DNA, 1068 bp, Artificial Sequence
  Description of Artificial Sequence: Synthetic coding sequence
atggaccagttccctgagagcgttacggagaattttgagtatgacgacctggcagaggcttgctatatcggcgacatagtggtgttcggaacagtctttctatccatcttttacagtgtcatcttcgctatcggcctagttgggaatctcctcgtggttttcgcacttacaaatagcaagaaaccaaagtcagtcaccgatatttacctgttaaacttagcactgagcgacctgctattcgtcgcaactcttcctttttggacccactaccttatcaacgagaaggggctgcacaacgctatgtgcaagtttacaacggcttttttctttatcgggttttttgggtcaattttctttattacggtgatctcaatcgacaggtacctggcgatcgtgctggctgcaaactccatgaataaccgcactgtacagcatggtgtgacgatctcgcttggggtctgggctgcagccatactggttgcggctcctcagtttatgttcaccaagcagaaggaaaacgagtgtctgggagactaccctgaagtactacaggagatctggcctgtgctgagaaacgtcgagacaaatttcttgggctttctgcttccccttctgattatgtcttactgctacttcaggattatccagaccttgttctcctgtaaaaatcacaagaaggctaaggctattaagttgatcttgttggtggttattgtttttttccttttttggaccccatacaatgtcatgattttcctcgaaaccctaaagctgtacgattttttcccaagctgcgacatgcggaaggacttgcggctggctctgagcgtcactgagaccgtggccttctctcattgttgccttaacccgctgatttacgccttcgctggggaaaagttcagaaggtatttgtaccacctttatggcaagtgcctggccgtcttgtgcggacggagcgtgcacgtggacttttcctcatccgagagtcagagatcacgccacggctctgttttgtcaagtaacttcacttaccatacgagcgatggggatgcgcttctgttgttgtag

SEQ ID NO: 111876 - DNA, 324 bp, Artificial Sequence
  Description of Artificial Sequence: Synthetic coding sequence
atggccagagctgccctgtccgcagcccctagcaatccgcgcctattgcgtgtggctctgttactcctgttactggtcgccgccgggcggagagcagcaggagccagtgtggcaactgagctcagatgccaatgtctgcagacactgcaagggattcatccgaaaaacatccaatctgtgaacgtgaaatccccaggtccccactgtgcccagaccgaggtaatcgcgacactaaagaatggccgtaaggcttgtttgaaccctgcctcaccgatcgtgaaaaagattatcgagaaaatgctgaatagcgataagagcaattag

SEQ ID NO: 111877 - DNA, 285 bp, Artificial Sequence
  Description of Artificial Sequence: Synthetic coding sequence
atgtcagtcaaaggaatggcaatcgcattagccgttatactttgtgcgaccgtggttcagggttttcctatgttcaagcgagggaggtgtctgtgtataggcccaggcgtgaaggccgtaaaggttgctgatattgagaaggcatccattatgtatccctcaaataattgtgacaagattgaagtaattataacactgaaggaaaacaagggccagcggtgcctaaaccctaaatcgaagcaggcgcgactaattatcaaaaaagtggagcggaaaaacttctag

SEQ ID NO: 111878 - DNA, 285 bp, Artificial Sequence
  Description of Artificial Sequence: Synthetic coding sequence
atgtcagtcaagggtatggctatcgcgttagcggtcattctttgcgcaactgttgtgcaggggttccccatgttcaagcgcggccgctgtctgtgtatcggacctggagtcaaagctgtcaaggtggctgatatcgaaaaggcttctatcatgtacccctcaaacaattgtgacaaaattgaagttatcattaccctcaaagaaaacaagggccaaaggtgtttgaatcccaaatccaagcaggcgcgtctcattatcaagaaggttgaaaggaagaatttttag

SEQ ID NO: 111879 - DNA, 336 bp, Artificial Sequence
  Description of Artificial Sequence: Synthetic coding sequence
atgagcctgttgccaagacgcgcacccccggtcagcatgcgtctgctggccgcagcactgctgctactgctgttggccctgtacacggccagggtggacggatctaagtgtaagtgctctcgcaaaggacctaaaatccggtatagcgatgtcaaaaagttggagatgaagcccaagtatccccactgcgaggagaaaatggtgattattacaacaaagagcgtcagtcgatatcggggccaggagcactgcctgcacccaaagctccaatctacaaaacggttcatcaagtggtataatgcatggaatgaaaaaaggcgcgtgtatgaggaatag

SEQ ID NO: 111880 - DNA, 300 bp, Artificial Sequence
  Description of Artificial Sequence: Synthetic coding sequence
atgcgcctgctggctgcagcactgctgctgctgttactcgccttatacaccgctcgagttgatggatctaaatgcaaatgttcccgcaaaggaccaaagatcaggtactccgatgtaaagaaactggaaatgaagcccaagtacccccattgcgaagaaaaaatggttatcattacaactaagagcgtttcccgctaccgggggcaggaacattgcctgcatcccaagctccagtctacaaaacgatttatcaagtggtacaatgcttggaatgagaaacgccgcgtgtacgaagaatag

SEQ ID NO: 111881 - DNA, 822 bp, Artificial Sequence
  Description of Artificial Sequence: Synthetic coding sequence
atgtctggctcgcaaagcgaagtagccccaagtcctcagtcaccccggtcacctgaaatgggcagagatcttcggcctgggagtcgggtgttgctgcttttactactgttactcttggtatacctgacacagccaggcaacggcaatgaaggcagcgtcacaggctcatgctactgtgggaagagaatatcttctgacagcccgccttcagtccaatttatgaacagactgaggaagcacctgcgggcataccaccggtgcttgtattacactagatttcaactgctgtcctggtccgtctgcggcggcaacaaggatccgtgggtacaggagctcatgagctgtctggacctcaaagagtgtgggcacgcctactcaggcattgtcgcacaccagaagcacctcctgcctacaagccccccaatttctcaagccagcgaaggggcctctagcgacatccacacaccagcccaaatgctgctgtcaacgcttcagtcaactcagcggcctacccttcccgtcggtagcctgagctctgataaggagctcacccggcctaacgaaaccaccattcacaccgctgggcacagtctggcggctgggcccgaggccggtgaaaatcaaaaacagccggaaaagaacgcaggacctactgccaggacctcagctaccgtgccggtcctgtgtctgctggctatcatttttattctgaccgccgctctttcttatgtgctgtgtaagaggcggaggggccaaagtcctcagtcatctcccgacctgcctgttcactacatacctgtcgcgcccgatagcaacacgtag

SEQ ID NO: 111882 - DNA, 822 bp, Artificial Sequence
  Description of Artificial Sequence: Synthetic coding sequence
atgtcgggatcccagtccgaagttgccccttctcctcaaagtccacgcagcccagaaatgggccgcgatctgaggccaggaagccgcgtgctgctgttgttgctattattgctccttgtctacctcacacagcccggtaatggcaatgaaggttccgtgactggttcatgttattgtgggaagcggattagctcggatagtccgccatccgtccagttcatgaatcgactcagaaagcacctgcgagcctaccaccggtgtctgtactacacccggttccagctgctttcatggtccgtctgcggcggcaataaagacccttgggtccaggagctgatgtcttgtttggacctgaaggagtgtggtcatgcttacagcggtattgtagcgcatcagaaacacctgttgcccacgtctccaccgattagccaggcaagcgagggggcttcaagcgacatccacaccccagcccagatgcttttgagtacgctccagagcactcaacggcccacgttacccgtcggctccctgtcatccgacaaggagctcaccagacctaatgaaaccacaattcacacggctgggcattccttggctgcaggccctgaggccggagagaaccagaaacagcctgagaagaacgctggccccaccgcgaggacttccgccaccgtccctgtactgtgtcttttggcgataatctttattctaacggcagctctgtcttatgtcctttgtaagagaaggagagggcagtcaccccaatccagtccagatctgccagtgcactacatccccgttgctcctgattcaaacacatag

SEQ ID NO: 111883 - DNA, 360 bp, Artificial Sequence
  Description of Artificial Sequence: Synthetic coding sequence
atgaaagtactgatctcctctctccttctgcttctgcccctcatgctgatgagcatggtctcaagctctctgaacccgggggtggccagaggccatcgcgatcgggggcaagcgtctcgccgctggcttcaggagggtggccaggagtgtgaatgtaaggattggtttctgcgcgcaccacggcgcaagtttatgaccgtctccggcctgcctaaaaaacaatgcccctgtgatcatttcaagggtaacgttaaaaagacaaggcatcagaggcaccaccgcaaacccaataagcatagtcgcgcttgccaacagtttctcaaacaatgccaactgaggtcttttgcactgcccctgtag

SEQ ID NO: 111884 - DNA, 360 bp, Artificial Sequence
  Description of Artificial Sequence: Synthetic coding sequence
atgaaggtactgatttccagcctgcttctgcttctacctctgatgttgatgagtatggtatcgagtagcctcaacccgggggtagcacgaggtcacagagatcgaggacaggcctccaggcggtggctgcaggaagggggtcaggaatgcgagtgtaaagactggttcctgagagccccacggcggaaattcatgaccgttagtgggctgcccaagaaacagtgcccatgtgaccatttcaagggaaacgtcaaaaagactcgtcaccaaaggcatcataggaaacctaataaacactcaagagcttgtcagcagtttctaaagcagtgtcagctacgatctttcgcactacctctttag

SEQ ID NO: 111885 - DNA, 324 bp, Artificial Sequence
  Description of Artificial Sequence: Synthetic coding sequence
atggccagagcaaccttatccgctgctccgtctaatccccggctccttcgggtagcccttctgctgttattgctggttgcagcctctcgaagagccgccggtgctccattggctacggaactccgatgtcagtgtctgcagacactccaaggcatccatctgaagaatattcagtctgttaaggtgaaaagtcctggaccccactgcgctcaaaccgaggttattgccacactaaagaatggccagaaagcctgcctgaatcctgccagcccgatggtgaagaaaataatagagaagatgttgaagaacggcaagtccaattag

SEQ ID NO: 111886 - DNA, 324 bp, Artificial Sequence
  Description of Artificial Sequence: Synthetic coding sequence
atggctcacgccacactgagtgcggccccctcgaatccccggctgctccgcgtggcgctgctgttgctcttgctggttgcagcctccagacgggctgcaggagcgtctgtggtcacggagctgagatgtcagtgtctgcagacactgcagggaatccatctgaaaaatattcagagtgttaacgtccgatcgcccggtccacattgtgcacagaccgaggtaattgccacactaaaaaacggaaagaaagcttgcttaaacccagcttctcccatggtgcagaagataattgaaaaaattctgaacaagggcagcaccaactag

SEQ ID NO: 111887 - DNA, 345 bp, Artificial Sequence
  Description of Artificial Sequence: Synthetic coding sequence
atgagcctgctctcttccagagctgctagggttcccggtccttccagcagtctgtgcgctctgttggtactgcttttgctcctgactcagcccggccccattgcttctgccggacccgctgctgccgtgctgcgtgagcttcgatgtgtgtgcttacaaacgacccagggcgttcatcccaagatgattagtaacttacaggtgttcgctatcggacctcagtgctctaaagtcgaagtcgtcgcttccctaaaaaacggtaaagagatctgcctcgaccctgaggccccattcctgaagaaagtcatccagaagatccttgacgggggtaataaagaaaattag

SEQ ID NO: 111888 - DNA, 1053 bp, Artificial Sequence
  Description of Artificial Sequence: Synthetic coding sequence
atgtccaacattacggacccacagatgtgggattttgacgatcttaattttaccggcatgccgcccgcagatgaggactattctccttgcatgttggaaacagagactctgaacaagtacgtggtgattatcgcctatgccctggtgttcctactgtcacttctgggaaatagcttggtgatgctggtgatactgtactctagagtaggtcggtccgtgaccgacgtgtaccttctgaacctggcgcttgcggacctcctgtttgcactcactctgcccatttgggcagcatccaaagttaacggctggatctttggaaccttcctctgcaaggttgtcagcttgttaaaggaggttaatttctattctgggatactactgttggcctgcatctccgtggatcggtacctcgctattgtgcatgcgactcgcacactgacgcagaagagacacctagtcaagttcgtgtgcctgggatgctggggtttgagtatgaatttgagcctcccattcttcctttttcgacaggcctatcaccccaacaactcctctcctgtgtgctatgaggtcctcggaaatgacacagccaaatggcgtatggtgctaaggatccttcctcacaccttcggattcatcgtcccactgttcgtaatgctcttttgttacggcttcaccttgcgcactctgtttaaggcccatatgggccagaaacatagagcgatgcgcgtgatcttcgccgttgttctcatctttttgttgtgctggctgccatacaatcttgtgctgttagcagacactctgatgaggactcaggtgattcaagagagctgtgaaaggaggaacaatattggccgcgccctcgacgcgacggagatcctgggctttttgcatagttgcctgaatccaatcatttatgcttttattggccagaactttcggcatgggttcttgaagattctggccatgcacggactcgtaagtaaggagtttctggcccgacaccgagtgactagttacacttccagctctgtgaacgtatcatcgaatttgtag

SEQ ID NO: 111889 - DNA, 885 bp, Artificial Sequence
  Description of Artificial Sequence: Synthetic coding sequence
atgagcaacattactgatccccagatgtgggacttcgacgatctcaacttcacggggatgcctcctgctgacgaggactatagcccgtgtatgctggaaactgagactctgaataaatacgtagtcatcatcgcctacgctctggtgttcttactcagtctgctcggaaactctcttgtgatgctcgtgattctctactcaagggtgggcaggagtgtgaccgatgtgtacctactgaacctggccatcgtccacgctactcggaccctgacgcagaaacggcatctcgttaaattcgtttgcttaggctgctgggggttaagcatgaaccttagtcttcctttcttcctcttccgccaggcttaccacccaaacaatagttcgcctgtatgctacgaggtactgggtaatgacactgcaaaatggcgaatggtgctgcgcatcttgccgcatacctttggctttatagtgcccctttttgtgatgctgttctgttatggctttaccctgcgcaccctctttaaggcacacatgggccaaaagcatagagctatgagagtaatctttgcagtggtgctgatcttcctgctgtgctggctgccttacaaccttgtgctgctggctgacactctcatgcgcacccaagtgatccaagagtcttgcgaacgacgcaataacatcggacgcgcactagatgccaccgaaatccttgggttcctccactcatgccttaaccccattatatacgcattcattggtcagaacttccgacatggctttcttaagatcctggcaatgcatgggctggtttccaaggagttcttagcccgtcatcgggtcacgtcatacacctcctcttctgtgaacgtctcatccaacctttag

SEQ ID NO: 111890 - DNA, 804 bp, Artificial Sequence
  Description of Artificial Sequence: Synthetic coding sequence
atggtcttggaggtgagcgaccaccaggttctgaacgacgccgaggtggccgcacttcttgagaacttctcttcatcctacgattacggggagaacgagtccgattcttgctgcacttcaccgccctgcccacaggactttagcttgaacttcgatcgggcctttctccccgcgctgtatagcctgctgttcctcttgggcttgctaggcaatggggctgtggccgctgtgctgctgagccgacgcacagccctgagtagtaccgatacttttctgttgcatctcgccgtagccgatacactgttagtgctgacactcccactctgggcagtcgacgccgccgtccagtgggtcttcggttctgggctgtgtaaagtagccggagcactgttcaacatcaatttctacgccggcgcattgttgctcgcttgtattagcttcgatcgttacctgaatatcgtccacgccacacagctttaccggaggggaccacctgccagagtgaccctcacttgcctggcagtgtggggcctgtgtcttctcttcgccttacccgattttatctttctttccgctcaccacgatgaaagactgaatgccactcattgccagtataatttcccccaaggctcctccagcggcagcgggtgtggatgttgttcctgcgcatgggcagctcctactagagagggctccagggggagtcaccgcctgcccgctggtattcacccagggctccgcccacaaagacctcccacccgggcttgcgaagccggtatcagagccccgttatcccctacttag

SEQ ID NO: 111891 - DNA, 1248 bp, Artificial Sequence
  Description of Artificial Sequence: Synthetic coding sequence
atggagctgcggaagtacggccctggcaggctggcaggtacagttattggaggagccgctcaaagcaagtctcagactaagtctgattcaatcaccaaggagtttcttcctggtctgtacactgcccccagctctccatttcctccgagccaggtcagtgaccaccaagtcctgaacgacgccgaagtcgctgccctgctggagaacttcagctcctcttacgattatggggaaaatgaatctgacagctgctgtacgagccccccgtgtccccaggacttttccctgaactttgaccgggcgtttttgcccgcgttatattctttgctttttttgttaggcctcttagggaatggcgcagtcgccgccgtgctgctttcgcggcggacggccctgagctcaactgataccttcctactgcacctcgccgtcgccgatacactgctcgttttgaccctgcccctctgggccgtagatgctgcagtgcagtgggtgtttgggtccggtctgtgcaaggtggctggagctctgtttaatatcaatttttacgctggggcacttcttctggcgtgcataagctttgatcggtacctgaatatcgtgcatgctacacagctctacaggcgtggccctccggcccgggttactctcacctgccttgcagtttgggggttgtgccttcttttcgccttgccagatttcattttcctgtcggcccatcacgacgaaaggctgaacgcgacccattgccagtacaacttccctcaggtaggccgaaccgccctccgcgttctgcagcttgttgccggttttctgttgcctctactggtaatggcgtactgttacgcccacatcctcgctgtgctcctggtttcacgcggtcagcgccggctgagggcgatgagattggtggtggtggtggtggttgcatttgccctctgctggacgccctaccacctggtggtgctggtagacatcctgatggacctgggcgcactggctcggaattgtggtcgcgagtcccgggtggacgttgccaagagtgttacatcagggcttgggtacatgcattgctgcctgaacccattactgtacgctttcgtcggcgtgaagttcagagaacgaatgtggatgttgctcttacgattaggatgccccaaccagagaggcctgcagcggcaaccgtcaagtagccggcgggacagcagttggtccgaaacatcagaggcctcatattctgggctgtag

SEQ ID NO: 111892 - DNA, 1107 bp, Artificial Sequence
  Description of Artificial Sequence: Synthetic coding sequence
atggtactggaagtttcagaccaccaggtgctcaatgatgcagaagtagccgcgctgttagagaacttctcatcttcttacgactacggcgagaacgaaagtgattcatgttgcactagccctccatgccctcaggatttttccctcaactttgacagggccttcctaccagcactctactctctgttattcttactgggcctcctgggtaacggcgccgtagctgcagtgctcctgagtcgccggactgcgctgtccagtaccgatacatttctgttacatttggctgtggcggatactctcctggtactgactctgccgttgtgggccgttgatgccgccgttcagtgggttttcgggagcgggctgtgcaaggtcgctggagccctgttcaatataaacttttatgcaggggccctgctcctggcctgtatctcgttcgacaggtaccttaacatcgtgcacgctactcaattgtacaggcgaggacctcccgctcgtgtgacactgacctgcttagcagtatggggtttatgcctgctgtttgctctgcctgatttcatctttctttcagctcaccacgatgagcggctgaatgctacgcattgtcagtataatttcccacaagtggggaggacggccttgagagtcctgcagcttgttgctggatttctgttacccctccttgtgatggcctactgctacgctcatattctggcggtcctgctggtcagtcgaggccagaggcgattgcgcgccatgaggttggtggtggtcgtggtcgttgccttcgccctgtgctggaccccttaccacctggtggtgcttgtggatatccttatggaccttggtgcgctggccaggaactgcggccgagaaagccgtgtcgacgtcgctaaatccgttacaagtggcctgggatacatgcactgctgcctcaacccactgctgtatgcgttcgttggggtaaagtttcgagagaggatgtggatgttgctactgcggcttggctgcccaaatcagcgagggctccagagacagccctcaagcagcagacgcgatagctcgtggtctgagactagcgaagcgtcctatagcggcctgtag

SEQ ID NO: 111893 - DNA, 1119 bp, Artificial Sequence
  Description of Artificial Sequence: Synthetic coding sequence
atgaactacccactgactcttgagatggacctcgaaaacttagaggacttgttctgggaactcgaccgccttgacaattataacgacaccagtttggtggagaatcacttgtgtcctgccaccgagggtcctctgatggcaagtttcaaggctgtcttcgtccctgttgcctattccttgatcttccttctcggagtcatcggaaatgtactggtcctcgttatcctggagagacaccggcagacgagatcaagtactgagacgttcctcttccacctggcagtggctgacttgctactggtgttcattctgcccttcgccgtagccgaagggtccgtcggctgggtgctgggcacatttctctgtaagactgtgatcgccctccataaagtgaacttctattgctcttcgctgctgctcgcctgcatcgcggtggaccgctaccttgcaatcgtgcatgccgtgcatgcatatcgccatcgaagattactgagcattcatatcacttgcggcacgatttggctggtgggctttttgctggccctgccagaaatcctgttcgctaaggtctcacagggacaccacaataatagccttccccggtgcacattttcacaagaaaaccaggcggagacacacgcttggttcacaagtcgatttttatatcatgtcgcaggctttctcctccctatgctcgtgatgggctggtgctatgtaggtgtggtccatcgtctgcggcaggctcaacgacggccacaacgacagaaggcagttagggtggcgatactcgtcacttctattttttttctatgctggtccccatatcacatagtgatttttctggacaccctggcccgacttaaagctgtggataacacctgtaagcttaacggctccttacccgtggcaattaccatgtgtgagttcttgggactggcccattgctgtctcaaccctatgctgtacacctttgctggggtgaagtttcgatcagaccttagtcggctcctcactaaattaggttgcaccggccccgcttctctgtgtcagcttttcccctcatggcggaggtcttctttatcagagtcagagaacgcaaccagtctaacaactttctag

SEQ ID NO: 111894 - DNA, 1029 bp, Artificial Sequence
  Description of Artificial Sequence: Synthetic coding sequence
atggccgagcacgattaccacgaggactacggattcagtagcttcaacgacagttctcaggaggagcaccaggattttctgcaattctcaaaggttttcctgccgtgcatgtaccttgtggtgtttgtctgcggtcttgtgggtaatagcctggtcctggtcatctccatcttttaccataaactccagtccctgacagatgtatttttggtgaacctgcctctggccgatctggtatttgtgtgcaccctcccattttgggcgtacgccggcatccacgaatgggtctttgggcaagtcatgtgtaagtccctgttggggatctacaccataaatttctatacctccatgctgattctgacctgtatcacagttgatagatttatcgtcgtggtgaaagccaccaaagcatataatcagcaagccaagcggatgacctgggggaaggtaacatcacttctgatttgggttatatcattgctggtaagccttcctcagattatctacggtaacgtcttcaacctcgacaagctcatctgcgggtatcacgacgaagctatcagcactgtggtcctcgcaacgcagatgaccctgggattttttctcccattacttaccatgatcgtgtgttattccgtcataatcaagacactgttgcatgctggcggcttccaaaaacaccgaagtctgaagattatcttcctggttatggccgtgtttctattaacacagatgccatttaatctcatgaagttcattcgcagcacccactgggaatattacgcaatgacctccttccattacactatcatggtcaccgaagcgatagcatacctgcgagcttgcctgaatcccgtattgtatgcctttgtgagtctcaagttccgcaagaacttctggaagctggttaaggatattggctgtctaccttacctaggcgtgtcacatcaatggaagtcctccgaggacaacagcaaaactttctccgcctcccataatgtagaagctacaagcatgttccagctgtag

SEQ ID NO: 111895 - DNA, 1029 bp, Artificial Sequence
  Description of Artificial Sequence: Synthetic coding sequence
atggcagaacacgactaccatgaagattatggcttcagtagcttcaacgattcaagccaggaagaacatcaagattttctgcagtttagcaaagtctttctgccgtgcatgtacctggttgtcttcgtctgtggactagtcggcaactcgctagtgctggttatcagcattttctatcataaactgcagagtctcactgacgtctttttggtgaatctgccactcgctgacttggtgtttgtgtgtacacttcctttctgggcttatgccggcattcatgagtgggtgttcgggcaggtgatgtgcaagtcactcctgggaatctatacaataaatttctatacatctatgctgatacttacttgcattaccgtggataggtttatcgtggtggtaaaagccaccaaggcctataaccaacaggccaagagaatgacctggggcaaggtgacttctctgttgatttgggtgatcagcctgctcgtgtcattaccacagatcatctacggcaacgtgttcaaccttgacaaactcatctgcgggtaccacgatgaggccatcagtaccgtggttttagctacgcagatgaccctcgggtttttcctgcctctgctgactatgattgtgtgttacagtgtgatcataaagacactccttcacgctggcggtttccaaaagcacagatctctgaagattatcttcctagttatggccgtgtttttgctgacccaaatgcctttcaaccttatgaaatttatccggagtactcactgggaatattatgccatgacgagcttccactacacaatcatggtcacagaggcgatcgcctatttgcgcgcttgcctgaatcccgtcctatatgcgtttgtctccttgaagttccgcaagaatttctggaagctcgtgaaagatatcggttgcctgccgtatctgggcgtttcgcaccagtggaagagttccgaggacaattcgaagacctttagcgcgtcacacaatgtggaagctacctcgatgtttcaactgtag

SEQ ID NO: 111896 - DNA, 1029 bp, Artificial Sequence
  Description of Artificial Sequence: Synthetic coding sequence
atggccgaacacgactatcacgaggactacgggtttagctcatttaatgacagctctcaggaggaacaccaagatttcctgcaattctcaaaggtctttcttccctgtatgtacctagtcgtcttcgtctgcgggctggtagggaactctttagtcctagttatttcaatcttctatcacaaactgcagagcctcaccgacgttttccttgtgaacttacctctggccgacctcgtttttgtgtgtaccctgccattctgggcttatgctgggatccacgaatgggtgttcgggcaagtgatgtgcaaaagcctattgggcatttatacaatcaatttctacaccagcatgctcattctgacttgcattacggtcgaccgcttcatcgtggtggtgaaagccactaaagcctacaatcaacaagccaagagaatgacttggggcaaagtgacaagtttactaatctgggtcatctctctgctggtttctcttcctcagattatctatggcaacgtttttaatctggataaattaatctgcggctaccacgatgaagcaatctctacagttgtgctggccacccagatgactcttggcttttttttgccattactgactatgatcgtgtgctactccgttataatcaagaccctacttcacgcaggtggattccaaaagcatcgatcattaaaaatcatctttttggtgatggccgtcttcttgctgacccaaatgcccttcaacttaatgaagtttataaggtctacacactgggaatattatgctatgactagcttccattacaccataatggtcaccgaggcgattgcctacttacgagcttgcctgaatcctgtcctgtacgccttcgtcagcttgaagttccgcaaaaacttctggaagctggtcaaggatatcggttgtctgccctatctgggcgttagccaccagtggaagtcgtctgaagataatagcaagaccttctccgcatctcataatgttgaggctacttcaatgtttcagttatag

SEQ ID NO: 111897 - DNA, 1029 bp, Artificial Sequence
  Description of Artificial Sequence: Synthetic coding sequence
atggccgagcatgattaccatgaagattatggcttcagttcatttaatgatagttcccaagaggagcatcaagattttctgcaattcagcaaagtgtttttgccttgtatgtatctggttgtcttcgtatgtggtctggtcggaaatagcctcgttttagtcatctccattttttaccataaactgcagtctctgactgatgtgttcctggtaaatctgcccttagctgacctggtgtttgtttgcaccctcccgttttgggcatatgccggaatccatgagtgggtatttggacaggtaatgtgtaaatcgttgctggggatctatactattaatttttacactagcatgcttattttgacttgcattaccgttgatcgattcatcgtagtcgttaaggctacgaaggcctataatcagcaggccaaaaggatgacatggggaaaagtgacttcgctgctgatctgggttatctcactgttggtgtcccttccccagataatctacgggaacgtgttcaaccttgataaactgatctgtggttaccacgatgaggcgatcagcacagtcgtcttggctacccagatgaccttgggtttcttcttgccgttgctgaccatgattgtgtgctacagcgtgattatcaaaactctgctccacgcagggggtttccagaaacatagatcacttaagatcatttttctagtgatggccgtgttcttattgacccagatgccgtttaatctcatgaaatttatccggtccacacactgggaatattacgccatgaccagctttcactatactatcatggtcacagaggcgatcgcttacctaagagcctgtctgaatcccgtgctctatgcgtttgttagcctcaagttcaggaagaacttttggaaactggtgaaggacatcggttgtctgccatacctgggggttagccatcaatggaagagttccgaggataattctaaaaccttttctgcatcccataatgtggaggccacctccatgtttcagctctag

SEQ ID NO: 111898 - DNA, 1089 bp, Artificial Sequence
  Description of Artificial Sequence: Synthetic coding sequence
atggacctgcacctgttcgactactccgaacctgggaacttctccgacatttcctggccctgtaatagtagcgattgtattgtggtcgacactgtcatgtgccctaacatgcccaataaaagtgtgctgctgtacaccctgtccttcatctacatctttatttttgtgattggcatgatcgctaactccgtggtcgtctgggtaaacatccaggccaagactaccgggtatgatacccactgctacattctgaacctggctatcgctgatctttgggtggtccttaccatacctgtgtgggtggtcagcctggtgcagcacaaccaatggccaatgggcgaacttacgtgcaaggtgacccatctgatattcagtatcaatctctttgggtctatttttttccttacatgcatgagtgtcgacagatacttgtccataacatattttaccaatactccatcatctcggaaaaagatggtgcgccgtgttgtgtgcattctggtgtggcttttggccttctgtgttagcttgcccgacacctactacctgaagacggtaacaagcgcctccaacaacgaaacttactgtcgcagcttttacccagagcactccattaaggagtggctgatcggtatggagctggtgtcggttgtcttgggcttcgccgtgcctttctctatcatagccgtcttctatttcctcttggctagggcgatctccgcaagttcggaccaggaaaaacattccagcagaaagataatcttctcctacgtggtggtgtttctggtttgctggctaccttaccacgtggctgtcctgctggatatcttttccatcctgcactacataccatttacctgccgccttgagcatgcactcttcactgctctccatgtcacccaatgtcttagcctagtgcactgctgcgtgaaccctgttctctacagcttcataaatagaaactatcgctacgagcttatgaaagcattcatttttaagtattctgccaagaccggtctgaccaagctgatcgatgcctcacgggtgagtgaaactgagtattcggcactagagcaatcaacgaagtag

SEQ ID NO: 111899 - DNA, 636 bp, Artificial Sequence
  Description of Artificial Sequence: Synthetic coding sequence
atggacctgcacctgtttgactactccgaacctggaaacttttccgatatctcatggccatgtaactcctctgactgtattgtcgtggataccgtcatgtgccccaatatgccaaacaagtccgtgctgctatacacgctgagttttatttacatctttatcttcgtcattggtatgattgctaactccgtggtggtttgggtgaacatccaagctaaaactactgggtatgacactcactgttatatcctaaacctcgccatcgccgacctttgggtagtgttgacaattccggtgtgggttgtgtcacttgtgcagcacaatcaatggcccatgggggaattaacatgcaaggtgacacatctgatcttctcaataaacttattcggctccatcttcttcctgacctgcatgtccgtggatcgttacttatctatcacttactttaccaatacccctagtagtaggaagaagatggtgcgtcgcgtggtgtgcattttggtctggctcctggctttttgcgtgtctctgcccgacacctactatttgaaaactgtgacgagcgcctccaacaacgagacgtactgcaggtccttctacccggagcattccattaaggagtggttaattggatag

SEQ ID NO: 111900 - DNA, 1155 bp, Artificial Sequence
  Description of Artificial Sequence: Synthetic coding sequence
atggcagctactgcaagtccacaacccctggctaccgaggacgcagactccgagaatagctccttctactactatgactacctcgacgaggtggctttcatgctctgccggaaagacgcggtggtgagtttcggaaaagtctttctgcctgtgttttactctctcatatttgttctgggcctgagcgggaacctacttcttctgatggtactgttgcggtacgtcccacggaggaggatggtggaaatctatttgctcaaccttgccatctccaacctgctgttcctggtgactctcccgttctggggcattagcgtggcctggcattgggtgttcggtagcttcctttgtaagatggtgagcactctctatacaataaacttttatagtggcattttctttattagttgtatgtcgctggataaatacctggagatcgtgcacgcccagccttatcaccggctgaggacaagagccaaaagcctgcttctcgctactatcgtgtgggcagtcagcttggccgtcagcattccagacatggtattcgtgcagactcacgaaaatccaaaaggcgtttggaactgccacgccgatttcggcggccacggcacaatctggaagctgttcctccgctttcaacaaaacttgctgggattcctccttccactgctggctatgatttttttctatagcaggatcggatgcgtgctggtgagactgcgcccggccgggcaggggcgggccctgaaaatagctgctgcgctggtagtcgcgttttttgtgctatggttcccatacaacctgacactcttcctccataccctcctggacttacaggtctttggaaattgcgaggtctctcagcaccttgattatgccctgcaagttacagagtccatcgctttcctccactgttgcttctcaccaatcctgtacgctttcagcagtcaccgatttagacagtacctgaaagctttcctagcggctgtgctgggctggcacttggctcccgggacagcccaggcttccctgtctagctgttccgaaagctctatcctgacagcccaagaggaaatgactgggatgaacgacctcggcgaacggcagtccgagaattatcctaacaaagaggacgtcgggaataagagcgcctag

SEQ ID NO: 111901 - DNA, 1155 bp, Artificial Sequence
  Description of Artificial Sequence: Synthetic coding sequence
atggccgcgactgccagtccacagccccttgcaactgaagacgccgattcggagaattcatcattttattattatgactacctcgatgaggttgctttcatgctgtgtcggaaggatgccgtggtatcttttgggaaggtttttctccccgtgttctactccctgatctttgtgcttggactgtccggcaatcttctcctgctgatggtattgctacgctatgtgcctcgccggcgcatggttgaaatttacctgttaaacctggctattagcaatctgctatttctggttacactccctttttggggaatcagcgtcgcttggcattgggtattcggctcatttctgtgtaaaatggtcagtaccttatatactattaacttctactccggcatatttttcatctcctgcatgagcctcgataagtacctagagatagttcatgcacaaccctaccatcggctgcgaacaagggcgaagtcgctattgctggccaccatcgtatgggctgtgagtctcgctgtttccattccagacatggtatttgttcagactcatgaaaatcccaaaggtgtttggaactgtcatgctgacttcggcggtcacggcaccatttggaaactgtttctcaggttccagcagaacctgttaggtttcctgcttccacttctcgctatgattttcttctatagtagaatcggatgtgtgctcgtcagactcaggccagccggacagggcagggcactgaagatcgctgctgcattagttgtggccttctttgtactctggtttccttacaatctcactctctttctgcataccctcctggatctacaagtttttggcaattgcgaagtgtcacagcatctcgattacgcccttcaggtgacggagtctatagcctttttacattgttgctttagcccaattctgtacgccttcagctcccaccggttcagacagtatcttaaggcattcttggccgcagtccttggatggcatttggcccctggtacggctcaggccagtctgtcaagctgttctgaatcttctattctcaccgcccaggaggaaatgaccggcatgaacgacctgggcgagcggcaatcagaaaattatccgaataaggaagatgtgggaaataagtccgcatag

SEQ ID NO: 111902 - DNA, 1155 bp, Artificial Sequence
  Description of Artificial Sequence: Synthetic coding sequence
atggccgctacagcctctcctcaacccctggcgacagaggacgccgactctgagaacagcagcttctactattacgactatctggacgaagtggccttcatgttatgcaggaaggatgcagtggtctcttttggcaaagtcttcttgcctgtcttttattccctgattttcgtcctgggtctttcaggcaatctgctgctgctgatggtcctcttgagatatgtcccgcgccgccggatggtagagatctacctcctgaatctcgctatctcaaacctgctctttctcgtcacgctgccattctggggaatcagcgtggcgtggcattgggtgtttgggtccttcctgtgtaagatggtcagtactctttataccattaatttctactccggcatttttttcatatcctgcatgtctctcgacaagtatttagaaattgtgcacgcccagccctatcatcgtctcagaacgcgggcaaaatctttactgttagcaactattgtttgggccgtgtctctggccgtgtctatcccagatatggtgtttgtgcagacccacgagaaccccaagggggtgtggaattgccatgccgacttcggaggacacggcactatctggaaactgttcctgagattccagcaaaacctccttggatttctgctgccccttctggctatgatctttttttattcacgaatcggatgtgtcctggtgcggcttcggccggcaggacagggccgggcgttgaaaatcgccgcagccctagtggtggcattcttcgttctgtggtttccctataacctcacactgtttctgcataccctgctggaccttcaggtgtttgggaactgtgaagtgtcacagcacctcgactatgctctgcaggtgaccgagtcaatcgcctttttacactgttgcttctctcctattctgtacgcctttagctctcaccggtttcgccagtaccttaaagcatttttggctgctgttctagggtggcacttggcgcccggcacagctcaggcctctttaagctcatgcagcgaatccagcatccttacagctcaggaggagatgaccgggatgaatgaccttggagagcgacagagcgagaattatccaaataaagaagacgtgggtaacaagagcgcgtag

SEQ ID NO: 111903 - DNA, 1122 bp, Artificial Sequence
  Description of Artificial Sequence: Synthetic coding sequence
atgagaatggaagacgaagactacaacaccagtattagctatggagacgagtaccctgattacttagattctatcgttgtcttggaggacctctccccattggaggcaagggtcactagaatatttctggttgttgtatacagcattgtgtgctttctgggcattttaggcaacggattagtgattattattgcgacttttaaaatgaagaagacagttaatatggtgtggtttttgaatctggccgtcgccgatttcctgtttaacgtttttcttcctattcacatcacctacgcagctatggattaccattgggtttttgggacagccatgtgcaagatctcaaacttccttttgatccacaacatgtttacctcagtctttctgctgacaatcatctccagcgacagatgtatttctgtgctgctccccgtgtggagccagaaccatcggtcagtccggctggcatatatggcctgtatggtgatttgggtgctggccttctttctctcttcacctagtctcgtatttagagacacagcaaatctccacggtaagatctcttgcttcaataacttttccctgtctacacccggctcttcatcttggcctacccattcccagatggaccccgtcggatatagtcgtcatatggtcgttactgtgacgcgtttcctgtgcggcttcttagtacctgtccttattattactgcttgttatctgactatagtgtgcaaattacagcgcaaccggctcgcaaagacaaaaaaacctttcaaaataatagtcactattatcataactttttttctctgttggtgcccgtaccatacactgaatctgctagaattgcatcacacggctatgccaggctctgtattctcactaggactgccactggctactgccctagctatcgcgaattcttgcatgaatcctatcctgtacgtgttcatggggcaagactttaaaaagttcaaggtggctctgttcagccgcctggtcaatgctttatccgaggacaccggtcattcaagctatccatctcaccggagcttcactaagatgtccagcatgaacgaacggacctccatgaacgaacgtgagacaggcatgctctag

SEQ ID NO: 111904 - DNA, 1116 bp, Artificial Sequence
  Description of Artificial Sequence: Synthetic coding sequence
atggaggacgaggactacaacacctcgattagttatggagacgagtaccccgactatttggattccatcgtggtgttggaagatctctctcctttggaagctcgggtcactcggatcttcctggtggtggtgtacagcattgtgtgtttcttaggtatcctgggtaacggcttggtcattatcattgcaacctttaaaatgaaaaagactgtgaatatggtctggtttttgaacttggccgtggcggactttctgtttaatgtctttctcccgatacatataacttatgccgcgatggattatcactgggtgttcgggactgcaatgtgtaagataagtaacttccttctgatccacaacatgtttacatccgtgttcctgctcacaattattagctcagacaggtgtatctccgtcttgctgcccgtttggtcccaaaaccatagaagtgtccggctggcctacatggcatgtatggtcatctgggtgctggcattctttctgagcagcccttcccttgttttcagagacactgctaatctccacggcaaaatatcttgtttcaacaatttctccctatcaacacccggcagtagtagttggcccacgcactctcagatggaccctgtcgggtattccaggcacatggttgtaaccgtcaccaggtttctgtgcggattcctggttccagtgctcattattaccgcctgctatctgacaatcgtctgcaaactgcaacgcaatcgcttggcaaagactaagaaaccttttaagatcatcgtgacaatcatcattacatttttcctctgctggtgtccttatcacactctgaacctgctggaactgcaccatacagctatgccagggagcgtgttctccttaggcctaccacttgccactgccttagcgatagcaaactcctgcatgaaccccatcttgtacgtgtttatgggacaagatttcaagaaatttaaagtggccttgttttcccgcttggtgaacgcactcagcgaagacaccgggcatagcagctacccaagtcatagatcttttacaaaaatgtcttccatgaacgagagaacatctatgaacgagagagaaactggtatgctgtag

SEQ ID NO: 111905 - DNA, 1122 bp, Artificial Sequence
  Description of Artificial Sequence: Synthetic coding sequence
atgagaatggaggacgaagattataatacctcaatatcatacggggacgaataccctgactatcttgacagcatagtcgtgctggaggacctctccccattggaggcacgggtaacaaggatttttctggtcgtggtctatagcatcgtgtgttttctgggcattctgggaaatgggctagtcattattattgcaacttttaagatgaaaaaaactgtgaacatggtctggtttctgaaccttgcggtcgccgacttcctgtttaatgtgtttctcccaatacatatcacatatgctgctatggattatcattgggtttttgggactgccatgtgcaagattagtaatttcctgctcattcacaatatgttcacctccgtgtttttgctgacaatcattagcagtgaccgttgtatctcagtgcttctcccggtgtggtcccaaaaccaccggtctgttcggttagcctacatggcttgcatggtaatctgggtgttggccttcttcctgtcaagccctagtctggtgttcagggatacagccaatctgcacgggaaaatttcgtgctttaacaacttcagtctgagcacaccgggctctagttcttggcccacacattctcagatggacccggtaggctattcccgtcacatggttgtaaccgtgacaaggttcctttgcggtttcctggtccccgtacttattatcactgcatgctaccttacaatcgtgtgtaagttgcaaaggaacagacttgctaaaactaagaaacctttcaaaattatcgtcaccatcatcattacattctttttatgttggtgcccttatcacacactgaatcttttggagctgcatcacactgcaatgcctgggtcagtcttctctttgggactccctttggccaccgcccttgccattgcaaattcctgcatgaacccgatcttgtatgtgtttatggggcaggatttcaaaaagttcaaagtagccctgttcagccggctggtgaatgcactgtctgaggacacagggcactcatcatacccatcacaccgaagcttcaccaagatgagctctatgaacgagcgaacaagcatgaacgagagagagaccggtatgctatag

SEQ ID NO: 111906 - DNA, 432 bp, Artificial Sequence
  Description of Artificial Sequence: Synthetic coding sequence
atgcgtatggaagatgaagactacaataccagtatctcctacggtgatgagtacccggactatctcgatagcattgtggtattagaagacttaagccccttagaggcacgcgtgactaggatcttcctcgtggtcgtctactctatcgtatgctttctgggcatccttggtaatgggctcgtgattatcattgccacgtttaaaatgaagaaaacggtgaatatggtctggtttctcaacttagctgtagctgactttctatttaacgtttttctccccatccacatcacatacgcggctatggattatcattgggtgttcggtactgccatgtgcaagatctcaaacttccttctcatacacaatatgtttacatctgtgtttttgctcacaattatttcctcagaccgttgcattagtgttctgttgtag

SEQ ID NO: 111907 - DNA, 1122 bp, Artificial Sequence
  Description of Artificial Sequence: Synthetic coding sequence
atgagaatggaggacgaggactataacacctccatctcttatggggacgagtaccccgactacctcgatagcattgtggtgctggaggatctttccccactggaggctagggtgaccaggattttcttggtcgtcgtttatagtatcgtttgctttctgggtatcctcgggaatgggctcgtcataatcatcgccactttcaagatgaaaaagactgttaatatggtgtggtttctgaatctcgcagtcgccgactttctgtttaacgtattccttcctatccacatcacatacgctgctatggactatcactgggtcttcgggaccgccatgtgcaagatatctaacttcttactcattcataatatgtttaccagcgtcttcttgttgactattatttcgtcagaccgctgtatttctgttctgttgcccgtgtggtcacaaaaccatcgcagtgtgcgcctcgcctacatggcctgcatggtaatctgggtgctggctttcttcttgtcttctccttctctggttttccgggataccgccaacctccacggaaagattagctgctttaataacttctcactgtcaacacccggatctagctcatggccaactcatagccagatggatcccgtgggatacagcaggcatatggtcgtcacggtgacgagatttctgtgtggtttcctggtgcccgtcctgatcataactgcctgctacctcacaatcgtgtgtaaactgcagagaaacagactggccaagaccaaaaaacccttcaaaattattgtaacgatcataattacatttttcctttgttggtgcccttaccacaccctcaatctgcttgaactacaccatacggccatgcctggctcagtgtttagcctgggactcccccttgctaccgccctggctatcgctaattcgtgcatgaatccaatcctctacgtattcatgggccaggacttcaaaaaatttaaggtggcgctgttttcacgtctagtcaatgctctgtccgaggataccgggcactcttcttatccatcccataggagtttcactaaaatgtcctctatgaacgagaggacctccatgaacgagagggagaccggaatgttgtag

SEQ ID NO: 111908 - DNA, 444 bp, Artificial Sequence
  Description of Artificial Sequence: Synthetic coding sequence
atgcgtatggaggacgaggactataatacgagcatttcttatggcgatgaatacccagattatctagatagcatagtggtgctcgaagatctcagcccactggaggcgcgcgtaacccgaatttttcttgttgtagtgtattccattgtctgtttcctgggcatacttggtaatgggctcgtcattattatagctactttcaagatgaaaaagactgtgaacatggtgtggtttctgaacctggccgtggccgatttcctttttaatgttttcctccctatccacataacttacgccgcgatggattaccattgggtgtttggtacagctatgtgtaagattagtaacttcctcttaatccacaacatgtttacttcggtgtttctactgaccattatatcctcagacaggtgtatcagtgttttgctccccgtgtggtcatag

SEQ ID NO: 111909 - DNA, 1116 bp, Artificial Sequence
  Description of Artificial Sequence: Synthetic coding sequence
atggaggatgaagactacaacacttctatctcgtatggcgacgagtaccctgattatctcgactccatcgtagtgctagaggatctgagtcctttagaggcccgggtaactcgaatcttcctcgttgtggtgtacagtatagtatgctttcttggcattttggggaacggtctcgtcatcattatcgcgacttttaagatgaagaagactgttaacatggtctggttcctgaatttagctgtcgctgatttcctttttaatgtgttcctgccgatccatattacttacgccgccatggattatcattgggtgtttggcactgctatgtgtaagatttccaattttctgctaatccacaacatgttcacctcagtgtttcttttgaccataatttcgtcagatcggtgtataagcgttctgctgcctgtgtggagccagaatcatcgatccgtcaggttggcgtatatggcctgtatggtgatctgggtgctggctttcttcctgtcctctcccagcttagtttttagagatacagccaacttgcacgggaagataagctgtttcaacaacttctcactgtcgacgcctggctcctcttcttggcctacccattcccagatggatccggtcgggtactcaaggcatatggtggtcaccgtgacaaggtttctctgcggctttctggtgcctgtgctgattatcactgcctgttacttaacgatcgtgtgcaagttgcaaagaaataggttggcaaaaaccaaaaagcccttcaagattatagtcactataattatcacattcttcttgtgctggtgcccttatcacactctcaatctgctggaactgcatcacacagccatgcccggctctgtattcagcctgggtctgcctctcgccaccgctctcgccatagctaactcatgcatgaatcccattctgtacgtgttcatgggccaagatttcaagaaatttaaggtggccctcttctcaaggctagtgaacgctttgtccgaggatactggtcactcatcctatccttcccacagatccttcacgaaaatgtcttccatgaacgaaagaacctctatgaatgagcgggaaacaggcatgctgtag

SEQ ID NO: 111910 - DNA, 1005 bp, Artificial Sequence
  Description of Artificial Sequence: Synthetic coding sequence
atgccgagcaaggaaagttggtctgggcgcaaaacgaatcgagctgctgtccataagtcaaagcaagaaggcaggcagcaggaccttttgattgcagccttaggtatgaaactggggtcacccaagtcttccgtgaccatctggcaacccttaaagctgtttgcatacagtcaactcacatcacttgtgaggcgggcaactctcaaggagaatgagcagattccaaaatatgaaaagattcacaacttcaaggtccacaccttcaggggtcctcattggtgcgagtactgcgcgaacttcatgtggggccttatagctcagggggtgaaatgcgccgattgcgggctcaacgtgcacaagcagtgtagcaagatggtgccaaatgactgtaaacctgacctgaaacacgtaaaaaaagtgtactcctgcgacttgacgacgctggtgaaggcacacactacaaaacgcccgatggtcgtggacatgtgcatcagggagatcgagagcagagggctcaattctgaggggctctaccgggtttccgggttctccgacctgatagaggacgtgaagatggcatttgatcgggatggcgagaaagcggacattagcgtgaatatgtatgaggatatcaacatcatcacgggagcgctcaagctctatttccgagacctgcccattccgctgattacttatgacgcatacccaaaattcatcgagtccgcgaagattatggatcccgatgagcagttggagactttgcatgaggcactaaagttgcttcccccagcccactgtgaaactctccgttacctgatggcccacctaaagagagtgaccctacacgagaaggagaatctcatgaacgccgaaaatttaggaatcgttttcggacccacgcttatgaggtccccggagttggacgctatggctgcattaaacgacattaggtatcaacgtcttgtggttgaactgctcataaagaacgaggatattcttttttag

SEQ ID NO: 111911 - DNA, 1302 bp, Artificial Sequence
  Description of Artificial Sequence: Synthetic coding sequence
atggcactgactctgtttgatacagatgaatacaggccccctgtctggaaatcctacctctaccagctccaacaagaggctcctcacccaaggcggattacgtgtacctgcgaggtggaaaataggccgaaatactacggcagggagtttcatggcatgatttcgcgcgaggctgccgaccagctgcttatagttgcagaaggctcctatctaattcgcgagagtcagcgacaacctgggacctacacattggctctgcgattcggttctcaaactcggaacttccgtctctattacgatggcaaacacttcgtaggcgaaaagcggttcgagtcaatccacgatttggtaacagacggtctgataactttgtatattgagaccaaagccgctgaatatatcgcaaagatgacaatcaatcccatatacgagcacgttgggtatacgactctcaaccgcgaaccagcctataagaaacacatgcccgtactcaaggaaacccacgacgagcgcgatagcacaggtcaagacggtgtgtcagaaaaaagagtgcacactttcaggggaccccattggtgtgagtattgtgccaatttcatgtggggcttaatcgcacagggcgtgaagtgcgccgattgcgggctgaacgtccacaagcagtgttcaaaaatggtgccaaacgactgtaagcccgaccttaagcatgtgaaaaaggtctattcttgcgaccttacaacactggtcaaagcacacacaaccaagaggcccatggttgttgacatgtgtatcagagaaattgagtcacgcggcctgaattcagagggattgtacagggtctcaggtttctccgatctgatcgaggacgtaaagatggccttcgatcgcgacggggaaaaagcagacattagtgtcaacatgtacgaggacattaatatcataaccggagccctgaaactatactttagggacctgcccatccccctgatcacatatgacgcgtacccaaagttcatcgaaagcgccaagatcatggatcccgacgaacagttagagaccctgcacgaggctttaaaattgctgccccccgctcactgcgagacattacggtatttgatggcacacttgaagcgcgttaccctccacgaaaaggaaaacctgatgaacgctgagaacctggggattgtgtttggaccaacactcatgagaagtccagagctggacgccatggcggctttgaatgacattagataccagcgcctcgtcgtcgagctcctgattaagaatgaagacatcctgttctag

SEQ ID NO: 111912 - DNA, 1380 bp, Artificial Sequence
  Description of Artificial Sequence: Synthetic coding sequence
atggccttgacactgttcgacacggacgaataccgaccccctgtgtggaaaagctacctgtaccaactacagcaggaagcaccgcaccctaggcgaattacttgtacatgtgaggtcgagaatcggcccaaatattacggtagagagttccacggaatgatatctcgtgaggctgcggaccagctgctgatcgtggcagaaggttcttacctaatcagagagagtcagcgccaaccagggacctacaccctggccctgcgctttggcagccaaaccagaaactttaggctgtactatgacgggaaacatttcgtaggggagaaaaggtttgagtccattcacgatctcgtgaccgatggactcataaccctgtatattgaaacgaaggctgctgaatacatcgcgaaaatgactatcaatccaatttatgaacacgttgggtacaccacactgaacagggaaccggcctacaagaagcacatgcccgtgctaaaagaaacccatgacgaacgtgactctacagggcaggacggagtttctgagaagaggctcacatccctcgttcgtcgggcaaccttaaaagaaaacgaacaaatccccaagtacgaaaaaatacacaactttaaagtccacactttcaggggccctcactggtgcgagtactgcgctaactttatgtggggtctgattgcccagggcgtgaagtgcgccgactgcggtttgaatgtgcacaagcagtgtagtaaaatggttccaaacgactgtaagcctgacctgaagcatgtaaagaaagtatattcttgtgatctgactacactagtaaaagcccacacgacaaagcgcccaatggtagtcgacatgtgtatcagggaaatcgagagtagaggcctgaactcagaggggctgtacagggtgagtggatttagcgacctcatcgaagacgtcaagatggctttcgacagagatggcgaaaaggcagatatcagcgtgaatatgtacgaggacatcaacataataactggggccctcaaactctacttccgggacctccccatccctctgatcacctacgacgcgtatccaaaatttattgagtctgcgaagataatggaccctgatgagcagttggagactcttcatgaggctctgaaactcttgcctccagctcattgcgagacccttcgctacctgatggcccatttgaagagggtcactctccatgaaaaagaaaatctgatgaacgctgagaatcttggcatcgtgtttggtcccacccttatgagaagtcccgagttggacgccatggcagctttgaacgatattagatatcagcgactagtcgtcgagctattgattaaaaacgaggacatcttgttttag

SEQ ID NO: 111913 - DNA, 1167 bp, Artificial Sequence
  Description of Artificial Sequence: Synthetic coding sequence
atgacggcctcagttctgctccaccctaggtggattgagcccacggtcatgtttctgtacgataatggcggagggcttgttgccgacgagttgaacaagaacatggaaggggccgcggccgcagcagcggccgccgccgcagcagccgcggcaggggcggggggtggaggatttccacatcctgctgcagccgccgctgggggcaatttttccgttgctgcagccgctgcagccgccgctgcagccgcagccaatcaatgccggaatctgatggcccacccagcccctctcgctcctggagccgcctcggcatactcctctgcccccggagaagcaccgccctcagctgcggccgcagccgccgccgcggccgcagcagcagctgccgctgctgcggcaagtagttctggtggacctggtccagcgggccctgctggagcagaggcggccaagcaatgctctccttgtagcgccgccgctcaaagctcctcagggcctgctgccctaccatatggctatttcggctcaggctactatccatgtgcacgaatgggacctcatccaaatgccatcaagtcatgcgcccagccagcgtcagccgccgccgccgcagcctttgcagataaatacatggacacagccggaccagctgcagaggagttctctagccgtgcgaaggagtttgccttctatcatcaggggtacgcggccgggccataccaccaccatcaacccatgccggggtacctcgatatgcccgttgtacctggcctagggggcccgggggaatccaggcacgagcccttagggctgccaatggaaagctaccaaccatgggcccttcccaatgggtggaacggtcaaatgtactgccccaaagaacaagcccagccaccccatctgtggaagtctaccttgccggacgtcgtatcccaccccagcgacgcatcctcgtataggcgtgggagaaagaaaagggtgccctacacaaaggtgcagttgaaggagctcgagagagagtacgccaccaataaatttatcacaaaggacaaacgtagacggatctccgctaccacaaatttgtccgagcggcaggtgactatatggtttcaaaaccggagggtcaaggaaaaaaaggtgatcaacaagctgaagactaccagctag

SEQ ID NO: 111914 - DNA, 999 bp, Artificial Sequence
  Description of Artificial Sequence: Synthetic coding sequence
atgttttctgaagaactctggcttgaaaatgagaaaaaatgcgccgtggtacggaaatctaagcaaggccgaaagcgccaggagctcttggctgttgcatttggggtgaaagtgggagtgaagggcggatttctgtggccacctctgaagctgttcgcctgttcacagatctcatcattagtccggcgtgcagctcttactcataacgataaccacttcaattacgaaaaaactcataacttcaaggtacacacctttcgaggcccacattggtgcgagtactgcgcaaatttcatgtggggtctcattgcccagggtgtccggtgtagcgattgtggcctgaatgttcacaagcagtgctccaagcacgtgccgaatgactgccaaccggacctgaagagaatcaaaaaggtgtactgctgcgaccttaccacactggtgaaggcccacaacactcagaggcctatggtggtagatatttgcatacgagaaattgaagccagaggcttgaagagcgagggtctgtaccgggtaagtggctttaccgaacacatagaagatgtgaaaatggcctttgaccgagacggtgagaaggctgatatctcggctaacgtgtaccccgatattaatataattactggggcgctgaaactgtatttcagagatctccccattcccgtaattacatatgacacatactctaagtttatcgatgcagcgaaaatctccaatgcggatgagcgcctggaagccgtccatgaggtactgatgctgctaccgcccgctcactacgaaaccctgaggtacctcatgattcatctgaaaaaggtaacaatgaatgagaaagataacttcatgaacgcagagaatttgggcattgtgtttgggcccacgttgatgagaccccccgaggatagcacgctgacgacgctgcacgatatgcgatatcagaaactgattgtgcagattcttattgagaatgaagatgtgctgttctag

SEQ ID NO: 111915 - DNA, 525 bp, Artificial Sequence
  Description of Artificial Sequence: Synthetic coding sequence
atggctgcctcctccaactcaagcctaagcgggtcctctgtgtcaagcgtttactccgagcctcggagtccgagagaactgcctaagtatgctgaggaatatcagccgcccatctggaagagctatctctatcaacttcagcaggaagccccaaggcccaagagaattatctgcccccgagaggtggaaaaccgacccaaatactacggccgtgaattccacggcatcatctctcgtgaacaagctgatgagttactgggcggggtagaaggagcatacatactcagggagtctcagagacaacccgggtgctacacactcgctttgcggttcggaaaccagaccctcaattaccgactttttcacgatgggaagcattttgtcggtgaaaagagattcgaatctatacatgacctggtgactgacgggctcattaccctctatattgagaccaaggcagcagagtatatatctaagatgacaacaaatcccatctacgaacacattggctacgcaacgctgtag

SEQ ID NO: 111916 - DNA, 825 bp, Artificial Sequence
  Description of Artificial Sequence: Synthetic coding sequence
atgttcagtgaggagctttggctcgagaatgagaagaagtgcgccgtcgtgcggaaatctaagcagggcaggaaacgccaggagttactggcggtagctttcggtgtgaaggtgggggttaaaggggggttcctctggccccccctcaagttgttcgcctgctctcagatcagtagtctcgttcgtagagctgccttgacccataacgacaatcacttcaattacgagaagacacacaacttcaaagtccacactttcagaggccctcactggtgcgaatactgcgctaatttcatgtggggcctgattgcacagggtgtccggtgtagcggcctcaaatccgagggcttgtatcgggtatccggcttcaccgagcacatcgaggatgtaaaaatggcatttgacagagacggagagaaggccgatatatcagccaatgtttacccagacattaatattattacaggtgccttgaagttgtacttcagagaccttcctataccagtcattacatatgatacatactccaagttcattgacgcagcgaagatttccaacgcggacgaacgtctcgaggctgtgcacgaggtgctgatgctgctcccacctgcgcattatgaaacactgcggtatctgatgatacacctgaagaaagtgaccatgaacgaaaaggacaattttatgaatgctgaaaacctgggaatcgtgttcggccccaccctcatgaggccccccgaggactccactttgaccaccttgcacgacatgagataccagaagttgatcgtgcagattcttatcgagaacgaggatgtgttgttttag

SEQ ID NO: 111917 - DNA, 864 bp, Artificial Sequence
  Description of Artificial Sequence: Synthetic coding sequence
atgttctctgaggagctttggctggaaaacgaaaagaagtgtgcggttgtccgcaaatctaagcagggtcgaaaacggcaggagctactggccgtagccttcggggtgaaggtgcataccttccgcggaccgcactggtgcgaatattgtgccaattttatgtggggcctcattgctcagggagttcgatgtagcgactgcgggctcaacgtgcataaacagtgtagcaagcacgtgccgaatgattgccagccagacctgaagcgcattaagaaggtgtactgctgcgacctgactaccttagtaaaggcgcataacacacagcggcccatggtggtcgacatttgtatccgtgaaatcgaggctcgaggcctgaaatccgagggactgtatagagtttccggatttaccgaacacattgaagacgtgaagatggcctttgacagggacggcgagaaggcagacatctcagccaatgtctatcccgatattaatatcattactggcgcacttaagctctattttagagacttgcctattccggtgattacatatgacacatatagcaaatttatagacgccgcaaagatatcaaatgccgacgagaggctggaggccgtccacgaggtgttgatgctgctccccccagcgcactacgaaacactgcgctatctgatgatacatctgaagaaagtgaccatgaacgagaaggacaattttatgaatgctgaaaacctgggaatagtatttgggcccacgctgatgaggccccctgaggactccacgctgacaacactacatgacatgaggtatcagaagctgattgtgcagatcctgattgaaaacgaggacgttctgttctag

SEQ ID NO: 111918 - DNA, 579 bp, Artificial Sequence
  Description of Artificial Sequence: Synthetic coding sequence
atggctgctagttctaattcctcactcagtggatctagcgtttcaagtgacgcggaagagtaccagccccctatttggaagagttacctgtatcagcttcagcaagaggccccgcgcccaaagagaattatctgtcctagagaggtagagaacagacccaagtattacgggcgggagtttcatggcattatcagccgagaacaagccgacgagctgctggggggtgtggaaggagcctacattctgagggaatcccagaggcaacctggctgttatacgctagccctccgcaatccgaccaaaatttcaaacgccgatgagcgcctggaggccgtgcacgaggttctcatgttactgccaccggcacactacgagacactgagatacctgatgatccaccttaaaaaagtaaccatgaatgaaaaggataacttcatgaatgctgagaaccttggaattgtgtttggccccaccctgatgaggccgccggaagactccactcttaccacccttcacgacatgcggtaccagaagcttatcgtgcagattctgattgagaatgaggatgtacttttctag

SEQ ID NO: 111919 - DNA, 861 bp, Artificial Sequence
  Description of Artificial Sequence: Synthetic coding sequence
atgttttctgaggagctttggctggagaatgagaagaagtgtgccgtggtgaggaaatcaaagcagggaaggaagcgccaagaactgctggccgtggccttcggcgtgaaggtgggcgttaaaggcgggttcctgtggccccccctaaaactgttcgcctgcagccagatcagcagcctggtgagacgcgctgctctgactcacaatgacaaccacttcaactacgagaagacacataacttcaaagtacacaccttccgagggcctcattggtgcgagtactgtgcaaacttcatgtggggcctgatcgcacagggggtcaggtgttctgactgtggcctgaacgtgcataaacagtgttctaagcacgtgcctaatgactgtcagccagatttgaagcggatcaagaaggtgtattgttgcgacctaacgaccctagttaaagcgcacaacacccaaaggcctatggtcgtggacatctgcattagagagatcgaagcaagggggctgaagagtgagggcctgtacagagtctccggattcactgaacatatagaagacgtgaaaatggcattcgatcgcgaaatctcaaatgccgatgaaaggctcgaggcggtgcatgaggtgctcatgcttctgccaccggcccactacgagactctacggtacctgatgatccacctcaaaaaagtgaccatgaatgaaaaggacaactttatgaacgctgagaacctcgggatagtatttggaccgaccctaatgcgaccacccgaggattccactctcaccacactgcacgacatgagataccagaagctcattgttcagatcctaatcgagaatgaggacgtcctgttctag

SEQ ID NO: 111920 - DNA, 1446 bp, Artificial Sequence
  Description of Artificial Sequence: Synthetic coding sequence
atggcagcctcttctaatagtagtctgagtggaagcagcgtgtcttccgtctatagcgagccacgtagccccagggaactgcccaagtatgcagaggaataccagcctcccatttggaaatcatacctgtatcagctgcagcaggaggcgccacgcccaaaaaggattatctgccctcgggaagttgagaataggccaaagtactatggtcgagagtttcatggtatcatatctcgagagcaggcagacgagctacttggtggggtcgagggggcctacatattaagagagagtcagcgacaacctgggtgctatacactcgcactcagattcggcaaccagacactgaattatagactgtttcacgacggcaagcacttcgttggtgagaaaaggttcgagtctatccacgacctggttactgatggactgattacactgtatattgaaacaaaggccgcagagtatataagcaagatgaccacgaatcctatctacgagcacattgggtacgccaccctactgcgagaaaaggtctctaggaggctctccagaagcaaaaacgaaccacgcaaaacaaacgtcacacatgaggagcataccgctgtagagaaaatcagcagtctggtgcgcagagccgccctcacccataacgacaatcatttcaattacgagaagacacacaacttcaaagtgcacacattcagagggccgcactggtgcgagtattgcgccaactttatgtgggggttaattgcacagggggtgcgctgctccgactgtggtctcaacgtgcataagcagtgctctaagcatgttcctaacgattgtcagccagaccttaagagaataaaaaaagtttactgctgcgacctgaccacactggtgaaggcccacaatacccagagacctatggtggttgacatctgcattagggaaattgaggcacgcggcctgaaaagcgagggactgtaccgggtgagcggtttcacggaacacattgaagacgtgaagatggcctttgatcgcgacggggaaaaggctgatatcagtgctaacgtgtatccggatatcaatatcattactggggcactgaagctctatttccgcgacctgccaattcccgtaatcacttatgacacctattccaaattcatcgacgcagcaaagattagcaatgcggacgagcgccttgaagcagttcacgaggtgcttatgttgctaccccctgcacactacgagaccctgcggtatctcatgattcacctcaaaaaggttactatgaatgaaaaagacaattttatgaatgcagagaatctggggattgtctttgggccaacactcatgagacctccagaagattctactctgacgactcttcacgacatgcgctatcagaagctcattgtgcagatcctcattgagaacgaggatgtgctgttctag

SEQ ID NO: 111921 - DNA, 975 bp, Artificial Sequence
  Description of Artificial Sequence: Synthetic coding sequence
atggcagctagtagcaacagttcactttccggttcctccgtttcctcagacgccgaggagtatcagcccccaatctggaagtcatatctgtatcagttgcaacaggaagccccacggcccaaacgaatcatatgtcctcgggaaatttcgagcctcgtgagaagagcggcacttacccacaacgacaaccatttcaactacgaaaaaactcataactttaaggtacacaccttccggggaccccactggtgcgagtactgtgctaatttcatgtggggcctgatagcgcagggagtgcgctgttcagattgtggcctaaatgtgcacaaacaatgcagcaaacacgtccctaatgattgccaacctgatctgaagcgcattaagaaagtgtactgctgtgacctgactaccctggtaaaagctcacaacacccagaggcctatggttgtggacatttgcattcgggaaattgaagcaagggggctgaaatctgagggcctgtacagagtctcaggattcaccgagcacattgaggatgttaagatggccttcgacagggacggagagaaagccgacatcagcgctaacgtatatccggatattaacattattactggcgctcttaaattgtactttcgcgatctgcctattccagtaattacatacgatacttactcgaagtttatcgacgctgctaagattagcaacgccgacgaaagactagaagccgtgcacgaagttttgatgctgttgccaccagcgcactatgaaactctgaggtatttaatgatccatttgaagaaggtaacaatgaatgagaaggataattttatgaacgctgaaaacctgggcattgtattcgggcctaccctcatgcggcctcccgaggacagtaccctgacgacactgcacgatatgcgctatcaaaaattgatagttcaaattcttatcgaaaacgaggacgtgctgttttag

SEQ ID NO: 111922 - DNA, 1632 bp, Artificial Sequence
  Description of Artificial Sequence: Synthetic coding sequence
atgacccaaacacaccgggcaaaatccgccagtagttgtcccaacttgttggtccccgagacgtggcctcaccaagtgagcgctagccacgccgggaggagtaagcagccacagggcgggatccttaagataaacgaggaacatcggcggggcgcaatccaggaccttctcgcttcccccgggttcacgttcgggaagcgcgtggtcttcgacagccactgcctgaagcgacaacatacattcgctgacggcctgcacagttcttgtaccagcaacgcagaagagtatcagcccccgatctggaaatcctacctgtatcagcttcagcaggaggctcctagacccaagcgaataatctgtcctcgtgaagtggagaaccgccccaagtactacggccgcgaatttcatggaattatcagtcgggagcaggctgatgagttgctggggggggtggaaggcgcatacatcctgagggagagtcagaggcaaccgggatgttacacattggctctcagatttggtaatcaaactctgaattaccgtttattccatgacgggaaacacttcgtgggagagaaaagattcgagtctattcacgatctcgtgactgacggtctgatcaccctgtatatcgagacaaaggccgcagagtacatctccaaaatgacgactaaccccatctacgagcatattgggtatgctacactgctaagggagaaggtctcccgacgactgagccggagcaaaaacgaaccacgcaagactaacgtgacccatgaagagcacacagccgttgagaagattagttccctagtgagacgtgccgctctaacccataacgataaccactttaattacgagaaaacacataacttcaaagtgcatacttttaggggcccacattggtgcgagtattgcgccaatttcatgtgggggttaattgcccaaggagtgcgctgttcggactgcggcctgaacgttcacaaacagtgctcaaaacacgtccctaacgactgtcaacctgacttgaaacgaattaaaaaggtgtactgttgtgacctgacaacacttgtgaaagcccacaatacgcagagacccatggtggtggacatatgcattcgcgaaatcgaagcgcgcgggctgaaaagcgaaggactctacagggtttccggctttaccgagcatatcgaggacgtaaaaatggcctttgaccgggacggagagaaggcagatatttctgctaacgtgtaccccgatataaatatcattacaggagcactgaagctttactttagggacctgcctattcccgttatcacatacgacacatactccaagtttattgatgccgctaaaatctcaaacgccgatgagaggctggaggccgtgcacgaggtgttaatgctgctgcccccggctcactatgagacccttagatatctgatgatccatttgaagaaagttaccatgaacgagaaagacaactttatgaacgctgaaaatctgggaattgtgttcgggccaacactgatgagacccccagaggattccaccttgacaaccctgcacgacatgcggtatcagaaattaatcgtccagatcctgattgaaaatgaagacgttctcttttag

SEQ ID NO: 111923 - DNA, 1362 bp, Artificial Sequence
  Description of Artificial Sequence: Synthetic coding sequence
atggatgctgaggagtatcagccacccatctggaaatcctatctctatcaactgcagcaggaggcccctcgcccgaaacgcataatctgccctcgcgaggttgagaaccgcccaaaatactacggccgggaatttcacggcataatcagcagggagcaggcagatgagctcttaggcggggttgagggcgcgtacatcttgcgagagtctcagcgtcagcctggctgctacactttagctctacggtttggtaaccagacacttaactaccgcttatttcacgatggcaaacatttcgtaggggagaagaggttcgagtctattcacgacctggtcacagacgggttaatcacattgtatatagaaaccaaggccgccgaatacatttctaaaatgaccactaatcctatttacgaacacattggttacgccaccctactcagggagaaagtttccaggaggttgtccagatcaaagaacgaacctagaaagacaaacgtaactcatgaagaacacaccgccgtggagaagatatcaagcctggttagaagagcagccctaacccacaatgataatcatttcaattatgagaagacccataatttcaaggtccacacatttagaggaccacactggtgcgagtattgtgctaatttcatgtggggattgattgcccagggggtgaggtgctctgactgcggtcttaacgtgcacaagcagtgcagcaagcatgtgcccaatgactgtcagccagatctgaagcgcattaagaaagtgtattgttgtgatttgacaacccttgttaaggcacacaatacccagcgtcctatggtcgtggacatttgtatcagagagatagaagctaggggcctgaagagcgaaggcctgtacagagtgtctggttttaccgaacacatcgaagacgtcaagatggccttcgatagggacggtgagaaggcggacatctctgcgaacgtctaccccgacatcaacatcattactggggcgcttaagctgtactttcgcgacctgcctattccagtaatcacctatgatacatattccaagttcattgatgctgccaagataagtaatgccgatgaacggctcgaggcagttcatgaagtgctgatgttgctaccgccagcacactatgagactttgcgctacctgatgatccacctcaagaaagtaacaatgaatgagaaagacaattttatgaacgcagagaacctgggtattgtgttcggacccactctcatgcgaccaccagaggattccactctcactaccctgcatgacatgcgataccaaaagcttattgtacagatattaattgaaaatgaggacgtgctgttctag

SEQ ID NO: 111924 - DNA, 1152 bp, Artificial Sequence
  Description of Artificial Sequence: Synthetic coding sequence
atgggagtcaaggcatcccagaccggcttcgtcgttttagtgctcctacagtgctgctccgcctataagctggtctgttactatacttcatggtcacaataccgcgaaggcgatggatcttgcttccccgatgcacttgatcgttttctgtgcacacatataatttattcttttgccaacatttcgaatgatcacatcgatacctgggaatggaacgacgtgacgctttacggcatgcttaatacgctgaaaaacagaaaccccaatctgaaaaccctgctgtccgtgggggggtggaatttcgggtcacaacgattcagtaaaatcgcttccaatacacaaagcaggaggaccttcattaaaagcgtcccaccatttctacgcacgcacggatttgatggtcttgatctggcatggctgtaccccggtagaagagataagcaacacttcactaccctgattaaagagatgaaggcggagtttatcaaggaagcccagccaggcaagaagcaattactgctctctgccgcgctgagtgctggaaaggtgacaatcgactcgtcttatgacatcgccaagataagtcaacatctggatttcatatcaatcatgacgtacgattttcacggggcatggcgggggactacaggtcaccacagtcctctcttccgcggacaggaagacgcttccccagataggttctcaaacacagattatgcagtcggatacatgctgcggctgggagcccccgcgagcaaactcgtaatgggaattcctactttcgggcggtcttttacacttgccagctccgagacaggagttggcgcacccatctccggtccaggcattccaggacgattcaccaaggaggcaggtactctggcgtactacgaaatttgcgacttcctcagaggcgccacagtgcaccggatccttgggcagcaggtaccgtacgctactaagggaaaccaatgggttggttacgatgatcaagagtccgttaagtccaaggtacaatatctaaaggacaggcaattggctggcgcaatggtatgggcactagacctggatgactttcagggcagcttctgcggacaggatttacgattcccccttacaaatgccatcaaggacgcactcgccgcgacctag

SEQ ID NO: 111925 - DNA, 459 bp, Artificial Sequence
  Description of Artificial Sequence: Synthetic coding sequence
taactgcttctgtctgccgccctcagcgcaggcaaggttaccatcgactcctcgtacgatatagccaaaatcagtcagcacctggatttcatttctatcatgacttacgattttcatggggcatggagagggacaacgggacaccacagcccactgtttaggggccaggaagacgcttctccagaccggttctcgaacaccatttgcgacttcctgcggggggctacagtgcatcggattctggggcagcaggtcccttatgccaccaagggcaatcagtgggttggttacgacgaccaggaatccgttaaaagtaaagtccaatacctcaaagataggcagctcgcaggggccatggtgtgggcgctggacctagacgacttccaaggctccttttgtggccaggatctacgcttccccctgacaaacgcgatcaaagacgctctcgcggcaacttag

SEQ ID NO: 111926 - DNA, 306 bp, Artificial Sequence
  Description of Artificial Sequence: Synthetic coding sequence
atggtgtcaacccctgaaaacaggcagacattcatcacctcggtcattaagtttctccgccaatacgagtttgacggtcttgattttgattgggagtaccctggtagtcggggatcccctccccaagataagcatctgttcactgtgctggtacaaatgaggaaactcaaatatagggaggatctgtctaacctgcccaagatcacacagctagtgggcataatcacttccagcgctgtgtggccacagagccctctgctgctcagtatcaccttggggtgccccctactccttagaaacgcatag

SEQ ID NO: 111927 - DNA, 1431 bp, Artificial Sequence
  Description of Artificial Sequence: Synthetic coding sequence
atgacaaagctgatacttctaactggtctggtgttgattctcaatttgcagctcggcagtgcttatcagttgacttgctacttcacaaattgggctcagtataggcctggactgggtcgcttcatgccggataacatcgacccttgtctgtgcacccacctgatttatgcttttgccgggcgccaaaacaacgagataactactattgagtggaacgacgtcactctgtaccaggccttcaacgggctgaaaaacaaaaattctcaactgaagacgctgcttgctatcgggggttggaacttcggcactgcaccatttactgcgatggtgtctaccccagaaaatcgtcagacctttatcacttccgtgatcaagttcttgagacaatacgaattcgatgggctggacttcgattgggaatacccgggctctcgtggcagccccccacaggataaacacctttttaccgtgctggtgcaggaaatgagggaagcctttgaacaggaagctaaacaaatcaataaacctaggctcatggtaaccgccgcagttgccgccggaattagtaacatccagtcaggctacgagattcctcaactcagtcagtatctggactatattcacgtgatgacatacgacctgcatggcagttgggagggctatacaggagagaactccccactctacaagtatccgactgataccggcagcaatgcttatctgaatgtcgattatgtgatgaattactggaaggacaacggtgcccccgccgaaaagctgatcgtggggtttcctacctacggacacaacttcatcctatccaatcccagcaacacggggatcggtgccccgacttcaggagctggacctgctggaccatacgctaaagaatccggaatctgggcctactatgagatctgtacattcctcaagaacggtgcaacacagggttgggacgccccccaggaggtgccgtacgcttaccagggcaatgtctgggtgggatatgataatattaagagcttcgatatcaaggcacagtggctcaagcacaataaatttggcggagctatggtgtgggccattgacttagacgattttacaggcaccttctgtaaccaaggcaaatttcctttgatctcaacactgaaaaaagctttagggctccaatcggcttcctgtaccgcgcctgcacaaccgatcgaaccaatcaccgcagcccccagcggaagtggtaacggaagcggttccagtagcagcggcggaagctctggagggagtggcttctgcgccgtgcgcgctaatggcctctatcccgtggctaacaaccgtaatgccttttggcactgcgtcaatggcgtcacatatcagcagaactgccaggccggcctcgtatttgatacaagctgcgattgctgtaattgggcgtag

SEQ ID NO: 111928 - DNA, 948 bp, Artificial Sequence
  Description of Artificial Sequence: Synthetic coding sequence
atgcgggaggcctttgagcaggaggcaaaacagatcaataaaccccgccttatggtcacggcggcagtggcggctggtatctctaacatccagtccggttacgaaattcctcagttaagccagtacctcgattatatacacgtcatgacttacgacttacacggctcttgggaggggtataccggggaaaacagcccattgtacaagtaccccaccgatacaggatctaacgcctacctcaacgtggattacgtgatgaactattggaaggataacggcgctcccgccgaaaagttgattgtcggcttccctacctacggacacaattttatcctaagcaacccttcgaacacaggtatcggagcccccaccagtggggcagggcctgcggggccatatgccaaggaatccgggatttgggcttactatgaaatctgcacttttctgaaaaacggcgctacgcaaggctgggacgctcctcaggaagtgccgtatgcctaccagggcaacgtgtgggttggctatgataacatcaaaagcttcgatattaaagcacagtggttaaaacataacaaatttggcggtgcgatggtgtgggcgatcgacctggacgatttcaccggaacgttctgcaaccagggaaagttcccactgatcagtaccctgaagaaagctctaggcctgcagtctgcatcttgtacggcccccgcgcaacctatcgaaccaataaccgcggcacccagtgggtccggaaatggctctggatcaagttcatccgggggcagcagcggtggctctggcttttgcgccgtcagggcaaacggactataccccgtggcaaataaccgcaacgccttctggcattgcgtgaatggggtaacctatcaacagaactgtcaggctgggctggtcttcgacacctcatgcgattgttgtaactgggcgtag

SEQ ID NO: 111929 - DNA, 1431 bp, Artificial Sequence
  Description of Artificial Sequence: Synthetic coding sequence
atgacaaagttgattctgctcacaggactggtcctgatcctgaatctgcagctagggtctgcgtaccaactgacttgctacttcactaactgggcacagtatagaccaggtctcggacgcttcatgcctgacaacatcgacccatgcttatgcacccacctcatctacgctttcgcaggcagacagaataacgaaattacaaccatcgagtggaatgatgtcactctgtaccaggctttcaacggactgaaaaacaagaactctcaactgaaaactttgctcgccattgggggctggaattttggcacagccccatttaccgccatggtttcaactcccgaaaatcgtcagacattcatcacatccgtgatcaagttccttcgccagtatgagttcgacgggctggactttgactgggagtatcccggctcccgcggttccccgcctcaagacaagcatcttttcaccgttcttgttcaggagatgagagaggcctttgaacaggaagccaagcagattaacaagcctaggctaatggtgaccgccgccgttgccgccgggatatcaaatatccaaagtggatacgaaattccacagctgtcccaatacctggactatattcacgtgatgacctatgatcttcacgggagttgggaagggtatacgggcgagaactccccattgtacaagtatcccaccgataccggctctaatgcgtacctgaatgtcgactatgttatgaactactggaaagacaatggcgctccagccgaaaagttgattgtgggctttccaacctacggccataactttatcctaagtaacccaagtaacacaggaatcggagcacctacgtcaggggcaggccctgccggcccctacgcgaaggagtccgggatttgggcgtactatgaaatttgcacatttctcaagaatggcgcgactcaaggatgggatgcgccacaggaagttccttatgcgtatcaaggcaacgtttgggtgggctacgataatatcaaatcgtttgacataaaggcgcagtggttgaagcataacaagttcggcggggccatggtgtgggcgattgatctggacgacttcaccgggacattctgtaatcagggcaagtttccgctcatatcgaccctaaagaaggcactgggcctgcagtccgcaagctgcaccgcacccgcccaaccgatagaacctatcacagccgctcccagcggaagcggcaatggatccggctcttcatctagtggcggctcctcaggcggttccgggttttgtgctgtgagagcaaacgggctttaccccgtggctaacaacagaaatgctttctggcactgcgttaacggggtgacctatcaacaaaattgtcaggcgggccttgttttcgatacatcctgcgattgctgtaactgggcttag

SEQ ID NO: 111930 - DNA, 1263 bp, Artificial Sequence
  Description of Artificial Sequence: Synthetic coding sequence
gaaactagcagctcggtgcacgagcaggtagctgactcaggcgcccaggccgtcgccttccaatcggggggagaatccagtatcgtgtggaactcgcagcttaagacactactagcaatcgggggatggaactttggaacagcccccttcacagccatggtgagtaccccagagaatcgccaaacctttatcacttctgtgatcaaattcctgcgccagtacgaattcgacgggctggacttcgactgggaatacccagggtcacgaggaagtccaccacaggataaacacttgtttactgtcctggtacaggaaatgcgtgaggctttcgagcaggaggcaaaacaaatcaacaaaccccgtctgatggttacggctgcagttgcagctgggatttctaatatccaatccgggtatgaaattccacaactcagtcagtacctggactatattcacgtgatgacgtacgacctccacggctcatgggagggctacactggcgagaattctccactctacaagtatcccaccgacacaggctcaaacgcatatctcaacgtggattatgttatgaattattggaaggataatggggcccccgcagagaaattgattgtgggttttcccacttacggacataattttatactatctaacccctccaataccggaataggagccccgacctcaggtgccggccctgctggcccctatgccaaagagtccggaatctgggcatattatgagatctgcaccttcctcaagaacggtgccactcaagggtgggatgctccgcaggaggttccctacgcatatcagggcaatgtctgggtgggctacgacaacataaagagtttcgacatcaaagctcaatggctgaagcataacaagtttggaggcgccatggtctgggcaattgacttggatgatttcacagggacattttgcaaccaggggaagtttccacttattagcaccttgaaaaaggccctcggattacaatcagcctcatgcactgcccctgcacaacctatagagcctattaccgccgcaccttctggcagtgggaacggctcagggagctctagctccggagggtcttccggcggctccgggttttgtgcagtcagggccaatggcttgtatccagtagccaacaatcgcaacgccttctggcactgcgtaaatggggtcacatatcagcaaaactgccaggctggcctggtatttgatacgtcatgcgattgttgtaattgggcttag

SEQ ID NO: 111931 - DNA, 1107 bp, Artificial Sequence
  Description of Artificial Sequence: Synthetic coding sequence
atggtgtcaacccccgaaaaccgccagactttcattacctccgtgatcaaatttctacggcagtatgagttcgacggcctggattttgattgggaataccccggatcgaggggctccccgcctcaggataagcacctttttaccgtcctagttcaggagatgagggaagcctttgaacaggaagctaaacagataaacaaaccgcgattgatggtgaccgctgccgtcgccgcgggtatttccaacatacagtctgggtacgagattccacagctttctcagtaccttgactatattcatgtgatgacatatgatctccacggctcgtgggaggggtacacaggagagaactctccactttacaagtaccccactgataccggatcaaacgcctatctgaatgtagactacgttatgaattattggaaggacaatggtgcgccagccgagaagctcattgtgggtttccctacctatggacataatttcatcctgtcaaacccctccaatacaggcataggcgcccctaccagtggcgcgggcccggcaggaccttatgcgaaagagagtggcatttgggcttattatgaaatctgcacctttctgaaaaatggagcaactcagggatgggacgcacctcaagaagttccttacgcctaccagggtaacgtttgggtgggttatgataatatcaagagtttcgatattaaagcacagtggttgaaacacaacaagtttggaggggcgatggtgtgggctatcgatttggacgacttcactggcacattctgtaatcagggaaaattccctctcattagtacactgaaaaaagctctaggactacagagtgcatcttgcacggcaccagctcaaccaatagagcccatcactgccgcccctagtgggtccggcaacggttctggctcgtcttccagcggcggttctagcggagggtccggcttctgtgcggttcgagccaatgggttgtaccccgtggcaaacaataggaatgccttctggcattgcgtcaacggcgtgacttatcaacagaactgccaggcaggtctcgttttcgacacatcctgtgactgttgcaactgggcttag

SEQ ID NO: 111932 - DNA, 948 bp, Artificial Sequence
  Description of Artificial Sequence: Synthetic coding sequence
atgcgagaggcatttgaacaggaagccaaacagatcaataaaccgagactaatggtcaccgccgcagttgctgctgggatctcgaatatccagtccgggtacgagatcccccagctcagccaatacttggactatatccacgtgatgacctatgaccttcatggttcttgggaagggtacaccggcgagaactcacccttatacaaatatcctaccgataccggttccaatgcctaccttaatgtggattacgtaatgaactactggaaggacaatggggcccctgcggagaaattgattgtcggttttcccacttatggacataactttatactgtccaacccatctaataccggaattggcgcccccacatctggagcaggaccggccggcccatacgcgaaagaatccgggatctgggcatactacgagatctgtacattcttgaagaatggagccacacagggttgggacgctccccaagaggtcccttacgcttatcaaggtaacgtgtgggtgggctacgataacataaaaagctttgatattaaggcccagtggttgaagcacaacaaattcggcggggcaatggtgtgggcaattgatctcgatgactttacaggcacattttgcaaccagggaaaatttcccctgatctccactctgaaaaaagctctcggcctgcagtcagccagttgcaccgccccagctcagcccatcgaacccatcactgcagctccaagcggatctggaaatgggtcaggaagcagctctagtggaggatccagtgggggtagcgggttttgcgccgttagggctaacggcctctatcctgtggcgaacaatagaaatgcattctggcactgtgtgaacggcgttacatatcagcaaaattgccaggcaggtctcgtttttgacacatcctgtgactgctgcaactgggcatag

SEQ ID NO: 111933 - DNA, 948 bp, Artificial Sequence
  Description of Artificial Sequence: Synthetic coding sequence
atgcgcgaggccttcgagcaggaagcaaaacagataaacaagccacggctcatggtgaccgccgctgtcgcagccggcatctctaatattcaaagtgggtatgagatacctcagttaagccaataccttgactacatccacgtgatgacatacgatctccacggcagctgggagggctacaccggagaaaattctcctctatataagtaccccacggataccggctctaatgcttatctcaacgtagactacgtcatgaattactggaaagataatggcgcgcctgctgaaaagctcattgtgggctttccgacatatggacacaacttcattctgtcgaatccctccaatacaggcattggggctcctacatcaggtgccggtccagcgggtccttacgccaaagaatctggcatctgggcgtactatgaaatttgcacctttcttaagaacggagctactcagggatgggacgccccccaggaagtgccctacgcctatcagggtaacgtctgggtgggatatgataatatcaagtcattcgatataaaggctcagtggttgaaacataacaaatttggcggggcgatggtttgggcgatagacctcgatgattttaccggaacattttgtaaccagggcaagttccctctgatttcgaccttgaagaaggctctggggcttcaaagcgccagttgcaccgcaccagcacagcccatcgaaccgatcactgccgcccctagcgggtcagggaatggctcaggctcctcctcttcaggaggctcatcgggtggctctggattttgcgcagtgagggccaacgggctgtatccggtcgctaataaccgcaacgcattctggcattgcgtgaacggggtgacgtaccagcaaaattgccaggcgggattggtgttcgatacctcatgcgactgttgtaactgggcctag

SEQ ID NO: 111934 - DNA, 864 bp, Artificial Sequence
  Description of Artificial Sequence: Synthetic coding sequence
atgagagaagcgtttgaacaggaggcaaagcagataaataagccccgtctcatggtcactgcagccgtggctgctggaatctccaacatacaatcaggttatgaaataccccagctttcacaatatctcgactatatccacgtgatgacatacgatcttcatggatcttgggaaggctacaccggggaaaacagtcccctgtacaagtacccaacggacacgggcagcaatgcctacctcaacgtggactatgtgatgaattactggaaagataatggagctcccgccgagaagctcatcgtgggttttcctacatatggccataatttcatcctcagtaacccaagcaatactggaattggagctccaaccagcggggcgggaccggccggcccctatgccaaggagtccggaatttgggcgtattatgagatatgcacattcctcaagaatggagcaacacagggctgggatgcccctcaggaagtaccatacgcttaccagggcaacgtatgggtaggctacgataacatcaagtcatttgatattaaggcccagtggctcaagcataacaaatttggcggggccatggtttgggccatcgatctggacgactttacaggaaccttttgcaatcaggggaagtttccactcattagcacgctgaagaaggcactgggactacagtcggcctcctgtacggcgcccgcacagccaattgagcccatcaccgcagcgcctagcgggtccggtaacggctccggaagttcctctagcggtgggtcttccggaggatcaggattctgtgccgtcagagcgaatgggttatatcccgtcgctaataaccgcaatgctttctggtag

SEQ ID NO: 111935 - DNA, 1158 bp, Artificial Sequence
  Description of Artificial Sequence: Synthetic coding sequence
atgtccagaccgcaactgcgccggtggcgcttagtctcatcaccacctagtggcgtgccagggctcgctttgctcgcactgctggctctgctcgctcttcgtcttgctgctggtaccgactgtccttgtcctgagccagaactgtgtcggccaattaggcatcatccagattttgaagtcttcgtgtttgatgtcggccagaagacctggaagtcatacgactggtctcaaatcacaaccgtagcaacatttgggaagtatgattctgagctaatgtgttatgctcacagtaagggcgccagagtcgtcctgaaaggggatgtatctcttaaggacataatcgatcctgcatttagggccagctggattgctcagaagttaaatctcgctaaaactcaatacatggatggcattaacattgacatcgaacaggaggtgaattgcctttctccagagtacgatgccctgactgcgctggtcaaagagactactgacagcttccatcgcgagattgaaggttcccaggtgacattcgatgtggcatggtcgcccaagaatatcgaccgacgctgttacaactacacagggatagccgatgcttgtgatttcctgtttgtgatgagttatgatgagcagtcacagatctggtcagagtgtatcgccgccgccaatgccccatacaaccagaccctgacaggatataatgattacatcaagatgagcattaaccctaagaagctggttatgggagtcccctggtatggctacgattatacctgtctcaatcttagcgaggatcacgtgtgcaccattgcgaaggtcccgtttagaggcgccccctgttctgacgctgccgggcggcaggtgccatataagacaataatgaaacagatcaattcgtcaatcagtggaaatctgtgggacaaagaccagagggcgccttattacaattacaaggaccccgcaggccatttccaccaagtgtggtacgacaaccctcagtcaatcagccttaaagcgacatacatacagaattaccggctgagagggatcgggatgtggaatgctaactgcctggactattccggagatgccgttgccaaacaacagaccgaggagatgtgggaagttctgaaacccaaactgttgcagcggtag

SEQ ID NO: 111936 - DNA, 2967 bp, Artificial Sequence
  Description of Artificial Sequence: Synthetic coding sequence
atggaacagtcccgctcccagcaacgcggcggcgaacagtcatggtggggatcagatccgcagtaccagtacatgccttttgaacattgtaccagttatggcctgccaagcgaaaatggtggattacaacatagattacgaaaagacgcggggccccggcacaacgtacatcccactcagatttacggccaccacaaagagcaattttctgatagagagcaggatattggcatgcctaaaaaaacgggcagttcaagcactgtggactctaaggacgaagaccactacagcaaatgtcaggactgcatccatagactggggcaggttgtgcggcgcaagctgggagaagacgggatatttctggtgctgctaggcttgctgatggccttggtttcttggtccatggattacgtgagtgctaagtccttacaggcatacaaatggtcatatgcccagatgcaaccttcattaccactgcagtttctggtgtgggtgacatttcccctggtactgatacttttcagtgcattgttctgtcacctcattagcccccaggccgtgggcagcggcattcccgagatgaagacgatcctgagaggagtcgtcttgaaggagtacttaactatgaaagccttcgtggctaaggtggtggccctgactgccggattgggttctggcattcccgtcggcaaggagggccctttcgtccatattgcctctatatgtgccgcggtgctttctaaattcatgagcgtattctgcggggtttacgagcagccttattattattctgatattctgaccgtaggatgtgccgtcggggtcggctgttgtttcggcacacctctgggtggagtcctgttctcaattgaagtaacatctacatatttcgccgtcagaaattattggaggggttttttcgccgcgacgttttccgcattcgtctttcgtgtcctggccgtgtggaacaaggatgcagtgacgatcaccgcactgttccgaacaaatttcagaatggacttccctttcgacctgaaggaactgcccgcctttgctgccattggaatatgctgtggtcttctgggggcagttttcgtgtacctgcaccgccaagtcatgctcggagtgaggaagcacaaagctttgtcacaattcctggccaagcacagactgctgtaccctggcatagtcacctttgtgatcgcaagctttacttttccgccaggaatgggacagttcatggccggtgaactaatgccaagagaggctatctctacactgttcgataacaatacctgggtgaagcatgccggtgacccggagtcccttggccaaagcgccgtttggatccacccaagagttaacgtagtgatcattattttcctcttcttcgtgatgaagttctggatgtcaatcgtggccaccactatgccaattccatgtggcggatttatgccagttttcgttcttggtgccgcatttggccgcctggtaggagagatcatggctatgctgtttccagacgggatcctgtttgacgatataatatacaaaatcctcccgggcgggtatgccgtgatcggcgccgctgcactgactggcgcggtatcacatacagttagcacagcggttatttgcttcgagctgactggtcagatcgctcatattctgcccatgatggtggcggttatactggctaatatggtcgcacagtcccttcaaccatcactttatgacagcataatccaggtgaagaagctgccatacctgccagatctcggatggaatcagctgagcaaatataccatttttgtcgaggacattatggtccgcgacgtgaaattcgtgtccgctagttatacatacggagaattacggactttgctgcagaccacaaccgttaagacactgccgctggtggattctaaagatagcatgatactcctcggatcagtcgagagatctgaactccaggccctcctgcagcggcatctgtgtcctgaacggaggctgagagctgcccaagagatggcaagaaaactctcagagttaccttacgacggtaaggctagactcgcaggcgaagggctgccgggcgctcccccagggaggcctgagagtttcgcatttgtggatgaggatgaggatgaagatctgtcaggaaagtctgagttaccaccttctctggccctgcatccttcaacgaccgcgcctcttagccctgaggagcctaatggccctctgcccggtcacaagcagcagcctgaggctccagaaccagcgggtcaacgtcccagtatcttccagtccctcctgcattgtctcctaggccgggcccggcccactaagaagaaaactactcaagattccaccgatttggtagataatatgagccccgaggagatcgaggcctgggagcaggagcagcttagtcagccagtgtgctttgacagctgctgtattgatcagtcccctttccaattggttgaacagaccacactgcacaaaacccatactctcttcagtttattgggtctacatcttgcttacgtgacaagcatggggaaattgaggggggtcctggctctcgaggaactgcagaaggctatcgagggccacactaaatccggcgttcaactgcgacccccgctggcctcgttccggaatacaacttccaccaggaagtcgaccggggcaccgcccagtagtgccgaaaactggaaccttcctgaggaccgcccaggcgcgactggaacaggcgacgtgatcgctgcaagtcccgagaccccagtcccttcaccctcacccgagccacctctgtcattagcccccggcaaggtcgaaggagagctggaggaactcgagctggtggagagtcctgggctggaagaagaactggcggacattctgcagggaccgtcactccgtagcactgatgaagaagacgaggacgagctgattctctag

SEQ ID NO: 111937 - DNA, 2697 bp, Artificial Sequence
  Description of Artificial Sequence: Synthetic coding sequence
atggcggcagccgctgcagaagagggcatggagcccagagctctccagtacgagcaaactctgatgtatgggcggtacacccaggatcttggcgcttttgctaaggaagaggccgctcgcattcgtttgggtggccctgaaccgtggaaaggtccaccgtcaagccgcgccgcaccggagctcctggagtatggccggagccggtgtgcgagatgcagagtctgctctgttagatgtcacaaatttttggtcagtcgcgtcggcgaggattggatattcctcgtgctcctgggcctcctcatggccctggtgagttgggtgatggattatgcgattgcagcttgtcttcaggcccaacaatggatgtctagaggcctgaataccagcatcttattgcagtacctcgcctgggtgacttacccagtggtgctgatcacattttccgccggctttactcagattctcgcacctcaggctgtgggtagtggcatcccagaaatgaaaaccatactcaggggagtcgtgctgaaggaatatttgacgctcaaaaccttcatcgccaaagtcatagggcttacctgcgcgctcgggagcggcatgccactcgggaaggagggaccctttgtgcatattgcgagcatgtgcgctgccctgttgtccaaattcctctccctctttggaggcatttatgagaatgaaagtcggaacactgaaatgttagctgccgcctgtgcagtaggagtggggtgttgtttcgccgcacctattgggggagtgctcttctcaatcgaggtcactagtacatttttcgcagtgcggaattattggcgtggcttcttcgcagccaccttctccgcttttatattccgcgtgctagccgtgtggaatagggacgaggagaccatcactgccctcttcaagacaagattccgccttgatttcccttttgacctgcaggaacttcccgcttttgccgtcatcggcattgcctctggctttggcggtgccctgttcgtgtaccttaatagaaagattgttcaggtcatgagaaagcagaagaccatcaaccggtttttgatgcggaagcggctgctgttccccgccctcgtcaccctgttgattagtacactcacctttccgccagggtttggccagttcatggcgggccagctgagtcagaaggaaacgctcgttaccctcttcgacaatcgaacgtgggtgcggcagggacttgtggaggaactggaaccaccttcaactagccaggcctggaatccgcctcgcgccaatgtgttccttacactcgtaatttttatcctaatgaaattctggatgtccgctttggccacaactattcccgtcccatgcggtgcctttatgcccgtgtttgttattggcgccgctttcgggcgactggtcggcgaatcaatggccgcttggttccctgacggtattcacacggatagcagcacctatcgcatcgtccctggcggctacgccgtggtgggcgcagctgccctggccggcgctgtcacacacacagtgagtacagcagtgatcgtcttcgagctcactggtcagattgctcatatcctgcccgtgatgatagcagtcatccttgcaaacgcagtcgcacagtccctgcaaccgtcactttacgactccatcatcaggataaagaaattgccttatctcccggagttggggtggggacgccaccaacagtacagggtcagagtggaagacattatggtaagggacgtcccccatgttgctctttcctgtactttccgggacctcaggctggcactccaccgaacaaagggacgtatgctggccttagtcgagtctccggagtctatgattctcttagggtctatcgagcgatctcaggtggtagcactactgggagcccagcttagcccggccaggcgtcggcagcatatgcaggaacggcgcgccacacagactagtccactgagcgaccaggagggaccccccacccccgaagcgtctgtctgctttcaggtgaacacagaagacagcgcattcccggccgcccgcggggagactcacaagccccttaaaccagccttaaaacgtggcccttctgtgacgaggaatctgggcgagtcccccaccggaagtgctgagagcgctgggatcgccctgcgctctttgttctgtggttcacccccaccagaggctgccagcgaaaagctggaatcatgtgaaaagcggaaattaaaacgggtcagaatttctctcgctagtgatgcggatctggaaggggaaatgtcaccggaggaaattttggaatgggaggaacaacagcttgacgagcctgtcaacttctctgactgtaagattgatccagctccttttcagcttgtagagcggacttctcttcataagacgcacactattttctcattgctcggtgtcgatcacgcctatgtgacctctattggccgcctcatcggtattgtaactctcaaggagttaaggaaagcaatcgagggatctgtgaccgcccaaggggttaaagtcaggcctccgttagcctccttcagggattctgccacctcgagttcggacacggagactacagaagtgcacgccttgtgggggcctcattcacgtcacggactgcctagagaaggatcaccgtctgactctgacgacaagtgccagtag

SEQ ID NO: 111938 - DNA, 381 bp, Artificial Sequence
  Description of Artificial Sequence: Synthetic coding sequence
atgagaaaacgcttgctgttccccgcccttgtgaccttgctgatatctacattgactttccctcctggattcggccagtttatggccgggcagttgagtcagaaagaaactctcgtaacactcttcgacaaccgaacgtgggtccgccagggcctggtagaagagctggagccaccatccacatcgcaggcgtggaaccctccaagagccaacgtgttcttgaccctggtcatcttcattctgatgaaacatttgggcgtttggtgggtaaaggcttggcttcctgggtcgcagatggagtttattaggacagccgcgccaaccggattgtgtctgggggccaccttgtggtctggacaattgcggtggcaggagcgctag

SEQ ID NO: 111939 - DNA, 2601 bp, Artificial Sequence
  Description of Artificial Sequence: Synthetic coding sequence
atggaaagcgagcaactcttccaccggggatattacaggaattcctacaattccattacatccgcatccagcgatgaggaactgttagatggcgccggcgtgatcatggactttcagactagtgaagacgacaatctcctggatggggatacggccgtcggcactcactacaccatgactaatggcgggagtatcaattcatcaacccatctgcttgatctcttggacgagcctatccccggagtagggacctacgacgacttccacactattgactgggtgcgggagaaatgcaaggatcgagagcgccataggcgtatcaacagcaagaagaaggaatctgcttgggagatgaccaaaagtttgtacgacgcctggtccggctggctggttgtcaccctgacagggctcgcctcgggggctctggcggggcttattgatattgcagctgattggatgacagacctgaaagagggcatatgtctgtctgccttatggtacaatcacgaacagtgctgctggggatctaatgagactaccttcgaagaacgcgacaagtgtccacaatggaaaacatgggctgaactgataatcggacaggcagagggcccggggtcatacataatgaattacataatgtacatcttttgggctttgtcgtttgcttttttggccgtttcactggtgaaggttttcgccccttacgcctgcggcagcggcatccccgagatcaagactattctatcggggtttatcatcagaggatatctcggcaagtggacactgatgatcaaaaccattacgctcgtgctagccgtggccagtggactgagtctggggaaggaaggacccctagtccacgtggcgtgctgctgcggcaatattttcagttatttgtttcccaaatattccacaaatgaagccaaaaaacgggaagtgttaagcgctgccagcgcggcgggggtttctgtcgctttcggagcccctatcggtggtgtccttttttctttggaagaggtctcctactattttcccttgaagactctgtggagatccttcttcgccgcgctggtcgccgcctttgttctgcgatccataaatccattcggaaactccagactcgtcctgttttacgtggagtatcacacaccgtggtacttgttcgagctgttcccattcattctgctgggcgtttttgggggactctggggcgccttcttcatcagagcaaacatcgcctggtgtaggaggaggaaaagcaccaagttcgggaaatacccggtcctagaggttattattgtggccgccatcactgccgtgatagcatttcccaacccctacactagactgaataccagtgaactgattaaggagctatttactgattgtggccctctagagtcctcctcattgtgcgactatcggaacgacatgaatgctagcaagatcgtcgatgatattcccgacagaccagctggaattggcgtgtacagcgcaatttggcagctgtgtctggctcttatctttaagataatcatgactgtgttcacattcggcatcaaggtgccgtccgggctttttatcccttccatggccattggtgctatagcaggaaggattgtcggaatcgcggtggaacaactggcctactaccaccatgattggtttatattcaaagagtggtgtgaagtgggcgccgattgcattacccctggtctgtacgcaatggtgggagccgccgcttgtttgggaggagttacgcggatgaccgtgtctctggtcgtcatcgtcttcgaattgaccggcggtctggagtacatcgtccccctaatggctgctgtgatgacttccaagtgggtgggcgacgccttcggtcgcgagggaatttatgaggcccacatccgcctcaatggctatcccttcctggacgcgaaggaggagttcacccatactaccctcgcggcagacgtgatgaggcctcgccgcaacgacccaccactggcagtgctgacccaggacaatatgaccgtcgacgacatcgagaacatgatcaacgaaacgagctacaatggtttcccagttataatgtccaaggagtctcaacgactggtaggctttgcccttcgcagggatctgactatcgccatagaatctgcgcgcaagaaacaggagggaatagttgggagttcccgtgtctgtttcgcccagcataccccttcgcttccagccgaaagtccacggcctttgaagcttaggagcattctcgatatgtcccctttcaccgtcaccgaccatacccctatggaaatcgtggtcgacatttttcgaaaacttgggctgaggcagtgtttggtcacacacaatggcatcgtgctgggcatcatcacaaagaagaacatcctggagcacctcgaacagttaaaacagcacgtggagcctcttgctcctccatggcactataacaagaaaaggtatcctcctgcgtacggacccgatgggaaacctcgcccacgctttaataacgtccagttaaacctgacagacgaagagagggaggaaaccgaagaggaagtgtacctgctcaattcaactaccctctag

SEQ ID NO: 111940 - DNA, 2376 bp, Artificial Sequence
  Description of Artificial Sequence: Synthetic coding sequence
atggagagcgaacagttatttcatcggggatattataggaactcgtacaatagcatcacctcagcttcgagtgacgaagaacttctggacggagcaggggtgatcatggattttcagaccagcgaagatgacaacttactggacggggacacggccgtaggtacccactacactatgactaatgggggaagtatcaatagtagtacccatttgttggatttgttggacgagcccataccgggagtcgggacgtatgatgacttccacacaattgactgggtcagagaaaaatgcaaggatcgagagaggcaccggcgcatcaactctaagaaaaaggagtctgcctgggaaatgacaaagtctctttatgatgcttggtctgggtggctcgtggtcacgctgactgggctcgccagcggcgctttagcgggcctaatagacattgcggcagattggatgactgacctgaaagaggggatctgcctgagtgcactgtggtacaaccacgagcaatgctgttggggttcaaatgagaccacctttgaggagagagataaatgcccacagtggaagacgtgggcggagctgataatagggcaggctgagggccctggctcatacataatgaactatataatgtacattttttgggcgctcagttttgcgttcctcgccgtaagcctggtcaaggtgtttgccccttatgcttgtggaagtgggattccagaaatcaagaccattctttccggctttatcatccgtggctatctgggtaagtggaccttgatgatcaagacaatcacccttgtgttggcggtcgccagtggtctctccttgggcaaggagggtccgctcgttcacgttgcttgttgttgtggcaacatattctcttatttatttcccaaatacagcacgaatgaggcaaaaaagcgggaagtcagctactatttccccctgaagacactgtggcgctcctttttcgcagcacttgttgcagcctttgtgttgaggtccatcaatcctttcggaaattccaggctcgtcctgttctacgtggaatatcacacaccttggtatcttttcgagcttttccctttcattctcttgggggtgttcggggggctctggggagcattttttatcagggccaatattgcatggtgccgacggcgtaaaagcactaaatttggtaagtaccccgtcttggaggtaattatcgtggcagctatcacagcagtaattgcgttcccgaacccttatacacggttaaacacttcagaactcatcaaagaactcttcaccgattgcgggcccctcgagtctagttctctctgcgattacagaaacgatatgaatgcaagcaagatcgtggacgacattcccgatcggcctgccggtatcggtgtttattccgccatttggcaactctgccttgccctcatctttaagatcatcatgacagtgttcacgttcggcatcaaagttccgtctggcctcttcattccaagcatggcgattggggccatagccggacgaattgtcggcatcgccgtagaacaactggcgtattatcaccacgattggttcatcttcaaagaatggtgtgaagttggagcggactgtattactccaggcctgtatgcaatggtgggcgcagccgcatgtttaggcggtgtgacacgaatgaccgtgtctttggtggttatcgtgttcgaactgactgggggattagaatacatagtgccattgatggcagccgtaatgacctctaagtgggtgggagacgcattcggccgggaggggatctacgaggctcatatcaggcttaacggatatccatttctggatgcaaaagaggaattcacacatacaaccctcgccgctgacgtgatgaggccacgccgtaacgatccgcctctggcagtactgacccaggacaacatgactgtggatgatatagaaaacatgattaacgagaccagctacaatggcttccccgtgattatgtccaaggaaagtcagcgacttgtggggttcgcgctgcgccgcgacttaacgatcgccatagagtcggctcggaaaaaacaggaaggcatagttggctcctcaagagtctgcttcgcccaacacacaccgagcctgcctgcagagagccccagacccctcaagcttaggtctattctcgacatgagcccctttacagtcacagaccacacacccatggagattgtcgtcgacatttttcggaaactggggctccggcagtgtctcgtgacccataatggtagactacttggcataataactaaaaaggatattcttcgtcacatggcacagaccgccaatcaagaccctgcaagcataatgtttaattag

SEQ ID NO: 111941 - DNA, 2406 bp, Artificial Sequence
  Description of Artificial Sequence: Synthetic coding sequence
atggtgaccctgcaactgggggaaagtcactacgtcgtccaggcgggacttcagttactcggctcgtccaatccacccgcactcgcttcacaggtggcggaaatcactggcacccactacaccatgactaacggggggagtatcaactcatcgacacatttactggatcttctcgatgaaccgatacccggggtaggaacctatgacgacttccacacaattgactgggtgagagagaagtgcaaagatagggagcgccataggcggattaattccaagaagaaggaatctgcttgggagatgaccaagtcgctctatgacgcatggtctggatggttggtggtgacactcaccgggctcgcatccggagccctggctggtctgattgacatcgcggcggactggatgacagacttgaaggaggggatttgcctaagtgccctgtggtacaatcatgagcagtgctgttgggggtccaacgagacaactttcgaagaacgggataaatgtccccagtggaaaacatgggccgagttaataataggccaggctgaaggaccgggctcttacattatgaactacataatgtacatcttctgggcgttgtcattcgccttcttggcagtcagcctggtaaaagtttttgccccttatgcctgtgggagtgggatccccgagattaagacaattctcagcgggttcatcataaggggataccttggcaaatggaccttaatgatcaaaacaataacattggtcctggctgtagcatcagggttgagcctgggcaaagagggtccactcgtgcacgtggcttgctgctgcggcaatatcttctcctacttattccccaagtattccactaatgaagcaaaaaagagagaggtgctgagcgccgcatctgctgccggcgtcagtgtggcatttggcgctcctatagggggagttctcttctcattggaggaggtgtcttattattttccactgaagacgctttggcgcagcttctttgcagctctggttgcagcctttgttctgcgctctatcaaccccttcggcaatagccggctagttttgttctacgtggagtaccatactccctggtatctctttgaactcttcccctttatccttctcggggtcttcgggggcctctggggggccttcttcatacgtgctaatattgcatggtgtcgcaggcggaagtccacaaaatttgggaagtacccggtgctggaagtaatcatcgttgctgcgataacagccgttatcgccttcccaaacccttacacccggttgaacacatctgagttaatcaaagagcttttcacggattgcggacccctggagtctagctctctatgtgactaccgcaatgacatgaacgcttctaagatagttgatgatattcctgacaggcctgccggtatcggggtgtattctgctatttggcaactgtgtctggccctgatcttcaagataatcatgactgtgttcacatttggcataaaggtcccctcagggttgtttatcccctccatggctattggggccattgctgggcggatcgtcggaatcgccgtcgagcagctcgcttactaccatcatgattggttcatcttcaaagaatggtgtgaggtgggggctgattgcatcacacctggtctctatgctatggttggagctgctgcctgcctagggggggtaacgagaatgactgtgagtctggtcgtgatagtgttcgaacttacgggtggcctggaatatattgtgcccttgatggcagctgtcatgacatctaagtgggtgggagacgcattcggacgtgagggtatttatgaagcacacattagactgaacgggtacccgtttttggacgcaaaggaggaattcactcacaccacactggcagcagacgtgatgaggcccaggcgcaatgaccctccactcgcagtgcttacgcaggataacatgaccgtagacgatatcgagaatatgataaatgaaacaagctataacggatttcctgttattatgagcaaagaatcccaacggctcgtgggattcgctcttcgccgtgacctgacaatagcaattgagtcggcccgaaaaaaacaggagggtatagttggatcctcccgggtgtgttttgcacaacatacaccttcactgcccgcagagtccccgcgtcctttgaagctgagatctatcctggacatgagtcccttcaccgtgactgaccatactccgatggaaattgttgtcgatatctttaggaaactgggcctgcgacagtgtctggttacccataatgggagactcctggggatcatcactaaaaaagatatactccggcatatggctcaaactgcgaaccaggaccccgccagcataatgttcaattag

SEQ ID NO: 111942 - DNA, 522 bp, Artificial Sequence
  Description of Artificial Sequence: Synthetic coding sequence
atggaatccgaacagttatttcatcgtggatattaccgcaactcatataactccataacctctgcctccagcgacgaagagctgcttgacggggccggggtcataatggacttccagactagtgaggatgacaatttgctggacggcgatacagccgtgggaacccactacactatgacgaacggaggttcaattaacagctcaacacatcttttggatctcctggacgagccaatcccaggcgttggcacgtacgatgacttccatacaatcgattgggttcgcgagaagtgtaaggatagggagaggcaccgcagaatcaatagcaaaaaaaaggagtctgcgtgggaaatgacgaagagtctgtatgacgcatggtccggctggctcgtggtgaccctcactggacttgcctcaggagctctggccggcttgattgacattgctgccgactggatgaccgatctaaaggaggggatttgcttatccgctttgtggtacaatcacgaacagtgctgctag

SEQ ID NO: 111943 - DNA, 420 bp, Artificial Sequence
  Description of Artificial Sequence: Synthetic coding sequence
atggaaagtgagcagctgttccacagagggtattatcggaacagctacaattcgattactagtgcctctagtgatgaagagctccttgacggagctggggtgattatggacttccagacctccgaggacgacaacctgctggacggcgacactgccgtggggacacattatactatgaccaatggcggaagcataaacagctcaactcatctgcttgacttactcgacgagcctatcccaggagtgggtacttacgacgatttccacacgattgactgggttcgcgaaaagtgcaaggaccgcgagaggcacaggcgaatcaattccaaaaagaaggagtctgcttgggaaatgaccaagagcctgtacgatgcatggtcaggttggcttgtggttacactgactgggttggccagttag

SEQ ID NO: 111944 - DNA, 2457 bp, Artificial Sequence
  Description of Artificial Sequence: Synthetic coding sequence
atggagtcggaacagttgttccaccgcggctactatcggaattcatataacagtattaccagtgcctctagtgatgaagagctgctggatggagccggcgtgatcatggatttccagacaagcgaggatgataacctacttgacggcgatacagctgtgggtacccattacactatgacgaacggcgggtccatcaactcttccacccacctccttgatctgctggatgagccgatccccggcgtgggtacatatgatgactttcacacaattgactgggtcagggagaaatgcaaagatagggagaggcacaggcggatcaatagcaagaagaaagagagtgcctgggagatgaccaagagcctgtatgacgcctggagcggatggctcgtggttactctaaccggcctggcctcgggcgcattggccgggctgatcgatattgccgccgattggatgaccgacctgaaggagggtatctgtttatccgcgctgtggtacaaccatgaacagtgctgctgggggagcaacgaaaccaccttcgaggagagagataagtgtccacagtggaagacctgggcagagctcatcatcggccaagcggaaggacctggttcgtacatcatgaattacattatgtatatattctgggctctttctttcgcttttcttgcggtgagcctcgttaaagtatttgccccatatgcgtgcggctcgggaattcccgagatcaagaccattctttcaggctttattatcagggggtacctcgggaagtggaccctcatgatcaagacaattaccctggtactcgccgtcgctagcgggctgtctcttggcaaggagggacctctggttcatgtggcatgctgttgtggaaacatcttttcctatctatttccaaaatacagcaccaatgaagccaagaagcgggaagtcttgagcgcggcttcagctgccggggtgtcagtagcctttggcgcgcccattggaggagtactttttagcctggaagaggtcagttactatttccctctgaaaactctctggcggtctttctttgcggccctggtagcggccttcgtgcttcgctccataaatcctttcgggaacagcagacttgtgcttttctacgtggagtaccacactccctggtatttgtttgagttatttccttttatcctgttgggagtgttcggtggactatggggggcattctttattcgggctaatattgcttggtgtaggcgacggaaatcaaccaaattcggtaagtatcccgtactcgaagtaattatcgttgcagcgataacagcagtgatcgccttccctaacccttatacccgtttaaataccagcgaactcatcaaagagctatttacggactgcgggcccctcgaatcctctagcttgtgcgactatcgaaacgatatgaacgcgagcaagatagttgacgacattcctgaccgccccgctgggattggcgtttattccgcgatctggcagctgtgcttagctctgatcttcaaaatcatcatgacggtcttcactttcggcataaaggttccctcaggtctcttcattcctagcatggcaatcggggctattgccggaagaatagtgggcattgcagtggaacagctggcttactatcaccacgattggtttatctttaaggagtggtgtgaagttggcgcagattgtattacccctggactgtatgccatggtgggcgccgccgcatgtctcggaggagtgacgagaatgaccgtatccctggtcgtgatagtttttgagctgaccggcgggctggagtatatcgtgccccttatggctgctgtgatgactagcaaatgggttggggatgcttttggaagagagggcatctatgaagctcacatacggctgaatggctacccatttctggacgccaaggaagagtttacccacaccaccctggccgcggatgtgatgaggccaaggaggaacgacccccctctggccgtcttgactcaggataatatgacagttgacgatatcgaaaacatgattaacgaaaccagttacaacggatttccagttatcatgtctaaggaatctcagagattagtcgggtttgccctgagacgcgacttgacgattgctattgaatccgcaagaaagaaacaggagggaatagtgggatctagccgcgtgtgcttcgcacagcataccccgagcttgcctgccgaatcaccccgccccctgaagctgagatctattctcgacatgtcgccattcaccgttaccgaccacacccctatggaaattgttgtcgatatctttcggaagctggggctgagacagtgtttggtcactcacaacggacggttgttagggatcatcaccaagaaggatatactgaggcatatggcccagactgccaaccaggaccctgcttccattatgtttaactag

SEQ ID NO: 111945 - DNA, 576 bp, Artificial Sequence
  Description of Artificial Sequence: Synthetic coding sequence
atggagtccgagcagctgttccaccggggctattaccgcaatagttacaatagtattaccagtgccagttcagacgaagaacttcttgacggtgcaggtgtgatcatggactttcagacctctgaggacgacaacttgctcgatggcgatactgctgtaggcactcactacacaatgactaacggaggaagcatcaactcaagcacccacttgttggacttgctggatgagccaatcccgggggttggcacctatgacgacttccacacaatagattgggtgcgcgagaaatgcaaggacagagagcgccacaggcgtataaactcaaagaaaaaggaatctgcatgggaaatgaccaagagcctttacgatgcttggtcgggctggttggttgttacactgacgggactcgcttccggagcgcttgccgggctcatagatatcgccgccgattggatgactgatctcaaggaagggatttgccttagcgccctgtggtacaaccacgaacaatgttgctgggggtcaaacgaaaccacattcgaaaaaaagaagaaaaaaaaaaaaaaagcatag

SEQ ID NO: 111946 - DNA, 2190 bp, Artificial Sequence
  Description of Artificial Sequence: Synthetic coding sequence
atggtcaacgcaggagcgatgagcggatctggaaacctgatggacttcctcgacgaaccttttcctgacgtgggcacatatgaggacttccataccatcgactggcttcgggaaaagagccgggataccgaccgacatcggaagatcacttcaaaatcaaaggagtccatctgggagttcattaagtcgctgttggacgcctggtccgggtgggtagtgatgctgcttatcggattactggcggggactttggccggggtgatcgacctagccgtggactggatgacagatctgaaggaaggggtatgcctgtccgcattttggtacagccacgaacagtgctgttggacatcaaatgagacaactttcgaggatcgagacaagtgtcctctctggcaaaagtggtctgaattgttggttaaccagtcagagggcgcctctgcttacatactgaactatctgatgtatatcttatgggccctgctctttgcgttcctagcagtctcactcgtccgggtatttgcaccatacgcttgtggatctggaatccccgagatcaagaccattctctccggcttcatcattcgtggctacctgggcaagtggactctacttataaagaccgttacgctggttttggtggtgtcaagcggattatccttagggaaggaaggcccactggtgcacgtcgcctgttgctgtgggaacttctttagcagcctgtttagcaagtactcaaagaacgaaggtaagcgcagggaggtcttgtcagccgcggcagctgccggcgttagtgttgcatttggcgccccaatcggcggagtgcttttctcccttgaagaggtctcatattactttccattaaaaaccctgtggcgctcttttttcgcggcacttgtggcggcattcacgttgcgctcaatcaatcccttcggcaatagtcgtttggtgttgttttacgtggaatatcataccccatggcgtagaaagaccacaaggctgggtaaatatcctgtattggaggtcatcgtagttactgccatcacagccatcattgcgtatcccaacccttatacgagacagtctaccagcgagctgatcagcgagttgtttaacgattgtggagcccttgagagctcccagctttgcgactacattaacgaccccaatatgaccagacccgtggatgatatcccagacaggcccgctggggtgggcgtttacacagccatgtggcagctggccctggccctgatattcaaaattgtggtgactatttttaccttcggaatgaaaattcccagcgggctgtttatcccatccatggccgtgggtgctattgccgggcgaatggtggggattggcgtggagcagctggcctaccatcatcatgactggataatctttcgcaactggtgtcgtcccggtgctgactgcgtgacgcctggactttatgcaatggtcggtgctgccgcgtgtttaggcggcgttaccaggatgacagtctccctcgtggtgattatgttcgaactgactggaggcctcgagtatattgtgcctctgatggctgctgcagtgacgagcaaatgggtcgccgatgccttcggaaaagaaggaatttacgaagctcatatacacctcaatggctacccatttttagatgtgaaagatgagttcacgcataggacactggctaccgatgtgatgcgaccccggcgtggcgagcctccgttatcggtcctgacccaagacagcatgacggtggaggatgtcgagactcttattaaggagacggactataatggatttccggtcgtagtgagccgggattctgagcgcctgatcgggttcgcgcagcggagggagctgattcttgctattaaaaacgctaggcagcgtcaagagggtatagtctctaattccataatgtattttaccgaagagcctcccgagctgcctgctaattctcctcacccgttgaagttgcggcgcatccttaacctgtctcctttcacagttactgaccacacacctatggaaactgtggtcgacatttttaggaagctcggcctgaggcagtgccttgtgacacgatctgggcgactgctggggatcataactaagaaagacgtgttgagacatatggcccagatggcgaatcaggaccccgagtccataatgtttaactag

SEQ ID NO: 111947 - DNA, 2283 bp, Artificial Sequence
  Description of Artificial Sequence: Synthetic coding sequence
atggtgaacgcgggcgccatgtcgggatctggcaatctgatggactttctcgatgaacctttccctgatgttgggacctacgaggacttccacacaatcgactggcttcgcgaaaaatccagggataccgaccggcatcgcaagatcacttcaaagagcaaagagagcatttgggaatttataaagagcctgcttgacgcgtggagcggatgggtagtcatgcttctcatcggcctcctcgctggaacattagccggagtgatcgatctggctgtggattggatgactgatctcaaggaaggagtatgcttatctgcattttggtatagtcacgaacagtgttgttggacgtctaatgagaccacctttgaagatagggacaaatgcccactttggcagaagtggagcgaacttctggtaaatcagtccgagggggccagtgcctacattttgaactatctcatgtatatcttgtgggctttactgtttgctttcctcgccgtgagtttagtaagagtgttcgccccttacgcatgtgggagcgggattcccgagatcaaaactatcctgtctggtttcattatcaggggttacctaggaaagtggaccctgctcatcaagaccgtgacactggtacttgtcgtgagcagcggtctctccctagggaaagagggacctctggtccacgtggcctgctgctgcggaaattttttctcaagtcttttctcgaaatactcaaaaaatgaggggaagcggcgtgaagtactttctgccgctgcagctgccggtgtttccgtcgcttttggggcccccatcggcggcgttctgtttagtctcgaagaggtcagctactactttccactgaagactctatggcggtctttctttgctgcattggtcgctgcattcaccctcaggagcatcaacccatttgggaattcccgcttggtgcttttctatgtggaatatcacactccatggtacatggcagagcttttcccattcatcctactgggtgtgttcgggggcctgtggggcacgcttttcattagatgcaatattgcatggtgtcgtcggcggaagactacccgcctgggcaaatatccagtcctggaagttattgtcgtgaccgccatcaccgccatcattgcatacccaaatccatacacgagacagtctacttccgagctgatctcagagctgtttaacgattgcggggccctcgagtcctcccagctctgtgattatattaatgaccccaacatgacaaggccagtcgatgatatccccgaccgacccgcaggagtgggcgtgtataccgcgatgtggcagctagcccttgcgttgattttcaaaatcgtggtcacgatttttacttttgggatgaaaattcccagcgggctattcattccctctatggcagtgggcgcaatcgctggacgcatggtgggtattggggtggagcagctcgcttatcaccaccacgactggataatcttccggaactggtgtaggccaggcgcggactgtgtaactcccggactgtacgccatggttggggctgcagcctgtttaggaggcgtgacccggatgacggtgtctctagtggtaatcatgttcgagctgaccgggggactggagtacatagtgccccttatggcagcagctgttacttccaaatgggttgcagacgcattcggcaaggagggcatatatgaggctcatattcacctaaacggatacccctttttggacgtcaaagacgaatttacacatcgcactcttgctactgatgtgatgcgacccagacgcggcgaaccccctctcagtgtactgactcaggacagcatgaccgtcgaagatgtggaaaccctcattaaggagactgactacaacgggttccctgtcgtcgtgagtagggacagcgagcggctgattggttttgctcagcgccgggagctgattttggccatcaaaaacgcccgccaaagacaggaggggattgtttctaactcgatcatgtatttcacggaagagccgccagagttacctgctaatagccctcatccgctgaagttgaggcgaattcttaacttgtctccattcactgtaaccgatcatactccaatggaaacggtggtggacatctttagaaagttaggtctccgacagtgcctggtcactcggagcgggcgtctcctagggatcataaccaaaaaagacgtgttaagacacatggcgcagatggctaaccaggacccggaatccatcatgttcaactag

SEQ ID NO: 111948 - DNA, 2001 bp, Artificial Sequence
  Description of Artificial Sequence: Synthetic coding sequence
atgacagacttaaaggagggcgtatgtctgtccgctttctggtactcccatgagcaatgctgctggacctctaatgagaccaccttcgaggatcgggacaagtgtccgttatggcagaagtggtccgagctcctggtgaatcaatcagaaggcgcgtccgcctacattctgaactacctaatgtatatcctgtgggctttgctttttgcctttctggcggtgtcattggtgagggtgtttgccccatacgcctgcggctctggcattcccgagataaaaacaatccttagtggcttcattattcggggatatctggggaagtggacactgctgataaagaccgtgactctagttctggtggtctctagcggcttatccctcggcaaagagggtccattggtgcacgtcgcctgctgttgtggcaacttctttagctctctgttctcgaaatacagcaagaacgaagggaaacgcagggaggtgctgagcgctgccgccgccgcaggggtgtctgtagctttcggcgctccaattggcggtgtgctattcagccttgaagaagtgtcctactatttcccactgaaaactctttggagatctttcttcgccgctttggtcgcggcattcaccctgaggagcattaacccatttggaaactctcgcctggtccttttctatgtcgaatatcacactccctggtacatggccgaactgttcccttttatactgctgggtgtgttcgggggactgtgggggacacttttcatccggtgcaatatagcttggtgccggcggagaaaaacaacaagattggggaaatatcccgtgcttgaagttatcgtggtcactgccattaccgccatcattgcatatccaaacccatatacaagacagagtacaagcgagttaattagcgagttgttcaatgattgtggagctctggagtctagccagctgtgtgattacattaatgatcccaatatgactagacctgtggacgatatcccagatcgccctgccggagtgggcgtttataccgccatgtggcagctggctttggctctcatctttaaaattgtagtaacgatattcaccttcggaatgaagatcccctccggcctatttatcccatcaatggctgtgggggcaattgcaggccggatggtggggatcggcgtggaacaacttgcctaccaccatcatgactggatcatatttcggaattggtgccggccaggcgcggactgcgttaccccaggactttatgccatggtgggcgccgcagcttgcctgggcggagtgactcgcatgaccgtcagtctcgtcgtcatcatgttcgaattaaccggtggcctggagtatattgttcccttgatggcagctgccgtgactagcaagtgggtggcggacgcctttgggaaggaaggtatctacgaagcgcacattcacctgaacggttacccttttctcgacgtgaaagatgagttcacccaccggaccctcgctaccgatgtcatgaggccccggcggggcgaacccccactgtcagttctcacccaggactctatgaccgtcgaagacgttgagactctcatcaaagaaaccgactataatggatttcctgttgtcgtcagccgagattctgagcgtttgatcggctttgcccaacgccgagaactcattttggccatcaagaatgcgagacagcgccaggaaggtatcgtctctaactctattatgtacttcacggaggagcctccggagcttcccgccaattctccccacccattgaagttgcgcaggatcctcaacctgagccccttcaccgtcaccgatcatactccaatggaaaccgttgtggatatctttcgcaaactggggctccggcagtgcttggtcacgaggagcggaagactactgggcatcatcacaaaaaaggatgtgctccgtcatatggcgcaaatggccaatcaggatccggaaagtataatgttcaattag

SEQ ID NO: 111949 - DNA, 459 bp, Artificial Sequence
  Description of Artificial Sequence: Synthetic coding sequence
atggtgaatgcgggggcaatgagcggcagcgggaatcttatggattttctggacgaaccattcccagatgtagggacatatgaagattttcatacaatcgattggctgagggagaaaagcagagataccgatagacacaggaagatcacttccaagtcgaaggagtccatttgggagtttattaaaagtcttctagacgcgtggagtggctgggtcgtcatgctgctaattgggctgctagcgggtaccctcgcgggagtaatcgatctggccgtggactggatgactgatctgaaggaaggagtgtgcctgagtgctttctggtactcgcatgagcaatgctgctggacaagtaatgagactacatttgaagaccgagacaagtgccctctttggcagaagtggagcgagcttctggtcaaccaatcagaagtgctgtcagccgccgcagctgcctag

SEQ ID NO: 111950 - DNA, 2241 bp, Artificial Sequence
  Description of Artificial Sequence: Synthetic coding sequence
atggactttctggaggagcctatacccggcgtcggtacctatgatgattttaatactatagactgggtgagagagaagtctagggaccgagatcgccaccgcgagattactaataagtcaaaggaaagtacttgggctctcattcattccgtgtcggatgctttcagtggctggctgctcatgttgttgataggcctactgtctgggtctttggcgggcttgatcgacatctcggcacattggatgactgatttgaaagagggtatctgcaccgggggcttttggttcaatcacgagcattgttgttggaatagcgagcacgtcaccttcgaagagcgggacaagtgtccggaatggaactcctggtcccagctgatcatttcaactgacgagggggccttcgcatacatagtgaattacttcatgtacgtgctttgggccctcctgtttgccttcttggcggtctctctggtgaaagtattcgctccgtacgcatgtggctccgggatccccgaaattaaaacaattttgtcaggtttcatcatccgtggttacctgggcaagtggaccctagtgattaagaccatcaccctcgtgcttgctgtgagttcaggcctctccctggggaaagaaggccccctcgtccacgtggcctgttgctgtggtaatattctgtgccactgttttaataagtataggaagaacgaagccaagagaagggaggtattgagtgccgcagctgccgctggagtgtctgtggcctttggcgccccaatagggggagtcctgtttagcctagaggaggtgagttactactttccactgaaaactctgtggagatcattcttcgccgcactcgtagccgcctttactctgaggtctattaatcccttcggaaattcgcggctggttctgttctatgtcgaattccatacgccgtggcatcttttcgaactggtgccatttattctgctgggaatcttcggtgggctttggggcgccctgttcatcaggactaatattgcttggtgtcgcaaacgcaaaactacccaattaggcaaatatcccgtcattgaagtgttagttgtcacggcgattaccgcgatcctggcattccccaacgagtatacacgaatgtccacttcagaactcatctcggaacttttcaacgattgtggacttctcgattcatccaaactgtgtgactatgaaaatcggtttaatactagcaagggcggtgaactgccagacagacccgctggcgtaggcgtctacagcgctatgtggcagttggccctcaccctgattctgaagattgtaatcaccatcttcactttcgggatgaaaattccatcgggtctgtttattccttcaatggccgtgggggcaatagccggcaggctgctgggcgtagggatggaacagctggcttactaccatcaagaatggacagttttcaatagctggtgcagccaaggagcagattgtattactcctggcctttacgctatggtgggcgcagctgcctgcctgggaggagtgacacggatgaccgtgagccttgtagtcattatgtttgagctgactggtgggcttgagtatatcgtgcctcttatggctgctgccatgacctcaaagtgggtcgcggatgcactgggccgcgaagggatctatgatgcacatatccgtttgaacgggtacccattcctggaggcgaaggaggagttcgcccataagacactggccatggatgtgatgaagcccaggcggaatgacccactacttacagtcttaactcaagattctatgaccgttgaggacgttgaaaccatcatctccgaaactacctattcaggtttccctgttgtggtctccagggagtcccagcgactcgttggctttgttctgagacgggatcttattatctccatcgagaatgcccgaaaaaaacaggatggggtagtgagtacatcaattatttacttcacagagcattctccccccctgcccccctatacgccgcctactctcaagctgcggaatatcctggacctgtccccttttactgttactgacctcacacccatggagatagtcgttgatatctttcggaaactggggctgcggcagtgcctggtgacccacaatggacgcctactcgggatcataaccaaaaaagacgtactaaaacacatcgcacagatggccaatcaggaccccgacagtatcctgtttaattag

SEQ ID NO: 111951 - DNA, 2451 bp, Artificial Sequence
  Description of Artificial Sequence: Synthetic coding sequence
atggctatgtggcaaggagcaatggacaataggggtttccagcaggggtccttcagtagcttccagaacagcagtagcgatgaagacctgatggatattccagctaccgctatggatttttcaatgcgagatgatgtaccccccttagaccgcgaggtgggcgaagacaagtcatacaacgggggtgggatcgggtcaagtaataggattatggattttctcgaagagccgattcctggcgtggggacctatgacgactttaatactattgattgggtgagagagaagtcgcgggatagggatcgccaccgcgaaattactaacaaaagcaaggaaagcacttgggcactgatccatagtgttagtgacgcgttctcaggttggctgttgatgctcctcattggcctcctgtcaggctcgttggcaggtctgatcgacatcagcgcacactggatgaccgacttgaaggaggggatttgcaccggaggtttctggtttaatcacgagcattgctgttggaacagcgaacacgtcactttcgaagagagggacaaatgtccagagtggaattcgtggtcccagctgataattagtacagatgagggtgcatttgcctacatcgtgaattattttatgtatgtgctgtgggctcttctattcgcttttttagccgtctccctggtgaaggtgttcgccccgtatgcttgtgggtctggcattccggaaataaagacgattctgtcaggattcattatccgcggttacctgggcaagtggaccttggtcataaagacaattacactagtattggcagtgtcgagcggcctgagcctcggaaaggaggggcccctcgtccatgtcgcctgttgttgtgggaacatcctgtgccactgcttcaacaagtatcgaaaaaatgaagctaagcggcgcgaggttctgtctgccgccgcggccgccggcgtgtcggtcgcctttggcgcacccatcggtggtgtactgttctccctggaagaggtgtcctattactttcctctgaagaccctttggcgctcattttttgctgcccttgttgccgcctttacccttagatctatcaacccgttcggaaactcccgccttgtcctattctacgtggaatttcataccccttggcacctctttgagctggtaccatttattctgctcgggatcttcggcggtctatggggcgctcttttcatccggacaaatatcgcatggtgtagaaagcggaaaaccactcagttagggaagtaccctgtgatcgaagttctggtagtgacggctatcactgcgattttggccttccccaacgaatacacccgtatgagcacatccgagctcatttccgagctctttaacgattgcggtctacttgactcgagtaaattgtgcgactatgagaatcgtttcaacacatccaaagggggagagctccctgataggccagcgggtgttggggtgtattctgcaatgtggcagctcgcacttaccctgatcctgaaaattgtgataaccatttttacattcggaatgaaaatcccgtcaggtcttttcatacccagtatggctgttggggccatcgctggccgccttttaggcgtggggatggagcagttggcatattatcaccaagaatggacagtcttcaattcttggtgtagtcagggggcggattgcatcacacctggtctctatgcaatggtgggtgcagcagcttgtctggggggcgtgacaagaatgaccgtcagtctggtggtgataatgttcgaattaacaggcggactggaatatatcgtgccactgatggcggccgccatgacaagtaaatgggtggctgatgctctgggacgggagggtatctatgacgcgcacatacgcctgaatgggtatccatttctggaggccaaggaggagtttgcccacaagactctggcgatggatgtcatgaaacctcgacgtaacgacccactattgacagtgctgacccaggatagtatgaccgttgaagacgtggagacgattatctctgagactacttacagcggctttcccgtggtcgtgtcccgtgagtctcagaggctcgtggggttcgtactcaggagggatctcatcatttcgatcgagaatgctaggaagaaacaggacggtgttgtgtccacctcaatcatatattttaccgagcactcgccccctctgccgccctatacccccccaacgctgaaactcaggaacatcctggacctgtccccgtttaccgtgactgatttgacacccatggagattgtggtggacattttcagaaaactagggttacgccagtgtctagtgacccataatggtaggctgctgggcattattaccaagaaggatgtgttaaaacatatcgcgcagatggctaaccaggatcccgactctatcttattcaattag

SEQ ID NO: 111952 - DNA, 2451 bp, Artificial Sequence
  Description of Artificial Sequence: Synthetic coding sequence
atggccatgtggcagggcgccatggataaccgcggctttcagcagggcagtttctctagctttcagaacagctctagcgacgaagacttaatggacattcctgcaacagcgatggatttctccatgcgcgatgatgtgccccccctggatcgcgaagtgggggaggataagtcctacaatggcggaggtatcggttctagtaatagaattatggattttctagaggaaccgattccaggggtgggtacatacgacgactttaacacaattgattgggtgcgtgaaaaaagtcgggatagagatagacatcgcgagattaccaataaaagcaaagagtccacatgggccctcattcattcagtgtctgacgctttttcgggatggcttctgatgcttctcatcgggttgctgagtggttccctggccgggctcatagatatttcagcacactggatgacagacttaaaagagggcatctgcaccggcggcttctggtttaaccatgagcattgttgctggaactccgaacacgtaaccttcgaggaaagagataaatgtccagagtggaactcttggtcgcagctgatcattagcaccgatgaaggtgcctttgcctatattgtcaattattttatgtacgtcctgtgggccctgctattcgcattcttggcagtttccctcgtcaaggtgttcgcgccctatgcctgcgggtcaggtattcctgaaattaaaactattttgtccggattcataataagggggtatctcgggaagtggactctggtcattaagacaatcaccctggtgctcgcagtgtcctccgggctgtcgttgggcaaggaggggcccctggtccacgtggcatgttgttgtggtaacatcctctgccattgctttaataagtatagaaagaacgaggccaagaggcgggaagtgctcagtgcagcagccgctgctggagttagcgtggcattcggagccccaattggcggagtgcttttttccttggaggaggtgagctactatttcccactgaaaactttatggcgatccttcttcgcagcactcgttgccgctttcacattgcgatccatcaatccattcggaaattcacgcttagttctcttctacgtggaatttcatacaccttggcacctgttcgaactggtgcctttcatactgctggggatcttcgggggcttatggggcgccctcttcatcaggacgaacatagcatggtgccgaaaacggaagaccacacaattgggaaagtatcctgtcatcgaagttctagtggtaaccgctattactgctattcttgccttccccaacgaatatactcgtatgtctacaagcgagctcatctccgagctgtttaacgactgtggcctgctggacagcagcaagctgtgcgactacgaaaaccgcttcaatacctcgaagggcggagaactgccggacaggcccgcaggagtgggagtatactcggcaatgtggcagcttgccctgacccttatcctgaagattgtcatcacaatttttacatttggcatgaaaatcccttccggcctctttattcccagtatggccgtgggtgccattgccggccgcttgctcggggtaggcatggaacagctagcgtactaccatcaggagtggactgttttcaattcatggtgcagccagggagctgattgcattacccccggactttacgctatggtcggggccgccgcatgtctaggaggggtaaccaggatgactgtgtctttggtggtgattatgtttgaactaactgggggactcgagtacatcgttccgctcatggccgccgcgatgacttccaaatgggtggctgatgcgttgggaagagagggaatttatgacgcacacataaggcttaacggctatccgtttttggaggcaaaagaggaattcgcccacaagacactggcaatggacgtcatgaagccgcgaaggaacgatcccctgctgacagtcttgacacaggatagtatgactgttgaagatgtggagacaatcatcagcgagaccacctattccggcttcccggtggtggtgagccgagaaagtcagaggctcgttgggtttgttttacggcgcgacttaattatcagcatcgagaatgctcggaagaagcaagacggcgttgtgtccaccagcatcatttactttacggaacactcccccccactacctccttatacacctccaacactcaaacttaggaacatactcgatctctccccatttaccgtgacggacctgacacccatggaaattgtcgttgatattttcagaaagctcggactgaggcagtgtctggtgacacataacggtcggctgttgggtattattaccaagaaggatgtgctgaaacacattgcccagatggcaaaccaggacccagattcgatactctttaactag

SEQ ID NO: 111953 - DNA, 2241 bp, Artificial Sequence
  Description of Artificial Sequence: Synthetic coding sequence
atggacttcctagaggaacctattcctggtgtgggaacttacgacgacttcaacaccatcgattgggttcgggaaaaatcccgggacagagacaggcatcgggagatcacaaataaatccaaagagtcgacttgggccttgattcattcggtgagcgacgccttttccggctggctgcttatgttgctcatcgggctgctaagtggatccctggctggcctaatagatatttcagcccattggatgacagatttgaaggagggtatctgcactggagggttttggttcaaccacgagcattgctgttggaacagcgagcatgtcacatttgaagaaagggacaagtgcccggagtggaatagctggagtcagcttatcatctccacagacgagggagcattcgcctacatcgtgaactattttatgtatgtgttatgggccctactatttgcttttcttgccgtttcactcgtgaaagtctttgcaccttacgcctgcggtagcggcatcccggagataaagacgatcctctctgggtttataattcggggatacctgggcaaatggaccttagtaattaaaactatcaccctggtgcttgctgtctcatcgggcttatcactgggcaaggagggacccttggtgcacgtcgcgtgttgctgcggcaatatattgtgccactgttttaacaaatatagaaagaatgaggcaaaacggagggaagtgctcagtgctgcagccgccgcaggtgtctctgtggccttcggcgcgccaattggaggagtgctcttctccttggaggaggtttcctactattttccccttaaaactctctggcgatccttctttgctgccttggtggctgcctttacccttcgctccataaacccctttggcaattcacgcctagttctgttctacgtggagttccataccccgtggcacctttttgaactcgtgccattcatcctgcttggcatcttcgggggcctgtggggagctctgtttatccgtacaaacatcgcttggtgtcggaaaagaaagactacccagctaggaaagtacccagtgatcgaagtgctggtggtgacggccattaccgccattctcgctttcccaaacgagtatacacgtatgtccacatcggaactgatttccgagctctttaacgattgtggactcctcgacagttccaaactttgtgactacgagaaccggtttaatacttcaaaaggaggagagctgcccgaccggccggcgggagttggtgtgtacagcgctatgtggcagctggccctgaccttgatcctgaagatcgtgatcaccatttttacttttgggatgaagatcccttccggtctttttataccctctatggctgtgggtgccattgccggacgactcctgggcgtgggtatggagcagctggcatactatcatcaagaatggacggtcttcaattcctggtgcagtcagggagccgattgcataacacctggattatacgctatggtcggagcagccgcgtgcttagggggagtcacacggatgacagtgtcattggtggtgatcatgttcgagttgaccgggggcttagaatatattgtgcccctgatggccgctgccatgacatccaaatgggttgcagatgccttaggaagggaagggatttacgacgctcatattaggctgaacggctacccgtttcttgaggcaaaagaggagtttgcgcacaaaacattggccatggatgtaatgaaacctagacgtaatgacccactcttaactgtattgacacaggattcgatgacagtggaggatgtggagactatcatttcagagacaacttactctggatttcctgtagtcgtaagcagagaaagtcagcggttggtgggctttgtgctgcggcgggatcttatcatctcaattgagaacgcccggaagaaacaagacggagtcgtgagtacatccattatttatttcacagagcacagcccacccctccctccctacaccccacccacattgaaactccggaacatcctggacctaagtccatttacagtcactgacctaacacctatggaaatcgtggtggatatttttcgcaagcttggactccgacagtgccttgttactcacaacgggaggttactcggcattataaccaaaaaggacgtgctcaaacacattgcgcaaatggcaaatcaagaccctgacagcattctgtttaattag

SEQ ID NO: 111954 - DNA, 1947 bp, Artificial Sequence
  Description of Artificial Sequence: Synthetic coding sequence
atgaatatcgtggctggtactttatccatgtctccccttaaaagggacaagtgccccgagtggaacagttggtcacagctcattatatctactgacgaaggtgccttcgcgtacatagtcaactacttcatgtatgtgctgtgggcccttctgtttgccttcctggctgtttcactcgtcaaggtctttgcaccctatgcctgtgggtccggaatccccgagatcaaaaccatactttccgggttcatcatcagagggtatttgggtaaatggaccctggtgattaaaaccattacgctggtgctggctgtgtccagcggactgtccctgggcaaagagggccccctggtacatgtggcctgctgctgtggcaacatcttatgtcactgtttcaacaaatatcgcaagaatgaggcgaagcgtagggaagtgttgtctgccgccgcagccgcaggggtgtccgtagcatttggcgctccgatcgggggcgtcctttttagtttagaggaggtgtcatactactttcctttgaagaccctctggcggagtttctttgccgccttggtcgccgcatttacactgaggtccattaatccattcggcaattctcgccttgtgcttttctatgtcgaatttcatactccttggcacctattcgagctagtcccattcattctcctgggcattttcgggggactgtggggtgctttattcattcgcacgaatattgcgtggtgccgaaagaggaaaacaactcagctgggtaaataccctgtgattgaagttctggtggtaacagccatcaccgcgatcctggcattcccaaatgagtatactcggatgtcgacaagtgagttgataagcgaactgttcaacgactgtggactactggacagcagcaaactatgcgattacgagaacaggttcaatacgagtaagggcggggagctgcctgaccgacctgctggagtgggagtgtacagtgctatgtggcagttggctcttacactcatcttgaagatagtcatcactatcttcacatttggcatgaagataccttccgggctgttcataccgtccatggccgtcggggcaattgctggtcgactgttgggtgtggggatggaacaactagcctactaccatcaggagtggaccgtatttaactcttggtgctcacagggagccgactgcattaccccagggctgtacgccatggtcggcgccgccgcttgcttgggcggagtgactaggatgacagtgagcctggttgtcattatgtttgagctaacaggtggcctggaatacatcgtgcctctgatggccgcagccatgactagtaagtgggtcgccgacgcactgggtcgcgagggaatctacgacgcccacattagactgaacggttatccattcttagaagccaaggaagaattcgctcacaagactctggcaatggacgtcatgaagccccgacgcaatgaccccctcctgacagtcctaacccaggattctatgacagttgaggatgtagagacaatcatctcagaaaccacctactcaggatttcccgtagtggtatcacgcgagagccaaagactggtgggctttgtcctccggcgagacctaattatctctattgagaacgcaaggaaaaagcaggacggcgtggtatccacaagtattatttactttactgagcattctcctcccctgcccccatacacccccccgactttgaaactgcggaatattctcgacttaagccctttcacagtgacggatttaacacccatggaaattgtggttgacatcttccggaaactgggccttcgccaatgcctggtgacccacaacggtagactgctgggcattatcacgaaaaaagatgtgctaaaacacattgcccaaatggccaaccaggatccagattctatcttgtttaattag

SEQ ID NO: 111955 - DNA, 1062 bp, Artificial Sequence
  Description of Artificial Sequence: Synthetic coding sequence
atggctggttgccgtggtagtttatgctgctgttgtcggtggtgctgctgctgtggggagcgagagactcggacccccgaagaattaacgatcctgggcgagacccaggaagaagaggatgagattctgccacgcaaagattacgagagtcttgactacgacaggtgcatcaacgatccctatcttgaggtgttggaaactatggacaataagaagggtcgccggtatgaagcggtgaagtggatggtggtctttgccattggggtctgcacaggattggtggggctcttcgtggattttttcgtcaggctttttactcagctcaaatttggcgtggtgcaaacctccgttgaagagtgctctcagaagggatgcctagctctctctctgctggagctgctcggattcaatctcaccttcgtgtttctcgcaagcctgctagttttaatcgaacctgtcgcagcaggcagtgggatccccgaggtgaaatgttatctaaatggtgtgaaggtacccgggatcgtgcggctgcgtacgctgttatgtaaagtactgggggttttgttttctgtggctggtggcctgttcgtggagaaggaaggccctatgatacactcaggatccgtcgtaggcgctggtctgccacagtttcagagcatttctctgcggaagatccagttcaactttccgtactttcgctctgaccgggacaaacgcgattttgtctctgctggtgctgctgctggggtggcagccgcctttggtgcaccaataggaggaactctgttctcactcgaagaaggcagttcattctggaaccagggattaacatggaaggtgctgttttgttcaatgtctgccactttcaccttgaatttttttagatctggaattcagttcggatcctggggaagttttcagctgccaggtttacttaatttcggggagttcaaaagcctgcgggagcctccttgcgtctctggcaatcaccggggaggcgtgtgcggacttgacggagtcagaaggatgcctactgatgtgctgtttgaatctaacaggtag

SEQ ID NO: 111956 - DNA, 2610 bp, Artificial Sequence
  Description of Artificial Sequence: Synthetic coding sequence
atggccggttgcaggggaagtctctgttgttgctgcagatggtgctgctgttgcggggagcgtgagaccaggacacccgaggaattgaccattcttggtgaaacgcaggaggaagaggatgaaatcctgccgcgtaaggactacgaaagtctggattacgatcgttgtatcaacgatccctatcttgaagtcctggagaccatggataacaagaaaggcaggagatatgaggccgtaaaatggatggtcgtctttgctatcggcgtatgcaccggcctggtgggcctgttcgtcgacttttttgtgcggctgttcacacagttgaaatttggcgtcgtgcagacctcagtggaagagtgctcccagaaaggctgtctcgcactgagtctcctggagctgctagggtttaatcttaccttcgttttcttagccagcctgcttgtgctgatcgagcccgtggctgcaggttccgggatcccagaagtgaaatgttacttaaacggagtgaaggtgcctgggatcgtaagattgcggactcttctgtgcaaagtgctcggagttctattttcagtggcaggcggattgttcgtcgagaaggaagggcctatgattcactctgggagcgtagtcggtgcaggcctgcctcagtttcaatcaatttccctgagaaaaatccagttcaatttcccttactttcgttctgacagagataaacgtgatttcgtttccgcgggagctgccgctggggtcgcagctgcgttcggcgcacctatcggaggaaccctattcagcctcgaggaaggttcttctttctggaaccaaggccttacttggaaagtgctcttctgttcaatgtcagcaacgtttaccctgaatttttttagatccgggatacagttcggttcttggggctccttccagctccctggcctgctgaactttggagagttcaaatgcagcgatagcgacaaaaagtgccacctgtggaccgcgatggacctcggtttcttcgttgtgatgggggtgatcgggggattgctgggagcgaccttcaactgccttaacaagagactggcaaagtacaggatgagaaacgtgcatcctaaacctaagctggttcgggtgttagagagcctgctggtttctctcgttaccacagttgtggtgtttgtggccagtatggtactgggcgaatgtagacaaatgagctcatcttcacaaattgggaatgacagcttccaactgcaggtgaccgaagacgtcaattcaagcattaagacattcttctgccccaacgacacctataacgatatggctactctgtttttcaacccgcaagagtccgcgatactgcagctgtttcaccaagatgggacattttcccccgtcacacttgcactgttctttgtcctctactttctgttagcttgctggacatatggcatctccgttccgagcggactttttgtgccaagcttgctctgtggggcagcatttggcagactggtcgctaacgtgcttaagagttacatcggcctggggcacatttactccggcacttttgctctgatcggagctgctgcttttctcgggggggtggtaaggatgaccatttcactcacagtgatcctaatagaatccaccaacgagattacttatgggctgcccattatggtgactctaatggtagctaagtggacaggggatttcttcaacaagggaatatatgatatccatgtgggcttgcgtggagtacccctcttggagtgggagaccgaggtcgaaatggacaagctcagagccagtgacattatggagcccaacttaacatacgtgtatccacacacaagaatccaaagtttagtctccatcctaagaaccactgtgcaccatgcattccccgtagttaccgaaaatcgcgggaacgaaaaggagttcatgaaagggaatcagctgatttccaacaatattaagttcaaaaaaagttccatactgacacgcgccggcgagcagcgcaagcgctcgcagtccatgaaatcctaccccagttcggagctccgcaatatgtgcgacgagcatattgcctctgaggagccggccgagaaggaggacctgttacagcagatgctcgagcgtaggtacacaccttatcctaacttgtatccggaccagtccccttctgaagactggaccatggaggaaaggtttcggccccttacattccacggcttgattttgcggtctcaattggtgactctgctggtgaggggggtgtgctacagcgagtcccaatcttccgcctcccagccgagactgagctatgctgaaatggcagaggattacccccggtatcctgacattcacgatctagacctgaccctgctaaacccaaggatgattgtggatgtaaccccatatatgaatcccagcccctttaccgtgtcaccaaacacccatgtctcccaagtttttaatctgtttagaaccatgggcctgaggcatctgccggtagtgaatgccgttggcgagattgtcggcatcataacacggcacaacctcacttatgaattcctgcaggcccgcttgaggcagcattatcaaactatctag

SEQ ID NO: 111957 - DNA, 2544 bp, Artificial Sequence
  Description of Artificial Sequence: Synthetic coding sequence
atggccggatgtcggggatcactgtgttgctgctgcagatggtgctgttgctgcggagagagggagacccggaccccagaagaactaacgatattgggcgaaactcaagaagaagaggatgagattctcccgcgtaaagactacgagaaggggcgaaggtacgaagccgtcaaatggatggtagtcttcgctatcggcgtctgtacaggtctcgtggggctgttcgtggatttctttgtccgtctatttacacagttgaagtttggcgttgtgcagacatccgtggaagaatgctcgcagaaaggttgtctcgctctcagccttctcgagttgctaggatttaatctcacattcgtttttctggccagcctgcttgtgctgattgaacctgtggcagccggcagcgggattcctgaggtcaaatgttacctcaacggcgtgaaggtgcccggtatcgtgaggctgcgtactttgctgtgcaaggttctcggtgtgctttttagcgtggccggtggactgttcgttgaaaaggagggacctatgatacatagtggatcagttgtgggagcaggccttccacaattccagagcatttccctgagaaagatccagtttaatttcccatatttcaggtcagatagggataagagagacttcgtgtcagctggcgccgctgctggagtagccgcagccttcggtgcccccatcggcggtactctgttcagcctggaggagggatcctccttctggaaccagggacttacttggaaagttctcttttgttcgatgtccgcaacatttacactaaactttttccgttctggtatccaattcggctcatggggctccttccagctgcccggcctgctcaatttcggagagtttaagtgtagtgactccgataaaaaatgtcatctgtggaccgccatggatctcggcttcttcgtggttatgggagtgatcggaggccttttgggagccacctttaactgcctgaataagcgtctcgctaagtatcggatgcgcaacgtccaccccaagccaaaattggttcgtgtgctggaatccctgctggtgtccctcgtaactaccgtggtggtgttcgttgcctccatggtgcttggcgagtgtagacagatgtcttccagcagtcaaattgggaatgacagctttcagcttcaggtgaccgaggacgtaaattcatcaattaaaactttcttctgccccaatgatacttataatgacatggctaccttgttttttaacccacaggagagcgccatcctgcagttgtttcaccaggatggtaccttcagtcccgtgacactggcactttttttcgtattatattttctcctggcctgttggacctatggcatttccgtgcccagtggcctgtttgtacccagcttgctctgtggtgctgcattcgggcgcttagtcgctaacgttttaaagtcgtatatcgggttaggccacatatacagtggcacattcgcccttatcggagccgccgcctttttggggggcgttgtccggatgacgattagcctgacagtcattctgatcgagagcactaacgagattacctacggactgcccataatggtaaccctgatggtggccaagtggactggggattttttcaacaaaggaatttatgatattcatgttggcctacggggggttcctcttcttgagtgggagaccgaagttgagatggataaacttagggcatccgacataatggagcctaatctgacttacgtgtaccctcacaccaggatccagtcactggtgagtattctgcgtactactgtccatcacgcattcccagtggttaccgagaacagggggaacgaaaaagagttcatgaaaggaaatcagttgatttcaaataatataaagttcaagaaatcaagtatcctgactcgggctggcgagcagaggaaaagatcacagtctatgaaaagctaccctagctccgagctgcgtaatatgtgcgacgagcacatagcaagtgaggagccagcggagaaggaagatttacttcagcagatgctcgagagacgctacacaccttacccgaatctctatcccgaccagtctccttccgaagactggacgatggaagaaagatttcggcccttgactttccacggattgattctgagaagtcagctggtgaccctgctcgtgcggggggtgtgttacagcgaaagccaatccagcgcttcacagcctaggttgtcttatgccgagatggcagaggattacccaaggtatccggacatccatgatctcgatttaaccctgctgaaccctagaatgatcgtggatgtgaccccttatatgaacccaagtccattcacagtatctcctaatacgcatgtgtctcaggtgttcaaccttttccgtactatgggcttaagacatctccctgtagtcaacgccgtaggcgaaattgtgggcattatcacgcgacataacctcacctatgaatttcttcaggccaggctgaggcaacattaccagactatttag

SEQ ID NO: 111958 - DNA, 963 bp, Artificial Sequence
  Description of Artificial Sequence: Synthetic coding sequence
atggcaggatgtcggggttcactttgctgttgttgccgctggtgttgttgctgtggtgaaagggagaccagaaccccagaggaactcacaattctgggcgagacccaggaggaagaggatgaaatattgccacggaaagattatgaatcattagattatgacagatgcatcaatgatccctacctggaagttctggagacgatggataataagaaggggagaaggtatgaggctgtaaagtggatggtcgtcttcgccattggcgtttgcactggcctggtggggttatttgtagacttcttcgtgcgactcttcactcagcttaagtttggagtcgtgcagacttctgtggaggaatgtagccagaaaggttgtctggctctgtcccttctcgagctcttaggattcaacctgacatttgtctttctggcgagtctgcttgtgctcatcgagcctgtggccgctggttccggaatccctgaggttaagtgctaccttaatggtgtgaaagtcccgggcatcgttcgattgagaaccctcctgtgcaaggtgttaggggtgctcttctctgtggcggggggcctttttgtcgaaaaggaagggccgatgatacactccggcagcgtcgtgggagccggactcccccagtttcaaagcatttcactgcggaaaatacaatttaattttccttatttcagatcggaccggtatggaaagcggcaggaacggttatgtataagtagaagtggctgctggtcttgctgttcttttcgcggtgccaatcggggatatcttgtgcaaagtagggggggctttgttttactggaaccacgtgctcacgtggagtctgcactgctctttcacgtctgtcatctccatcctcagcttctacctttttgggactcggtatggaagctcggctttctgcccgctccttggatcgccgagctgtggagggtgtag

SEQ ID NO: 111959 - DNA, 927 bp, Artificial Sequence
  Description of Artificial Sequence: Synthetic coding sequence
atggcagggtgtcgaggtagtctgtgctgctgctgtcgttggtgctgttgttgtggcgagcgcgaaacccgaacgcctgaggagctgactattctcggagagacgcaggaggaggaagacgagatcctgccccgtaaagactacgagtccttggattatgatcggtgtattaatgacccatatctcgaggtgttagagacgatggataacaagaaggggcggcgttatgaagccgtgaagtggatggtcgtctttgcaattggtgtatgtacagggctcgtcggcctctttgttgactttttcgtcaggctgtttacccaactcaaatttggcgtggtgcagaccagtgtggaggagtgctcacagaaaggttgcctagccttgtcactcctggagctgctcggcttcaatctgaccttcgtcttcctcgcgagcctgcttgtcttgatcgagcctgtggccgccggttctgggatcccagaagtgaaatgctatctgaatggagttaaagtaccaggtattgtgcggctcagaacccttctgtgcaaagtactaggtgtgttgtttagtgtggctgggggtctgttcgtggaaaaggagggaccgatgattcacagtggaagcgtcgtgggagccggactcccacagtttcagagtatttcgctgcggaagatccagtttaactttccctatttcagatccgacaggtcgggatgttggtcttgctgttccttccgcggtgcaaatcgcggctacctagtccaatcgcgtggaggatttgtcctcttggaaccgagagcgcatgtggaatcggcactccttttccatgtctgtcatctgcacccgcagcttctgcccttctgggattcggtttggaagctgggctttcttcctgctccgtggatcgccgagctctggagagtctag

SEQ ID NO: 111960 - DNA, 1062 bp, Artificial Sequence
  Description of Artificial Sequence: Synthetic coding sequence
atggcgggttgtcgaggaagcctgtgttgttgttgtaggtggtgctgttgctgcggcgagcgcgaaacccgcacccccgaagaactgacaattctcggggagacccaggaagaggaggatgagattttacctcggaaagactatgagtccctcgattacgaccgatgtataaacgacccctatcttgaagtgctggagacaatggataacaaaaagggccggcgttatgaggccgtaaaatggatggttgtgttcgcaataggggtctgcaccgggctggtgggcctgttcgtggactttttcgtgcgtctatttactcaattgaaatttggagtcgtccagacctcagtggaggagtgcagccagaaagggtgcctggccctttccttgctcgaactcctaggttttaacctcacctttgtctttctggcatcccttctagtactgatcgagccagtcgccgctggctcgggcatcccggaagtgaagtgttaccttaatggagtgaaggtgcctgggattgtgcgattaaggaccctcttgtgcaaagtgctaggggtattgttctcagttgcaggcggcctcttcgtcgagaaagagggccccatgattcacagtggttctgtagtcggtgcgggtctgccacagttccagagtatctctctgcggaagattcagtttaactttccatattttagaagcgaccgggataaaagagactttgtctccgctggtgccgcggctggagtggccgccgccttcggagctcccattggtggcacactcttttctcttgaagagggcagttctttttggaatcagggcctgacatggaaggtcttgttttgttcaatgtcggctaccttcacgctgaatttcttccgctccggcatccagtttggctcctggggtagttttcagctgccaggcctcctcaacttcggagagtttaagagcttgcgggagccaccctgtgtgtccggaaatcacagaggcggcgtgtgtggtctggacggagtcagaaggatgccaactgacgtcttgtttgaaagcaaccgctag

SEQ ID NO: 111961 - DNA, 2862 bp, Artificial Sequence
  Description of Artificial Sequence: Synthetic coding sequence
atggcagggtgccgaggatccttatgctgttgctgccgttggtgttgttgctgtggcgagcgcgaaacccgcacccccgaggaattgacaattctcggggaaacccaagaggaggaggacgaaatccttcccaggaaagattacgagagtctagattatgatcggtgtataaatgacccgtatctggaggtgctggaaactatggacaacaaaaaggggcgcagatacgaagcagtgaaatggatggtggtcttcgctattggcgtatgcactgggctggtaggtctcttcgtcgatttctttgtccggctcttcacccagcttaagtttggagtcgtgcaaactagcgtggaggagtgcagccagaaggggtgtctggccctgtcattgcttgagctgcttggctttaaccttactttcgtcttccttgccagtctgttagtcctcattgagcccgtggctgcaggttcagggatccccgaggtgaagtgctacctcaatggagtgaaagtgccaggaattgtccgcttgcgcacactcctgtgcaaggtactgggcgtccttttcagcgttgccggggggctttttgtcgagaaggaagggccaatgatacatagtggcagcgtagtaggagccggactccctcagtttcagagcatttccttaagaaaaatccagtttaacttcccgtacttccggtcagatagggacaaaagagactttgtaagcgccggggcagcagcaggggtggccgcagccttcggagcacccatcggcggtaccctgttcagcttggaggaaggttccagtttctggaatcagggcctcacctggaaggttttgttctgttccatgtcggccacttttaccctgaattttttcaggtcaggcattcagttcggctcttggggttcttttcagttgcccggacttctgaacttcggcgaatttaaatgctccgattcagataaaaaatgccacctctggacagcgatggatctggggttttttgttgtgatgggcgtgatcggaggcctgctaggggcaacttttaactgtctgaataagagactggccaagtacaggatgagaaacgtccaccctaaaccaaagctggtgagggtcctggagtcactgctggtcagtctggtgacgaccgtggtggtcttcgtagccagcatggtcctcggagaatgccgtcagatgtcctcttcctcgcagattgggaacgactcctttcagctgcaggtaaccgaagacgtgaattcttctataaaaacttttttctgtccgaacgacacctacaacgatatggccacactgtttttcaaccctcaggagtccgccattctgcaactcttccatcaagacgggaccttcagcccggtgaccctggccctcttctttgtactgtacttcctgctcgcttgctggacatacgggatctctgtcccctcagggttgttcgtcccctctttgttgtgcggcgctgcttttggccggctggtcgctaacgtacttaaaagctatattggtctggggcacatctactcaggaactttcgccctaatcggagcagccgcctttcttggtggagtagtccggatgaccatttctctgaccgtaatcctgatagagtcaacaaacgaaataacatacgggctgcccataatggtcacgctcatggttgcaaagtggacgggtgatttttttaataagggaatatacgatatccacgtcgggctacgaggcgtgccattgttagaatgggagacagaagtcgagatggacaaactgagggcaagtgatatcatggaacccaatctgacatatgtgtatccgcacaccaggatccagagtctggtcagcattctacgcaccacagtccaccacgcatttcctgttgtgaccgagaaccgaggcaacgagaaggaattcatgaagggcaatcaactgatcagcaacaacatcaagtttaaaaagtcgtccatcctcacccgcgctggcgaacagcgaaagcgctcccagagtatgaaatcttaccccagctctgaactccggaatatgtgcgacgagcatattgcatctgaggagcctgccgagaaagaggacctgttacagcagatgctcgaacgcaggtacactccttaccctaacctataccccgaccaatctcctagtgaggactggaccatggaggagcgcttccgcccactcacgtttcacggactgattctccgcagccaactcgtgaccctattggtgagaggggtgtgttactccgagagtcaatcctctgcaagtcagccaagattaagttatgcagaaatggcagaggactacccaaggtatccggatatccatgacctggatctgacgcttctcaacccgaggatgatagttgatgtgaccccttacatgaatcccagtccctttaccgtttcccctaatactcatgtgtcccaggtcttcaacctttttagaactatggggctcaggcatttacccgttgtaaacgcagttggtgaagtttcagaggctccggccttgcctcctcccctccgagaggaccccttggcgcgctgttgcctgtgcactcaagcttcccaccaaaagcgccgtcatcccacacggagaggcgagtgcggccctaccctcgctctcaaccccgctcgcttgccttgtacacgggaccccttcccttgtttgccagctgacggtacctccgttcctctcgcggtattgagctctcagagccgtgcctccacccgtctttgcttaccccccgaaatgttgctatttacaccgtaccattggtgtagcttagttctccacctgcgtcgcgatctgcgcatccgatag

SEQ ID NO: 111962 - DNA, 369 bp, Artificial Sequence
  Description of Artificial Sequence: Synthetic coding sequence
atggccgggtgccgggggtcactctgttgctgctgccgatggtgctgctgctgcggagaaagagagaccagaactcccgaggaactgactatcctaggcgagacacaggaggaagaggacgagatcctcccaagaaaagattacgaatccctcgactatgatcgttgtattaacgatccatacctcgaagtgctcgagacaatggacaacaaaaaaggacgccgttacgaggccgtcaagtggatggtcgtttttgccattggggtttgcactgggcttgttggcctgttcgtcgatttcttcgtgagattattcacccaacttaagtttggcgtagtgcagacatacaagtttcagatgaaaatgtag

SEQ ID NO: 111963 - DNA, 2277 bp, Artificial Sequence
  Description of Artificial Sequence: Synthetic coding sequence
tcacctagatcggccttattcagggtagggcacatgtcttctgttgagctcgacgacgagttgctagatccagacatggatccacctcacccttttcccaaggaaataccccataatgagaagctcctgtctctcaaatatgaaagtctggactatgacaattccgagaaccaactgtttctcgaagaggagaggcgcatcaaccacacagcctttcgcaccgtagagataaaaaggtgggtcatttgcgctctcattgggattctgacaggtctcgtggcctgcttcatcgatatcgtcgtggagaatttggcaggcctgaaataccgtgtgatcaagggtaacatcgataaattcacggagaaaggtggtctctccttctcactgctcctgtgggccacactgaatgctgcgttcgttctggtagggagcgtcatagtggcctttatcgagcctgtggccgctggaagtggaattccccagattaagtgtttcctgaatggggtcaagattccccacgtcgtccgactgaaaacactcgttattaaagtgagtggcgtgatcctgtccgtcgtcggtggactggctgtggggaaggagggacccatgatacactctgggtccgtaattgccgccggaatcagccaggggcggagtacttccctgaagagggacttcaagattttcgagtacttcaggagagatacggaaaagagggattttgtttcagctggggccgccgccggcgtgtcagctgcctttggcgctccagtcgggggggtactgttttctctggaggagggtgcctccttttggaaccaatttctgacgtggcggatcttttttgcctccatgatctccacctttactttgaacttcgtcttatctatttatcacggaaatatgtgggatctgtctagccctggactgattaacttcggtaggtttgacagtgaaaagatggcctatacaattcacgagattccagtgtttattgccatgggcgtggtagggggtgtgctcggtgccgtattcaatgccctgaattattggctgactatgtttcgaatcaggtacatacataggccctgcttgcaggtgatcgaagccgtgctcgtcgctgctgtgacagctacagtggcgtttgtattaatatactccagcagggattgtcagccgctccaagggggaagtatgtcctacccgctgcagctcttctgtgcagatggggaatataacagcatggctgctgccttttttaatactcccgagaagtctgtggtgtcactgtttcatgaccctcctgggtcctacaaccccctgaccctcggcctctttacactcgtatatttttttctggcttgttggacttacgggctcacagtgtctgctggcgtgttcattccaagtctccttattggggcagcctggggccgccttttcgggatcagtctgagctatctaaccggggcagcaatctgggctgaccctggaaagtacgcgctgatgggcgcggccgcacaactgggtggtatcgttagaatgactctgtcattgactgttatcatgatggaggccacatctaatgtgacatatggcttcccaattatgctcgtccttatgaccgccaagatcgtgggagatgtcttcattgagggattgtacgatatgcatatacagttgcagagcgtcccattccttcactgggaggcacccgtaacttcccatagtctgactgctcgggaggtgatgagcactcccgtaacatgtctacgaagaagagagaaagtgggcgttatagtcgatgtcctgtctgatacagcctcgaaccacaacgggttccccgtggtggaacatgctgatgacacgcaacccgcccggttacagggcttaatactgaggtctcagctgattgtgctgctgaaacacaaagtttttgtggaaagaagtaaccttgggcttgtccagcgacgtctaagacttaaggactttagagacgcctaccctagatttccaccaattcagagtatccacgtcagtcaggacgaaagagagtgcactatggatctaagtgaatttatgaatccgagtccatacaccgtaccgcaggaagccagcctgccccgagtattcaaattattccgagctctgggcctgagacacttggttgtagtggacaaccgaaaccaggtggtgggcctagttacccggaaggacctcgctcgatataggttaggtaaaagaggattggaagaattgtcactggcacagacttag

SEQ ID NO: 111964 - DNA, 2418 bp, Artificial Sequence
  Description of Artificial Sequence: Synthetic coding sequence
atggctaatgtttccaaaaaggtgtcatggagtggacgagatcgcgacgatgaggaagctgctcctctgctgcgaagaacggcccgaccggggggtggcaccccactgctcaacggtgctgggcctggggcagcacgccagagcccaaggtcagctctctttcgggtggggcacatgtcaagtgtggaactagatgacgaattattggatcccgacatggacccaccacaccccttccccaaagaaatcccccacaacgaaaagctgctgtccctgaagtatgagtccctggattatgacaattctgaaaatcagctcttcctggaagaagaaagacgcatcaaccacaccgcttttcggacagtggaaattaagcggtgggtgatctgtgctcttatcggaatcctgactggtctggtagcatgcttcatcgatatcgtggtcgagaatttggccggactgaagtatagggttattaaggggaatattgacaagttcactgagaagggcgggctaagtttcagtctgctgttgtgggccactctgaatgccgcctttgtattagtcggcagcgtgatcgtggcattcatcgagccagtggccgccggaagcggtattccacagatcaagtgcttcctgaatggcgtgaaaataccccatgtggtgcgactgaaaacgctcgtgataaaggtgtcgggcgtgatcctttctgttgtgggtggcttggccgtaggcaaagagggaccaatgatccacagcgggtccgtcattgccgccggaatcagtcaagggagatcaaccagcctcaaaagagattttaagatctttgaatactttcgacgggacacagaaaaaagggactttgtttccgccggcgcagcagcgggcgtgtccgccgccttcggtgcccctgtagggggggtgctgttctcactggaagagggagcctctttttggaatcagtttctgacctggaggatttttttcgcgagcatgatttccacttttaccttgaacttcgtgctaagtatataccatggcaatatgtgggatctgtctagtcctgggctgatcaattttggccgctttgactccgagaaaatggcgtacaccattcatgaaatcccagtctttatcgccatgggcgttgtgggtggagtgttaggagcagtgttcaacgcgctgaactactggctgaccatgtttcgaattcggtacattcacaggccttgcctccaagtcatagaggcagtgcttgtggccgcagtaactgcaacagtggcctttgtgttgatatactcaagccgcgattgccaaccattgcagggtggatcgatgagctatcccctccaactgttctgcgccgacggggagtacaactcaatggctgccgccttttttaataccccagagaaatctgtcgtgtccctttttcacgatcctccgggctcatacaaccccctgactctcgggctttttaccctggtgtacttctttctggcctgctggacctacggactgaccgtgtccgctggcgtgttcattccgtcccttcttatcggcgcggcatgggggcgactattcgggatctcattgagctatttgactggtgctgccatttgggccgatcccgggaagtatgcgctaatgggggcggctgcacagctggggggcattgtgagaatgaccctatccctgacagtaattatgatggaggctacttcaaatgtcacatacggcttcccgattatgctagttctcatgacagccaaaattgtgggggatgtcttcatcgaggggctctacgacatgcatatacagttacagtctgtcccgttccttcattgggaggcacccgttacgtctcatagtctgaccgcccgggaggtcatgtctactcctgtcacttgcctacggcggcgcgagaaggtgggggtgatcgtggacgtcctctctgacactgcctctaaccacaacggctttcccgtcgtcgagcatgctgatgacacccaaccagctagactgcagggtctcatccttcgcagtcagctgattgtgctgctcaagcataaggtcttcgtggagagaagtaaccttgggcttgtccaacgtcgcctcagactgaaggactttagagatgcctatccacgttttccacctattcaaagcattcacgtaagccaggatgagcgggaatgcaccatggacctcagcgagttcatgaatccgagtccctacacagtcccacaggaagccagtcttccgcgtgtgtttaagctctttcgagcattgggtctgcgccatctggtcgtggtagacaacaggaaccaggtggtcggcctcgtaaccaggaaagatctggctaggtatcggcttggcaagagaggtctggaagaattaagcttggcccagacctag

SEQ ID NO: 111965 - DNA, 2244 bp, Artificial Sequence
  Description of Artificial Sequence: Synthetic coding sequence
atgagcagtgtcgagcttgatgacgagttactcgatcccgatatggatcccccacacccattccccaaggaaattccccacaacgaaaaactactcagtcttaagtacgaaagcctggactatgacaacagtgagaaccagctatttctagaggaggagcgtaggataaaccacacagctttcaggacagtggagatcaagcgctgggtgatctgtgccttaataggcatcctgactgggctggtcgcttgcttcatagacatcgtggtggagaacctggccggcctgaagtaccgagtaatcaagggcaatatcgataaattcactgagaaagggggactgtcattttctctgttgctgtgggcgacgctgaatgccgccttcgtacttgttggttcagtcatcgtcgcctttatcgagcccgtggctgccggcagcggaatcccgcaaatcaagtgtttcctgaatggcgtgaagatcccacatgtcgtccgtctgaagaccttggtgatcaaggtttcgggggtgattctctcggtggtcggtggactggctgtcgggaaggagggacccatgattcattctggttccgtaattgccgctggaattagccaggggaggtctaccagcctaaagcgagattttaagatattcgagtactttagacgcgacacagagaaaagagacttcgtatccgcaggtgcggccgccggggtttcggcagctttcggggctcctgtgggaggagtgctttttagtctagaggagggagctagcttttggaaccaattcctcacctggaggatcttttttgccagcatgatatccactttcaccctcaatttcgtgttaagcatctaccatggcaatatgtgggacctgtcctctcctggtctcattaactttggtagatttgatagcgagaagatggcttacacaatccatgagatccccgtcttcatcgccatgggcgtggtgggaggcgtcttgggcgctgtgttcaatgctcttaattattggcttaccatgttcaggataaggtatatccacagaccttgcctccaggtgatagaagccgtgctggtggcagccgttactgcaactgtggctttcgtgctcatctattcaagccgagattgccagcccttacagggagggtctatgagttacccattgcaacttttctgcgctgacggcgaatataatagtatggccgcggcgttctttaatactcctgagaagtcagtggttagcctgttccacgatcccccaggctcttataatcccctgaccctgggactgtttaccttggtgtacttctttcttgcctgctggacctacgggttaaccgtgtcagccggtgtatttataccatcactgctgattggcgctgcatggggacgcctttttggaatctcactgtcatatctcaccggagcggccatctgggccgatccggggaaatacgccctgatgggtgctgccgctcagctgggtggcattgtcagaatgacactctcgctgacagtgattatgatggaggccacttcaaacgttacatatggatttccaatcatgctggtgctgatgactgcgaaaattgtcggcgacgtgttcatcgaaggtctgtacgacatgcacatacaacttcagagtgtacccttcctccactgggaagcaccggtgacatcgcatagcctgaccgcgcgtgaagtgatgtccactcccgtcacgtgtctgcgtagaagggagaaagtcggcgtgattgtggatgtgctctctgatacagcttccaatcacaacggctttccagtggttgagcatgccgatgacacacaacctgcccggcttcaaggactgattctgcggtctcaacttatcgtgttgctgaagcacaaggtgttcgtagagagatctaatttgggcctggttcagcgccggcttcgcttgaaagactttcgggacgcctatcctaggtttccccctatccagtctattcacgtttcacaggatgagcgagaatgcactatggatttatcggagttcatgaatccttccccttacactgtcccacaggaagccagtctcccaagggtcttcaagctgttccgagccctgggcttgaggcacttggtggtggttgataacagaaatcaggttgtgggtctcgtgacaagaaaggatttagcacggtacagactggggaagcgtggactcgaggaactcagtctggcccagacgtag

SEQ ID NO: 111966 - DNA, 2346 bp, Artificial Sequence
  Description of Artificial Sequence: Synthetic coding sequence
atggccaacgtgagtaagaaggtctcttggagcgggagagatcgggatgacgaggaagccgcacctttattacgccgaacagcccggccaggggggggtacaccccttctgaacggcgctgggccaggcgctgcccgccaggacatggacccaccacaccccttccctaaggagatacctcacaatgagaagctactgagtttaaaatacgagtcactcgactacgacaattcagaaaatcagctgtttttagaagaggagcggagaattaatcatacagcctttcgcaccgtggagattaagcgctgggttatttgtgccttgatcggtattctgacaggtctggtagcctgcttcatagacatcgtggttgaaaacctggccgggttgaagtacagagtgataaagggtaatattgataaatttaccgagaagggaggcttgtcatttagtctcctgctgtgggccacgcttaatgctgcattcgttttggttggtagcgtgatcgtggcctttattgaacctgtggctgccgggtctggtattccacaaatcaaatgctttctgaacggcgtcaaaatccctcacgtggtaaggctgaagaccctagttatcaaagtgtccggggttatactcagcgtggtgggtgggctagctgtgggtaaagagggccccatgattcactccggcagtgtgatcgccgccggcatttcacagggccgatcaacctctctaaagagggacttcaagattttcgagtatttccgacgggacaccgaaaagcgtgactttgtgtctgctggagccgcggccggggtgtctgctgcgttcggagctcccgtgggaggggtgctcttttcactggaagaaggcgcatccttctggaaccagttcctgacatggaggattttctttgccagcatgatttccacatttacattgaacttcgttctgtccatataccatggtaacatgtgggatctcagttcaccaggtctgatcaactttggtcgattcgactccgagaagatggcctatactatccatgaaattccagtttttattgccatgggagttgtcggcggcgtgctgggtgccgtgttcaacgctctgaactattggttgactatgtttcggattcgctacattcacagaccatgtctgcaggtgattgaagcggtattggtagccgcggtcaccgctaccgttgcatttgttctaatttattccagccgcgactgtcagcctctgcagggagggtctatgtcttatccactgcagctattctgcgctgacggcgagtataactcaatggccgcagctttttttaacacccccgagaaatccgtcgtgtcactgtttcacgatccacccgggtcgtataatccactgacattggggctgttcaccttggtgtatttttttctggcctgttggacctacggactcacggtgagcgccggagtgttcattcctagcctcctgataggggccgcctgggggcgactcttcgggatctctttgtcatatctgacaggcgccgctatctgggctgatccggggaaatatgctttgatgggggcagcggcacagctgggcgggatcgtacgaatgacgctgagtctgacagtcatcatgatggaagctacaagtaatgtgacctacgggttccccatcatgttggtgctgatgacagctaagattgtcggcgacgtttttattgaagggctgtatgacatgcacattcaactgcagtccgtcccctttcttcactgggaggccccggtcaccagccacagcctgacggcaagggaggtgatgagcacacccgtgacatgcctacgcaggcgagagaaggtcggggttatcgtggatgtcctgtctgacacggcttcaaatcacaacggttttcccgtggtcgagcatgcggatgacactcagccagctaggcttcaggggttgatcttacggtctcagcttattgtgcttctcaagcacaaagtgtttgtggagcggtctaacctgggcctcgtgcagcggcgcctaaggcttaaagatttccgggatgcttatccccggttccccccaatccagtccattcacgttagccaggatgaacgggagtgcaccatggatctgtctgagtttatgaatcccagtccctatacagtaccccaggaggctagtctgcctcgtgtattcaaactcttcagggctctcggactgagacacctcgttgtggtggacaaccggaatcaggttgtcggtcttgttactcgcaaagacctggcaagataccgtctgggaaaacggggccttgaagagttgagcctggctcagacctag

SEQ ID NO: 111967 - DNA, 1545 bp, Artificial Sequence
  Description of Artificial Sequence: Synthetic coding sequence
atggtcctggatctcgacctcttccgtgtggacaaagggggtgacccagcactaatcagagaaacacaagaaaagcggttcaaagaccccgggctggtcgaccaactagtgaaagccgatagtgaatggcgacgatgccgcttccgggcggataacctgaacaagcttaagaatctttgctctaagactataggtgagaaaatgaagaagaaggagccagtcggcgacgacgaatccgttcccgagaacgtcctgagttttgacgacttgaccgcagatgctcttgccaacctcaaagtgtctcagatcaagaaggtcagactactgattgatgaggctattctaaaatgcgacgctgaacgcattaagctcgaggccgagcggtttgagaatttgagagaaatcggtaacctcttgcatccctccgttccgatcagtaatgatgaggacgtggataacaaagtggaacgcatctggggtgattgtaccgtccggaagaagtattcccacgttgatctggtggttatggtcgatggttttgaaggggaaaagggggcagttgtggccgggagtaggggttacttcctcaaaggcgtactcgtttttcttgaacaagcacttattcagtacgcattgaggaccctagggagtaggggctacatccctatctatactccattttttatgcggaaagaggtgatgcaggaagtggcccagcttagccagtttgacgaggagctatacaaggtaatcgggaagggctccgagaagagtgacgataatagctatgatgagaaatatctgatcgccacctctgaacagccaattgccgccttgcatcgcgacgaatggctacgcccagaggatctccctataaagtacgccggtctgtcaacctgctttcgccaggaggtcgggtcacatggccgggatacacgcggtatcttcagggtacaccagttcgaaaagatcgaacagttcgtgtactcctctccccatgataacaagtcgtgggagatgttcgaggagatgattacgactgccgaagaattctaccaatcccttggcattccttaccacatcgtgaacattgtcagcgggtctctcaaccacgcagcctccaagaagctggatctggaagcgtggttccctggcagcggggcctttcgagagctcgtgtcctgttctaactgcaccgactatcaggccaggagactgaggatacggtatgggcagacaaagaaaatgatggataaagtcgagtttgtgcacatgcttaacgccacaatgtgcgctacaacacggaccatctgcgcgatactggagaattaccagaccgaaaagggcatcaccgtgcccgaaaagctcaaagaattcatgccccccggactccaggaacttatcccgttcgtaaagccagctcctatcgaacaagaaccaagcaagaagcagaaaaagcagcatgagggctccaagaaaaaggcggctgctagggatgtgactctggaaaataggctacagaatatggaggtgacagacgcctag

SEQ ID NO: 111968 - DNA, 2745 bp, Artificial Sequence
  Description of Artificial Sequence: Synthetic coding sequence
atggggcctttcaaaagctcagtctttatccttatattgcacttactggaaggagcactgagcaattctctgatccagcttaataataatggatacgagggtatcgtagtggccatcgatccaaatgtgccagaagatgagactctgattcaacagatcaaagacatggtcacccaggcctcactatatctcctggaggctacaggtaaaaggttttattttaagaatgtggccattttgattcccgaaacttggaagaccaaggccgactacgtaaggcccaagctcgagacatataagaacgctgatgttttagtggcggagtctacgccccctggcaacgatgagccatacacagaacagatgggtaactgtggggaaaaaggcgagcgcatccatctcacgccagattttattgccggtaaaaaattagccgaatatgggccccaaggccgagcattcgtccatgaatgggcccatctgaggtggggggtgtttgacgaatataataacgatgaaaaattttatctttcaaatggcagaattcaggccgtgagatgctctgcaggtattacagggactaacgtagtaaagaaatgtcagggaggaagctgttatacaaaaaggtgtacctttaacaaggtgacgggactttacgaaaaagggtgtgaatttgtcctccaatcccggcagactgagaaagcctcaataatgtttgctcaacacgtggatagtattgtggagttttgtactgagcagaaccacaataaagaggcacccaataagcagaaccagaagtgcaatctgcgaagcacctgggaagtcatcagagattccgaagattttaaaaagacgacaccaatgactacacaacccccaaaccctacgtttagcttgctacagattggccagaggatcgtatgcctggtcctggacaaatccggaagtatggccacaggtaacaggctcaaccggctgaaccaggcggggcagctattcctcctccagaccgttgaactgggttcctgggttggcatggtgacatttgactccgccgcacacgtccagaatgagctgatccaaatcaactctgggtccgacagggacactctggccaaaagactgcccgcagccgcatccggaggaacttcaatatgtagcggtctgagatctgcatttaccgtcatccggaaaaaataccctacagacggaagcgaaatagtgctgttgacagacggcgaagataacacaattagtggatgctttaatgaggtcaaacagagtggtgccattattcacaccgtggcactgggtccatccgccgcccaggagctggaggagttgtctaagatgaccgggggtttacagacttacgcatctgatcaggtgcaaaacaatgggcttatcgatgcctttggcgccctgagctctggcaatggagcggttagccagaggtctattcaactggagagtaaaggattgacgctgcagaactctcagtggatgaacggtacggtgattgtggattcgaccgtgggaaaggacaccttgtttttgatcacatggactatgcaacctcctcagatccttctgtgggatcctagcggccaaaagcaaggtggctttgttgtggataagaacaccaagatggcgtacctgcagattccagggattgccaaggttgggacttggaaatactcactgcaggcctcttcccaaaccttgactctgacagtgactagccgggcctcaaatgctacactgcctcccataacagtgacctccaaaaccaataaggatacatcgaagtttccctctcccctggtggtatacgcaaacatacgacaaggcgcatcacctatcctccgcgcatccgtcactgcccttatagaaagcgtaaacgggaaaacagtcacactagaactcctcgataacggagcaggggccgatgctacgaaggatgacggtgtttatagcagatacttcaccacctatgataccaatggccgctactccgtgaaggtacgagcattgggcggagtgaacgctgctcggaggcgggtgataccccagcagtctggcgcactgtatataccagggtggatagaaaatgacgaaatacagtggaatcctcctaggcctgaaattaataaggatgacgtgcagcataaacaggtatgcttctctcggaccagctcaggtggaagcttcgtggcgagcgatgtgccgaatgctccaataccagacctcttccccccaggccagattactgatttgaaggccgagatccacggaggatcacttattaacctgacctggaccgcccctggagatgactacgaccacggcaccgctcataagtatattatcaggatttccaccagcatcctcgatttaagagataaattcaacgagtccctgcaggtcaataccacagcactgatacccaaagaagccaacagcgaggaggtattcctgtttaaacccgagaacataacatttgagaatggaaccgatctgtttatcgccatccaagccgtcgacaaggtggacttaaagtcagagatctcgaatatcgcacgagtctctctgtttatccctcctcagacgccaccagagaccccttccccagatgagacttcagcaccttgccctaacatacatattaatagcaccataccagggatccatattcttaagatcatgtggaaatggatcggggaacttcagctgtctattgcttag

SEQ ID NO: 111969 - DNA, 987 bp, Artificial Sequence
  Description of Artificial Sequence: Synthetic coding sequence
atgacaacacaaccccctaacccaacattctccttgctacagatcggtcagaggattgtgtgcctggtattagataagtctggatcaatggccactggaaaccggctgaatcggctaaaccaggccggccagctcttcctgcttcagactgtcgaacttggcagctgggtgggtatggtcacatttgattcagccgctcacgtccagaatgaattgattcagattaactctggctctgatagggacacattagctaagagactgccagctgccgctagtggcggaacctctatatgctcaggtctccgttcagcgttcacagtcatcaggaagaagtatccgaccgacggttctgaaattgtgctactcactgacggggaggacaatactatcagcggctgtttcaacgaagtcaagcaatcaggagcaattattcataccgtagccctggggccctccgccgcgcaggagctagaggagctgtcaaagatgacaggtggcttgcaaacgtatgcctctgatcaggtgcagaataacgggcttatcgacgcctttggcgccctctcttctggaaatggcgctgtgtcacagcggtccatccagctcgaaagcaaaggtttaacactgcagaactcccagtggatgaatggtaccgtgatcgtagattccactgttgggaaggatacactctttctaattacatggactatgcagccgcctcagattcttctgtgggatccctccggccagaaacagggcggtttcgtggtcgacaagaataccaaaatggcctacctccagattccagggattgccaaggttggcacatggaaatattctctgcaggcatcttctcagaccctcacactgacagtcacatctagggcttcgaatgcgacactgccccctatcacagtgacaagtaaaactaacaaggacaccagtaatctccctaattctcagggccaatgtcacagcccagactag

SEQ ID NO: 111970 - DNA, 2064 bp, Artificial Sequence
  Description of Artificial Sequence: Synthetic coding sequence
atggaggagctggtcggcttgcgcgaagggttctcaggcgatccagtcactctgcaggagctctggggaccgtgtcctcacatcaggcgggcgatccagggtggtctggagtggctcaaacagaaagtgttcagacttggcgaagattggtactttttgatgactctgggagtcctaatggccctcgtgtcttatgcaatgaatttcgctatagggtgcgtggttagggcacaccagtggctttaccgggaaattggtgactctcacctgctccgctatcttagctggactgtctatccggtggccctagtgtctttctcgtctggattctcccagtccatcactcctagctctggcggatccgggattcccgaactgaagaccatgctcgccggagtaatactggaagactacttggacatcaaaaacttcggcgcaaaagtggtaggactcagctgtacgctggccactggctcaactctctttctcggtaaagtggggccctttgtccacctgtccgtaatgatagcggcctacttaggccgagtgcggaccacaactattggtgagccagaaaataagtcaaagcagaatgagatgctggtcgccgcagcagctgtgggagtggccactgtatttgcagctcctttctccggggtgctcttcagcattgaagtcatgagtagtcatttttctgtgcgggactactggcgggggttttttgccgcgacctgtggcgccttcattttcagattgctggccgtgttcaacagcgaacaggaaaccatcaccagtctgtacaaaacctccttcagagtggacgtgcccttcgacctgccagagatctttttttttgtagctctgggaggcatctgtggagtactctcttgcgcctacctgttttgccaaaggaccttcctcagtttcataaagaccaatcgatactcaagtaaactcctcgcaacttctaaacctgtgtactccgcgctggctacgctgctcctggcatccattacctatcctccaggagtgggccatttcctggcttcacgcctgagtatgaaacagcacctggactccctgttcgataaccattcctgggcattaatgacacaaaatagttccccaccctggcctgaggaactggaccctcaacacctgtggtgggagtggtaccacccaagatttactatatttggaacactggcatttttcctagtaatgaagttttggatgctcatcctggctactaccattccaatgccggccggatatttcatgccgatttttattctgggggcagctatcggccgactgctgggggaggccctggcagtcgcattcccagagggtattgtcactgggggggtgacaaatcccatcatgccagggggatacgcccttgccggggctgccgctttcagcggcgccgtcacccacactattagtacagccctgctggccttcgaacttaccggacagattgtccacgccttgccagttctaatggctgtgctcgcggccaacgcaatcgctcagtcttgccagcctagcttctatgacggcactatcatcgttaaaaaattgccgtacctgccccggatcctcgggcgtaatataggcagccaccatgttcgggtcgagcattttatgaaccactccatcacaacacttgcaaaggatacgcctctggaggaggtcgttaaggtcgtgaccagcacagacgtcaccgagtatccccttgtggagtccacagagtcccagattctggtggggattgtccagagagcacagctggtgcaggccctccaggccgaaccccctagtcgtgcaccagggcatcagcagtgtctgcaggatatcctggcccgcggatgtccaaccgagcctgtcaccctgacactgttctcggagaccactctccatcaggcgcagaatctgttcaagctgttgaacctgcagagtcttttcgttacttctcggggaagagctgttggttgcgtgtcatgggtcgaaatgaagaaggcaatttccaacctaactaatcctccggcaccaaagtag

SEQ ID NO: 111971 - DNA, 2061 bp, Artificial Sequence
  Description of Artificial Sequence: Synthetic coding sequence
atggaggaacttgtgggcctcagagagggcttcagcggcgatcctgtgacccttcaagaactgtggggtccctgcccacacattaggagggccatacagggcggcctggaatggctcaagcagaaggtgttccggctaggcgaggattggtactttctgatgacactgggcgttcttatggctctagttagctatgccatgaactttgctattggctgcgtcgtcagggcccaccagtggctgtacagggaaataggtgactctcacctgctgcgttacctcagttggacggtctatcctgtggccttggtgagctttagctcagggttcagccaatcaattactccttctagcgggggcagcggaatacctgaactgaagaccatgttggcgggagtgattctcgaggactacctggatatcaaaaacttcggggctaaggtggtagggttatcctgcaccctggccacgggcagcaccctttttctagggaaagtgggaccattcgtgcacctctccgtaatgatagccgcgtacctgggtagggtcagaacaaccacaattggtgaacccgagaataaaagtaaacaaaatgaaatgctggtggcagccgccgccgtgggggttgctacagtttttgccgcgccatttagcggggttctgttctctatcgaggtgatgtcctcacacttctccgtaagggactactggcggggcttcttcgccgcaacctgtggcgccttcattttcaggctgcttgcagtatttaattctgaacaggaaaccattacctctctctacaagaccagctttagagtcgatgtcccctttgacttgccagagattttcttttttgtggctctcgggggcatatgtggagtactcagttgtgcatacctgttttgtcagaggactttcttaagctttataaaaacaaataggtattccagcaagctgttggccaccagtaagccggtctactcagccctggcaaccctcttgcttgcctctattacttaccctcccggtgtgggacacttcctggcaagccggctaagcatgaagcagcacctggatagcctctttgacaaccattcatgggctcttatgacccagaattcttccccaccctggccagaggagttagatcctcaacatctgtggtgggagtggtaccatcctaggtttactattttcgggactttagcctttttcctagtgatgaagttttggatgctcattctggcaaccactatcccaatgcctgcaggatatttcatgccaatcttcattctcggagctgccatcggacgcctacttggggaagccttagccgtggccttcccagaaggaatcgtgacaggaggagtgactaaccccattatgcccggaggctacgcgcttgcgggcgctgcagcgttcagtggtgccgtgacacacaccataagcaccgcactgcttgcctttgaacttacgggacagatcgtccatgccctgccagtactgatggctgttctggccgctaacgctattgctcaatcctgccaaccatctttctacgatggaacgatcattgtcaagaaactcccatacctgccacgcatcctcggtcggaacatcgggtcccaccatgtgagggtcgaacatttcatgaatcattccattaccactctggcgaaagacacaccactggaggaggtcgttaaagtggtgacttcgaccgatgtgacagaatatccgcttgtggagtccactgagagccagatacttgttggcatcgtccaacgcgcacagctggttcaggctctgcaagccgaacccccgtcccgcgctccaggccaccagtgcctgcaagatattctcgccagaggttgtcctacagaacctgtgaccttgactctgttttccgaaacaactttgcatcaggctcagaatctgttcaagctcctcaatctgcagtctctgttcgtgacttcccggggcagagccgtgggctgtgtttcatgggtggaaatgaaaaaagcgatcagcaacctgactaatccgccagctccaaagtag

SEQ ID NO: 111972 - DNA, 2061 bp, Artificial Sequence
  Description of Artificial Sequence: Synthetic coding sequence
atggaagagctggtaggactacgtgagggcttcagtggcgaccccgtcactcttcaagaactgtggggaccatgtcctcacatcaggagagcaatacaggggggcctggagtggctaaaacagaaagtgttcaggcttggtgaggactggtattttctgatgactctgggcgtactcatggctctcgtttcttacgccatgaactttgctatcggctgcgttgtgcgtgctcaccaatggctttaccgcgaaatcggagattctcacctgttgagatacctgtcctggacggtctatcctgtggctttggttagtttctcttccgggttctcccagtccatcaccccaagcagcggaggaagcggcatccccgagctaaagaccatgctagccggcgtgatcctagaggattatctggacatcaaaaactttggcgccaaggtcgtcgggttgtcctgcactctggcaactggctccaccctcttcctaggcaaagtcgggccatttgtgcacttgtcggtgatgatcgctgcctatctcggcagagtgcggacaaccacaatcggggaacctgaaaacaagtctaagcagaacgagatgttggtagcagccgctgcagtcggagtggcaacagtgtttgctgcccctttctctggcgtgctgttctccatcgaggtcatgtcaagtcacttttccgtgcgggactactggcgcgggttcttcgcagccacctgtggggcttttattttcaggttactcgcagtgttcaactccgagcaagaaactattacgagcctttacaaaacctcctttcgcgtggacgtgccatttgacctccctgaaatttttttcttcgtagcattgggcggaatctgcggcgtcctttcttgcgcttatctgttttgtcagaggacctttctttctttcataaaaaccaatcgctattcatctaagcttctggccactagcaagccggtgtattctgccctggcaaccctgctgctggctagcattacgtatccccccggcgtcggacacttcttggcctcccgcctctccatgaagcagcatctggattcgctattcgacaaccatagctgggccctgatgactcagaattcatctccaccatggccagaggagctggatccccagcacctgtggtgggaatggtaccacccaaggttcacaatctttggtacccttgccttctttctcgtcatgaaattttggatgctgatcctcgcgaccacaataccaatgcccgcagggtatttcatgccaatcttcattctgggcgcggccatcggcaggctgttaggagaagcactggctgtagcctttcctgagggcattgtaacaggcggcgtgacaaaccccattatgcccggaggctacgcattggccggcgccgccgccttctcgggggctgtgacccacactatctccaccgctctcctggcttttgagttgaccggccagattgtgcacgcactacccgtgcttatggccgtcctcgccgccaacgccatcgctcaatcctgtcagccatccttctacgacggaaccatcattgtgaaaaagctgccatatctgcccagaattctaggccggaatattggcagtcatcatgtgcgggtggaacattttatgaaccactctatcacaactctggctaaagacaccccactggaggaagttgttaaggttgtgacgagtaccgatgtgactgagtaccccctggtagaaagcacagaaagccagattttagtaggaatagtacagcgggctcaactagtgcaggcgttgcaggcagagccaccgagccgcgctcccggtcatcagtgcttacaggatattctggcccgcgggtgccctacagaacccgtgactttgaccctattctcagagacaacactgcatcaggctcaaaatctgttcaagctgttgaacctacagagcctgttcgtaacttcgcggggacgcgcagtcggatgcgtttcttgggtcgagatgaaaaaggccattagcaacttaacaaaccctcctgcccccaaatag

SEQ ID NO: 111973 - DNA, 1935 bp, Artificial Sequence
  Description of Artificial Sequence: Synthetic coding sequence
atggaggagctagtcggtcttagggaaggtttcagcggggatcccgtgacattacaggagctgtggggcccctgccctcacattaggagggctatccagggcggcctggaatggctgaaacaaaaggtgtttaggttaggggaggattggtatttcctcatgaccctgggggtcctgatggctctcgtcagctatgccatgaatttcgcgattggttgtgtggtgcggggctccggcattcctgagttaaagaccatgctggccggagttatcctggaggactatctggacatcaaaaattttggggctaaagtggttggattgtcctgtactctcgctactggtagcacattgtttttgggtaaagtgggccccttcgtgcatctgtcagtgatgatcgccgcatatttgggccgggttcgcaccaccacaatcggggagcctgaaaacaaaagcaagcaaaacgaaatgttagttgcagcagcggccgtgggagtggccaccgtcttcgcagcccctttctccggggtgttgttttcaatcgaggttatgtcctcccacttttccgttagggactactggcggggtttctttgctgcaacatgcggggcttttattttccgcctgttggctgtgttcaattctgagcaggagaccattaccagtctctataagacctctttccgagtggatgtaccatttgacctgcctgagatcttcttttttgttgccctcggcggaatctgcggggtgctgtcatgcgcgtaccttttctgccagagaaccttcctgagcttcatcaagacgaatcggtattccagtaagcttctggcgacgagcaaacccgtgtactctgcgctcgctaccctgctgttagcctcaataacctatccacctggcgtgggacacttcctcgcatctcgcttgtccatgaaacaacacctagacagcctgttcgataaccactcatgggcgttgatgactcagaactcttcacccccatggccagaagagctcgatccccagcacctatggtgggagtggtatcaccctcgctttacgatttttggcacccttgcattcttcctcgtcatgaaattctggatgctcattctcgctactactatcccaatgcctgcaggctatttcatgccgatctttatcctgggggccgccatcggtcggctcctcggtgaggcactggcagttgcttttccggaaggaattgtgactggaggggtgaccaatcccattatgccgggtggatatgccctggccggcgctgctgctttctccggcgcagtgacccacactatctccaccgctcttctcgcgtttgagctcacaggacagattgtccacgctctccctgtgctgatggctgtcctagcagccaacgctattgcccaaagctgtcagccttctttttatgatggcacaatcatagtgaagaagctaccctatctcccccgtatcctgggccgcaacattggctctcaccatgtgagggttgagcactttatgaaccactctattactacactggcgaaggacacccccctggaggaagtggtaaaagtggtcacttcaaccgatgttaccgagtatccactagtcgagtctacagagtctcaaatcctggttgggattgtacaaagagcacagcttgttcaggctctccaagccgaacctccaagtagagccccaggccaccagcaatgcttgcaggacatcctcgctagaggatgccctaccgaacccgttacactgacactgttcagtgagacgacgcttcaccaagcacagaacctgtttaagcttctgaacttgcagagtctgttcgtgacatctcgtggccgggcagtggggtgcgtatcttgggttgagatgaagaaggctatttccaacctcactaacccaccagcaccaaagtag

SEQ ID NO: 111974 - DNA, 1389 bp, Artificial Sequence
  Description of Artificial Sequence: Synthetic coding sequence
atggaggagtttgtaggactccgggagggtagctctggcaacccagttactctgcaggagttgtggggcccctgcccaaggattaggaggggaatcagaggtggactggaatggctgaaacagaagctgttcaggttgggggaggactggtattttttaatgactcttggagttctgatggcactggtttcatgcgccatggatctcgctgtggagtccgtagtgcgcgcccaccagtggctctacagggaaatcggagactctcaccttctcaggtacttgtcgtggacagtgtacccggtcgctctcgttagttttagctcgggcttcagccagtccattacacctagcagtggcggatcaggcatccctgaggtcaaaacaatgttagctggagttgtgctggaggactacctggatataaagaatttcggagccaaagtagttggcctgtcctgcaccctcgcatgcgggagcactctattcttgggcaaagtcgggcccttcgtacaccttagtgttatgatggcagcctacttaggtcgcgttagaaccaccaccattggcgagccggaaaacaaatcgaagcctgtgtactctgccttggccacccttgtacttgccagtatcacatatcctccttctgccgggcgatttctggcatctagactcagcatgaagcagcatctggattcactgtttgataaccattcttgggccctgatgacccagaacagtagcccgccctggcccgaggagctggaccctcaacacctatggtgggaatggtaccaccctcggttcaccatcttcgggactttggcattttttttggtgatgaagttttggatgttaatactggccacaacaattcccatgcccgctggttacttcatgccgatcttcgtttacggggccgccattggccggttattcggggagacactgagctttatttttcccgagggcatagttgcaggcggcataaccaaccctattatgccagggggctacgcactcgctggagccgctgccttcagcggagcggtgacccacaccatatccacagccctcctcgctttcgaggttaccgggcagatagtccacgcactgcccgtactcatggcagtcctagcagccaacgctatcgcccagtcatgtcaaccgtccttttacgatgggacagttattgttaaaaagctcccctatctgcctaggatccttggacggaacatcggctcccaccgcgttcgcgtcgagcatttcatgaatcactcaattacaacactcgccatcactctgatgaacgacgagatcggtgtccattgccaccaaggtcaagcccagatgccaagtggcgttgtgtggtttccggtccggggctcatag

SEQ ID NO: 111975 - DNA, 1554 bp, Artificial Sequence
  Description of Artificial Sequence: Synthetic coding sequence
atgccttgcccccccctgctgtccgtgccagttcgcgccgctggcgagcaggatcgttgggtccgtgaggaagtgacttggggcggcggaccaacagtcaccggcggatggggctggagggcccacctccgctccgtcagcccaccaggcgtcctattttccatagaggtgatgagtagccactttagcgtgtgggactactggcgcggcttctttgccgctacctgtggagcctttatgtttcgtctgctggctgtctttaattctgagcaggagaccatcacgagtctgtataagacaagttttagagtggatgtgccattcgacctacctgaaatttttttcttcgtggctctgggtggcctttgcgggatcctcggctctgcgtatctattttgtcagagaattttcttcggttttatcaggaacaatagatttagctctaagttactggccacttctaaacccgtgtattcagccctggccacactggtcctcgcctcaattacctatccacctagcgccggccgcttcttagcttctcgcttaagcatgaagcagcacctagacagtttgtttgataaccacagctgggcactgatgacacagaattcttctcccccgtggcctgaggagctggatcctcaacacctctggtgggaatggtaccacccgcgcttcacaatctttggcacgttagcctttttccttgtcatgaagttctggatgctcattctcgcaaccaccatcccaatgcctgcgggatacttcatgccaatatttgtgtacggcgcagccatcggtcgcctgttcggtgaaactctgtcatttatttttcctgagggcatcgttgcaggcgggatcacgaacccaatcatgccagggggttatgctttggcgggagcagctgccttcagtggcgccgtgacacatactataagcacagcccttctggccttcgaagtgaccgggcagattgttcatgccctgcctgtgctgatggctgtcctagccgctaacgccattgcgcagtcatgccagccttccttctatgacggaactgtcatagtcaagaagctcccatacttacctcgcattctgggaaggaatatcgggagtcaccgtgtccgggtggagcattttatgaatcactcaattacgacactcgccaaagatatgccactcgaagaggtcgtaaaggtggtgacctcaaccgatgtcgccaagtatccgctggtcgagtcaaccgaaagtcaaatcctggttggcatcgtgcgaagagctcaattggtgcaggcattaaaggctgaacccccctcctgggcacctgggcatcagtgccttcaagatatcttggcagctgggtgtcccactgagcccgtgactttgaagctgtccccggagacttccttgcatgaagcccacaatctcttcgaattgctgaatttgcatagccttttcgtcacaagtaggggccgagcagtggggtgtgtgagctgggtagagatgaagaaagcaatctccaacctaacaaatccacctgctccaaaatag

SEQ ID NO: 111976 - DNA, 468 bp, Artificial Sequence
  Description of Artificial Sequence: Synthetic coding sequence
atggctgtactggcagctaacgctatcgctcagtcctgccagccaagtttctatgatggcactgtgatcgttaaaaaattgccttatttaccacgaattcttgggaggaatattggctctcatagggtgcgggtcgagcatttcatgaaccactcgataactactcttgccaaggatatgccattggaagaagtggtgaaagttgtgacctcaactgacgtggccaagtaccccctagtcgagagtacggagtcacagatcctcgtaggtattgttagaagagcccagctggtgcaggcgcttaaagcggaaccaccttcctgggctcccggccatcagtgtctgcaggacatactagccgctggttgtcccaccgagccggtgacgttaaaactatcgcctgaaacgagcttacacgaggcccagatgcccagcggggtcgtgtggttccctgtccgcggttcttag

SEQ ID NO: 111977 - DNA, 2064 bp, Artificial Sequence
  Description of Artificial Sequence: Synthetic coding sequence
atggaagagtttgtgggtctgcgtgagggctccagcgggaaccctgtaactctccaggagctgtggggaccttgtccccggattagacggggcatcaggggaggcctggaatggctgaaacagaaactgtttcgcttaggcgaggactggtattttctgatgaccttgggggtattgatggcactggtgtcttgtgcgatggatctcgccgttgagagtgtcgttcgcgcacaccagtggctgtatagagagatcggggatagccacctgctgcggtatctcagctggaccgtgtatcccgtcgccctcgtgagcttttcttccgggttctctcagtccattactcccagctccggcgggagcggcatccccgaggtgaaaacgatgttagctggcgttgtgctggaggattacctcgacatcaagaactttggagctaaagttgttggcctgtcttgcactttagcatgcggttccaccctctttctggggaaagtcggccctttcgtgcacctctctgtcatgatggctgcctatctaggacgtgtacgtactaccaccatcggagaacccgagaacaaatctaaacagaatgagatgctggtggctgctgccgccgtgggcgtcgctaccgtattcgccgcccccttctccggggtactcttttctatcgaagtcatgtctagccacttctccgtatgggactactggcgcgggtttttcgccgccacatgtggagcctttatgttcaggctccttgccgtcttcaactccgaacaggaaacaatcactagtttgtacaaaacttctttccgggtggacgtgccttttgatttgcccgagatttttttcttcgtcgcactgggaggcctttgtggcattctcgggtcagcatatctgttttgccagcggatcttcttcgggtttataagaaataatagattttcttccaaactgctcgctaccagcaagccagtgtatagcgcccttgctactctcgttttggcatcgataacatatccacccagcgccggacgctttctggcatctagattgagcatgaaacagcacctcgacagcctcttcgacaatcactcatgggccctgatgacccaaaatagtagcccaccttggccggaggaactcgaccctcagcatctctggtgggagtggtatcaccccagattcaccatctttgggacacttgcgttctttctcgtcatgaagttttggatgctcatcctagctaccacaataccaatgcccgctggatactttatgccaatctttgtatatggggctgcgataggacggcttttcggagaaacactgagctttatctttcctgagggtatagtcgccggcggcataaccaatcccatcatgcctggtggttacgccctggctggcgcggcagcgttctcaggtgcggtcacccataccatcagcactgcattgttggccttcgaggtgacagggcagattgtacatgccctgcccgtcttgatggcagtgttagcagcgaacgctattgcccagtcatgccagccaagcttttacgatggaacagtgatcgtgaagaagcttccttacctccctaggattctcgggagaaatatcggaagtcacagggtgcgggtcgaacattttatgaaccactccatcaccaccctggccaaagacatgcccctggaagaggtggtgaaggtcgtaaccagcacagatgtggccaaataccccttggtggaatccactgagtcccagattttggtaggcattgttcgaagagcacaactggtgcaagccctgaaagctgagcctccctcctgggctcctggtcaccagcagtgtctgcaggacatcctggctgcgggctgccccaccgagccggtcacattgaaactgtcgccagaaacatcactgcacgaagcccataacctctttgaattactaaatctccatagcctgttcgtgaccagccgaggcagggcggtcggctgcgtgagctgggtggaaatgaagaaggccatcagcaacctaacaaacccgccagcccccaaatag

SEQ ID NO: 111978 - DNA, 441 bp, Artificial Sequence
  Description of Artificial Sequence: Synthetic coding sequence
gctcaaagctgccagcccagcttctatgacggcactgtgatcgtgaagaagttgccctacttgccccgcatcttgggacgcaacattgggtcccatcgcgtgcgcgtagagcatttcatgaatcattccataacaaccctggcaaaggatatgcctttggaggaagtcgtgaaggtagtcacatctaccgacgtagctaagtatcctctggtagagtctacagagtctcagattctggtagggatcgtccgtcgggctcagctggtgcaggcactcaaggcagaacctccttcctgggcccctggccaccagtgcctgcaggatatcctggccgccggttgtccaacagaacccgtcaccctcaaactatccccagaaacatccctccatgaggctcagatgccgtcaggagtggtgtggttccccgtcagaggatcctag

SEQ ID NO: 111979 - DNA, 2646 bp, Artificial Sequence
  Description of Artificial Sequence: Synthetic coding sequence
atggctgccgctgcagctgaagagggcatggagcctagagcccttcagtatgagcagacccttatgtacgggagatatacacaggacctcggggctttcgctaaggaggaggctgcgcgaatccgcttgggcggccctgagccctggaagggccccccaagctcccgggctgcgcctgagttgcttgagtatgggagatcacggtgtgcacgctgccgcgtgtgttctgtccgctgccacaagttcctggtctctcgtgttggcgaagattggatttttctagtgcttctgggactcttgatggctctcgtgtcgtgggtcatggattacgccattgctgcgtgtttgcaagcccagcagtggatgagccggggacttaacacttctattctcctgcaatatctggcatgggtgacttatcccgtcgtcctgatcactttcagtgccggcttcacacagatactagctccgcaggcagtcgggtccggaattcccgagatgaagacaatactacgaggggtggttctcaaggagtatctgacactgaagacatttattgccaaggtgatcggcctgacctgcgctctgggttccggtatgccattgggaaaagaagggccatttgtgcacattgcctctatgtgcgccgcactgctgagtaaatttctctccctgttcgggggaatctatgaaaacgagagtcgcaatactgagatgttggccgctgcctgcgccgtaggagtagggtgttgcttcgctgccccgatcggaggcgtgctctttagcattgaggtgacatccacattcttcgccgtccgaaactactggcgcggcttcttcgccgctactttttctgcctttatctttcgagtgctggctgtgtggaatagggacgaagagacaattactgctttattcaaaacaaggttcaggctagactttccttttgatctgcaggagctgccagcctttgccgtcatcgggatcgctagtggttttggaggcgctttgttcgtctatctgaatcgaaagatcgtccaggtcatgcggaaacagaagactatcaaccggtttctgatgcgcaaaagactgctgtttcctgcccttgtaaccctgctgatttcaaccctgacattcccccctggttttggtcagtttatggcaggtcaactcagccagaaagaaaccctggtgacgctgtttgacaacaggacttgggtccgccagggtctggtcgaagagcttgaacctcccagcacttctcaggcgtggaaccctcccagagcaaacgttttcctcacactcgtgatatttattttaatgaagttttggatgtctgctctggccacaacaataccagtgccttgtggagcttttatgcctgtgttcgtcattgacggaattcataccgattcatcaacataccggatcgtccccgggggttacgcagtcgtaggggccgccgcccttgccggggcggtgacccacacggtgagcacagccgtgattgtgttcgagctgaccggtcagatcgcccatattctgcctgtgatgatagctgttattctcgcgaacgccgtcgcacagtctttgcaaccttctctatacgattctataattcgcattaaaaaactgccctatctacctgaactgggatggggccgccatcagcagtacagagtgagggttgaagatattatggtccgggacgtcccgcacgtggccctgagctgcaccttccgggatctccgcctggctctgcacagaaccaaagggagaatgctggccctggttgaatctcccgagtccatgatacttctgggctctattgaacggtcccaggtggtggctctcctcggagctcagctgtccccagcgcgacgcagacagcatatgcaggagcgccgagcaacacaaaccagcccgctcagcgatcaagagggacctccaacgccagaagcatcggtttgctttcaagtcaataccgaggactcagcctttcctgcagcacgcggagaaacccacaaacccctaaagcccgccctcaaacggggaccctcggtgacgcgtaatcttggagagtctcctaccggcagcgcagagtccgccggcatcgccctccgctcacttttttgcggatccccaccccccgaagccgcttcagagaagcttgagtcctgcgagaagaggaagctaaagcgggtaagaatcagtctcgcttctgacgctgatctggagggcgagatgtcacccgaggagatactcgagtgggaggaacagcagcttgatgagccagtcaacttttcggattgtaagatcgatccagcgccgtttcaattagtcgaacgtaccagcctgcacaagacgcacaccattttttcactacttggcgtcgaccacgcctatgttacaagcattgggcgcctgatcggcatagtgaccctgaaggagctcagaaaggcgattgagggaagtgtgactgctcagggcgtgaaggtgagaccacctttggcatcattccgcgatagtgccacctcatccagtgacactgaaacaactgaggtgcatgctctgtggggcccccacagccgccacgggcttcctcgagaaggttctccaagtgatagcgacgacaagtgccagtag

SEQ ID NO: 111980 - DNA, 2565 bp, Artificial Sequence
  Description of Artificial Sequence: Synthetic coding sequence
atggccgccgctgctgctgaggagggcatggaaccacgagcactccagtacgagcagaccctgatgtacggccggtatactcaggatctgggagcctttgctaaggaagaagctgctcgtatccgactgggcggacccgagccatggaaaggtccccccagcagccgagctgcccctgagctgctcgagtacggcaggagccgctgcgccaggtgccgggcccagcaatggatgtcccggggtttgaatacctcgattctacttcagtatctggcttgggtgacctatccagtggttcttattacctttagcgccggttttacacagatcctcgccccacaggcagtcggctcaggcatccccgagatgaagaccattcttagaggtgtggtgctgaaagagtacctgactcttaagactttcattgctaaagtgattggcctgacatgcgccctcggatctgggatgcctttgggaaaagagggcccctttgtccacatcgcgagcatgtgtgccgctctgttgtctaagtttctgagcctctttgggggaatttacgaaaacgaatctaggaacactgagatgctggctgctgcctgcgcagtgggcgtaggatgttgtttcgcggcacctatcgggggagttcttttctctattgaggtcaccagcactttctttgccgtacggaattactggcgaggcttctttgccgccacctttagtgcttttatcttcagagttctcgccgtctggaacagggatgaagagacaataactgctctgttcaaaacacgattcagactggattttccatttgatctccaggaattaccagcattcgctgtgatcggcatcgcatcgggatttggaggagcattatttgtgtatttaaatagaaaaatcgtgcaagtgatgaggaaacaaaagactatcaaccgcttcctgatgcgcaaaaggctgctgttcccggcactagtaactctgttgatatcaacgctgaccttccctcccggattcggacaattcatggcggggcagctctctcagaaagagacacttgtcacgttattcgacaatcgcacttgggtgcggcagggcctggtggaggaactggagcccccaagcacctctcaggcttggaacccccctcgtgcaaatgtttttctgaccctggttattttcatactcatgaagttttggatgagtgcgctggccactaccatcccagtaccctgtggcgctttcatgccggttttcgtgataggcgctgctttcgggcggctagtgggagagagtatggcggcgtggttccctgatggaatacataccgattcctcaacctacaggatagtgcctggaggttatgccgtcgtaggcgctgcagccttagctggcgccgttacccataccgtatccaccgccgtaatcgtgtttgaactgaccggccagatcgcccacatcctcccggttatgatcgccgttatcttggccaatgctgtggcccagtccctacaacccagtttatatgacagcatcattaggattaaaaaactcccttaccttcctgaacttgggtggggcagacaccagcaatatagagtgagagtggaggacatcatggtccgcgacgtcccgcacgtggccctgagctgcacctttagggatctccgcctcgctctccacagaaccaaggggcgcatgcttgcccttgtggaatcacctgaatctatgatcttgctgggctctattgagaggagtcaggtggtggccttgctgggtgcacaactgtccccagcccgacgacgccaacatatgcaagagcgtagagctacccaaacctctcccctcagcgaccaggaaggcccaccaacaccggaagcctccgtttgcttccaggtaaataccgaagactctgctttccccgctgccaggggcgagactcacaaacccctgaaaccggctcttaaaagaggcccctccgttactcggaatctgggtgagtctccgacaggcagtgctgaaagcgcaggaattgccctgagatctcttttttgtggatctccccctccggaggccgcttcagagaagctggagtcctgtgaaaagcgaaaactgaaacgcgtcagaatttcactggcctcagacgccgatctcgagggcgaaatgtcgcctgaggaaatactagaatgggaggaacagcagcttgatgagcctgtgaattttagcgactgtaaaattgatcctgccccctttcagctcgttgagaggacctccctccacaaaacacacacgatcttctccctgctaggtgtggaccacgcctatgtgacatcaattgggcgcctcatagggatagtgaccttgaaagagctgagaaaggccatcgagggatccgtcaccgctcagggtgtgaaggtgcgccccccactcgccagctttagagactccgctacttcaagttctgacaccgagacaaccgaggtgcatgccctttggggtccacacagcagacacgggttgcctagggagggatctcccagcgactctgacgataagtgccagtag

SEQ ID NO: 111981 - DNA, 2610 bp, Artificial Sequence
  Description of Artificial Sequence: Synthetic coding sequence
atggcagccgccgctgccgaggagggaatggaaccccgggcattacagtacgagcagactctcatgtacggtaggtacacacaggacctgggcgctttcgctaaggaagaggcagcgcgcattcggctggggggtcccgagccctggaaaggccctccatcgagccgggctgcccctgaacttctggagtacggacgctcaaggtgtgctcgctgccgcgtatgctctgtgcgatgccataagttcttagtgtcccgcgtcggagaggactggatcttcctggtgctcctaggtctgctaatggccctggttagttgggtcatggattacgccattgctgcctgcctgcaggcccagcagtggatgagtcggggccttaatacctccatcctgttgcagtacttggcctgggtaacttacccagtggtgctgattacattcagtgcaggatttactcagatcctggcccctcaggcagtaggatccggaattcctgaaatgaagacaatcctcaggggtgttgtgttgaaggagtacttgaccctgaagacctttatcgctaaagttatcggtctcacctgcgcccttggctcaggaatgccattgggcaaggaaggcccctttgttcacatagcctcaatgtgcgctgcattgctgtctaaattcttgtcactgtttggcggaatttacgaaaatgaaagccggaataccgagatgctcgctgctgcctgcgccgtcggcgtcggatgctgtttcgccgcccccatcggtggtgtgcttttttcgatagaagtcaccagtactttcttcgcagttcggaattactggcgcgggtttttcgccgcgacgttcagtgcctttatttttcgggttctagccgtgtggaatcgcgatgaagaaactatcaccgctctgtttaagacccgtttccgactggatttccctttcgatcttcaagagctgcccgcattcgccgtgataggtattgcctcaggattcggtggcgctctgttcgtgtacctcaaccgaaagattgtacaggttatgcgcaagcagaaaactattaacagatttctcatgcggaagcgcctgctttttccagccctggtgaccctactcatatctaccctgacctttccccctggtttcggtcagttcatggcgggccagctctcacagaaagagacgcttgtaaccctgtttgataatcggacatgggtgagacaaggattggtagaagagcttgaaccgcccagcactagtcaggcatggaatcctccccgagcaaacgtgttcttgacactcgtgatctttatcctgatgaagttttggatgtcggccctggctacgactattccagtgccttgcggcgccttcatgccagtcttcgtgattggtgctgcatttgggcgtctggtgggggaaagtatggccgcctggtttcctgatggaatccatactgactcgtccacgtatcgtatcgtgcctggaggctacgccgtggttggggccgctgcattagctggtgccgtgacacatacggtgtccaccgcggtcattgtgttcgagctcactgggcagatagcccatatcctgcctgtcatgatcgccgtgatactggcaaatgcagtggcgcagagtcttcagccctctctttatgatagtattattcgaattaagaaacttccatacttgcccgagctgggatggggtcggcaccagcagtatagggtgagagttgaagacattatggtgagagatgtccctcatgtagccctttcctgtactttccgcgaccttagactggccctccataggaccaaagggcggatgctggccttggtagagtctcctgagtcaatgatcctcctggggtcaattgagcgctcccaggtggtggcgttgctgggcgcccagttgagcccagcccggaggagacagcacatgcaggaacggagggcgactcagacgagtcctctatccgatcaggaaggaccaccaaccccagaggcctctgtgtgctttcaggtgaacacagaggacagtgcctttcccgccgcgaggggagagacacacaaaccactgaaacctgctttgaagagaggccccagcgttacaaggaatcttggagaatcccctactggctctgctgagtcggcggggatcgccctgcgatcactgttctgcgggagccctccgcctgaagccgccagcgaaaaactggaatcttgtgaaaaacgaaagctcaagcgcgtccgaatctcacttgcctcggatgcagacctcgagggtgagatgagtcccgaggaaatactggaatgggaggagcaacagctggatgagcccgtcaactttagtgattgcaagatcgatcccgcccccttccagttagttgagcgtacttccctgcacaagctgaggaaggctattgaagggagcgtaactgcccagggcgttaaagtgcggccacctctcgcctcctttcgcgactcagccacatccagtagtgacactgagacaactgaagttcatgctttgtgggggccccattcacgtcacggtctacctagagaaggctctccaagcgactcagatgacaagtgccagtag

SEQ ID NO: 111982 - DNA, 714 bp, Artificial Sequence
  Description of Artificial Sequence: Synthetic coding sequence
atgtctttcctcaagagcttcccacctcccggaccagcagaagggttgctcagacagcagcctgataccgaggccgtcctgaacggcaaggggttgggtacaggcaccttgtacattgcagaatctcgactctcctggctggacggttctggacttgggttcagtctggaatacccaaccatcagccttcacgccctgtccagagaccggtccgattgccttggcgagcacctctatgtgatggtgaacgcaaagtttgaagaagaatccaaagagccagttgccgatgaggaggaggaggacagcgacgacgatgtcgaaccaatcacggagttcaggtttgtgccttccgacaaaagtgccctggaagcaatgttcacagcgatgtgcgaatgccaagcgctacacccggacccggaggatgaagactccgatgattacgacggggaagaatacgatgtagaggcccatgaacagggacaaggggacatccctaccttctatacatatgaggagggactgagtcaccttacagctgagggacaagcaactctggagcgcctcgaaggcatgctctcacagagcgtttcttcccaatataacatggccggggtacgcacagaagactctattagagattatgaggacgggatggaagtggatactaccccaacggttgccgggcagttcgaggatgctgacgttgatcactag

SEQ ID NO: 111983 - DNA, 714 bp, Artificial Sequence
  Description of Artificial Sequence: Synthetic coding sequence
atgtcattcctgaagagctttccgccaccaggtcctgctgaaggtttgcttcggcagcagcctgacacggaggcggtgctgaacggtaagggcttggggactggaaccttatatattgccgaatctagactttcctggctggacggcagcggactgggcttctctctggagtatccaacgattagcctccacgctttgagtcgggataggtccgactgcctcggagagcatttatacgtgatggtcaatgctaaattcgaggaggaatctaaagagccagtggcagacgaagaggaggaggattctgatgacgacgtggagcctattacagagttcaggtttgtaccatcggacaaatctgccctggaagctatgttcacagcaatgtgcgagtgtcaggctctgcaccctgaccctgaggacgaagactcagatgactatgacggagaggaatacgacgtggaggctcatgagcagggacagggcgatatccctacgttctatacctatgaagagggcttatcacaccttacagccgaaggccaggccaccctggaaagattagagggtatgctttctcaaagtgtctcaagccagtataatatggcaggagtgagaacagaggattcgattcgggattatgaggacggcatggaagtggacacgacacccacagtggctggccagtttgaagatgctgacgtggatcactag

SEQ ID NO: 111984 - DNA, 504 bp, Artificial Sequence
  Description of Artificial Sequence: Synthetic coding sequence
atggtcctgcttctgaagggggtgccattcaccctgacaaccgtagacactcgccggtcccccgacgtactgaaggactttgcccccggatcacagttgcctatcctgctctatgattcggacgcgaagactgatacgctgcagattgaggacttcctggaagaaacgcttggtcccccagactttccctctttggcgccaaggtaccgggagtcgaatacagccggcaacgacgttttccataagttttcagcgtttattaaaaatccggtccctgctcaggatgaggcactctaccagcagctgttgcgggcactcgcacgcctggactcatacctgagggctcctttggaacatgagctcgctggtgaaccacaactccgcgagagccgccgcagattcctcgatggggatcggcttactcttgcggattgttccttactgcctaagctccacattgtggacaccgtctgtgcccactttagacaagcacccataccctag

SEQ ID NO: 111985 - DNA, 711 bp, Artificial Sequence
  Description of Artificial Sequence: Synthetic coding sequence
atggcagagacgaagctgcaactatttgtcaaagcaagcgaagacggggagtctgttggacattgcccctcttgccagagactgttcatggtgttgctgcttaagggcgtccccttcactttaactaccgtagacactagacgaagtcccgacgtgctgaaagacttcgcacccggatcacagttgcctattttactgtacgactctgatgctaaaaccgataccctgcagattgaggatttcctggaggaaacccttggaccgcccgacttccccagcttagcaccgcgataccgcgaaagcaatactgcgggcaatgatgtattccacaaattcagtgcatttattaaaaatcctgtccctgctcaagatgaagccctgtaccaacagttgttaagggctttagcccggctggatagctacttgcgcgccccactggagcacgagttggcaggagagcctcagctgagagagagcagacgcagattcctagacggggatagacttacgctggccgattgctccctgctgcccaagctgcatatagtcgacaccgtctgcgcccattttcgccaggctccgattcccgccgagctacgcggagtacgcaggtacctggattccgctatgcaggagaaggagttcaagtacacgtgcccgcattctgccgagatcttagcggcctacaggcccgcagtccacccgaggtag

SEQ ID NO: 111986 - DNA, 348 bp, Artificial Sequence
  Description of Artificial Sequence: Synthetic coding sequence
atgaattcaggtgtgtgcttatgcgtattgatggccgtactggcagccggggcactaacccagccagtgcctcctgccgatccggccggaagcgggctgcagagagccgaagaagcaccacgccggcagctccgcgtgagccagagaacggacggtgaaagccgcgctcatttaggagccttacttgcacggtacatccagcaggctaggaaagctcccagcggaagaatgagtatcgtgaaaaatctccagaatctagacccttcacaccgaatttccgatagggattatatgggttggatggacttcggccggagatcagctgaggaatatgagtacccatcatag

SEQ ID NO: 111987 - DNA, 348 bp, Artificial Sequence
  Description of Artificial Sequence: Synthetic coding sequence
atgaacagcggcgtgtgtttatgtgtgcttatggccgtcctagccgccggggccctcacccaaccagtccctccagcagatcctgccggcagtggccttcagagggcagaggaagcaccacggcggcagctgagagtgtcccagaggacagatggagaaagcagagctcatcttggcgccctactggcccgttatatccagcaagcccgtaaagctccaagtggtcgtatgagtattgtgaagaatcttcaaaaccttgatccatcccatagaatctccgacagagactacatgggttggatggatttcgggcggcgaagcgcagaggagtacgagtatccctcatag

SEQ ID NO: 111988 - DNA, 348 bp, Artificial Sequence
  Description of Artificial Sequence: Synthetic coding sequence
atgaattcaggcgtctgcctgtgtgtgttgatggcagttctggcagccggagctctcacccagccagtgccccccgctgatccagccggaagtggtttacaaagggcagaagaggcaccacgtcgacagttacgggtctcccagaggacggacggcgagtcccgagcacacctcggagccttgctggccaggtacatccaacaagcccgtaaggctccatccggacgtatgtcaattgttaagaacctgcaaaacctggatccttcacatcgaatttccgacagggattacatggggtggatggacttcggccggcgttcggccgaggagtatgaatacccatcatag

SEQ ID NO: 111989 - DNA, 1287 bp, Artificial Sequence
  Description of Artificial Sequence: Synthetic coding sequence
atggacgttgtggactcattactggtcaacggaagcaacattaccccgccatgcgaactcgggttagaaaatgaaacgctcttttgtctggatcagcctcggccttccaaagagtggcagcctgccgtgcagatcctgttgtattccctgatctttttgttgagcgtcttaggtaataccctggtgattaccgttctgatacggaacaaaaggatgagaacagtcacgaacatcttcctcttgtccctcgcagtcagcgatctgatgctttgtctattctgtatgccattcaacctcatccctaatctactgaaagactttatttttgggtctgccgtgtgcaagaccacaacctacttcatgggtacctcggttagtgtgagcacctttaaccttgtggccatctcactcgaacggtatggtgcaatatgtaaacccttgcaaagccgcgtctggcagaccaaatctcacgccctgaaggtcattgccgctacctggtgtctgagttttaccatcatgacaccataccccatctactccaaccttgtgccattcacaaagaacaacaaccagactgccaacatgtgccgcttcctcctccccaatgacgtaatgcagcaaagttggcacactttccttctgctcatcttgtttctgatccctggtattgttatgatggtcgcctatggccttatcagtctggaactgtaccagggcatcaaattcgaagcctcccagaagaagagcgctaaggagaggaagccgagcaccacaagctccgggaaatacgaagatagcgatgggtgttatcttcaaaagacccgcccacctcgaaaacttgaattacgccagctgtctacggggtccagtagccgagctaacagaattaggtcaaattcttccgcagccaatctgatggccaaaaaaagagtaattcgaatgttaatcgtcattgtggtacttttttttctgtgctggatgcccatcttctccgccaatgcctggcgagcatatgatactgcatccgcagaacggcgtctgtccggcacaccgatcagcttcattctactgctttcatatacttcatcttgcgttaaccctataatctactgttttatgaataaacggttccggctcggttttatggccactttcccgtgctgtcccaatccaggaccccccggcgcaaggggtgaggttggtgaggaggaggaggggggtacaactggagctagtttgtctagattctcctactctcatatgtccgcatccgtcccaccccagtag

SEQ ID NO: 111990 - DNA, 1344 bp, Artificial Sequence
  Description of Artificial Sequence: Synthetic coding sequence
atggaactgttgaagctgaataggagtgttcagggcactggccccggccctggggcgagcctatgccgcccgggggctccactgctgaattccagtagcgttggaaatctaagttgcgagcctcctcggatccgaggagcgggtactcgcgagctcgaactggccatccgtattacgttgtatgccgttatctttctcatgtctgtcggtggcaacatgctaattattgtggtgctcggcctgagccgccggctgcgtacagtcactaacgcttttctgctgtcattggccgttagtgatctgctgcttgccgtcgcatgtatgccctttacactgctgcccaaccttatgggaacattcatcttcgggacggtgatatgtaaagcggtgtcttatctgatgggagtctcagtgtcagtatctacgctctcattggtggccatcgccctcgagagatattccgcaatctgtaggccacttcaggcccgggtgtggcagaccaggtcacacgctgccagggtaatcgttgctacctggctgttgtccggtctgctcatggtcccttatccggtatacactgtggtccagccggtaggacccagagtgctgcagtgcgttcatagatggccctctgctcgcgtgagacagacctggagtgtgctgctgctgctgcttctcttctttatccctggtgtcgttatggcagttgcgtatggccttattagcagggagctgtatctaggtttgaggttcgatggcgactccgacagtgactcgcagagcagggtcagaaaccaaggagggctaccaggcgctgttcaccaaaacggccgatgccggcccgagaccggggccgtgggtgaggatagtgatggctgctacgtccagctgcccaggtcacggccagctctggagctgacagcccttacagcgccgggccctgggagcgggtccaggcctacccaggcgaagcttttggcaaaaaaacgcgtggtgcgcatgctgctcgtgatagtcgtcctgtttttcttgtgttggcttcccgtctattcagcaaacacttggagagcattcgacggccctggagcccaccgggccctctcaggggcccctatctccttcatccatcttctgtcatacgcctccgcctgcgtcaatccactagtgtattgttttatgcacagaagatttcggcaggcatgtctagagacctgcgctagatgttgccctcgtcctcctcgagctagaccccgtgcccttccggacgaagatccccctacaccctccatagcttctctgtccagactgtcttacacaactatcagcaccctaggtccaggatag

SEQ ID NO: 111991 - DNA, 1551 bp, Artificial Sequence
  Description of Artificial Sequence: Synthetic coding sequence
atggagctgctgaaactcaataggtccgtccaggggacaggcccaggtcccggagcctccctgtgtaggcccggtgcccctctgttgaactcgtctagtgtagggaatctgagttgtgagcccccccgtatcagaggcgccggaacaagagaactcgagttggctatacgaattaccctttatgccgtaatttttctgatgagcgtggggggtaatatgctgatcattgtcgtactggggctctcaagacggctccggaccgtcactaatgcattcttgctgtcgctcgctgtgagcgaccttcttctggcggtagcgtgcatgcctttcaccctgctgccaaacctgatggggactttcattttcggcacagttatttgcaaggccgtgtcttatctcatgggcgtctccgtctcggtctccacgcttagtctggtcgccattgccctggagcggtatagcgccatatgccggcccctgcaggccagggtttggcagacaaggtctcacgccgccagggttattgtagctacctggcttctatccggacttctgatggtcccttatcctgtgtatacggtggtccagcccgttggcccaagggtgctacaatgtgtgcaccgatggcctagcgcccgcgtgcggcaaacctggagcgtgctactgctcctgttgcttttcttcattcccggggtagtgatggctgtcgcctatggcctcatttctagagaattgtacctcggcctccggttcgacggagactctgatagtgatagtcagtccagggtgaggaaccagggcgggttgcctgggggagccggccctcgcgagcagaatttgggcgaagccgaactgtggcgtgctacggggcccgctggcgtaggcggaactgagatgaaggtacgggtaagacggaagttagagatggaactgtcttgggagaggcggtcggggggagattgggctggggattggggcgactcccccttcagcctgacagcacatcccctgtgcagcggggccgtgcatcagaacggccggtgtagaccggaaactggcgccgttggcgaagattccgatggatgctacgtgcaactgcccagatccaggcccgccctggagctcactgccctcacggcccccggtccgggcagtggatccaggcccactcaggcgaaattactggctaaaaagagggttgtgcggatgctccttgtgattgtagtgcttttctttctgtgttggttgcctgtctacagtgctaatacgtggagggcgtttgatggccctggagctcaccgtgccctgtctggcgctcccatttcatttatacacctgctgtcatatgcatcggcctgcgtcaacccccttgtgtactgctttatgcacaggcgttttaggcaagcatgcttggagacctgtgcacgatgttgcccaaggcctcctcgcgcccggcctagagcactccctgatgaggatccccctactccatcaatcgccagccttagtcgactgagttatacgactatttcaacattagggcccggatag

SEQ ID NO: 111992 - DNA, 819 bp, Artificial Sequence
  Description of Artificial Sequence: Synthetic coding sequence
atgagctgtcacaactgttctgatccccaggtactttgctcctccgggcagctgttccttcaacccctctgggaccacctgagatcctgggaggctctgctgcagagccccttcttccccgtcattttctctattactacatatgtggggttctgcttaccgttcgttgtgctcgacattctctgctcctgggtgcctgcactacgacggtataagattcaccccgatttcagccccagtgcgcagcagctgcttccttgtctgggccaaactctgtatcaacacgtgatgtttgtattccccgttacactcttgcattgggccagaagccccgcactgctcccacatgaggccccagaactcctgctgctgctccatcacattctcttttgcctattgctgttcgacatggaatttttcgtttggcatctactgcaccataaggtgccctggctgtaccgcacttttcacaaagtgcatcatcagaactctagttcctttgcgctggccacacagtatatgtcagtttgggaactgttctctttgggattctttgacatgatgaacgtgacattattgggctgccaccctctgacaactctgacctttcatgttgtgaacatttggctcagtgtggaagaccactctggttacaacttcccatggtccacccaccggttggtgccctttggttggtatggaggcgtggtgcaccatgatttacaccattcgcactttaactgtaattttgctccttactttacgcattgggataagatactgggcaccctcagaacagccagcgtgcccgcaagatag

SEQ ID NO: 111993 - DNA, 1482 bp, Artificial Sequence
  Description of Artificial Sequence: Synthetic coding sequence
atgctggccgctacagtcctgaccctggctctcctcggcaatgctcatgcatgttctaaggggacaagtcacgaagcaggcatcgtctgtcggatcacgaagcctgctctacttgtcctcaaccatgaaaccgccaaggttattcaaaccgctttccagcgtgcatcttatcccgatataaccggcgagaaggcaatgatgctgcttgggcaggtgaagtacggcctgcacaatattcagatcagccatctgagcattgcttcgtctcaagtcgagttagtcgaggccaaaagcatcgacgtgtcaattcagaacgtatctgtcgtgtttaaaggcactcttaaatatgggtatactactgcttggtggctaggcatcgatcagtccatcgacttcgagatcgatagcgcaattgaccttcagatcaatactcagttaacctgcgattcaggtcgcgtgcggactgatgctccggactgttacctgtccttccacaaactgttactgcacctgcagggtgagcgggagcctggttggattaagcagctgtttaccaacttcatctcatttacattgaagcttgtactgaaaggccaaatctgtaaggaaatcaacgtcatttccaatatcatggctgatttcgtccagactagggccgcttctatcctatctgacggagacatcggcgtggacatttctctgactggcgaccccgttattactgcttcctacttagagtctcatcacaaaggccacttcatatacaagaatgtctcggaggatcttccgctgcctacctttagcccgactctgttaggggactccaggatgctttacttttggttttcagagagggtatttcatagcctcgcgaaagtagcatttcaagatgggcgcttaatgctctccctgatgggcgacgagttcaaggccgtcttggaaacctggggttttaacacgaaccaagaaattttccaagaggtggtaggcgggttcccttcacaggcacaggtgacggtccattgtctaaaaatgccaaagatctcctgccagaataaaggtgtggtggtgaactcttccgttatggtgaaatttctcttcccccggcctgatcagcaacacagtgtggcttacacttttgaagaggacattgtcactactgtgcaggcaagttattctaaaaagaagttgtttctgtctctgctggattttcagattactcctaaaacagtgtctaatcttacagagtcctcatctgagagtgtccagagcttcctgcagtccatgattaccgcggtcggtatacctgaggtgatgtcacggctggaagttgtctttactgcgctgatgaattcaaaaggagtttccctgtttgatattatcaatccagaaattatcacaagggacggatttctgctcctacagatggacttcggtttcccagaacatttgcttgtagatttcctgcaaagtctttcctag

SEQ ID NO: 111994 - DNA, 1302 bp, Artificial Sequence
  Description of Artificial Sequence: Synthetic coding sequence
atgctggccgccaccgttctgacactagccctgctggggaacgcccacgcttgctccaaaggcacgtctcacgaggcgggcatagtctgcagaattacgaagccagcactgctcgtcctgaaccacgagacagccaaagtcattcagactgcctttcagagagccagttaccctgatataaccggggagaaagctatgatgctactcggacaagtgaagtacggactgcacaacatccagatctcccatttatccatcgcatcgagtcaggtggaacttgtagaagccaaaagcatagatgtgtcaatccagaacgtgtccgttgttttcaaagggacactaaagtacggatacacaacggcttggtggttgggcatcgatcaaagtatagatttcgagatcgattcagctattgatttgcaaatcaatacacagcttacctgcgactctggacgcgtccggactgatgccccagattgctatctctctttccacaagctcttactgcatttgcagggcgaaagggaacctgggtggatcaaacagctctttacaaactttatttctttcacactgaaacttgttctaaaagggcagatttgcaaggagattaacgtcatctccaatataatggcagattttgtgcagacccgagccgcgagcatactgagcgacggggatataggagtggacatctctctcaccggcgaccctgtcatcactgcatcatatctggagtcacaccacaaggcggtgcttgaaacctgggggtttaacacaaaccaggagatatttcaagaggtggtggggggttttccgtcccaggcccaggtgaccgtgcattgtctaaagatgcctaagatttcttgtcagaacaagggcgtggtggtgaacagtagcgtcatggttaaattcttattcccacgtcctgatcagcaacacagtgtggcttatacgttcgaggaggatattgttaccaccgtgcaagctagttatagcaagaagaaattatttctgtctctcctggactttcaaatcacacctaaaaccgtctctaacttgaccgagtcctcctcagagagcgtgcagtccttcctccagtccatgatcactgctgttgggatccctgaggttatgtctaggctggaggtggtcttcaccgctctgatgaacagtaagggagtctctctgtttgacattattaatcctgagataatcacacgggatggcttcctcctgctccagatggactttgggtttccagaacatttgctcgtcgattttcttcagtcgctctcatag

SEQ ID NO: 111995 - DNA, 1374 bp, Artificial Sequence
  Description of Artificial Sequence: Synthetic coding sequence
atgaagactaagttttgtactggaggagaagctgagccatcccctcttggcctcctactgtcctgcgggagtggctctgctgcccccgcccccggtgtgggacagcagagagatgcagccagcgatctagaatcaaagcagctgggcggacaacagcccccactcgccctgcctccaccgccccccctaccgctgccacttccactcccccagcccccccctccacagccccccgccgatgaacagcccgaacccaggaccagacggagagcctatctgtggtgtaaagagttcctgccaggggcttggcggggtctgagggaggatgagtttcacatttccgtgatcagaggaggactcagcaacatgttattccagtgtagtctgcccgacaccaccgcgacactgggggacgaaccacggaaggtcctgttgagactgtacggcgcgattctccagatgcgcagctgtaataaggagggcagcgagcaagcacagaaagaaaatgaattccaaggagctgaagccatggtcctcgaaagcgtaatgttcgccattcttgcagagcgaagcctgggacctaagctctacggaattttcccacaaggaaggctggaacagttcataccatctcggcgcctggatactgaagagctaagcctgcccgatataagtgccgaaatagctgagaagatggccactttccatggcatgaagatgccgttcaacaaggagccaaagtggctctttgggacgatggagaagtacttaaaggaggtcctgcgtataaaatttaccgaagagtcccggataaaaaagctgcataaactgctaagctacaacttacccctagaactggaaaaccttaggagcctgctggagtcaactccatcccccgtggttttctgccacaatgattgtcaggaaggtaacatactgctgctcgaaggaagagagaactccgaaaaacagaagttaatgttgatcgattttgagtattcctcttataattacaggggatttgatatcgggaaccacttctgtgagtggatgtacgactactcctacgagaagtacccattcttcagagcgaacattaggaaatacccaactaaaaaacagcagctccactttattagctcctatctgcccgcctttcaaaacgatttcgaaaatctgtccactgaagagaagagcataattaaggaggagatgcttttagaagtgaaccggttcgctctggcaagtcatttcctgtggggcctgtggtcgatcgtgcaggccaagatctctagcattgagtttggatacatggactacgcccaggccaggtttgatgcatacttccaccagaagagaaagcttggagtgtag

SEQ ID NO: 111996 - DNA, 1320 bp, Artificial Sequence
  Description of Artificial Sequence: Synthetic coding sequence
atgaagacaaagttctgcaccggtggagaagcagagccctctcctttggggctgttgcttagctgtgggtccggcagcgctgcacctgccccaggtgtgggtcagcagcgcgacgcagcatcagatctggaatctaagcagctaggagggcagcagccaccactggccctgccacccccccctcctctcccacttccgcttcccctcccccagcctcccccaccccaacctccagcggacgagcagccggaaccacgcacccgccgccgcgcttacctctggtgtaaagagttcttgcccggcgcatggcgcggcctcagagaggacgaattccatatttctgtgattaggggtggtctaagcaatatgctttttcagtgtagtctccccgacacgaccgccacactgggtgatgagcctaggaaagttctgctccgtctgtatggggccatcttgcagatgggagcagaagccatggtgctggagagcgtgatgttcgcgatcctggccgagaggtcactaggaccgaaactctatggtatcttcccacaaggccgcctcgaacagttcattccatcacggcgactggacaccgaagagttgtccctgccggatatcagcgccgaaatcgctgagaagatggccacctttcacgggatgaaaatgccattcaataaggagccgaagtggctgtttggcaccatggagaagtacctcaaagaagtgctgcgcatcaaatttactgaagagtcgaggatcaaaaaactgcataagttgctgtcttacaatctccccctcgaactggaaaatctcagatctctgttagagtcgactccttcgcctgttgtgttttgccataatgattgtcaggagggcaatattctgctgttggagggccgggagaattcggaaaagcagaagctcatgttgatcgactttgaatacagcagttacaactacaggggattcgacatcggcaaccacttttgtgagtggatgtacgactacagttatgagaagtacccctttttccgcgcgaacatcagaaagtaccccaccaagaagcagcagctgcactttatttcaagctacttgccagctttccagaacgatttcgagaatctcagcaccgaagaaaagtccatcattaaggaggagatgctcctagaggtcaatcggttcgccttagctagccacttcctctggggcctgtggagcatcgtgcaggcaaaaatatcgagcattgagttcgggtatatggattatgcacaggcacgattcgatgcatactttcaccagaagagaaagctgggagtgtag

SEQ ID NO: 111997 - DNA, 1188 bp, Artificial Sequence
  Description of Artificial Sequence: Synthetic coding sequence
atggcagctgaggcaaccgcagtggccggcagcggcgctgttggagggtgcctggccaaggatgggctgcagcagtctaagtgcccagacactactcccaagcgcagaagggcctcgtccctgagccgggacgccgaacgcagggcctaccagtggtgcagagagtacctcgggggagcttggagaagggtgcagcccgaggagctgagagtttacccagtctcaggcggcctatctaatctgctctttagatgttcccttcctgaccacctgccttcagtgggtgaggaacccagggaagtcctgctgcgtctttacggggcaatcctccagggagtggacagtttggttctggagtcggtcatgtttgctatcttagccgagagatctctgggaccgcaactgtacggcgtgttcccagaaggacgactcgagcaatacatcccgtcccgacccctgaaaacccaggagctccgggaacccgtcttgtctgccgccattgccaccaagatggctcagttccacgggatggagatgccttttaccaaggaacctcactggctatttgggacaatggagcgatacctcaagcagatacaggacctgccaccaacaggcctacccgagatgaatctcttagaaatgtatagcttaaaggatgaaatgggaaacttgagaaagttgctcgagtccacaccaagcccagtcgtcttctgccacaacgatatacaggaggggaatatcctcctccttagcgaaccagagaacgccgattccttgatgctcgtggattttgaatatagttcctacaattatcggggatttgatatcggaaatcatttttgcgagtgggtgtatgactacactcacgaagaatggcctttctacaaagcacggcctaccgactatccaacgcaagagcagcagcttcacttcataagacactacttagccgaagccaagaagggcgaaaccctctcccaagaggaacagcggaaattagaggaggacctcttggtcgaagtgtctcggtatgccttggcctctcattttttttgggggttgtggtctatcctccaggcctccatgtcaacaattgagtttgggtatctggactacgcccaaagcagattccagttttacttccagcaaaagggccagctgaccagtgtgcatagttctagctag

SEQ ID NO: 111998 - DNA, 2247 bp, Artificial Sequence
  Description of Artificial Sequence: Synthetic coding sequence
atggggctgcgcaccgccaagaaaaggggccttggaggcgggggcaagtggaagcgcgaggaaggtggaggtacccgagggcgccgagaggtgcgccccgcctgctttctgcaaagcgggggcagaggagatcctggtgatgtcggagggcccgccggaaaccctgggtgcagtccccacccgcgggctgccactcgacccccccccctgccggcccatacccctgctcacacacctgaatggtgtggtgctgctagtgctgaggcagccgaaccccgcagagccggaccccatctgtgcattcccgctcctggcttgacaaagacacctatactggaaaaggtgcctagaaagatggccgccaagactcctagtagcgaagagtcggggctgccaaaactgcctgtgccacccctgcaacagacactcgctacatacctgcaatgtatgcgtcacttagtgtcagaggaacagttcaggaaatcccaagctatcgtgcaacagtttggggctcctggcgggctcggggaaaccctgcaacagaagctgttagaacgacaggaaaaaacagccaattgggtgtccgagtattggcttaacgacatgtatctaaataatcgtctcgcgctccccgtgaactcatcacccgctgttatctttgcgcgccaacacttccctggcactgatgaccagctcaggttcgcggcaagcctgatcagtggcgtgctcagctacaaagccctgttagacagccattccatccccacagattgtgctaagggacagctttccgggcagcccctgtgcatgaaacagtactacggcctgtttagctcttataggctccccggtcacacgcaggacacccttgtggctcaaaactctagtatcatgcctgagccagaacacgtgatcgtcgcatgctgtaaccaattcttcgtcctggatgtggtaattaactttcgaaggctgtctgaaggggatctattcacccagctccgaaaaatcgtcaaaatggcctccaacgaggacgaaagacttccccctattgggctgctgacttctgatggcaggagcgaatgggctgaagcaaggaccgtgctggtaaaggattctaccaatagggacagcctggacatgattgagcggtgcatttgcttggtgtgcctggatgctcccgggggagtcgagctatcagacactcatcgagcacttcagctattacacggtggtgggtattcgaaaaatggggccaaccggtggtatgacaagtctctgcagttcgtggtggggagggacggtacttgcggagtggtatgtgagcactctcctttcgacggcatcgtgctggtgcagtgcactgaacatctcctgaagcacgtgacccagagcagcagaaaactcattagggcggattcagtgtcagaactacccgcgccacgacgcttgcggtggaagtgttctccagagatccagggacacctcgctagttccgcggagaaactccagagaattgtgaagaacctcgactttatagtgtataaattcgataactacggaaagacctttataaaaaaacagaaatgctcgcccgatgccttcattcaagtggcattgcagctcgctttttacaggctgcatcgccgtctggtgccaacctatgagtctgcttcaatccgcagattccaagagggaagagtggataacatcaggtccgccacacctgaggccctcgcattcgtgagggcggtaactgatcataaagccgccgtgccggcctccgaaaagttgctgctgttgaaagacgcaatccgggcacagaccgcctacactgttatggcgatcacgggcatggcgatcgacaaccatttgcttgcattgcgcgaactcgcccgagccatgtgcaaagaacttcctgagatgttcatggacgagacatacctcatgtcaaaccgtttcgtgttgtcaaccagccaggtgcccaccacaaccgaaatgttttgctgctatggtcctgtggttccaaatggatacggcgcatgctacaatcctcagcccgaaaccatcttattctgcatatctagctttcactcctgtaaagagacatccagtagcaaattcgccaaggctgtcgaagaaagtttaatcgacatgcgcgatctgtgcagtctgctgccccccacagaatcaaaaccactagccaccaaggagaaagcgacaagaccttcgcaagggcaccaaccctag

SEQ ID NO: 111999 - DNA, 1893 bp, Artificial Sequence
  Description of Artificial Sequence: Synthetic coding sequence
atggcagctaaaacaccatcctcagaggagtccggtttaccaaaactgccagtgccgccacttcagcaaacactggccacttatttgcagtgcatgcggcacctcgtctctgaggagcaattccgcaagagccaggcaatcgttcagcaattcggcgccccaggcggactgggggagacgcttcagcagaaattgctcgagaggcaagagaaaacagcaaattgggttagcgagtactggctcaacgatatgtacctgaacaatagactggcactgcctgtgaactccagcccagctgtgatcttcgcacgccaacactttccaggtacagacgaccagcttcggtttgctgcctcgttgatatccggagtcctctcttacaaggctctactcgattcccattctattcccactgattgcgcaaaaggacagctctctggccagcccttgtgcatgaagcagtactacggcctgttttctagttaccgactgcctgggcacacccaggacactctggttgcgcagaactcgtccatcatgccagaacccgaacacgtaatagtggcttgctgcaatcaattcttcgttctggatgttgtaatcaacttcaggcgcttgtctgagggcgacttgtttactcagctgcggaagattgtcaagatggccagtaacgaggacgaaagactgccgccaatcggactcctgactagcgacggtcgcagcgagtgggccgaagcccggaccgtcctggtgaaggattcgaccaacagggattcacttgatatgatagagcgctgcatttgcctcgtgtgcctagatgcaccgggaggcgtcgaactttccgacactcaccgtgcccttcagttacttcatggggggggttatagcaagaacggcgcaaacaggtggtacgataagtcacttcaattcgtggtgggacgcgatggaacttgcggcgtcgtgtgtgagcacagcccctttgatggaattgtgctggtccagtgtacagagcacctcttgaagcacgtgactcagtcctctcgtaagctgatcagagctgactctgtgtcagagcttcctgcgccaaggaggctgaggtggaaatgtagtcctgagatccaaggtcatttggcatcctccgctgaaaagctgcagcgcattgttaagaacctcgattttatcgtgtataagtttgataactacggtaagaccttcatcaaaaagcagaaatgctctcccgatgcattcatacaagtggcccttcagttggccttctatcgcctccaccgcaggctggtccccacatacgaatctgcctctatcagacgattccaggaaggacgagttgataacataaggtccgctaccccagaagcacttgcttttgtgagagctgttaccgaccacaaggccgctgtgcctgcctcagaaaaacttctactgctgaaagatgcaatccgcgctcaaacagcctacacagtgatggccatcaccggtatggccatcgataatcaccttctggccctgcgcgagctagcgagagccatgtgtaaggagctaccagaaatgtttatggatgagacatatctcatgtctaatcgtttcgtcttatccacttcccaggtacccacaaccaccgaaatgttctgttgctatggaccagtggttcccaacggctatggcgcctgctacaaccctcagcctgaaaccattttgttctgtattagctcttttcactcatgcaaggaaacaagtagctccaagtttgccaaggccgtggaggagagccttattgacatgcgggacctctgttctcttctgccacccaccgaatccaaaccattggccaccaaggagaaggctacacgaccctcgcaaggtcaccagccctag

SEQ ID NO: 112000 - DNA, 1893 bp, Artificial Sequence
  Description of Artificial Sequence: Synthetic coding sequence
atggctgccaaaacaccaagttccgaggaatcaggactccccaaactgccggtgcccccactccagcagaccctagccacctacctgcaatgtatgcggcaccttgtatcagaggaacagtttcgcaaatcccaggcaatagttcagcaatttggggctcctgggggactcggggagacactgcaacagaagctactcgagaggcaggagaaaactgctaattgggtgagcgagtactggctgaacgacatgtatctgaataatcgactcgctctgcccgttaactccagccccgctgtgatcttcgcacgtcagcacttccctggtaccgatgatcagctgcggtttgccgcctccctgatttctggagtgctcagttacaaagcattactcgatagtcactccatccctaccgattgcgctaagggccagctaagcggtcaacccctctgcatgaaacagtactatggcctttttagtagctaccgcctgcccggacacacacaggacactctggtagcacaaaactcaagcataatgcctgagccagagcatgtaatcgtggcctgctgtaaccagttttttgtgctggatgtggtgattaacttcaggaggctgagcgaaggtgatcttttcacacagttacgaaaaatcgtgaagatggcctctaatgaggatgaacgcttgccccctataggactcttaacttcggacggacggtccgaatgggctgaagcacggacagtgctggtgaaggacagtacgaacagagattcgctcgatatgatcgaacgttgcatttgcttggtgtgcctagacgccccggggggtgtggagctgagtgacacccaccgtgcccttcagctactgcacggcggggggtattccaagaacggcgcgaatagatggtacgataaaagccttcagttcgtggtgggcagagatggcacttgcggggtcgtttgcgaacacagcccgttcgacggcattgttctggtgcagtgcacagagcatttacttaagcacgttacccagagctcacgaaaactcattcgggccgattcagtgagtgaactcccggccccccgccgcctcagatggaagtgtagcccagagattcaggggcatctggcgtcttccgctgaaaagctgcaacggattgtcaagaaccttgacttcatcgtatacaagtttgacaactatggaaagacctttataaaaaaacaaaagtgctctccagatgcctttattcaggtggcacttcaattggcgttctataggctgcatagaaggctggtacccacctatgagtctgcctccataaggcgcttccaggaagggcgggtcgacaatattcgttcggctacacccgaggcactggctttcgtacgggcggtgactgaccataaggccgccgtgccggcatctgaaaagttgctcctcctcaaggatgcgattcgggcacagacagcttacaccgtcatggctatcaccggcatggcgatcgacaatcacttgcttgccctgagggagttggcccgggccatgtgtaaggaattaccggaaatgttcatggacgagacctacctcatgtctaatcgctttgtgcttagtacgtctcaggtgccaactactaccgagatgttctgctgttacggtccggtcgtgccgaacggctatggcgcttgttacaatccacaacccgagacaatcctgttctgcatttcctcattccattcctgcaaagagacttcttccagtaagtttgccaaagccgtggaggaatctctcattgatatgagggatctgtgctctctgctgccccctaccgagtcaaagccgcttgcaaccaaggaaaaggctacgcgtccttcccaggggcaccagccttag

SEQ ID NO: 112001 - DNA, 1893 bp, Artificial Sequence
  Description of Artificial Sequence: Synthetic coding sequence
atggcagcaaagaccccttcgagcgaagagtcagggcttcctaaactccccgttcctcctctgcagcagacactggctacatatctccagtgtatgcgtcatctggtgagcgaggagcagtttcggaagtcgcaggccatcgtacagcagttcggggctcctggaggattgggagaaaccttacagcagaagctattggaaagacaggaaaagactgccaattgggtctcagagtactggcttaatgacatgtatctgaacaataggctggcgctcccagtgaatagctctccagccgtcatcttcgcccgtcagcattttcccggaactgacgaccagctcagatttgccgcctccctgattagcggcgtcttgagctataaagctctcttggacagtcactctatccctactgactgtgcaaaaggacagctttctggtcagccactgtgtatgaaacagtattatggccttttctcatcatacagactgccgggccatacccaggatactctggtggcccagaactcgtccataatgcctgagccggagcacgtcattgtggcttgctgcaatcaattttttgtgctggatgtggttatcaacttccgccgtctgagcgagggcgatctgtttacgcagctgagaaaaatagtgaaaatggcttccaacgaagacgagagacttcccccaattggtctcctgacttcagatgggcgtagtgagtgggccgaggccagaaccgtgctcgtgaaggactccactaaccgcgattcactggacatgatcgagcggtgcatatgcctggtttgcctcgatgcacccggtggtgtggaactgtccgacacccacagggccctacagctactccacggaggtggctactctaaaaacggcgccaatcgctggtatgacaaatccttgcagtttgttgtgggacgcgacggtacatgtggcgttgtgtgcgagcactcaccctttgatggtattgtattggtccagtgtaccgagcatctactgaagcacgtaacccagtcgtctcgaaaactgatcagggccgacagcgtctcagaactccccgcgccgagaagactgagatggaaatgctcccctgaaattcaaggtcatctggccagttctgccgaaaagttgcaacggatagtgaaaaatctagacttcattgtatataaattcgataactatggaaaaaccttcataaagaagcagaagtgttcaccagatgcatttattcaggttgcacttcagttagctttttacagattgcataggcgcctcgtaccaacttacgagagcgcatcgatccgtagattccaggagggacgtgtcgataatatccgcagcgcgactccagaggcactggctttcgtcagagccgttaccgaccacaaggcagcagttccggctagcgaaaagttacttctgctgaaggatgcgataagagctcagactgcctacactgtgatggccatcaccggcatggccatcgacaatcaccttcttgctctgcgggaacttgcccgcgcaatgtgcaaagagctacccgaaatgtttatggacgaaacatacctcatgagcaatagatttgtgctctctacaagtcaggtgccaaccacaaccgaaatgttttgctgttatggacccgtggtgcctaacggctatggcgcctgttataaccctcagccagagacgattctgttctgtatctcttcctttcatagttgcaaggaaacctcctcgtcaaaattcgctaaggctgtggaagaatcactgatcgacatgcgggacttatgctccctcctgccccctaccgagtccaagcctctggcgacaaaggaaaaagccacccgcccgagtcagggtcaccagccttag

SEQ ID NO: 112002 - DNA, 2001 bp, Artificial Sequence
  Description of Artificial Sequence: Synthetic coding sequence
atgtggcctgagtgtagggacgaggccctttccacagtgggtccacatctgtgtatccccgcccccggcctaactaaaacacccatcctggagaaggtgcctaggaagatggctgccaagactccttccagtgaagaatcaggcttgccgaagctccctgtgcccccactgcagcagacgctggctacctatctgcagtgtatgcgccaccttgtgtcagaagaacagtttcgaaaaagccaagccattgtgcagcagttcggggcccccggaggactgggagagactctgcagcagaagctcctcgaacgacaggagaaaaccgccaactgggtgtcagaatactggctgaacgacatgtacctgaacaatcgcctggctcttcccgtgaactcgtcgcccgcagtgattttcgcccgccaacacttccccgggaccgacgatcagctcagatttgccgccagtttaatctctggtgtgttgagctataaagcattactggatagtcacagtatacccaccgattgtgccaagggccagctgagtggacagcctctttgcatgaagcagtattacgggctattttcgagctaccgcctgcccggccacacccaggataccttggtggcccagaacagctccatcatgccggaacctgagcacgtgatcgtggcttgttgtaaccagttctttgttttagatgtcgttattaattttcgacggttgtctgaaggcgatctgttcactcaactgaggaaaatcgtgaagatggcatcaaacgaggatgagcgtctgccccccattggactgctgacatcagacgggcgctctgaatgggctgaagctagaacagtgttagtcaaagattcgactaacagggatagcctggacatgattgagagatgcatctgtttggtatgcctggatgccccgggcggagtcgaactgtctgatacccaccgggctctccagctgttgcacggtggtggatattccaaaaatggtgccaacaggtggtatgataagtcactgcagttcgtggtcggtagagacggaacttgcggggttgtatgcgagcacagcccctttgacgggatcgtgctggtccagtgtacggagcacctactgaagcacgtgacccaaagtagcagaaaattgattcgggccgatagcgtgagcgaactgccggcccctcgccgactcaggtggaaatgttccccagaaatccagggacacctcgccagctccgctgagaagctgcagaggattgtgaaaaacctggacttcatcgtgtacaagttcgataactatggaaaaactttcatcaaaaagcagaaatgcagccctgatgcattcattcaagtggcgctgcaacttgcgttctaccgcctgcatcggagactggtacccacatacgagagcgcctcgattcggcgcttccaggagggaagagtcgataacatcaggtctgctacacccgaagcattggcctttgtccgggccgtgacagaccataaagcggcagtgcccgcctcagagaagcttctgctgctgaaagacgctattcgggcacagacggcctatactgtcatggcaatcactggtatggccattgataatcacctgttagcactcagagaactcgcacgcgctatgtgcaaagaactgcctgaaatgttcatggacgagacgtatctgatgagcaaccggttcgtcttgtcaacaagccaggtgcctacaactaccgagatgttctgctgttatgggccggtggtcccaaatggatacggggcttgttacaatccacagccagaaaccattctcttttgtatcagttcctttcattcttgtaaggaaacctcatcctccaagttcgcgaaagccgtagaggagtctctgatagacatgagggacctttgtagtctgctccccccaaccgaaagtaagcccctagcaaccaaggagaaagcgacccggccttcccaggggcaccaaccttag

SEQ ID NO: 112003 - DNA, 1638 bp, Artificial Sequence
  Description of Artificial Sequence: Synthetic coding sequence
atggctgccaaaaccccttcgagcgaggagtctggactgcccaaacttcccgttccccccctgcaacagactctagcgacctacttacaatgcatgcggcacctggtcagtgaagaacagtttcggaaatcccaagccatagtgcagcagttcggcgccccagggggcttgggcgagacgctgcagcagaagttgctcgagagacaggagaagaccgccaactgggtgagcgagtattggttaaacgacatgtatctgaacaaccgcctggctctcccagttaatagttcacccgcagtcatctttgccaggcagcatttcccgggcacggacgatcaacttaggtttgctgctagcttaatcagcggcgtcttatcctataaggccttacttgattcacactcgatccctaccgactgcgccaagggtcagctgtccggccagccgctgtgcatgaaacaatattacggcctattctcgagctatcgactccctggccacactcaggataccctcgtggcccagaacagtagcatcatgccagaacccgagcatgtcatcgtcgcctgctgtaatcagttttttgtgctggatgttgtgattaattttagaagactgtcggagggcgacctgttcacacagctgcgtaagatagtcaaaatggcaagtaatgaggatgaaagactgcccccgatcggattgctgacctccgacggccggtctgagtgggcagaggccaggactgtgctcgtgaaagacagtacaaatcgggactccctggatatgattgagagatgcatctgtcttgtttgtctcgatgctcccggaggggtagagctgtccgatacgcacagagcgctccagttactgcacggaggcggatatagcaaaaatggagccaatagatggtacgacaaatcactgcagttcgtggtcggcagagacggaacttgcggggtggtgtgtgaacattccccttttgatggcattgtgttggtacagtgcaccgaacatctccttaagcatgtgacacagagttcccggaaattgatccgcgccgactccgtgagcgagcttccagctccaaggagactcaggtggaaatgcagccccgagatccaggggcacctagccagctccgccgaaaagctgcaacgcattgttaaaaatctggactttatcgtgtataaattcgataactacggaaagacctttatcaaaaagcaaaagtgttcccccgatgctttcattcaagtggccctgcagctggctttttaccgattgcaccgaaggctcgtccccacctacgagtccgcctctatcaggagatttcaagagggtagggtggataacataaggagtgccacacctgaagccttagcgtttgtacgtgcagtgactgatcataaggctgcagtcccagcctctgagaaactcctgttattaaaagatgccattcgagcacagactgcctacaccgtaatggctatcaccggcatggccatagacaaccacctcctggccctcagggaactggcacgcgctatgtgtaaagagctgccggagatgtttatggatgaaacctacctcatgagcaatagattcgtcctgagtacttcacaattatgctggccatag

SEQ ID NO: 112004 - DNA, 1383 bp, Artificial Sequence
  Description of Artificial Sequence: Synthetic coding sequence
atgaatacatcagccccaccagcagtgtccccaaatataacggtgctggcccccggcaaaggaccctggcaggtggctttcattggaataacaacaggactgctgtcactggcaaccgtgaccgggaacttgcttgttctgatcagtttcaaggtaaatactgagctgaagaccgtgaacaactattttctgctcagcctggcatgtgccgatcttatcatcggaaccttctctatgaacctgtataccacctacctgttgatgggccattgggcactcggcactttggcatgcgacctgtggctggctttggactatgtggcgtcaaatgcgagtgttatgaatctgttactgatctccttcgatcgatatttttcggtaacacgcccactttcatatagggcaaagaggaccccgcgacgcgcggccctgatgattgggctggcctggctcgttagttttgtgctgtgggcacccgctattctgttttggcaatatctggtcggggaacgaaccgttctggccggtcagtgctacatacagtttttgagtcaacccatcatcacttttggcacagccatggctgccttttatcttcccgtgactgttatgtgtactctctactggaggatttaccgagagaccgagaacagagcacgggagctggctgcactgcagggaagcgaaacccctggtaagggcggaggttcatcatcctcctccgagagatcccagcccggggccgaggggagccctgagacaccccctggccggtgctgccgatgctgccgtgctcccaggctcctgcaagcttacagttggaaagaggaggaagaggaggacgaaggctcaatggaaagtctgaccagcagcgagggcgaggaacctgggtcggaagtcgtgatcaaaatgcccatggtggaccccgaggcacaagcaccaacaaaacagcctccccgatcaagcccaaacaccgtcaagagacccacaaagaaggggagggacagagcagggaagggacagaaacctcgtgggaaagagcaactcgccaaaaggaagaccttctcactcgttaaggaaaaaaaggccgcccgcacattgtccgcgattcttctggcattcatcctgacctggacaccctacaacattatggtgcttgtctccactttctgcaaagactgcgttccagaaacactatgggaattgggctactggctctgctacgtcaactctacaatcaacccaatgtgctacgccctgtgcaataaggcgttcagagacaccttccgtctgctactgctgtgtaggtgggacaaacgccgctggcggaagatcccaaaacgtcccggctcggtgcatcgcacacccagccggcagtgctag

SEQ ID NO: 112005 - DNA, 405 bp, Artificial Sequence
  Description of Artificial Sequence: Synthetic coding sequence
atgaatacctctgcaccacctgcagtgtctcccaacatcacagtgctggcccccggcaaaggcccgtggcaagtggccttcatcggcattaccaccggcctccttagtctagctactgtcactggtaatctgctggttctgatctcattcaaagtgaacactgagcttaaaacagtcaacaattatttcttactgagtctcgcatgtgcggacttgattatcgggaccttcagcatgaacctgtacactacctacctacttatgggccactgggcactaggtaccctggcctgtgatctttggctggccctggattacgtggcctctaacgcctctgttatgaacctgttgctgatctccttcgacagatacttctctgtaaccaggcctctcagctacagatag

SEQ ID NO: 112006 - DNA, 1365 bp, Artificial Sequence
  Description of Artificial Sequence: Synthetic coding sequence
atgaacaccagtgccccaccagctgtctctccaaacataacggtgctggctcctgggaagggcccctggcaggtcgccttcattggcatcactaccgggctgttaagccttgccaccgtgaccggcaatctgcttgtactcatctcctttaaagtgaacaccgaactcaaaaccgttaataactacttcctcctgtccctcgcttgtgcggatctgattattggaacattcagcatgaatctctatactacttacctgctgatggggcactgggccttagggacattggcgtgtgacttgtggctggctttggactacgtggcatcaaacgccagtgttatgaacctgctgctcatcagctttgatcggtatttttcggtgaccaggccgttgtcttacagagcaaagagaacaccgcggcgcgccgcactcatgattgggctggcatggctggtgagtttcgtactgtgggctccagcaattttgttctggcagtatctcgttggggagcgcacggttttggcaggccagtgctacatccagtttctgtcccagcctataatcacattcggcactgcgatggcagcgttttatttgcctgtcacagtgatgtgcaccctgtattggcggatttatcgggagaccgagaaccgcgctcgagagctagcggcactgcaggggagtgaaacacccggaaagggaggggggagctcctctagcagcgaacgaagccagccaggagccgagggatccccggaaacccctcccggacggtgttgcaggtgctgccgggccccacgcctccttcaggcctattcgtggaaggaggaggaagaggaggacgaagggagtatggagtctctgactagttcagagggcgaagagcctggtagcgaagtggtgattaaaatgccaatggttgaccccgaagcgcaggcacctacaaagcaaccacccagatcttcgccaaacaccgtgaagcgtcccactaaaaaaggaagggaccgcgccggaaaaggccaaaaacctagggggaaggagcagctcgccaaacggaaaacattctccttggtgaaggagaaaaaggccgcaagaacattgtccgcaatattactagcctttattttgacgtggacaccctataatatcatggtcttggttagtactttttgtaaggattgtgtgccagaaacactgtgggagctgggctattggctgtgttacgttaacagcactatcaatccgatgtgttacgctctgtgcaataaggccttcagagatacttttcggctcctgttgttgtgcaggtgggataaaagaaggtggcgtaaaatcccaaagcgcccgggatctgtccaccgatag

SEQ ID NO: 112007 - DNA, 1401 bp, Artificial Sequence
  Description of Artificial Sequence: Synthetic coding sequence
atgaataactctactaactcatcaaataatagcttagcactgacaagcccctacaaaacatttgaggtcgtgtttatcgtgctggttgccgggtcccttagtctcgttacaattattgggaacatattagtgatggtgtctatcaaggttaataggcacttacagaccgttaataactacttcttattttctctcgcctgcgcagatctgatcataggagtgttctctatgaacctttacactctgtacacagttataggctattggccactgggcccagtggtatgtgatctctggctggctcttgactatgtcgtgtctaatgcttcggtcatgaacctccttattatatctttcgacaggtatttttgtgtgactaaaccgctcacttacccggttaaaaggactactaagatggccgggatgatgattgcggctgcctgggttctgagcttcattctctgggctcctgcaatactgttttggcagtttatcgtgggggtgaggactgtggaggatggcgagtgttatatccagttcttctcgaacgctgctgttaccttcggaaccgcaatagccgccttctatctgcctgtcattattatgaccgtcttatactggcatatctcgcgtgcgagcaagtcccggatcaagaaggacaagaaagagcctgtggcaaaccaagacccggtctccccgagccttgtgcaggggcggattgtcaagcccaataataacaacatgccctccagtgacgacggcttggaacataacaaaatacagaacggcaaagctccccgcgatcccgtcacagagaactgcgtccagggtgaagaaaaagagtcatctaacgattccacctcggtgtccgccgtcgcaagcaatatgcgcgacgacgagataacccaggacgagaacacggtctccactagcctgggtcacagcaaggacgagaattcaaagcagacttgtatccgcattgggacaaagacgcctaaatctgattcttgcaccccaaccaacactaccgtggaggtggtcggcagtagcggccagaatggcgacgagaaacagaatatcgtggcccgtaagatcgttaaaatgactaaacaacctgctaagaaaaaacctcctccttcaagggagaaaaaagtgactcgcactattttggccattctgctcgccttcattatcacatgggccccatacaacgtgatggttcttatcaacactttctgcgcaccctgtattcctaatactgtctggactattgggtattggctatgctatatcaacagcacaatcaacccagcatgttacgctttgtgcaacgctacctttaaaaaaacatttaagcacttgctgatgtgtcactacaaaaacatcggagcgactagatag

SEQ ID NO: 112008 - DNA, 1401 bp, Artificial Sequence
  Description of Artificial Sequence: Synthetic coding sequence
atgaataatagtaccaatagctctaacaattccctcgcgctcacctcaccttacaaaaccttcgaggttgtctttatcgtactggtcgcaggatcgctcagtctggtgacaatcatcggcaacattcttgttatggtgtcaatcaaggtgaatcgacacctccagaccgtgaataactacttcctgtttagccttgcatgcgccgacctgattattggggtcttttcaatgaacttatatactctgtatacggtgattggctactggccactgggtcccgtggtctgtgacctgtggctagcattggactatgtggtgagtaacgctagtgtgatgaatctgctgatcatttcgttcgatcggtatttctgcgtcactaaacccctaacctaccccgtgaagagaaccaccaaaatggcaggtatgatgattgccgcagcctgggtcctttcctttattctttgggccccagccatccttttttggcagttcatagtgggagtgcgcacagtcgaggacggcgagtgttacattcagttcttctccaatgctgccgtcacttttggtacagctattgccgcgttctacctccccgttatcattatgacggttctatactggcacatcagcagagcttccaagtctcgaattaagaaagacaaaaaggagcccgtagcaaaccaggacccagtctcaccgtccctggtgcagggacggatcgttaaaccaaataataataacatgccttcttctgacgatggattagaacataacaaaatacaaaatggaaaggctccacgcgacccagtgaccgaaaactgtgtgcagggagaagaaaaggaatcctcaaacgactcaacaagcgtctctgcagtggcatcaaatatgcgcgacgacgaaataactcaagacgagaacacagtgtctacgtctctgggccattccaaagatgaaaattctaagcagacctgcatccgtatcggcacaaaaacaccaaaaagtgactcctgtaccccaactaatacaactgtcgaggtagtgggttccagcggacagaacggcgacgagaaacagaatatcgtggcacgaaagatcgtaaaaatgaccaaacaaccagctaaaaaaaaaccgcctccttccagggaaaagaaggtgacacgaactattcttgctatcctcctggcctttattatcacttgggccccctacaatgtcatggtcctaataaacacattttgtgccccctgtatcccgaacacagtttggaccatcggttattggctctgttatattaattccacaattaacccagcatgctatgccctctgcaatgccacttttaaaaagactttcaaacacctgctgatgtgccactataagaatatcggagccacaagatag

SEQ ID NO: 112009 - DNA, 1401 bp, Artificial Sequence
  Description of Artificial Sequence: Synthetic coding sequence
atgaacaattccaccaacagttccaataattctttggcccttactagtccctataaaacattcgaagtggtgttcattgtacttgttgccggatctttgtccctggtcacaattattggcaatattctggtcatggtttcaatcaaggtaaatcgacacctgcagaccgtgaacaattacttcttgttttctctcgcctgcgccgatttaatcatcggagttttctccatgaacctttatactttgtatacggttatcggttactggccccttggtccggttgtgtgcgatctctggctcgccctggattacgtcgtgtccaacgccagcgttatgaacctcctgattatctcttttgatcgctatttttgcgtgaccaagccattgacctaccctgtgaagagaaccacaaagatggcagggatgatgattgcagccgcgtgggtcctgagttttattctttgggcacctgccatcctattctggcagttcatcgtgggggtgcggaccgtcgaggacggagagtgctacatccaatttttttccaatgccgctgtcacgttcggcacagcgatagctgccttctatctacctgtgatcatcatgacagtcctatactggcatatcagccgggcctcgaaatcacggattaagaaggataaaaaggagcctgtggccaatcaggaccccgtcagtcctagtctagtacagggtaggatcgtgaagcctaacaacaataatatgcccagtagtgatgacgggcttgaacacaacaaaatacagaacggaaaagctccacgcgacccagtaactgaaaattgtgtgcaaggagaggagaaggagagttcaaacgacagtacatccgtcagcgccgtagcctccaatatgagggacgatgaaatcactcaagacgagaacaccgtctctacaagtttgggacactctaaagatgaaaatagcaagcagacctgtattagaatcggtaccaagacccccaaatccgattcttgcacccctaccaatacaacagttgaggtggtgggctcatctggacagaacggggacgagaagcagaacatcgttgcgcggaaaatcgtaaaaatgactaaacagcccgctaaaaaaaagccgcctccatcaagggaaaaaaaggtcacgaggactattctcgccatcctcctcgcgttcatcatcacctgggcaccctacaacgttatggtactgataaacaccttctgtgcgccctgtattcccaatactgtctggaccatcgggtactggctatgttacataaatagtacgataaaccccgcctgctacgccctgtgtaatgccactttcaagaagacctttaagcacctcctgatgtgccactataaaaatattggcgccaccaggtag

SEQ ID NO: 112010 - DNA, 1401 bp, Artificial Sequence
  Description of Artificial Sequence: Synthetic coding sequence
atgaataactccaccaattcctctaataacagcctggctctgacctccccatacaagacattcgaagtggtcttcatcgtgctggtcgccggctccctctctctggtgaccattataggtaatatcttggtgatggtgagcatcaaggtgaatcgccacctgcaaacggtcaataactatttcctctttagcttggcatgcgcggatttgatcattggggtcttctccatgaatctctatacactgtacaccgttataggctactggcccctgggtccagtcgtgtgcgacttgtggcttgcccttgactacgttgtctctaacgccagtgtgatgaacctgctcatcatcagctttgaccgttacttttgtgtgacgaagccactgacgtacccagtgaagcggactaccaagatggccgggatgatgatcgcagccgcttgggtactgagctttatcctgtgggcaccagctattcttttttggcagttcatcgtgggcgtcagaacggtggaggatggcgagtgttatattcagtttttcagcaacgctgctgtaacatttggaaccgcgattgccgccttctacttacctgtcattattatgactgtactttattggcacattagtagggcctccaaaagccgcatcaagaaggacaagaaggaacctgtggccaatcaggacccagtgagtccaagcctagttcaagggcggatagtgaagccaaataataacaacatgccaagctctgacgacgggctggagcataacaagattcagaacggaaaggctccccgggatcccgttacggagaattgcgtccagggtgaggagaaggagagttcaaacgacagtacctctgtctcagccgttgccagcaatatgcgagacgacgaaatcactcaagatgaaaacaccgtttcgacctccctcgggcacagcaaggacgaaaacagcaagcagacctgcatcaggatcggaacaaagaccccaaagagtgactcatgcacccctactaacaccaccgttgaggtggttggctccagcgggcagaacggagacgaaaagcaaaacattgtggctcgaaaaattgtgaagatgacgaaacagccagctaaaaagaagcctcctccatctcgagagaaaaaagttactaggactatattggccatcttgcttgccttcattattacatgggcaccctataacgtaatggtcttaattaataccttttgcgccccttgtattccaaacacagtctggacaatcggctactggctatgctacattaatagtaccattaatcccgcatgttacgccctgtgtaatgccacatttaagaagacctttaagcacctactgatgtgccattataaaaacattggggctacacgctag

SEQ ID NO: 112011 - DNA, 1401 bp, Artificial Sequence
  Description of Artificial Sequence: Synthetic coding sequence
atgaacaacagtactaactcatcgaataatagcttggccctgacctccccctacaaaactttcgaagtggtcttcattgtgctcgtggctgggtcactcagcctggtgacgatcatcgggaacattctcgtgatggtgtctatcaaggtgaatcgccatttacagaccgtcaacaattactttttgttctccctggcttgcgcagatctgatcataggtgtcttttctatgaacttgtacacgctatacaccgtcatcggctactggcccctcggacctgtcgtgtgcgatctttggctagctctggattacgtcgtctccaatgccagtgtgatgaatctcttgataatctccttcgaccgttacttttgtgtaacaaagccccttacctatccagttaagagaactacaaaaatggcggggatgatgattgccgccgcgtgggtattgtcctttattttgtgggcccctgctattcttttttggcagttcatagtcggcgttcgcactgtggaggacggggagtgttatattcagttcttctcaaacgcagctgtaacctttgggacagcaatcgccgcattctatttgcctgtgattattatgaccgtcttatattggcatatcagcagggcctcaaagtcccgcatcaaaaaggataagaaagagccagtagccaatcaggatccggtgagtccttctctggtacagggcaggattgtgaagcccaataacaataacatgccgagctctgatgacggactggaacacaacaagatccagaatggcaaagcacctagagatccagttacagagaattgtgtacagggcgaggagaaggagtctagcaatgattcgactagcgtttctgctgtggccagtaacatgagagatgatgagatcactcaagatgagaatacagtgtcaacctcactggggcacagcaaggacgaaaatagtaagcagacctgtatccgcataggtaccaaaacaccaaaatccgattcttgtacacccaccaacactaccgtagaggtggtcggcagcagtggtcagaacggggatgagaagcagaacattgtagcaaggaaaattgtcaagatgaccaaacagccagcaaaaaagaaaccacctccttcacgagaaaagaaggtcaccagaactatcctcgccattctgctcgcattcatcatcacctgggcaccttacaacgtcatggtgctgataaatacattctgcgccccttgtattcccaacactgtgtggacaataggatactggctctgttacatcaattcgaccattaatccagcgtgctatgcgctgtgtaacgcgacatttaagaagacattcaagcatctgctgatgtgccactacaaaaatatcggggctacgaggtag

SEQ ID NO: 112012 - DNA, 1401 bp, Artificial Sequence
  Description of Artificial Sequence: Synthetic coding sequence
atgaataacagcacaaactcctctaataactccttggcactgacctccccatataagacatttgaggtggtgtttatcgtactcgtagcagggagtctgtcattggtgaccattattggcaacattctggttatggtgtcaattaaagtgaatagacatttgcagaccgtgaataattacttcctgttttctttagcttgtgcagacttgataattggcgtgttttctatgaacctctacacactttatacagtcattggctactggccactgggcccagttgtgtgcgatctgtggctggccctggactatgtcgtgagcaatgcctccgtcatgaatctcctcattatttccttcgatagatacttttgtgttaccaaaccccttacttatcccgtgaagagaaccaccaagatggctgggatgatgattgccgcagcttgggtcttatcatttatcctgtgggcacccgcgatactattctggcaatttattgtgggcgtgcgaaccgtggaagatggcgagtgttacatccagtttttttctaatgcggccgtgaccttcgggaccgccattgcggccttctatctcccggtgatcatcatgactgttctctattggcacatttcacgcgcctctaaaagtaggataaaaaaggataaaaaggagcctgtcgctaaccaggatcccgtatccccctccctcgtgcaaggccgcattgtgaagccaaataataacaatatgcccagtagtgatgacgggctcgaacacaacaaaatccagaacggaaaagcacctcgtgacccggtcaccgagaactgcgtccaaggggaggagaaggagagttcaaacgactccacatctgtcagcgctgtggcctctaacatgcgtgacgatgagatcacccaggacgagaacaccgtttcaacatccctgggacactcaaaggatgaaaacagcaagcaaacatgcatacgtatcggcacaaaaactcctaaatcagacagttgcacccccaccaataccactgtagaggttgtgggatcatctggccagaatggggacgagaagcagaacatcgtggcccgtaaaattgtgaaaatgacaaaacagccagcaaaaaaaaagccacctcccagtcgggagaaaaaggtcactaggactatactggcaatcctattggctttcattatcacgtgggccccttacaacgtcatggtgctgatcaacaccttctgtgccccctgcattcccaacactgtatggaccattggatattggctgtgctacatcaatagcactatcaacccggcctgctacgcattatgcaacgcgaccttcaaaaagaccttcaagcatttactaatgtgccactataagaacatcggtgcgacgcgctag

SEQ ID NO: 112013 - DNA, 1773 bp, Artificial Sequence
  Description of Artificial Sequence: Synthetic coding sequence
atgacactgcataataattcaaccacatcacccctcttcccaaacatctcatcgtcctggattcattccccctccgacgcgggcttgccgcctggaacagtaactcacttcggctcttataacgtttcacgggccgctggaaacttcagctccccagatggtaccacagatgatcccttgggaggccataccgtatggcaggtggtatttatcgcttttttgactgggatcctggcgcttgtcactattatcgggaacattctcgtgatagtgagttttaaagtcaataagcagctaaagacagtgaacaactatttcctcctgtcactggcgtgtgctgacctaatcatcggcgttatctcaatgaatcttttcactacgtacatcattatgaacaggtgggcacttggcaacctggcctgtgacctctggctcgcaatagattatgtggccagtaatgcttcagtaatgaatctgctcgtgatctccttcgaccggtatttcagtattacaaggcctctcacctatcgggctaagagaacaaccaagcgcgctggtgtcatgatcgggctggcctgggtaatcagttttgtcttgtgggctccagccatcctgttctggcagtatttcgtggggaaacggaccgtgcccccaggagaatgtttcatacagtttctctccgagcctactatcacctttggcacggccatcgccgcattctacatgcccgtgaccatcatgaccatcctctactggcgtatttacaaggagacagaaaagagaaccaaggaactggccggcctccaggcctctggaactgaagctgaaactgagaacttcgtgcatcccactggcagcagcaggagctgcagctcctatgaattgcagcagcagtccatgaagcgatccaacaggcggaagtatggccgatgtcacttctggtttacaactaagtcatggaagccctcgagtgagcagatggatcaagatcattcatccagtgattcatggaacaataacgatgctgctgcgtctctggagaactctgcctcatcagatgaggaggacatcggatccgaaaccagagcaatctattccatagtgctcaagctacccggacattctaccatactgaatagcaccaaactgccaagcagcgataacctgcaggtgcccgaggaagagcttgggatggtggatctggaacggaaggcagacaagctgcaagcccagaaaagcgtggatgatggtggaagtttccccaaaagtttcagtaaacttcctattcaactggagtccgccgtcgatacagccaagacaagtgacgttaactcatctgtaggcaaaagtactgctacactgccactcagcttcaaggaggccacgttggcgaagaggttcgcccttaagactcgttctcagatcactaagagaaagaggatgagtctagtgaaggaaaagaaggctgcccagacattgtcggccatcctgctagcattcatcataacgtggacgccttacaacattatggtattggtaaatacattctgcgacagttgtattcccaagaccttttggaacctgggatactggctgtgctatatcaatagcacagtcaatcctgtttgctacgctctctgcaacaaaacattccgcacaacctttaagatgctccttctctgtcagtgcgataaaaaaaaacgaagaaagcagcagtatcagcagagacagagcgtgatcttccataagagagcacccgagcaggctctctag

SEQ ID NO: 112014 - DNA, 333 bp, Artificial Sequence
  Description of Artificial Sequence: Synthetic coding sequence
atgactttgcacaataactcaacgaccagcccactgttccccaatataagctctagctggatccatagtccatcagatgccggactgcctcctggcaccgtgacacactttggcagttacaacgtttctcgtgccgctggaaactttagttcgccagacgggaccacagatgaccctctgggcgggcacacagtctggcaggtggtttttatagcgttcctgaccggtattcttgcattagtgacaatcatcggtaacattcttgtcattgttagcttcaaagtgaacaaacagctgaagaccgtcaataactatttcttattatccctttag

SEQ ID NO: 112015 - DNA, 1440 bp, Artificial Sequence
  Description of Artificial Sequence: Synthetic coding sequence
atggccaacttcaccccagtaaacggatctagcgggaaccagtccgtaaggcttgttacaagtagctcccacaacaggtacgaaacagtcgaaatggttttcatagctaccgttacaggatcactgagtttggtgacagtagttggcaacattttagttatgctctccattaaggtcaaccgtcagctgcagaccgtaaataactatttcctctttagcttggcttgcgccgacctgataattggagccttttcaatgaatctgtataccgtgtacataatcaagggctattggcctctcggagctgtggtttgtgacctatggttggcactggactacgtggtctccaacgccagcgtaatgaatttacttataatcagttttgaccgctacttctgcgtcaccaagcccctcacgtacccagcacgacgaaccaccaagatggcggggttgatgatagcagccgcgtgggtgctttcatttgtgttgtgggccccagccattctgttttggcaattcgttgtgggcaagcggacggtccctgacaatcagtgcttcatccagtttctgtctaacccagctgtgactttcggtacggctatcgcagcattctatctgcccgtggtaattatgacagtcctttacatccacattagtctcgcgtctcgcagtcgggtacacaagcatcgacccgagggacccaaggagaaaaaagcgaaaacactggcctttctcaaatctcctctcatgaaacagagcgtaaagaagcctccaccaggagaggcggcacgagaggagctgaggaacgggaagctcgaggaagctccccctcccgccttgcctccgcccccaagacctgtggcagataaggatactagcaatgagtctagctctggctccgccacacagaacacaaaggaaagacctgccaccgaactgtccacaactgaagctaccacccctgctatgcctgctcctccactccaaccacgtgcattaaatcccgctagtcgttggtcaaaaatccaaatcgtcactaagcagaccggcaatgagtgcgtgactgccatcgaaatcgtgcctgcaacccccgctggaatgaggccggccgccaacgttgctcggaagttcgcatcaatcgccagaaatcaggtgaggaagaaaaggcagatggccgctcgcgagcgcaaggtgactcgaacgatcttcgctatactgctcgctttcatccttacctggacgccctacaatgttatggtcttagtgaatactttttgtcagagttgcatacctgataccgtctggtccatcggctactggctgtgttatgtaaatagcactattaacccagcctgctatgctctgtgcaacgccaccttcaagaaaacttttcggcacctgctgctgtgccagtacagaaatatagggactgcgcgctag

SEQ ID NO: 112016 - DNA, 1599 bp, Artificial Sequence
  Description of Artificial Sequence: Synthetic coding sequence
atggaaggggactcttatcataacgccacaactgtgaacggaacccccgtgaaccaccagcctttggagagacacaggttatgggaagtaatcaccatcgccgccgttaccgcagtggtctccctcataacaattgtgggcaacgttctagtgatgatttccttcaaggtaaatagccagttgaaaacggtcaataactattatctgctaagtttagcttgtgcagatcttatcattggcatcttttcgatgaatctatatacgacttacatcctgatgggacgctgggcattgggtagtctggcttgcgacctgtggctggccctggattacgtcgcatcaaatgcctcggttatgaacttacttgtgattagcttcgacagatacttttccatcactcggcccctcacataccgcgctaagcggacgcccaaaagagccggaatcatgataggtctggcctggctaatttctttcatcctctgggctcctgcaattttatgttggcagtacctggttgggaagcgtactgttccactagacgagtgccagatccagttcctatccgaacctacaataacttttggaacagctattgccgcgttttacatcccggtctctgtcatgaccatcttgtattgtagaatttatagagaaaccgaaaaaaggacaaaggacctcgcggatctccaggggagtgactctgtaaccaaagctgaaaaacgcaagcccgctcaccgagcactcttccgctcttgtctcagatgtccaagacccacactggcgcagcgggaaagaaatcaagccagttggtcaagtagtaggcggagcacttcaactacaggaaaacccagccaggcaactgggccctctgcaaattgggcgaaagcagagcagctgacgacttgctcttcatacccctcatccgaggatgaggacaaacccgctactgaccccgttcttcaggtagtttataagtctcaggggaaggaatcacctggagaagagttttcagccgaggaaacagaggagacattcgtcaaagccgagaccgagaagtcggattatgacactcctaattatctgctctcacctgccgccgctcacaggcccaagtcccagaagtgtgtggcctacaaatttcgcctagtagttaaagccgatggtaaccaggagactaataatgggtgccataaggtaaagattatgccatgccctttccccgtcgccaaggagccatcaaccaaagggttgaaccctaatcccagtcaccagatgaccaagcgaaagcgggttgtgctcgtgaaggaacgcaaggcagctcagactctgtccgctattttgctggcgttcataatcacttggacgccgtataatatcatggtactagtaagtaccttttgtgacaaatgtgtgcctgttactctctggcacctggggtattggttgtgttacgtcaattcaacggtgaaccctatttgttacgccctgtgtaatcggactttccgcaaaactttcaagatgcttttgctgtgtagatggaaaaaaaagaaagtggaagagaaattatattggcagggcaacagcaaactgccctag

SEQ ID NO: 112017 - DNA, 1599 bp, Artificial Sequence
  Description of Artificial Sequence: Synthetic coding sequence
atggagggcgactcctatcacaacgctacgacggtgaacggcacccctgtgaaccatcaacccttggagcgacataggctgtgggaggtcattaccattgcagcggtgaccgctgttgtgtcccttatcaccatagttggaaatgtgcttgtgatgatcagcttcaaggtgaattcgcagctaaaaacagttaataactattacctcttgagtctcgcctgtgcggatctgatcattggcattttctcaatgaacctgtatactacctacattttgatggggagatgggcactggggtcattggcttgcgatctgtggctggccctcgactacgtggcctcaaacgcctctgttatgaacttgttagtcatcagctttgatcgatattttagcatcacacgacctctaacatacagggctaaacgaactcccaagagggccggcatcatgattggcctggcatggttaatttcctttatactgtgggccccagctatactctgttggcagtatctggtgggtaaacggaccgtgcctcttgacgagtgtcagatccaatttctctccgaacctacaatcacattcggtactgctatcgcagcattctacatcccggtctctgtaatgacgatcttgtattgccgtatctaccgggaaaccgaaaagcgcactaaagacctcgctgacttgcagggatctgatagtgtaacaaaagctgagaagcgcaagccagcccatcgcgctctgtttaggtcatgtctccgatgcccccgcccaactcttgcgcaacgcgagcggaaccaggcatcctggagttccagtaggaggagcacctctaccacaggaaaaccctctcaggccacaggccccagcgcaaattgggcaaaggcggagcagctcactacctgcagctcatatccatcctctgaggacgaggataagccagctactgaccctgtgttgcaagtagtatacaaatcacaaggaaaggagtctccaggagaagaattcagtgccgaggaaacagaagaaacgtttgttaaagctgagactgagaagtcggactacgacactccgaattatctgctgagccccgctgctgcacatcgtcctaaaagtcagaaatgtgtcgcctataagttccgcttggtggtgaaggcagatggaaatcaggagaccaataatggctgccataaggtgaaaatcatgccatgtccatttcctgtggcgaaagaaccaagtacaaaaggattgaacccaaatccatcacatcaaatgactaagaggaagagggtggtcctggtcaaggaaagaaaagctgcccaaaccctgtctgctattctgttggcattcataatcacttggacaccgtataacataatggtgttggtgtcaaccttctgcgataaatgtgttccggtcaccctgtggcacctaggatactggctatgttatgtgaattcaactgtgaatcccatctgttatgctctgtgtaaccgtacctttaggaaaacctttaagatgcttcttctgtgcaggtggaagaaaaaaaaggttgaggagaagctgtactggcagggaaactccaagctcccctag

SEQ ID NO: 112018 - DNA, 69 bp, Artificial Sequence
  Description of Artificial Sequence: Synthetic coding sequence
atggaaggtgatagttaccataacgcaaccactgtgaacgggaccccagtaaatcaccaacccctttag

SEQ ID NO: 112019 - DNA, 1449 bp, Artificial Sequence
  Description of Artificial Sequence: Synthetic coding sequence
atggaaccatggccacttctcttactgttctcgctctgttcggcaggcctcgttcttggaagcgaacatgagactaggctcgttgctaagttgttcaaagattactcttccgtggtgcggcccgtggaggaccatcgccaagtggttgaggtgactgttggtttgcagctgatccagttgattaacgtggacgaggtcaatcagatcgtgaccacaaatgtccgactgaagcaaggagacatggtggatctccccaggcccagctgtgtcacgctgggcgtgcccttgttctcacacttacagaacgagcagtgggtcgactacaacttgaagtggaatccagacgactatggaggcgttaaaaagatccatatacccagcgaaaaaatctggaggcctgatcttgtgctgtataacaacgctgatggggactttgcaatcgtaaagtttacaaaagtgctgctacagtacactggacacatcacctggactcctccagctattttcaaatcatattgtgagattattgtgactcattttccgtttgatgagcaaaattgttccatgaagctgggtacttggacctacgacggatccgttgtggctattaatcctgagagcgaccagcctgacctctcaaattttatggaatcaggcgagtgggtcattaaggagagtcgagggtggaagcacagtgttacctactcctgttgtcccgatacaccatatctggacatcacataccactttgtcatgcaacgccttcccctatacttcattgtcaatgtaatcatcccctgcttgctttttagctttctcactgggttggtgttctatttaccaacagattccggggagaagatgaccctgagcatttcagtgctacttagccttactgtgtttctgttggtgattgtcgagttgatcccctcgacctcctccgccgtccctctgataggtaagtatatgctatttacaatggtgtttgtcatcgcttcaatcattatcaccgtgattgttataaatacacaccaccgatctccatcaacgcacgtcatgcccaactgggtccggaaggtattcattgataccatccctaacatcatgttcttttctaccatgaaacgcccatctcgagaaaagcaggacaaaaaaatttttaccgaagacattgatatctctgatatcagtggcaagccaggaccccctccgatgggatttcattcgccactgatcaaacaccctgaagtgaagtcagccatcgagggaattaagtacattgcagagaccatgaagagcgatcaggagagcaataacgccgctgcagaatggaagtacgtcgctatggtcatggatcatatcttacttggtgtgttcatgctcgtgtgcatcataggcaccctcgctgtatttgctgggcgtctcatagagcttaatcagcagggttag

SEQ ID NO: 112020 - DNA, 1374 bp, Artificial Sequence
  Description of Artificial Sequence: Synthetic coding sequence
atggagccctggccactcctgctgctattcagcttatgctccgcagggcttgtcttagggagtgaacacgagaccaggttagtggccaaacttttcaaagactactccagtgtcgtgcggccagtcgaggatcatagacaggtggttgaagtaaccgtgggtctgcagctcatacaactcattaatgtggatgaagtcaaccagatcgtcaccactaatgttaggctgaagcaacagtgggtggactacaacctcaagtggaatccagatgactatgggggcgttaagaagattcacattccgtccgaaaaaatatggcgtccagacctggtattatacaacaatgccgacggggactttgccatagtgaagttcaccaaagttttgctgcaatacaccggccacatcacttggacgcctcccgccatcttcaagtcatattgtgagataatcgtaactcattttccctttgatgagcagaactgtagcatgaagctcggcacttggacctatgatggcagcgtagtggctataaaccctgagtccgatcaacccgatctgtctaacttcatggaaagcggggagtgggtgatcaaggagtctcggggttggaaacactctgtgacttacagttgctgccctgacaccccttatctggacatcacttaccactttgtgatgcaacgactgcccctttattttattgtgaatgtgattattccgtgtctgttgtttagtttcctgacaggcctcgtcttctacctccccactgattcaggcgaaaaaatgaccctttcaataagcgtgctcctctccctcaccgtgtttctactagtcatcgtcgaactgattccttccacctcatcagctgtccccctcatcgggaagtacatgcttttcaccatggtattcgtcatagcgtctataatcatcacagttatcgtcattaacacacatcataggtcacccagcacacacgttatgccgaactgggtacgcaaggtgtttatagatactatccccaacatcatgtttttctctaccatgaaacggccctctagagaaaaacaagacaaaaaaatctttaccgaggatattgacataagtgatatctccgggaagcccggccctccaccaatggggtttcactctccactcattaaacacccagaagtcaaatctgcgatagaaggcatcaagtacatcgccgaaaccatgaagtctgaccaggagtccaacaacgccgcagctgagtggaagtacgtggctatggtgatggatcatatcctcttaggagtgttcatgctcgtttgtattatcggaactctggcggttttcgcgggtcggctgatcgagcttaaccagcaagggtag

SEQ ID NO: 112021 - DNA, 1353 bp, Artificial Sequence
  Description of Artificial Sequence: Synthetic coding sequence
atgggattgcggtctcatcatctgtcacttggtcttctcctcttatttttactacccgcggaatgcttgggcgcagaggggaggctggcactgaaactctttcgtgacctctttgcgaactatacctccgcactacgccctgtcgccgatacagaccagacgctcaatgtgaccctggaggtgacactgtcgcagattatcgacatggatgagcgaaatcaggttctgaccctttacctgtggatccgacaagaatggacggacgcctacctaaggtgggatcccaacgcatacggcggcctggatgcgattcgaatcccttcctccctggtatggcgaccggatatcgttctgtacaacaaagcagacgcgcagcccccggggtcagctagcacaaatgtggtgctccggcacgatggcgccgtcaggtgggacgcgcctgcaattacgcggtccagctgccgggttgatgtggcagctttcccctttgatgcccaacactgtgggcttacatttggatcatggacccatggaggccatcagctcgacgtgaggccaaggggggccgctgccagtctggctgattttgttgaaaatgtcgagtggagagtcctgggaatgcccgctcgcaggagagtgttaacctatggctgctgctcggaaccctacccggacgtaacatttactctgcttctccggaggcgggccgccgcctatgtttgtaatctcctgctgccgtgcgtactcataagccttctcgcaccactggcgttccacctccctgccgacagcggtgagaaggtgagcctgggggtcaccgtcttgctggcccttacagtgttccaattacttctcgcggagagcatgcccccggcagagtctgtgccgttaattggcaagtattacatggcaacaatgaccatggtgactttctcgaccgccctgaccatccttattatgaacctccattactgcggccctagtgtccggcctgttccagcttgggccagagcactgctcctggggcacctggcccgtggcttgtgtgtgcgggagagaggcgaaccgtgcggacagtccagaccacccgagttgagccccagccctcaaagtcctgagggcggcgctggcccacccgcagggccttgccacgaaccaaggtgtctctgtagacaggaggccctacttcatcacgtggccactattgcaaataccttccgctcacaccgggccgcccagcgttgtcacgaggactggaagcgcctagcaagagtcatggaccgcttctttctggccattttcttcagtatggccttggtgatgtccctacttgtgctggtgcaggcgttgtag

SEQ ID NO: 112022 - DNA, 1590 bp, Artificial Sequence
  Description of Artificial Sequence: Synthetic coding sequence
atgggccctagctgtcccgtcttcctcagtttcaccaaactctcactgtggtggttgctgctcactccggctggtggagaggaagccaagcgaccgccgcccagagcgcccggtgaccctctgagctcgcccagccctacagctttgccccagggaggatctcatacggagaccgaggaccggttatttaagcacctgttccgaggatataatcgatgggctcgcccagtgccaaacacttcagacgtagtgattgttaggttcggtctctctatagcccagctcattgacgtggatgagaaaaaccagatgatgacaactaatgtttggctcaagcaagaatggagcgattacaaacttaggtggaaccctactgatttcgggaacattactagtctgagggtcccctctgagatgatttggatccccgatattgtactctacaataacgccgacggcgaattcgcggtcacacacatgacgaaggcacatctttttagcaccggaaccgtgcactgggtaccacctgctatttataaaagtagttgtagcatcgatgtcaccttttttccattcgatcaacagaactgtaaaatgaagtttggtagctggacctatgacaaagccaagattgatcttgagcaaatggagcagaccgtggacctgaaggattactgggagagcggcgagtgggccatagtcaacgctactgggacatacaacagcaaaaagtatgactgttgcgctgaaatctaccccgatgtgacttacgccttcgttattaggagacttcccctgttctatacaatcaacttgatcattccatgtctcctgatctcatgcttaacagtgctggtcttttatctccctagcgattgcggagaaaaaatcacgctgtgtatctccgttttgctgagcctaactgtattcctccttttaattacagagatcatcccctcgaccagcctcgtgattccactgattggcgaatacttgctctttacaatgattttcgtgacactgtccatagtaatcactgtatttgtcttaaatgttcaccataggtcacccagcacccacaccatgcctcactgggtccggggggccctgttaggatgcgtgccccggtggcttttaatgaatcggccccccccccccgtggagctttgccaccctctcagattaaaattatcaccttcttatcactggctggagagcaatgtggacgctgaagagcgggaagttgtggtagaagaggaagaccgttgggcatgcgcgggccacgtggctccctccgtcggaaccctttgttcgcacggtcacttgcactcaggtgcttcaggaccaaaagccgaggcgctgttgcaggagggggaattactcctgtctccccacatgcagaaagcccttgagggcgtccattacattgcagaccatcttcggagcgaggacgctgacagtagtgtcaaagaagattggaagtacgtcgctatggttatcgaccgaatatttctctggttgttcatcattgtttgctttctgggcacgataggattgtttctccctcccttcctagccggcatgatctag

SEQ ID NO: 112023 - DNA, 1590 bp, Artificial Sequence
  Description of Artificial Sequence: Synthetic coding sequence
atgggcccaagttgccccgtcttcttgtccttcactaaacttagcctgtggtggcttctcctaacacctgccgggggtgaagaagccaagaggcctccccccagggcgccaggcgatccgctttcctctccctcacccactgctctcccgcagggaggaagccacacagagacagaagatagactctttaaacatctcttcaggggatataaccggtgggcaaggcctgttccgaataccagtgatgtggtcatagtgcgcttcggcctgagcattgcgcagctcatcgacgttgatgagaagaaccagatgatgactactaacgtctggttgaaacaggagtggagtgactacaaactccgctggaaccctactgatttcggcaatattaccagtctccgcgtcccttccgagatgatttggatccccgacatcgtattgtacaataacgccgacggcgaatttgccgtgacacatatgactaaagcccatctgttctccaccggaacggtccattgggtgccacctgcaatttacaagagctcttgtagcatagacgttacattctttccatttgatcaacagaattgtaaaatgaaatttggctcttggacctatgataaggctaaaatcgacctagaacaaatggagcagaccgtcgacctgaaagactactgggagtctggcgagtgggctattgtaaacgctactgggacttataacagtaaaaagtacgactgttgcgctgaaatttaccccgacgtaacatacgcctttgtcattcgacgccttcccctcttttacactattaatttgattatcccatgtctcctgatctcatgcttaacggtcctggtgttctatcttccaagcgactgcggggaaaagattactctgtgcatcagcgtcctcctgtctctcaccgttttcctccttctgatcacagaaattatcccttccacatccttggttattccacttatcggcgagtatctgttatttacaatgatctttgtgacactctccatcgtgataacagtctttgtactgaacgtacaccatcgttcacccagcacacataccatgccccattgggttagaggtgctctcctggggtgcgtgccaaggtggctcctgatgaaccggccaccccccccagtcgaactgtgtcaccctcttagattgaagctctcacctagctatcactggcttgaatcaaacgtagacgcggaagagcgggaagtggtggtggaggaggaggatcggtgggcttgcgcaggccatgtagccccatcggtaggaacactatgttcgcacggtcacctccattctggcgcgagcgggccgaaggctgaggccctgctgcaagagggagagctgctgttgtccccgcacatgcaaaaggcactggagggggttcattatatcgcagaccacctccggagtgaggatgccgactcctctgtgaaagaagattggaagtacgtcgcaatggttatcgatagaattttcttgtggctgttcataattgtgtgcttcttggggactattgggcttttcttaccacctttcctggctgggatgatatag

SEQ ID NO: 112024 - DNA, 1518 bp, Artificial Sequence
  Description of Artificial Sequence: Synthetic coding sequence
atgggttcagggccgctgtccctcccactggcactgtcccccccccgacttctcctgctactgctcctctctctgctgcctgttgctcgcgcatctgaagccgagcaccgcctctttgagagattattcgaagattacaatgagatcattcggccagtggcaaacgtgtctgaccccgttatcatccattttgaagtgtccatgagccagctggtaaaagtggacgaggtcaatcagataatggaaacaaacctgtggctgaaacaaatatggaacgactacaaactgaaatggaacccatcagactatggaggtgccgagttcatgcgggtgcccgctcaaaagatatggaagcccgacatcgttctctataacaatgctgtgggagacttccaggtggatgataagaccaaagctcttctcaagtatactggtgaagtgacatggattccaccagctatcttcaagagcagttgcaagatcgatgtgacatactttccctttgattaccaaaattgtaccatgaaattcgggtcctggagttatgataaagcaaaaatcgacctggtcctcatcggctcctccatgaatctgaaagactactgggagagtggagaatgggctattatcaaagctccaggttataagcacgacattaagtacaattgctgtgaggaaatctatcctgatatcacttatagcttatatatcagacgtctgcccctcttctacactatcaacctgattattccatgcctgttgatttcgttcctcaccgtattagttttttacctcccctctgactgcggggagaaggtgacactgtgcatttcggttctgctgtccctaactgtatttttactcgtcattacagaaaccattccctcgactagcttagtaatacccttaatcggtgaatatctgctcttcactatgatcttcgtgactttgagtattgtcattacagtgttcgtgctgaatgtgcactaccgaacgcctactacacacaccatgcccagctgggtgaagacagtgttcctgaatctactgcctcgtgtgatgttcatgacacgacccaccagcaacgagggcaacgcccagaaacctagaccactgtacggtgccgaattgagcaacttaaattgcttctccagagccgagagcaaaggatgcaaggaagggtacccctgtcaggacggaatgtgcgggtattgccatcatagaaggattaaaattagtaacttttcggccaacctgacccgctcctcttcatccgaatctgtggatgctgttctgagcctctctgcactttctcctgaaataaaagaggctattcagagcgtaaaatatattgccgagaacatgaaggcgcagaacgaggccaaagagatacaggacgactggaaatatgtcgccatggtgattgataggatttttctctgggtgtttacgcttgtgtgtatactgggtacagcaggtctgtttttgcagcccctgatggcccgggaggacgcttag

SEQ ID NO: 112025 - DNA, 939 bp, Artificial Sequence
  Description of Artificial Sequence: Synthetic coding sequence
accaaggctctgctgaagtacactggagaagtcacttggatcccacccgcgatatttaagagttcttgcaagatcgacgttacatacttcccgtttgattaccagaattgcaccatgaagtttggcagctggtcctatgataaggccaagatcgatctagtacttatcgggtccagcatgaacttgaaggattactgggagtctggagaatgggcaatcataaaagcacccggatataagcacgatatcaagtacaactgttgtgaggaaatataccccgacatcacttactctctgtacatccggcgcctcccacttttttacactataaatcttatcattccctgtttgttaatatcttttttgacagtgctggttttttatctgcccagcgactgtggtgaaaaggtcactttgtgcatctctgtcctgctatctctcacggtcttcctactagtgattacagagacaataccgtctacaagcctggtaatcccactgattggtgaatatctgctctttaccatgatcttcgtgaccctctctatcgtcatcacggttttcgtgctgaacgtgcactataggactccaacaacccacactatgccctcatgggtgaaaactgttttcctcaacctcttaccgagggtcatgtttatgacgcggcccacatccaatgaaggtaatgcccagaaacccagaccactatacggtgcaagccccaaggcagctcggcgagagattaaggaggcaattcaatctgtgaagtacatagctgagaacatgaaagcccagaacgaggcaaaggagatccaggatgattggaaatatgtcgctatggttatcgacaggatttttctatgggtgttcaccctcgtgtgtatcctgggcaccgccggcctatttctccagccccttatggcccgagaagatgcctag

SEQ ID NO: 112026 - DNA, 1470 bp, Artificial Sequence
  Description of Artificial Sequence: Synthetic coding sequence
atgggctcaggtccactgtctttgcctctggcattatccccccctcggcttctgttgctactccttctgtctcttctgcctgtggcccgtgcatcagaggccgaacatcgcttgttcgagcgtctgttcgaggattataacgagatcatcaggccagtcgctaacgtgtctgaccccgtgatcattcactttgaggtatcgatgagccagcttgttaaggtggacgaagtgaatcagattatggagacgaatctgtggctcaagcagatttggaacgactacaaactcaagtggaatccctcggattatgggggcgcagagttcatgcgagttcccgcccaaaaaatctggaagcccgacatcgtgttgtataataacgccgttggcgacttccaggtcgatgacaagaccaaagccctgctgaaatacaccggtgaggtcacctggatcccacccgccattttcaagtctagctgtaaaattgacgtcacctatttccccttcgactaccagaactgcaccatgaaattcggctcatggtcttatgacaaagcgaaaattgatctggtattaattggcagtagtatgaatttaaaagattattgggagtccggcgagtgggcaattatcaaggctcccggatacaagcacgatatcaaatataactgctgcgaagagatttatccagacattacctacagcctgtatatcaggaggctccccctgttctataccatcaacctcatcataccttgcttgttgatttctttcctgacggtgctagttttttacttgcccagtgattgcggagagaaggtgacactgtgtatctcggtactcctgagcctcacggtcttcttgctcgtcatcactgagaccattccaagcacaagcctggtaatccccctgataggcgaatacctcctgttcaccatgatcttcgttacgctcagcatagtgatcactgtttttgtactgaatgtgcactatcgtacacctaccacccacactatgccatcttgggtgaaaactgtgtttttgaatcttctgcccagagtgatgtttatgacacggccgacgtctaatgaaggcaacgctcaaaagcctaggccactgtatggggcagagctgtcgaatttgaattgtttttccagggccgagtctaagggctgtaaggagggatacccgtgccaggacgggatgtgcggatactgtcatcacaggagaataaagatttccaacttctccgcaaatctgactaggagcagctctagcgagtcagtcgacgcagtcctgtccctgagcgcacttagcccagaaatcaaggaggccattcaatctgtaaagtatatcgctgagaatatgaaggcgcagaatgaagcaaaagaggagcagaaggcccaagaaatccagcagctgaagagaaaagagaaaagcactgaaacatcggatcaggaaccaggactctag

SEQ ID NO: 112027 - DNA, 1518 bp, Artificial Sequence
  Description of Artificial Sequence: Synthetic coding sequence
atggggagcggtcccttgtctcttcctcttgcattaagccctccccggttgttactcctgttactcctgagccttcttcccgtggcaagagcctctgaggccgagcaccggctgttcgaacgactgttcgaggattacaatgagatcattaggccagtagctaacgtgtccgaccccgtcatcatccacttcgaggtttccatgtctcagctcgtgaaagttgacgaggtcaatcagataatggaaaccaatctctggcttaagcagatctggaatgactacaagttgaagtggaatccctccgattatggtggtgctgaatttatgcgcgtgccggcacagaaaatctggaaacctgatattgtcctctacaacaatgcagtgggagattttcaggtggacgacaaaacaaaagccctgttgaagtacactggcgaggttacatggattcctcctgccatatttaagtcatcttgtaagattgacgttacgtatttccctttcgattaccaaaattgtacaatgaagtttggctcttggagctacgacaaggccaaaattgacctcgtgctgatcggaagtagcatgaatctcaaggactactgggaaagcggagagtgggccattattaaagccccaggctacaaacacgatattaaatacaactgttgcgaggagatctaccctgatataacctattcactctatatccgccgactgcccttgttttatacgatcaatctcatcatcccatgcttactgatctcatttctcactgtcttagtgttttacttgccaagcgattgtggggaaaaggtgactctgtgcatcagtgtcttgctcagtctaacggtgtttctcctcgttattactgaaaccattcctagcaccagcctggtcattccattgatcggggaatatctgctgttcaccatgatcttcgtcactctctctattgttattacagtgttcgttctgaatgttcactacaggacacccaccacgcacacaatgccttcatgggtcaaaaccgtgtttcttaatcttctgccgagagtgatgtttatgactagacccacttccaatgagggcaacgcccagaaaccccgccccctgtatggcgccgagctcagcaacctgaattgtttttccagagcagagtctaaaggatgcaaagaaggctatccttgtcaggatggcatgtgcggttattgtcaccacaggaggatcaaaatttctaatttttcagctaacctgaccagaagtagttcatccgagtctgtggatgctgtcctgtctctcagcgccctttccccagagatcaaagaagctattcagtcggtgaaatacatcgcagaaaacatgaaggcccagaatgaggctaaagaaattcaagatgactggaagtatgtagccatggtgatcgaccggatcttcctgtgggtctttaccctggtatgtatcttaggtactgccgggctgttcctgcaacctctgatggcacgtgaggacgcttag

SEQ ID NO: 112028 - DNA, 1602 bp, Artificial Sequence
  Description of Artificial Sequence: Synthetic coding sequence
gctcccgagccaggagaggcaccgagattggaccgagctcaccccggatgtgcctgcgcagagctctccttactctggctgtgctgttgcacgttcacatccgcagatggcgacttcgctgtgacacacttgactaaggctcacctgttccatgatggccgggtgcagtggacaccaccagccatctataaatcttcatgcagcatagatgttactttcttccccttcgaccagcagaactgcaccatgaagtttggctcctggacttacgataaggctaagattgacttagtgaatatgcatagcagagtagaccaactggatttttgggaatctggggaatgggtgatcgttgacgctgtcggaacttacaatactcggaagtatgagtgctgcgccgaaatatatcccgatattacttatgcgttcgttattcgacgcctgcctttattttacaccataaacttgatcatcccatgcctgctgatcagctgcctgacggtacttgtgttctacttgccatccgaatgcggagagaaaatcactctgtgcatcagtgtactgctgagtctcacagtttttttattacttattacggaaatcatcccttccacctcacttgtcatcccccttattggggagtacctgctgtttacgatgattttcgtgacactgtctatcgttattaccgtgttcgttctgaacgtgcaccatcgaagtcctaggacgcacactatgcctacttgggtgaggcgagtattcctggacatagtacctagactgctcctcatgaagcgcccatctgtggtgaaggataactgtcggagactgatcgagagcatgcataagatggccagcgccccgcggttctggcctgaaccggaaggcgagccccctgccacctccggcactcaatctctgcacccacccagcccctcattttgcgtccctctcgacgtcccagcagaacctggtccatcctgcaagtcaccgtccgatcagctgcctccgcagcagccgctcgaagccgaaaaggccagtccgcatcccagccctggaccatgtaggcctcctcacggcactcaggctcccggcctggctaaggccaggagcctctcagtgcagcacatgagttcgccaggggaggccgttgaaggcggagtacggtgccgctcaaggtctatccagtattgtgtgccccgggatgacgcagccccagaagcagacggccaggccgctggagcccttgcctctagaaacacccactccgcagagttgccaccccctgaccaaccttctccctgcaagtgcacttgtaagaaggagccgtcatctgtgtctccttcggcgactgttaaaactcggtcaacaaaggccccgccccctcacctgccactttctccggccctgactcgggccgtggaaggggtacaatacattgccgaccatctgaaggcagaggacacagatttctctgtgaaagaagactggaaatacgtggctatggtgatcgatcggattttcctttggatgttcattatcgtttgcttactgggaactgtagggctattccttccaccttggctggctggaatgatttag

SEQ ID NO: 112029 - DNA, 1884 bp, Artificial Sequence
  Description of Artificial Sequence: Synthetic coding sequence
atggagttaggtggccccggcgcacctcgccttctaccacccttgcttctgctgctcggcacgggtctgctccgcgcctcctcacacgtggaaaccagagcacatgccgaagagaggcttctgaaaaagttattctccgggtataataagtggtctcggccagttgcaaacatctccgatgtcgtccttgttcggtttgggctctccatcgcccagctgatcgacgtggacgaaaaaaatcagatgatgactaccaatgtctgggtgaagcaagaatggcacgactacaagctgagatgggatcctgcagactacgaaaatgtgacctctattaggatcccatccgagcttatctggaggcctgacatcgttttgtacaacaacgctgacggggacttcgctgtgactcacctgactaaagcccacctctttcacgatggaagggtgcagtggaccccaccggctatctataagtcctcatgctccattgacgtgacgtttttcccctttgaccaacagaattgtaccatgaagttcggctcttggacatatgacaaagcaaaaattgacctagtgaacatgcattctagggttgaccagctggatttttgggaatccggcgagtgggtgatagtggatgccgtaggaacttacaacacaagaaagtacgagtgttgcgccgagatttaccccgacatcacttacgcctttgtcatacgccgcttgcccctcttctacactatcaacttaatcatcccctgtttgctgatttcctgtctgaccgtgctggtgttttacctcccatccgaatgtggggaaaagatcactttgtgcataagcgtactgctgtctttaacagtgtttttgctcctcattacagagatcattccatccacaagcctagtcatcccactcattggagaatacttacttttcaccatgatcttcgtgaccttatcgatcgttattaccgtctttgtactgaatgtacaccatcgatcccctaggacgcatacaatgcctacttgggtaagaagagtgttcctcgatatcgttccacggctgctgttgatgaagaggccctctgtggtgaaagataattgcagaagattaatagaatcaatgcacaaaatggccagtgctcctaggttttggcctgaacctgaaggagagcctcccgccacctccgggactcagtccctgcaccccccctccccgtctttttgtgtgcccttggatgtgcccgcagagcctggccccagttgtaagtcccccagtgaccagctgccgcctcagcagccacttgaggcagagaaagcttccccacatcctagtccaggcccctgcagacctccacatggcacacaggccccaggtctggccaaggccagatcactaagtgtgcagcacatgagcagccccggggaggctgtcgaagggggcgttcgctgtcgatcacggagtatccagtattgtgtgccacgagacgacgctgcccccgaggccgacgggcaggccgccggcgctttggcgtctaggaacacccattccgcagagctgcctccccctgatcagcctagtccttgcaagtgcacttgcaagaaggagccttcatcggtcagtccctcggctaccgtaaaaacaagatctaccaaggccccgccaccgcatctgcctctatccccggcactcactagagccgtagaaggcgtccagtatattgccgatcacctcaaggccgaggacaccgacttttcagtcaaagaggattggaaatatgttgccatggtgatcgatcggatctttctctggatgtttattattgtttgcttactggggacagtgggcctgtttctgccaccctggcttgcgggaatgatctag

SEQ ID NO: 112030 - DNA, 1671 bp, Artificial Sequence
  Description of Artificial Sequence: Synthetic coding sequence
atgcgaatgagcccaccatcggcaagccctccttcttcatcagggggaagaacaagttcttcaacaactactgccggagagccattttgggccggtgttctgttcgccataaggcctcacccaggcttatcaggaagaatagtttggaccgccgggtgcccaggagagggtgccgacggagactttgcagtcacacatctcacgaaggcacatctgtttcacgatgggcgcgttcagtggaccccaccagcaatctataagagttcgtgctccatcgacgtgactttttttccctttgatcagcagaactgcacaatgaaatttggaagctggacttacgacaaagctaagatagaccttgtgaacatgcactcacgcgtggaccagctcgatttttgggaaagcggagagtgggtgatcgtagacgccgtcgggacatacaacacccggaagtacgaatgctgcgctgaaatttaccctgacataacatacgccttcgtgatcagacggctgccgttgttctataccatcaacctgatcatcccatgccttttgattagctgcttaaccgtgcttgtgttctacttgccaagcgagtgcggcgaaaaaatcacgctttgcatcagcgttctgctgtctctaacagtgttcctgctgctcattacagaaatcatccccagcacaagtctggttattccattaataggagagtatctgttatttacaatgatattcgtgactctatcgatcgtcattacagtgtttgtcttaaacgtgcaccatcggtctccacgcacccatacaatgcctacctgggttagacgggtgttcctggacatcgtgcctaggctgctcctcatgaagcggccctccgtggtcaaggacaattgccggaggttaatagagtcaatgcacaaaatggctagtgcccctaggttctggcctgagccagagggggaacctccagcaaccagtggcacacagagtctacatcccccatctcccagcttttgcgtacccttggatgtccccgcggagccgggaccgtcttgcaaatcgccctcggaccaactgcctccccagcagccacttgaagccgaaaaggccagccctcaccccagccccggtccatgtaggcctccacatggtacacaggcacctggcctcgcgaaagctcggtctctgtctgtacagcatatgtcgtcacctggagaggcggtcgaaggcggagtgcgatgccgctctaggagcatccagtactgcgtgcctagagacgatgccgctcccgaagccgacgggcaggcggctggggcactcgcgagcagaaacacacatagcgccgagcttccacctccagaccagccctctccctgtaagtgtacctgcaagaaggaaccctccagtgtatctccttccgctaccgtcaaaacccgttctaccaaagccccccccccccatcttccactttctcccgcgctgacgagggcagtggaaggtgttcagtatattgccgatcaccttaaggcagaagatactgattttagcgtgaaggaggattggaaatatgtcgctatggttattgacagaatatttctgtggatgttcatcattgtgtgtttgctcgggaccgtcgggctctttttaccgccctggctggccggaatgatctag

SEQ ID NO: 112031 - DNA, 1407 bp, Artificial Sequence
  Description of Artificial Sequence: Synthetic coding sequence
atggccgctcgagggagcggacctcgcgcactccggcttctcctgctggtgcagttagttgcggggcggtgcggactggccggtgcagcaggtggagcccagagaggcttgtcggaaccttccagtatcgcaaaacacgaggactcactgttaaaggatctgtttcaggactacgagcgatgggtaagaccagtggagcacctcaacgacaaaatcaaaataaagtttggactggcaatctcccagttggtggatgtggatgaaaagaatcaactgatgacgacaaacgtctggctgaaacaggaatggatcgacgtcaaactgcggtggaatcctgatgattatggcggcattaaggtgatcagagttcccagtgattcagtctggactcccgatattgtcctattcgataatgccgatggcaggttcgaaggcacctctactaaaactgtaatccggtacaacgggaccgtaacttggacacccccagctaactacaaatcatcctgtacaatcgatgtgaccttcttcccttttgacctccaaaactgcagcatgaagttcgggtcctggacttatgatggctcacaggtggatatcattctcgaggaccaggatgtggataaaagagatttctttgataatggcgagtgggagattgtcagcgctactggtagcaaaggcaataggacggacagctgttgttggtacccctatgttacctactcatttgtgatcaagcgtctccccctgttctatacattattcttgattatcccatgcatcggattgtcattcctgacagtgcttgtcttctaccttccctccaatgagggagagaagatttgtttatgtactagcgtgctggtgagcctcaccgtcttcctgttagtgatcgaggagatcatccccagttcatcaaaggtaatcccgctaataggagaatacctggtgttcaccatgatctttgtaaccctttcaataatggtcaccgttttcgctataaatattcaccaccgctcttctagcactcacaacgctatggcaccactcgtgcgaaaaattttcctacatacccttcccaagctcctgtgtatgcggagccacgtggatcgctactttacccagaaagaggagaccgagtcgggcagcggacccaaaagttcacggaacacattggaagcggcactcgacagtattagatacatcacccgccacattatgaaagagaatgacgtacgcgaagtggtagaggattggaagtttattgcccaggttctggatcggatgttcttatggaccttcctcttcgtgtcaatcgtgggatcgctgggactgttcgtccccgttatttataagtgggcgaatattctgatccccgtgcacattggtaacgcaaataaatag

SEQ ID NO: 112032 - DNA, 1485 bp, Artificial Sequence
  Description of Artificial Sequence: Synthetic coding sequence
atgctgacctctaagggtcaggggtttctccacggcggcctctgcttgtggctgtgcgtatttacacccttcttcaagggctgtgtcggttgcgctacagaggaacggctgttccacaaacttttctcccactataaccagttcatcagaccagtcgagaacgtttcagaccctgtgaccgtacattttgaagtggccatcacacagcttgccaacgttgatgaggtgaaccagattatggaaacaaatctatggctccgccatatctggaatgactataaacttcgatgggatcccatggagtatgacggcatcgagacccttcgtgtgccagccgataagatctggaagccagatattgttctttacaataatgctgtgggtgatttccaagttgaaggcaaaaccaaggcattgctgaagtacaatggcatgataacctggacacctccggcaatttttaaaagttcctgtcctatggatattaccttttttccgtttgatcaccagaattgctctctcaagtttggcagttggacttacgacaaggcagaaatagatctattaatcattgggagcaaagtggacatgaacgacttctgggagaactcggaatgggaaatcatcgatgcgagtggctataaacatgatataaaatacaattgctgcgaggagatatatactgatataacttattcattttatatccggcgcctaccgatgttttatacgattaacctgattatcccttgtctcttcatcagctttctgacggtgttggtcttctacctcccctctgattgtggagaaaaggtgactctgtgtatcagcgtgttgctgtctcttactgtgtttttgctggtaataaccgaaactatcccgagcacgtcgttggtcgtgcccctagtcggggagtatctcttgttcacaatgatcttcgtcaccctgtcaattgtggttactgtctttgtactcaatatccactaccgtacgccaactacccatactatgccacggtgggttaaaacggtctttctgaaattgctgccccaagttctacttatgcgctggcctctagacaagacccggggaaccgggtcagacgccgtgccacgtggcctggctagacgacctgctaaaggaaaactcgcgtcccatggggaacccaggcatctcaaagaatgctttcactgccataagtctaacgagctggcaacgtctaaacgcagattaagtcaccagccactacagtgggttgtcgagaattccgagcacagtccagaagtggaggatgtcattaattctgtgcagtttatagcggaaaacatgaagagccataatgaaaccaaggaagttgaagatgactggaagtatgtggcgatggtggtcgatagagtgttcctgtgggtctttatcatagtatgtgtgtttggaactgccggcctgtttctgcagcctctgttaggaaatacgggcaaatcttag

SEQ ID NO: 112033 - DNA, 1440 bp, Artificial Sequence
  Description of Artificial Sequence: Synthetic coding sequence
atgctcaccagtaaagggcaaggctttctccatgggggcctgtgcctgtggctttgtgttttcaccccatttttcaaggggtgtgtgggatgtgccactgaggagcggctcttccataagcttttttcacactacaatcagtttataaggcccgtggaaaacgtctctgacccagtgaccgtccattttgaggttgctataacgcaactagctaacgtgatatggaatgattacaagctgaggtgggatcctatggagtatgatgggattgagaccctgagggtgcctgcggacaagatttggaagccggacattgtgctttacaataacgcagtcggggacttccaggtcgaggggaagacaaaggccctgttgaaatacaacggcatgattacctggaccccccccgctatttttaagtctagttgtccaatggacatcactttttttccctttgaccatcagaactgtagtttaaagttcggctcctggacttacgacaaggcggaaatcgacttgctgattatcggcagcaaagtagatatgaacgacttttgggagaactcagagtgggagattatcgatgcctctgggtataaacacgacattaagtacaattgctgcgaggaaatctatacagatattacctacagtttctatattagacgcttacctatgttctatacaattaatttgattatcccatgtttgtttatatcctttctgacagtgctcgtgttttacctgccgagcgattgcggcgagaaggttaccctttgcataagtgtgttgcttagtttaactgtgtttcttctcgtcatcaccgaaactatacccagtacatctctcgtggtccctctggtgggtgagtacctattgtttacaatgatctttgttaccctttcgatcgtcgtgaccgtatttgtgcttaacattcactataggaccccgacgactcacaccatgccacgatgggtgaagaccgtattcctgaagttgcttccacaggtcttactgatgaggtggcctctggacaaaacgcggggtactggctcggatgccgtccccaggggattagcccgcagacccgccaaaggaaaattagcaagccatggtgagcctaggcatctaaaagagtgttttcactgccacaaatctaatgagctagccacatcaaaacgacggctgtcccatcagcctttgcagtgggtggtggagaattccgagcactcccctgaggtcgaagatgtgatcaatagcgtgcagtttatagccgaaaatatgaagagccataacgagaccaaggaagtggaggatgactggaaatacgtggctatggtggtagatcgagtgttcctgtgggttttcattattgtctgtgtgtttgggacagcaggtctgttcctccagcccctgctgggtaataccggtaagtcctag

SEQ ID NO: 112034 - DNA, 1509 bp, Artificial Sequence
  Description of Artificial Sequence: Synthetic coding sequence
atgcgttgcagccctggcggagtttggctcgccctagccgcgagcctgttacacgtgtccttacagggagagttccagagaaagctctacaaggagctggtgaaaaattacaatcccctggaaagaccagtcgcgaacgactctcagcctctaactgtctacttcagcctatctctgcttcaaataatggatgtggacgagaagaaccaggtgcttacaactaacatttggctccagatgtcttggacagatcactacctgcagtggaacgtgagcgagtatccgggggtaaaaaccgtgcggtttcctgacggtcagatatggaaacccgatattctgttatacaactccgccgatgagcggttcgacgcaaccttccacaccaacgtgttggtgaatagtagcggccactgccagtatttaccgccagggatcttcaagtcatcctgttacatcgatgtacgctggtttccattcgatgtccagcactgtaagctgaaattcggatcctggtcctacggcggctggtccctggatctgcagatgcaggaagcagacatcagcgggtacatccctaatggcgagtgggatttggtgggcatccccggcaaacggtctgaacgcttttacgagtgctgcaaggaaccatatcccgatgttacattcacagttacgatgcggaggcgcacactctactatgggctgaacctcctgatcccttgcgtgctgatttctgccctggccttactcgtctttctcctcccggcagattctggagaaaagattagcctgggaatcaccgtgctgctcagtctgacagtctttatgctcttagtcgctgaaatcatgccggccacctctgactccgtaccccttatagcccagtattttgcctcgacgatgattatcgtcgggctcagcgttgtagtgaccgtcatcgttttgcaataccatcatcacgaccccgatggcggcaaaatgcccaagtggactcgagtaattctgctgaattggtgcgcctggtttctgcgtatgaagcggcccggagaagataaagtgcgcccagcttgccagcacaaacagcgtcgctgctctctggccagtgtggagatgtcagctgtggcccctccacccgctagcaacggcaacttgctgtatatcggatttcggggcctggatggggttcactgcgttcccaccccagattctggagtggtatgcggccgcatggcttgctcgcccacccacgacgaacatttgcttcatggtggccagccaccagaaggagatcccgatctggcgaagatcctggaggaagtgaggtatatagcaaaccggttccggtgtcaggacgagtctgaggctgtgtgctctgaatggaaattcgccgcctgcgttgtcgaccggctatgtttgatggcattcagcgtgttcacaattatatgcacaattggaatcctcatgtccgcccccaacttcgtcgaggctgtcagtaaggactttgcatag

SEQ ID NO: 112035 - DNA, 210 bp, Artificial Sequence
  Description of Artificial Sequence: Synthetic coding sequence
atgcagaagtattgtatttatcagcactttcagtttcaattactgatccagcacctttggatagccgccaactgtgatatctgggctaaagtagctcgggtcatcggcctgctggcctcccacaagacagacctccaggaaaatactcccgtagttgaggcatttccaaactcccctagaacccctaccttgccaggggttctaacttag

SEQ ID NO: 112036 - DNA, 1239 bp, Artificial Sequence
  Description of Artificial Sequence: Synthetic coding sequence
atgcaaaaatattgcatatatcaacatttccaatttcagctgctgatacagcacttgtggatcgctgcgaattgcgacatagccgatgagaggttcgatgcgacttttcacaccaacgtgctagtcaacagctctgggcattgccagtatctccctcctggaatatttaagtcctcctgctatatcgacgtgaggtggtttccgttcgatgttcagcactgtaagctcaagttcgggtcctggtcttacgggggatggtctctggatcttcagatgcaggaggccgacatctctggttatatccccaatggcgaatgggacctcgtcggcatcccaggaaaaagatccgaacgcttctacgagtgctgtaaggaaccgtaccctgacgtaacttttactgtgacaatgagacgtcgcactctttattatggattgaatctgttaattccctgcgtgctcattagcgcacttgccctgttagtttttctcctaccagctgacagcggagagaaaatttccctgggcattacagtgctgttatctctgactgtgttcatgctgctggtggctgagatcatgcccgccacaagtgacagcgtgccactgatcgcccaatacttcgcctccactatgataatcgttgggctctcagtggtggttaccgtaattgtgctgcaataccaccaccatgatcctgacggggggaagatgcctaagtggacgcgcgtcatactgctgaactggtgcgcctggttcctgcgaatgaaacgccctggtgaagacaaggtgaggcccgcctgccaacacaagcagagacggtgcagcttggcctccgtggaaatgtccgctgtcgcaccaccccccgcatcaaacggtaatcttttgtacattggcttccggggcttggatggcgttcactgcgttcccacccctgacagtggcgtggtgtgtggaagaatggcttgctcgcctacccacgacgagcatctcctacacggaggccaaccccccgaaggagatcccgacctcgccaaaatcctcgaggaggtgcggtacatagccaacaggttccggtgtcaggacgagtccgaggccgtgtgctccgaatggaagtttgcggcctgtgtggtggaccggctgtgtctgatggcattctccgtgtttacaatcatctgcaccattggcatcctgatgtcagcgcctaacttcgtggaagccgtctcaaaggattttgcatag

SEQ ID NO: 112037 - DNA, 447 bp, Artificial Sequence
  Description of Artificial Sequence: Synthetic coding sequence
atgaggtgtagccccggtggcgtatggctagccctggccgcctctctgctgcacgtttctttgcagggcgaatttcaaagaaaactatacaaagaactggttaagaactacaaccctttagagaggccagtggccaacgattcacagccattgacagtttactttagtttaagtctgctccagattatggatgtggatgagaagaaccaagtgcttaccactaacatctggctccagatgtcgtggaccgaccattatctgcaatggaacgtgtcggaataccccggagttaagaccgtgaggttcccagacggacaaatctggaagccagatattctgctgtataattcctcctatgaccagcagcaggaagtgctggcctatgggatgcattgctggagtccccagttcggccctacctctagcagcatgtttcccgtcgtgtag

SEQ ID NO: 112038 - DNA, 600 bp, Artificial Sequence
  Description of Artificial Sequence: Synthetic coding sequence
atgacaaattctcgcaagtgttggccaatggggtgcaccgccggtgcacactctctggatcctcacccacgcctatgcagtttgctgtgtatcggggaattttgcggccgtgacggctgctccgccgacgaacgtttcgatgccacatttcacaccaatgtcctggtgaactctagcggccattgccagtacttgccccctgggatctttaaatctagctgttacattgatgtaaggtggttcccatttgacgtgcaacactgcaaactgaaatttgggtcttggtcttacggcggttggtccctggacctgcaaatgcaagaggcggacatttctggctacatccccaacggcgagtgggacttagtgggcatccccggaaaacggtccgaaagattttacgagtgctgcaaagaaccctatcctgatgtcacattcactgtgaccatgaggcgtcgaacactctattacggcctcaatctgctgatcccatgcgtcctcataagtgcactcgcgctgttagtctttctcttaccggcagattccggcgagaaaatatcactgggcataacagtcttgttatccctaacagtgttttag

SEQ ID NO: 112039 - DNA, 1596 bp, Artificial Sequence
  Description of Artificial Sequence: Synthetic coding sequence
atgaggtgctcgcctgggggtgtctggctggctctcgctgcaagcctcctgcatggtaaagccaccgcctcccccccatccactcccccctgggatcccgggcatattcctggtgcgtccgtccgtcctgcgcccgggccggtaagccttcaaggcgaatttcagagaaaactttataaagaattggtaaagaactataatcccctggagaggcccgtggctaatgactctcagcccctgactgtttacttttctctttctcttctccagatcatggacgtggatgaaaagaatcaagtcctgaccactaacatctggctccagatgtcttggacagaccactatctgcagtggaacgtgagtgaataccctggggtgaagacagtgagattccccgatggtcagatatggaaacccgatattctgctgtacaatagcgcagacgagagattcgatgcaacattccacacaaatgtgttagtgaactccagcggccattgccagtacttgccacctgggatatttaaatcttcgtgttatattgacgtccgttggttcccatttgacgttcagcactgtaagctgaagttcggcagctggtcgtacggaggatggagccttgacctgcagatgcaggaggccgacatctctgggtatatccctaacggtgagtgggacctggtgggaattcctggaaagcgctctgagcgcttctatgagtgttgcaaagagccctacccagatgtaaccttcactgtgaccatgcgcagacgaaccctgtactatggactaaatttactcatcccatgtgtgctcatcagcgccctcgccttgctggttttcttattgccagctgattccggcgaaaaaatctccctcggaattactgtgctgctctcactgaccgtcttcatgctgttagtggcagaaatcatgcctgccactagtgactcggtgccacttattgcccagtacttcgcctcaaccatgattattgttgggttatctgtagtggtgaccgtgatcgtgctccagtaccatcaccatgaccctgacggaggaaaaatgccgaaatggaccagagtaatcctcttgaattggtgtgcttggttcctcaggatgaaaaggccaggagaagacaaggtgcgtcccgcgtgtcaacacaaacagagacgctgctcactcgcctcagtggagatgtcagctgtggctccccccccagcttcaaacggcaacctgctatacataggcttccggggcttggatggagtgcattgcgtgccgacgccagacagtggcgttgtctgtggccgcatggcctgtagccccacacacgacgagcatctgctccacggcggccagccccccgagggagaccccgacttagccaaaatcttggaagaagttagatatattgcaaacagattccggtgtcaggacgaatccgaggcggtgtgttccgagtggaagtttgcggcatgtgtggtagaccgtctgtgccttatggccttttccgtgttcactataatctgtaccatcgggatccttatgagcgcccccaacttcgtagaagccgtgagcaaagacttcgcttag

SEQ ID NO: 112040 - DNA, 966 bp, Artificial Sequence
  Description of Artificial Sequence: Synthetic coding sequence
atgcaggaggcagatatatcagggtatatacccaacggcgaatgggacctggtaggtatccctggcaaaaggagcgagcgattctacgaatgctgcaaggagccctacccggacgtgacctttacggtgaccatgcgaagacgtacattgtattatggcctcaacctgctgattccatgcgtgctgatctccgcacttgccctgcttgtctttttgctcccggccgattcaggagagaaaatttccttgggcattaccgttcttctgtctctaaccgtctttatgttgttggtggccgaaatcatgcccgccacttctgatagcgtacctctcattgcccagtattttgcatccactatgattatcgtgggcttgtcagtcgtcgtgacggtgatcgtgttgcagtatcatcaccatgatcccgacggaggcaaaatgcctaaatggactcgggtgatcctccttaattggtgcgcctggttcctgaggatgaaacgacccggagaggataaagtgcgaccggcgtgccaacacaaacagcggcggtgctcattagcaagcgtagaaatgtctgctgtggcaccacctcccgcttctaacggcaacttgctctacatcggctttagaggattggacggtgtgcactgtgtccctacacctgactccggggtagtgtgtgggcgcatggcctgtagtcctactcacgacgagcacttactccacgggggccaaccaccagagggcgaccccgatctcgctaagatccttgaagaagttagatatattgcaaatcgcttccggtgtcaggatgaaagtgaggcagtgtgctccgagtggaaattcgccgcttgtgtcgtggaccggttgtgtttgatggcctttagcgtctttactatcatatgtaccatcggcattttgatgtctgcgccaaactttgttgaagctgtgtccaaggattttgcatag

SEQ ID NO: 112041 - DNA, 1440 bp, Artificial Sequence
  Description of Artificial Sequence: Synthetic coding sequence
atgaactggagccactcatgtatttctttttgctggatttattttgcagcaagcagactgagggcagcggaaactgctgacggaaaatatgcacaaaagctgtttaacgatctcttcgaggattacagcaatgccttgcggccagtcgaggacacagataaagtgctgaacgtgactcttcagattaccctcagccagataaaggatatggatgagaggaatcaaattctgacggcgtatctttggatccggcagatatggcacgacgcttatctgacctgggacagggatcaatacgacggcctggattccattcgtattccatctgacctcgtgtggaggcctgacattgtactctacaacaaagctgatgacgagtcctccgagccagtcaataccaatgtagtgctgcgctatgacggactcatcacatgggacgcgcccgccatcacaaaatcctcgtgcgtagtagatgtgacgtattttccctttgataatcaacagtgcaacttaacattcggatcctggacatataacggaaaccaggtggacatctttaacgcgttagactccggcgatctgtccgatttcatagaggatgttgaatgggaggtacatggaatgcctgccgtgaagaatgtgatcagttacgggtgttgcagtgaaccgtatccagacgtcacatttaccctgctcctgaagaggaggtcgtccttctatatcgtaaacttgctgattccctgtgtgttgatatccttcctcgctcccttatccttttatctgccagctgcctctggagagaaggtcagcctgggtgtgaccattctgttggctatgacggtctttcagctcatggtcgcggaaatcatgccagcttctgagaacgtgccgttaataggcaagtattatatcgcaaccatggccctgatcacagcatccactgccctgaccataatggtgatgaatatccacttttgcggcgccgaagcgcggccggtaccccattgggctagagtggtcatcttgaagtacatgtctagagtcctctttgtatatgacgtgggggagtcgtgcctctcaccccaccattcacgtgaaagggaccatctgaccaaagtgtactccaaactgcccgagagtaatctaaaagcagctagaaacaaagatctgagtcgaaaaaaagacatgaacaagaggttgaagaacgatcttggatgtcagggcaagaacccgcaggaggcagagtcttattgtgcacagtacaaagtactcacacggaacatcgagtacatcgcgaagtgcctcaaggatcacaaggcaacgaatagcaaggggtctgagtggaagaaggttgccaaagttatcgatagattctttatgtggatattctttattatggtctttgtgatgacaattctcataattgccagggctgactag

SEQ ID NO: 112042 - DNA, 1506 bp, Artificial Sequence
  Description of Artificial Sequence: Synthetic coding sequence
atgacacctggagcactgttgatgctgctgggggccttaggtgctccactggcaccaggcgtgcgggggtctgaagccgagggccgcctgagagagaaactgttttctgggtacgattcatccgtaaggcctgcacgcgaagtgggggatcgcgtgagagtgtctgtgggccttatactggcccagctgatttctctgaatgaaaaagacgaggagatgagcaccaaggtgtacttggacctcgagtggaccgattatcggctgtcttgggaccctgctgagcacgacggcatcgatagcctgcgcataactgccgagagcgtctggctccccgatgtcgtgctgctcaacaataacgacggcaacttcgacgtggcactcgatatctctgtggtcgtctcaagtgacggatcagtcaggtggcagcctcccggtatctaccgaagcagttgctctatccaagtgacatattttcctttcgactggcagaactgtacgatggtcttctcatcatactcgtatgattcgagtgaggtgtctttacagacagggctgggcccggatggccaaggccaccaggaaatacacattcatgaaggcacatttattgaaaacggccaatgggagatcatacataagccttcccgcctcatccaaccacctggagatccacgagggggccgagagggacaacggcaagaagttatattttacttgatcatcagacggaagcccctattctacctcgtgaacgtgatcgcgccttgtatattgattaccctcctggccatctttgtgttttatcttccgccagatgctggagaaaaaatggggctctcaatttttgctttgttgaccctgaccgtctttctgcttctgctggcggacaaagtgcctgagactagcctctcagtcccaatcatcatcaagtacctgatgtttacaatggtcctggtgacgttcagcgttatccttagcgttgtcgtgctgaatcttcaccaccgtagcccacacactcaccagatgcccctgtgggtccggcagatcttcatccacaaattacccctatatttgaggctcaaaaggcccaagcctgagcgggatctcatgcctgagccaccacactgtagttccccgggttcgggctggggtcgcggcacggacgaatactttatcagaaaacctcccagtgattttctgtttcccaaaccaaatagattccaacctgagcttagcgcccccgacttgaggcggttcatcgacggaccaaacagagcggtagccttgttgcctgagctgagagaagttgtcagtagcatctcttatatcgccaggcagctccaggagcaggaggaccacgatgctctgaaagaagattggcagtttgtcgctatggtggtagatagactgtttctctggacattcattatattcacgagtgtggggacccttgtaattttcctcgacgctacttaccacttaccaccccccgatccctttccttag

SEQ ID NO: 112043 - DNA, 1290 bp, Artificial Sequence
  Description of Artificial Sequence: Synthetic coding sequence
atgtccactaaagtgtacctcgacctagagtggacagactataggctgtcttgggatccagccgaacatgatgggatagacagtctgaggattaccgctgaaagtgtgtggctgcctgacgtggtcctgctgaacaataatgacggaaacttcgacgtcgccttggatatctctgtggttgtgagcagcgatggctctgtgaggtggcagcccccgggaatttaccggtcatcctgtagtattcaagttacctacttccctttcgactggcagaattgtaccatggtattcagctcctattcttatgactcatctgaagtcagccttcagaccggtctgggtccagatggccagggacatcaggagattcacattcacgaaggaacattcatcgagaacggtcagtgggaaattatccataaaccatcaaggctgatacagcctcctggcgatccacgggggggccgcgagggacagcgacaagaggtgattttttatctgattattaggaggaagccccttttctacttggtaaatgtcatagcaccgtgtattctcataaccctgttggccatctttgttttttatctgcccccagacgccggagagaagatgggattgagtatatttgcactgctcactctcactgtgttcctgctgcttctagctgataaagtgcccgagaccagcctctccgttccgatcataattaaatacttgatgtttaccatggtgttagtgacgttctctgtcattctgtctgtggtagtattgaacctacatcatcggagtcctcacactcaccaaatgcccctgtgggtacgccagatattcatccacaagttacccttgtaccttagactgaaaaggcctaaacccgaaagggatctcatgccagagccgcctcactgttcctctccgggctctggttggggtcgcggcaccgatgagtactttatcagaaagccaccttccgatttcctcttccccaagcccaatcgattccaaccagagcttagtgctcccgatctccgaaggtttattgacggccctaaccgagccgtcgccctactccccgaattacgcgaggtggtcagctcgattagctatatcgcaaggcagctccaggaacaggaagatcacgatgccttaaaagaagattggcagttcgtggccatggtagtcgatcgcctgttcctgtggaccttcatcatttttacctcagttgggacactggtgattttcctggacgccacataccatctaccccctccagatccattcccctag

SEQ ID NO: 112044 - DNA, 1509 bp, Artificial Sequence
  Description of Artificial Sequence: Synthetic coding sequence
atggctcggcggtgcgggcccgttgcactgctcttgggatttggactcctccgtctgtgtagcggcgtgtggggtactgacacagaggagcgtctagtggagcaccttttagaccccagccgctataacaagctgattcggccggctaccaacggctctgaactggtgacagtccagctgatggtaagcttggcccaactcatctcagtccacgaacgggagcagattatgactacgaacgtttggctgactcaagagtgggaagattatcgcctcacttggaaaccagaggaatttgacaatatgaaaaaagtgcggctgccttctaaacatatctggctccccgatgtagtgctgtacaacaacgctgatggcatgtacgaggtttctttttatagtaatgcggtcgttagctatgacggctccattttttggctacctcccgctatctataagtctgcctgcaagatcgaggtgaagcactttccttttgaccaacagaactgcacaatgaaatttaggtcttggacatatgatcggacagaaatagacttagtgctcaagtccgaggtggctagtctcgatgacttcacacccagtggcgaatgggatatagtggctctcccaggcaggcggaatgagaaccccgacgatagcacctacgtggatattacctacgattttataattagaaggaagcctctgttctataccatcaacttgattattccctgcgtattaattacctcattggcaattttggtgttctacctgcccagcgattgtggcgaaaagatgaccctgtgtatctccgtgctgctagctttgacagtcttcctgcttctgattagcaagattgtgcctccgacatctctggatgtccctttggtgggcaagtatctaatgtttacaatggtgctggtgacgttctccatcgtgaccagcgtgtgtgttcttaatgtccatcaccggtcacctaccactcacaccatggccccatgggttaaagtggtctttctggaaaagctcccggcccttctttttatgcagcagccgagacatcactgcgctcggcagaggttgcgcctgcgacggcggcagcgggaaagggagggagcaggagccctttttttccgggaagcacccggcgctgactcctgcacctgctttgtgaaccgggcttctgtgcagggcctcgcgggcgctttcggggctgaacctgcgccggtagccgggccaggtaggtcaggcgagccatgtggttgtggactccgtgaagcagtggatggagtgcgtttcatcgctgaccacatgcgctccgaggatgatgaccagtcggtaagcgaggattggaaatacgtggccatggttatcgatagacttttcttgtggatattcgtattcgtctgtgtgttcggtaccattggcatgttcttgcagccactcttccagaactataccacaaccacattcctgcacagcgatcattcagcaccaagctccaagtag

SEQ ID NO: 112045 - DNA, 1377 bp, Artificial Sequence
  Description of Artificial Sequence: Synthetic coding sequence
atgttgcctgattttatgctcgtgttaatcgtcttggggataccatccagcgccaccacgggatttaattcaattgccgagaacgaagatgcactgcttagacatctatttcaaggctaccaaaaatgggtgaggccggttctacatagcaacgatactattaaggtgtatttcgggctgaagataagccaactggtggatgtggacgagaaaaatcagcttatgactactaatgtgtggctgaaacaagagtggaccgatcacaaacttcgatggaacccggatgattacggcggcattcacagcatcaaagtcccaagtgaatccctgtggttgccagatatcgtgctgttcgaaaatgcggacggtcgcttcgagggaagtctgatgacaaaggtgatcgtcaagtccaacgggacagtcgtgtggacgccccccgcgtcatacaaatcaagttgtacaatggacgttaccttttttcctttcgataggcagaattgttccatgaagtttgggagttggacttacgacggtacaatggtggatctcattctgataaacgaaaatgtcgacagaaaagatttcttcgataatggggagtgggagattctcaacgccaaggggatgaagggtaacagaagggatggggtgtacagctacccctttattacctacagctttgtgcttagacggcttcctctcttttacactcttttcctaatcataccctgcttggggttgtcattcctgacagtcttggtgttctatttaccctccgatgagggtgagaaactcagtttgtctacttcagtccttgtttctttaacagtgttcctgctagtgatcgaagagatcatcccttcatcttcaaaggtgatccctctgatcggggagtatctcctcttcattatgatcttcgtgaccttgtctatcatcgtgactgtattcgtgatcaatgtgcatcatcgatcaagctccacataccatccgatggcaccctgggtgaaacggctgtttctgcaaaagctgcctaagctgctatgtatgaaagaccacgtcgatcgttacagctccccagagaaggaggaatctcaacccgtcgtgaagggaaaagttctagagaagaagaaacaaaagcagctgtcagatggagaaaaagtgttagtggcattcctggagaaagcagctgacagcatccgatatattagtagacacgtgaagaaggagcacttcatcagccaggtggtgcaggattggaagtttgttgcccaggtgctcgaccggatctttttgtggttgttcctaatcgtgagtgtgacagggtcagtgcttatctttaccccagccctaaagatgtggctccattcttatcattag

SEQ ID NO: 112046 - DNA, 1497 bp, Artificial Sequence
  Description of Artificial Sequence: Synthetic coding sequence
atgagaagagctcccagccttgtcctctttttcttggttgccctgtgtggtcgaggaaattgtcgggttgcaaacgctgaagagaagctgatggacgacctcctaaacaaaacccgctataataacctgatccgcccagccacctcgagctctcaactgatcagcataaagctgcagctgtcccttgcgcagctcatctctgtgaacgagcgagagcagattatgacgacaaacgtctggctgaaacaggaatggaccgactataggctgacgtggaactcgtcgaggtatgaaggcgtcaacattttgcggatacccgctaagcgtatctggcttcctgacatcgtgctgtacaacaacgccgatggcacctatgaggtgtcggtgtacactaacttgattgtgaggagcaacgggagtgtgctatggttgccgcccgccatttacaagagcgcctgcaagatcgaggtgaagtatttccccttcgatcagcagaactgcactctgaaattccggtcctggacgtatgaccacacggaaatcgacatggtcctgatgaccccgactgccagcatggacgactttacgccatcaggtgagtgggatattgtcgcgctccctggtcgccggacggtaaacccccaggacccaagctatgtggacgttacctacgattttattattaaaaggaagccactcttttataccatcaatctgatcatcccgtgcgtcctgacgactctcctggccatcctggtgttttacctgccttcagactgtggcgaaaagatgacgctctgcatttcagtattgctggccctaacatttttccttctcttgatctcaaaaattgtgcccccgaccagcctggatgtcccgctgatcggaaagtacctgatgttcaccatggtcctggtgacattttctatcgttacttcagtgtgtgttctgaatgttcaccatcggtctcccagcacccacaccatggccccttgggtcaaacgttgttttctgcacaagctacccacctttttgtttatgaaaaggcctgggcccgattcatccccagccagggcctttcccccttctaagtcctgcgtgacaaaaccagaggcaaccgccacgtctactagtccttccaacttctatggcaatagcatgtattttgttaaccctgcctccgccgcttctaagtcccctgccggctccacccccgtcgctattccaagggacttttggctgagatcctctggccggtttaggcaggatgtacaggaggccctggagggcgtgtcattcatagctcaacacatgaagaacgacgacgaggaccagagcgtggttgaagactggaaatatgtggcaatggtagtggacagactgttcttgtgggtcttcatgttcgtatgcgtattgggtactgtgggacttttcttgccacccctgttccagactcacgctgcctcggaaggtccctatgcggcccagcgcgactag

SEQ ID NO: 112047 - DNA, 696 bp, Artificial Sequence
  Description of Artificial Sequence: Synthetic coding sequence
atgcgtcgagccccctccctcgtgctattctttcttgtcgccctatgtggccgcggcaactgtcgggttgctaatgccgaagaaaagcttatggacgacctgctcaataagacaaggtataacaatctgatcagaccagcaacatccagctcacaactgatctctattaagctgcagttatctctcgcacagcttattagcgtgaacgagcgggagcagattatgactaccaacgtttggctcaagcaggagtggactgactatcgcttgacatggaactcaagtcgttatgaaggagtaaatattctacggattccggcgaaaagaatctggctgcccgatatagtcctgtataataaaagccttagaaccggtagcacctggttgtggtggtggaccggctgcagttgcggttgttcctgcctctgtgcctcctgggctttgtggggatccagctacagaccttcttctcgacctatgcagctgctgcgaggacctaccctgccgtcagtgactgagggacccctgggatgcggagtcaggggctgtgagtggcccggaggccacttcgccgcatctttctgggtcgtcgccgatgaggccctgtccaagtatgtgagcattgggcaccagcctcatcagaccagccattcaaggggaacgggaaaggatgggggtctgggttgtccgctttag

SEQ ID NO: 112048 - DNA, 1554 bp, Artificial Sequence
  Description of Artificial Sequence: Synthetic coding sequence
atggaaggccccgtactgaccctgggactcctcgccgcgctggccgtgtgtggcagctggggtctgaacgaggaggaacgtctcatccggcatctgtttcaggagaaagggtacaacaaagaactcaggccggtcgcacataaggaggaatcggtggacgtggcactggcattgacactgagcaacctgataagcctgaaggaagtggaggaaaccctgacaactaatgtgtggatcgaacacgggtggactgataacaggctgaaatggaacgcagaggaatttggcaacatatctgtgctgagactgcccccggacatggtgtggttgcccgaaattgtcttggagaataacaacgacgggtcgttccagatcagttattcatgcaatgtgctggtgtaccactatggattcgtgtactggctgcccccagccatcttccgcagctcatgtcctatatccgtgacctattttccgttcgactggcaaaactgctcactcaagttctcctccctcaagtacaccgctaaagagattacactgagtttaaaacaggacgcgaaggagaatcgcacttacccagtggagtggattatcatcgaccccgaagggtttacagaaaacggggaatgggagattgtccatagaccagctcgggtcaacgtggatcctcgagcgccgctcgacagtcctagtcgccaggacattacattctacttgattataaggaggaagccactgttttatatcatcaatattctagttccatgcgtgctgatctccttcatggtgaatcttgtcttttatttgcccgccgactctggcgaaaagacctccgtggccatatctgtcttacttgcccagagcgtattcctgctgcttatctccaagcggctgccggcaacttcaatggctatcccactgattgggaaattcctgttgttcggaatggtccttgtaaccatggtggtggtgatctgtgtcattgtcctgaacatccacttccgtacacccagcacccacgtcctgtcggagggtgtgaaaaaactgttcctggaaacactgcccgaacttttgcacatgagtaggccggctgaggatggaccttcccctggggctctcgtgcgaagatccagcagcctgggatatatctcaaaggctgaggagtactttctcttgaaaagtcggagtgatctcatgtttgagaaacaatccgaaaggcacggcttggcccggcgactgaccaccgcgcggagaccaccagcaagttcggagcaggcacagcaggaactgtttaacgagctcaagcccgccgtggacggcgcaaactttatcgtgaaccatatgcgcgaccaaaataactacaacgaagagaaggatagctggaacagggtcgctcggacggtggacagactctgtctgttcgttgtgactcccgtgatggttgtgggtacggcctggatcttcctgcagggcgtgtataaccagccacctccccagccctttcctggtgacccctattcatataacgtccaagacaaacgattcatctag

SEQ ID NO: 112049 - DNA, 708 bp, Artificial Sequence
  Description of Artificial Sequence: Synthetic coding sequence
atggaaggccctgtcttaactttgggtctcctcgctgctctggcggtttgtggatcttggggcttgaatgaggaggaaagacttattaggcacctcttccaggaaaaagggtacaacaaggaactccgccccgtagctcacaaggaagagagcgttgacgtcgccctcgcactcactctgtccaatctcatatccctgaaagaggtagaggaaacattaaccaccaacgtctggatcgaacatggatggacagacaatcggcttaagtggaatgcagaagagttcggcaatatttccgtgctgagactccccccagatatggtctggctgcctgagatcgtcctggaaaataataatgacggcagctttcagatcagctactcttgcaacgtgctcgtatatcattacgggtttgtgtattggctaccccctgctatattccgcagctcatgccctattagcgtgacctattttccctttgattggcagaattgtagcttgaaatttcgagaaagaggcgttggagactctcctccagctggccaggggcagcgaggaccccagtctcctagtggacagcctcaacctcctggccatcacctgcttcctcatcatccaccccaagctccgttgctgcaccatcaacatcccggcgcgctgcgggcacatctgctgcatggccagcctgggcttctccccaccggctag

SEQ ID NO: 112050 - DNA, 972 bp, Artificial Sequence
  Description of Artificial Sequence: Synthetic coding sequence
atgctgaagaacctggagacctccgtgtcctgtgcctcacctagaacatggtgtgggtcccaaaggctttgctggcgtacaacgatgacagcccccagccgctcgccgacaccagccacgtgcctgagtacaaccactgcttcatgcaccggatgccatcttccttccagcgccccccctgccccttctctctcacccatttccccttccaccggcaggactgcaccatctagttctgggggtgagaaaacctcagtggcaatcagtgtgctgctcgcacagagcgtatttctgctgctgatctctaagcggctccccgccacttcgatggcaattccgctgattgggaaattcctgctgtttgggatggtcctcgtgactatggtcgttgtcatctgtgtcatagtgttaaacattcattttcgaactccctctacgcatgtgttaagtgaaggcgtgaagaaactattcttggagaccttgcccgagctgctacacatgtccagacctgcagaggatgggccctctccaggcgcactggtgaggaggagcagtagcctggggtatatttccaaggctgaggagtatttcctgctgaaaagtagatcagatctaatgttcgagaagcaaagcgaacggcatggcctggctcggcggttgactactgctaggaggccacctgctagtagcgaacaagcccagcaggaactgtttaatgagcttaagcccgccgtggatggtgccaatttcatcgtaaatcatatgcgtgatcagaataattataatgaagagaaggacagttggaacagggtcgctcgcacagtcgacaggctgtgcctgttcgttgtgacaccagtcatggtcgttggcactgcatggatctttctgcagggtgtgtataaccagccacctccgcaaccattcccaggggacccatatagctataacgtgcaggacaaaaggttcatttag

SEQ ID NO: 112051 - DNA, 708 bp, Artificial Sequence
  Description of Artificial Sequence: Synthetic coding sequence
atggaaggccctgttctgacactgggcttgctggccgcgttagcagtgtgcggatcctggggacttaacgaagaagaaagactgatcagacatctgttccaagaaaagggatataataaggaactgagacctgttgcccacaaggaagagagtgtggatgtcgcactcgctctaacactgtcgaatctcatatccctgaaggaagtggaggaaaccctcaccacaaatgtgtggattgaacacggctggactgataatagattgaagtggaacgcagaagaattcggaaacatctccgtgctgcggctacccccagatatggtttggttaccagaaattgtactggagaataataacgatggcagcttccagatcagttactcctgtaacgtgttagtataccattacggcttcgtctattggctcccccctgcaatcttccgaagcagctgtccaataagtgtgacttatttcccctttgattggcagaattgcagtctcaagtttagagagagaggcgttggggatagtcctccagcaggccaggggcaacggggcccccaaagcccctctggacaacctcaaccaccaggtcatcatctgctgccccaccaccccccacaggcaccactgttgcatcaccagcaccccggagctctccgtgcccatctgctgcacggccaacctggcctattaccaactggttag

SEQ ID NO: 112052 - DNA, 1509 bp, Artificial Sequence
  Description of Artificial Sequence: Synthetic coding sequence
atggaaggcccagtgctgaccctcgggttgctcgcagccctggctgtctgcgggtcatggggattgaatgaggaggagagattgatccgtcatttattccaggagaagggttataataaggaattgaggcctgtggcccataaagaagaatcagtggacgtggcactcgcattgacccttagcaatctgatctcacttggatggacagacaacaggttaaaatggaacgccgaggagtttggaaatatcagcgtactcaggctgccacccgacatggtatggttacccgagatagtactagaaaacaataatgatggatcctttcagatttcttatagttgcaatgtcctggtctatcactacggatttgtctactggctgcctcctgcaatcttcaggtcctcgtgccccatctccgtgacatatttcccatttgattggcagaattgtagcctgaaattcagtagtctgaaatacacagctaaagagattactcttagccttaaacaggacgcaaaggaaaacagaacgtaccctgttgagtggatcatcatcgaccctgagggatttaccgaaaatggcgaatgggagatcgtgcatcggccagcccgcgtgaatgtggatccccgcgcccctctggattcccccagccggcaggatatcactttctacctcattattaggcggaaaccacttttctatattatcaatattctggtgccatgtgtgctcatttcctttatggtcaatcttgtgttttacctaccggcagactccggcgagaagacctccgttgcgataagcgtgcttctggcccagtctgtgtttttgctgctgatttccaagcggctgcccgctacttcaatggccatcccactcataggtaaattcctcttattcggaatggtgcttgtgacaatggttgtggtgatctgtgttattgtcctgaatatccacttcagaactccttcaacccatgtgctcagcgagggggtcaagaagctgttcctggagacccttcctgaactgctgcatatgtcgcgacccgccgaggacgggccaagccctggcgccctggtgcgtaggtcctccagcctgggctacatttccaaagcggaagagtattttctgttaaagtctaggtccgatctcatgttcgaaaagcagtctgaacgccatgggttagcaagacgcctgaccaccgcccgtaggccccccgccagttcagagcaagcccagcaagaactctttaacgagcttaagccagccgtggacggcgctaattttatcgtgaatcacatgcgcgaccaaaataattataacgaggaaaaggactcctggaatagggtagccaggacagtggaccggttgtgcttatttgtagtgacacccgtcatggtggtgggcacagcttggatttttctgcaaggggtctacaatcagccccctcctcaaccatttcccggcgatccatatagctacaatgtccaggacaaacgcttcatatag

SEQ ID NO: 112053 - DNA, 1482 bp, Artificial Sequence
  Description of Artificial Sequence: Synthetic coding sequence
atggcccgcgccccgctcggtgttctgctcctgctcgggttgctaggccgcggggtgggaaaaaacgaggagctcagattgtaccaccacctgtttaataactatgacccgggctcccgacctgtccgcgaacctgaagatactgtgaccatttccctgaaagtcacactgactaacttgatctcactgaatgagaaggaagagactctcaccacatccgtgtggattggcatcgactggcaggactaccggctgaattactccaaagacgatttcgggggaattgaaacgctacgggtgccgtccgaactcgtctggttgccagagatcgtgctggaaaacaatattgacggacagtttggagtcgcctacgatgctaacgtcctggtctacgaaggtggatcggttacgtggctgccccctgctatctatagatcagtgtgtgcagtggaggtgacatattttccatttgattggcagaattgctctctcatttttcgctctcagacttataacgctgaggaggtcgagtttactttcgccgttgacaacgatggcaaaactattaataaaatcgatatagatacggaggcctatactgaaaacggagagtgggctatcgatttctgcccgggcgtgatcagaagacaccacgggggtgcgaccgacggtcccggggaaactgatgtgatctattcactaattattcggcggaaaccactgttttatgtgatcaacataatcgttccttgcgtcctgattagtggcttggtgttacttgcctactttttaccagcccaggctgggggacaaaagtgcacagtcagtattaacgtgcttcttgctcagactgtattcctttttttaatcgctcaaaagatccccgaaacgtccctatctgtgcctctgctggggcgcttcctgatatttgttatggtcgtggcaacactgatcgtgatgaactgcgtaattgtgctcaatgtgtcgcagcgcactccaacaactcatgccatgagtcctcgcctcaggcatgtgctgctggagctgctccctagattgctgggctcacccccaccaccagaagccccaagagcagcttctccaccacgtagagcttcttccgtcggtctgctcctcagggctgaagagttgatcctcaagaagcctcggtctgagctcgtgttcgaagggcaaaggcatagacagggtacgtggaccgcagcattctgtcaaagtctgggagctgcggcaccagaagtgaggtgctgcgttgacgccgttaatttcgtggccgagtctacaagagatcaggaggccacgggagaggaggtctcagactgggtacggatggggaatgcgctggataacatttgcttctgggcggcactcgtgctattctcagtgggatcctcactgatctttttaggcgcatatttcaaccgcgttccagatctgccctacgccccttgcatccagccatag

SEQ ID NO: 112054 - DNA, 1554 bp, Artificial Sequence
  Description of Artificial Sequence: Synthetic coding sequence
atgcatggcgggcagggccctcttctgctgctgctgcttctcgccgtttgtttgggcgcccagggccgcaaccaggaggagcgacttttggccgatcttatgcagaactacgaccccaatttgcgccctgcagagagggactccgacgtggtgaacgtaagcctcaaactgacactaactaacctgattagcctgaatgaacgtgaagaggctctgactacaaatgtatggatcgaaatgcaatggtgtgactatcgactcagatgggatcctagagattatgagggcctgtgggtgttacgagttccgtctaccatggtgtggcggcccgacatcgtcctggaaaacaatgtagatggcgtctttgaggtggccctgtactgcaatgttctcgtctcgcctgatggatgtatctactggttacccccagccatattcagaagcgcatgttcgatctcagtgacatatttcccattcgactggcaaaactgctctctaatctttcagagccaaacatactcaaccaatgaaattgatctgcaactctctcaggaagatggacagacaattgagtggatatttattgaccctgaggcctttaccgagaatggggaatgggccatccaacatcggcccgctaagatgctgctcgatcctgccgcgcccgcccaggaggccggccaccagaaagtggtgttctatctgctgattcagaggaagcccctcttttatgttatcaacatcattgccccgtgcgttctgatctcctctgtggctattttgatccacttcctcccggcaaaagcaggtggccagaagtgcactgtggccatcaacgtgctccttgctcaaacagtgtttttgtttttggtggccaagaaggtccccgaaaccagtcaggcagtacccctcatctctaaataccttacattcctgctcgtagtgaccatcttgatcgtggtcaatgctgtggtagtactgaacgtgtccttgcgatcacctcacacgcatagcatggctaggggggtcagaaaggtatttcttagactcctcccgcagctactgcgaatgcatgtgaggcccctcgccccagccgcagtgcaggatacacagtccagattgcagaatggtagttccggttggtctattacaaccggggaagaagtagccttatgtttgccacgctccgagctgcttttccaacagtggcaaaggcaaggactggtggccgcggcactggaaaagttggaaaagggccccgagctggggctaagccaattctgcggaagcctcaagcaggctgcgccggccatacaggcttgtgtcgaggcatgtaacctcatagcttgcgcccgtcatcagcagtctcactttgataacggaaatgaggaatggtttctagtcggtagagtccttgatcgggtgtgctttcttgcgatgctgtccttatttatatgcggcactgccggtattttcctcatggcccactataatagggtacctgccctcccattccccggggatcccaggccgtacttgcctagtcctgattag

SEQ ID NO: 112055 - DNA, 1554 bp, Artificial Sequence
  Description of Artificial Sequence: Synthetic coding sequence
atgcacggcggacaaggcccactcctgttactcctccttcttgccgtctgcctgggcgctcaggggcgtaatcaagaggaacgcctacttgctgatctgatgcagaattatgatcctaacttgcgccctgcagaaagagactcagatgttgtgaacgtgtctcttaaactgactctgactaatctgataagtttaaatgagcgggaagaggccttaaccactaacgtgtggattgagatgcagtggtgcgactacaggctgagatgggatccacgcgattacgagggactgtgggtgctgagggttccttccactatggtgtggcgccccgacattgtgttagagaacaacgtcgacggagtgttcgaggtggcactgtactgcaatgtgttagtgtcacccgatggatgcatctactggttaccacctgccatctttcgcagtgcttgttctatcagcgtgacctacttcccttttgactggcagaattgcagtttaatttttcagagtcagacatattctacaaacgagatcgatcttcagctgtcacaagaggacggccagacaatcgaatggatttttatcgaccccgaggccttcactgagaacggagagtgggcgatccagcatcgtcccgccaagatgctccttgatccagcagcacccgcacaggaagccggtcaccagaaagtcgtgttttaccttcttattcagcggaagccattattctatgtgatcaatattatcgccccttgtgtccttatttcttcagtggcaatactaattcactttttacccgctaaagcaggcggccagaagtgcaccgtagcaataaacgtgcttcttgcccagaccgtgttcctcttcctggtagccaagaaggtacccgaaacatctcaggctgtcccgctcatctctaagtatcttaccttcctcctggtcgtgacaatactgatcgttgtgaatgctgtggtggtgttaaacgtgtccctccgtagcccgcatacccattccatggctagaggtgtcaggaaagtgtttttaagattgctgccacagctcctgcgtatgcacgtccggcccctggctcctgctgccgtccaggacactcagtcacggttacaaaacggaagcagcggttggtctatcacaacaggagaggaggtggcgctctgtctgccacgatcggagctgctattccagcaatggcagcggcagggcctggtggctgctgcccttgagaaactcgagaaaggaccagagctgggacttagccagttctgtggctccctcaagcaggccgcacctgccattcaagcctgtgtcgaagcttgcaatctgatcgcatgtgctcgacatcagcagtcacactttgacaacgggaatgaagagtggttccttgtaggaagagtgctggatagagtttgttttctggccatgctgagtttatttatttgcgggactgcgggcatttttttgatggctcattacaacagagtacccgctctccccttcccaggagaccccagaccctatctgccaagccccgattag

SEQ ID NO: 112056 - DNA, 1080 bp, Artificial Sequence
  Description of Artificial Sequence: Synthetic coding sequence
atggtcagacctatgttactgctcagtctcggtctgctggcaggcctgctgccggcactagccgcttgccctcaaaattgccattgtcactcagatttgcaacatgttatttgcgacaaggtggggctccagaaaattccaaaagtctcggaaaaaaccaaactgctgaacctgcaacgcaataacttccccgtactggctgcaaacagctttagagccatgcccaatctcgtttcgttgcatctgcaacactgtcagatacgagaggtcgctgccggtgccttccgtggtctgaaacagttgatttacctctatctttctcacaacgatataagggttttaagggcgggagcatttgacgacttaaccgaactgacttatttgtatctcgaccacaataaagttaccgaattgcctaggggcttgctctcccccctagtgaacttgttcatcctgcagctgaataataacaaaattcgcgagctccgggccggagcctttcagggggctaaggatctgcggtggctttatttgagcgagaatgctctaagtagtcttcagcctggcgccctggatgatgtggagaacctagcaaagtttcacgtagatcgcaatcagctatcaagctatccctcagctgcgctatccaagttacgagtcgttgaagaactgaaactctcccataaccctctcaaatccatccctgataacgcatttcaatcattcggcagatatctggaaaccctgtggttggataatacaaacctggagaagttctcagatggcgccttcctaggggtaaccacactgaagcacgtgcacctggagaacaaccgtctgaaccagcttccttccaattttccgttcgatagtctggagaccctagcgcttacgaacaatccttggaagtgtacatgccagctgcgtggactgagaagatggcttgaggccaaggcctcacgcccagatgccacatgcgcgtcccctgccaagttcaagggacagcacatacgggacactgacgccttcaggagctgtaaattcccaacaaaacgcagtaaaaaagccggcaggcattag

SEQ ID NO: 112057 - DNA, 129 bp, Artificial Sequence
  Description of Artificial Sequence: Synthetic coding sequence
tgagcgtcacgtcccgacgcgacctgcgcaagtccagcaaagttcaagggccagcacattagggatactgacgcattcaggtcttgcaaatttcccaccaaaagatccaaaaaggccggacgccattag

SEQ ID NO: 112058 - DNA, 1080 bp, Artificial Sequence
  Description of Artificial Sequence: Synthetic coding sequence
atggtgaggcctatgctgctgttgtccctggggttgctggctggcctgctgcccgcacttgctgcttgcccccagaactgtcactgccactccgatcttcaacatgtcatttgtgataaagtggggctccagaagatcccaaaagttagcgaaaagacaaaactgttaaatctgcagcgtaacaatttcccggtcctcgccgcgaactcttttcgcgccatgccaaacttagtctctcttcacctgcagcattgccagatcagggaggtcgccgccggggcgttccgcggactcaagcagctaatttacctgtacctcagccacaacgatattagggtgcttagggctggcgctttcgatgatctgacagagctgacgtacctttacctcgatcataataaggtgactgaacttccacgagggctgttatccccactggtgaacttgtttatccttcagttaaacaacaacaagattcgagagttgcgcgccggggccttccagggagcgaaagatctccggtggctgtatctttccgaaaacgcactgtcatccctccagcctggcgctttggatgatgtagagaacttggctaaatttcacgtagaccgcaatcaattgagctcttacccgtccgccgctctttccaaactgcgcgttgtagaagaattgaagctttcccacaaccctttgaaatctattcccgacaacgccttccagtcttttggcaggtatttggagacgttgtggctggataatactaacctcgagaagttttcggacggcgcctttctaggcgtgactacactaaaacacgtccatctagagaacaacaggctgaatcagcttcccagtaattttccatttgactctctggagacacttgcacttacaaacaacccttggaaatgcacctgccagctccgggggttacggaggtggttagaggcaaaggcctccagaccagatgccacctgtgccagtccagccaagtttaaaggtcagcatattagggatactgacgcttttcggagttgcaagtttccaacgaagaggagtaagaaagccggcagacattag

SEQ ID NO: 112059 - DNA, 2328 bp, Artificial Sequence
  Description of Artificial Sequence: Synthetic coding sequence
atgcgcgcatccctcctgctgtccgttctgagacccgccggcccagtggccgttggaataagtctcggattcacactaagtcttctgtctgtgacctgggtggaggaaccctgtggaccaggtcccccccaacctggcgacagcgagctaccgccgcgtggcaatacaaatgccgcccgcaggcccaactctgttcagcctggagctgaaagggaaaagcctggcgccggagaaggggcaggcgagaattgggaaccccgtgtgcttccctatcatcctgctcagccagggcaggcagccaagaaggccgtgaggacccgctacatcagcactgagctaggcattaggcagcgcttactcgtggccgtgctcacgtcccagactacccttcctacgctgggtgtggctgtcaatagaaccttgggacatcgactagaacgcgttgtgttcctgacaggcgcgcgggggagacgcgctccaccggggatggcagtggtcaccctgggtgaggaaaggcccattggacacttacatctagccctcagacacttgctggaacagcacggagacgactttgattggttttttctggtccctgatacaacctacactgaggcccacggcctggcacggctgactggacacttgtcactggcctcagcggcacatctctacctgggaagaccacaggactttatcggcggcgagcccactcccggccgatactgtcacggggggtttggagtgctgctatcacgaatgctgctgcagcaattgcggccgcacctggaggggtgtcggaacgacatcgtttcagcccggcctgatgagtggttaggccgctgtatacttgacgccacaggcgtgggatgcaccggagaccatgagggtgtgcactatagccatctcgaactgagcccaggtgagccagttcaagagggcgacccccattttcgttccgcactgactgctcaccccgtgagggaccccgtgcacatgtatcagctgcacaaagcatttgcacgggccgagcttgagcgtacataccaagagatccaggagctgcagtgggaaatccagaacactagccatctcgcagtcgatggtgatcaggccgctgcctggcctgtgggtattcccgctccttctagaccggccagccgattcgaggtgctccggtgggactactttaccgagcaacacgccttttcttgcgcagacgggtcaccaaggtgcccgctgcggggagcagaccgcgcagacgtcgccgatgtcctaggaaccgctcttgaagaacttaaccgccggtaccaccccgcattgaggttacaaaaacagcaactcgtgaatgggtaccgacgctttgatccggcccgcgggatggagtatactttggatttgcagttggaagccctcactccccaaggggggcgtaggcccctcacacgaagagttcaacttcttaggcccttgtcccgggtcgaaatccttccagttccttacgtgacggaggcgagtagactcacagtactgctacctttggccgcagctgaaagagacctagcaccagggtttctggaggcattcgcaacggcggcattggaacccggcgacgctgcagcggcacttacattacttctcctatacgagcccagacaggcccagcgtgtagctcatgcagatgtatttgcccccgtgaaagcccatgtcgccgagctggaaaggaggttcccaggggccagggtgccttggctttccgtccaaaccgcagcaccatcccccttacggctgatggaccttttgagcaagaagcaccctctggacacactgtttctgctggcaggaccagatacagtgttgacacctgattttctgaataggtgtcgtatgcacgcgatttccggttggcaggccttctttccgatgcacttccaggcattccatccagccgttgcccccccacagggaccagggccccctgagctgggacgtgacacgggtcgctttgatcgccaggccgctagtgaagcttgtttctacaattctgactacgtggctgcccgcggcaggcttgccgccgcttcagagcaggaagaagaactgctggagtcgctcgacgtctatgaactcttcctgcacttttcatctctgcatgtgctgcgggcagtcgaacccgcactgctgcagcggtatcgggctcagacctgctcggctcgtctgtctgaggacctttaccaccgctgcctgcagagtgtcctggaggggctggggagcagaacacagctcgccatgctcctcttcgaacaggaacaggggaacagcacatag

SEQ ID NO: 112060 - DNA, 1842 bp, Artificial Sequence
  Description of Artificial Sequence: Synthetic coding sequence
atggcagtagtgacacttggggaagaacgtcccattggccatctgcacctggccttgcggcacctattagagcagcacggcgatgatttcgactggtttttcttggttcctgataccacttacaccgaagcccatggcctcgcccggctcaccggccacctctccctggcttctgccgcccacctgtatttgggccggccgcaggatttcatcgggggcgagcctactcctgggcgatactgccacggtggattcggcgtcctgctcagtaggatgttactgcagcagctccgtcctcacttggagggatgcagaaatgacatcgtgtccgctcgcccagacgaatggctagggaggtgtatcctggatgcaacaggcgtgggctgcacgggcgaccacgaaggtgtccactactctcacctggagctgagccctggggaaccagtgcaagagggcgatccacactttcgctcagctcttaccgctcaccctgtcagagatccggttcacatgtatcagctgcacaaggccttcgcacgcgctgagctggaaagaacctatcaggagatccaggaactccagtgggagattcagaacacatcacatctagccgtagatggcgaccaagccgccgcgtggcccgttggaatcccagccccgtcccgccccgcttccaggttcgaggtgttgcgatgggattacttcacagagcaacacgccttcagttgtgccgacggatcaccaagatgcccactgcgtggcgccgatcgcgcagatgtggctgacgtgctcggaaccgcgctcgaagagctaaaccgcaggtatcatcctgcgctaaggctccagaaacagcaattagtgaacgggtacaggaggtttgatccagcgcggggaatggagtacacgctggacctgcagctggaggccttaaccccacagggggggcgtcgcccactgactagacgggtacaattgctcagacccctgagccgggtcgaaatactgccagtcccatatgtgactgaggcctccaggctcacagtcctgctgcctttagccgctgctgaacgggacctagcccctgggtttctggaagcatttgctacagctgctctagagcccggtgatgctgcggcagcactcacattgctattactgtacgagccacgccaggcacaaagggtggcacatgccgacgtatttgcccctgtcaaggctcacgtggctgaattggaacgcaggttccccggggcaagagtcccttggctctccgtccaaactgctgccccaagccccctgcgattaatggatctcttaagtaaaaagcatcccctggacaccctgtttctcctggccggtccagatacagtgcttacacccgatttcctgaaccgctgccgaatgcatgcgatcagcgggtggcaggcattcttcccaatgcactttcaagcattccatccagccgtggctcccccacaaggtccaggtccgcccgagttgggacgcgacacggggcggtttgatcggcaagccgcttcagaagcctgtttctacaacagtgactatgtggcagcccgaggtcgcctcgccgctgcatccgaacaggaagaggagttgctggagtctttggatgtgtatgagctgttcctacacttcagcagcttgcacgtactgagggccgtggagcccgccttgttacagcgatacagagctcagacgtgctctgccagattatcagaggacctctatcatcggtgtctacagagcgtgctcgagggcttaggcagcaggacacagctagctatgctgctgttcgaacaggaacaagggaacagtacgtag

SEQ ID NO: 112061 - DNA, 2319 bp, Artificial Sequence
  Description of Artificial Sequence: Synthetic coding sequence
atgaggttatcctccttgctggctctcctgagaccagcactgccacttatccttggattatctttgggatgcagcctgagcttgttgagagtctcttggatccagggagagggggaagacccatgcgtggaagccgtgggtgaaaggggcggaccccagaaccccgattcgagggcacgccttgatcagagcgatgaggatttcaagcctaggatcgtaccttattacagggatcccaataaaccctacaagaaggtgctgagaacacgctacattcagaccgaactggggtcaagagaacggctcctcgtagctgtcctgacgagtcgggctactttgagcacactcgctgtcgccgtgaacagaacagtggcccaccattttccccggctgctctatttcaccggccagcgcggcgcaagagctcccgcaggcatgcaggtggtcagccatggtgacgaaagaccagcatggctgatgtcagaaacccttagacatttacatacccatttcggggccgactatgactggttctttatcatgcaggacgatacgtatgtgcaggcccctaggttggctgctctggccgggcacttatcaatcaaccaggatttgtacctgggcagagctgaagagttcattggggccggagagcaggctaggtactgccacggtggatttggatacctgctgtctagatcacttctgctccggcttcggccccacttagatggctgtcgaggagatattcttagcgctcgccccgatgaatggctcggacggtgtctaatagacagcctgggcgtgggatgtgtctctcaacatcagggccagcagtatcgatcttttgagctggccaaaaacagagatcctgagaaggaaggatcttctgcgtttcttagtgccttcgccgttcaccccgtgagcgagggaacgctgatgtaccgcctccataagcgcttctccgccctagaattggagagagcttactctgagattgaacagttacaggcacagattagaaatctcacggtcctaactccggagggggaggccgggctgtcttggccagttggccttcctgccccttttaccccacattcccggttcgaggtcctggggtgggactatttcacagagcagcacaccttcagctgtgcggacggagccccgaagtgtcccctgcagggagctagtcgagccgatgtgggggatgccctggaaactgccctcgagcagctgaataggaggtaccaacccagactgaggtttcagaagcagcgcctgctgaatggataccggcgatttgatccagctcgggggatggaatacacgcttgatctcttgctggagtgtgtcacccagcgcggccaccgccgggccctcgctagaagggtgtctctgttgaggcccctgtctagggtcgagatactacccatgccctacgtcacagaggccaccagagtacagctggtacttccattgctggtcgctgaagccgcggcagcgccagcatttttggaagccttcgcggccaatgtgctcgaacctcgggaacacgccttgctgacacttctgttggtgtatgggccgagggaaggcggcaggggcgccccagatccctttctgggcgtcaaagcagccgcagccgagcttgaacgcaggtatcctgggacaagactggcatggcttgccgtcagagcagaagcaccttcccaggtgaggcttatggatgtggtaagcaaaaagcaccctgtcgatacgctgttcttcttaactacggtgtggacaagacccgggccagaagtactaaaccgctgcagaatgaacgctattagcggatggcaggccttctttcctgtgcacttccaggagtttaatccagctctaagcccccaaagatcccctcctggcccaccaggcgcggggcccgatccaccctcacctccaggcgctgacccaagtagaggcgccccaatcggcgggaggttcgaccgccaagccagtgctgaaggatgtttttacaacgccgattatctggccgctcgcgcacgactagcaggcgaacttgcggggcaggaagaagaggaggcccttgaaggcctggaggttatggatgtgttcctgcggtttagcgggctccacctcttccgtgccgtggagcctgggctcgtccagaaattttccctaagggattgcagtcccagactgtcagaggaattgtaccaccgttgcagactaagcaacttggaagggctcggggggcgggcgcagcttgccatggccctgtttgaacaggagcaagctaattcgacgtag

SEQ ID NO: 112062 - DNA, 2004 bp, Artificial Sequence
  Description of Artificial Sequence: Synthetic coding sequence
atgcggttgtcatctctcttggctctgctcagaccagcactgccccttatcctgggcctcagccttggttgtagtctgtctttattaagagtcagttggatccagggggagggtgaggacccttgcgtggaagcggtcggggagcgcgggggcccgcagaatcccgacagccgggcgcgactagaccagtctgacgaagactttaagcctcgtatagtgccctattacagagaccccaacaaaccctacaagaaggtactccgtaccaggtacatccagaccgagctcggctctagagaacgtcttctggtggcagtcctcactagccgcgccacccttagtacactggccgtcgcagttaataggacagtcgcccaccactttccacgcctattatactttactggtcaacgtggggctagagcacctgccgggatgcaggtggtgagtcatggagacgaacgcccagcgtggctgatgtcggagaccttaagacacctccacactcacttcggagccgactatgattggttttttatcatgcaagacgatacttacgttcaggccccccgactggccgcgctggctggccacctgagtattaatcaggacttgtatctgggccgggcagaagagtttattggtgccggcgagcaagccaggtactgtcatggcggattcggatatctgcttagtaggagcctactgctgagactgagaccacacctagacggctgccgcggtgatattctgtcagcccgccctgacgaatggttgggaaggtgcctgatcgattcgctcggtgtcggctgcgtatcacagcatcagggacaacagtatcgctccttcgaactggctaagaacagagatccagaaaaagaaggttcatctgctttcctgtccgcatttgctgtgcacccggtcagtgagggcacacttatgtaccggttacacaagaggttttccgcactggagctcgagcgcgcctacagtgaaatcgagcagttacaggcccagatacgtaacctgactgttctgactccagagggagaagcaggactgtcttggcctgttggacttcctgcaccctttaccccccacagccggttcgaggttctgggctgggactactttaccgagcagcacaccttctcgtgcgccgatggggctcccaagtgcccactccagggcgcttcgcgggccgacgtgggcgacgctctggagaccgccctagagcagctcaaccgccgctaccagccccgcctcaggttccagaagcagcgccttttgaacgggtacaggcggtttgatcctgctaggggcatggaatacacattggatcttttgcttgagtgcgtcacacagagggggcacagaagggccctggcgcggcgggtaagtctcttgaggcctctgagtcgcgtcgagattctccccatgccttacgtgaccgaagcgacacgggtccaattggtgctgcctctactggtcgcagaagccgctgctgcacccgcgtttctggaggcctttgcggcaaatgtgttggagcccagggaacacgccctgttaacacttctgctcgtgtacggtccccgggagggcggcaggggagcaccagatcctttcctcggcgtaaaagccgccgcggctgaattggagcgacgatacccgggtacacgcctcgcatggcttgctgtcagggccgaggcccccagccaggtgaggctaatggatgtggtgtccaaaaagcatccagtggacactttatttttccttaccactgtttggacaaggcccgggcctgaagtcttgaaccggtgcaggatgaatgctattagcggctggcaggcctttttccccgtgcacttccaggaatttaaccctgccctttctccgcaacgaagcccaccccctaatttgataacattcccactgagcgcgtcggcccccggccgagcacgacaagacggcggacaaatcgaaaattgttgctgcatcttctag

SEQ ID NO: 112063 - DNA, 6969 bp, Artificial Sequence
  Description of Artificial Sequence: Synthetic coding sequence
atgcaatctggacctcgcccacccttgccagctcccggcttggccttggccctcacattgaccatgctggcccgcctagcgtcagcagcaagcttcttcggagagaaccacctggaagtgcctgttgccactgccttgaccgacattgacttgcagctgcaattctctacctcccagccagaggctctcctcctcctggcagctggccctgccgaccatttactactgcagctgtattctggaagactccaagtgagacttgtgcttgggcaggaagaactgcgcctgcagaccccagccgagacactgctgtccgattcaattccccacacagtcgtgttaacagtcgtggagggctgggccacactcagcgtcgatggatttctaaatgcctcatccgccgtcccaggggctccgctcgaagtaccttatggtctgttcgttggcggcaccggcactttagggctcccttatctcagaggcaccagtcgccccctgcgcggttgcctgcatgccgcaaccctcaacggccggtcactgctgaggcctttgacccctgacgtgcacgaaggatgtgcggaggagttctcagcaagcgacgacgtggctctgggtttcagcgggccccacagccttgctgctttccccgcctggggcacacaggacgagggaaccctagaatttacactgacgacccagtcaaggcaggctcctctcgcgttccaagccggcgggagacgtggagatttcatatacgtggatattttcgaaggccatctcagggccgtcgtcgaaaagggccaagggaccgtgctgctgcacaatagcgtacccgtggccgacggtcagccacacgaagtttctgtgcacatcaacgctcacaggctggaaattagcgtggatcagtacccaacccacacctcgaatcgaggcgtgctgtcttaccttgagccacgaggctctttgcttcttggtgggctcgacgccgaggcatccagacacttgcaagagcatagacttgggctgactcctgaggccacaaacgcttccttgctgggatgcatggaggacctctcagtgaacggccagcggagggggctgcgtgaggctctcttaactcgcaacatggcggccggctgcaggctcgaggaggaggaatacgaagatgacgcatacgggcactacgaggcattctctaccctcgctcctgaagcttggccagcgatggagctgcccgagccttgcgtgcctgagccaggtctacctccagtgtttgcaaatttcacacagctgttgactataagcccactggtggttgccgagggcggaaccgcatggttagaatggcgccatgtgcaaccaacactcgatctcatggaagccgaactgcgcaagtctcaagtacttttctccgtgactaggggtgctcgtcacggagaattagagctggacatcccgggcgcacaggcccggaagatgtttacccttctcgacgtagtgaaccgcaaagcgcggtttatacatgatggcagtgaagatacttctgatcagctggtgctagaagtgtcagtcaccgcccgcgttcctatgccgtcttgtctccgaagaggtcagacctatctattgcctatacaggtcaatccagtgaacgacccgcctcacatcatctttccacatggatcccttatggtgatattagagcatacccagaaacctctgggccccgaggtattccaggcgtatgaccccgactcagcctgcgaaggattaaccttccaggtgctgggcacttcttctgggctccccgtagagaggagggaccagcccggagagcctgcaacagagtttagctgtagagaacttgaggctgggtctttagtatacgtacaccgtgggggccctgcccaggatcttactttcagggtgtccgacggattacaggcatctccaccagcgacgttgaaggtagtggctattagacccgctatccagattcaccgatccaccggcctgcggcttgctcaggggagcgccatgccaattctcccggctaacctgtctgtggagacaaatgcagtgggtcaggatgtgagtgtgttgtttcgcgtgaccggtgcactgcagtttggggaactccagaaacagggggcgggaggagtggagggcgccgagtggtgggcgacgcaagcatttcaccaacgcgatgtagaacaggggcgagtgcgctacttgtcaactgaccctcagcaccacgcatatgacacggtggagaacctggccttagaagttcaagttggtcaagagatcctaagtaatttatcttttcccgtgacaatccaaagggccacagtgtggatgctgaggcttgagcctttgcatactcagaacacgcagcaggagacactgactacagctcacctcgaagctacactagaagaggcagggcccagccctcccaccttccactatgaagtcgttcaagcacccaggaagggaaatctgcagctgcagggtaccaggcttagcgacggccagggcttcacacaggatgacatacaggctggacgagtgacatatggggccactgcccgcgctagcgaagccgtggaggacacctttcgctttagagtgacggcccccccgtattttagtcccctctatacattccccattcacatcggtggagaccccgacgcacccgtgcttacaaacgtcttactcgtggtccccgagggcggcgagggggtcctgagtgctgaccaccttttcgtaaagtctcttaatagcgcaagctacttgtacgaggtgatggagcgccctcggcacggtcgactcgcctggcgtggcacacaggacaaaacgactatggtgacgagtttcaccaacgaagaccttctcagggggcggttggtgtaccaacacgacgattccgagactacagaagatgatattccatttgtagctaccagacaaggcgaatcatctggcgacatggcctgggaggaggttcgcggggtttttagggttgccatccagcctgtgaatgaccacgccccagtgcagaccatctctaggatttttcacgtggcaagaggcggccgtcgccttctcacaacagatgatgtagcattcagcgatgctgacagcggcttcgccgacgcccagcttgtactgacaagaaaggacctgttgttcggatctatcgtggcagtggacgaacctacccgaccaatatacaggttcacacaggaggacctaagaaagcgtcgggttcttttcgtgcatagtggagctgatcgtggctggattcaattacaagtctcagatgggcaacaccaggccactgctctgctcgaggtacaggcttccgagccttacctaagggtagcaaacggctcttcattggtggtgccacagggaggacagggtactatcgacaccgcggtgttacacctcgatacgaacttagacatcagatctggtgacgaggtgcactaccacgttacggccgggcctcgctggggccaactggtgcgggccggacagcccgcaactgcgttctcccagcaagaccttcttgatggggcagtcctctacagccacaatggttctctgtctcccagagataccatggctttctccgtagaagccggacccgttcacacagatgccaccctgcaagttacgatcgcattggagggccctctggcccccctgaagctggtccgccacaagaagatttacgtttttcagggtgaagcagctgagatacggcgggatcagctcgaggccgcccaagaagccgtaccgccagcagacattgttttctctgtgaaatcccctcccagcgctgggtatttggttatggtgagcaggggcgctctcgctgacgagccgccaagcctggaccccgtccagtctttcagtcaagaagctgtcgatacaggtcgagtactttatctgcacagtaggcctgaggcttggagcgacgctttcagcctagatgttgccagcggactgggggcccctttggagggcgtactcgtggagctggaggttctgcctgccgccatccccctggaagcccagaattttagcgttccagagggagggtcattgactttggctcccccactacttagggtgtccgggccgtatttcccaacactcctcggattaagcctgcaggtcttagagcctccacaacacggagccctgcagaaggaggacggcccacaggcgaggaccctttcagccttctcgtggcggatggtcgaggagcagttgatcagatacgtacacgacgggtccgagaccctgaccgacagcttcgtccttatggccaacgcctccgagatggacaggcaaagccatccagtggcatttaccgtcacagtcctgcctgtcaatgaccagccccccatactaacgaccaatacaggacttcagatgtgggagggagccactgcgccaatccccgccgaggcattgaggtcgaccgacggagacagcggcagcgaggatttagtttatacaattgagcaaccaagcaacggacgggtagtattaaggggggccccaggcaccgaggtcaggtctttcacgcaggcacagctggacggtgggcttgtgctgttttcccaccggggcactttggacggcgggtttcgcttccggctgtctgatggcgagcacaccagccctgggcacttctttagggtgaccgcacagaaacaggttttactttctttgaagggatcacagaccttgacagtgtgtcccgggtctgtccagcccttgtcctcccagacactgagagcaagttccagcgccggcacagaccctcagctcttgctttatagagttgtgcggggccctcaactggggcggctttttcacgcgcaacaggacagcactggtgaggctctggtgaactttacgcaggcggaggtctatgcgggcaatattctgtacgaacacgagatgcctcctgagcccttttgggaggcacacgacacactcgagctccagctctccagccctcctgcacgcgatgtggctgccaccttggcggtcgccgtctccttcgaggcggcttgccctcagcgcccgtcacatctgtggaaaaacaaaggcttatgggtgcccgagggccagagagcaagaattacagtggcggccctcgacgccagcaatctgctggccagtgtccccagccctcagagatccgaacacgatgtactgtttcaggtgacccagttcccatctcggggccagcttctggttagtgaggaaccgcttcatgccggccaaccacactttctccaaagtcagctggccgcgggccagctggtgtacgctcacggaggtggaggaacacagcaggacggctttcactttagagctcacctacaggggcctgccggtgcttccgttgcaggtccgcagaccagcgaggccttcgccattacagtgcgcgatgtgaacgagcggcccccccaaccacaggcttctgtgcccctgaggctcacacgcgggtctcgggccccaattagccgcgcgcaattatcagtcgttgatccagactccgcccccggcgaaattgagtatgaagtgcagcgggcccctcataacggcttcttgtccttagtggggggtggactgggacccgtgacccggttcacacaagctgacgttgacagcggccgactggctttcgtggcaaacggaagtagcgtggcaggcattttccagctgagcatgtccgacggcgcctcacctcctctgcctatgtcgcttgctgtggacatccttcctagcgctattgaagtccagcttcgtgcaccactggaggtcccacaagcccttggtagatccagcctctcccagcagcagctcagggtcgttagcgaccgcgaggagcctgaggccgcttatcggctgatccagggaccccagtatggtcacctgctggttggaggcaggcctaccagcgcattcagccagttccagatcgatcagggcgaagtggtctttgcctttactaacttctcgtcctctcacgatcatttccgggtactggctctggcacgcggcgttaatgcttcagctgtggtgaacgtgactgtgcgcgctctcctgcatgtctgggctggaggcccatggccccagggcgccactctgcgtctggaccccacagtactggacgccggagagttagccaatcgaacaggctcggtcccccgttttcgtcttctcgagggccccagacatgggcgtgtagtcagggttccacgagccagaacggagcccggtggatcccagctggtggagcagtttactcagcaggacctagaggacggccggttaggcttagaagtcggacggcccgaagggcgcgcgccgggccctgcgggggacagccttacactggagctgtgggcccagggagttcctccagccgtggccagcttggacttcgctaccgagccatacaatgccgcaagaccatatagtgtagcgcttctgagcgtacctgaagctgcacgtacggaggcagggaagcccgaaagttcaacaccaacgggggagccaggtccgatggcatccagtccagaaccagcagtcgctaaagggggattcctcagttttttggaagcgaacatgttctccgtgattattcctatgtgcctggttctgctccttctggctctgatactccctctcctgttctacctgcggaaacggaataaaactggaaaacacgacgtgcaagtgttgactgccaaaccccggaatggactggccggtgataccgaaacattccgcaaagtggagccaggtcaggccataccgctgactgccgtccctggccaggggcctcccccgggagggcagcctgacccagagcttttgcagttttgccgcacaccaaacccagccctcaaaaatggccagtactgggtttag

SEQ ID NO: 112064 - DNA, 984 bp, Artificial Sequence
  Description of Artificial Sequence: Synthetic coding sequence
gaacaacaccgggaagagcctgaggccgcttacaggttgatccaggggcctcagtatggccatctgctcgtcggtgggcgtcccacttccgcttttagccaatttcagattgaccagggggaggttgtgttcgccttcaccaattttagctcttctcatgaccatttccgtgttttggcgctggctcgaggggttaacgccagcgccgttgtgaacgttacagtgcgagctttattacacgtctgggcagggggcccctggccacaaggtgctaccctgcgcctggaccccaccgtcttagatgccggagagttagcaaatcgtacagggagtgtgccacgatttcgactgctggagggccccagacacggaagagtagtgagagttccccgggcacgaaccgagcctgggggatcccagcttgtggaacagtttactcaacaggatctggaagacggtagactggggctggaggtgggaagacctgaaggaagagcccctggtccagcgggcgattcccttaccctggaactgtgggctcagggcgtgcctcctgccgtggcatcactggatttcgccacagaaccttacaacgccgctcgaccctatagcgttgccctgctgagcgtgcccgaggcagctcgtacagaagctggaaaacctgagtccagcacccctacaggagaacctggtcctatggctagctcacccgagcctgcggtggccaagggcgggtttctaagtttcctcgaagctaacatgttctcggtaatcattcccatgtgtcttgtcctgttgctcctggccctcatcttgccacttttgttctacctgcggaaaagaaacaagaccggaaagcacgacgttcaggtcctgaccgctaaaccacgaaatggcctggccggagacacagagaccttcaggaaggtggagcccggacaagcaattccacttaccgccgtccccgggcagggcccaccttag

SEQ ID NO: 112065 - DNA, 2409 bp, Artificial Sequence
  Description of Artificial Sequence: Synthetic coding sequence
atggcggcacgcggacgacgtgcttggttatcggtcctattagggctagtcctgggatttgtgctggcctcaagactggttctgccaagagcaagtgagttgaagcgtgcagggcccagaaggcgggcaagccccgagggctgtagatctgggcaggccgcggcttcacaggctggaggcgctcggggggacgcccggggagctcagctgtggcccccggggtccgaccccgacggtggtccgagagaccggaactttctgtttgtcggagtaatgacagcacaaaagtatttacagacccgggcagtcgcagcctacagaacatggtccaagactatacccggcaaggtccaattcttttcgagtgagggctctgataccagtgtaccaattcccgtggtaccgctgagaggcgttgacgattcctatccacctcaaaagaaaagcttcatgatgctgaagtatatgcacgatcactacctggataagtacgagtggttcatgagggctgacgatgatgtgtacattaaaggcgatagactcgaaaacttcctgcgcagcctgaacagcagcgaaccattgtttctgggccagactggtctcggaactactgaagaaatgggtaaacttgcattagagcccggcgaaaacttttgtatggggggccccggggttatcatgagtcgtgaagtcttacgaaggatggtcccccatatcggcaagtgtctgcgcgagatgtacacgacccacgaagatgtggaggtgggtcgttgcgttcggaggttcgccggcgtccaatgtgtgtggagttacgaaatgcagcaactgttctacgaaaactatgagcagaacaagaaagggtacattagagatctccacaactccaaaattcatcaggccataacgttacatcccaataagaaccccccttaccaatatagactccactcttacatgctctcacgtaagatctcagagctgaggcaccgcaccatccagttacaccgagaaattgtgcttatgagcaaatatagcaataccgagatccacaaagaagacttgcaactcggcatcccacctagtttcatgagattccagcctcgccagagggaggagattctcgaatgggaattccttactggaaagtatttgtacagtgctgtcgacgggcaacctccccggcgcggcatggacagtgctcagcgagaagccttggacgatattgttatgcaggtgatggaaatgattaacgcaaatgccaaaacacgcggacgcattattgacttcaaggaaatccaatatggctatagacgagtgaacccaatgtacggtgctgagtatatcctcgacctgctcctcctgtacaagaagcacaaggggaagaaaatgactgtgccagtgcggcgccacgcgtacctgcagcagacttttagcaagatccagttcgtagagcatgaagagttggacgcacaagagctggccaagcgtattaaccaggaatccggcagcttgagttttctctccaacagtctcaaaaagctggtcccctttcaactgcccggcagcaaatctgagcacaaagaaccaaaagacaagaaaattaacatcctaatcccattgagtgggcgatttgacatgttcgtgcgtttcatgggaaacttcgagaaaacatgcttaatcccgaatcagaatgttaagctggtggtactcctgtttaacagcgactccaacccagataaagccaagcaggttgagctaatgcgcgattaccgcattaagtatccgaaggccgacatgcagattctgcctgtgtcaggagagttctcgcgcgctctggctctcgaggtcgggagctcccagtttaataacgaaagtctgttgtttttctgcgacgtggatcttgtgttcacaacggaatttttgcagaggtgtagagccaacactgtgttaggacagcagatctattttccaatcattttcagccaatacgatcccaaaatcgtctattctggcaaggtgccttctgataaccatttcgcttttacccagaaaactggcttctggagaaactatggctttggaataacctgcatctacaagggcgatctagtcagagtcggcggtttcgacgtttctattcaaggctgggggttggaggacgtggatctgtttaataaagtggtccaggcggggcttaagactttccgttcccaggaggtgggagtggttcacgtgcaccaccctgtgttttgtgaccccaacctagaccctaagcagtacaagatgtgcctcggctcgaaagcatcaacttacggatcaactcagcagctggcggaaatgtggctggagaagaacgatccctcttattccaagagctctaacaacaacggctccgtgcgtacagcttag

SEQ ID NO: 112066 - DNA, 2649 bp, Artificial Sequence
  Description of Artificial Sequence: Synthetic coding sequence
atggctgtccggtccaggcgaccatggatgagcgtggcactgggactggtgctgggctttaccgctgcctcatggctaattgctcctagagttgcagagctatccgaacggaaacgtcggggatcctcgctgtgctcttattatggccgaagcgccgccggacctcgcgccggtgcccagcagccgctacctcagcctcagtcccggcctcggcaagaacagtccccgccaccggctcgtcaggatctgcagggcccacctctgccagaagctgcccccggcattaccagcttccgtagtagcccctggcaacagcccccacctctccagcagagacgacgagggcgagagccagagggcgctaccggattgcccggtgcaccagctgccgagggggagcccgaggaggaggacggcggtgcggctggccagcgccgtgatggtcgcccgggtagctctcacaacggctcaggagacgggggcgcagccgccccaagcgctcgcccccgagacttcttgtatgtcggggtgatgacggctcagaagtatctaggctcccgagccttggctgctcaaaggacttgggcccggttcatccccggccgggtagaattcttttcttcccagcagccgcctaatgcagggcagccccctccaccactgcccgtaatagcactccctggggttgatgatagctacccccctcagaaaaaatcttttatgatgataaagtacatgcatgaccattatctggataaatacgagtggttcatgagggccgacgacgacgtctacatcaagggggacaaacttgaggaattcttgcgtagcctgaactcttctaaacccctttatcttggccagactggcctgggcaacattgaagagcttgggaagctcggacttgagcccggcgagaacttctgtatgggaggccccggaatgatcttctccagagaggtgctgcgcagaatggtgccccatatcggggagtgtttgcgcgaaatgtacaccactcacgaggacgttgaagtgggcaggtgtgtgagacgatttggcggaacccagtgtgtgtggtcgtacgagatgcaacaactgttccatgagaactacgaacataatcggaaaggatatatccaggatttgcacaactcaaagatccacgcggctataacactgcacccaaacaaacggcctgcctaccaataccgcctccataactatatgctgtcgcggaaaatctctgaattacgctataggacgattcagctccatagggaatctgccctcatgtcgaaactgtcgaacaccgaggtgtctaaagaagatcagcaactcggagtcatcccttcctttaaccattttcaaccaagagagagaaatgaggtgatcgaatgggaatttctcactggaaagctcctgtatagtgccgcggagaaccaaccaccacgacagagcttgtcctccattctacgaaccgctcttgacgacaccgttttacaggtaatggagatgattaatgagaatgcaaagagccgcggcaggttgatagatttcaaggagatccaatacggttatcgtcgggtgaaccccatgcacggggtagagtacattctggacctgctcctgttatacaaacgccacaaaggccgcaaactcacggtaccagtgcgaaggcacgcttacctccaacagctcttctccaaaccctttttccgggaaaccgaggaactggacgtgaactccctggtcgaatcaatcaatagtgaaacacagtccttcagcttcataagcaattccctcaaaatcctttcttctttccagggcgccaaggagatggggggacataatgagaaaaaggtgcacatcctggtgccactgattggccggtacgatattttcttgcgctttatggaaaattttgaaaacatgtgtctgatcccaaaacaaaacgtgaagctcgtgattatcctcttcagtcgcgactcaggccaggactccagcaagcacatcgagctcattaagggataccaaaacaaataccccaaggcagagatgactctgatcccaatgaagggcgaattcagccgcgggttaggcctggagatggcttctgcccagttcgataacgatactcttcttctattttgtgatgtagatctgatcttcagagaggactttctccagcgatgcagggacaacaccattcaggggcagcaggtctactaccccattattttcagccagtatgaccccaaggtgacaaacggagggaatccccccaccgacgactactttattttcagcaagaaaactggcttttggagagactacggctatggtattacttgtatctacaagtcagatctgctgggagcagggggcttcgatacgtctatacaaggctggggcttggaagacgttgacttgtacaataaagtaatcctgtccgggctcaggccatttcgcagccaggaggtgggtgtggtgcacatcttccatcccgtgcactgtgaccccaacttagaccctaaacagtacaagatgtgtttaggaagcaaggcctcaacgttcgcttctaccatgcaactggcggagctatggctggaaaagcatctgggagtacggtataacaggacgttatcatag

SEQ ID NO: 112067 - DNA, 2868 bp, Artificial Sequence
  Description of Artificial Sequence: Synthetic coding sequence
atgcctagcctgccagccccgcctgccccactgctcctgcttggattgctgctccttggctcacgcccagccagaggagctggacccgagccccctgtgctccccattagatccgagaaagaacctttgcccgtacggggggctgccggctgcacgtttggcggtaaggtctacgcccttgatgagacctggcacccagatctgggcgagccattcggagtgatgcgctgcgttctgtgcgcgtgcgaagctccacagtggggcaggaggactagggggcccggaagagtaagctgtaagaacattaaaccagagtgtcccactcctgcctgcgggcagccacggcagctgcccgggcactgctgccagacatgtccacaggaaagatcctcctctgaacggcagccgtccggcctgtcttttgagtatcctcgggaccctgaacatcgaagctattcagaccgtggagagccgggggctgaagaaagggctaggggcgacggccatacggacttcgtggcactcctaaccgggccacggagccaggcagtggcacgggcccgggtttcactgcttcggtcttctctgaggttctccatctcttaccgccgcctagaccggcccaccaggatccggttcagcgatagcaacggaagcgtgctatttgagcaccctgccgccccaactcaagatggtttggtctgtggcgtttggagagcagtcccaagattgagcctgcggcttctgcgagccgagcaactgcatgtagccctcgtcacactgacccatccgtccggtgaagtatggggaccactgatcagacaccgggctctggcagccgaaaccttctctgcaatcctcaccctcgaggggcccccccagcagggcgttggcggaatcaccctgctgacactttcagataccgaagattctctgcacttcctcctgctgttccgcgggctgctggaaccacgctcaggcggcttgacccaggtaccgctgaggttacagatcctccaccagggccagcttctgcgggaactgcaggcaaacgtgtcagcacaagagccaggcttcgcagaagtcctacctaacctgacagtgcaggaaatggattggctcgttctgggggaacttcaaatggccctggaatgggccggccgtccgggccttagaatctctggccacattgctgcacgaaaatcatgcgacgtactgcagtcagtgctgtgtggcgcggatgccctgattcccgtgcagaccggtgccgctgggagtgcctcactgacactgctggggaacggaagtctcatctaccaggttcaggtcgtcggaacaagctctgaagttgtagccatgacactggaaacgaaacctcaacggcgggatcaacgcactgtgttgtgtcacatggcaggcctgcagccagggggccacactgccgtgggcatatgccctggtctcggcgctcgcggagcacacatgctgttgcagaacgagctcttcctgaacgtgggcaccaaagattttccagacggagagttgaggggccatgtcgcagccctgccatattgcgggcacagcgctaggcacgacacactgcctgtcccactcgctggagccttggtcctcccccctgtgaagagccaggccgcagggcatgcatggctgagcctggacacgcactgtcacctccattatgaagtgctgctggccgggctgggtggaagtgaacaggggacggtaaccgctcacctactagggccacccggtaccccaggccctcggcggttgttgaagggattctacggcagtgaagcccagggggtggtgaaggatctggagcccgagctgctcaggcacctcgctaaggggatggcaagcctgatgatcacaaccaagggttcccctagaggtgaattgaggggtcaggtccacatcgccaatcagtgtgaagtggggggactgcgtctcgaggccgccggcgcagaaggggtgagggcattgggagctcctgatactgcctctgcagccccccccgttgtacctggactgccagccttagcacctgcaaaacccggtggcccaggccggccacgcgaccctaacacctgtttttttgagggccagcaacggccccatggcgcaaggtgggccccaaactacgaccccctctgctccctctgcacttgccagcgcagaactgtgatctgcgatcctgttgtttgtccacccccttcctgtccccaccctgtccaagctcctgatcagtgctgccccgtgtgcccagaaaagcaagacgtgcgagacctgcctgggctccctaggagcagagaccctggagagggatgctactttgatggcgaccgctcttggcgagcggcaggcacacgatggcatccagtggtcccaccttttggtttgattaaatgtgccgtttgcacatgcaaaggcgggacgggcgaggtgcattgtgaaaaagtccagtgtccgaggctggcctgcgctcagcccgtgagagtcaacccaacagactgttgtaaacagtgtcccgtgggatcaggtgcacacccccagcttggggatcctatgcaggccgacggacccagagggtgccgatttgcaggccagtggtttcctgagagccagagctggcatcccagcgtcccaccatttggcgagatgagctgcattacctgtaggtgtggcgccggggtcccacattgtgagagggacgattgctccctcccgctctcctgtggcagcggcaaggaatctcgctgctgctcccgatgcacagcgcaccgtcgacctgcccccgagactaggactgaccctgaactggagaaggaagccgaggggagctag

SEQ ID NO: 112068 - DNA, 285 bp, Artificial Sequence
  Description of Artificial Sequence: Synthetic coding sequence
atgccatcattgcctgccccaccagcgcccctgctcctcctgggcctgttactgcttggatcaaggccggctagaggggccggacctgagccacctgtgctgcccatcaggagtgaaaaagaacctctgcccgtacgtggagccgcaggatgtactttcggcggtaaggtttatgccctggacgaaacctggcatccggatttaggggagccctttggtgtcatgagatgcgtactctgtgcatgtgaagccaccggaacactaagaccacgggaaatgaagtag

SEQ ID NO: 112069 - DNA, 1512 bp, Artificial Sequence
  Description of Artificial Sequence: Synthetic coding sequence
ggtgagcacctgtcccagaaaggacctcatgtgagaccatgtcggacaaaccccgggagcttggaagctcccgactcaacacctggggcggccactgccaggacatccgggcagtgcctgtcgcccggcgagtggggctctgggagtaggtgtcacttgagctggcccttggccattgcccaccataccctgctgtgcccccaggaaccagggttcgcggaagtgctccctaatctgacagtccaggaaatggattggcttgttcttggcgagctgcagatggccttagagtgggcaggtagacccgggttgaggataagtggacacatagctgcacgcaagtcttgtgacgttctccagagtgtcctgtgcggggcagatgccctgatccccgtgcagactggagccgcaggttccgctagtttgaccttactcggaaatggaagcttgatttaccaagttcaggtggtggggacatcgagcgaggttgttgccatgacactggagaccaaaccacagcggcgggaccagaggactgtgctgtgccatatggcagggctacagcccggaggccatacagccgtcggcatctgcccaggtctcggcgccaggggcgcccacatgctgctgcagaatgagctgtttttaaacgttggcacaaaggatttcccagacggagagctaagaggacacgtcgcagcactcccgtattgcgggcactctgcgcggcatgacacccttccagttcccttggctggtgccttagtgcttccacccgtgaagtctcaagctgccggtcacgcttggctctccctggatacccattgtcaccttcactacgaagttctgttggcagggctaggcgggtctgagcagggtaccgtaaccgcgcacctgctcggccctcccggtacacctggccccagacgcctcctcaaagggttctacgggtcagaagctcagggggtggtcaaggatctagagcctgaactgctgcgccatcttgccaaggggatggcatctctgatgattaccacaaaagggtccccacggggagaactgaggggtcaggtgcacatcgcaaatcagtgcgaggtcggaggactccgtctcgaagcggctggagcggaaggcgtacgggccctgggtgcacctgatacagcaagcgctgcgccccctgtcgtgcccggcctgcccgcgctggctcctgctaagcccggaggacccggcagaccgcgggatccaaacacctgtttctttgagggccagcagagaccgcacggcgcgaggtgggccccaaactacgaccctctctgttccctttgtacatgtcagcggcggaccgtgatatgcgaccccgtcgtttgcccaccgccgtcatgcccccacccagtgcaggcccccgaccagtgctgtcccgtgtgtcccgaaaagcaagatgttcgcgacctgcctggacttccccgctcacgtgacccaggagagggaggacactggagaggagctctgtag

SEQ ID NO: 112070 - DNA, 2748 bp, Artificial Sequence
  Description of Artificial Sequence: Synthetic coding sequence
atgccttcccttcctgccccaccagctcccctgctcctactggggctgctactgctgggatctcgaccagcacgtggggccggccctgagccccccgttctgcctatcaggagtgagaaagagcccctgccagtgcggggtgccgctggctgtacattcggtgggaaagtgtatgcgttggatgaaacatggcacccggatctcggtgaaccttttggcgttatgcgctgcgtcctgtgtgcctgcgaagccccacagtggggtcgaagaacacggggaccagggagagtcagctgcaagaatatcaagcccgaatgtcctacccccgcctgcggacaacctagacagttacccggccattgttgccaaacgtgcccacaagagcggtcatccagcgagcgacaaccaagtgggctgtctttcgagtacccgagggaccccgagcataggagctattccgatcgcggagaacccggggcagaggaacgtgctcgcggcgacggccatacagactttgtagcattgctgacaggaccgcgatctcaggctgtcgctagggcgagggtgagcctgcttcggagtagcttgagattttctatcagctaccgacgccttgataggcccactcggataagattttctgattccaatggtagtgtgcttttcgaacatcctgccgctccgactcaagacggactggtgtgcggagtgtggcgggcagtgccgcgactctccctgcggctgttgagggccgagcagctgcatgttgccctagtgaccctgacccacccaagcggtgaagtttggggaccgcttattcggcaccgggccctcgccgctgaaaccttcagcgccatcctgactttggaagggcctccacagcaaggcgtcggagggattactctcctcacactcagtgacacggaagactccctgcacttcttgctgctgttcaggggcctcctcgagccccgatccggaggcctgacccaagtgcctcttcggctgcagatcttgcaccaggggcagttactccgtgagttgcaggctaatgtgtctgcccaagagcctggattcgcggaagtcttacctaacttgacagtgcaagagatggattggctggtgctaggcgaactgcagatggccctagaatgggccggaagacccgggctccggatcagtggccacattgccgccaggaagagctgtgacgtcctccaatccgtattgtgcggggccgatgcccttattcctgtgcagacgggggctgctggtagtgcctctctaacacttttaggcaatggctctctcatctatcaggctgtagggatttgccctggcctcggtgcccgtggtgctcacatgctcctccagaacgaactgttcttgaatgttggcactaaagacttcccagacggagagctaagaggacacgtcgctgcactgccctactgtggtcactcagccagacacgatactctcccagtccctctcgcaggagcactggtgctgcctcctgttaaaagtcaggccgcgggtcacgcttggctaagtctcgatacacattgtcacctgcactacgaggtgctactggctggactggggggctcggaacaaggaaccgtaactgctcacctgctaggcccccctgggaccccagggcctagacgcctacttaagggcttctatggctcagaagcccagggcgtggtaaaggatctggagcccgagctgctccgccatcttgccaagggcatggcaagcctgatgatcaccaccaagggctccccaagaggggagctgcggggtcaggtccacatcgccaaccaatgcgaagtgggcggtctgcgactggaggcagccggggccgagggcgtcagggctctaggcgctccagacaccgccagcgccgcacctccggtagttccaggacttcccgcactggctcctgccaagccaggtggacctggacgacccagggatcctaatacatgcttttttgagggccaacagcggccacatggagccagatgggctcccaattatgaccctctgtgctccctgtgtacgtgccagcgtaggactgtgatatgtgacccagtcgtgtgtcccccacctagctgccctcatccggtccaggctcctgaccagtgttgcccggtgtgtccagagaaacaagacgttagagacctccccggcctgcctaggagcagggacccgggggagggttgctacttcgatggagaccgcagctggcgcgccgctgggacccgatggcaccccgtggtaccaccatttggactgatcaagtgtgctgtttgtacctgcaaagggggtacaggcgaagtccactgcgagaaagtacagtgtcctaggttggcatgcgcccaaccagtccgcgtgaatccaaccgactgttgtaagcaatgccctgtgggatctggagcccatccgcagcttggagatcccatgcaagcggatgggccccggggatgccgatttgccggccagtggtttcccgagagccagtcttggcacccctcggtccctcccttcggcgaaatgtcctgcataacctgcagatgtggcgccggggtcccacattgcgagcgtgacgattgtagtctgccgctgtcttgcggctcagggaaagaatcccgctgctgcagtcggtgtaccgcacatcgtcggccagcccccgaaactcgcacagaccctgagctcgagaaggaggcagaggggtcgtag

SEQ ID NO: 112071 - DNA, 1494 bp, Artificial Sequence
  Description of Artificial Sequence: Synthetic coding sequence
atggactggctcgtgttgggagaactacagatggctctggaatgggctgggcgaccaggcctgaggatatcgggccacatcgccgcacgcaaatcctgtgacgttctgcaatctgtgctgtgcggcgcagatgctttgatcccagttcagactggcgccgcagggtccgctagcctcacgcttttgggcaatggcagcctcatctaccaggtccaggttgtgggaacctcatctgaagtcgtcgccatgactttggagaccaaacctcagcggagggatcagaggactgtgctgtgccacatggctggtttgcagccaggagggcacacagcagtgggaatctgccccggactgggcgctcgcggtgctcatatgctccttcagaatgagctttttctcaatgtagggacaaaagactttcccgacggagagctgcgcggccacgttgcagcattgccatactgtggacactcagcccgccatgacactctccccgtgcccctggccggagccttggtgcttccacctgtcaagagtcaggccgccgggcacgcttggctttctctggacactcattgccacctgcactacgaagttctattggcgggacttggtggatcagaacagggtactgtcactgcccatctgctcggtccccctgggactccgggaccacggcggttgcttaagggattttatggatctgaagcacagggagttgtcaaggacctcgaaccagaactcctgagacaccttgcaaagggcatggcatcgcttatgataacaacgaagggctccccacgtggcgagctgcggggccagcgaagaacagtgatttgtgaccctgtcgtctgtccgcccccatcatgcccacatcccgttcaggcccccgatcaatgctgtccagtatgcccagagaagcaggacgtgagggacctgccagggctcccgcgcagccgcgacccaggagaaggatgctactttgatggcgaccggtcctggagggcagccgggactaggtggcatcctgtagtgcccccgtttggattgatcaagtgtgcagtgtgtacctgcaaaggcggcacaggtgaggtgcactgcgaaaaagttcagtgtccaaggctagcctgtgctcaacccgtgcgagtaaacccaaccgactgctgcaagcagtgcccagtgggcagtggtgctcaccctcaactgggggatcctatgcaggcagacggacccaggggctgcaggttcgccggtcagtggtttccagaatcacagtcctggcacccgagcgttcctccatttggcgagatgagttgtattacatgccgatgtggggccggggtgccccactgtgaacgagacgactgctccttaccattatcctgtggctccgggaaagaaagcaggtgctgctcgaggtgcacggcccatcgacgtccagctccagagactaggacagatcccgagctggagaaagaagctgagggaagttag

SEQ ID NO: 112072 - DNA, 3126 bp, Artificial Sequence
  Description of Artificial Sequence: Synthetic coding sequence
atggagaacatgttccttcaaagttcgatgctgacctgcattttcctcctgattagcgggtcttgcgaattgtgcgccgaagagaacttctcaaggtcatatccttgcgacgagaagaaacagaatgacagtgttatcgctgaatgctcaaatagaaggctccaggaggttccacagactgtcgggaagtacgtgactgaactggatctctctgataattttattacccatatcacaaatgagtcattccagggattgcaaaacttgaccaagattaacctgaaccataatcctaacgtacagcatcagaatgggaatccaggcatccagagtaatggcctgaacatcacagacggcgcattcctgaacttaaagaacttgcgggaactgctacttgaggataatcagcttccccagattccatccggcctacctgaatctctgaccgaactttctctgattcagaataatatttacaacatcactaaggaggggatttctcgacttattaatcttaagaatttatatcttgcctggaactgctattttaacaaagtgtgtgaaaaaaccaatatcgaagacggagtcttcgaaaccctgactaacttggaacttctctctctgtctttcaactccctgagtcatgtgcccccgaaactcccatcctccctgagaaagctcttcctatctaatacccagatcaagtacattagtgaagaggactttaaagggctcattaacctaactctgctcgatcttagtggcaattgtccacggtgctttaatgcaccatttccttgtgtcccgtgtgacggaggagcctcaataaacattgaccgctttgcatttcaaaatctcactcagctacggtaccttaacttgagttctacaagcctgcgaaagatcaatgccgcctggttcaagaacatgccacacctgaaagtcttggatctcgagttcaattatctcgtgggcgagatcgcaagtggggccttcttgaccatgctgcctagactcgaaatcttggacctgtccttcaactacatcaaggggagctacccccagcatatcaacatctcccgtaacttctcgaaactgctctccctgcgcgctctgcacttgagaggctatgtgttccaggagctgcgggaggacgattttcaacctctcatgcagctgccgaacctgtctactattaacctgggcataaactttattaaacaaatcgatttcaagctcttccagaatttctctaacttggagattatctatctcagcgagaacaggatttctcccctggttaaggacacgagacagtcctatgccaattcatccagcttccagcgccatattcgtaagcgcagatctaccgactttgaattcgatcctcacagcaatttttatcattttaccagacctctcattaagcctcaatgcgccgcttacggaaaggcactggatctctccttgaatagtatcttttttattgggcctaaccagttcgaaaatctcccggatattgcgtgcctcaatctgtctgcaaattccaatgcacaagtactttctggtaccgagttctctgcgatcccacatgtgaagtacctggacctgaccaacaataggctggacttcgataatgcaagtgccttaactgagctgagcgacctggaagtcctcgatctctcctacaattcccactacttccggatcgctggcgttactcaccacctcgagtttatacagaattttacgaatctcaaagtactgaatttgtctcataataatatctacactctgactgacaaatataacctcgagagtaagagcctggtggagctggtattcagcggtaacaggctggacatactgtggaatgatgacgacaatagatatatatcgatattcaagggattaaaaaatctgacccgtttggacctcagtttaaatagactcaaacacatccctaacgaagcattcctgaacctgcctgcttccctgaccgaactgcacattaatgacaatatgcttaaattctttaattggaccttgcttcagcagtttccacgccttgaacttctcgatctgcgcgggaataaactcctgtttcttacggactcgttgagcgactttacctcctcgctccggacactgctgttatctcacaataggatctcacacttacctagcgggttcctgtcagaggtgtcctccctcaaacacttagatttatccagcaacttactgaagacgatcaataagagcgcgctggagactaagactaccaccaagctgagtatgctggaactccatgggaacccatttgaatgcacatgtgatatcggagactttcggcggtggatggacgagcatctaaacgttaagattcctaggctagtggatgtaatctgtgcttcaccaggcgatcaaagaggaaagtctatcgtgtctctagaattgactacctgcgtatctgatgttaccgctgtaatcctgtttttcttcacattctttattaccacaatggtaatgctggctgcccttgcacaccacctattctattgggacgtgtggttcatctacaacgtctgcctggcaaaagtgaagggctatcggtctctttcgacgtcgcagaccttctatgatgcttatatctcatacgacacaaaagatgcgagcgtgactgactgggttatcaatgaactccgataccacctggaggaaagcagagataagaacgtgcttctttgcctcgaggaaagggactgggaccccgggctcgccatcattgacaaccttatgcagtcaatcaaccagtccaagaaaactgtatttgttctgacgaagaagtacgctaagagctggaattttaagactgccttctatctcgcactgcagcggttgatggacgagaacatggacgttataatatttatactactggaacccgtccttcaacattcacagtatttgagactacgacagaggatatgtaaaagctcaatcctgcagtggccggacaaccccaaggccgaaggcctcttctggcagactctcaggaacgtcgttttgaccgaaaacgatagtcgctataacaatatgtatgtcgatagcattaaacagtactag

SEQ ID NO: 112073 - DNA, 1377 bp, Artificial Sequence
  Description of Artificial Sequence: Synthetic coding sequence
atgagaaagaagtggaagatgggggggatgaaatacatcttctctttacttttcttcctgttgctagaggggggaaagacagaacaggtcaagcactcagagacgtactgtatgtttcaagacaaaaagtaccgtgtgggtgagaggtggcacccttacctagagccatatggtctggtctactgcgtgaactgcatctgttccgagaatgggaacgttctatgcagtcgtgtcaggtgccccaacgttcattgtctgagtccagtgcacatccctcacctgtgttgtcctaggtgtccagaggattccctgccaccggttaacaacaaagtgacttctaaaagttgtgagtacaacgggaccacgtatcagcacggcgaactctttgttgccgaagggctgttccagaaccggcagcctaaccagtgtactcagtgcagctgctctgaggggaacgtgtattgcggactcaaaacatgtccgaaattgacctgtgctttccctgtttcagtcccggactcgtgttgtcgcgtctgccggggcgacggagagttgtcatgggaacatagcgacggagacatattcagacagccagcgaatcgcgaagcccggcactcttaccatcggagtcactatgatccccccccaagccggcaggcaggggggctctccagattcccaggggctaggtcccacaggggcgccctcatggattctcagcaggcaagcggaactattgtgcagatcgtgatcaataacaagcacaaacatggacaagtttgcgtgagtaatggaaagacctactcccatggcgaatcctggcaccccaatctgcgagcattcggcattgtggaatgtgtactgtgtacctgcaacgtaacaaaacaggaatgtaagaaaatacattgccctaaccggtatccttgcaaatatccacagaaaatagacgggaaatgctgtaaggtttgcccaggaaagaaagcaaaagaagagttgcctggccagtctttcgataataaggggtatttttgcggagaagaaaccatgcccgtgtacgagtccgtgtttatggaggacggggagacgaccagaaaaatcgctttggagactgaacggccgcctcaggtcgaagtacacgtctggaccatccggaaaggaatccttcaacactttcacatcgagaaaatatctaagagaatgtttgaagaattaccccacttcaaattagtaactcggacaaccctgtctcagtggaaaattttcactgaaggcgaggcccagatcagtcagatgtgtagcagccgcgtctgtagaactgaactagaggatttggtcaaggttctgtacctggagcggtcggagaagggccactgctag

SEQ ID NO: 112074 - DNA, 1353 bp, Artificial Sequence
  Description of Artificial Sequence: Synthetic coding sequence
atgggagggatgaagtatattttcagcctgctgttcttcctgctgctagaagggggcaagacagagcaggtcaaacacagcgaaacatattgtatgttccaggacaagaagtatagggtaggggagcggtggcacccttatctggagccatatggcctcgtttattgtgtgaattgcatttgtagcgagaatggcaatgtcctatgcagcagagtgcgctgtcctaatgtgcattgcttaagccctgtccatatcccccacctgtgttgccctcgctgcccagattctcttccgccagtcaacaataaagtgacttcaaaatcgtgcgaatacaatggcactacctaccagcatggggaactgtttgtagctgagggcctgttccagaatcgccagcctaaccaatgtacccagtgctcctgcagcgaggggaacgtgtattgtgggctgaaaacgtgccccaaacttacctgcgctttccccgtgtcagttcctgactcttgctgccgggtgtgccggggggacggcgaattatcatgggagcactccgacggcgacatctttaggcagcccgctaaccgggaagcccgccattcctatcaccgaagccattacgatccgcctccttcacgacaggccggcgggctgtcgcgcttccccggagccagaagccatcgaggcgccctcatggacagtcagcaagccagtggaacgatagtacaaattgtgatcaataataagcacaagcacggacaggtttgtgtgagtaatggaaaaacttattcacatggcgaaagttggcacccgaatcttagagcctttggtattgtggagtgtgtgctgtgcacgtgtaatgtgactaaacaggagtgcaaaaaaatacactgtccaaatcgctacccctgcaaatacccccagaagatagacggaaagtgctgcaaagtatgtcccgggaagaaggccaaagagctccctgggcagtccttcgacaataaaggctacttttgcggggaggaaaccatgcccgtgtatgaaagcgtttttatggaggacggtgaaaccacgaggaaaattgctctggaaactgagaggcctcctcaggtagaggtccatgtctggactattagaaaaggcattctgcagcactttcacatagagaagatctcaaaacggatgttcgaagaactgccccatttcaagcttgtgaccagaaccacactttcacagtggaagatcttcaccgagggggaggcacaaatctcccagatgtgctcctcccgggtatgccgtactgaactggaggatctcgtgaaagtactttatcttgagaggagtgagaagggacactgttag

SEQ ID NO: 112075 - DNA, 1371 bp, Artificial Sequence
  Description of Artificial Sequence: Synthetic coding sequence
atgagaaaaaagtggaagatgggaggcatgaagtatatatttagcctgttattcttcctccttcttgagggcggaaagaccgagcaagttaaacattccgagacatactgcatgttccaggataaaaagtatagagtgggcgagaggtggcatccttacttggagccatacggcttagtgtactgtgtgaattgtatctgttccgagaatggcaacgtgctgtgcagtcgtgtgcgctgtccaaacgttcactgcctcagccctgtacatatccctcatttgtgctgcccacgatgcccagattcacttccacctgtgaataataaagtcacgagcaaaagctgtgagtacaacggaactacataccaacacggagaactgttcgtggcagagggcctctttcagaaccgtcagccaaaccaatgtacccagtgctcatgctctgagggcaacgtgtactgcggtctgaaaacatgcccaaaactaacttgcgcttttcctgtttcagtccccgattcatgctgccgagtgtgccgcggggacggcgagttatcttgggagcattcggacggcgacatattcaggcagccagccaatcgggaagcgagacactcgtatcatcgcagccactatgaccctcctccttctcgacaggccggaggcctgtcccgctttcctggagctcggagtcaccgaggggctctgatggacagtcaacaggcctccggcacaatcgtacagattgtcataaataacaaacataagcacgggcaggtttgcgtctctaatgggaaaacgtatagccatggagaaagctggcatcctaacctgcgggccttcgggatagtggagtgcgtgctctgtacctgcaacgtgacaaaacaggagtgtaaaaagattcattgccccaacagatatccctgcaagtatcctcagaaaattgacggtaaatgttgtaaggtttgccccgggaagaaggctaaagagctgcccggacagtcctttgacaacaaggggtacttttgcggcgaagagaccatgccagtgtacgaatcagtgttcatggaggacggggagaccacgcggaaaatagccttagagaccgagcggccgccacaggtggaggtccacgtgtggacaatcaggaaaggcatcctccagcacttccatatcgagaagatttctaagaggatgttcgaagaacttcctcattttaagctcgtgacacgcactacccttagccaatggaagatattcactgaaggtgaagcacagataagccagatgtgctcttccagggtttgccgtaccgagctggaggacttggtgaaagtcctgtacttagaacggtccgagaaaggccactgttag

SEQ ID NO: 112076 - DNA, 1134 bp, Artificial Sequence
  Description of Artificial Sequence: Synthetic coding sequence
atgaggaagaagtggaaaatgggtggcatgaaatatatcttctccctgctgttttttctgctgctcgaaggtggcaagaccgaacaagtgaaacactctgaaacgtactgtatgttccaggataagaaatatagagtcggagagcgctggcacccgtatctggaaccctacggactggtttattgtgtcaactgtatctgttccgaaaacgggaacgtgctttgctcaagggtgagatgtccaaatgtccactgtctgagccccgtgcacatcccccacttatgctgtcccaggtgtcctggtgacggggaactgagttgggagcactctgacggtgatatcttcagacagccagccaatcgggaggcccgacacagctaccaccggagccactatgatccacctccatcgcgacaggcaggtggcctttccagattcccgggcgcccggagccaccgcggcgccctgatggattctcagcaggcctcaggcaccatcgtccagattgttatcaacaataaacacaaacacgggcaggtgtgtgtaagtaatggaaagacctattctcacggggaaagttggcacccaaatttgcgcgcgttcggaattgtggagtgtgtcctgtgtacttgtaacgtcaccaaacaggaatgtaaaaaaatacattgccccaaccggtatccctgcaagtacccccagaagatcgacggcaaatgttgcaaagtctgccctggcaagaaggccaaggaactccctggtcagtctttcgataataaaggctacttctgtggcgaggagacaatgccagtttatgaatcagtgtttatggaagacggagagaccactcggaaaatcgcacttgagacagagaggcctcctcaggtggaggtgcatgtgtggacaatcaggaagggtattctgcagcattttcacatcgaaaaaatcagtaagcggatgttcgaagagttaccacactttaaactggtaacacgcacgactttgtctcaatggaaaatttttacggaaggagaggctcaaatctctcaaatgtgttctagcagggtgtgcagaacagaattagaggatctcgttaaggtgctgtatctggaacgcagtgagaagggtcattgctag

SEQ ID NO: 112077 - DNA, 1374 bp, Artificial Sequence
  Description of Artificial Sequence: Synthetic coding sequence
atgcgcaagaagtggaaaatgggaggaatgaagtatatcttcagcctgctgtttttccttcttctggaaggagggaagacagaacaggtaaaacattccgaaacctactgcatgtttcaagataaaaaatatcgggtcggggagcgctggcacccttacctggagccttacgggctggtgtattgtgtcaactgtatatgttctgagaatgggaacgtgctgtgcagcagggtgcgatgtccaaatgtgcactgtctcagcccggtgcatatccctcatctatgctgtcccagatgcccagactccttaccgccggtcaacaataaggtgacatccaagtcatgcgagtataatgggacgacttatcaacatggtgagctgttcgttgctgagggattgtttcaaaatcgacagccgaaccaatgtacacaatgctcttgttcggaaggtaatgtatactgtgggctcaaaacctgtcccaaacttacatgcgcgtttcctgtgtcagtccctgactcgtgttgccgggtgtgccgtggagacggagaactgtcatgggagcacagcgacggcgacatattccggcagcccgccaatagggaagcacgtcactcataccacagaagtcattacgacccaccaccttcacgtcaggcagggggtctgtcaaggttcccaggcgcacggtcccatagaggcgcccttatggacagtcagcaggcctccggaactattgtccagatcgtgatcaataataagcacaaacacggacaagtttgtgtgtccaatggaaagacgtattcccacggagagagctggcaccccaatcttagggcctttgggattgtcgagtgtgtactttgcacctgcaacgtgacaaagcaagagtgtaagaaaatccattgtccaaacaggtatccatgtaagtatcctcagaaaattgatggcaagtgttgtaaggtgtgtccaggcaagaaagcaaaggaagagttgccaggtcaatctttcgataacaagggatacttttgtggtgaggaaaccatgccagtatacgagtccgtatttatggaagatggagaaactacacgcaaaatcgcccttgaaactgaacgcccccctcaggtcgaagttcacgtgtggaccatcagaaagggcatcctgcagcatttccacattgagaagatcagcaagcgtatgtttgaagagttgcctcactttaagttggttacacgcaccaccctaagtcagtggaaaatctttacagaaggagaagctcaaatctcccagatgtgtagcagcagagtgtgtcggacggagctagaagatttagttaaggtgctttacctcgagcggagtgagaaaggacactgttag

SEQ ID NO: 112078 - DNA, 1137 bp, Artificial Sequence
  Description of Artificial Sequence: Synthetic coding sequence
atgcgtaaaaagtggaagatgggaggcatgaagtacatattttctctcctgttctttttattgctcgaaggaggaaagactgagcaagtgaagcactccgaaacttattgcatgtttcaggataagaaatatagggtcggggagaggtggcatccatacctcgaaccttacgggctggtatattgtgttaactgcatttgcagtgaaaacgggaacgttctttgttccagggtgaggtgccccaatgttcactgtctgagtcctgtccacatccctcacctgtgttgtccacgatgtcctggagatggggagctgtcatgggagcactctgacggggatatttttcgtcagccagccaatagagaggcccgccattcctaccatagatctcattacgacccacctcccagtcggcaggcaggcggactttccagatttcccggcgcaaggtctcaccgcggggcgttgatggactctcagcaagccagcgggacgattgtccaaatcgttatcaataataaacacaaacatggacaggtatgcgtaagcaatggtaagacatactcccacggcgagtcttggcaccctaatcttcgcgcctttggaattgtagaatgcgtgttgtgcacctgtaacgttacgaaacaggagtgcaagaaaatacattgtcctaaccggtacccttgcaagtacccccagaaaattgacgggaaatgctgtaaggtgtgcccggggaagaaagccaaagaggaactgccggggcagagcttcgacaacaaggggtacttctgtggtgaggagacgatgcctgtgtatgaatcagtctttatggaagacggcgagactaccaggaagatagctctcgagaccgaacggcccccccaggtggaggttcatgtatggacgattaggaaggggatacttcaacacttccatattgagaaaatctctaagcgtatgtttgaagagctcccacatttcaagttggtgacacgcacgaccctttctcagtggaagatctttacagaaggcgaggctcaaatatcccagatgtgcagctcaagagtgtgtcgcactgagttagaggatctcgtaaaggttctgtacctggagcggtcagagaaggggcattgctag

SEQ ID NO: 112079 - DNA, 1356 bp, Artificial Sequence
  Description of Artificial Sequence: Synthetic coding sequence
atggtccctgaggtgcgtgttcttagtagcctcctgggtctggcactgttgtggtttccactggattcccatgctcgggcacgaccagacatgttttgcctgttccatggtaagagatattctccgggtgagagctggcacccctacctcgagccccaaggcctgatgtactgcctgaggtgcacatgctcagaaggcgcccatgtctcttgctacaggctccattgccctcccgtgcactgccctcaacccgtcacagagccccagcaatgttgtccgaagtgtgttgagccgcacaccccttcgggtctgcgcgctccaccaaagtcatgtcagcacaacggaaccatgtatcagcatggcgagatcttctctgcccatgagctcttcccaagccggctgccaaaccaatgtgtattgtgttcttgtacggagggccagatctactgtggattgactacctgtcccgaacctggctgcccagcccctttgcctctgcctgatagctgctgccaggcctgcaaggacgaggcaagtgagcaaagtgatgaagaggatagtgtgcaatccctgcacggagtccggcacccacaagatccatgctcaagtgacgccgggagaaaacggggtcctggcactcctgctcccaccggactgtctgcaccactaagctttattcccaggcacttcagacctaagggagccgggagcaccaccgtcaagattgtcttgaaggagaagcataaaaaagcctgcgtgcacggaggaaagacctattcacacggagaggtgtggcatccagcatttagggcttttggccctctgccctgtattctctgtacatgcgaagacggtcgtcaagactgtcaacgcgtgacctgccctacggagtacccatgtcggcatccagagaaggtagctgggaaatgttgtaagatttgccctgaagacaaggccgatcccggccacagcgaaattagcagcacccgctgtcctaaggcacccggaagggttctcgtacacacctcagtgtcgcccagcccagacaacttgcgcaggttcgctctcgaacatgaagcctccgatctggtcgagatctatctgtggaagctggtaaaagacgaggaaacagaagcccaaaggggggaggtccccggaccccggcctcattcacaaaatttacccctggactcagatcaagaatcgcaagaggcacgcctgccagagcgggggaccgctctgccaacagcccggtggcccccccggcgcagcctcgagcgtctgccatcccccgatccaggcgcggagggacacggccagagccgccagtctgatcaggatatcaccaaaacctag

SEQ ID NO: 112080 - DNA, 846 bp, Artificial Sequence
  Description of Artificial Sequence: Synthetic coding sequence
atgtaccaacacggggagatcttctctgcccacgaactgtttccttccaggctgccgaatcagtgtgtgctctgctcctgtaccgaggggcagatatattgtggcctgaccacatgtcccgaacctggctgccctgcaccattgcctctaccggactcttgttgccaggcctgcaaggctggaagctcttggggacttttgtgtagtgtgagtgactttcaccccagctgccatctgcaacgtcatccccaggacccttgctcaagtgacgctgggagaaagcgcgggcccggcactcccgcccctacagggctcagcgcacctctgagtttcatcccaagacactttagaccaaagggggcaggctctaccaccgtgaagattgtgctgaaggagaaacataagaaagcttgcgtgcacgggggcaagacttatagccatggagaggtgtggcatccagcttttagagcgttcgggcctttgccttgcattctgtgtacatgtgaagacggccgccaggactgccaaagagtaacttgcccaaccgaatatccatgccgccatccagagaaagtcgcggggaaatgttgtaagatctgccccgaggacaaagcagatccagggcactccgaaattagctctacccggtgtcccaaagcaccgggtagggtccttgtacatacctctgtcagcccctctcctgacaatctgcggcgcttcgctctggaacatgaggccagtgatttggtcgaaatctacctgtggaaactggtaaaaggagtgtttttagctcagaccctcgagctgaaagtgaccgcgtcccccgataaagtcaccaaaacctag

SEQ ID NO: 112081 - DNA, 1290 bp, Artificial Sequence
  Description of Artificial Sequence: Synthetic coding sequence
atggtcccggaggtgcgggttctgagcagcctacttggcctcgcactgttgtggtttccactcgactcccatgcgagggccagacctgacatgttttgtctgttccacgggaaacgctacagcccaggcgagtcgtggcatccatacctggagccacagggcctgatgtactgtcttcgatgtacctgttctgagggagctcacgtgtcttgctataggttacactgtcctcctgtgcactgcccacagccggtgaccgagcctcagcaatgctgccccaagtgtgtggaaccccacacgccaagcggcctgagggccccgcccaagagctgtcagcataatggcacaatgtatcagcatggtgaaatctttagtgctcacgaattgttccctagcaggctcccgaaccagtgcgttttgtgtagctgtactgaggggcagatctattgcggcctcaccacgtgtccagagcctggttgcccagccccactgcccctgccagacagttgctgtcaggcttgcaaggatgaagccagtgaacagtccgacgaggaggattctgtgcaatcactccatggcgtgcgccatccccaggacccttgttcctcagacgcgggtcggaaacgcgggcccggaactcctgcgccaacggggttgtcggcgcctctgtctttcatacccaggcatttccggccaaagggggctggaagtaccaccgtgaaaattgttctgaaggagaagcacaagaaggcctgcgtgcacggcggtaagacctactctcacggggaggtgtggcaccccgcgttccgggctttcggcccactcccatgcatcctgtgcacctgcgaagatggacgacaagactgccaaagggtcacgtgcccgactgagtatccatgccgccaccccgaaaaggtcgcaggcaagtgctgcaagatttgcccagaagataaagccgatcccggtcacagcgaaatttcctctactaggtgccccaaggcgcccggcagagtgttggtgcatacctctgttagcccttcccccgacaacctaaggaggttcgcactggagcacgaggccagtgatctcgttgagatttacctgtggaagctcgtcaagggaatctttcatctgactcagatcaaaaaagttaggaagcaggacttccagaaagaggcccaacactttaggctgcttgccggacctcatgagggccactggaatgtgttcttagcccagactctcgagttgaaggtcaccgccagccccgacaaggtgaccaagacctag

SEQ ID NO: 112082 - DNA, 840 bp, Artificial Sequence
  Description of Artificial Sequence: Synthetic coding sequence
atgtaccagcacggcgagatcttctctgctcacgagctcttccccagccgacttcccaaccagtgcgttctctgctcatgtaccgagggccagatttactgcgggctcacaacctgtccggaaccaggttgtcccgcacctcttcctctgcctgacagctgctgtcaggcctgcaaagacgaggccagtgaacagagtgatgaagaagactctgtgcaaagcctccacggcgtccgccatccacaagacccctgctcatccgatgccggccgaaagcgcggccccggcacccccgccccaacggggctaagcgcccctctgagttttatccctcgccacttcagaccaaagggcgccggctcaaccaccgtgaagatcgtccttaaagagaagcataaaaaagcctgtgttcacgggggcaagacttacagccacggagaggtttggcatcccgccttcagggctttcggccctttgccatgcattctctgtacatgtgaagacgggcgccaggattgtcagcgtgttacatgtccaacagaatacccctgccgtcaccctgagaaagtggcaggaaagtgctgcaagatctgtccagaggataaggccgatccagggcactctgagattagctccacccgctgtcccaaggcacctggacgggtgctggtgcacaccagcgtgtctcccagccctgacaatctccggaggtttgcgctggagcacgaagctagtgatctggttgaaatttacctgtggaaactggtcaaggatgtgttcctggcccaaaccttggagctgaaggtcactgccagccccgataaagtgacgaaaacatag

SEQ ID NO: 112083 - DNA, 498 bp, Artificial Sequence
  Description of Artificial Sequence: Synthetic coding sequence
atggaaatgtttcagggcctcctgttgttactgttactcagcatgggtggcacttgggcctctaaggagcccctgcggccgaggtgccggcctatcaatgctaccctggcagttgagaaggagggctgccctgtctgcatcaccgttaataccaccatctgcgccgggtattgcccaaccatgaccagagttttgcagggcgtcttgccagcgctcccacaggtggtctgcaactaccgggacgtacgcttcgaatccatcaggctgcccggctgtccccggggtgttaacccagttgtgtcatacgccgtggcactttcttgtcagtgcgctctttgcaggaggtcaactaccgattgtgggggaccaaaagatcaccctttgacttgtgacgatcccagattccaggactcttcctccagtaaagctcctccaccttctttgccttctccttctcggctacctgggccttcggatacgcccattctaccccagtag

SEQ ID NO: 112084 - DNA, 507 bp, Artificial Sequence
  Description of Artificial Sequence: Synthetic coding sequence
gctccgcggatggagatgttccaaggactgctgctgttgctcctcctgagtatgggcggtacctgggcatcgaaagagccccttcgacccaggtgccggcctattaatgccactttggcagtagagaaggagggatgtccggtgtgcattacagtgaacaccacaatctgcgcagggtactgtcccacaatgacccgggtgctccagggcgttttgcccgcactgccccaggtggtatgcaattacagggatgtcaggtttgagtcaattcgactcccaggatgtccccgtggcgtgaatcctgttgtttcctatgcagtcgccctttcctgtcaatgcgccctgtgtcggagaagcacaacagactgtggtggacccaaggatcacccgttaacatgcgacgatccgaggtttcaggactcatcttcgtccaaggcgcctcccccatccctcccgtctccctcaaggctgccaggtccttcggacacccctatactgccacagtag

SEQ ID NO: 112085 - DNA, 654 bp, Artificial Sequence
  Description of Artificial Sequence: Synthetic coding sequence
atggcgcctggtagccggacctcactgcttttggcctttgcgctactgtgcctcccctggctgcaggaggctggagcagtacagactgtacctttatcgaggctgtttgatcacgccatgctgcaggcccacagagcccaccagctggcaattgacacctaccaggagtttgaagagacttatatccccaaagatcagaaatacagctttctgcacgatagccaaacgtctttttgcttttccgacagcatcccgaccccctctaatatggaggaaacccagcagaaatcaaacctggaacttctgagaatcagtctgctgcttattgaaagttggttggagccagtccggttcctgagatctatgttcgccaacaacctggtatacgatacgtctgacagtgacgattatcatcttctcaaggatctggaagaaggcatccagacgttgatgggaagacttgaagacggatcccgtcgcaccggtcagattctgaagcagacgtacagtaaatttgacaccaacagccacaatcatgatgctctgctgaaaaattacggcctgctgtactgctttaggaaagacatggacaaagtagaaacttttctcaggatggtccagtgtagatcagttgagggttcctgtgggttttag

SEQ ID NO: 112086 - DNA, 771 bp, Artificial Sequence
  Description of Artificial Sequence: Synthetic coding sequence
atggccccagggtccagaacttctttgctgttggcattcgctctgctctgtctgccgtggcttcaggaagctggagctgtgcagacggtccccctttcccgtcttttcgatcacgccatgctccaggctcacagagctcaccaattggctatcgacacgtaccaggagttcgaggaaacgtacatcccaaaggaccaaaagtactctttcctgcatgacagtcagacttccttttgtttctccgattccatccctacgccttccaacatggaggaaacacagcagaagagcaatctcgagctgctaaggattagtctcttactcattgaatcttggctggaacccgtccggtttctgcggtctatgttcgcaaacaacctggtgtacgatacatccgactcagacgactatcacctactgaaggatctcgaggaaggtattcagacacttatgggagtacgcgttgctcccggagtgaccaatccgggaacgcccctcgcctccagagccgggggggagaaatactgctgccccctgtttagctcaaaagccctgacacaggagaacagtccttattcatccttccggttggtcaatccacccggcctcagcctccacccagaaggagagggcggtaaatggataaatgagcgcggacgcgagcagtgtccttccgcctggccgctgctcctgtttcttcacttcgccgaggctgggaggaggcaaccccccgactgggccgacccacaggcagacttgcagcaggtctag

SEQ ID NO: 112087 - DNA, 369 bp, Artificial Sequence
  Description of Artificial Sequence: Synthetic coding sequence
atggcccctggaagcagaacttccctgctcctggcctttgcactgctgtgcctcccatggctgcaagaagccggcgccgttcagacggtgcccctttcacggctcttcgaccacgccatgctccaggcccaccgtgcgcatcagctggccattgatacctaccaggaatttcgccttgaggacggctcccgacggacgggtcaaattctaaaacagacatattccaagttcgatacgaattcacataatcatgacgccttgctgaagaattacggtctgctctattgcttcagaaaagacatggacaaggtggaaacgttcctcagaatggtacagtgcagaagtgtggagggctcttgcggcttttag

SEQ ID NO: 112088 - DNA, 552 bp, Artificial Sequence
  Description of Artificial Sequence: Synthetic coding sequence
atggcccccggcagccgcacatcattgctccttgccttcgctctgctttgcctgccatggttacaggaggcagaaacatatattcctaaagatcagaaatactccttcctccatgattctcagaccagcttttgttttagcgatagcattccaacccctagcaatatggaggagactcagcagaagagcaaccttgaacttcttcgcatttctctcctacttattgaatcctggcttgaacccgtgcgttttctcaggagcatgttcgctaataatcttgtatatgacacctccgattccgacgactaccacctcctcaaagacctggaagaggggattcaaacgctcatgggtcgcttggaagacggctcaaggcgcacaggtcaaatcttgaaacagacctactccaagttcgatactaatagccacaatcatgacgccttattaaagaattacgggctgctgtattgttttcgaaaggatatggacaaggtcgagacgtttctgcgcatggtccagtgtaggtcggtagaggggtcttgtggattctag

SEQ ID NO: 112089 - DNA, 504 bp, Artificial Sequence
  Description of Artificial Sequence: Synthetic coding sequence
atggccgcaggttccagaacctccctgctgcttgcgttcgccctgttgtgtctcccatggcttcaagaagccggggccgtccaaaccgttcctctgtcgagactgttcgaccatgctatgctgcaggcccatcgagcgcatcagctggccatcgacacctaccaggagtttgaggagacctacattcccaaagaccagaaatactcgtttctgcacgattcacagacctcgttctgcttttctgattcaatacctaccccctctaatatggaggaaacccaacagaagtccaatctggaattattgagaatttctctgctacttattgagagctggctcgaaccagtccggttcctgcggagcatgttcgccaacaacttagtgtacgacacatctgacagtgatgactatcatttgctcaaagaccttgaggagggaatccaaaccctgatgggcgttagagttgcgcccggagtggccaatcctggcaccccccttgcctag

SEQ ID NO: 112090 - DNA, 369 bp, Artificial Sequence
  Description of Artificial Sequence: Synthetic coding sequence
atggccgctggttccaggacctcattacttctggctttcgccttgctttgcctgccctggctgcaggaggcaggagctgtgcagacagtccccctcagtaggctgtttgatcatgctatgctgcaggctcaccgcgctcatcagctagccatcgacacataccaagaattcaggctagaagacgggtcaagaagaactggtcagattctcaaacagacctatagtaagtttgacactaactcacacaaccatgacgccctgttgaagaactacggacttctttactgcttcagaaaggatatggacaaggtggaaacattcctccgaatggttcagtgccgcagcgtcgagggatcttgtgggttttag

SEQ ID NO: 112091 - DNA, 654 bp, Artificial Sequence
  Description of Artificial Sequence: Synthetic coding sequence
atggctgctggtagtcgcacatcactgctgttagcatttgctctgttgtgtttgccttggcttcaagaagccggagccgtgcagaccgtgccgctgagtagattgttcgaccatgcaatgctccaggctcatagagcccatcagttggccattgatacatatcaggaattcgaagagacttatattccaaaggaccagaagtatagcttccttcacgacagccagactagcttctgcttctcggattctattcctacaccaagcaatatggaggaaacacagcagaaaagtaaccttgagctgctccggatctctcttctgctcattgagtcgtggctagagccagtcaggttcctgcggagtatgttcgctaacaacctcgtgtatgatacctcagatagtgatgattatcacctgttaaaggatctcgaagagggcatacagacactcatgggtcggctggaagacggatcgcgcaggaccggccaaatcctgaagcagacctactccaaatttgatactaactcccacaaccacgacgctctgctgaagaactacggcctcttatattgctttcgtaaagatatggacaaggtggagacatttctacggatggtgcagtgtcgttcagtggaaggctcctgcggattttag

SEQ ID NO: 112092 - DNA, 483 bp, Artificial Sequence
  Description of Artificial Sequence: Synthetic coding sequence
atggctgctggcagccggacttctctgctcctggcattcgcactcttgtgcctgccttggttacaggaggccgactcaataccaaccccctctaatatggaagaaactcagcaaaagtccaacttggaactcctcaggatctctcttcttcttattgaatcatggttggaacccgtccgctttctccggtcgatgtttgcgaataacctagtttacgacaccagtgacagcgatgactatcatttgttgaaggatttagaggaaggcatccaaacgctgatggggcgcttggaagacggctcccgaaggaccgggcaaatacttaaacagacttactctaaatttgatacgaactctcataatcacgacgccctgcttaaaaactatgggctgctgtattgtttccgaaaggatatggataaggtggaaactttcctgaggatggtgcagtgtcgcagtgtcgaagggagctgtggattctag

SEQ ID NO: 112093 - DNA, 498 bp, Artificial Sequence
  Description of Artificial Sequence: Synthetic coding sequence
tgaggcagccgcacatcactgctcctggcattcgctctgttgtgcctgccttggttacaggaggccggagcggtacagactgtccccctgtcacgtttgtttgaccatgcgatgctgcaggctcaccgggcgcaccagctcgccatagacacataccaggagttcgaggaaacatacattccgaaggatcaaaagtacagcttcttgcatgacagccagacctcattttgttttagtgactcgatcccaacccccagtaacatggaggaaactcagcagaagtcaaacttggagctgcttaggatcagcctcctgctcattgaatcttggcttgagccagtacgtttcctccgcagcatgttcgcaaacaatttggtgtacgatacctccgattccgatgactatcacctccttaaagatctggaagagggcattcagactctgatgggagtcagagtcgcgcctggagttgctaaccctggaaccccactggcctag

SEQ ID NO: 112094 - DNA, 669 bp, Artificial Sequence
  Description of Artificial Sequence: Synthetic coding sequence
atggccgccggatccaggaccagccttctcttggcgttcgccctgctgtgtctgccatggcttcaggaggccggggctgttcagaccgttcctctgtccagattgttcaaagaagcaatgctccaggcacacagggctcaccaactagccatcgacacctaccaggagttcattagcagctgggggatggaagcatatattaccaaggagcagaaatattcattcctacacgatagtcagacatctttttgcttttcagattctatcccgacgtcctctaacatggaggaaacccagcaaaagtcaaatctggagcttctgcatatatccttactgctgattgaaagtcggttggaacctgtcaggttcctgagaagcacttttacaaacaacctcgtgtatgatacaagcgattcagatgattatcacctcctgaaagatctggaagaaggaatacagatgctcatggggaggctcgaagatggctcccacctgaccgggcaaacactaaagcagacctacagtaagttcgacacgaatagccacaaccatgacgccctcttgaagaactacggattgctgcactgtttccggaaagatatggacaaagtggagacatttttgaggatggtgcaatgcagatctgtcgagggctcatgcggcttttag

SEQ ID NO: 112095 - DNA, 387 bp, Artificial Sequence
  Description of Artificial Sequence: Synthetic coding sequence
atggaggaaacacagcagaagtctaatctcgagttgcttcacatttccctgctattgattgagagccggctcgaacccgtgagattcctgcgcagcacctttactaataatcttgtatacgatacctcagactctgacgactatcatctgctgaaggatttagaggagggaattcagatgcttatgggccgcttagaggacggttcacatcttaccggccagacacttaaacagacctacagcaagttcgataccaacagtcacaaccacgatgctctgctaaaaaattacggcctactgcactgttttcggaaggacatggataaggtagaaaccttcctcagaatggtacaatgcagatcggtcgaggggtcatgtggattctag

SEQ ID NO: 112096 - DNA, 522 bp, Artificial Sequence
  Description of Artificial Sequence: Synthetic coding sequence
atggccaccggctcacggacctctctgctgctagcatttgcgttattatgtctcccatggctccaggaagccggcgcggtgcagacagtgcccttgtctaggctctttaaggaagctatgcttcaggcccatcgagcccaccagctggcaattgatacctaccaggagtttatctcctcttgggggatgggggcaggacaaggctggcaagagggtgtgactttcccacattggggttctaatggaaggagattacggtctagcgggctgttctctgaggcaaagatgcaagccgatgagcaccgcctgagccaggtcccacgacgtgtcactgtcggtgccggcctgcagcacagaaagcagtggagctttctggttggcggtccctcacctcgcaagaaacctatttcccagagaaatcggtcaatccattcttgtatgacgccacggcccccctcagctagccagactctgttccggcatccaccgacctggcggaagaggtctcgaaacccgacctag

SEQ ID NO: 112097 - DNA, 420 bp, Artificial Sequence
  Description of Artificial Sequence: Synthetic coding sequence
atggcagctgattccatcccaactagcagcaacatggaggaaacccagcagaagtctaatctggaactactccacatctcactgttgctgatcgaatcaaggctggagcctgtgcggttcctaagaagcacttttactaataatctagtgtacgacacctctgactcagatgactaccaccttcttaaggatctagaggaaggtatacagatgcttatgggaagattagaggacggatcccacctgactgggcagactctgaagcaaacatactcaaagtttgacacaaacagtcacaatcatgacgcattactgaagaactacgggttacttcattgtttcagaaaggatatggacaaggtggaaaccttccttaggatggttcagtgcaggtccgtggagggaagttgcggcttctag

SEQ ID NO: 112098 - DNA, 1962 bp, Artificial Sequence
  Description of Artificial Sequence: Synthetic coding sequence
atggcggacactctccccagcgagttcgatgtgatcgttattggcaccggactccctgagtctattattgccgcggcatgtagtcggtcaggccggcgcgtgcttcatgtggattcaagaagctactacgggggcaactgggcgtcgttctcattctccggtttgctttcttggctcaaagaatatcaggagaattctgacattgtgtcagacagccccgtgtggcaagaccagattctcgaaaacgaagaggccatcgcactgtccagaaaagataagacaattcagcacgtagaagtcttttgttacgcttcacaggaccttcacgaagacgtggaagaagctggtgcccttcagaagaaccatgccttagtgacaagtgccaactcaacagaagcagcagacagtgcattcctgccaaccgaggatgaaagcctgtcgaccatgagttgcgagatgctgactgaacagactccgtcaagcgatccagaaaatgccctcgaagtgaatggagcggaggtgaccggcgaaaaggagaaccattgtgatgataagacatgtgtcccatccacaagcgctgaagacatgtcagaaaacgtccccatcgctgaggataccactgagcagcccaagaagaataggattacctacagtcagatcataaaggaaggaaggcgctttaatattgaccttgtctcaaaactgctgtattcacgagggttgctgattgatctcctgatcaaaagcaatgtgtctagatatgccgagttcaaaaacattacccgaattctggcctttagggaaggcagggtagagcaagtgccatgttcacgagcagatgtgtttaattccaagcaactgactatggtggaaaagcggatgcttatgaagttcttgaccttctgcatggagtatgaaaagtacccagatgagtacaaaggctatgaggaaatcactttctatgaatacctaaaaacacaaaagctaacccctaaccttcaatacatcgtgatgcatagtattgcgatgacgagcgagaccgcctcaagcactattgatgggctgaaagccactaagaacttcctccattgtcttggcaggtatggcaatactccgttcttatttcctctgtacggccagggagagctccctcagtgcttctgtcgaatgtgcgccgtcttcggaggcatctactgcctaaggcattccgttcagtgcctcgtagtggacaaagagagtcgaaaatgtaaagctatcatcgaccaattcggacagcgtatcatctccgaacactttttggtggaggactcttattttccagagaatatgtgctcgcgagtccagtacagacaaatttcccgtgcagtccttattactgatcggagcgtcctaaaaaccgactctgaccagcagatatctattctgaccgtgccggcagaagagcccggaacatttgccgtgcgcgttatcgaactatgctcctccactatgacatgcatgaaaggaacctatctcgtgcacctcacctgcacttcttccaagaccgcccgcgaagatttggaatcagtcgtgcaaaagcttttcgtgccatacacagagatggaaattgagaacgagcaggtcgagaaacctcgaattctgtgggccctgtacttcaatatgcgggactcctcagatatctcaagaagttgttacaacgatctgccaagtaatgtttacgtgtgttctggaccagactgcgggctgggaaacgataacgcagtgaaacaagctgaaacactctttcaggaaatatgccctaacgaagatttctgccctcccccacccaacccggaggatatcattctggatggggattccctccaaccagaagcctcagaatcatctgctatccccgaagccaattcagaaacgtttaaagaatccaccaatcttggaaatctggaagagtccagcgaatag

SEQ ID NO: 112099 - DNA, 333 bp, Artificial Sequence
  Description of Artificial Sequence: Synthetic coding sequence
atggcagacacactgccttcagaatttgatgtgattgttataggtaccggcctacctgaatcgattatcgccgccgcttgcagtcgatccggcaggagagtcctgcacgtggatagcagatcctattacggcggcaactgggcctcctttagcttctcaggtctgctttcctggctcaaggagtaccaggaaaactcagatattgtttccgacagcccagtgtggcaggatcaaattctagaaaatgaggaagcaatcgctctgtctaggaaggataagaccattcagcacgtggaagtgttctgctacgcccgctctacccttctgctctag

SEQ ID NO: 112100 - DNA, 1518 bp, Artificial Sequence
  Description of Artificial Sequence: Synthetic coding sequence
atgtcgtgtgaaatgctgactgagcagactccatctagcgatcccgaaaatgctctggaggtaaatggcgcagaggtcaccggggagaaggagaaccattgcgacgacaagacctgcgtgccgtcaacaagcgctgaagatatgtctgaaaacgtacccattgccgaggacaccaccgaacaaccaaagaaaaatcggattacatacagccagatcatcaaagaagggcggcgctttaatattgaccttgttagtaaactcctgtactcccgcggtctgctcatcgacctgttaataaagagcaacgtcagtcgttacgccgagtttaagaacatcactagaattcttgctttcagagagggacgcgtggaacaggttccttgctctagagccgatgtcttcaattccaagcagcttaccatggtggagaagcgtatgctcatgaagtttctcaccttttgtatggagtatgaaaaatacccagacgaatataaagggtatgaagaaataacgttctatgaatacttgaagacacagaagcttactcctaatctccagtacattgtgatgcactccattgctatgacatctgagacagcaagcagcaccattgatggactgaaggccacaaagaatttcctgcactgccttggtaggtacggaaatacgcctttcctctttccgctctacggtcaaggcgagcttccacagtgcttttgcagaatgtgtgcagtcttcggcggcatctattgcctccgtcatagcgtgcagtgcctggtggtcgataaagagtctagaaaatgtaaagccatcatcgaccaatttggacaacggattataagcgaacatttcttagttgaggactcctactttccagagaatatgtgcagtcgagtgcaatatcggcaaatttcaagggcggtgctgatcactgataggtcagtcctgaaaactgattccgaccaacaaatttcaattctgacggttcccgctgaagagcccgggaccttcgctgttagagtaatcgaactttgttcaagtactatgacttgcatgaagggaacctatttggtccacctgacctgcacttcgagtaagactgctagagaagacctagagagtgtggtgcagaaacttttcgtaccgtacactgaaatggagattgaaaatgaacaggtcgagaagccccggattctctgggccctctattttaatatgcgggactcttctgatatatctcgcagttgctacaacgacctcccatctaatgtctatgtttgtagcggccctgattgtggtcttggaaatgacaatgccgtgaagcaggcagagactttatttcaggaaatctgtcccaatgaggacttctgcccaccaccccctaatcccgaagatattatcctagatggtgactcccttcagcccgaagcgtccgagtctagtgcaattcccgaagcaaactccgaaacattcaaagaaagcaccaacctgggcaatctggaggagtctagcgagtag

SEQ ID NO: 112101 - DNA, 1971 bp, Artificial Sequence
  Description of Artificial Sequence: Synthetic coding sequence
atggcagacaatttgcctacggaattcgacgtggttatcatcgggaccggcctccctgagtcaattctcgctgctgcctgctcacggtctggtcagagggtgctgcacatcgattccaggtcgtactacggcgggaactgggcatccttcagcttctccgggctgctgtcatggctgaaagaataccagcagaataatgatattggtgaggagagcacagtggtgtggcaggatctgatccacgagacagaggaagccattaccttgaggaagaaagacgagacaatccagcatacagaagctttttgctacgcatcccaggacatggaggacaacgtcgaggaaataggcgctttgcaaaagaatccatccctcggtgttagtaatacgtttaccgaggtgcttgatagcgctttacccgaagagagccaactttcatactttaatagcgatgagatgccagctaaacacacacaaaagagcgataccgaaatatcactggaagtcaccgatgtggaggaatccgttgaaaaggaaaagtattgtggtgacaaaacgtgtatgcacacagttagtgataaggatggcgacaaggatgagagtaaaagcaccgtggaagacaaggctgacgagcccattaggaaccgaatcacatactcccagatcgtgaaggaggggcgaagattcaatatcgacctggtatcaaaactcctatactctcagggcctgctaattgatcttctgattaaatctgatgtgtcaaggtacgtggaattcaagaatgtgacacgcatcttggccttccgagagggcaaggtcgagcaagtgccctgctccagagcggatgtattcaactctaaggagctcactatggttgagaaaagaatgctgatgaaatttctgacattctgtctggaatatgagcagcacccagatgaataccaggccttccgtcagtgcagcttctcggaatatcttaagaccaagaagttgacccccaatctgcagcattttgtcctgcattctatcgcaatgacctcagagagcagctgcacgacaatagacggtctgaatgcaactaagaatttcctgcagtgcctgggtagatttggcaacacaccattcctgttcccactgtacggacagggagaaatcccacaaggcttttgcagaatgtgtgcagtctttggcggtatttactgcctccgccataaggtccagtgctttgtagtagacaaggagagcggaagatgcaaagctatcatcgaccacttcggacagcggattaatgccaaatattttattgtcgaggattcctatctctcagaagaaacatgctccaacgtgcagtataagcagatctctcgcgctgtactgattactgatcagagtatcctgaagacagaccttgaccagcagacctcgatcctcattgtgcctcctgccgagccgggtgcttgcgctgtacgggtcacagagctgtgctcatcgacaatgacctgtatgaaggatacttacctggtgcacctgacttgttcctctagtaagactgcacgagaggatttagaatctgtggtcaagaagctgttcactccatacactgagacggagatcaatgaagaggaattgaccaagccaaggctcctctgggctctttatttcaacatgagggactcttccggaatctctcgcagcagctataatggactgccttcaaacgtgtacgtgtgttccggccccgattgcgggctgggaaatgaacacgccgtcaagcaggccgaaaccctcttccaggaaatttttccaaccgaagagttctgccccccacctcctaatccagaagatatcatcttcgacggagacgataaacagccggaggcccctggaactaacaacgtggtgatggccaaactcgagtctagcgaagagtcaaaaaacctggagagccccgagaaacacctccagaactag

SEQ ID NO: 112102 - DNA, 1641 bp, Artificial Sequence
  Description of Artificial Sequence: Synthetic coding sequence
atggagcagcggcgggtgacagattttttcgctcggcgacgccctggtcctcctcgcatcgcgccaccgaaattggcctgcaggaccccatcacctgccagacctgcattgcgcgcccccgcaagcgctacgtccgggagcaggaagcgggcgaggccccctgccgctccgggacgggaccaggcacgcccacccgcccggcgaagacttcggctctcagtcgacgaagtctcttcgccgtctacccctgaagcccccgacattcctgcgtgcccatcccctggtcagaaaataaagaagtccaccccggctgctggccaaccgccacatcttaccagcgctcaggatcaggacaccatttccgagctggcctcctgcttgcagcgtgccagggaactgggcgcaagggtcagagcactaaaggcctccgctcaggatgctggcgaatcatgcacccccgaggccgagggccgtccggaggaaccctgcggagagaaggccccagcctatcagcggtttcacgcacttgcccaacctggactgcctggactcgtgctgccttataaataccaagtcctagctgagatgtttcggtctatggacaccatagttggaatgttacacaacaggtctgagacccccacttttgccaaagtgcagcgcggagttcaggatatgatgcgccggcgttttgaagaatgtaatgtgggacaaatcaagacggtgtaccccgcgtcttacaggtttcgtcaggagagatcagttccaacttttaaggacggcacacgacggtccgattaccagctgaccatagagccccttttagaacaggaggccgatggcgcagcaccccagctgaccgcctctagactgttgcaaaggcgccagatcttttcccaaaagctggtggagcacgttaaagagcatcataaagccttcctggccagcctgtccccagcaatggtcgttcctgaggaccagctgacacggtggcacccaagattcaatgtggatgaggtcccagatatcgagcctgcagccctgccccagccacccgctacggagaaactgacgacagcccaggaggtactggcacgcgcccgtaacttgatctcacctagaatggaaaaagctctgtctcagctggcactgaggagcgccgcacccagtagtcccggctccccccgacctgcactcccggccactcccccagccacaccccccgcagcatcaccctccgcactgaaaggtgtgagccaggacctcttggaacgtattcgcgccaaggaagcccagaaacaactggcccagatgacccggtgccccgaacaggaacagcgtctgcagcgcttagaacggctccctgaactcgctagagtgctgcggagtgtgtttgtatcggagcggaaaccagctctgtccatggaggtcgcctgcgcacgtatggtcggttcctgctgcaccattatgtcaccaggagaaatggaaaaacatcttctgctccttagcgaattgctccccgattggctcagcctgcataggatcagaaccgatacctatgttaagttggacaaagccgccgacctggcccatatcacggctcgattggcacatcaaacccgggcagaggaaggactgtag

SEQ ID NO: 112103 - DNA, 306 bp, Artificial Sequence
  Description of Artificial Sequence: Synthetic coding sequence
atgcagcagcagcagcagttggcttccgcacgcaatcgcagactagcccagcagatggaaaaccgccctagtgtacaggccgcgcttaagctcaagcagaaatcactaaaacagcggctgggaaagtccaatatccaggcacggctaggtcgaccgattggcgcacttgcccgcggcgctatcggcggacgcggactcccaattatccagaggggactaccacgagggggactgcgcgggggacgagcgactcggacactcctgagaggggggatgagtctaagaggacagtgttgcgtgccctag

SEQ ID NO: 112104 - DNA, 672 bp, Artificial Sequence
  Description of Artificial Sequence: Synthetic coding sequence
atgcttaaaaataagcagcccacgcccgtgaatattagggccagcatgcagcagcagcagcagctggcctcggcacgaaacagaaggctcgctcaacagatggagaacagaccctcagtccaggctgccttgaagctcaagcagagcctgaaacagcgcttggggaaatccaatatccaggctcgactaggtcgccctatcggagcccttgctaggggcgccataggaggtcgaggactgcctattattcagaggggactgcccaggggcggcctgcggggggggagggccacccgaactctcctgcgaggtggcatgtctctgagaggacagaatctcctaaggggcggccgagcagtggccccaaggatggggctacggagaggcggcgtgcgtggacgcggtgggccgggcagaggcggcctgggcagaggcgccatggggcgtgggggaatcggtggccgcggacgaggcatgattggcaggggtaggggcggctttgggggcaggggcagggggagaggcagaggccgtggggcccttgccaggcctgttttgacaaaggagcagctggataaccagttggacgcatatatgtccaaaacaaagggccacttggacgccgagctggatgcatatatggctcagactgaccccgagacaaatgattag

SEQ ID NO: 112105 - DNA, 609 bp, Artificial Sequence
  Description of Artificial Sequence: Synthetic coding sequence
atggccgcacaaagtgcacctaaagtggtgctgaaaagtacaacgaagatgtcattgaacgaacgctttacaaatatgttaaaaaacaaacagcccacacctgtgaatatcagagcctcgatgcagcagcaacaacagctggcatccgcacgaaaccgccgcctggctcagcagatggaaaatagacctagtgtccaagcagctctcaaattaaagcagtccctcaaacagagactcggcaaatctaatatccaggccaggctgggtcgccccatcggcgcccttgccagaggtgccatcggcggccgagggctgcccatcatacagcgcgggctcccacgcggcggcctgcggggggggagagccacaaggacattgctgagagggggaatgagcttgaggggcaggggaatgatcggacgtgggcggggcggattcggcggacggggacggggacggggacgcggccggggagcccttgccaggccagtgttgactaaagaacagctagacaaccagctggacgcctacatgtcaaagacaaaagggcacttagatgctgaactggacgcttacatggctcagaccgatcccgaaacaaacgactag

SEQ ID NO: 112106 - DNA, 747 bp, Artificial Sequence
  Description of Artificial Sequence: Synthetic coding sequence
atggctgctcagtcagcacctaaggttgtgctgaagagcaccaccaagatgagcctgaacgaacgctttaccaatatgttaaagaacaaacagcctactcctgtgaatatccgggctagcatgcagcagcagcagcagctcgcgtctgcaagaaaccggcggttggcccaacagatggaaaataggccgtccgtccaagccgcattaaagctgaaacagtcacttaaacagcgcttaggtaagtctaacattcaggcaagacttgggaggccaatcggtgccctcgcaagaggggccattgggggtcgcggcctgccaatcatccagcgtggactgcctcgaggcggcctcaggggggggagagcaactcggaccctgctccgaggtggaatgtccctcagaggccaaaatctgctgcgtggtggccgtgccgtggcccctcgaatgggcctgagaaggggcggagtaaggggcaggggcggccccggccggggtgggctagggaggggggccatgggccgagggggtattggagggagagggaggggcatgatcggccggggcagaggtggcttcggcggccgcggtcgcggccgggggagggggagaggggccctcgccaggcctgtcctgactaaagagcagctggataaccagttggacgcttacatgagcaagacaaaggggcatctggacgcagaacttgacgcctatatggcccagacggaccccgagaccaatgactag

SEQ ID NO: 112107 - DNA, 609 bp, Artificial Sequence
  Description of Artificial Sequence: Synthetic coding sequence
atggctgctcagtctgccccaaaggtggtcctgaaatcaacaacaaagatgtcacttaacgaaagatttacgaacatgcttaagaacaaacaacccaccccagtcaatatccgtgccagcatgcagcaacagcagcagctcgccagcgcccgcaacagaagactggcccagcaaatggaaaacaggccgtccgtgcaggctgctctgaagctgaagcagtctctcaagcagcgcctcggtaagagcaatattcaggccagactggggagacccatcggtgcacttgccaggggagccatcggggggaggggcctgcctattattcagaggggactccctcgaggtggcctaagaggcggacgtgcgactcggacgttactgagggggggcatgagtctgcggggacgcggcatgatcgggaggggtcgaggcggtttcggcggacggggccgtgggagagggaggggacgcggagcactggctcgtcctgtgctgactaaggagcagttggacaatcagttagacgcatacatgtctaaaaccaaagggcacctcgatgccgagctggacgcttacatggctcagaccgatccagaaaccaacgactag

SEQ ID NO: 112108 - DNA, 636 bp, Artificial Sequence
  Description of Artificial Sequence: Synthetic coding sequence
atggaagagctcagcagcgtgggcgaacaggttttcgctgccgaatgtattttgagcaagaggctgagaaaggggaaattggagtatctggtcaagtggagggggtggtctagtaagcacaatagttgggaaccagaggagaatatcctggatccacgcctgcttctggctttccagaagaaggagcatgagaaagaggtgcaaaaccgcaaacgcggtaagcgccctcgcggacgccccagaaagttaactgccatgtcttcttgttcccggcggtctaagctaaaggtaggaggttgtgctggctacgcggatcccacatcccagcaccctttgggagtcggcggcagacagagggagggacttggcccctccggacgcggatggcacttctgccagcagagtgtcccgctgctgggcaaacaagaacccccattttttctttcactctctttctgttgccagggtccccaaccggccgaaagttcctcaccccccttaccaggcgcaagctgcttctctttgagctgtactcctctgtgctgggtggccggctcaaactgttgtcgtcaggctcttttccctcctagaggcagcttgggtgacgggaaggagcaagaagcctgcgtgcaatag

SEQ ID NO: 112109 - DNA, 1599 bp, Artificial Sequence
  Description of Artificial Sequence: Synthetic coding sequence
atggaagagctatccagcgtaggggagcaggtgttcgctgcagagtgcattctcagcaagcgtttgcgtaagggtaaacttgagtacttagttaagtggcggggctggtcgtccaaacacaatagctgggaacccgaggagaacatcctggatccccgcctactgctagcctttcaaaagaaagagcacgaaaaagaggtacagaacagaaaaaggggaaaacgtccaaggggcagaccccggaagctaactgccatgtcttcatgcagccggaggtcaaaacttaaggagcctgacgcacctagcaagagtaagtcaagcagctcttcctccagtagcacatcttctagtagctccagcgacgaagaagacgatagtgaccttgatgctaagcgaggcccgagaggccgcgagacccaccctgttcctcagaaaaaagctcagattctcgtggctaaacctgaactaaaggatcctatcagaaaaaaaagagggagaaagcccctgcctcccgagcagaaggccacaaggcgccctgtatctctggcaaaggtgctgaagaccgccaggaaggacctcggcgcccccgcctccaaacttcctccccctctatccgcccctgtggctggattagcagccctgaaagcccatgctaaagaagcttgcggagggcctagcgcaatggccacccctgagaacttagcctccctgatgaagggaatggcatcatctcctggacggggcgggatttcttggcagagctctatcgtacattacatgaacagaatgactcagagccaggctcaggccgcctcgcggttggcgctgaaagcccaagccaccaataaatgcggacttggcttggatctaaaagtccgtacccagaagggcgaactgggcatgtccccccccggatcaaaaattccaaaggcgccgagtggcggcgccgtggagcagaaggtgggcaatacagggggacctccacacactcatggagcatcgagggtgcctgccggctgtcccgggcctcagcccgctccaacccaagaactgtcgcttcaggtgttagacctccaatccgtgaagaacggtatgcccggagtagggctgttagccagacatgcgactgctactaagggagtacctgctacaaaccccgcccccgggaagggcaccggttcaggtctgatcggcgctagcggagcaactatgccgaccgacacttcaaaatccgaaaagctggctagcagggccgtggccccccctactccagcgtctaaacgcgactgtgtcaaggggagtgctaccccgtctggccaagaaagtcggaccgcccccggcgaggctcgaaaggcagcaaccctcccagagatgtcagccggggaggagagtagcagcagcgacagtgacccagattccgccagccccccttccaccggccagaatccgtctgtgagtgtccagacctctcaagactggaagccgacacgaagtctgatcgaacatgttttcgtgaccgacgtgactgccaatctgatcacggtcacagtgaaagaaagccctacctctgtgggattcttcaaccttcgtcactattag

SEQ ID NO: 112110 - DNA, 1935 bp, Artificial Sequence
  Description of Artificial Sequence: Synthetic coding sequence
atggaagccgaacggggcccagagagaagacctgcagagaggtctagcccaggtcagactcccgaggagggcgcccaagcgcttgctgagtttgccgccttgcacggtcccgcgctgcgagcctctggagtacctgagaggtactggggccgcctgctgcacaaactcgaacatgaggtgttcgacgcgggcgaggtgtttgggattatgcaggtggaggaagtggaagaggaagaagatgaagctgctagagaagtgagaaagcagcagcccaaccccggcaatgagctatgctacaaggtgatcgtcacacgtgagtctgggctgcaagctgcgcatcctaattccattttcctgatcgatcacgcatggacctgccgcgtggaacacgctcggcagcaactgcagcaagtgccgggcctcttacataggatggcaaacttgatgggtatcgagttccacggcgaacttccaagtaccgaagctgtcgccctcgtccttgaggagatgtggaagtttaaccaaacttaccagctggcacacggtacagctgaggagaaaatgcccgtgtggtacatcatggacgaatttgggagccgtattcaacatgctgacgtacctagtttcgcaactgcccctttcttctacatgccacaacaggtggcctacaccttactgtggcctcttagagatcttgacacaggagaagaagttacacgcgacttcgcttatggggaaacagaccctctgatcaggaagtgcatgctgctgccctgggccccgactgatatgctggatctctcctcgtgcactccagaacctcctgcagagcactatcaggcaattttggaggagaataaagagaagcttccactggacattaaccccgtggtccacccccatggacacatttttaaagtgtacactgacgtccagcaggttgcgtcttcacttactcatccgcggttcactctgacacagtctgaagcggacgcggacatcttgtttaacttcagtcatttcaaggattatcgaaaactgtcccaggaacgacctggggttctcctgaaccaattcccctgcgaaaacctgctcacggtgaaagattgcctggcttcgattgccaggcgcgccggcgggccagaagggcccccttggttgcctcgaacctttaatttacgcacagagctgccacagtttgtatcctacttccagcagcgcgagaggtggggcgaagataaccactggatctgtaagccatggaatctggccagaagtctggatacccacgtcaccaagtcactgcacagcattataagacacagggaatccacccctaaagtggtcagtaagtatatcgagagccccgtgctgttccttagagaggacgtcggcaaagtgaaatttgacattaggtatattgtactccttcggagcgtccggccactgcgtctcttcgtatatgatgtcttttggctgagattcagcaatcgcgcgttcgcactcaatgatcttgacgattatgaaaagcacttcacagtgatgaactacgaccctgatgttgtgctgaagcaggtgcactgcgaggaatttatccctgagttcgagaaacagtatcctgaattcccctggaccgatgtgcaggcagaaatcttccgcgcctttaccgagttgttccaggtggcatgtgcaaagcctccccctctggggttgtgtgattatccatcaagcagagctatgtatgctgtggatctgatgttaaaatgggataacggcccagatgggagacgagtcatgcagccacaaatcctcgaggtcaacttcaatcctgactgcgaaagagcgtgtagatatcaccccacgttcttcaatgacgtcttttccactctgtttctcgatcagcccgggggatgccatgtgacctgcctcgtgtag

SEQ ID NO: 112111 - DNA, 477 bp, Artificial Sequence
  Description of Artificial Sequence: Synthetic coding sequence
atggagctgtccgctattggagaacaggtctttgctgtagagtcaataagaaagaaaagagtgcggaaaggcaaagtcgagtatctggtgaagtggaaaggatggccacccaagtatagcacttgggaaccagaggagcacattcttgatccacgtctagtgatggcctatgaggaaaaagaagaacgcgacagagcctcagggtatagaaagcgagggccaaaacccaagcgtctgttactgcaggaacctcccgctccggacgtgcttcaagcagcaggagaatgggaacctgccgctcagcctcctgaggaggaagccgatgccgatctagctgaagggccgccaccttggacacccgcactgccatcctctgaggtcaccgtcacagacatcacagccaactccatcaccgtcacctttagagaggcacaggcagcagaagggttttttcgggatcgaagtggaaagttctag

SEQ ID NO: 112112 - DNA, 366 bp, Artificial Sequence
  Description of Artificial Sequence: Synthetic coding sequence
atggagctgtcagcaatcggagaacaggtcttcgccgtcgaaagcatacgaaagaaacgggtgaggaagggcaaagtggagtatctggttaagtggaaaggttggccccccaaagaggaacgggacagagcctcgggataccggaagagaggcccaaaacccaaacggctgctcctccagagactttactctatggatctgaggagctctcataaggcaaagggcaaggagaaactctgctttagtctcacatgccctcttggctccggctccccagagggggtggtgaaagcaggtgctccagagctggtggacaagggaccattggtccccaccctgccttttcctcttcgcaagccgcgatag

SEQ ID NO: 112113 - DNA, 5133 bp, Artificial Sequence
  Description of Artificial Sequence: Synthetic coding sequence
atgaatggccactctgatgaagagtctgttcgcaattccagcggcgagagttcacagagcgacgatgactcgggtagcgcaagcggtagcgggagcgggagcagctctggctcctccagcgacgggagttctagtcagagtggatcttcggactctgactccggatcagagtccggatcccaaagcgaatcggagtctgatacatctcgcgaaaataaggtgcaggcgaaacctccaaaggtcgacggggcggagttttggaaatcttccccctccatcctggctgtgcagaggtctgctatcttgaagaagcaacagcagcaacagcagcaacagcagcaccaagccagttccaatagtggcagcgaggaggatagtagttcctcagaagacagcgatgattccagctccgaggttaaaagaaagaagcacaaggacgaggactggcagatgagtggaagcggatctccatcacaatccggctctgacagtgagagcgaagaggagcgcgaaaaaagttcctgcgatgagaccgagtctgactacgaacccaaaaacaaggtgaagagtagaaagccccagaaccgttcaaagagtaagaacggcaaaaaaatcttaggccagaagaaacgccagattgactcaagcgaagaagacgatgacgaggaagactatgacaatgataagcgaagtagcagaagacaggctacggtgaacgtcagctacaaagaagacgaggagatgaaaacagatagtgacgacctcctggaggtttgcggagaagacgtgccccaaccggaggaagaagagtttgagactatcgagcgcttcatggattgtcgcatcgggcgaaagggtgccacaggagccaccaccactatttacgccgtcgaggccgacggggacccgaacgctggattcgagaagaacaaggaacccggggagattcagtacctcatcaagtggaagggatggtctcacatccacaacacttgggagactgaggagaccttgaaacagcagaatgtgcggggcatgaagaagctggacaactataagaagaaggaccaggagactaaacggtggttgaagaatgcctcccctgaagatgtggagtactacaactgccagcaggagctgacggacgatctgcacaagcagtatcagatagtggagcgtattatcgcccactcgaatcagaaatcagccgccggctacccagattactactgcaagtggcagggccttccctacagtgaatgttcttgggaggacggcgctctgatttccaagaagtttcaagcctgtatcgacgagtactttagtcgaaaccaatcgaagaccacccctttcaaagactgtaaggtgctcaaacagcggcctaggttcgtggcgttaaagaagcaacctagctatatagggggccatgaaggtctggaacttagagattaccagctgaatggcttaaattggctggcacatagctggtgtaaaggtaattcatgcatcctggcggacgagatggggcttgggaaaactattcagacaatctcatttttgaattatctgttccatgagcaccaactctacggacccttcctgctggtggtgccgctgtctaccctgacaagttggcagagagaaatccaaacatgggcttcccagatgaatgcagtcgtctacctgggagacatcaacagccgcaatatgatccgcacacatgagtggacacaccaccagactaagaggctgaagttcaacatcctcctgaccacgtacgaaatcctgcttaaagataaggcattcctcggcggcttgaactgggcatttattggtgtggatgaggcccaccggctgaaaaacgacgattcactcctttataagactctaatcgatttcaaatctaatcaccggctgttaattaccgggacgccactgcagaacagcctgaaggaactgtggtcgttactccacttcattatgcccgaaaagttctcttcttgggaggactttgaagaagagcatggcaaaggacgggagtatgggtatgcttcgctccataaagaactagagcctttcctgctccgccgggtcaaaaaagatgtggagaaaagcctacccgctaaggtggagcagattctgcgcatggagatgagtgcccttcaaaagcaatactataagtggatcctcacaagaaattataaggcactgtcaaagggatctaagggctcaacttctggattcctcaatattatgatggagctgaaaaagtgctgcaaccattgctacctcatcaagccacctgacaacaatgagttttacaacaagcaggaggcactacagcacttgattagaagttctggtaagctgattcttctggataaattgcttatccgcctccgggaaaggggaaaccgcgtgctgatcttctcccagatggttagaatgctggacatcctcgctgagtacctaaagtataggcagtttccttttcaacggttagacggttcgatcaagggagaactcaggaaacaggctcttgaccacttcaacgccgaaggcagcgaggatttttgctttttgctaagcaccagagcgggagggctgggaataaacctggccagcgccgacaccgtggtcatctttgactccgactggaatccacagaatgatctacaggcccaggcgagagctcacagaataggtcagaaaaaacaggtgaatatctataggttagtgactaagggaagtgtggaagaggacattctggagcgcgcgaagaagaagatggtgttagatcacctcgtgatccagcgcatggacacaactgggaaaacggtcctccataccgggtctgctccgtcctcgtccaccccattcaacaaagaagaactgtcagctatcttgaagttcggcgctgaggaattgtttaaggaacctgaaggcgaggaacaggagcctcaggaaatggacattgatgaaatcctgaaacgagcagagacccacgaaaacgaaccgggccccctgactgtcggcgatgaactgctgagccagtttaaagtcgcaaacttctcaaatatggacgaggatgatattgagctggaacctgaacgcaactcgaagaattgggaagaaatcataccggaagatcagcgccgtcggctggaggaggaggaacggcagaaggaactggaggaaatctatatgttgccccgcatgaggaattgcgcgaagcagatttcatttaatggctccgagggacgccgcagtcgcagtcgacgttactctggatcagatagcgattccataagtgagggcaaaaggcccaagaagcgcggccggcctaggactattccccgcgagaacatcaagggcttctccgacgccgaaatccggaggttcatcaagagctataaaaaatttggcggccctctggagagattggacgctattgccagagacgccgagctagtcgataagtcagagaccgatctacgacgtcttggtgaactggtccacaacggctgcattaaagctcttaaggactcgtcatccgggaccgagagaaccgggggccggttggggaaagtaaagggacccactttccggatttcgggggttcaggtcaacgccaagctggtgatttctcacgaggaggagcttattccactgcacaaatcaatccctagcgatccagaagagcggaagcagtatacaattccgtgtcacactaaagccgcccattttgacatcgactgggggaaggaggatgacagtaacctgctgatcggaatttacgaatacggatatggttcatgggagatgatcaagatggaccccgacctgagccttacgcataaaatcctgcctgatgatcccgacaagaagccacaggctaagcagttgcagacacgagcagactacctgattaagttgctgagcagagacctagctaaaaaggaggctctgtcgggcgcaggttcttctaaacgacggaaggcaagggctaagaagaacaaagccatgaagagcattaaggtaaaagaagaaatcaagagcgactctagcccattgccaagcgagaaaagtgacgaggatgatgataaactgtccgagtctaagagcgatggaagagagcgaagcaagaagtcatcagtttccgatgctcccgttcacattaccgcgagcggcgagccagttccaattagcgaagaatctgaagagctcgatcaaaagacgttctccatctgcaaggagcgaatgcggcctgtgaaagcagcattgaagcaactggataggccagagaagggactgagtgagcgagagcagctcgaacacacaagacagtgtcttattaagatcggtgatcacatcactgaatgtctgaaggaatacacaaacccagaacagattaagcaatggaggaagaacctatggatctttgtaagcaagtttacggagtttgatgctcggaaattgcacaagctgtataagcacgctatcaagaagcgacaggagagccagcagaacagcgatcagaacagtaatctgaatccccatgtgataagaaatccagacgtcgaacgtctgaaggagaacactaatcacgacgactcttccagagacagctactcttcagatagacatttaacacagtaccacgaccaccacaaagataggcatcagggggactcctacaagaagagcgactctagaaagcggccatattcctctttttctaacgggaaggaccaccgcgactgggaccattataagcaagactctcggtattattcagacagggagaaacataggaaactggatgaccatagaagcagggatcatcggagtaatctggagggctcacttaaggacaggagtcactctgatcaccgctcccattcagaccatcgcttgcatagtgatcatagatcctcttcagagtatactcaccacaagtcttctagagactatagataccactctgattggcagatggaccatagggcgtcatcctcaggcccacgctccccccttgaccagcgcagcccatacgggtcccgaagccctttcgagcattccgtcgagcacaagtccacacccgaacatacatggagcagccgaaagacctag

SEQ ID NO: 112114 - DNA, 903 bp, Artificial Sequence
  Description of Artificial Sequence: Synthetic coding sequence
atgtttagcttcaccggagtgctagtgatttatgaggtcttaaaaaaatgtattggcaaactcatcagcctgcgtgtatgcagcatcgaggggtgcgtttgtgtgtacgtgttcgttcccggaggtaaggaattccatgagaagctgaacatctttcatcaaactaatctaatttgtctcttcctgaattcttcgcggaatctctggattttcgtatctaagttcacggaattcgatgcacggaaactgcacaagctgtataagcatgccatcaaaaagagacaggaatctcaacagaatagcgatcagaactcaaatctgaacccacacgtgattcggaatcccgatgtcgagcgtttgaaggagaacacgaaccacgacgatagctcaagagacagctattcaagcgacagacatcttacccagtatcatgaccatcataaggacaggcaccagggagacagctacaaaaaatccgattcacgcaaaagaccatattcctccttttccaacgggaaggaccaccgggactgggaccattacaagcaggactcacgatattactcagacagggagaaacatcggaaactcgacgaccatcggtcccgggatcatcggtccaatctcgaaggatccctgaaggatcggtcccacagcgaccaccgcagtcattccgatcaccgcttacactccgatcatcgcagcagctccgagtacactcatcataagtccagcagggattatcgataccacagcgactggcagatggaccaccgcgcgtctagcagcgggcccagatcccctcttgaccaaaggtcaccctacggatccaggtcaccgtttgaacattctgtcgaacacaagtccacacccgaacacacttggagctcccggaagacctag

SEQ ID NO: 112115 - DNA, 624 bp, Artificial Sequence
  Description of Artificial Sequence: Synthetic coding sequence
atgaacggccactcagacgaagagtcagtgcgtaactctagcggagaatccagccaatccgatgacgactctggttctgcatctggaagcgggtccggttcaagtagtggatccagcagcgacggctcctcttcacagagtggttccagcgactccgactcaggctctgaatcaggctcacaatcagaatccgagtctgacacatctcgcgagaacaaggtccaggctaagccccctaaagtcgacggagccgaattttggaaaagctcaccgtccatcttagcagttcaacgcagtgctatcctgaaaaagcaacagcagcagcaacaacagcagcagcaccaagctagtagtaattcgggatccgaggaagacagcagcagctcagaagattcagatgactcctcatccgaagtgaagaggaaaaagcataaggacgaggactggcagatgtcgggctcgggcagcccttcccagagcggctcggactccgaaagcgaggaggaacgggagaagtcttcctgcgatgaaaccgaatccgactacgagcctaaaaacaaagtgaagtctagaaaaccacagaacagaagcaaaagtaagaatgagaagaagaaaaagaagtag

SEQ ID NO: 112116 - DNA, 660 bp, Artificial Sequence
  Description of Artificial Sequence: Synthetic coding sequence
gtgggcgctgaccgagacagtcccacactcctgcctgccggagggtcaaactggctcgcccagcgatttcactgccagaacggatgcatcctcggggatgaaatgggcctcggaaagacctgccagacaatcgctctatttatctatctcgccgggcggctgaatgacgaggggccgtttctgattctatgcccacttagcgtcgagcagttagagcgacgtaacgccgagatttgttctaggtccttcctatgcaatatatgcggcgataaagaggagagagcctgtttgcagcaggatttaaaacaggaatctagattccacgtgctgcttaccacatatgagatctgtctcaaggacgcatcatttctcaagagctttccctggtctgtattggtggtcgacgaggcacacaggctgaagaatcaaagctctctcttacacaaaaccctgtccgagttctcagttgtgttcagccttttacttaccggtacccctattcagaactctctgcaggagctgtatagtttgctgtcatttgtcgaacccgatctgttttctaaggaggaatgggagatcttgtttaacgccacccggatactgcgaaagaatctttcgcagcaagtgaattgcaccaatagttgttcccacttctgctag

SEQ ID NO: 112117 - DNA, 1851 bp, Artificial Sequence
  Description of Artificial Sequence: Synthetic coding sequence
atgtctgccctgcagaaaaaatactataaagcgatcctcatgaaggatctggatgcgtttgaaaacgagactgcaaaaaaggtgaagctgcagaatatcctgagccagttgaggaaatgtgtagatcatccatacctgtttgacggggttgaacctgagcctttcgaggtgggagatcacttgaccgaagcgtcaggcaaactgcacctgctagataaactccttgcattcctctatagtggcggacacagggtacttcttttctctcagatgacgcagatgctagacatcctacaggactacatggactatagaggatattcctatgagagagtggacggctctgttaggggggaagagcgccacctcgccattaagaattttggccagcagcccattttcgtcttccttctgagcactagagctggcggcgttggtatgaatcttaccgcggctgacactgtgatattcgtggattccgattttaaccctcagaacgacctgcaggctgctgcaagagcccatcgaatcgggcagaataaatcggtgaaggttattcggttgatcgggcgcgacactgtggaggaaattgtttacagaaaggccgcttccaagcttcaactcaccaatatgattattgaagggggccattttacactcggggctcagaagcctgcggctgatgcagatctgcagctgtcagaaatactaaaattcggtctggacaaactgctggcttcggagggatccacaatggacgagatagacctggagtccatcctgggcgagacaaaggatggtcagtgggtgagtgatgccctgccagctgcggaggggggatcccgcgatcaggaagaaggaaagaaccacatgtacctgtttgagggtaaggactactccaaggaaccctcaaaagaggacagaaaatcctttgaacaactggtgaacctccagaagactttattagagaaagcgtctcaggaaggaaggagcctgcgcaataaagggtctgtacttattcccggacttgtcgaggggagcactaaacgcaagcgagttctgagtcccgaggagctggaggatcggcagaagaagcgccaggaagccgcagcaaaaaggcgacggcttattgaagagaaaaagcggcaaaaagaagaggccgaacacaaaaaaaaaatggcttggtgggagagtaacaactaccagagtttctgcttacctagcgaggaaagcgagcctgaagacttagagaacggcgaagaaagttccgctgagctggattaccaggatcctgacgcaaccagcctaaagtacgtgagcggtgacgttactcaccctcaagcaggtgctgaagatgccctgattgttcattgtgttgacgacagtggccactggggccgagggggactctttaccgcactcgaaaaacgatctgccgagcccaggaagatttacgagttagctggcaagatgaaggatctctccctcggaggagtgctgctcttccccgtggacgacaaggagagccggaacaaagggcaagacctcctcgccctcattgtcgctcagcaccgcgatcgatccaacgttctgagcggtataaagatggccgccctggaagagggactgaaaaagatcttcctcgcagccaagaaaaagaaagccagtgtgcatctaccccgaattgggcatgcaactaagggctttaattggtacggaactgaaaggcttattcgcaaacacttggcagctcgaggtatacccacatacatttactacttcccgaggagtaagagcgcagtgctgcacgcccagagtagcagttcctcttcgcggcaactggtaccgtag

SEQ ID NO: 112118 - DNA, 2694 bp, Artificial Sequence
  Description of Artificial Sequence: Synthetic coding sequence
atggagagggccggcgctaccagccggggaggccaggccccagggtttctgctgcggctccacacggaaggtcgggccgaagctgcaagggtgcaggaacaggatctgcgacagtgggggctcacaggtatccacctccggtcttaccagctggaaggcgtcaactggcttgctcaaaggttccattgccagaacggatgtatcctgggggacgagatgggattaggaaagacatgtcagactatcgccctgtttatctatctggccggtcgtctgaacgatgaggggcctttccttatactatgtcccttgagcgttcttagcaactggaaggaggagatgcagagatttgcgccagggctctcgtgcgttacctatgctggcgacaaggaagagagggcctgtctgcagcaggacctgaagcaagaaagtcgtttccatgtcctgctgacaacatacgagatttgcctcaaagatgcgagcttcctgaaaagtttcccgtggagcgtcctcgtcgtggatgaggctcacaggcttaaaaaccagagctccctgctgcataagacattgagtgagttctcagtcgtgttcagccttttgctgaccggcacacctatccagaattccctccaagagttatattccttactatcctttgtggagcctgacctatttagcaaagaggaagtgggggattttatccagaggtatcaggatatagaaaaagagtcagaatctgcgagtgagcttcacaaacttctgcagccctttctgttgagaagagtgaaggccgaagtggctacggagctgccgaagaagacggaagttgtgatttaccacgggatgtctgccttgcagaaaaagtactataaggctatcctgatgaaggacttagatgcttttgagaatgagacagcgaaaaaagtcaagcttcagaatatcctgtcccagcttagaaagtgcgtggatcatccatatcttttcgacggggtggagcccgagccattcgaggtgggagatcatctgaccgaggcttccggaaagctccacctgctggataaactcctggctttcctatacagcggaggacatagagttttgttgttctcacaaatgacccagatgctggacattcttcaggactacatggactacaggggctattcttatgaacgcgtggacggatcggtgaggggcgaggaaaggcaccttgcaatcaaaaatttcggacagcagccaatttttgtgtttctgttgtcgacgcgcgctggcggggttggtatgaacctgacggcagctgacaccgtcattttcgttgattcggactttaacccgcagaatgacctgcaggcagccgctagagcccacaggatcggccagaacaaaagtgtcaaagtgatacgactgatcgggagggacactgtagaagagatcgtgtaccgaaaagctgcatctaaactgcaactgactaatatgatcatagagggaggccattttaccctgggagcccagaaaccggcagccgacgctgatctgcagctgtctgagattctgaaattcgggctggacaaactcctcgcaagtgaaggcagcaccatggacgagattgatctcgagagcatcctcggagagactaaggacgggcagtgggtcagtgatgcacttcctgcggcagagggggggtcacgagatcaggaggaaggcaagaatcacatgtacttattcgaggggaaggattacagtaaggagccctcaaaggaggataggaagagcttcgagcagctcgtgaatctgcagaaaactttgttggaaaaggcctctcaggaaggacgctcattgaggaacaaaggctccgttctgatacccggcctagtggaggggtcaacaaagagaaagagggtcttatctcccgaagaactcgaagacagacagaaaaagagacaggaagcagctgcgaaaaggaggagactgatcgaagagaagaaacgccagaaggaagaagcagagcacaagaagaaaatggcttggtgggaaagcaataactaccagtctttctgcttaccaagcgaagagagcgaaccagaggacctggagaatggagaggagtcctcggctgagctggactaccaggaccccgacgccactagcctcaagtacgtgtcaggcgacgtgacacaccctcaggcaggagccgaagacgctcttatagtgcattgcgtcgacgactctggacattggggccgaggggggctttttaccgccctcgagaaacgctctgctgagccgagaaaaatctacgaactcgccggcaaaatgaaggatctgagcttgggcggcgtcctcttattccccgtagatgacaaagagagccgcaataagggccaggatctcttggcccttatcgttgcacagcatagggacagaagcaacgtgctgagcggcattaaaatggcagccctcgaagagggcctaaaaaaaatcttcctggccgcaaaaaagaagaaagcgtccgtccatttaccgagaatcgggcacgcaacaaagggcttcaactggtacggtaccgagaggctcatccggaagcatctggccgcaagaggcattcccacctatatctactactttccccggagcaaatcagctgtgttacacgcccagtccagcagttcttcctctcgacagctggtcccttag

SEQ ID NO: 112119 - DNA, 2082 bp, Artificial Sequence
  Description of Artificial Sequence: Synthetic coding sequence
atggaaagagctggagcaacatcaagagggggccaggccccgggattcctgctcagactgcacaccgagggaagagccgaggccgcccgcgtgcaggaacaggacctgagacagtgggggctcaccgccagtgagctgcataagctgctccagccttttctgctgcggagggttaaagctgaggtagccaccgagctcccaaagaagaccgaagtggtgatctatcatgggatgtccgcacttcaaaagaagtactataaggcaattcttatgaaggacctggatgcgtttgaaaacgaaaccgcaaaaaaggtgaagctacaaaacatactgagtcagctccggaagtgcgtcgatcatccttatctcttcgacggagtggagccggagccttttgaggtcggggaccatctgaccgaggcctctggcaagcttcatctcttggacaaactgttggcttttctgtattctggcggccaccgcgtgttactcttctcacagatgactcagatgctagacatcctgcaggactacatggactaccggggttattcctatgaacgggtcgatggctctgtgagaggagaggaacggcatctagcaataaagaattttggacagcagcccatcttcgtgtttctgctctccaccagagccggaggggtaggaatgaacctaactgccgcagacactgtgatatttgtggattccgactttaaccctcagaatgacctccaagctgcagccagagctcacaggattggacagaacaagagcgtgaaagtgattcgacttatcggaagggacacggtggaagagatcgtgtataggaaggctgcctcgaaactgcagctcacaaatatgatcatcgaaggagggcactttacactcggggcgcagaaaccagctgccgacgccgatctgcagctgtctgaaattttgaaattcggtctcgacaagctgcttgcttcagagggaagtaccatggacgagatagatctcgagagcatactcggcgagactaaagatgggcagtgggtatctgacgctctcccagctgctgagggcggaagtcgcgatcaagaggagggcaaaaaccacatgtatctgttcgaaggcaaagattactctaaagaacccagcaaagaagatcgtaagtcctttgagcagctagttaacttgcagaaaactctcttggaaaaggctagccaggaaggcaggagcctgaggaataaagggagtgttcttatccctggcctcgtcgaaggtagtaccaagcggaaaagggtgctgtctccggaggaactggaagacagacagaagaaacggcaggaggctgcagccaaacggaggaggctcatcgaagagaaaaagagacaaaaggaggaggcggaacataagaagaaaatggcatggtgggagtcaaataactatcagagcttctgcctgccttccgaagaaagtgagcccgaagatctggaaaacggtgaggaaagttcagcagagctggactatcaggaccccgatgccactagcctgaagtatgtgagtggagatgtgacacacccacaagctggtgcggaagacgcacttatcgtccactgcgtggacgacagtggtcattggggtaggggaggtctatttactgcgctggagaagaggtcagccgaacctcgaaaaatatatgagttggcagggaagatgaaagacctgagtttaggcggagtgctgctgtttcccgtagacgacaaggaatcgcgaaacaaaggtcaagacctgctggccttaattgtcgcccagcatagggacagaagcaatgtgctctccggcataaaaatggccgcattagaggaggggctaaaaaagatatttctggccgccaaaaaaaagaaggcttcagtccacctgccacggattggccatgcaaccaaaggttttaactggtatggcactgagcggctgatacgaaagcacttggccgcccgcggaatccctacttacatctactacttccctagaagcaagtctgccgtgttgcacgcacaatcaagctcctccagctcaaggcaactggtgccctag

SEQ ID NO: 112120 - DNA, 2412 bp, Artificial Sequence
  Description of Artificial Sequence: Synthetic coding sequence
atggagcgagccggcgcaacatctaggggaggacaggctcctggctttctgctgcgcctccatacagaaggtcgggctgaagccgccagggtacaagaacaggacctaaggcagtgggggttgacaggcatccacctgagatcatatcagctggaaggtgttaactggctagcacaacgattccattgtcagaacggctgtatactgggagacgaaatgggtcttggcaagacgtgtcaaaccattgccttgttcatttacctggcagggcgccttaatgacgaggggccatttcttatcctctgtcccctaagcgtgttgtccaattggaaagaggaaatgcagagattcgctccgggactgtcttgcgtgacgtatgccggagataaggaggagagagcatgcttacagcaggatctgaaacaagaatcaaggtttcatgtgctgctgaccacgtacgagatttgcctgaaagatgctagctttttgaaaagctttccctggtcagtgttggtagtcgacgaggcccaccgccttaagaaccaatcttcactgctgcacaagaccctgtctgaatttagcgtcgtcttttctcttctgttaaccggcaccccgatccagaactcacttcaggaactctattcactccttagcttcgtcgagcccgacctcttctcaaaggaggaagtgggcgactttatccagagatatcaagatatagaaaaggaaagtgaaagtgcctccgaactacataagctgctccagccgttcctgctgagaagagtgaaagctgaggtagcgacggaacttcccaaaaaaaccgaggtagtgatttatcacggcatgtctgccctgcaaaagaagtactataaggccattttgatgaaagacttagatgcgtttgagaatgaaaccgccaaaaaagtaaaattacagaatattctcagtcagcttcgcaaatgtgtcgatcacccttacctgttcgacggcggtgtgggtatgaatctcactgccgccgacaccgttatctttgttgattctgatttcaaccctcagaatgatctgcaggccgccgctcgagcacatcgcatcgggcaaaacaagagtgtgaaggtcattaggctgatcggccgggataccgtcgaggagatcgtctaccgtaaggccgcctctaaattgcagcttacaaacatgatcattgaaggcggccattttacactcggtgcccagaaacccgccgctgacgctgacctgcagttaagcgaaatcctgaagttcggattggataaactgcttgcctccgagggatctactatggatgaaatcgaccttgaaagcatcctgggagagactaaggatggccaatgggttagcgacgcgcttccagccgccgaaggtggatctcgagaccaggaggaaggtaagaatcacatgtacctgttcgaaggaaaagattacagtaaagagccgtccaaggaggatagaaagtccttcgagcaattggtcaacctccagaagaccttattagaaaaagcctcacaagaggggcgatctctccggaacaaaggctctgtgttgattccaggtctcgtggagggcagcacaaagaggaagcgagtcttgtcccctgaagagctggaagaccgacagaagaagcgccaggaggctgcagccaaaagaagacgccttatagaagagaaaaaacggcagaaggaggaggccgaacacaaaaaaaaaatggcctggtgggagagcaataactatcagtcgttttgtttgccaagcgaagagtccgaaccggaagatctggagaacggcgaggagagcagcgctgagctcgactatcaagatccggacgcgacaagtctgaagtacgtgagcggcgacgtcacacaccctcaggcaggtgccgaggacgctctgattgttcactgtgtggatgactctgggcattgggggagagggggcctgttcactgcactagaaaagaggtccgccgagcccaggaaaatttatgagttggccggcaagatgaaggatcttagcctcggaggagtgctgcttttccctgtggacgacaaggagtccaggaacaaggggcaggacttactggccttaattgtcgcccaacatcgagaccgcagtaacgttctaagcgggatcaaaatggctgcactggaagagggcttaaagaaaatcttccttgcggccaagaaaaagaaagcatcagtgcatctgcccagaattggccacgccaccaagggtttcaactggtatggtactgagcggctcatcagaaaacatctcgccgccaggggcattcctacttatatctactattttccccggtctaagtctgctgtcctccacgctcagtcaagctcttctagttcacggcagctcgtgccttag

SEQ ID NO: 112121 - DNA, 1305 bp, Artificial Sequence
  Description of Artificial Sequence: Synthetic coding sequence
atggcggtttcctgggagatgcgctgggcatgggggcgacctgcaaggttcgcgccaggcctgtcttgcgtcacgtacgcaggggataaggaagaacgggcctgcctgcagcaggatttaaagcaggagtcccggtttcacgtgctactcaccacttatgagatttgccttaaagatgcatcttttttaaagtcatttccttggtccgtgctggtggttgacgaggcccatcgactgaagaatcaatcctcacttctccacaagactctgtccgagtttagtgtggtgttttccctcctgcttacaggaacacctatacagaactctctccaagagctctactcactgctcagctttgttgagcctgacctcttcagtaaagaggaggttggggatttcatccagcgatatcaggacattgaaaaggaatctgagtctgctagtgaacttcacaaactgctgcagccgttccttctcagacgagtgaaggcagaagtcgccactgaattgcccaagaaaaccgaagtcgtgatctaccatggcatgtccgccctccagaagaaatattataaagccatcctgatgaaggatctggacgctttcgagaacgagacggcaaagaaggtgaaactccagaacatattgtcccagttgagaaagtgcgtcgaccacccctacttgttcgacggagtggaacccgaaccattcgaagtcggtgatcacctgacagaagcaagcgggaaactacatctgctggacaagctgctggcctttctgtactccggaggacaccgtgttttgctgttcagccagatgacccagatgctcgacattctccaagattacatggactacaggggctacagctacgaacgagtggatggaagcgtgcgcggcgaagagcggcatctggccattaaaaacttcggacagcagccaatcttcgtgtttcttctctccactcgagctgggggcgttggaatgaatctgacagctgcggacacagtgatcttcgtcgactcagattttaacccacagaacgatctgcaggctgccgcccgtgcccacagaattggccaaaataaaagtgttaaagtcatccgcctgattggtagggacacagttgaggaaatagtataccgcaaagccgctagcaagcttcagcttaccaacatgatcatcgaaggcggccacttcaccctgggcgcgcagaagccagctgctgacgccgaccttcaggtgcggtacagtaacctggtctggattaattgctggcccctgaggggcgccccatggatgaagtag

SEQ ID NO: 112122 - DNA, 5487 bp, Artificial Sequence
  Description of Artificial Sequence: Synthetic coding sequence
atgatgcggaacaaggataaatcccaggaggaagacagcagcctgcacagtaacgcttctagtcactcggcttccgaagaagcgtccgggagtgactcaggctcgcagtccgagagtgagcaagggtcggatccgggaagcgggcatggatccgagtctaacagctcttccgagtcgtctgagtcccagtcagagtccgagagcgagagcgctggatcaaaatctcaaccagtgctgcccgaagcaaaggagaaaccggctagtaaaaaggagcgcatcgctgacgtgaagaaaatgtgggaggaataccccgacgtctatggcgtccgtcgctctaaccggtctcgacaagagccgtctcgcttcaacatcaaggaagaggctagctccggctcagagtctggcagtccaaaacgccgaggacagagacagctcaagaagcaggaaaagtggaaacaggagcctagcgaggacgaacaggagcagggcacttccgctgaaagcgagcccgaacagaaaaaagtgaaggctaggagaccggtgcccaggagaaccgtgcctaagcctcgggtgaaaaaacagccaaagacgcagagagggaagaggaaaaagcaggacagcagcgatgaggatgacgacgatgatgaagccccaaaacggcagaccagaagacgcgccgccaaaaatgtttcatataaagaggacgatgacttcgaaaccgactcagatgacctgatcgaaatgacaggagaaggagtggacgaacagcaggacaattcagaaacaattgagaaagtgcttgatagtcgcttggggaagaaaggcgcgactggcgccagtaccactgtgtacgccatagaagcaaatggggatccgagcggcgacttcgataccgagaaagatgaaggggagatccagtatctgatcaagtggaagggctggagttacatccattcaacctgggaatcagaagagagcctgcaacagcagaaagtgaagggtctgaaaaaactggaaaattttaagaagaaggaggacgagattaaacaatggctggggaaagtatcacctgaggacgtggagtactttaactgtcaacaggagctagcaagtgagcttaacaagcaatatcagatcgtggaacgagtgattgcggtgaaaactagcaagtctaccctaggacagacagactttccagcccatagcaggaagccagcaccatcgaatgaaccggagtatctgtgcaaatggatggggctgccatattctgagtgtagttgggaggacgaagccctgatcggaaagaagttccagaattgtattgactcctttcatagtagaaataatagtaagaccatccctacgagggaatgcaaggcgttaaaacagcggccacggtttgtggctctgaagaaacaacctgcctacctgggaggagagaacttggagctacgtgattaccaattagaaggactcaattggctggctcactcgtggtgcaaaaacaattccgttatccttgctgatgagatgggacttggcaagaccatacaaacaatatccttcctatcttacctctttcaccagcaccaattatacggccctttcctgatcgtggtcccactttcgactttgacctcctggcagagggaatttgaaatttgggcacccgagattaatgtggttgtgtatatcggggatttaatgagtcggaacaccattcgcgaatacgagtggattcacagtcagactaagagattaaaatttaatgccctgattacgacctacgagatcctgttgaaggacaaaactgttctgggatcaattaactgggcgttcctcggagttgatgaagcgcatcggctcaagaatgacgatagcctgctttataaaacactgatagacttcaagtcaaaccatagactgctgataactgggacgcctctacagaactccctgaaggaactctggtctctgctccacttcatcatgccagaaaaattcgagttctgggaggacttcgaagaggatcacggaaaaggtcgagagaacggatatcaaagcctccataaggtgttggaaccattcctccttcgtcgggtaaagaaagatgtcgagaaatccctgccggctaaagtcgagcagatccttcgggttgaaatgtccgcactgcagaagcagtactacaagtggatccttacgcggaattataaggccctcgcaaaagggacacggggaagcacaagcgggttcctgaacattgtaatggagttaaaaaagtgttgtaatcattgctatttaataaaacccccagaggagaatgaaagagagaacgggcaggaaatcctgctgtctctgatccggtccagtgggaagcttatcttgctcgataaattactgactcgtctgcgcgagaggggcaatcgggtcttaatcttcagccagatggtaagaatgctggatatccttgcagagtatcttactattaaacattatccttttcagaggttagatggctccatcaagggcgaaatcagaaagcaagccctagaccatttcaatgccgatggcagcgaagacttctgcttcttgctctctactagggccgggggactgggcatcaatctggctagcgccgataccgtggtgatcttcgactccgattggaaccctcagaacgacctgcaggctcaggctcgcgctcataggattgggcagaagaaacaggtgaacatttacaggcttgtgactaaagggaccgtcgaagaagaaataatcgagagggcaaagaaaaagatggtattagaccatctagtgatccagcggatggacactacaggtaggacaatcctggaaaacaattccgggcggagtaacagtaacccattcaacaaagaagagttgactgctatcctgaaattcggcgctgaggacctgttcaaagaattggaaggtgaagaatctgaaccccaggaaatggatatcgatgagatcttaaggttggcagagacccgagagaatgaggtctccacctccgccaccgatgaactcttgagtcagtttaaagtggccaatttcgccaccatggaagacgaggaggaacttgaagagaggccccataaggactgggatgagatcatccccgaggagcagaggaagaaagtcgaggaggaagagcggcagaaggaactggaggaaatttacatgctgcctcggatcaggagctcaacaaagaaggcccaaacgaacgactctgactccgacactgaatcaaaaagacaggcacaacgcagttccgcaagcgagtctgaaaccgaagatagcgacgatgacaaaaaacctaaacggagaggccgccctcggtccgtgcgcaaagacctagtggaggggtttaccgacgctgagatcaggcggttcataaaagcttacaagaaatttggacttccattggaacgcctggagtgtatcgccagagatgcagagcttgtggacaagagtgtcgcggacctgaagcgtctaggtgaattaatccacaattcatgcgtgtccgccatgcaggagtatgaagaacagctcaaagaaaatgctagcgaaggaaaagggcctggcaagcgccgaggacctacaattaagatttcaggcgtacaagtaaacgtaaagagcataatccagcacgaggaggaatttgagatgctacataagtccataccggtggatcccgaggagaaaaaaaagtattgtctgacttgtagagttaaggcggcccacttcgacgtagaatggggagtagaagatgatagccgacttctgcttggcatttatgagcacggctacggtaattgggagcttatcaaaactgatccagaattaaagctgacagacaagattctgccagtggagacagacaagaaacctcagggaaaacaacttcagacgcgcgccgactacttgttaaagttgctgaggaaaggtctggagaagaagggggcggtgaccggaggggaggaagctaagttgaagaaacgcaaaccacgcgtgaagaaagagaataaggtgccccgattgaaggaagaacacggcattgaactctcctccccacgacatagcgataatccaagtgaggagggcgaagtgaaagatgacggcctcgagaagagccccatgaagaaaaagcagaaaaaaaaggagaacaaagagaataaggagaaacagatgtctagcagaaaggataaggagggggacaaggagagaaagaagagcaaggacaagaaggagaaacccaagagtggtgacgctaagagttcctccaaaagcaaacgctcacaaggccccgtccatatcactgcgggcagtgaaccagtgcccatcggtgaggatgaggatgatgacctcgatcaggagactttttcaatctgcaaggaaaggatgaggcctgtgaagaaagccctgaagcagctggataaaccagataaaggcttaaacgttcaagagcagctcgaacacacacgcaattgccttctcaaaatcggggaccgcatcgcagaatgccttaaagcatacagtgatcaggagcacataaaactgtggcggcgcaacctatggattttcgtctccaagtttactgagttcgacgcacggaagctgcacaaactttacaaaatggctcacaagaagaggagtcaggaggaagaggaacagaagaaaaaggacgacgtaacaggtggtaagaagccctttagacccgaggccagcggttctagtcgggatagccttattagtcagtctcatacatcccacaacctgcacccacagaaacctcaccttccggccagccacggtccacagatgcatggtcatccccgagacaactataaccatccgaacaagcggcacttctcgaatgccgacagaggagattggcagagagaacgcaaattcaattacggtggagggaataacaatccaccctggggtagtgaccggcatcaccagtatgagcagcactggtataaagaccaccactatggagatcgccgacacatggacgcacacaggagcggctcctataggccaaacaacatgagtagaaaaagaccatatgatcagtactcgtcagatcgtgaccacagagggcaccgggattactatgatagacatcatcatgattccaaacggaggaggagtgacgagttccggccacagaactaccaccaacaagactttcgcagaatgagtgaccatcgcccagctatgggctaccatggacaaggcccaagcgaccattacagatcctttcatactgataaattgggcgagtacaaacaacctctgcctcctctccaccccgcagtgtcggatccaagatcgccaccctcccagaaatcccctcacgactcaaagtcacctctcgatcatcgcagtcctctggagcggtctctagaacagaagaataacccagactataattggaatgtgcgcaagacctag

SEQ ID NO: 112123 - DNA, 1506 bp, Artificial Sequence
  Description of Artificial Sequence: Synthetic coding sequence
atgatgcgcaacaaggataaaagtcaggaagaggactccagcctccatagcaacgctagctcgcattctgcatctgaggaagctagcggcagtgattctggatctcagagcgagtccgaacagggcagcgatccaggctcaggccacggatctgagagcaattcgtcttcagaatccagcgagtctcagagtgagagcgaaagcgaaagcgctggctctaaatcccagcccgtgctcccagaagcgaaggaaaaaccagcatctaagaaggagaggatcgctgacgtcaagaagatgtgggaggagtatccagacgtatatggagtaaggcggtcgaatcggagcagacaagaacctagccgcttcaatatcaaggaagaagcgtcaagcggctcggagtccggctccccaaaaagacggggtcaacggcagttaaaaaagcaggagaaatggaaacaggaacccagcgaagatgagcaggagcaaggcacatctgccgagagtgagccagagcaaaaaaaggtgaaagcacggagacccgtaccgcgccgcactgtacccaaaccccgtgtcaaaaagcagcccaagactcagcgaggcaaaaggaaaaaacaggacagcagtgacgaagacgatgatgacgatgaggcacctaagcgccagacccgacggagggctgccaagaacgtgtcctataaggaagatgacgactttgaaaccgattcggacgatcttattgagatgaccggcgaaggagtcgatgagcagcaggacaactctgaaacgattgaaaaggttctggatagtcgcctgggcaagaaaggcgctacgggcgcatccacaaccgtttacgccatagaagcgaatggagatccttcaggcgactttgatacagaaaaggacgagggggagattcagtatcttataaagtggaagggatggtcatatatacacagcacttgggaaagtgaagagtccttacagcagcagaaggtgaaggggctcaaaaaacttgaaaattttaagaaaaaggaagacgagattaagcagtggcttggtaaggtgtccccagaagacgtggaatacttcaactgccagcaggaacttgcctcggaactaaacaagcagtaccagatcgtcgaacgagtgatagccgtgaagacatcaaagagcacactcgggcagacagacttcccagcacactcaagaaaacctgctcccagcaacgagccagaatacctatgcaaatggatgggcttgccatatagtgaatgtagttgggaagatgaagctctgataggaaagaagtttcagaattgcatcgactccttccactcccgaaataacagtaagaccattcctactcgagagtgcaaggccctgaaacagcgaccgcgtttcgtggccctgaaaaaacagcccgcctaccttgggggagagaacctggaactaagggactatcagctggaaggcctcaactggctcgctcattcctggtgcaaatag

SEQ ID NO: 112124 - DNA, 1545 bp, Artificial Sequence
  Description of Artificial Sequence: Synthetic coding sequence
atggcccataagcagagagaggattacttgaatctgagcccctgtgttttcacctggtaccgtaccttctcacagcttgctttcgacggcgagaagctgtctcacagcgcatctgaggaggcaagcggaagtgactcagggagccaaagcgaatcagagcaggggtcggacccgggtagcggtcatggcagcgaaagcaacagctcttctgagagcagcgagtcgcagtccgaaagtgaatctgaatcggcaggtagcaagagccagcctgtgctgcccgaagcaaaggaaaagcctgcctctaaaaaagagcggatcgcggacgtgaaaaagatgtgggaggaataccccgacgtgtacggcgtgcggcggagtaaccgaagccggcaggagccaagcaggtttaacataaaggaggaggcttctagcggctctgaaagcgggtctcccaagcgtaggggccagagacagctgaagaagcaggagaagtggaagcaagaaccctccgaggatgagcaggaacaaggtacatcggcagaatctgaacctgagcagaagaaagttaaggctagacgcccagtcccgcgccgaacagtgcctaagcctagggttaagaaacagcccaagactcagcgggggaagcgtaagaaacaggactcaagcgacgaagacgatgatgacgacgaggcaccgaagaggcaaactaggcgcagggctgcgaagaatgtctcctataaggaagatgacgacttcgagacagacagtgacgacttgatagagatgactggcgagggcgtggacgaacaacaggacaattctgaaaccatcgaaaaagtgttagactcccgactgggtaagaagggcgccaccggggcttccacaaccgtctatgctattgaagccaatggagacccatcaggagattttgacacggagaaggatgaaggggagatacagtatttaatcaaatggaaaggctggtcatatatccactctacatgggagtcagaagaaagtctgcagcaacagaaggtcaaaggcttgaaaaagctggaaaactttaaaaagaaggaagatgagattaaacagtggctgggcaaggtgtcaccagaggacgtggagtacttcaactgtcagcaagagctggcaagtgagctcaacaaacagtatcaaatcgtcgagagggtgatcgctgtaaagacaagcaagagcacgcttggccagacagactttcccgcacacagccgaaaacctgcacccagtaatgaaccggagtatctgtgcaagtggatgggtttgccgtattccgagtgtagttgggaggacgaggctctcatcggcaaaaagttccagaattgtattgattcctttcactcaagaaacaacagtaaaacgatacctacccgagaatgcaaagcattgaagcagcgccctcgatttgtagctcttaagaagcagccagcgtacttgggcggtgagaatctcgaattacgcgattaccagctcgaaggcctaaattggctcgcccacagctggtgcaaatag

SEQ ID NO: 112125 - DNA, 552 bp, Artificial Sequence
  Description of Artificial Sequence: Synthetic coding sequence
atgatgcgaaacaaggacaagtcacaggaagaggatagctccttacacagcaacgcaagcagccactctgcctctgaagaggcctcaggtagtgattccggtagtcagtcagagagcgagcagggttcagatccaggatctggccatggatctgaaagcaattctagctcagaatcctccgagagccagtccgagagcgagtctgaatctgctggtagtaaatcgcaacccgtgctgcctgaagctaaagagaagccagcctcaaagaaagaacgaatcgccgatgtaaagaagatgtgggaggaatacccagatgtctatggcgttcggaggtcaaaccgatcccggcaggagcccagtcggttcaatatcaaggaggaagcctcaagcggatccgaatcagggtcaccaaagaggagggggcagcggcagcttaagaaacaggagaaatggaaacaggaaccatccgaggacgagcaggagcagggaaccagcgccgagtctgagccggagcagaagaaagtgaaggcaagaaggcctgtgccccggtag

SEQ ID NO: 112126 - DNA, 5220 bp, Artificial Sequence
  Description of Artificial Sequence: Synthetic coding sequence
atgatgcggaacaaagacaagagtcaggaagaggactcctcattacacagcaatgcttcatcacatagcgcctcagaagaagccagtggatctgatagtggcagccaaagcgaaagcgagcagggatccgaccctgggagtggccatggatcggagtctaatagttcgagtgagtcctcagagagccagtccgaaagcgaatccgaaagtgccggatcaaagtcacaaccagttctcccagaagcgaaagaaaaaccagcatccaaaaaagaaaggattgcagatgtgaagaagatgtgggaagagtaccccgatgtgtatggggtgagacggagtaatcggagtagacaggagccgagtagatttaacataaaagaagaagcatccagtgggtcagaaagtggttcgcctaagcggaggggtcagcgccaattgaaaaaacaggagaaatggaagcaggaaccatctgaggacgaacaagagcaaggcacctccgccgaatcagagccagaacaaaagaaggtgaaggcacggcgacctgtcccccgccgaacggtaccaaagccacgagtgaagaaacagccaaagacgcaacggggaaagcgcaaaaaacaggacagctcagacgaggacgatgacgatgatgaggctccaaaacggcagacgcggagaagagctgccaaaaatgtcagctataaggaggacgacgactttgaaaccgacagcgacgaccttatcgaaatgacaggcgaaggtgtcgacgaacagcaggataattcggaaacgatcgaaaaagtgttagatagcaggttgggcaagaaaggggccactggcgcttctactaccgtgtatgccatcgaggctaacggagatccctctggagacttcgacactgaaaaggacgaaggggagatccagtacctcattaagtggaagggatggagttatattcattctacctgggagagcgaagagagtctccagcaacagaaggtaaaaggattgaaaaaacttgagaactttaaaaagaaggaagacgagatcaagcaatggctgggcaaggtatccccggaagacgtggagtatttcaactgtcagcaggagctggccagcgagttaaacaagcaataccagatagtggagcgtgtcattgccgttaaaacctccaaatccaccctgggccagaccgattttccggcccactcgcgtaagccagccccaagtaacgaacccgagtatctctgcaagtggatggggcttccgtactcggaatgttcttgggaggatgaagcgttaataggcaaaaagtttcagaattgtatcgattctttccatagcaggaacaactccaagaccatcccgacccgagagtgtaaagctctcaaacagcgcccccgtttcgtggcactgaagaaacaacccgcctacctgggcggggaaaatctggaactacgcgactaccagcttgaaggactgaactggctggcacattcgtggtgtaagaacaactcagtgattctggcggacgagatgggactgggtaaaacaattcagaccattagttttctgtcctatctgttccatcagcaccagttgtacggcccttttctgattgtcgtgccacttagcactctgacctcttggcaacgggagttcgagatctgggcccccgaaataaatgtcgttgtttacataggtgatctaatgtctaggaataccataagagaatatgaatggatccacagccagaccaagaggctgaaatttaacgctctgattaccacatacgaaatactgctcaaggacaaaacagtcctcggatccattaattgggcctttctgggcgtcgatgaagcccaccgcctgaagaatgatgactcgctgctgtacaaaactctgatagattttaagtccaaccacaggctgctgatcacgggtactcccctgcaaaatagtctgaaggaactttggtccctcctgcacttcatcatgcccgagaagttcgaattctgggaagatttcgaggaggaccacggcaagggaagagagaacggctaccagtctctccataaagtgctggaaccttttctcttgcggagagtaaagaaagacgtggagaaatctctacctgcaaaagtggaacagatcctgcgagtcgaaatgtccgccctacagaaacagtactataagtggattcttacgaggaattacaaggccctggctaaaggcacacgcggctccacatccggtttcctgaatattgttatggaactgaagaagtgttgcaatcattgctacctgatcaagccgcctgaggaaaatgagcgcgaaaatggccaggagattctactgagcctcattcgttcttccgggaagctgattctgctcgataagctgttaacccgcctgagggaacgtggaaatagggtgctgatctttagccagatggtaagaatgctagacatcttggcagagtacctcactatcaaacactatccgtttcagcggctcgatggcagtatcaaaggcgaaatcagaaagcaggccttagaccacttcaatgcagacgggagtgaagacttttgttttttgctgtccactagggcgggcggtcttggaattaatctggcatctgccgatactgttgtcattttcgactctgattggaatcctcaaaatgaccttcaggcccaagccagggctcacagaattggccagaaaaagcaagtgaacatatatcgcctggtgacaaagggaactgtggaagaagaaataatagaaagagccaagaagaaaatggttctggaccacctcgtgatacagcgcatggacacaaccggaagaactattcttgaaaacaactccggcaggtccaattctaatcccttcaacaaggaagaactgactgctattctcaagttcggtgcggaagatctgtttaaagagctagagggagaggaatccgagcctcaggagatggacatcgatgaaatcctgagactggctgagacacgagaaaatgaggtcagcacctcagcaacagacgagctgctgtctcagtttaaggtggcaaacttcgcaacaatggaggatgaagaagagctggaggagcgtccccacaaggactgggatgaaatcatccctgaggagcagcgtaaaaaggtggaggaagaggagaggcagaaggaacttgaggaaatatacatgctgcccagaattcgaagctctacaaagaaagcacagaccaacgacagcgatagcgataccgaatcaaaacggcaggcccagcgaagctctgcctcagagtcggagaccgaggatagcgatgatgacaagaaaccgaagcgtcggggcagaccacggagcgtccgcaaggatctggtggaaggatttacggacgcagaaatacgacgcttcattaaagcatataaaaagttcgggctccccctcgagagactggaatgcattgcccgggatgccgagctcgtggacaaaagcgtagctgacctcaagagacttggtgagcttattcataactcctgcgtctccgccatgcaggagtacgaggagcagttgaaggaaaacgcctcagaaggcaaggggcccggcaaaaggcgaggacctaccatcaaaatcagtggtgttcaggtgaatgtgaaaagtataatacagcatgaggaggagtttgaaatgttgcacaagtctatccctgtcgatccagaagagaagaagaagtactgcctcacatgccgggtgaaagccgcccacttcgacgtcgaatggggggtcgaggatgactcacgtctcctgcttggcatatatgagcatggatacggaaactgggagctaatcaagaccgacccagaactcaaactgacggacaaaatactgcccgtggaaacggacaaaaaaccccagggcaagcagcttcagactcgagctgactatctcttaaagcttcttagaaaaggactcgagaagaaaggggcagtgaccgggggcgaggaagccaagctcaaaaaaagaaaaccacgtgttaaaaaggagaacaaagtgccacgattgaaagaggagcatggcatagaactgtctagcccacggcatagcgataacccctccgaagaaggtgaagttaaggacgatggcctggaaaagtccccaatgaagaaaaaacaaaaaaaaaaagaaaataaagaaaacaaggagaagcagatgagttcgcgaaaagataaagagggggacaaagagagaaagaagtcaaaagacaaaaaggaaaagccaaagtccggagatgcgaaaagtagtagcaaatctaagcgctcccagggcccagtgcatattactgcaggctctgagcctgtccccatcggagaggatgaagacgacgacctagaccaagaaactttcagcatttgcaaagagaggatgaggcctgtgaagaaagcactgaagcagttggacaagcccgataaaggtctgaatgttcaggaacagctggagcacaccaggaactgcctgctgaaaatcggggaccggattgccgagtgtctgaaagcctattctgaccaggaacacatcaagctgtggaggcggaacttgtggatctttgtcagtaagttcaccgagtttgatgcccggaagctccacaagctgtataagatggcccataagaaacgatcccaggaagaggaggaacagaagaagaaagatgacgttactggaggcaagaagccttttagaccagaagcctccggctccagccgggactcactgattagtcagtcccacactagtcacaatctgcaccctcagaaaccgcacctccccgcttcccatggtccacaaatgcacggccaccctcgggataattacaaccaccccaataagagacattttagcaatgcagaccgcggggactggcaacgcgagaggaaattcaattatgggggtgggaacaataatcctccatggggttctgataggcaccatcaatatgaacagcactggtacaaagatcaccactatggagaccgcagacacatggacgcacacaggtcaggcagctacaggcctaacaacatgtcccgcaagcgaccttatgatcagtattcctccgaccgggatcatcgaggacaccgcgactactatgatagatatgcgaagggatgtgaaacgcccggggcaaatctttgtcaggaactcttcctgggccggaagtag

SEQ ID NO: 112127 - DNA, 6003 bp, Artificial Sequence
  Description of Artificial Sequence: Synthetic coding sequence
atgaaggccgcagatactgtgattttgtgggcacgttctaagaatgatcagctgagaatcagtttccctcctggcctctgttggggtgatcggatgcctgataaagatgacattagactcctgccctcggctctgggggttaagaagcggaaacgtgggcccaagaaacagaaggaaaataagcccgggaagcccagaaagaggaagaaaagagacagcgaggaagagttcgggagcgagcgggacgaatacagagagaagtcagaatccggcggttcagagtacggaaccggccctggcagaaagagaaggaggaagcatcgcgagaaaaaggaaaagaagaccaaacgccgcaaaaaaggtgaaggtgacgggggccagaagcaagtggaacaaaaatcttccgcgaccctcctgctgacgtggggactcgaagacgtggagcatgttttctccgaagaagactatcacaccctcaccaattacaaggcttttagtcagttcatgaggccactcatagcaaagaaaaatcctaaaataccaatgagtaaaatgatgacaattcttggcgccaaatggagggagttcagcgccaataatcctttcaagggaagtgctgcggccgtcgccgctgccgccgccgcagcagccgccgcagtggctgagcaggtgtccgcggcagtcagttcggctaccccgatagccccttccggacctccagcccttcctccaccacctgccgccgacatccagccaccccctattaggcgcgcaaagacgaaagaaggaaaggggccgggccacaaacggcgctcaaaatcgcctagggtccccgatggtcgtaagaaactaagaggtaaaaagatggccccacttaagatcaagttagggctcctaggcggcaaacggaagaagggtggttcttatgtgtttcagagtgatgagggtccggaacccgaggcagaagagtccgatctggattcaggatccgttcactcggcaagcggtcgcccggacggtcccgtcaggacaaagaaactcaaaaggggaagaccaggtagaaagaaaaagaaggtgttaggatgccccgctgtagcaggcgaggaggaggttgacgggtatgagacggaccatcaggattactgcgaagtctgtcaacaggggggcgaaatcatcctctgtgacacctgccctagagcatatcatttggtgtgcctggacccagaactggatcgcgccccagaaggcaaatggtcctgccctcactgcgaaaaagaaggggtccagtgggaggccaaggaagaagaagaagagtacgaggaagagggggaggaagagggtgagaaggaagaggaagacgaccacatggaatactgtcgggtttgcaaagatggaggcgagctcctttgctgcgacgcatgtattagctcataccatattcattgtctgaacccacctcttcctgacatacctaacggcgagtggctgtgccctcgttgcacctgcccagtgctgaagggccgtgttcagaagatccttcattggcgatggggggagccacctgtcgcagtgcccgccccccagcaggctgatgggaaccccgacgtgcctcccccacgaccacttcaagggcgaagcgagcgggagttttttgtgaagtgggtcgggttaagttactggcattgtagctgggctaaggagctccagctggagatatttcatcttgttatgtatcgaaattaccagaggaaaaatgacatggacgagccacccccactcgactacggctccggagaagacgatggcaagtcagacaaaagaaaagtaaaagatccgcattacgcagagatggaggaaaaatactaccgattcggcataaagccggaatggatgaccgttcataggatcataaaccattctgttgataagaagggtaattatcattaccttgtgaaatggcgtgatcttccatacgaccagtcaacgtgggaagaagacgaaatgaacattccagagtatgaggaacacaagcagtcttactggcgccatagagagctgattatgggggaggatcccgcccagccaaggaagtataagaagaagaagaaggagctccagggcgatggtccccctagctcaccaaccaatgaccctacggtaaagtacgaaacccagccaaggttcattaccgccaccggcggcaccttacatatgtatcaactggagggtctcaactggcttcggttctcgtgggcccagggtaccgataccatcctggctgacgaaatggggctcggcaaaacaatccagaccatagtattcctttattcactgtacaaggaaggccacactaaaggaccgttcctcgtgtctgctcctctcagcactatcatcaattgggagcgagagtttcagatgtgggccccaaaattctatgtcgtcacatatacaggcgacaaggacagtcgggccataattcgggagaacgagttctctttcgaagacaatgccattaaaggcgggaagaaggcattcaaaatgaaacgtgaggcccaggtgaagttccatgtcctcctcacaagctacgagctcattaccatcgatcaagccgccctcggaagtattcgctgggcttgcctggtcgtggatgaagcccatcgcttgaagaataatcagagtaagttcttcagagtacttaacgggtataaaattgaccacaagcttttgctgaccggaacacctctacagaacaacctggaagaactttttcatctgctcaacttcctaacccctgagcgtttcaacaatctcgaagggtttcttgaggaatttgccgacatctcaaaagaggatcagatcaagaaactccatgatctgctcgggccacacatgctccgccgactgaaggccgacgtgtttaagaacatgcccgctaagacagagttaatcgtgagagttgaactgagcccaatgcagaagaaatactacaagtacatcctgactaggaattttgaggctcttaattcgaggggcggaggcaaccaggtgtcgctgttgaacattatgatggacctaaaaaagtgctgtaatcatccttatttgttcccagtggccgctatggaaagcccaaaactgccttcgggggcctatgagggaggagccctgatcaaaagcagcggaaagctgatgctcctgcagaaaatgcttagaaagctgaaagaacagggccaccgagtcctcatcttctctcagatgaccaagatgctggacttgctggaggattttctggattacgagggttacaaatatgagagaatcgatggcggcattactggggcccttcgacaggaagccatagataggttcaacgcacctggagcacaacagttttgcttcctgctgtctaccagggccggtggactggggatcaacctggcaactgctgacacggtgataatcttcgactcagactggaatccccacaatgatattcaagcattctcgcgggctcacaggataggacaggccaacaaggtgatgatctacagattcgtcacccgcgccagtgtagaagaaaggataacccaagtcgctaagaggaaaatgatgctcacacatttggtggttagaccaggtcttggctccaaagccgggtccatgagcaaacaggagttggatgacattttgaaattcgggaccgaagagttgttcaaagacgaaaatgaaggagaaaacaaggaagaggacagctccgtcattcattacgacaacgaagcgatcgcgagactcctcgatagaaaccaggacgccactgaagacaccgacgtccagaacatgaacgaatatttgtctagcttcaaggtagcccagtatgttgtccgcgaagaggacaaaattgaagagatagagcgagaaatcataaagcaggaagaaaacgtcgatccggactattgggagaaactgctacggcaccactatgaacagcaacaggaagacttagctaggaacctgggcaaagggaagagagtccggaagcaggtgaattacaacgatgctgctcaggaggaccaggataatcaaagcgagtacagtgttggcagtgaggaggaagacgaagattttgacgagcggcctgaggggcggcggcagtctaagagacagctcaggaacgaaaaggataagcccttaccccctctgctcgcccgggtcgggggcaatatcgaggtcctgggcttcaacacgcgccagagaaaggcctttctgaatgctgtgatgagatgggggatgccccctcaggatgctttcacgacccagtggctcgtgagagacctgagaggcaaaacagagaaagagttcaaagcgtacgtcagccttttcatgcggcacctttgtgagccaggagccgatggttccgagactttcgcggacggggttccgcgtgaagggctgagtcggcagcaggtactaacccgaataggtgtgatgagcttagtgaaaaagaaggtccaggaatttgagcatataaatggcagatggtctatgcctgagttgatgccggaccctagtgcggattctaagcgctcttcccgagcttccagcccgactaagacttcacctaccacaccagaagctagcgccaccaatagcccctgcacttctaagccagccacgccagcgccttcggagaagggtgaaggcattaggacaccgcttgagaaggaagaagccgagaatcaagaggaaaaaccagagaaaaactcccgtatcggagaaaagatggaaacagaggccgacgcaccttcacccgccccttcattgggagagcgccttgagcctaggaaaatccctctggaggacgaagtaccaggcgttccgggggaaatggagcccgagcccggatatcgcggcgaccgagaaaaaagtgcaacagaatctacacctggcgagagaggagaggagaagcccctagacggtcaggagcatcgggaacgccccgagggggagaccggcgacctgggaaaaagggaggacgttaaaggcgacagggaactccgacccgggccaagggatgagccccgcagcaatggcaggcgggaggaaaagacggagaagcctaggtttatgttcaatatagcggatgggggcttcacagagctgcacactttgtggcagaatgaggagcgggctgcgatcagcagtggtaaactgaacgaaatttggcataggcgccacgattactggctcctggccggtatcgtgctccacggttatgctcgatggcaggatatccagaacgacgctcaatttgccatcattaatgaaccattcaagactgaggctaacaaaggtaactttctggaaatgaaaaacaagtttctagcgaggcgatttaagctcctggaacaggccctggtaatcgaagaacagctgagaagggctgcctatctcaatctctcgcaggaacctgcccatcctgctatggccctgcatgccagatttgctgaagctgagtgtctcgcagaatcccaccagcacttaagtaaagaatctctcgcaggcaataaaccagcaaatgctgtgcttcataaggtcctgaaccaattagaagagctcctgtctgatatgaaagctgacgtgaccagactcccagccacgttgtccagaattcctccgatcgccgctaggctgcagatgtctgagagatctatactctcgcgcctcgcctcaaagggcaccgagccccacccgacccccgcatatccccccggcccatatgccacgccccctggttatggtgcagcattctcggccgccccagttggggcgctcgccgccgcaggggccaattatagccagatgcccgcggggagttttataacggccgccacaaatggtcccccagtgctcgtgaaaaaggaaaaagaaatggtgggggctctggtgtccgatggactggacagaaaggagccgcgggcaggcgaagtgatctgcatcgacgattag

SEQ ID NO: 112128 - DNA, 5901 bp, Artificial Sequence
  Description of Artificial Sequence: Synthetic coding sequence
atgaaggcggccgacacggtcattctttgggcgcgtagcaagaacgaccagttgcgaataagctttccaccagggctgtgttggggcgatagaatgcctgataaagacgatatacgtctgttaccgtccgcactaggcgttaagaagcgcaagcggggcccgaaaaaacaaaaagaaaacaaacccggaaagcccagaaaaagaaagaaacgcgattcagaggaggagtttggttccgagagagacgaataccgagaaaaatcagagagtggcggttctgagtacgggacaggaccagggcgcaagcgccgccggaagcaccgtgagaaaaaggagaaaaagaccaagaggcgtaagaagggggagggggacggcggccaaaagcaggtggagcagaagtctagcgccactctgctgttaacatggggtttagaagatgtggaacacgttttctcggaagaggattaccacacactcaccaattacaaggccttctcccagttcatgaggcctttgatcgctaaaaagaacccaaaaatacctatgtctaagatgatgactattctcggcgccaaatggagggagttctctgctaataacccctttaagggctctgcagcagccgtggccgcagcagcggcggccgcagccgccgctgtggccgagcaagttagcgccgccgtgagttctgctacacctattgctcctagcggtcctcctgcactccctccaccccctgctgccgatattcagccccctcccatccggcgagctaagaccaaggagggtaagggtccaggacataagagacggtctaagtcccccagggtccctgacggcaggaagaagttgagaggaaaaaagatggcaccattgaagatcaagctcggcttactgggcgggaaaagaaagaagggcggctcctatgtgtttcagagcgatgagggccctgaacccgaggcagaagagtcagatcttgacagtggctctgtccattctgcctcagggcgccctgacggtccggtgcggactaaaaagctgaagcgagggagacctggcaggaagaaaaaaaaggttctggggtgccctgccgtggctggagaagaggaagtcgatggatatgagaccgatcaccaggattattgcgaggtatgccagcaggggggagagatcatactgtgcgatacatgtcctcgagcataccaccttgtatgcctggatcctgagctggatcgcgcaccagagggcaaatggtcatgcccacactgcgagaaggaaggagtgcagtgggaggctaaggaagaggaggaagaatacgaggaggagggcgaagaggaaggcgagaaggaagaggaggacgaccacatggagtattgtcgcgtgtgcaaggacggcggggagttgctttgttgcgacgcctgcattagctcctatcacatacattgcttgaaccctccactacctgatattccgaatggcgaatggctgtgcccgaggtgtacatgccctgtgttgaagggtcgagtacaaaagattctccactggcgctggggagaaccccccgtggctgtgcccgcccctcagcaggctgacggcaaccccgatgtgccgcctccaaggcccctgcagggaaggtcggaacgggaattcttcgttaagtgggttggtctgtcctactggcactgttcttgggccaaagagctgcaactcgagatcttccatcttgtaatgtataggaattaccagaggaagaacgatatggacgagccgcctccacttgattacggatctggcgaagacgatggaaaatcggataagaggaaagttaaggaccctcattatgctgagatggaagagaaatactaccggttcggcattaaaccagaatggatgactgtacatagaataatcaatcactctgtggacaaaaagggtaactatcactaccttgtgaagtggcgcgacctgccctatgaccagagcacctgggaagaggatgagatgaacattcccgagtatgaggaacacaaacagtcttattggagacatcgggagctaattatgggcgaagatccggcgcagcctcgaaagtataaaaagaaaaagaaagagttacagggggatggaccccctagtagtcctactaatgaccctacagttaaatatgagacccagccaagatttatcactgcaacagggggtactttgcacatgtaccagctcgagggactgaactggcttcgcttctcctgggcacaaggcaccgataccatactcgctgacgagatggggctgggtaagacaattcagactatcgtgttcctgtactcattgtacaaggaaggacacactaaaggcccctttctcgttagcgccccattgtccaccatcatcaactgggaacgggagtttcaaatgtgggctccgaagttttacgtcgtgacatataccggcgataaagatagcagggctatcatccgtgaaaatgagttctcttttgaggacaatgccattaaagggggtaagaaagccttcaaaatgaagagagaggcccaggttaaattccatgttcttctaacctcgtacgagttaatcactatcgatcaagcagctctgggatcaattagatgggcgtgtcttgttgtggatgaggctcacaggctaaagaacaatcagtccaagttttttcgagtgttaaatggatacaagatcgaccacaagctactactgaccgggaccccattacagaacaacctggaagagctgtttcatctcttaaactttctcacacccgagagatttaataacctggaaggattcctggaagagttcgctgacataagcaaggaggaccaaattaagaagctgcacgacctcttggggccccacatgttgagacggctgaaggcagatgtgtttaaaaacatgcctgcaaagaccgagcttattgttcgagtggagcttagtcccatgcagaaaaagtactacaagtacattctaacgagaaatttcgaagctctgaattcacggggcgggggcaatcaagtaagcttgcttaacataatgatggacctcaagaaatgttgtaatcacccgtatctctttcctgtggctgccatggagagccctaaattgccaagtggggcctatgaagggggagctctcatcaaaagtagcgggaagttaatgctcttacagaagatgcttcgcaaattgaaggagcagggacatagagtactgatcttctctcagatgacaaaaatgctggacctgcttgaagatttcctagattacgaaggatacaagtacgagcgcatcgatggtggtatcaccggcgctctgcggcaagaggcaatcgacaggtttaatgccccgggggcacagcagttctgctttcttctttcaactcgggccggaggcctcggaataaacctcgcaaccgctgacacggtcatcatcttcgacagcgactggaatccccataatgacatccaagcttttagtagggcccacagaatcggccaggcaaacaaagtcatgatttatcgctttgttacccgcgccagtgttgaagaacgcataacccaggtcgcgaagcgaaagatgatgctcactcatcttgtggtgaggccaggtctagggagcaaagcgggctctatgagcaagcaagagcttgatgatatactgaaattcggcacagaagaattgttcaaggacgaaaatgaaggtgagaataaagaagaggacagctcagtcatccactacgacaacgaagccatcgccaggcttctggacagaaatcaagatgcaaccgaggatacagacgtgcagaatatgaatgaatatctcagctcattcaaagtggctcaatacgtggtacgcgaggaagataagattgaggaaatcgaaagagagatcattaaacaggaagaaaacgtagatcctgattattgggaaaagctcctgagacatcactatgagcagcagcaggaagacctggcccgtaatcttggaaagggaaagcgggtaagaaagcaagtcaactacaacgatgccgctcaggaagaccaagataatcagagtgagtacagcgtcggtagcgaagaggaggacgaggattttgatgagagaccggaaggccgtcgccagagtaagcgccagctgaggaacgaaaaggacaaaccactgccaccactcctagccagagtaggcggaaacattgaggtgctcggtttcaatactagacagcgtaaagctttcctaaatgccgtgatgcgttggggaatgccacctcaagatgcatttaccacacagtggcttgtccgcgacctgcgtgggaaaaccgagaaggaattcaaggcttacgtgtcccttttcatgaggcatctttgtgagcccggagccgatggcagtgaaactttcgcagatggagtaccacgcgaaggactttcgcggcagcaagtgttgacacgtattggtgtcatgtccctcgtaaaaaagaaagttcaggagttcgaacacattaatggtcggtggagcatgcccgagctgatgcccgatccgtccgccgatagtaaaagaagttcccgtgcctccagtcccacaaaaacaagccccactacccccgaagcctctgcgaccaactctccatgtacatccaagccagctaccccggcaccgtccgaaaagggtgaaggaattagaaccccactggagaaggaggaagccgaaaatcaggaagagaagccagagaagaattccagaattggagagaaaatggaaacagaagcagatgcaccatccccagcccctagcctgggtgagcgtctcgagcctaggaaaatccccttggaggacgaggtgccaggcgtcccaggagaaatggagccggagccgggctacagaggcgatagagaaaagtctgaagacgtgaaaggagaccgagagctcaggcctgggccccgggatgagcctcgatctaacggccgcagggaagagaagaccgagaagccacggttcatgtttaatatcgccgacggtggttttaccgaactgcacacgctttggcagaacgaggagcgggcggcgatcagtagtggaaagttaaacgagatttggcataggcgccacgattattggctgctggccggtatcgtgctgcacggttatgcgaggtggcaggatatccagaatgacgcccaatttgcaattattaatgagcccttcaaaaccgaggccaacaagggaaacttcctcgaaatgaagaataagtttctggctcgccggttcaagctgctcgaacaggcattagtcattgaagagcagctccgcagagccgcgtacctgaacttgtcacaggagcctgcccatcccgccatggcattgcatgctcgctttgccgaggcggaatgtctcgctgagagccaccagcacttaagtaaagagagcctcgcaggaaataagccagctaacgcagtgctgcataaggtgctgaatcagctggaggagctcttatcagatatgaaagcagatgtgaccagattgcccgccactctttctcgcatacccccaatcgccgctaggttgcagatgagtgagcgctcgatcctgtctagacttgcgtccaagggcactgagcctcatccgactcccgcttacccacctggcccatacgccacaccgccaggttatggtgctgcttttagtgcagcccctgttggtgctctcgcggccgcgggtgccaattatagtcagatgcccgccggcagtttcattacagctgcgaccaacggtccacccgttctggtgaagaaggagaaggagatggtcggggcgctggtgtcagacggacttgatcgcaaggagccacgcgctggcgaagtgatctgtattgatgactag

SEQ ID NO: 112129 - DNA, 6180 bp, Artificial Sequence
  Description of Artificial Sequence: Synthetic coding sequence
atggcatctcctctgcgggacgaggaagaggaggaagaggagatggtggtgtccgaggaagaagaggaggaggaggaggaaggtgatgaggaggaggaagaggaggttgaagccgcagatgaggacgacgaagaggatgacgacgaaggagtgctcggtagaggcccagggcacgatcggggtagagacagacatagcccgcctggctgccacctcttccccccacccccaccacctccgccccccctgcctccccctccacctcctccaccgccggataaggacgatatcagactcctgcccagcgcacttggcgtgaagaaaagaaagcgaggccctaagaagcagaaagaaaacaagccgggtaagccaagaaagcgtaagaagcgcgattccgaagaagaattcggcagcgagagagacgaatatcgagaaaagagtgagtctggaggcagtgagtacggcaccgggcctggacggaaacgaaggagaaagcaccgcgagaaaaaagagaagaaaaccaagcgccgtaagaagggcgagggcgacggagggcagaaacaggttgaacagaagtcatccgccacactactgctcacttggggtctcgaggatgtggagcatgttttttcggaggaagattaccatacactgactaattacaaagcattctctcaatttatgcgcccccttatcgccaaaaaaaacccgaaaattcctatgtcaaagatgatgaccattcttggagctaagtggcgggaattctcagccaacaatccctttaaagggtccgccgctgcagttgcagccgcagcagccgcagctgctgcagctgtcgccgaacaggtcagcgctgccgtgagtagtgctaccccaattgctccatctgggcctcccgctctccccccgcctcctgccgcggacattcagcctccccccatcagaagagccaagaccaaggagggtaagggacctgggcataaacggagaagtaaaagtccaagagtcccggatggtagaaaaaagctaagaggcaagaaaatggcgcccctgaagatcaagcttggtctgctgggtggcaaacggaagaaagggggcagttacgtgtttcagagtgacgagggccctgaaccagaggccgaggaaagtgatctcgactccggttctgtgcactccgcctcgggaaggccagacggtccagtgcggaccaaaaaactaaaaagaggacgccctggaagaaaaaaaaagaaagtcctgggctgcccggcagtcgcgggggaagaggaggtagatggttacgagacagaccaccaggactactgcgaggtttgccagcaaggaggggagataattctgtgcgatacctgtccccgagcctaccacttggtctgcctggatccagagctcgatcgggcgcccgagggcaagtggtcttgtccacactgcgagaaagaaggtgttcaatgggaggctaaggaggaagaggaagaatacgaggaagagggcgaagaagaaggagaaaaagaggaagaggatgaccatatggaatattgtagagtgtgcaaggacggaggcgaactgctgtgctgcgatgcatgtatcagctcttatcacattcactgtctgaatccgcccctgcccgacatccccaacggagagtggctgtgtccacgttgcacatgccccgtgctcaagggccgggtccagaagattcttcattggcggtggggtgaacctccagtcgcggtccctgctccacagcaagcggatggcaatcctgacgtccctcctccaaggccattgcaaggtcgcagcgagcgcgagttcttcgtcaagtgggtcggcctgagctattggcattgctcttgggccaaagagctgcaactcgagatattccacttggtgatgtatagaaattaccaaaggaaaaacgacatggacgaacctcccccgcttgattatggatctggtgaggacgacggcaagtctgataagcggaaagtgaaggatcctcattacgcagagatggaggagaaatactaccgatttggaatcaaaccggagtggatgaccgtccataggatcataaatcactcagtggataagaagggcaactaccattatcttgtcaagtggagggacctcccttatgatcaaagcacctgggaagaggacgagatgaatattccagaatacgaggaacacaaacaatcttactggcgacaccgggaacttattatgggggaagacccggcgcaacctcgcaagtacaaaaagaagaaaaaagagctgcaaggagacgggcccccttcgtcccctacaaatgatcctacggttaaatacgagacccagcctcgatttataaccgctactggcgggacccttcacatgtatcagttggagggattgaattggctgaggtttagctgggctcagggtaccgatacgatccttgcagacgagatgggactcgggaagacgattcagacaattgtgttcctctactctctctacaaggaaggccacactaagggaccctttctcgtgtcagcccccctttctaccataataaattgggagagggaattccagatgtgggcccccaaattttacgtcgtgacatacactggcgataaggacagcagagctataattcgggaaaacgaattttctttcgaggataacgctatcaaaggcggcaaaaaagcttttaagatgaaaagagaagcccaagtgaaatttcacgtgttactgacctcatacgagctgataaccatcgatcaggctgcactgggaagcatccggtgggcatgtctggttgtcgacgaggcacacaggctgaagaacaatcagtcaaaattttttagagtgctgaacggctacaaaattgaccacaagctgttgctaaccggaaccccacttcagaacaatctggaggaactgttccatctcctgaatttcttgacacccgaacgattcaataatctcgagggcttcctggaggaatttgctgacatttcaaaggaggatcaaattaagaagctacacgaccttctaggccctcatatgctaaggaggctgaaggccgatgtcttcaaaaacatgcccgcaaaaacagaactgattgtccgcgtggagctgagcccaatgcagaagaagtactataagtacatcttgacacgcaatttcgaagctcttaactccaggggaggtggcaaccaggtgtccttactcaatattatgatggatctgaaaaaatgttgcaatcacccctaccttttccctgtcgcagccatggagagccccaagcttccgtctggagcctatgagggtggagctctcattaagtcaagcggcaagctgatgctacttcagaagatgttgaggaaactgaaagaacaaggccaccgagtgctaatattctcacagatgaccaagatgctggatcttttggaagactttctggattacgagggctataagtacgagcgcattgacggaggcataactggagctctgcgtcaagaggccattgaccggttcaacgccccaggagctcagcagttttgctttctactttctactcgcgcaggtggtctaggaataaatttagctaccgctgacaccgtgataatctttgattctgactggaacccccacaatgatatccaagccttcagccgggcgcaccgcatcggacaggccaataaagtgatgatctacaggttcgtaacaagagcttccgttgaagagcggattactcaggtcgctaaaagaaagatgatgcttactcatctggtggtgagacccggcctgggctccaaggcagggtctatgtcgaagcaggaactcgacgacatattaaagtttggcacagaagagctctttaaagatgaaaacgagggtgaaaataaagaggaggactcatctgtcattcactacgataacgaagcaatcgctagattgctggaccgcaaccaggacgctaccgaggataccgacgttcagaatatgaacgagtacttaagttcctttaaggttgcccagtatgtcgtcagggaagaggacaaaattgaggaaatcgaacgcgaaatcatcaaacaggaggaaaatgtggatcctgactattgggagaagttgctccgacatcattatgagcaacaacaggaggacctcgctaggaatcttggcaagggtaaacgtgtccgcaaacaagtgaactacaacgacgcagctcaagaggaccaagataaccaaagcgagtacagtgtggggtccgaggaggaggacgaagattttgacgagaggccagagggaaggcgccagagcaagcgccagctgaggaatgagaaggataagcccctcccacctctcttggcgagggtcggtggcaacatcgaggttttgggttttaacacccgacagaggaaggccttcctaaacgcagtcatgcgctgggggatgccaccgcaggacgcttttacaactcagtggttagtaagagatctccgggggaaaacggaaaaggaatttaaagcctatgtgtcattgtttatgaggcacctctgtgagccaggcgcagacggttcagaaaccttcgccgatggagttccacgggagggcttgtctcggcaacaagtacttaccagaatcggggtgatgagtctggtcaagaaaaaggtccaggagttcgagcacataaatgggaggtggagtatgccggaactaatgcctgacccaagtgccgatagcaaacggagctctcgcgcttcttctcccacgaagacgagcccaaccacccctgaggcctcagcgacaaacagcccctgcacctccaagccagccactccagctcccagtgagaaaggtgaaggcataagaactcctctggaaaaggaagaggccgagaatcaggaggaaaagcccgagaaaaacagtcgcataggggagaaaatggagaccgaagccgatgccccttccccggccccaagcctaggggagcgactggagccccggaaaatcccactggaagacgaagtgccgggagtgccaggggaaatggagcccgagcccggataccgcggcgatcgagagaaaagtgcaaccgaatccaccccgggtgagaggggtgaagagaagccccttgacggccaagagcacagggagcgccccgaaggcgaaactggtgacctaggcaagagagaagatgtgaaaggcgatcgtgagttgcgccccggacctagagacgaacctcgttccaatgggagacgggaagagaaaacggagaaacctagatttatgttcaatatcgctgacgggggcttcactgaattacacaccctttggcagaacgaggagcgggcggcaatttcctccggcaagcttaacgagatttggcataggcggcatgactactggctcctggctggaatagttctccatgggtatgccagatggcaggacatacaaaatgacgcacagtttgcgattatcaatgagccattcaaaacagaggccaataagggtaatttcctggagatgaagaacaagtttctggcgaggaggtttaagctcctggagcaagctctggttattgaggagcagctgcgacgagccgcctatttaaatttgagccaggagcctgcccaccccgccatggcgctccatgcacgctttgcagaggcagagtgtctggccgagagccatcagcacctaagcaaggagagccttgcaggtaacaagccggctaacgcagtgttgcacaaggtcttgaaccagctggaggagctcctcagcgatatgaaggccgacgtgactcggttgcccgctacgctgagtaggattcctcccatagctgcacggttgcagatgagcgaaagatctattctgtcacgactggcatcgaaggggacagaaccccacccaacaccagcctacccgcctggtccttatgctacccctcccgggtatggcgccgccttttctgctgcacctgtgggggccctcgccgctgcaggagcaaattattcccagatgccagccgggtcctttattactgccgccacaaatggcccgccggttctcgtgaagaaagagaaagaaatggttggcgcacttgtcagcgacggcctggaccgcaaggaaccgcgggccggggaggtgatctgcatcgatgactag

SEQ ID NO: 112130 - DNA, 5865 bp, Artificial Sequence
  Description of Artificial Sequence: Synthetic coding sequence
atgcgaggaccagtggggaccgaggaggagttacctcgcttgttcgcagaagaaatggagaacgaggatgagatgagcgaggaagaggatggaggccttgaggcctttgacgatttctttcctgtagaaccagttagcttgccaaagaagaaaaagcccaaaaagctcaaggagaataaatgtaagggtaaacggaaaaagaaggaggggagcaacgatgagctgagcgaaaatgaagaggatcttgaggagaagtccgaatccgaaggcagcgactactcacccaacaagaagaaaaaaaagaagctgaaggacaaaaaggagaaaaaagccaagaggaagaagaaagatgaggacgaggatgataatgatgatgggtgcctcaaagagccaaagtcaagcgggcagctgatggccgaatgggggctcgatgacgtggattacttgttcagcgaagaagattaccatacccttaccaactataaggccttcagccagttccttaggccattaatcgccaagaaaaatcccaaaattcctatgtccaaaatgatgacagtgctcggcgccaagtggcgcgaattctcagccaacaacccgtttaaggggtctagtgctgccgccgctgcagccgcagttgccgcagccgtggagacagtcaccatctccccccccctggcagtgtcacctcctcaggttccccaacctgtgcccatcagaaaagctaagaccaaagaggggaaggggcccggggttcgcaagaaaatcaagggatcaaaagacggtaaaaaaaaaggaaagggtaagaagacagctgggctcaagttcagatttgggggaatatccaataagagaaagaagggatccagcagcgaggaggacgaaagggaggagtcggatttcgactccgcgtctattcactctgcaagcgttaggtcagaatgcagtgccgccctcggcaaaaaaagtaagagacgcagaaagaaaaagcggattgatgacggggacggctatgaaacagatcatcaagattactgcgaagtgtgtcaacaaggaggagagattatcctctgtgacacatgtccccgcgcctatcatcttgtgtgtctggacccagaactcgaaaaggctccagaggggaaatggtcatgcccacactgcgaaaaggaaggaatccagtgggaaccgaaagatgatgacgacgaagaagaagagggcggctgcgaagaagaagaagatgaccatatggaattctgtcgagtgtgcaaagacggcggcgagcttctttgctgtgacgcgtgtccaagctcatatcatctacactgtctgaatcccccattacctgagatccccaacggtgagtggctgtgcccccgctgcacttgcccacccttaaagggaaaggtgcagcggatcctgcactggcgatggaccgagccacctgctccatttatggtaggtcttccagggcctgacgtggaacctagccttcctccccccaaacctttagaagggattccagagagggaattctttgtaaaatgggcagggctgtcttattggcactgcagctgggtgaaggagctgcaactggaactgtaccataccgtaatgtacagaaactaccagcgcaagaatgacatggacgaacctcccccattcgactatgggtccggggacgaggacggaaagagcgaaaaacgcaaaaacaaggacccattgtacgcgaaaatggaagagaggttttaccgctatgggataaagccagagtggatgatgattcacagaatcctaaaccacagctttgataagaaaggggacgtgcactatctaattaagtggaaggatctgccctatgatcagtgcacatgggagatcgatgacatcgatattccatattacgacaacctgaaacaggcctattggggtcatagggaacttatgttaggtgaagacactaggctgcctaaaagactgctcaaaaagggaaaaaaattgcgggacgacaaacaggagaagccacctgataccccaatcgtggatcccactgtgaaatttgacaagcagccatggtacattgatagtactggcggaacccttcacccgtatcagctggagggcttaaattggctgcggttttcatgggcccaggggaccgacacaatcctagcggatgaaatgggcctgggtaaaactgtgcagacaatcgttttcctgtactcgttgtataaggaagggcattcaaagggcccctacctggtgagcgctccgttatccacaatcattaattgggaaagagagttcgagatgtgggcccctgacttctacgtcgtcacctatactggagataaagagtccagaagcgtgattagagaaaacgagtttagctttgaagataacgccattcgcagtggcaagaaagtgtttcgtatgaaaaaggaggtacagattaagttccacgtgttactgacgtcttatgaacttattacgatcgaccaggcaatcctaggttccattgagtgggcatgtctagtggtcgacgaggctcatcggctgaagaacaatcagtccaaatttttccgcgtactgaattcatacaagatcgattataagttgctgctgaccggcactcccctccagaacaatctcgaggagctattccacctgctcaatttcctgactccagagcgattcaataatctagaaggcttcctggaggaattcgccgatatctcaaaggaggaccagattaaaaagctgcacgatctgttagggccacacatgcttagaagacttaaggccgatgtgtttaagaatatgccggccaaaactgaactgatcgtacgggttgagttgagccaaatgcagaagaagtattataagttcatactcacccgcaatttcgaggccctgaatagcaagggcggcggtaaccaagtgagcctactgaatattatgatggaccttaaaaagtgttgcaatcatccatacctcttccctgttgccgccgtggaggcgcctgtgctacctaacggaagttacgacggatcatccctcgtgaaatcttctggcaaacttatgctacttcagaaaatgctaaaaaaacttcgggacgaggggcatagggtcctgatttttagccagatgacaaagatgctagacctgctcgaagattttcttgagtacgaaggatacaaatacgagcggatagatggcggcatcactggtggactcagacaggaggctatcgatcgcttcaacgcaccaggtgcgcagcaattttgttttctgctgtctacaagagccgggggcttaggcattaatttagctaccgcggacaccgttataatctatgactcagactggaacccacacaatgatatccaagcttttagtagagctcatcggattggacagaataaaaaagtcatgatctatcgcttcgtgaccagagcttccgttgaggagcgaattactcaggtagccaagagaaagatgatgttaacacatttagtggttcgccccggacttggctccaagtcaggaagtatgacgaagcaagagttagacgatatcctgaagtttgggacggaggagcttttcaaggatgacgtggagggcatgatgagtcagggacagagacctgtgacacctattcccgacgtgcagtccagcaagggcggcaatctagcagctagcgctaaaaaaaaacacggctcgactcccccgggcgacaacaaggatgtagaggacagttcagtaatccactatgatgatgccgccatttccaaacttttagaccgcaatcaggatgccactgacgacacagagttgcaaaatatgaatgaatacctgtccagcttcaaagtggctcagtatgtcgttagggaggaggacggggtagaagaggtggagcgtgaaataattaagcaagaggaaaacgttgacccagactactgggagaaactgctcagacaccattacgaacagcagcaggaagaccttgctagaaatctgggtaagggcaaacgcatcagaaagcaggtcaactacaatgacgcctcccaggaggatcaagagtggcaggacgaattaagcgataatcaatcggaatattctattggatcagaagatgaagacgaggattttgaggagagaccagaggggcagtctggacgccgccaatcccgcaggcagctcaaaagcgacagagataagcctttacccccactgctcgcccgggtgggtggcaacattgaagtgttgggatttaacgcccggcagcgaaaggcatttctaaatgccataatgcgctggggcatgccgccacaggacgcttttaactctcattggctggtgagagatctgcggggcaagtccgagaaagaatttcgtgcatatgtgagtctttttatgcgacacctttgcgagcctggggcagatggtgcagagacttttgccgacggagtgcctcgtgagggcctttcgcggcagcacgttctgactaggatcggggtgatgtccttagtaagaaagaaggtccaagagttcgagcatgttaatggtaagtactcaactcccgacctgattcctgaaggacctgagggcaaaaaatcgggggaggtgatcagtagtgaccccaatacacctgtccctgcaagccccgcccacctgctgccagccccgttggggctccctgacaagatggaggcccagctggggtatatggacgagaaagacccaggcgcccagaaaccgaggcagcctctggaggtgcaggcactcccagccgcacttgatcgcgtcgagagtgaagataagcacgaatccccagccagtaaagagcgggcgagggaagaaagaccagaggagaccgagaaggcaccgcctagccccgaacagctgccaagagaagaggtgctgccagagaaagagaagatcctcgacaaactggagctcagtttgattcacagtcggggcgatagctccgaactgagaccagatgacacaaaagcagaggaaaaggagcccattgagacccaacagaacggggacaaggaggaggacgatgaaggcaagaaggaggacaagaaaggtaaattcaaatttatgttcaacattgccgatggcgggttcaccgagctgcatactctgtggcagaacgaggaaagagctgctgtcagttctggcaaaatctacgacatttggcacaggagacacgattattggctgcttgccggcatcgtgactcacggctacgcccggtggcaggacatccaaaatgacccacgatatatgattctgaacgagccatttaaatctgaggtgcacaagggaaactacttggaaatgaagaacaaattccttgccagaaggtttaaactcctcgaacaggcgctcgtgatagaggaacagttacgccgcgcagcttacttgaacatgactcaggatcccaaccatcccgcaatggccctgaacgcccggcttgccgaagtggagtgcttagcagagtctcatcagcatttgtcaaaagagtccttggcggggaacaagccggcgaacgctgtcctccacaaggtgctcaatcaactggaggaactgctcagcgacatgaaagcagacgtgaccaggctaccttcaatgctatccaggatacctcccgtggctgctcggctgcagatgagcgagcggtctatactttcccggcttaccaatcgggccggcgatcctaccatacagcagggggcctttggatcttcgcaaatgtattctaataattttggacccaactttcggggacccgggcctggaggcatagtcaactacaaccagatgcccctgggcccctatgtgactgatatttag

SEQ ID NO: 112131 - DNA, 2427 bp, Artificial Sequence
  Description of Artificial Sequence: Synthetic coding sequence
atgatctaccggtttgttacaagagcgagcgtagaggagagaattacacaggtggcaaagagaaagatgatgctgacacacctggtggtgcgccccggacttgggagcaaatctggaagcatgacgaagcaggagctggacgatatcttgaaatttggaaccgaagagctttttaaggatgacgttgaaggaatgatgtcccaaggccagcggcctgtgaccccaataccggacgttcagagttcgaagggcggaaatttagccgcgtccgcaaaaaagaaacatgggtcgactccacccggggacaacaaagacgtggaggatagtagtgtcatacactatgatgatgctgctatcagcaagttgttagatagaaatcaagatgccaccgacgacactgaactgcagaatatgaacgaatatctctcctcgttcaaagtggcccagtacgtcgtacgagaagaggacggagtagaggaagtggagagggagattattaaacaggaggagaatgttgaccctgactattgggagaaactacttcgtcaccattacgagcagcagcaggaggacctggctagaaatcttggcaaggggaagcgcatacgcaagcaggtgaactacaatgacgcttctcaggaggaccaggagtggcaagatgaattgtctgacaaccagtctgagtatagcatcggctctgaagatgaagatgaggacttcgaggagagacctgaaggtcagtctggtagaaggcagtcaagaaggcagctcaagtctgacagggacaaaccgctgccccccctgttagcaagggtcggtggcaatattgaagtgctggggtttaatgcccggcaacgcaaagcgtttctgaacgctattatgcgctggggaatgcccccacaagacgcttttaatagtcattggttggtccgggacttgcgcggtaaatccgaaaaggaatttagggcgtacgtgagccttttcatgcggcatttgtgcgagcctggggcagacggggcagaaacttttgctgatggcgtgcctagagagggactcagtcgacagcatgttttaactagaattggagtcatgtcattggtacgcaaaaaggttcaagagttcgagcatgtcaacggtaaatacagcactccagatctgatcccagagggcccagagggtaaaaagagcggggaggtcatctcgtcagatcccaacacaccagttcccgcatcacctgcgcatctgctgccagctccgctgggattacccgacaaaatggaggcacagctgggttatatggatgaaaaagacccgggggcacaaaaacccaggcagcctctagaagtccaggcactgccagcggccctggacagagtcgagtctgaggataagcacgagagcccggccagtaaggagagagcacgggaagaacggcccgaggagacggaaaaagccccaccatcgcccgaacagttgccccgagaagaagtcctgccggaaaaagagaagatcctggataagctggaactgagtctgatccacagccggggggatagctctgagctgagacccgacgacacaaaggccgaagagaaggagccgatcgaaacccaacagaacggagataaagaggaagacgacgagggaaaaaaggaggataagaagggaaagttcaagtttatgtttaacatagccgatggcggctttacagaactgcacaccctttggcagaatgaggagcgcgcggccgtgtcttccggcaagatctatgacatctggcataggcggcacgactattggttgctggccgggatagtgacccatggctacgcccgatggcaggatatccaaaatgaccctcgctatatgatcctgaatgagccattcaagagcgaagtgcataagggaaactatttagaaatgaaaaacaaattcctggccagacgatttaagctgctagagcaagcgctggtaatcgaagagcaactgcgtagagctgcctatcttaatatgacgcaggaccccaaccatcccgcgatggccctgaacgcacgcttggccgaagtcgagtgcctcgccgagagccatcaacatctatctaaagaatcattagcgggaaataagcccgcaaatgcagtgctccacaaggtccttaaccagctggaggaactgcttagcgacatgaaggccgacgtgactagactgccatcaatgctctcacgaataccgcctgtggcagcacgtctacagatgagtgagagaagtattctcagtcgcctcacaaaccgggcaggagatcccacaatccagcagatctcctcccgtccacgcgactttcctgttttacagcgatcattcccagccgagccacgccttcccggccacctgcctgatccacacggacgcgagaagctcccacccttctag

SEQ ID NO: 112132 - DNA, 3588 bp, Artificial Sequence
  Description of Artificial Sequence: Synthetic coding sequence
atggttggactgccgggccctgatgtggagcctagtcttcccccccccaagcccctcgaagggatacctgagcgggaattcttcgtgaagtgggccggcttgagctattggcactgcagttgggtgaaggagcttcaactggaactttaccacaccgtcatgtatcgcaattaccagcgtaagaacgacatggatgagccgccaccgttcgattacggatctggcgacgaagacggcaaaagtgagaaaaggaaaaacaaagaccctctttacgcaaagatggaagaacgcttctaccgttacggcatcaagccagagtggatgatgattcatcgaattctgaatcatagcttcgataagaagggagatgtgcactatctgataaagtggaaagatctgccatatgaccagtgtacttgggaaatcgatgacattgatataccttactacgataatctcaagcaagcgtactggggccatcgcgagctgatgctgggagaggatacaagattgcccaagcggctcctgaagaagggcaaaaaacttcgagatgacaagcaagagaaaccacctgacacacctatcgtggacccgacggtgaagtttgataaacagccttggtacatcgactctactggtggtacgcttcatccatatcagttagaaggcctgaactggctaagattttcctgggcccagggcacagacaccatattagcggatgagatgggactgggaaaaacagtgcagacaatcgtctttctctacagtctctacaaggagggccactctaagggcccgtatctcgtgtcggcacccctgtctaccattattaattgggagcgggaatttgaaatgtgggctcccgacttttatgtcgttacttatactggggataaagaaagtcggtcggtcattagggagaatgaattctcctttgaggacaatgcaattcggtccggtaaaaaggtgttccggatgaagaaagaggtgcagatcaagttccacgtactgctgacatcgtacgaactcataacaatagatcaggctattcttggatctatcgagtgggcctgtcttgtggtcgacgaagcacaccgccttaaaaataaccaatcaaaattttttcgggtccttaattcgtataaaatcgactataagttgctgcttaccggaacgcccttacagaacaacctggaggaactctttcacctgctgaatttcctcacaccggagaggtttaataatttggaggggttcctggaggagttcgccgacatctcgaaagaggaccagattaaaaagttgcacgatctgctgggcccccatatgcttagacggcttaaggccgatgtgtttaagaacatgcctgccaaaacagaattaatcgtgcgtgtggaattaagccaaatgcagaagaagtactataaattcattcttactcgaaatttcgaggcactcaactcgaagggaggtggaaatcaggtcagcctgctcaatattatgatggatcttaaaaagtgttgtaatcatccttacctgtttcccgtggcagcggtcgaggcacctgtgcttcctaacgggtcatacgacggctcttccctcgttaaatccagtgggaaactgatgctgcttcaaaaaatgctcaagaagctgcgcgacgaagggcaccgtgtccttatcttttcccagatgacaaagatgctggatctgcttgaggattttttggagtacgaaggatacaaatatgaacgaattgatggaggcatcacagggggactgaggcaggaagcaatagaccgatttaacgccccaggggcgcagcagttttgtttcctgctgtccacaagagccggagggctgggcataaacctggccacagcagataccgtgatcatttatgattctgattggaacccccataatgatattcaagctttcagcagggcccaccgaataggacaaaacaagaaggtgatgatatacaggttcgttacccgcgccagcgtggaagagcgcattacccaggttgctaagaggaaaatgatgctgacccacctcgtggtgagacctggtctgggttccaaatccggtagcatgaccaaacaggagctggacgatattctcaagttcggtacagaagagctattcaaagatgacgtagaaggcatgatgtcacaaggacagcgtcccgttactccaataccagacgtgcagagtagtaaaggtggtaatttagccgctagtgccaagaagaagcatggcagtacccctcccggtgataacaaagacgttgaagactcatctgtcattcattacgacgatgcagccatttccaagcttttagatcggaaccaggacgccaccgatgacaccgagctgcagaatatgaacgaatatctgagttccttcaaggtcgcccagtacgtggtgagggaggaggacggcgtggaggaggtagaacgggaaatcattaaacaggaggagaacgtcgacccggattactgggagaaactcctgagacatcattatgagcagcagcaggaggacctggcccgtaacctcggcaagggaaaacgcatcaggaaacaagtcaactataatgatgcttcccaggaggaccaagagtggcaggacgagttgagtgataaccagtcagagtactccatcggttctgaagatgaggatgaagacttcgaggagagacccgaaggccaatctggtcggcgacagagcagaagacagctgaagagtgatagagataagcctctgccccctctcttggctagggtaggcgggaatattgaagtgctgggatttaatgcacgccagcggaaagccttcctgaatgctataatgcgatggggaatgcctccacaggatgcttttaattcccactggctggtccgggatttgcgaggcaaatcggaaaaggagttcagagcctatgttagcctgttcatgcgccacctatgcgaacctggggccgatggcgcagaaacattcgccgacggtgttcctagggagggcttgtcccggcaacatgttctaacccgtatcggtgtcatgagcctcgtcaggaaaaaggtgcaggaattcgaacacgtgaatggaaaatactcaactcctgacttgatcccagaaggcccagaaggtaaaaagtcgggcgaagtcatctcttctgaccctaatacacccgtccctgctagcccggctcacctcctaccagcccccttaggcctgcctgacaaaatggaggcacagctgggttacatggacgagaaagaccccggtgcccaaaaacccaggcagccgctggaggttcaggctcttccagcggcactagatcgggttgaatcagaggacaagcacgaaagccccgcctccaaggagagagctcgcgaagagcgccccgaacagaccccgcctgctcaggcgcaactgaggggggggcggcccctgtccccaggaaccgcacctgggtggcagagggaaggaccggggcttggggccaggagagctcgcagtccatctcagggcgggcctggcggaggcgggtcttcctttggatctcaggcacctctttag

SEQ ID NO: 112133 - DNA, 2427 bp, Artificial Sequence
  Description of Artificial Sequence: Synthetic coding sequence
atgatctatcggtttgtgacgcgagcatccgtagaggagagaataacacaggtggctaaaaggaaaatgatgttaactcacctggtcgtcaggcccgggctgggctctaaatccggatcaatgacaaaacaggagttggatgatattttgaagttcggtacggaagagctgttcaaagacgacgtcgaaggcatgatgagccagggtcaacggccggtgacgccgatccccgatgtgcagagttcaaagggaggcaatttagccgcgagtgcaaagaaaaaacacggctctacacctcccggcgacaataaggacgtggaagatagctccgtgatacattatgatgacgctgctattagtaaactgctggatagaaaccaggatgccacagacgacaccgagctgcagaacatgaacgaatacctgtcctcttttaaggtggcccagtatgttgtgagggaagaagatggggtcgaggaggtagagcgggaaataattaaacaggaggaaaatgtcgaccctgactactgggagaaactcctaagacaccactatgagcagcagcaggaagacctagctaggaaccttgggaagggtaagcgaattcgtaaacaggtaaactacaatgacgccagccaggaggaccaggagtggcaggacgagctcagtgataatcagtcagaatacagcattgggagcgaggacgaagacgaagatttcgaagagcgacccgaaggccagtcaggtagacgccagagcaggcggcagctgaagagcgaccgcgacaaaccgctcccacccttattagcccgagtcggaggcaacatcgaggtgctgggcttcaatgcacgacagagaaaggcttttttgaacgctattatgcggtgggggatgccaccacaagatgcattcaacagccattggctggtgcgagaccttagaggaaagagcgagaaggagtttagagcctatgttagtctgttcatgagacatttgtgtgagcctggagcagacggggcagaaaccttcgcagatggcgtccctagagaaggcctaagccgacaacacgtgctgacaagaattggcgtgatgagcctcgtgcggaaaaaggtccaggagtttgaacatgtcaatggcaagtatagcactccagatttaatacccgaagggccagaagggaagaagagcggcgaggtgatcagctctgaccccaatactcccgttcctgcctctccggcacacctcttgcccgcccctctgggccttccagacaagatggaggcccagctgggctacatggacgagaaggatcctggcgcacagaagcccaggcaacctcttgaggttcaggccctgcccgctgccctagacagggtcgagtctgaagacaaacatgagtcccctgccagtaaggaacgagcaagagaggaacgaccagaggaaacagagaaggccccaccatcgcctgagcaactaccgcgagaggaagtgctccccgaaaaagagaagatattggataagctggaactttcactcatccacagtcggggagacagttccgaattgaggccagatgacaccaaggctgaagagaaagaacctatcgaaacccagcaaaacggtgataaggaggaggacgatgaaggaaaaaaggaagacaaaaaagggaaattcaagttcatgtttaatattgctgacggcgggttcaccgagctccacacactctggcagaacgaagaacgggcagctgtctcttccgggaaaatttatgatatttggcacagaagacacgactattggctcctggccggcatcgtgacgcacggatatgctcgttggcaggatatccagaacgatccaaggtatatgatattaaatgagccgttcaaatctgaagttcataagggcaactatctggaaatgaaaaacaagtttttagctcggcggtttaagctcttggaacaggcgctggtgattgaggaacaactgcgccgcgctgcctacctcaacatgacacaggatcccaatcaccctgctatggctctgaatgccagactggccgaagtcgaatgtttagctgaatctcatcagcacctgagcaaagaatccctggccgggaataagcccgccaacgcagtcctgcacaaagtactaaatcagcttgaggagttactctctgatatgaaggcagacgtgactagattaccctctatgctgagccgaatcccaccagtcgccgccagactacagatgtccgaacgtagcattctcagccgtttgaccaaccgggcaggcgatccaacaattcagcagatctcctccagacctagagattttcccgttttgcagcggagtttccctgccgagcctaggctacctgggcacttaccagacccccatggtagagagaagttgcctccattctag

SEQ ID NO: 112134 - DNA, 3288 bp, Artificial Sequence
  Description of Artificial Sequence: Synthetic coding sequence
atgattcatcgtatcctgaatcacagttttgacaagaagggggacgtgcactacctgattaagtggaaggatctaccgtacgaccagtgcacttgggagatcgatgatatagacattccgtactacgacaacctgaaacaggcctactggggacacagagagctcatgctcggcgaggataccagactgcctaaaagacttttgaagaaaggcaagaagctgagagacgataagcaggaaaaaccgccggacacccccatagtggatcctactgttaagtttgataaacagccatggtacatagatagtactgggggcacactgcacccttatcagcttgaaggcctgaactggctgcgattttcatgggcccagggaactgatacaattctagcagatgaaatggggttgggcaaaaccgtgcagacaattgtcttcctttattcactgtataaagagggccacagcaaggggccctatcttgtgtccgcccctttgtccacaatcataaattgggagagggaatttgaaatgtgggcaccagacttttatgtagtgacctacactggcgataaggaatctcggtcagtaattcgcgaaaatgagttctcttttgaagacaacgctatccgatccggcaagaaggtgtttagaatgaagaaggaagtccagataaaattccacgtgcttctgacgagctacgagctgattactatcgatcaggccatcctaggatccatcgaatgggcctgcttggtcgtcgacgaggcccatcgcctgaagaataatcagagtaaattcttcagagtactcaattcctataaaatcgattacaaattgttacttaccggaaccccgttacaaaacaaccttgaagagttattccatctgctgaacttcctgacaccagaacggtttaacaatctcgagggatttctggaggaatttgctgatatcagcaaagaagaccaaattaagaagctgcacgacctactgggaccgcatatgctgagacgactgaaggccgacgtattcaaaaatatgccagccaagactgaactgatcgtgcgagtggagctttcccaaatgcagaagaaatactacaagtttatcctgactcggaatttcgaagctttgaacagcaagggtggggggaaccaggttagcctgctgaatattatgatggatctgaaaaagtgctgtaatcatccttatctctttccagtggcagctgtcgaggctccagtcctgcctaacggctcatacgacggctctagcttagtgaaaagctccgggaagttgatgctgttgcagaaaatgcttaagaagctgcgcgatgagggtcacagagtgctcatttttagccagatgaccaaaatgttagatcttcttgaggactttctggaatacgaaggttacaagtacgaaagaatagatggcggaatcaccggggggcttcgacaggaggccatcgatagattcaacgcgcccggagcacagcagttctgctttctgctctccacacgagccggtggcctaggaataaatctggccaccgccgatacagtgatcatatatgattcagattggaatccccacaacgatattcaggcattctctagagcacatcgtatcggacagaataagaaagtaatgatctatcgattcgttacacgagcctccgttgaggagcgcattactcaggttgcaaaaaggaagatgatgttaacccaccttgttgttaggccaggtctcggctccaagagcggatcaatgacaaaacaagaactcgacgacattctgaagttcggtactgaggagctctttaaagacgatgtggagggcatgatgagccaagggcaacgccctgtcactcccatccctgatgtgcagagtagcaagggtggcaatttagccgcatcggccaaaaagaaacacgggagtacaccacccggggacaacaaagatgttgaggattcgagtgttatccactatgacgacgccgcgatcagcaagctgctggatagaaatcaggatgctaccgatgatacagagctccagaacatgaatgaatatctctcgagcttcaaggttgcccaatatgtagttagagaggaggatggagtagaagaagtggagagggaaatcattaagcaggaggaaaacgtggatcccgattattgggaaaagctgctgcggcatcattatgagcagcaacaggaggatttggcgagaaacctgggcaaaggcaaacggattcgcaagcaggtcaattacaacgacgccagccaggaggatcaggagtggcaggatgagttatctgataaccagtcggagtacagcattggaagtgaagatgaagatgaggacttcgaagagagacccgaaggacaaagtgggagaagacagagtcggaggcaactgaagagtgaccgggacaaacccctccctcctttacttgcccgcgtcgggggcaatatcgaagttctcgggttcaacgcacggcagagaaaggcctttttgaatgccattatgcgttggggtatgcctccacaggacgccttcaactcacattggctggtcagagacctgagaggcaaatccgaaaaagagttcagagcctacgtcagtctctttatgcgccatttatgtgagcctggagccgacggggccgaaacatttgctgatggtgtgcctcgcgaggggttgtcacggcaacacgtgttaacgcgcataggcgtgatgtcactggtccgcaaaaaggtccaagagtttgaacacgttaatggtaaatactccaccccagatctaatcccagaaggacccgaaggcaagaagagtggagaggtgatatcctctgaccccaatacgcccgtaccagcatctccagcccaccttctgcctgctcctctcggcctaccggacaagatggaagcacaacttgggtatatggacgaaaaagaccccggagcacagaagcctagacagcccctggaagtgcaagctctacccgctgctctggacagggtggagtccgaagataaacatgaatcaccagcgtccaaagaacgcgcccgcgaggaacgcccagaagagaccgaaaaagcccccccctctccggagcagcttcctagagccagctgttccgtaactcaggctggggtgcagtggcggcaccgcttgatgggagctttcatctcatcggcccaggctaccctgccaccacagctgcccgagcagagaagatgctttctcaggcggaggcggtcttggacatcgtggagttag

SEQ ID NO: 112135 - DNA, 3258 bp, Artificial Sequence
  Description of Artificial Sequence: Synthetic coding sequence
atgatccatcgcattctgaatcactctttcgataagaagggagacgtgcactacttgatcaagtggaaggacctgccgtatgatcagtgtacttgggagattgacgacatcgatataccatactatgataatctgaaacaggcgtactggggtcaccgcgaactgatgttgggggaggatacccgacttcccaagcgattactcaagaaggggaagaagctccgggatgataagcaggagaagcctccagacacgcctattgtagaccccaccgtcaagttcgataagcaaccttggtacatcgacagtaccggcggcaccctgcatccatatcagctcgaagggctgaattggctgcgcttttcctgggcacagggaacagacacaatactagccgatgaaatggggcttggcaaaaccgttcagactattgtgttcctctacagcctctacaaggagggtcattcgaagggtccttacttagtgtctgcccccctgagcacgattataaactgggaacgcgagtttgaaatgtgggctcccgacttttatgtagtgacatataccggagataaggaatccagatccgtgattcgcgagaacgagttttccttcgaggacaacgctattcggtccgggaagaaagtgttccgcatgaagaaggaggtccaaattaagttccatgtgcttctgacaagctatgaactgataacaatagatcaggccatcctgggaagcatcgagtgggcatgccttgtggtggacgaggctcacagactgaagaacaaccagtctaaattctttcgagttctcaactcctataagattgactacaagctgttgctgacaggcacgccgcttcaaaacaatctggaagagttgtttcaccttctaaacttcctgaccccagaaagatttaataatctggaaggctttttggaagagttcgccgatatctccaaagaggaccagatcaagaaactgcacgatctgttgggtcctcacatgctgcgacggcttaaagctgacgtctttaagaacatgcccgcaaagactgaacttattgtgcgcgtcgaattgagccagatgcagaaaaaatactataaatttattctaacacggaatttcgaggctttaaatagcaagggtggtgggaaccaggtgagcctcctcaacatcatgatggacctgaaaaagtgctgtaatcatccttacctgttccccgtcgccgcggtcgaggctccagtgctgccaaacggaagctacgatggtagctcactggtgaaaagctccggtaaattaatgctgctgcaaaaaatgctcaaaaagctcagggacgagggacaccgcgtcctaatcttttcacagatgacaaaaatgcttgatttattggaggacttcctagagtatgagggatacaagtacgaaaggatcgacggtggcatcactggaggcctgcgtcaggaggcaattgataggtttaacgctccaggcgcccagcagttttgctttctgctgagtacgcgcgccggtgggctgggaatcaatctcgccactgccgacacagtcatcatctatgactccgattggaaccctcacaatgacatccaggctttctccagggctcaccgcatcggacagaacaaaaaagtgatgatttaccgattcgtgacacgagcttccgtggaagagagaattacacaggtcgcgaaacggaagatgatgcttacccatctggtggtcaggcctggtcttggcagtaagagcgggagcatgaccaaacaagaactggatgacattttaaagtttgggacagaagaactctttaaagatgacgtggagggcatgatgtctcagggccagcggccagtgacacccattcccgacgtgcaatcatcgaaaggtgggaacctagctgccagtgccaagaagaagcacggcagcactccccccggcgataataaggacgtggaggactcttctgtgattcactatgatgacgctgctatatcaaaactgctggaccgaaaccaggacgcgactgatgatactgagttgcaaaatatgaatgaatacctgtccagctttaaggtggcccagtatgtagtgagagaggaggatggtgttgaggaggtagagcgtgagatcattaaacaggaagagaacgtagacccagattactgggaaaagcttctgaggcatcactacgaacagcagcaggaggacctggcccgcaacctgggcaagggcaagcgcatcagaaagcaagtgaattataacgatgcatcccaagaagaccaggagtggcaagacgaactgagcgacaatcagtctgagtacagtattggatcagaggacgaggatgaagattttgaggaacggcctgaggggcagagtggccgccggcagtccagaaggcagctgaagagcgaccgtgataagcccctacccccattactagcccgggttggcggcaacatagaggtgcttggcttcaacgccagacagcgaaaagcctttctaaatgcgatcatgcggtggggaatgcccccccaagatgcattcaattcacattggttggtgcgcgatcttagagggaagtctgagaaggaattccgcgcatacgtgagcctgtttatgaggcatctgtgtgagccaggggccgatggtgctgaaacttttgctgacggtgtgccacgcgaaggtttgtcacggcagcacgtgttgaccaggataggagtcatgagtttggtaaggaagaaagtccaggaattcgagcacgtcaatggaaaatactccacacccgacttaatcccagagggccccgaggggaaaaaaagtggagaagtgatttcaagtgatcccaacacacctgtccccgctagcccagctcacctcttacctgctcccctcggtttacctgataagatggaggcccagctggggtatatggatgagaaggatccaggggctcagaagcctagacagccacttgaggtccaagccctgccagctgcgctggatagggttgagtccgaagacaagcacgagtcgccagctagcaaagaaagggctagagaggagagaccagaggagacggagaaggcccccccttctcccgaacagctcccgcgggccagttgttccgtaacgcaagccggggtgcagtggaggcacctgggatcctgggaacccctgtcaccccgactcaagcgccctagtcacctttcgttcctcaatagagggggggcatcgtag

SEQ ID NO: 112136 - DNA, 8994 bp, Artificial Sequence
  Description of Artificial Sequence: Synthetic coding sequence
atggccgaccctggaatgatgtccttgtttggcgaagacgggaacatcttctccgaaggcctcgaaggcttaggggagtgcggctatcctgagaatcccgttaatcctatgggccagcaaatgcctattgaccaggggtttgcctcccttcagcctagcctacaccatccttcaacaaatcagaatcagacgaagcttacccacttcgaccactacaaccaatatgagcaacaaaagatgcaccttatggaccaacctaatcgtatgatgtccaacaccccgggcaatggacttgcgagtccacatagccagtatcacaccccccctgtgccgcaggtgccccatgggggctcaggcggaggacaaatgggcgtgtacccaggtatgcagaacgagagacacgggcagtcatttgtcgatagctctagcatgtggggccctagggcagttcaagtgcccgaccagatccgggcaccatatcaacagcaacaacctcagccccagccgccacagcccgcgccttccggaccaccagcacagggacaccctcagcatatgcagcagatgggatcatatatggcccgcggggacttcagtatgcaacaacacggacagcctcagcaaagaatgtcccaattttcgcagggccaggaagggctcaaccagggaaacccatttatcgccacgagcggccctggccatctgagtcacgtgccccagcaatcaccctctatggctccctctctaaggcattccgtgcagcaattccatcaccacccatcaacagcactgcatggggagtctgtcgcacacagtccccgcttttcacctaatcctcctcaacagggggctgtgagaccacaaacccttaatttttcctctcggtcacaaacggtgccttctcccaccattaacaactcggggcaatactctcgatatccgtattcaaaccttaaccagggtctagtcaacaacactggtatgaaccagaatctgggtctcacaaataacacacctatgaatcagtctgtccctcgctatccgaacgctgtgggctttccttccaattccggtcagggtctcatgcatcaacaacctatccacccgtcagggagcttgaatcagatgaacacacaaacaatgcacccctcccagccccagggcacttacgcctcgcctcctcccatgtcccccatgaaagcgatgtcaaatccggccggcactcccccacctcaggtgagacccggctcagcaggtatccctatggaagtgggttcatatccaaatatgccacatccgcagcccagtcaccaaccccccggcgctatgggtattgggcagcgtaacatggggccaagaaatatgcagcaaagcaggccgttcattgggatgagtagtgcacccagagagctcacaggccatatgagaccaaatggttgtcctggtgtcggactgggggacccccaggcaatccaggagcggctcatccccgggcagcagcaccctgggcagcagcctagctttcagcagctaccaacatgtccaccactgcagccccatcctgggctccaccaccagtcctctcctccacacccacatcatcagccctgggcccagctccatcccagcccccaaaatacccctcaaaaggttcccgtgcatcagcactcgcctagcgaaccgtttctggaaaaacccgtgccagacatgacccaggtatcgggccctaatgcccagttggtaaagtccgacgattacctcccaagtatcgaacagcagcctcagcagaaaaaaaaaaagaagaagaacaaccacattgttgcggaagatcccagtaagggattcgggaaggatgacttccctggcggcgttgacaatcaagagctaaatagaaattcgttagacgggtcacaggaagagaagaagaaaaaaaagagaagcaaggccaagaaggaccccaaggagccaaaagaaccaaaagaaaaaaaggaacccaaagaaccaaaaactccaaaggcccctaagattcctaaagagcctaaagagaaaaaagcaaagaccgccacccccaaacctaaatcgtcaaagaagtcctccaacaaaaagcctgattcggaagcgtctgcgttaaagaaaaaagtgaataaaggtaagacagagggtagcgagaactctgatctggacaaaaccccgcccccctcaccaccccctgaagaagacgaggacccgggtgtgcagaagcgtcgctcgtctcggcaggtgaagagaaagcggtacacggaggatctagaattcaagatcagcgacgaggaggcagatgacgccgatgcagcaggcagagactccccgtcaaacacttcacagagtgaacaacaggaaagtgtggacgcggaaggccccgtggtcgagaagatcatgagttctcgatctgttaaaaaacagaaagagagcggcgaggaagtggaaatcgaggagttttacgttaaatataagaacttttcttacctgcactgccagtgggcctctatagaggaccttgaaaaagataaaagaattcagcaaaagattaagaggttcaaggccaaacagggacagaacaagtttctctcagagatcgaggatgagttattcaaccctgattatgtggaggtcgacagaattatggacttcgcccgatcaacagacgatcgcggagagcctgttacccactatcttgtgaaatggtgcagtctgccatacgaggattccacgtgggagcggagacaagatattgatcaagctaagatagaggagttcgaaaagttgatgtctagagaacccgaaaccgaaagggtggagcgtcctcccgcagatgattggaaaaagtctgagtccagtagagagtataagaataacaataaactgcgcgaataccaactagagggggttaattggcttctgttcaattggtacaacatgagaaactgcatcctggcagatgaaatgggcctggggaaaactatccagagcataactttcctgtacgaaatttaccttaaggggatccatggcccattcttagtgatcgctccccttagcaccatcccaaactgggagagagaatttcgcacctggactgaacttaatgtagttgtgtaccacggcagccaggctagccggcggacgatccagctatatgagatgtattttaaagatcctcagggcagagtcattaagggttcttataagttccacgccattatcaccactttcgaaatgatactcacagactgccccgaactgaggaatattccctggcgctgcgtggtgatcgatgaggctcatagattaaaaaacagaaattgtaaactcctagagggacttaagatgatggatctcgagcacaaggtgctcctgaccggcaccccactgcagaataccgtagaggagctgtttagccttcttcacttcctggaacccagtcgcttcccatccgaaaccacttttatgcaggaatttggagacctgaagaccgaagagcaggtccagaaactccaggccattttgaagccaatgatgctccgaagattgaaagaggacgtagagaaaaaccttgctccaaaagaagagacaatcatcgaagtggagctcaccaacattcagaagaagtactacagagccattttggagaagaactttacattcttgagtaaaggtgggggccaggcgaatgtcccaaacctgctaaacaccatgatggaattgagaaaatgttgtaaccatccatacttgatcaacggagccgaggagaagatccttgaggagttcaaagagacacataatgctgagtctcctgactttcagctgcaagccatgattcaggccgcagggaaattggtcctaatcgacaaactgctccccaagctgaaggcggggggacatagggtactgatctttagccagatggttcggtgcttggatatcctggaggactacctaattcagaggcgctacccttatgagcggattgacggccgcgtgcggggcaacttaaggcaagccgctattgatcgcttctcgaaacccgattccgaccgcttcgtatttctgctgtgcacccgggctggtggcctgggaatcaatctgactgctgccgacacatgtataatcttcgacagcgactggaatccccagaacgacctgcaggcacaggcaagatgtcaccggattggacagagtaagagtgtgaagatctacagactcatcaccaggaatagttatgagcgtgagatgttcgacaaagcctctctgaagctaggactcgataaagccgtgctgcagagcatgagtggaagggagaatgctaccaacggcgtccagcagttgtcgaaaaaggaaatcgaggatctgctgcgaaagggagcttatggtgcgctgatggacgaagaagacgaggggagtaaattctgcgaagaagatattgatcagattctactcagacgcacacacacgataacaattgagtcggaagggaaaggtagcacttttgccaaggcctcatttgtggccagtggcaataggactgatatctccctggacgaccccaatttctggcagaaatgggccaagaaggccgaattggacattgacgctttgaacggacggaacaatctggtgatagacaccccgagggtgcgcaaacagaccaggctatattccgctgttaaagaagatgagctgatggagttttctgatttggagtctgattctgaggaaaagccctgcgctaagccccgaaggcctcaggataagagccagggctacgccaggtctgaatgcttcagagtggaaaaaaacttactggtctacggctggggccggtggactgatatactgagccacggaagatacaagcgccagctaacagaacaggacgtggaaacaatatgtcgcaccatcctggtgtattgcctcaaccactacaagggggacgagaacatcaaatcgtttatttgggacctgatcactcccaccgcagatggccagacaagagcacttgtcaatcactcaggtctgagtgcccccgttcctcggggtcggaagggaaaaaaagtcaaggcacaatccactcagcctgtggtccaggatgctgactggctcgcaagctgtaatccggacgctctgtttcaggaagacagttacaagaaacatctgaaacatcactgcaacaaagttttgttgagagtgcgaatgctctactatctcaggcaagaggtcatcggcgaccaggctgataaaatcttggaaggagctgacagctcagaggccgatgtgtggatcccagagccgttccacgcagaggtgccagctgattggtgggacaaggaggcagacaagagtttgctgattggggtttttaagcatggatatgagaagtataattccatgcgtgccgacccagctctgtgctttctggaaagagtaggtatgcccgatgctaaggccatcgctgcggagcagcgggggacagatatgctggccgacggcggcgacggcggagagtttgatcgagaagatgaagatcctgaatataaacctactaggacgccctttaaagatgaaatagacgaatttgccaattcaccgagcgaggataaggaggagtccatggagatccatgctactggcaagcattctgagagcaatgctgaattgggccaactgtattggccaaatacctctaccctgactacccgactccggcgcctcattacagcctaccagcggagctacaaacgacagcagatgcggcaagaagcacttatgaagactgaccggaggcgtcgcaggccacgcgaagaggttcgagctctggaggctgagcgcgaagccattataagcgaaaaacgccagaagtggactagacgagaggaagcagacttctaccgagtagtgtcaaccttcggagttatattcgatccggtgaagcagcagtttgattggaaccagttccgggcctttgcacgactggataaaaagtcagatgaatccctcgagaaatatttcagttgtttcgtggccatgtgccgccgagtctgtcggatgcccgtgaaaccagacgacgaaccacccgatctgagcagcattatcgagccaattactgaggagcgggcatctcgcaccctctacaggattgagctcctgcggaagatccgcgagcaggtgctgcatcatccgcagctgggtgaaagactaaaactgtgccaacccagtctcgacttacccgaatggtgggagtgtggcagacatgaccgcgacctgttggtcggtgcagctaagcacggtgttagtaggactgattatcatattctgaacgaccctgaactgtcttttctggatgctcataagaattttgcacagaataggggcgcgggaaatacgagctccctgaatccactggccgttgggttcgtccagaccccccccgtgatttccagcgcacatatccaagacgagcgcgttcttgaacaggctgagggtaaagtggaggagcccgagaatccagcagcaaaggagaaatgtgaagggaaggaagaggaggaagagacagatggctcagggaaggagagtaagcaggagtgcgaggctgaggcaagctcagtgaagaacgaactcaaaggggtagaggtgggggcggacaccggttccaagagcattagcgaaaaaggctccgaagaagacgaggaagaaaaactcgaggacgatgacaagtctgaggagtctagtcagccagaagctggggctgtaagccgtgggaaaaacttcgatgaagaaagtaatgcgtccatgtcgacagccagggatgaaacacgtgacgggttctatatggaagatggagatccaagcgttgcacagcttctgcacgagcggaccttcgcttttagcttttggccaaaggaccgtgtcatgattaatcgactggacaatatttgcgaggccgtgctcaagggaaaatggccagtgaatagacgccaaatgttcgatttccaaggccttatccctggatatactcccacaaccgtggattctcctctccagaagcgttctttcgccgagctctcaatggtaggacaggcttctatcagcggcagcgaggatattaccacatctccacagctctctaaagaggatgccctgaatctgagcgttccccgccagaggaggaggcgccgccggaaaattgagatcgaagcggaacgtgccgctaagcgccggaatctcatggagatggtggcgcagttgcgcgaatctcaggtagtgagtgagaacggtcaagaaaaagtggtggacctgtccaaggcctctagagaagcaactagttcaacctctaacttctcttccctgagcagcaaattcattcttcctaacgtgagcacacccgtctccgacgcttttaaaacccaaatggagctcttgcaggccggtctgtcgcggactccaacgcggcatctcctaaatggttctctggtcgatggagagccacctatgaagaggcggcgcgggcgcaggaagaacgtggagggcctggacttattatttatgagtcacaagaggacttccctgagcgcggaagacgcagaggtgacgaaggcttttgaagaggacatcgaaacacccccaactcgaaacatccccagtcccgggcaacttgatcctgacacccggattcccgtcatcaacctagaagacgggaccagactggtgggtgaggatgcccccaagaataaggatttagtggagtggttgaaactgcatcctacctatactgtagacatgccatcatatgtaccaaaaaacgcagacgtattattcagctcctttcagaagcccaagcagaaaaggcatcggtgcagaaatcccaataagcttgatatcaatacactgacaggcgaggaaagggttccagtggtgaataaacgcaacggcaaaaaaatggggggggcaatggctcctcccatgaaggatttgcctagatggttggaggaaaatccagagttcgcagttgctcccgactggacagatattgtcaaacagtccggtttcgtgcctgagagtatgttcgaccgactcctcacagggcccgtggtacgtggtgaaggcgcgagccgtagaggtaggcgacccaagtccgaaatcgctcgcgcagccgctgcggctgctgcagtggcctctactagtggtatcaacccactcctggtcaatagcctattcgcagggatggacttgacatcactgcagaatctgcaaaacctacagagcttgcagctggcgggattgatgggctttccgccaggcctggccaccgccgctacagccggtggtgatgcgaagaatcccgcggccgtgttaccacttatgcttcccggcatggccggactcccaaacgtgttcggcctcgggggacttctgaataaccccctgagtgctgccaccggtaatacaacaactgcatcgagccagggcgagcctgaggactccacttcgaagggtgaggagaaagggaacgagaacgaagacgaaaacaaggacagcgagaagagcactgacgccgtctctgctgctgacagcgctaatgggtccgtaggggcagccacggcccctgccggactgccgagtaaccctttggcattcaatcctttcctgctttccaccatggcaccaggcctgttttatccaagcatgtttctaccaccggggctgggaggactcacgctcccggggtttcccgccctggctggcctgcagaatgccgtcggttcttccgaggagaaggccgcagacaaagctgagggcgggcctttcaaagacggagagacccttgaggggtcagatgcggaagaatccctcgacaaaacggcggagagctccctgctggaggatgaaatagctcagggcgaagaactggactcacttgacggcggagatgagatcgaaaacaacgaaaatgatgagtag

SEQ ID NO: 112137 - DNA, 8994 bp, Artificial Sequence
  Description of Artificial Sequence: Synthetic coding sequence
atggcagatccagggatgatgtcgctttttggtgaagatggcaatatcttttccgaagggctcgagggcttaggagagtgcgggtatcccgagaacccagtgaatcccatgggccagcagatgcctattgatcaggggttcgccagtctgcaacctagccttcatcatccctctactaatcaaaatcagacaaagttgacacattttgaccattacaaccagtatgagcaacagaaaatgcatctgatggatcagccgaacagaatgatgtctaatactccagggaacggtcttgcaagcccccatagccagtatcacacccctcccgtgccacaggtacctcacggtggcagtggcgggggccagatgggggtgtaccccggtatgcagaacgaaagacacgggcagtccttcgtcgattctagctctatgtggggcccccgagccgtgcaggtgcccgaccaaatcagggctccatatcaacagcagcagccccaaccacaaccaccacagcctgcacctagcggacctcctgcccaggggcatccccagcatatgcagcagatgggcagctatatggcaagaggagactttagtatgcagcagcatgggcagcctcagcaacgaatgagtcagttttctcagggccaggagggtcttaaccagggaaatcctttcattgctacctctgggcctgggcacctttcacatgtacctcagcagtcccccagtatggctccctctctccggcactctgtgcagcagttccatcaccatccatcaactgctctccacggcgaaagcgtggcgcacagtccccgattctctcccaatccccctcagcagggggctgtgcggccgcagacgctgaacttcagcagccgatcccaaaccgtgccgagcccaacaattaataattccggccagtactccaggtatccctatagtaatttaaatcaggggctcgtgaataatacagggatgaatcagaatctgggtctgactaacaacacccctatgaaccaaagcgtccctaggtatccgaacgccgtaggatttccatccaacagcggacagggactgatgcatcaacagcccatacatccgtcggggagtctgaaccagatgaatacacaaaccatgcatcccagccagcctcaggggacatacgcctctcccccccccatgtcgcccatgaaagcgatgagcaatcccgccggcacaccccctccgcaggtgagacccggatctgccgggatccccatggaggtcggcagctaccccaatatgccccacccccaaccaagccatcagccaccgggcgcaatgggcattggccaacgcaacatgggcccccgcaatatgcagcaatctaggcctttcatcggcatgagttctgcaccacgagaattgactggccacatgagacccaatggctgtccaggcgtgggtctgggtgatccccaggccatacaagaacgactaattccgggacagcagcaccctggccagcagcctagctttcagcaactccccacgtgcccaccactccagccccaccccgggctgcaccaccaatctagccccccccatcctcaccaccagccatgggcgcaactccacccctctccgcaaaacactccacagaaagtacccgttcaccagcatagcccttcggagcccttcttagaaaaacccgttccagatatgacccaggtatctggacccaatgcccagcttgtgaagtccgacgattaccttccctctatcgaacagcaacctcagcagaagaagaaaaagaagaaaaacaatcatatcgtcgctgaggacccctcaaaaggcttcggcaaggacgatttccccggaggggtggataatcaggagttaaatcggaactccctggatgggagccaggaagagaagaaaaagaagaaacggtcaaaagccaagaaggaccccaaggagcccaaggaacctaaggagaagaaggagccgaaagagccgaaaactcctaaggctccaaaaattcccaaggagcccaaggagaaaaaggcaaaaaccgccacacctaaaccaaagagtagtaaaaaatccagtaacaaaaagcccgactccgaggcgagcgccctcaagaaaaaagtcaacaagggcaaaaccgaggggtcagagaactcagatctcgataagactccccccccctcaccacccccagaagaggatgaggaccccggggtgcagaaacggcgcagtagtcgccaagttaaacggaagcgctacacagaggatctggagttcaaaatctccgatgaggaagctgacgatgccgacgccgctgggagggactccccgtcaaatacgagccaaagcgagcagcaggagtcggtggatgccgaaggcccagtggtggaaaagattatgtcatctagatctgtgaagaagcagaaagagagtggtgaagaagtggagatcgaggaattctatgttaagtataagaacttctcatacctccattgccagtgggcaagcatcgaagatcttgagaaggataaacggattcagcagaagattaaacgctttaaggccaaacaaggccaaaacaaattcctatctgaaattgaagatgagttatttaacccggattacgtggaggtcgacaggatcatggatttcgcccgttcaacagacgatcgcggcgaaccggtcacacattatctggtgaaatggtgtagcctaccatacgaagatagcacttgggagaggaggcaggacatcgatcaggccaaaatcgaagagttcgaaaaactcatgtcgcgggagccagagacagaaagggtggaacggcctcccgctgatgattggaagaaaagcgagtcaagccgagagtacaagaacaataacaagctgagagaatatcagctggagggggtgaactggcttcttttcaactggtataatatgcgaaattgtatacttgctgacgagatgggactggggaaaacgatccagtcaataacgttcctatatgaaatctatctcaaagggatccacggaccatttctcgtaatagccccacttagcacaataccgaactgggagagggaatttcggacgtggactgagctgaacgtcgttgtctatcatggcagccaggccagccgaagaacaatccagctctacgaaatgtattttaaggatcctcagggtagagttattaaggggtcttacaagtttcacgcaatcatcactaccttcgagatgatacttaccgattgtcctgagctgcggaacatcccttggaggtgtgtggtgatagatgaggctcacagactgaagaatcggaactgcaagctgctggagggcctcaagatgatggatctggagcataaagttctgctcacggggacccctcttcagaacacagtggaagagctcttcagcctgttgcactttctggaaccctcaagattcccatctgagaccacattcatgcaagagttcggagacctgaagacagaggagcaagtgcagaaactccaggctatcctgaaacctatgatgcttcggaggttaaaggaggatgtggaaaagaatttagctcctaaagaggaaacgatcattgaagtcgagctgacgaacatccagaaaaagtactaccgcgccatcttagaaaaaaactttacatttctatctaagggaggtggtcaggcaaatgtacccaacctcctcaacacaatgatggagctgcgaaagtgctgcaatcacccttatttgatcaacggggctgaggagaaaatcctggaggaatttaaagaaactcataacgccgaaagccccgattttcagctgcaggcgatgatccaggccgccggcaaactggtgctcatcgacaagctgctgcctaaattaaaagccggcggacacagggtcctcattttcagtcagatggttaggtgtctggacattctcgaagattacctgatccagagacggtacccatatgagcgtatcgacgggagagtcaggggaaatcttaggcaggccgctattgatcggttctctaaacctgactccgatagattcgtgtttctactttgtaccagagctggagggttgggcattaacctcactgctgctgacacatgtattatctttgactccgactggaaccctcagaacgatctgcaagctcaggcaaggtgtcatcgtattggacagtctaagtccgtcaaaatttatcgcctcattacccgcaacagttatgagagggagatgtttgacaaagctagccttaaactgggactggataaggccgtactccagtctatgagcgggcgagaaaacgccacaaatggggtgcagcagctgagcaagaaggagatcgaggatctattacggaagggtgcatacggagccctgatggatgaggaggacgaaggatcaaagttttgcgaagaggacattgatcagattctcctgaggcggactcacacaatcaccatagagtcagagggcaaaggttcaacttttgcaaaagcaagctttgttgcttcagggaacagaaccgatatcagcctggatgacccaaatttttggcagaagtgggctaaaaaagcggaactggacatcgatgccctgaacggaagaaacaatctggtgatcgacaccccccgagtccgaaagcaaactcgattgtacagtgcggttaaagaagatgaacttatggagttcagcgatttggaaagcgatagcgaagagaaaccatgcgctaaaccccgcagaccccaagataagtcacaaggctacgcaaggtccgaatgctttcgcgtcgaaaagaatctcttggtgtacgggtggggtcgatggaccgatatactgtctcacggccggtataaacggcaactgaccgagcaagacgtggagaccatttgtcggactattctcgtgtactgtctgaaccactataagggcgacgagaatattaaaagctttatctgggatttgattactccgactgcggacggccagaccagggccctagttaaccatagtgggctgtccgcacccgtaccacggggacggaaagggaaaaaagtgaaagcgcagtccacccaacctgtggttcaggacgctgattggctggcaagctgtaatcccgatgctctttttcaagaggactcatataagaaacatctgaaacaccactgcaacaaggtgctgcttagggtgcgcatgctttactatttgaggcaggaagtgattggagaccaggctgataagatcctcgagggagcggattcaagtgaagctgacgtctggatccccgaacctttccatgctgaagtccctgccgattggtgggataaagaggcagacaaaagtttgctgatcggcgtttttaagcacggatatgagaagtacaactcgatgcgagccgatcccgccctgtgttttctcgagagggttgggatgccagatgctaaggctattgctgctgagcagcgcgggacagacatgctcgcagatggcggggacgggggggagtttgaccgtgaggacgaggatccagagtataagcctacccgcactcccttcaaggatgagatcgatgaatttgccaattcaccctccgaggacaaagaagaaagcatggaaattcacgccactggcaagcattcagagtctaatgccgaactgggccagctgtattggccgaatacctctacactcaccacccggctgcgacgtctgattacagcataccagagaagctacaagcgacaacagatgcggcaggaggccctgatgaaaaccgacagacggaggcggcgtcctagggaagaagtaagagcactggaagcggagcgcgaggctatcatatccgagaaacgccaaaaatggaccaggagagaagaagctgatttttacagagtagtatcaactttcggggtgatctttgatcccgttaaacaacaattcgattggaaccagtttagggccttcgccagattggacaagaaaagcgacgagagtctggaaaagtacttcagttgctttgtggcaatgtgtaggcgggtttgtcgaatgccagtgaagcccgacgatgagccccctgatctgtcttcaataattgagccgattacagaagagcgcgctagccggacactgtaccgcattgagttgctaaggaaaatcagagaacaggtactgcatcatccgcagctcggggagcgtctgaagctttgccagcccagcctcgacttgcctgagtggtgggagtgcggaagacacgatagagatctcctggttggcgcagcgaagcatggtgtttccagaaccgattaccacatcctcaacgacccagaactgagcttccttgatgcacataaaaacttcgcccagaacaggggagccggtaacactagctctctgaaccccctcgccgttgggtttgtgcaaacgcctccagtcatcagctccgctcacatccaggatgagagagtgctggagcaggctgagggaaaagtcgaggaacccgaaaacccagccgctaaagaaaagtgtgagggaaaagaggaggaagaagaaactgacggctcggggaaggagtcaaagcaagaatgtgaggcagaggcctctagtgtcaagaatgagctcaagggagtggaggtgggcgcagacacaggatcgaaatcaatctctgagaagggtagcgaggaagacgaggaggaaaagctagaagacgacgacaagtccgaggagtcatctcagcccgaagctggcgcagtgagccgtggaaagaacttcgacgaagaatctaacgcgtcaatgagtaccgctagggacgagacccgcgatggcttctatatggaagacggcgatccaagtgtcgcccagttacttcacgagagaacttttgcattttcgttttggccgaaagatcgggttatgattaataggctcgacaacatttgcgaagcggtgctgaaaggcaagtggccggtgaataggaggcagatgttcgactttcaaggtctcatacctggctataccccaaccaccgtcgacagccctctgcagaaaagaagtttcgccgaactgtctatggtgggccaggcttcaatttcgggaagtgaggacattacgaccagtcctcagttgtctaaggaagatgcgctgaacctctcagtgccgagacagagacgacggagacgtcgcaaaatcgagatcgaggccgagcgggccgcaaagagacgtaatttaatggaaatggtggcccagctccgcgagtctcaggtggtgagcgaaaatgggcaggaaaaggttgtggatttatcaaaagctagccgtgaggccacatcttcaacatcgaacttttcctcgctatccagcaagttcattcttcccaatgtcagtacacctgtgtcggatgcttttaaaacccagatggagctgctgcaggccggattgtctcgcactcccactcgccatctcttgaatgggagcctggttgacggggaaccacccatgaagcgaaggaggggaaggcgaaaaaatgtggagggactggacttacttttcatgagtcacaagcggacatcattgtccgcagaggacgccgaggttaccaaggcatttgaagaagacatcgagaccccaccgacaagaaatatcccatcacctggtcagttggacccagataccaggattcccgtgattaatttagaggatggtacccggctggttggggaagacgctcctaagaataaggacctcgtggagtggctcaagttgcacccaacgtacaccgtcgatatgcccagctacgtcccgaaaaacgccgacgtcctcttcagttcctttcagaaacctaagcaaaagagacatcggtgccggaatcccaacaagctggacataaataccttgactggggaggagcgcgtgccagtggtgaacaagagaaacggaaagaaaatgggaggagccatggccccgccaatgaaagacctccccagatggttggaggaaaatcctgagttcgcagtggcccccgactggaccgacatcgttaaacaatcggggttcgtcccagagagcatgttcgaccgattgcttaccggacccgtggttagaggtgaaggcgccagtcggcgcggcagacgacccaagtcagagatcgctagagcagcagccgcagctgcagccgtggcgtccacctccggaataaacccccttttggttaactctctgttcgctggcatggatctgacaagtctgcagaatctgcagaatttgcaatccctccaactcgccggcctgatggggttcccccctgggttggccacggctgcaactgccggtggagacgcaaaaaaccccgcagctgtgctgcctctcatgctgcccgggatggccggcctccctaacgtgttcgggctgggaggacttcttaataatcccctatctgcagccaccggcaacaccaccacagcctcctctcagggcgagcccgaggactctacttccaagggcgaggaaaaggggaacgaaaacgaagacgagaataaagatagcgagaaatccacggatgccgtaagcgctgccgactcagccaatggcagcgtgggcgccgccacggcgccagccggtcttccctctaatccattggccttcaacccattcctcctatccaccatggctcctggcttgttctatccatcaatgttccttcctcccggcttgggggggctaacgttgcccggctttcccgcattagctgggctccagaatgctgtaggatcctccgaagagaaggccgcagataaggcagaagggggaccctttaaggatggagagaccctggaggggagcgatgcagaggagtccctggacaaaaccgctgagagctcactcctggaagacgagatcgcacagggagaagagttagattcattggacggaggagacgagatagagaataacgaaaatgatgagtag

SEQ ID NO: 112138 - DNA, 102 bp, Artificial Sequence
  Description of Artificial Sequence: Synthetic coding sequence
atggccgatcctggaatgatgtccttgttcggagaggacgggaatatcttctcggagggactggagggcttgggagaatgtgggtacccggagaacccatag

SEQ ID NO: 112139 - DNA, 6906 bp, Artificial Sequence
  Description of Artificial Sequence: Synthetic coding sequence
aaaggagagtctaaaaggattacattggtgctgcaacagccacaaagtggcggcccacaagggcaccgacacgtagtcctgggctccctgcccggtaagatcgtcctacaaggtaaccagctggcagccctcacacaggcgaaaaatgcccaggggcagccagctaaagttgtaactattcagctccaggttcaacagccacagcagaaaatccagatcgtcccccaacctccaagcagtcagccccagccccagcagccaccatccacccagccagtgaccctatctagtgtccagcaagctcagattatgggcccaggccagtctcccggacaacggcttagcgtgcctgtcaaggtggtactgcagccccaggctggtagctcccagggcgcctctagtggattgagcgtggttaaggtcctgtctgcctccgaggtagcagctctttccagccccgctagctccgccccacatagcggagggaaaacagggatggaagaaaaccgccgtctcgagcatcaaaagaagcaggagaaagccaatcgcattgtcgccgaggctatcgcccgcgccagggccaggggggaacagaatatcccgagagtgctaaatgaggatgagttgcctagcgttcgaccagaggaggaaggagaaaagaagcgcagaaaaaaatccgccggagagcgcctgaaggaagagaagccaaaaaaatctaagaccagcggagcttcaaagaccaagggcaaatctaagcttaacacgattactcccgttgtgggcaaaaaacgaaaacggaacacctcttccgacaactcagatgtcgaggtgatgcctgcccagtcccctagggaggatgaggaaagttctattcagaaacgtcgctctaacagacaagtcaaacgcaaaaaatacaccgaggatctcgatataaagattactgacgatgaagaagaagaagaggtagacgtcacagggcctattaagcctgagccaatcctgccggagcctgtgcaggagcctgacggcgaaaccctgccaagcatgcaattcttcgtggagaatcctagcgaagaggatgctgccattgtggacaaggtattatcaatgcgaatcgtaaaaaaggaactcccatcaggccagtataccgaggccgaggaattcttcgtcaaatataaaaactacagctacctgcactgcgagtgggccaccatctcccaacttgaaaaagataagagaatccaccagaaactcaagcgattcaagaccaagatggctcaaatgagacattttttccatgaggatgaagaacccttcaatccagattatgtagaagtggatcgcattctggatgagtctcacagcatcgacaaggacaatggtgagccagtgatttactatctggtgaagtggtgctcccttccctatgaagattctacatgggagctcaaagaagatgtcgacgaagggaagattagagaattcaaacggatccagagccggcacccagagttgaaacgcgttaaccggcctcaggcaagcgcctggaaaaaattggaactctcccatgagtataagaaccgaaaccaactgagagagtaccagctcgaaggggtgaactggttgctgttcaattggtataacaggcagaactgcatcctcgcggatgagatggggctgggcaaaaccattcagagcatcgcctttctgcaggaggtttataacgtcggaattcacggccccttcctcgtcatagcacccttgtctaccatcacaaactgggagagagaattcaacacttggactgaaatgaataccatcgtgtaccatggctccttggccagcaggcaaatgattcagcagtacgagatgtactgtaaggattctagagggcgcctgattcccggtgcatataaatttgatgcactgattaccacctttgaaatgatcctgagcgactgtccagagttacgggagattgagtggagatgcgtcattatcgacgaggctcaccgactcaaaaacagaaattgtaagttgctggacagcctgaagcacatggacctagagcataaggtactgttgacgggcacaccactccagaacacagtggaggaattattcagcttgcttcactttctggaaccgagccagttcccgtccgagtctgagtttcttaaggactttggagaccttaaaactgaggagcaggtgcagaagctccaggctatcctcaaacccatgatgcttcgaaggctgaaggaggacgttgagaaaaatctggccccaaaacaggagactattattgaagtagagctgacaaatatccagaaaaagtactaccgtgcaattctggaaaagaatttcagctttctcagcaaaggcgcaggccatacaaacatgccaaacctgctgaatacaatgatggaactcaggaagtgctgcaaccatccctacctgatcaacggggccgaggaaaagattctgaccgagtttagagaggcgtgccacatcatcccacatgattttcacctgcaggcaatggtgcggagtgctgggaaactcgtactgattgacaagctgctcccaaagttgaaggcaggggggcacaaagttctcatattttcccaaatggtgagatgtcttgatattctggaggactacctcattcagaggcggtacttatacgaaaggatcgacggaagagttcgtggtaatttgagacaagccgcgatagaccgcttctcgaagcctgattccgacagattcgttttcttgctatgcacaagagctggggggctggggataaacctaaccgccgctgatacatgtattatcttcgactctgactggaacccccagaatgacttgcaggcacaggctcgctgccacaggattgggcagtccaaggctgttaaggtgtataggctgatcactagaaactcatatgaaagagaaatgttcgataaggcctcactgaaactgggactcgacaaggcggtgctccagagtatgagcggtcgtgatggaaacatcacggggatccagcagttttccaaaaaggagatcgaagacctgcttagaaaaggagcttatgccgccatcatggaagaggatgacgaaggcagtaagttctgcgaagaggatattgatcaaattctcctgcggaggacaactacaatcacaatcgaaagcgaaggtaaggggagcacttttgccaaggccagttttgtggcatcagaaaaccgcaccgacatttcactagacgaccctaacttttggcaaaaatgggctaagaaagctgacctggacatggacctcctgaattccaaaaataatctcgtcattgacacaccacgggtgcgtaaacaaacccggcacttctcaaccttaaaagacgacgatctcgtcgagttcagcgacctggagtccgaggacgatgagaggccacgcagcagacgacacgaccggcaccacgcttacggcaggaccgactgctttcgcgtcgagaagcacctgctcgtatatggctgggggaggtggcgcgacatcctgtcacatggccgcttcaaacgaagaatgactgagcgggatgtggagacaatttgcagggctattttagtgtactgcctactgcactaccggggggacgaaaatattaagggatttatttgggacctcatctcgcccgcagagaatggcaaaaccaaagaacttcagaatcattccgggctttctatccccgttccacggggtagaaaaggaaaaaaggtgaaaagccagagtacgtttgatatacataaggccgattggatccggaaatacaatccagacacactgtttcaggatgagtcatacaagaaacacttaaaacaccagtgcaacaaagtcctattaagagtccggatgctatactatctaaggcaagaagtaattggggaccaggcagaaaaagtgctgggtggggccattgcgtccgagatagatatttggttccctgtggttgatcagcttgaggtcccaacaacctggtgggattcagaggcagacaagtctctcttgatcggcgtgtttaaacacggttatgagaagtataatactatgagggctgatcccgccctgtgctttctcgaaaaggcagggcggcctgacgacaaagccatagctgctgaacaccgggtcctggataacttttctgacatagtggaaggcgtcgactttgacaaagactgtgaggatcccgagtacaaaccactccagggaccccctaaggaccaggatgacgagggcgacccgctgatgatgatggatgaagagatatctgtgatcgacggggacgaggctcaggtgacccaacagcctgggcacctattttggccacctgggagcgccctcacagcccgcctcagacggctggtgactgcctatcagcgaagctataagagggagcagatgaagatcgaggcagcagagcgaggcgataggcgccggagaaggtgtgaggccgctttcaagctgaaggaaattgctcgccgggaaaagcagcagcgttggaccagacgtgagcagaccgatttttatcgcgtggtttcaacatttggggtggaatacgaccccgataccatgcagtttcactgggataggttcaggactttcgcacggctggacaagaaaacggacgagtccctcactaaatatttccacggatttgttgctatgtgtcgccaggtatgcaggttgcctccagcagcgggagacgaacctccggatcctaacctgtttatagagcctattaccgaggaaagagcgagtcggaccttatatcgcattgagttactcaggcgtctccgcgaacaggttctatgtcatccattgctggaggatagactggcactgtgtcagccacccggccctgagctcccaaagtggtgggaacccgtgcggcacgatggcgaactgctcaggggcgccgccagacacggagtcagccagactgattgtaatattatgcaggacccggacttttccttccttgctgcacgaatgaactatatgcagaatcatcaagctggggcgccggcgcccagcctgtcaagatgttcaacgccactgcttcaccagcaatatacctcccggaccgcctcgccactgccccttaggcccgacgcccctgtggaaaaatctcctgaagagaccgcaacgcaggtcccatcactcgagtctttgacacttaaacttgagcatgaggtggtggccagatctagacccaccccccaggactacgagatgagggtaagcccctctgacacgacgccactcgtctcccggtcggtgccccctgtgaagttagaggatgaggatgacagcgacagtgagttggacctgtccaagctgagtccttctagctcttcttcatcaagcagctctagctcatcgtctagcactgatgagtcagaagatgagaaggaagaaaagctcaccgaccaaagccgcagcaagctgtacgatgaggagtcgttgctgtccctgactatgtcgcaggacgggttccctaatgaggacggagagcagatgacacctgaactgttgttattgcaagaacggcagcgggcttcggaatggcctaaagaccgggtcttaattaacaggattgatttggtttgtcaagccgtgctgtccggtaaatggcctagttcacgccgctcccaggagatggtgaccggcggcatccttggaccgggcaaccatcttctggactctccgtccctaaccccgggagaatacggcgacagcccggtgccaaccccaagatcatcttccgccgcttccatggctgaggaagaagcctccgccgtgtctacggccgctgcacaattcactaagctaagaagggggatggacgaaaaggagttcacagtgcaaatcaaggacgaagagggtctgaaattgacattccaaaagcacaagctgatggcaaatggggtaatgggagatggacaccctctgtttcacaagaaaaaggggaaccgaaagaaactggttgagttggaagtggaatgcatggaggagcctaaccacctggatgtggacctggagaccagaatcccggtgataaataaggtggatggtacattgttggtgggtgaggacgctcccagacgggccgagcttgagatgtggctacagggccaccccgaatttgcagtggaccccagatttcttgcctatatggaggaccgtcgcaaacagaagtggcagcgctgcaagaaaaataacaaggctgagttgaattgcttgggtatggaaccagtccagactgcgaattcgagaaacggaaagaaaggccaccacacagagaccgttttcaaccgagtgctccctggtccaatagccccagaatccagcaagaaacgtgcccgccgcatgaggccagacctgagcaaaatgatggcgttgatgcaaggcggcagtacaggatctttgtccttacataatacatttcagcattcatcctcagggttgcagagcgtatcctctcttggacatagctctgctacttcggcaagcttaccctttatgccattcgtgatgggtggagccccatcttcaccccacgtcgattcctccacaatgctgcatcatcaccaccaccatccccatccacatcatcaccatcaccatcacccaggcctcagggcccctggatatccctccagccctgtgaccactgcctccggcacgaccttgcggctgccccctctgcagcctgaggaggacgacgatgaagacgaagaagatgatgatgacctgagccagggatatgattcttccgaacgtgacttctcgttgatagatgatccaatgatgccggccaatagcgattccagcgaagacgcagacgactag

SEQ ID NO: 112140 - DNA, 7746 bp, Artificial Sequence
  Description of Artificial Sequence: Synthetic coding sequence
atggcggatcccattatggacctgttcgatgatcccaacctgtttgggttggacagcttgaccgacgattcctttaatcaggttacccaggacccaatcgaggaggcactcggtctgccatccagtctggactccttggaccagatgaatcaggacggcggggggggcgatgtgggcaactcttccgcgagtgagttggtcccgcccccagaagagactgcaccgaccgagcttagcaaagagagtacagccccagccccagaaagcatcaccttgcacgactacaccactcaacctgcctctcaagagcagccagcgcaacctgtgctccagacatcgacacctacctctggcttgctccaggtcagtaaatcacaggagattctttcacaagggaacccttttatgggagtttccgcgactgcagttagtagctcttccgccggcgggcagcccccccaatctgcaccaaagatcgtaatccttaaggcccccccaagcagctctgtcaccggggcccatgttgcccagattcaggcccaaggcatcaccagcacagcccagcccctcgtagcaggtaccgcaaacggagggaaggtgaccttcacaaaggtattgacagggacccctttgaggcctggcgtgagcattgtctcagggaatactgtgttggccgccaaggtcccaggtaatcaggcagctgttcagcgcatcgtccagcccagtcgccctgtcaagcagctcgttctacagcccgtcaaagggagtgctcctgccggtaaccctggcgctacagggccacccttgaagccggcagtgacactgacatcaacgcctacgcagggagaatccaagcgaattacgctcgtgctccaacagccacagagcggaggaccccagggacatagacacgtggttctggggagtctcccaggcaagatagtgctgcaggggaatcagttggccgctctgactcaggccaaaaacgctcagggccagcccgctaaagttgtcaccatccagctgcaggtgcagcaaccacagcaaaaaatccagatagtgcctcagccaccctcttcccagccacaaccccaacagccgccgagtactcagccagtcacgctgtcatcagtccagcaggcccagattatgggccccgggcagagtccgggtcagagactgtccgttccagtgaaggtggtgctacaaccccaggccgggagctcccagggcgccagctctggtctttctgttgtgaaggtgctgagtgcttcggaggtcgcagcactctcatctcccgcatcttccgcaccacatagtggcggtaagaccggaatggaggagaaccgtaggctggaacatcagaagaaacaagagaaagctaacaggatagtagcagaggctatcgcccgggcccgggcccgtggcgagcagaacatccctcgggtcctgaatgaggacgaattgccctcggtccggccagaagaggagggtgaaaagaaaagacgaaagaaatctgccggagagcgcctcaaggaggagaaacctaagaagtctaagaccagtggcgctagcaaaaccaaagggaaatctaaactcaacacaataacgcctgtggtgggtaagaaacggaagcggaatacctcttcagacaatagcgatgtagaagtaatgccagctcagtcaccccgcgaggacgaagaatcttccattcagaaacgaaggtcaaatcggcaggtgaaaaggaaaaaatatacagaagatctggacattaagatcacagatgacgaagaggaggaggaggtcgacgttactggccctatcaaaccagagccgatcctccccgagcccgtgcaagagcctgacggggagacactaccatctatgcagttcttcgtggagaacccctccgaggaagatgctgcgattgtggacaaggtgctgtcgatgaggattgtcaagaaggagctaccatctggacagtacaccgaggcagaggagttcttcgtgaagtataagaactattcctatctgcattgtgagtgggctaccattagtcagctcgagaaggacaaaagaattcaccagaagctgaagcggttcaagactaaaatggcccaaatgaggcactttttccatgaggatgaagagcccttcaaccctgattatgtagaagtggaccggattcttgacgaaagccatagcatcgacaaggataacggcgaaccagtgatctactacctagttaaatggtgttctttaccttatgaagacagcacctgggagcttaaagaggatgtggacgaggggaagattcgtgagtttaaaaggattcagtcacgccatccagaacttaaaagagtaaaccggccccaggcttccgcctggaagaaacttgagctgagccatgagtataagaaccggaaccagttgcgcgagtaccaactcgaaggcgtcaattggctcctcttcaactggtataatagacagaattgcatactggctgatgagatgggactgggcaagaccatccaatctattgcctttctgcaggaggtttataatgtcggtatccatgggccctttctcgtgatagctcctttgtcaacgatcaccaattgggaacgggaatttaacacctggacagaaatgaataccatagtgtaccacggatccctcgccagccgccagatgatccagcagtatgaaatgtattgtaaagattcacgtggaagattaattccaggcgcttataagtttgacgcactgatcaccacattcgagatgatcctgtcagactgtcccgagctgcgcgaaatcgaatggcggtgcgtgattattgacgaggctcaccgcctgaagaaccggaactgtaaactgctcgacagtctgaagcacatggacctggagcacaaggtgctgctgactggcacgccactccaaaataccgttgaagagctgttttcccttctgcactttctggaaccatcgcaattcccctccgaatccgagttcctcaaggactttggcgatctaaagactgaagaacaggtacagaagctgcaggccatcctaaagccgatgatgctgcgacgtttgaaggaggatgtggagaagaacttggccccaaagcaggagactataatcgaagtggagctgactaatattcaaaaaaaatactatcgcgccatcctggaaaagaatttcagcttcttgtcgaagggagccggccacacaaacatgcccaatctgctgaatactatgatggaactgcgcaagtgctgcaaccacccctatctaattaacggagctgaagagaaaatactgactgagttcagagaggcctgccacattattccacatgatttccatctgcaggccatggtgagaagcgcgggaaagctagtcctaattgataagctccttcctaagctcaaggccgggggtcacaaagttctgatattcagccagatggtgagatgtctggacatcctggaagattatctgattcaaaggcggtatctatacgagcgaattgacggacgggtgagaggaaacttaaggcaggcggccattgacagattctcaaaacccgacagcgaccgcttcgtcttcctgctctgcacacgggccggagggctggggataaatctgaccgccgccgatacctgcattatttttgatagcgattggaaccctcagaacgatcttcaggcacaggcacggtgtcacaggatcggccagtccaaagccgtgaaggtgtatagactgatcacgcggaactcctatgaacgtgaaatgtttgacaaggcctccctgaagcttgggcttgataaagctgtgctccagagcatgagcggccgcgacggaaacattaccggtatccagcagttttctaaaaaggaaattgaggatctattacgaaagggagcctatgccgcgatcatggaagaagacgacgagggttctaaattttgcgaggaagacattgatcagattctactgcgccggaccactaccatcacaatcgaatccgaaggaaagggctctacattcgccaaggcatctttcgttgccagtgaaaacaggacagacatctcactcgatgaccctaatttctggcaaaaatgggctaagaaggctgatctggatatggacctgctcaatagcaaaaacaatcttgtgatcgatacaccccgggtgcggaaacagacgcgccacttcagcaccttgaaggatgacgatctagtggaattctccgatctggaaagcgaggacgacgaaaggccacgcagccgaaggcacgaccggcaccacgcctacggtcgcacagactgtttccgggtggagaaacacctgcttgtgtacggatggggacgatggagggatattttaagccatgggcgattcaagcgacgcatgaccgagagagatgtggaaacgatctgccgggctattctcgtgtactgtctgctacattatagaggggatgagaacattaaaggtttcatatgggatctcatttccccagccgagaacggaaaaaccaaagagctccagaatcacagcggactgtctatcccagttccgagaggtcggaagggaaaaaaggtcaagtcacagtccactttcgatatccacaaggcggactggatcaggaagtacaacccagatacactcttccaagacgaatcatataagaaacatcttaagcaccagtgtaataaggtgctgctccgagttcggatgttgtactacttacggcaagaggtgatcggggaccaggccgagaaggtactgggaggcgcaatcgccagcgaaattgacatctggttccctgttgtggatcagttggaggtgccaacaacatggtgggactctgaagctgacaagtcgcttttaataggcgtatttaaacatggatacgagaaatacaatacaatgagggctgatccagccctttgtttcctggagaaggcaggcagacccgacgacaaggctattgcggccgagcaccgtgtcctagataatttttccgatattgtagaaggagtcgattttgacaaagactgcgaagacccagaatacaagcccctgcagggccctccgaaggaccaggatgacgagggagatcccctcatgatgatggatgaggagatttcagtgatagatggggatgaagcacaggtgacccagcagcctggccatctgttctggccacccggaagcgccctgaccgcgcgtctgcggcggctggtcaccgcttaccagcggtcttacaagcgggagcagatgaaaattgaagcagcagaaagaggagacaggcggcgacgcagatgtgaggcggccttcaagctgaaagagatcgcacgtcgggaaaagcagcaaagatggacccgtcgggagcaaacagatttctatagagtcgtgtccacattcggggtggaatatgatccggacacgatgcaattccattgggatcgcttccgaaccttcgctcgacttgataaaaagaccgatgagtccctgacgaagtacttccatggcttcgtggcaatgtgtcgccaggtatgtcgacttccccccgctgctggggatgagccccctgacccgaatctctttatcgagccgatcactgaagagagggcttctcgtacgctgtatcggattgaactgcttaggcggctgcgcgaacaggtactgtgtcatccattgttagaggatcggctcgcactgtgtcaacctccgggaccggagcttcctaagtggtgggagcccgtccgtcacgatggggaactcctccggggagctgctaggcacggcgtgtcccagactgattgcaacattatgcaggacccggacttctcatttctcgctgcacggatgaactatatgcagaaccaccaggcaggggcgcctgcaccttctttaagtagatgttctactccactgctccaccaacaatacacttcgaggacagcgtctcctctccctctccgccctgacgctcctgtagaaaagagccccgaggaaacggctacacaagtaccctctcttgagagtctcactctgaagcttgaacacgaggttgtcgcaagaagtagaccgactccgcaagactacgaaatgagggtctctcccagtgataccacaccactggtctcacgctccgtgccccccgtgaagcttgaggatgaggacgatagtgacagcgagctggatctttccaaactctctccctcctccagcagctcctcttccagctcttcaagttcatcctctacagatgaatcagaggacgagaaggaagaaaaattgacagaccaaagcaggtctaagctttacgacgaggagtcgctgctatccctcaccatgtcccaggacggcttcccaaacgaggacggagagcagatgacaccagaactgcttctgctgcaggagaggcagcgtgcatctgaatggcctaaggacagagttctgataaacagaatcgatctggtatgtcaagccgttctaagcggcaagtggccaagttctcggcgttctcaggagatggtcacagggggtatccttgggcccggcaatcatcttctggactcgccctcccttactccaggggaatacggcgactctccagtgcccactccacggtcctcctctgccgcgtccatggctgaggaggaggcaagtgctgtgagcactgccgccgcccagttcacaaagctaaggaggggcatggatgagaaagaatttactgtccagatcaaggatgaagagggtctcaaactgaccttccaaaaacacaaacttatggctaacggtgtcatgggggacgggcaccctctcttccataaaaagaaaggaaacagaaaaaagctggtcgaattagaggtggaatgtatggaggagcccaatcaccttgacgtggatctcgaaactaggatcccagtgatcaacaaagttgacggcaccctgttggtgggagaggatgccccacgacgcgccgaattggaaatgtggctgcaaggccatcctgagtttgccgtcgaccctcggttccttgcctatatggaggatcggcgcaaacagaagtggcagagatgcaagaaaaacaacaaagcggagcttaactgcttgggaatggaaccagtgcaaacagctaactcgaggaacggaaagaaggggcatcataccgagacagtgttcaatcgtgtattgcctggaccgatcgccccagagtcgtcgaaaaagagagcccgcaggatgcgaccagacctctctaagatgatggccttgatgcaaggaggatctaccggtagcctgagtttgcataatacgtttcagcacagctctagcgggctccagagcgtctcgtcacttggccacagtagcgcaacttctgcctccttgcccttcatgcctttcgttatgggcggagcgccctcaagcccgcacgtcgatagttctactatgctgcaccatcaccatcaccaccctcatcctcaccaccaccatcaccaccacccaggattacgggccccaggttatccatctagccctgttaccaccgcttctggcaccacattacgtctgcctcccctccaacccgaggaggatgacgacgaggacgaggaggacgacgatgatttatcccagggctatgactcgtccgaaagggactttagcctgatcgacgatcctatgatgccggctaattcagacagtagcgaagacgctgacgactag

SEQ ID NO: 112141 - DNA, 6909 bp, Artificial Sequence
  Description of Artificial Sequence: Synthetic coding sequence
atgaagggggagtctaaacgcatcacacttgtccttcaacaaccgcagagcgggggcccccagggccatcgtcacgtcgtcctcgggagcctccccggtaagattgttctgcagggcaatcagctggctgctcttacccaggctaaaaacgcgcaaggacaacccgctaaagttgtcacaatacagctgcaagtgcaacagccccagcagaagatacagatcgtgccacagccccctagctctcaaccccagccacagcagcctcctagcacccagcccgtcactctgagtagtgtgcagcaggcccaaatcatgggtcccgggcagagccctggacagaggctcagcgttcctgtgaaagtagttctgcagccgcaagcaggctcgtcacaaggtgcctccagcggtttgtcagtcgtgaaagtactgtccgctagcgaagtggctgccctttcgtcccccgcctcgtccgccccccactctggcggcaaaactggaatggaggagaaccgacggctcgagcaccagaaaaagcaggaaaaggccaatcgcatcgttgcagaggcaatcgccagagcccgcgccagaggggaacagaatataccgcgggtgctgaacgaggacgagcttccttccgtgagacctgaagaagagggtgagaaaaaacggagaaagaagtcagccggcgagcggctgaaggaagagaaaccgaaaaaaagcaaaacttcaggggcttctaaaaccaaaggcaagagcaagctgaacaccatcaccccagtggtagggaaaaagagaaaaagaaacacaagttcagataactccgacgtggaagttatgcccgcacaaagcccacgcgaagacgaggaatccagtatacagaagcggcgctctaatagacaagtgaaacgcaagaagtataccgaggacctggacatcaagatcaccgacgatgaggaggaggaggaagtggacgtgacgggaccaatcaaaccggaacctatcctgcccgagcctgtgcaggagcccgacggcgaaaccctgccatccatgcagttcttcgtggaaaacccaagcgaagaggacgccgctattgtggacaaagtactttctatgcgcatcgtgaaaaaggaactgccatctggacagtatacagaggccgaggagttttttgtcaagtacaagaattattcttacctccactgtgaatgggccacaatcagtcagctggaaaaagataagcggatccaccagaaactaaagagatttaagactaagatggcgcagatgagacacttcttccacgaagacgaagagccttttaaccccgactatgttgaagttgacaggatactggacgaaagccactccatcgacaaggacaatggtgagccagtcatctattatcttgtgaagtggtgttcccttccttacgaggacagcacttgggaactcaaggaagatgtagatgaaggaaaaattcgggagttcaaaaggatccaatccaggcaccctgagctcaagcgtgtcaaccggcctcaggcctccgcctggaaaaaactggaactctctcacgagtataaaaaccggaaccagcttcgcgagtaccaattggaaggggtgaattggctcctgtttaattggtacaatagacagaattgcatcttggctgatgagatgggcctcggaaagaccatccaaagtatagcctttctccaggaagtgtataatgtggggatccatggcccctttctggtgattgcgcccctgtccacaatcactaactgggaacgagagttcaatacctggactgagatgaacaccatagtttaccatggttcgctggcttcacggcaaatgattcaacagtacgaaatgtattgtaaagactcgcgtggccgcctcatacccggtgcctacaaattcgacgcgctaattacaacattcgagatgattctgagcgattgccctgagctgcgagagatcgagtggaggtgtgtgataattgacgaggcacaccgccttaagaatcgaaactgtaaacttttggactctctcaaacatatggacctggaacataaggtcctgctgacaggcacgcccctacagaacacagtggaggagctcttcagcttactgcacttcctggagcccagccagtttcctagtgagtcagaattcctgaaagatttcggcgacctgaaaaccgaggaacaggtccagaagctacaggcaattctgaagcccatgatgttgcgccgactcaaagaagatgtcgaaaaaaacttagctcctaagcaggagaccattattgaggtggaactgacgaatattcagaaaaagtactatagagccatcctggagaagaactttagcttcctaagcaaaggagctggccacacaaatatgcccaacctgttgaataccatgatggagctgagaaagtgctgtaatcatccctacttgatcaatggagccgaagagaaaattttgaccgagttccgcgaggcctgtcacataattcctcatgatttccatctgcaggctatggtccggtccgccgggaaactggtcctgatagacaagctgctgcctaagttaaaagccggcggccataaagtgctgatcttcagtcaaatggtgagatgtctggatatcctggaagattacctaatccagagaagatacctatatgaaaggatcgacggcagagttcgcgggaatctgcgacaggcagctattgaccggttctctaagccggatagtgatcgattcgtctttcttttatgcactcgcgcagggggactgggcatcaacctgactgccgccgatacttgcatcattttcgactctgattggaatcctcaaaacgatttgcaggcacaggccagatgccacagaatcgggcagagcaaagctgtgaaggtctatcggctcatcacacgcaatagctacgagcgagagatgttcgacaaagcttccttgaagcttggactggataaggctgtactgcaatcaatgagtggtagggacggaaatatcaccggaattcaacagttcagtaagaaggagatcgaagacttattgagaaaaggggcctacgccgccatcatggaagaggatgatgaggggtctaaattttgtgaggaagacatagatcaaattttattgcgacggaccaccaccatcactatagagtctgaagggaagggaagtacttttgccaaagcctcgttcgtagcgagtgagaatcgaaccgatatttctttagatgaccccaacttctggcagaaatgggctaagaaggccgatctcgacatggatctgctgaattctaagaacaatctagtgatcgatacaccgcgtgtgcggaagcagacacgccatttctcgaccctcaaggacgacgaccttgtggagttttctgatcttgaatcagaagacgatgaacgcccccgctcccgcagacacgatagacaccatgcctatggcagaacagactgctttagagtagaaaaacacctgctcgtatacggttggggcaggtggcgagacatcctgtctcatggaagattcaaacgtaggatgacagagcgcgacgtggagacaatatgccgcgccatacttgtgtattgtctgctgcactaccgaggggacgaaaacataaaagggttcatctgggaccttatctcaccagccgagaacggtaagactaaggagctgcagaatcattcaggcctgtccattcctgttcctagagggcgcaaaggtaaaaaagttaagagtcagagtacctttgatatccataaggccgactggatcaggaagtacaacccagatacactgtttcaagacgaatcctacaagaaacacctgaagcatcagtgcaacaaggtactcctgagagtgagaatgctctactatctgcgtcaggaagtcatcggagatcaggctgaaaaggtcctgggcggcgccattgcttctgaaattgatatttggtttccggtggtagatcagctggaagtgcctactacctggtgggacagcgaagccgacaagtctctgctgattggagtgttcaagcatggatatgagaagtataataccatgagagcagaccctgccctgtgcttcttggaaaaggcaggcagaccagatgataaagcaatcgcggcggaacaccgggtgctggataacttcagcgatattgtggagggtgtggactttgacaaagactgcgaggatccagagtataagccgctccagggacctcctaaggatcaggacgacgaaggagatccactgatgatgatggacgaggaaatatccgtcattgatggcgatgaggcccaggttactcaacagccaggccacctgttctggcccccagggagcgcactgacagccagacttaggcggctggtcactgcttaccagcggtcgtataaacgggagcagatgaaaatagaggccgccgagaggggggaccgcaggaggagaaggtgcgaagccgcctttaagcttaaggagatcgctcgcagagagaaacagcagcgatggacccgcagggaacagaccgatttttatagagtagtatcaacctttggggtggaatatgaccccgataccatgcaattccattgggataggttccgaactttcgcccgtctggataagaagactgatgagtctctcactaagtacttccacgggtttgttgccatgtgtcggcaagtttgcagactgccaccagcagccggtgacgagcccccagatccaaatttattcattgaacccatcacagaggagcgagcctccaggactttgtataggattgagcttctgcggaggcttcgggagcaagtcctgtgccatcccttgctggaggaccgactcgccctgtgtcagccacctgggccggagctccctaagtggtgggagccagtcagacacgacggggagctgctgaggggtgcagcgagacacggtgtgtcacagactgattgtaacatcatgcaggatccagacttttcattcctcgctgccagaatgaattacatgcagaaccatcaggcaggcgcccccgcacctagcctgagccgttgctccactccactgctccatcaacagtatacctcgaggactgccagccccctgcctttaaggcccgatgccccagtggaaaagtcccctgaagagactgcgacgcaggtgcctagcttggagtctttgactctgaaactcgagcatgaagttgtcgcccgctccaggccaaccccccaggattatgagatgcgcgtgagcccaagcgatacaactccactggtatccagatctgtcccacctgtgaaactcgaggacgaggacgacagcgattcggaactggatctgtccaagctgtccccatcctcatccagtagctcatcatcgtcctccagcagttcctcaactgatgagagtgaggacgagaaggaagagaaactgactgaccaatctaggtcaaagctgtatgatgaggagtcactcctgagcttgacaatgtcccaggacggatttccaaacgaagatggggaacagatgacccctgagctgttgctgctccaggagcgacagcgagcttccgagtggcccaaggacagggtgttaataaacagaattgacctcgtgtgtcaggcagtgctgtctggtaaatggccctcttcacgccggtctcaggaaatggtcacaggtggcatcctggggccgggcaaccacctgcttgactcgccttccttaaccccaggtgagtacggtgatagcccagtgccaactccccgctcatcttccgctgcaagtatggctgaggaggaagccagcgcggttagtactgccgccgcccagtttaccaaattgcggcgcgggatggatgaaaaggaatttactgtgcagattaaggacgaggagggcttaaaactcacctttcagaagcacaaactcatggctaacggtgtgatgggagacggtcatcccctgtttcacaagaaaaagggcaatcggaaaaagttggttgaactggaagttgaatgcatggaagaacccaatcacctggatgtcgaccttgaaacgcgaattcccgtgatcaataaggtagacggcaccctgctggttggcgaggatgctcccagaagagcagagctggagatgtggttacagggacatcccgaattcgctgtggacccgaggttcctcgcgtatatggaggatagacggaaacaaaaatggcagcgatgtaaaaagaataacaaggctgaactaaactgtctgggcatggagcctgtgcaaacagcgaatagtcgtaatggtaaaaagggccaccacactgaaaccgtatttaacagggtcctgcctggcccaatcgctccagagtcaagcaagaaaagggcaagaaggatgaggccagatcttagcaaaatgatggcgttaatgcaaggcgggagtacggggagcttaagtctgcataatacgttccagcactcaagcagcgggctccagtcagttagctccctcggacattcatccgcgacctctgctagtctccctttcatgcccttcgtaatggggggcgctccttcgtctccccatgtggacagttcaacgatgctgcatcaccatcaccatcatccacacccccatcaccatcaccatcatcacccagggctcagagcaccgggatatcctagtagcccagttactaccgccagtggcacaacgctgagacttcctcccctgcaacctgaggaggatgatgatgaagacgaggaggatgatgatgatctgtcacagggatacgatagcagcgaaagggactttagcttaattgatgacccaatgatgcccgctaacagcgatagcagtgaggatgctgatgattag

SEQ ID NO: 112142 - DNA, 7746 bp, Artificial Sequence
  Description of Artificial Sequence: Synthetic coding sequence
atggcagatcccatcatggacttattcgatgaccccaatctcttcggtttagattcactgacggatgactcttttaaccaggtcacccaggatccgattgaggaagctctcggcctgcccagctctttggacagtctggatcagatgaaccaggatggtggtggtggagacgtaggaaactcgagtgcgtccgaactggtcccgcctccagaagagactgcacccacagaacttagcaaggaatcgaccgctcccgccccagaatcaatcacccttcatgattatactactcagccagcttcacaagagcagcctgcgcagcccgtccttcagaccagcactccaacctctgggctgcttcaagtcagcaaatcacaagaaattttgtcccagggaaacccctttatgggcgtttcggccacggccgtatctagcagtagtgccggcggtcagcccccacagtctgcccccaagattgttattcttaaggcccctcccagctcatccgttacaggcgctcacgtagcccagatccaggcccagggaatcacatcaactgcacagccactcgtggccgggaccgcaaatgggggtaaggtgaccttcaccaaagttctcaccggcacccctctgaggccaggagtctccatcgttagtggaaatacggttcttgctgccaaagtccccggcaaccaggctgctgttcagagaatcgtgcaaccaagcaggccagtcaagcagctcgtgctccagccagtgaaggggtctgccccagccgggaatcctggtgcaacagggcctccactgaaacccgctgtgactctcacctctacacccacccaaggcgagtctaagcgaatcaccctggtgctacagcagccccagtcggggggtccccaaggccacagacacgttgtactgggtagcctgccagggaagatcgtgctccagggtaatcaattggcagcgttaacccaggcaaagaatgcccaagggcagccagccaaggtggttaccatacagttacaggtgcagcagcctcagcagaaaatccagatcgtgcctcaaccaccttcctcgcaaccacagcctcagcaacctcctagcacacagccagtgaccctttcttcagttcaacaggctcagatcatggggcctggtcagtcgcccggccagcgcctgtccgtacctgttaaggtggtgctgcagccccaggctggatcctcacaaggcgcgtctagtggtctgtccgtcgtgaaagtgctgagtgcttctgaggtagcggccctctcatctcccgcgagcagcgcaccacacagcggcgggaaaacaggtatggaggagaaccgcaggctagaacaccaaaagaagcaggaaaaagctaaccgcatcgtagctgaggccatcgcacgtgctagagcccgcggagaacagaacattcctcgggtgctcaatgaggatgaactcccatccgtccggccagaagaggaaggggagaaaaagcgcagaaaaaagtctgccggagaacggctgaaagaagagaagcctaaaaagtccaagacctccggtgccagtaagactaagggtaaatcaaagctgaacaccattacaccagttgttgggaagaagagaaaaagaaacacatccagcgataactcagatgtggaagtgatgccggcccagagcccccgggaagatgaagagtcaagcatccagaaacgacgatcgaatcgtcaagtgaagcgcaaaaaatataccgaggacctagatataaaaatcacagatgacgaagaggaagaagaggtagatgtgacaggcccaataaagcccgagccaatactgcctgaacccgtccaagagcctgacggggagacactaccctcaatgcagttctttgttgagaacccgtccgaagaggatgccgcaattgtcgataaggtcctcagcatgcgaatagtaaaaaaagaactcccatcgggccagtacacagaggctgaggagttctttgtcaaatataaaaactactcttatttgcattgtgaatgggcaactatttcacaactggaaaaagataagcggatccaccaaaaactgaagagattcaagactaaaatggcccaaatgagacacttttttcacgaggatgaagagccgttcaaccccgattacgtcgaggtcgaccggattttagatgagtctcactccatcgataaggacaatggagaacccgtcatatactacctggtaaaatggtgttctctaccatacgaggattcaacgtgggagcttaaggaagacgtcgatgaaggtaaaatcagagagttcaaaagaatccaatcaaggcacccggagcttaagagagtgaaccgccctcaggcgagtgcatggaagaagctggaactatcccacgaatacaaaaaccggaatcagctcagggagtaccagctcgagggcgtgaattggctcctcttcaattggtacaaccggcagaattgcattctggctgatgaaatggggttgggcaaaactatccaaagcatcgcttttctgcaggaggtgtacaacgtgggcattcacgggcccttccttgtgatcgcccccctcagcacaattaccaattgggaaagggagttcaacacttggactgaaatgaacacaatagtgtaccatggatccctcgcaagccgacagatgatccagcagtatgagatgtattgcaaggatagtcgcggcaggcttatccctggagcgtataaatttgatgcactgattacgacctttgagatgatcctctccgattgtcctgaactccgggagatagagtggcgctgtgtcattattgacgaggcacacaggctgaagaatcggaactgcaagctgctggattcacttaaacatatggatttggaacataaggtgctattgaccggtacccccctgcagaataccgtcgaagagttattctccctcttgcattttctggagccttcccagttcccatccgagtccgagtttctgaaggactttggtgacctaaagaccgaggaacaggtgcagaagttgcaagcgatactgaagccaatgatgctacgcagactgaaggaagacgttgaaaaaaacctagctcccaaacaggaaactatcattgaggtcgaactaactaacatacagaagaaatattatagagctatcctagagaagaacttttccttcctttcaaaaggtgcaggacatacaaatatgcccaacctgctcaacacaatgatggaacttaggaagtgctgcaaccatccctaccttattaacggcgccgaggagaaaatcctcaccgagtttcgagaggcctgccacatcataccacatgattttcatctgcaggcgatggtaaggtcagccggcaaactggttctgatcgataagctccttccaaagctaaaggcaggggggcataaggttttgattttttcacagatggtgcgctgcctggacatcctggaagactatctgattcagcgcagatatctctatgaacgaattgacgggagagttagaggaaacctgagacaggctgcaattgatcgcttcagcaagccggacagtgataggttcgtctttctcttatgtactagggctggcggcctagggataaatttgacagcagctgatacgtgtatcattttcgacagtgattggaatccacagaatgatctccaggcccaggcacggtgccatagaataggacagagtaaggcagtgaaagtttatcgcctgatcaccaggaactcttatgagagagagatgtttgacaaggcctcgcttaagctcgggttagacaaggcagttctgcagtcaatgtctgggagagacggcaatattactgggatccagcagttcagcaaaaaggaaattgaagacctactgcgaaaaggcgcttatgccgccatcatggaggaggacgatgagggatccaaattctgtgaagaagacattgaccagatattgctccgacggaccacaactattactatcgagagcgaaggtaaaggctctacctttgccaaagccagtttcgtggctagcgaaaacaggactgatatttcccttgacgatcccaacttttggcagaagtgggctaaaaaggccgatttggacatggaccttctgaatagcaagaacaacctcgtgattgacaccccccgagttcgaaagcagacgcggcattttagtaccttgaaagacgacgacttggtggaattttctgacctagaaagcgaggacgacgagagacctcggagtaggcgccatgataggcaccacgcttatggtaggacagactgcttccgggttgagaagcatctgctggtgtacggttggggccgttggcgggacattctgtcccacggacggtttaagaggcgaatgactgagcgggatgttgagaccatctgccgggccatcttggtgtactgcctacttcactataggggggacgaaaatattaaaggattcatctgggacctgataagcccagctgagaacggcaaaaccaaagaactccagaatcacagtgggctctccattcccgtcccacgtggcagaaagggcaagaaagttaaatcacagtcaaccttcgacattcacaaggccgattggattagaaaatacaaccccgatacactctttcaggacgaaagctataagaagcatctcaaacaccagtgcaataaagttttgttaagagtcaggatgctatactacctgaggcaggaggtgatcggggatcaggctgagaaagttttgggtggggctattgctagtgaaatagacatatggttccccgtggtcgatcagctggaggtccccacgacttggtgggatagtgaagctgacaagtctttgttgattggggtgtttaagcatggttacgagaaatataacacgatgcgagcagaccctgccctctgcttcttggaaaaagcagggcggccagacgataaagccatagcagcagaacaccgggtgctggataacttctcagatatcgttgagggagtggatttcgacaaggattgtgaggacccagagtataagcctcttcagggcccacctaaggatcaggatgatgagggggacccactgatgatgatggacgaagaaatcagcgtgatcgatggcgacgaagcacaggttacacaacagccgggtcacttgttctggccacccgggtccgccctcacagcccgtttgcggaggttagtgaccgcttatcaacgtagttataagcgggagcaaatgaagatcgaagccgctgagcggggcgatcgtcggcggcgaagatgtgaggctgcgttcaagttgaaagaaatagcccggcgagaaaaacaacagcggtggacaagaagagagcaaaccgacttttacagagtggttagtacctttggcgtggagtatgaccctgacacaatgcagtttcactgggacaggtttcggacttttgctcgtctggacaagaagactgacgagtcgttgacaaaatacttccatggctttgtcgcaatgtgtcgtcaggtgtgccgcctgccaccggccgccggggatgaaccccccgaccctaacctgttcattgaaccaatcactgaggagagagctagcaggaccctctatcgaattgagctgctgaggcgcctgcgggaacaggtgttgtgccatccgctgctcgaggatcgcctggccctgtgtcagcctcccgggccggaacttcccaaatggtgggagcctgtgagacacgatggcgaactgctgcgtggcgccgcccgacacggcgtcagccaaactgactgcaacattatgcaggatcccgacttctcgttcctcgcagccaggatgaattatatgcagaaccaccaagccggtgcaccagccccgagcctgtcaagatgctccacccctctacttcaccagcagtacaccagtcggacagcctctccactacccctgcgacccgatgcccccgtcgaaaagtctccggaggaaacagctactcaggttcccagcctggaatcactaacgctcaagctcgagcacgaggtcgtcgcaaggtcccgccccacacctcaggactatgagatgagggtatcgccttctgacaccactcccttggtgtctaggtcggtcccccccgtgaagttagaggacgaggatgattctgattccgagttggacttgtccaaactgagtccttcaagcagtagctccagcagcagtagctcatcctctagttcaactgacgagtctgaagatgagaaagaagaaaagctgacagatcagtcccgcagtaagctatacgatgaggagagtctcctgtcgctcaccatgtcccaggacggtttcccgaatgaggatggagaacaaatgacccccgagctgctgttgctgcaggaaagacagagggcaagcgagtggcccaaggatagggttctcattaacagaatcgacctcgtgtgtcaggcggtcttgagtggcaagtggccgtccagtcgaaggtcacaggaaatggtaacaggaggcatattggggccaggcaaccatttgcttgatagtccgagcttgacacctggagagtacggagacagccccgtccccacacccaggtcaagctcggcggctagcatggctgaagaggaagctagcgccgtgtcaacggcggccgcccagtttaccaaactgcgacgcggaatggacgagaaggaattcaccgttcagatcaaagacgaagagggcctcaagttaaccttccaaaagcataagcttatggctaacggcgtgatgggcgatggccaccccctcttccacaagaagaaaggcaatcgaaaaaaattggtcgaattagaagtggagtgcatggaagagcccaatcatctggatgtggacctcgagacaaggattccagtcattaacaaggtggatggcacacttttggtcggcgaggatgcaccgcgcagggccgagctagagatgtggctacagggccacccggagttcgcagttgaccctagatttctggcttatatggaggaccggaggaaacagaagtggcagcgctgcaaaaaaaataataaagccgagcttaattgcctgggcatggagccggtgcaaaccgctaattctcgaaatggaaaaaaggggcaccacactgaaactgtgttcaatagagtgttgcccggcccaattgcaccagagtcttcgaagaaacgtgcgcgcagaatgcgccctgatctgagcaaaatgatggcactcatgcagggcgggtccaccggttcactgagcctgcataacacctttcagcattcttcctcaggcctccagagcgtctcgtcattgggtcatagttccgctacaagtgccagcttaccattcatgcccttcgtcatgggcggtgcaccttccagcccacacgtagattcctctaccatgctgcatcatcaccaccaccatccacacccccatcatcatcaccatcaccaccccggactgcgggctcctgggtatccttcctcacctgtcacaaccgcttctggcacaaccctccgcctaccacccctgcagcctgaggaagacgatgacgaggatgaggaagatgacgatgacctgagccaaggctatgactcctcagaacgagatttcagcctcattgatgacccaatgatgcctgcaaatagcgacagttccgaggacgctgacgattag

SEQ ID NO: 112143 - DNA, 1797 bp, Artificial Sequence
  Description of Artificial Sequence: Synthetic coding sequence
atgacctttcaggcatcgcacaggtcagcttggggaaagtctcgaaagaaaaactggcaatacgaaggcccgactcagaagttgttcctcaagcggaacaatgtatcagcacccgacggccccagtgatccttctatcagtgtttcgtcagaacagtcgggggctcagcaacctcctgcactgcaggtcgaaaggattgtggacaagcggaagaacaagaagggcaagactgagtatctggtgcgttggaaaggctatgactctgaggatgatacctgggagcccgaacaacacctggtcaattgtgaggaatatatacatgatttcaaccggaggcatacggaaaaacagaaagaatcaactcttaccaggacgaatcgcacatcacccaataatgcccgcaaacaaatcagtaggtctactaactctaacttttccaagacttcacccaaggcgctcgtgatcgggaaagaccatgagtccaagaactcccaactgtttgcagcgtcacaaaagttccgaaagaacactgcaccgagcctctcatctaggaagaatatggacctagccaaaagtggcattaaaattctggtaccaaagtctccagtgaagagccgaaccgccgtggacggctttcagtctgagtccccggagaagctcgatcccgtggaacaaggacaagaggatacagttgcccccgaagtggctgccgagaagcctgtaggtgcacttctgggaccaggagccgagcgtgcccgcatgggtagtcgaccacggattcatccactcgtcccgcaagtccccgggccagtgaccgcagcgatggcaacggggctggccgtgaacggaaaaggaaccagtcccttcatggatgccttgacggctaatgggacaaccaatatacagactagtgtgaccggggtgactgcaagcaagagaaagtttatcgatgaccggcgcgaccagccttttgataagcgattgagattttctgtcaggcagaccgagagcgcctaccggtacagagatatcgtagtgagaaaacaggatggtttcacacacattctgctttccacaaaaagcagcgagaataattccctgaacccggaagtgatgagagaggtgcagtctgcattgtcaaccgccgccgcagacgactccaagctcgtgctgctcagcgcggttggcagcgtattctgctgcggcctggactttatttactttattcgaagactaactgacgacaggaaacgtgagtccactaaaatggccgaagctatccggaattttgtcaatacatttattcaatttaagaaaccaataatcgtcgccgtcaatggaccggcaattggactgggggcctctattcttcccctgtgcgacgtggtgtgggcaaacgagaaggcttggttccagactccgtatacaacgttcggacagagcccggatggatgctccaccgtaatgttccccaaaatcatgggaggcgctagcgccaatgaaatgcttctgtctgggagaaagctcactgcacaagaggcatgcggaaaggggcttgtctctcaggtgttttggccaggaactttcactcaggaagtgatggttcgcataaaggagctggcatcctgcaaccctgtcgtgttagaagagtcaaaagcattagtgcgctgcaatatgaaaatggagctggagcaggctaatgaacgtgagtgcgaagtactaaaaaaaatttggggctcggcccaggggatggacagcatgctcaaatatctgcagagaaaaattgacgaattttag

SEQ ID NO: 112144 - DNA, 1239 bp, Artificial Sequence
  Description of Artificial Sequence: Synthetic coding sequence
atggatctggccaagagcggcattaagatcttggttcctaaatctccagttaagtcccgcacggccgtggatggctttcagagtgagtcccctgagaagctggatccagtggagcaaggacaggaggacactgtagcccctgaggtagcggccgagaagccagtaggcgccctactaggccccggggccgagcgcgcccggatgggatcgcggccgagaatccacccgctggtacctcaggttccaggccccgttactgcggccatggcaacaggtctagccgtcaacggcaaggggacttctccttttatggacgctctgacagcaaacgggactaccaatattcaaacctcagtaacgggcgtgaccgcaagtaaacggaaatttattgacgaccgtagggaccagcccttcgacaaacgcctgaggttctctgttcggcaaactgaatcagcttacaggtacagagatattgtggttaggaaacaagacggctttactcatatcctgcttagcaccaaatcgtccgaaaataacagtctcaatcctgaggttatgcgcgaggtccagtctgccctgagcactgcagccgcggatgactcaaaacttgtgctgttaagtgccgtgggaagcgtgttctgttgtggactggacttcatctacttcatcaggcgtctgactgacgatcggaagagggagtcaaccaaaatggcagaggctatccgaaacttcgtcaacacttttatacagtttaagaagccaatcattgtcgccgtgaacgggccagctatcgggctaggcgcatctatcctgcctttgtgtgatgtggtgtgggctaatgaaaaggcttggttccaaaccccctataccacttttggacagagtcccgatggatgctctactgtgatgttcccgaaaattatgggtggcgccagtgcaaacgagatgctgttgtccggaagaaaactaaccgcacaggaggcctgtggcaaaggcttagtcagccaagtgttttggccaggcacctttacccaggaggttatggtgcgaattaaggagctggcaagttgcaatcccgtcgtcttggaggaaagcaaggccctggtgcgctgtaacatgaaaatggaattggagcaggctaatgagagagaatgtgaggtcctcaagaaaatctggggatcggctcaggggatggatagtatgttgaagtacctccagcgaaaaattgatgagttttag

SEQ ID NO: 112145 - DNA, 1635 bp, Artificial Sequence
  Description of Artificial Sequence: Synthetic coding sequence
atggcaagcgaggaattatatgaggtggaacggatagtggacaagcgaaagaacaagaaaggaaaaacggagtatctagttcgctggaagggctatgactccgaggacgacacttgggaacctgaacaacacctggttaactgtgaggagtatatccacgatttcaatcgccggcacacggaaaaacaaaaggagagcactctcaccagaactaaccgaacttcacctaacaatgctcggaagcagattagccgctccactaattcaaactttagcaaaacgtctccaaaggccttagtcatcgggaaggaccacgaatccaagaatagccaactattcgcggcgagtcagaaattcagaaaaaacactgctccttcactctcgagccgtaagaacatggacttggctaagagcgggatcaagatcttggtgcccaaatcccccgtgaaatctaggaccgcagttgatggatttcaatcggaaagcccagaaaaattagaccctgtcgagcaaggccaagaagatactgtcgcacctgaagttgctgcagagaagcccgtcggggccctcctgggcccgggcgcggaacgggcacgaatgggatcccgccctagaattcatcctctagtccctcaagtacctggccctgtaactgccgctatggccacgggtctcgctgtgaacggtaaaggcacttcaccctttatggatgctctaacagcaaatggcaccacgaacatccagacaagcgtgacaggggtgactgcctccaagcgaaaatttattgacgatcggagggaccagccattcgacaagagactgaggttctccgtccggcagaccgaatctgcttaccggtatagggatatagtggtgagaaagcaagacgggtttacccatatattgttgagtacgaagagcagcgagaataatagcctgaatccagaggttatgcgggaggtgcaaagcgctctttcaactgctgccgccgacgattctaaactcgtcttgctctcagccgtgggaagtgttttctgctgcggactcgacttcatttacttcatcagaagacttactgacgacagaaaacgggagtccacaaagatggccgaagccatccgaaattttgtgaataccttcattcagttcaagaaacctataatcgttgctgtgaacggtcctgccattggcctgggggcatccatactgcctctgtgcgatgtggtgtgggctaacgaaaaggcgtggttccagactccgtatacaacttttgggcagagtcctgatggctgctccacggtcatgttccctaaaatcatgggtggggcgagtgcaaatgagatgctgctgagcggacgaaagctgacagcacaggaggcatgcggcaagggcttagtctcccaggtgttctggccaggcacatttacccaggaagtgatggtgcgcattaaagagcttgcttcatgtaacccagtcgttctcgaggagagtaaagcgctggtccgctgcaatatgaagatggagttggaacaagcaaatgaaagggaatgtgaagtgctgaaaaagatctggggaagcgcccaagggatggactccatgctcaaatatttgcagcgaaagatcgacgagttctag

SEQ ID NO: 112146 - DNA, 1239 bp, Artificial Sequence
  Description of Artificial Sequence: Synthetic coding sequence
atggacctggccaagtcagggattaagatcttggtgcctaagagccccgtgaagagcagaaccgccgtggacgggtttcaatcggaaagccccgaaaagcttgaccccgtagagcagggccaggaagacacagtggcgcctgaagtggcagccgaaaaaccggtgggtgctcttcttggtccaggagctgagcgtgcccgcatgggctcccgaccgcgaattcacccactggttcctcaggtgcccggacctgtcacagctgcgatggcaaccggcctggcagtcaacggaaaggggaccagcccctttatggacgccctcacggcaaatggcacgacaaacattcagaccagcgtgaccggggtgactgcaagtaaacgcaaattcatcgacgatcgccgagaccagcctttcgataagaggctaagattcagcgtgcgccagaccgagtcagcttacagataccgcgatattgttgtgcggaagcaagacgggttcactcacatcttactgagcaccaaaagctccgaaaacaacagtttgaacccagaggtaatgagagaagtccagagcgccttgagtacggctgcggctgacgattccaagttagtgcttcttagcgcagtgggatctgtgttttgctgcgggctggatttcatctacttcattcgcagattgactgacgacagaaagcgagagagtacaaaaatggctgaggccattcggaatttcgttaataccttcattcagtttaagaaaccgattattgtcgcagtaaatggtcccgcaataggactgggagcttctatactaccgttgtgtgatgttgtttgggccaacgaaaaggcctggttccagactccatatacaacttttgggcagtctcccgatggctgcagcacagtgatgttcccaaagattatgggaggagccagcgcaaatgagatgctcctttctgggaggaaactgaccgcccaggaggcctgcgggaagggactggtgagtcaggttttttggcccggaacatttacacaagaagtcatggtgaggatcaaggagctcgcctcatgcaaccccgtggttctcgaagagagtaaggccctggtccgctgcaatatgaaaatggagttagaacaggccaacgagcgggaatgtgaagtgctgaaaaaaatatggggaagcgcccagggaatggacagtatgctgaaatacctgcagaggaaaatcgacgagttctag

SEQ ID NO: 112147 - DNA, 1665 bp, Artificial Sequence
  Description of Artificial Sequence: Synthetic coding sequence
atggcctctcaggagtttgaagtggaggctatagtagataaaaggcaggataagaatggcaatacacaatacctggtcaggtggaaaggctacgataagcaggacgacacttgggagccagagcaacacttgatgaattgcgagaaatgtgtacacgactttaaccgcaggcaaacagagaagcagaagaaactgacttggaccacaacatcccggatattcagcaataatgccagaagaaggaccagccgcagtacgaaagccaattactcaaaaaactccccaaagacccccgtcactgataagcaccaccgcagtaaaaataggaagctctttgccgcaagtaagaatgttcgcaggaaggccgcttcaatcctttctgataccaagaacatggaaattatcaattctaccattgagacccttgccccagattccccattcgatcacaagaccgtgtccggcttccaaaagctcgagaagctagaccccatagccgccgaccagcaggacacagtggtgtttaaggtcactgaaggcaaactgctccgcgacccactgtccaggcccggggctgaacagacaggaatacagaacaagactcagatccatccattgatgtctcagatgagtggttctgtgaccgccagcatggccaccggtagtgccacgagaaagggaatcgtggttctgatcgaccccttagcggcaaacggaaccactgacatgcatacttctgtgcccagagtgaaaggtgggcaaagaaacatcacagacgactcacgggaccagccattcataaaaaagatgcatttcaccatccggttgacggaaagcgcctcaacatacagagatattgttgttaagaaagaggatggttttacccagatcgtgcttagcaccagatctaccgaaaaaaacgcattaaacacagaggttattaaggagattgtcaacgctcttaactctgccgccgcggatgatagtaaacttgtgctattttctgcagctgggagcgtcttctgctgtggcctcgattttggctacttcgtgaaacacctgaggaacaaccgaaacacagccagcctggaaatggtggataccataaaaaacttcgtaaacacttttatccagtttaagaagccaatcgtagtgtccgtaaatggaccggccatagggttgggcgcatcaatcctgcccctctgcgacttggtgtgggccaatgaaaaagcctggtttcaaactccttacacaacctttggccagagccctgatgggtgttcttccatcactttccctaagatgatggggaaggcatctgccaacgagatgctaatcgcgggcaggaaattaactgcacgtgaggcgtgcgccaagggacttgtctcccaggtgtttcttaccggcaccttcacccaggaggtgatgatccagattaaggagttggcaagctacaatcctatcgtgttggaagagtgtaaggccctagtcagatgcaacatcaagctggaacttgaacaagctaacgaaagggagtgcgaggtgctgcgcaagatatggtcttctgcacagggcatcgagtctatgcttaagatacccctcctgggttacaaggcagccttcccccctcgcaagacccagaacgatcagcgctggtgtccatag

SEQ ID NO: 112148 - DNA, 1623 bp, Artificial Sequence
  Description of Artificial Sequence: Synthetic coding sequence
atggcctctcaagaattcgaagtggaagcaattgtcgataagaggcaggacaaaaatggcaacacccagtaccttgttaggtggaagggctacgacaagcaggatgatacctgggagcctgagcaacacttaatgaactgtgagaagtgtgtgcacgacttcaaccgcaggcagacagaaaagcagaagaaattgacatggacaaccacttctcggatcttctcgaataatgctaggcgaagaacaagtagatccacaaaagccaattactccaaaaattcgcccaaaaccccggtcaccgacaaacaccaccgttccaagaatcgcaagctgttcgcagctagcaaaaacgtccgtcgcaaggccgctagcatcctgtccgacacgaaaaacatggagatcataaattccacgattgaaactctggctcccgactctccgtttgaccacaaaacagtatctggatttcagaaattggagaagttggatccaatcgccgctgatcagcaagataccgtagtcttcaaggtaactgaaggcaaacttttgagggacccattatcccggccaggagcagaacaaacaggaatccagaacaaaactcaaatccaccccctgatgagccagatgagtggatccgtgactgctagtatggcaacagggagtgccacacggaaaggaatagttgtgctgatagaccccctggctgccaatggaaccacggacatgcatacaagtgtccccagagtaaagggcggccaaaggaatattaccgacgactcacgggaccagccgtttattaagaaaatgcacttcactattcgcctaaccgagagtgcttctacctaccgagacatcgtggtgaagaaagaagacggatttacacagatagtcctgtcaacccgtagcacagagaagaatgccctcaacacggaggtgatcaaggagattgtcaacgcgctcaactctgcagcagcagacgacagtaaactggtgctgttttcagcagccgggtcagttttttgctgcgggctggatttcggctactttgttaagcacctgcgaaataatcggaacactgcttctctcgaaatggtagacaccataaaaaattttgtgaacaccttcattcaattcaagaaacctattgttgtatcagtgaatgggccagctattggactgggagcctcgatcctcccgctgtgtgatctggtctgggcaaacgaaaaggcctggtttcagaccccttatacaacatttggacagtccccagatggctgcagctcaatcacgttcccgaagatgatgggcaaagcttcagcaaatgagatgctcatcgctggtcggaagctgacagcccgcgaagcttgcgcgaaagggttggtttcccaggtatttctgacgggcactttcacgcaggaagtgatgatccaaattaaagagctcgccagttataaccctatcgtgctggaagagtgcaaagcgttggtcaggtgtaatatcaagctcgagctcgaacaggcaaatgagcgtgagtgtgaggtgcttcggaagatctggagctcagctcaagggattgaaagcatgcttaaatacgtcgaaaataaaatcgacgagttctag

SEQ ID NO: 112149 - DNA, 1170 bp, Artificial Sequence
  Description of Artificial Sequence: Synthetic coding sequence
atgggaaagatggctgctgccgtcggaagtgtcgccactctagctaccgaacccggagaggacgccttccgcaaattgtttagattttataggcaaagtagacccgggactgcagatctggagggggtgatagacttcagcgctgctcatgctgcccgcggcaagggaccaggcgcccagaaagtaattaagagccaattgaatgttagtagcgtgtcagaacaaaacgcctatcgtgccggccttcaacccgtgtccaagtggcaggcttacggcctgaaaggttacccaggtttcatctttatccctaatcctttcctgcctggataccagtggcattgggtgaaacagtgccttaaactgtacagccagaaacccaacgtatgcaacttagataaacacatgagtaaggaggagacccaggatctgtgggaacaaagcaaggaattccttcgttataaagaggctaccaagaggcggccccggtctctccttgaaaagctgagatgggtgactgtagggtaccattataattgggattctaagaagtactctgctgaccactacactccatttccctctgaccttggatttctgagcgagcaggtggctgccgcttgtgggttcgaagattttcgggcagaagccggcatactcaattactaccggttggacagtacacttggcatccacgtagataggtcagaactcgatcattccaagcctttactgtccttcagcttcggacagagcgctatcttcctcctcggtgggctgcaacgagacgaggcccctaccgctatgtttatgcatagcggcgacataatgatcatgtctggctttagcaggctgctgaatcacgctgtacctcgggtcctgcccaaccccgagggcgagggcctgccccactgcctcgaggcccctttaccagccgtgctgcctcgtgacagtatggtggagccttgttcaatggaagactggcaggtctgtgcatcctacctgaagactgctcgggtcaatatgaccgtccggcaggtgttggccacggatcagaactttcccttggagcctattgaagatgagaagcgcgatatctctacagagggattttgccaccttgatgaccagaatagtgaagtcaagcgtgccagaattaaccccgacagctag

SEQ ID NO: 112150 - DNA, 921 bp, Artificial Sequence
  Description of Artificial Sequence: Synthetic coding sequence
atgcgatcagccgccgtcttggccctcctcctttgtgcagggcaagtgactgctctccccgtgaacagtcctatgaacaaaggagacaccgaggtaatgaagtgtattgtcgaagtgattagtgataccctatcaaagccctctccaatgccagtgtcccaggaatgcttcgaaactctccgaggtgacgagagaatcctgtccatcctgcgacatcaaaatctgctcaaggagctgcaagacctggctctccagggcgcaaaggaacgcgcacaccagcagaaaaagcactcaggcttcgaggacgaactgagtgaagttcttgaaaaccaaagctcccaagccgagttgaaaggtagaagtgaggcactggctgtggatggcgctggcaaacctggagccgaagaggcccaagatcccgagggcaaaggcgaacaggagcattctcaacagaaggaggaggaagaggaaatggctgtggtcccacagggactgtttcggggtgggaaatccggtgaactggagcaggaagaggagcgtcttagtaaggagtgggaggactctaaacggtggtctaagatggatcagctggcaaaggagttgaccgcagagaaacggctcgagggccaggaagaggaagaggacaatcgcgattctagcatgaagttgagtttccgagcccgggcatacggatttcgcggcccaggcccacagctcaggcgcggttggcggcctagcagccgcgaggactcattggaggctggcctccccctgcaggtacgcgggtatcccgaagagaaaaaagaggaggaaggctcagccaataggcgaccggaggatcaggagctcgagtctctatccgcaatcgaggcagaactggagaaagttgcacaccagttacaagctcttcggaggggctag

SEQ ID NO: 112151 - DNA, 2034 bp, Artificial Sequence
  Description of Artificial Sequence: Synthetic coding sequence
atgcagccgacccttcttttatccttactcggggcagtaggactcgccgcagtgaattcgatgcccgtcgataatcgtaatcacaacgaagggatggtgaccaggtgtattatagaggtgctgtctaatgccctgagtaagagttctgctcctcccatcaccccagagtgcagacaagtgttaaagacgtcgcggaaggacgtcaaagataaggagaccaccgaaaatgaaaacacaaaattcgaagttcgcttgctaagggatcctgccgatgcatccgaagctcacgaaagttcttcccgcggagaggcaggggcccccggcgaggaggatattcagggccccaccaaagccgacaccgaaaagtgggccgaaggcggcggtcactctagggagcgggccgacgaaccccagtggtctctgtatcctagtgattcgcaggtatctgaggaggttaaaacgagacacagcgagaaaagccagagggaggacgaagaggaagaggaaggagaaaactaccagaaaggcgagaggggcgaggattccagtgaagaaaaacacctagaagaacccggggaaactcagaatgccttcctgaacgaacggaaacaagccagcgccattaaaaaagaggagctggtggctcgatctgagacacatgcagccggacacagtcaggaaaaaacccacagtcgtgaaaaatctagccaggaatcaggagaggaaaccggttcccaagaaaaccacccccaggagagtaaagggcagcctcggtcccaggaggaatccgaggaaggcgaggaggacgctacgagtgaggtggacaagcggaggacgcgaccacgccaccaccacgggcggtcacgccctgaccgctcgagtcagggtggaagcctacccagtgaggagaaggggcatcctcaggaagaatccgaagagagtaacgtgagcatggcatccttgggggagaaacgggatcatcattccacccactacagagcatctgaggaggaaccggaatacggagaagagatcaaggggtatccaggagtgcaggcccccgaagatctcgaatgggaacgctacagaggccgcggatccgaagaataccgggcccctaggccgcagtcagaggagtcttgggacgaggaggacaaacgtaattatccttcacttgaactggataagatggcacatggatatggtgaagagagcgaggaagagcgcggccttgagccagggaaggggcgtcatcaccgcggaaggggaggtgaaccacgagcgtattttatgagtgatacacgcgaagagaaaagattccttggagagggacatcaccgggtgcaggaaaatcagatggacaaggcaagacgccatccgcagggcgcatggaaggaattagaccgcaattacctcaattatggtgaagagggggcccctggcaaatggcagcaacagggcgatctgcaggacaccaaagagaaccgagaagaagcaagatttcaagacaaacaatatagcagccatcatacagcggagaagcgaaagcgtctgggcgaactcttcaatccttattatgaccccctgcagtggaaaagcagccacttcgagcggcgggataacatgaatgataattttctggaaggtgaggaagagaatgagctgaccctaaacgaaaaaaactttttccctgaatacaactacgattggtgggaaaagaaacccttctctgaagacgtgaattggggctatgagaagaggaatctagcgcgggtccccaaactagatctgaaaagacagtatgacagagtcgcccagttggatcagctgctgcactataggaagaaaagtgctgaattccctgacttttacgacagcgaggaacctgtgtctacgcaccaggaggccgagaacgagaaggatagagcagatcagacggtgctgactgaagatgagaagaaggagcttgaaaacctggccgccatggacctggagttgcaaaagatagcggagaagttttcgcaacggggctag

SEQ ID NO: 112152 - DNA, 870 bp, Artificial Sequence
  Description of Artificial Sequence: Synthetic coding sequence
atgccggtcgacaatagaaaccacaatgaaggaatggtgacaagatgcattatagaggtactatccaatgcgctcagcaagtcctcggccccccctattactcccgagtgccgccaagttcttaagacctcaaggaaagacgttaaggacaaagagacaacagaaaatgaaaataccaagtttgaagtgaggttactgagagaccctgcagacgcctccgaagctcacgagtctagcagtcgcggagaagccggcgcaccaggtgaggaagacatacagggacccactaaggccgacaccgaaaagtgggcggagggagggggacattctagagaacgcgctgacgagcctcaatggagtctctatccgtccgactcccaagtgagcgaggaggtgaaaactagacacagtgagaaatcccagagagaggacgaagaagaggaggagggtgagaactaccagaaaggggagagaggcgaggatagttccgaagagaagcacctcgaggagccaggtgagactcagaatgcgtttctgaacgagcgaaagcaggctagcgccattaaaaaggaggagctggtagcgcggtccgagactcacgctgcagggcacagccaggagaagacacatagccgggagaagtcttcccaggagtccggggaggagacaggaagtcaggaaaatcatcctcaggagtctaagggacagccaagatcccaggaagaatcagaggaaggggaggaagacgcaaccagcgaggtggataagagacggactagaccccggcaccaccatgggcgctcaaggccggatcgcagcagccaagggggatctcttccaagcgaggagaaggggcaccctcaggagtag

SEQ ID NO: 112153 - DNA, 1806 bp, Artificial Sequence
  Description of Artificial Sequence: Synthetic coding sequence
atgcccgagagggagctttggccggcaggaacaggtagcgaacctgtaaccagagtcggcagttgcgactccatgatgagtagtacgtctacccgcagcgggtcctctgactcgagttacgacttcctaagtactgaggagaaagaatgccttctcttcctggaagagactatagggtccttggataccgaggctgattccggactgtccaccgacgagagcgagcccgcgactaccccgcgtggctttagggctttgcctatcacccagccaaccccaagaggaggccccgaggagaccataacccagcagggtagaaccccacgcactgtgacagagagtagctcaagtcatccccccgagcctcaaggtttggggctgcgcagcggcagttattccttgcctagaaacatccacattgcccgcagtcagaactttcgcaagtccaccacccaggcatcaagccacaatccaggagagccaggccggttggctcctgagccggaaaaggaacaggtgtcgcagtctagccagcctcgtcaagccccagcttctccacaggaggctgccctggacctggacgttgtcctcattccacctccagaagcgttccgtgacacacagccagagcagtgcagagaggctagcctgcctgagggccctgggcagcaagggcataccccccagctgcacactccctcgagctcccaggagagggagcagactcctagtgaggccatgtcccagaaagccaaggagaccgtctccactcgctacacacagccccagccgccgcctgctggactcccacagaatgcaagagcagaagacgcccctttgagtagcggcgaggatcccaacagccggctggctccccttacaacgcccaagcctaggaagttgccgccgaacatagtcctcaaatcttccagaagcagctttcacagtgatccgcaacactggctgtcccgtcacactgaggcagcccccggcgactcgggcctaatttcatgttcgcttcaagaacagcggaaagccagaaaggaggcactcgagaagctcggtctcccccaggatcaggacgaacccggccttcatctctctaagccaaccagctccatacggcccaaagaaaccagggcgcagcacctgagccccgcacccggcctggcacagcctgcagcccccgcccaggccagcgccgccattcctgctgccggcaaggctctggcacaggctcccgcgcctgcaccgggcccagcacagggccctctgcccatgaagtcgcctgctccaggaaacgtcgcagcttcaaaaagcatgccaatctctatccctaaagcgccccgagccaattccgccctcacacccccaaagcccgagtcaggacttacgcttcaggagtccaacacgccaggccttaggcagatgaacttcaagagtaacactctggagagatctggcgtcggtctgagctcctatctttctacggagaaggatgccagccccaagacctcgacaagtctcggtaagggttccttccttgacaaaatcagtccctcggtccttaggaattcccgccctcgcccagcatccttgggaactggcaaggactttgccggaatccaggttggcaaactggcagacctggagcaagaacaatcaagcaaaaggttaagctaccagggccagagccgggacaaactccctcggccaccttgtgtgagcgtgaagatttctccaaagggtgtacctaatgagcaccgtagagaggctctgaaaaaactgggattgctgaaggagtag

SEQ ID NO: 112154 - DNA, 1068 bp, Artificial Sequence
  Description of Artificial Sequence: Synthetic coding sequence
atgtcacaaaaggccaaagagaccgtctccacccgttacacccagccccagccaccccctgctggacttccacagaatgctcgggcagaagacgctcccctttccagcggcgaagacccaaacagccggttggcccccttgaccaccccgaagccacggaagttgccacctaatattgtattgaaaagtagcaggtcctcatttcattctgatccccagcattggctgagccggcacacagaggctgccccgggcgatagtggattaataagctgttctctgcaggaacagagaaaagcccgcaaggaagctctggagaagctcggcctaccccaggaccaggacgagcctggactccatctgagcaagcctacaagctccatacgccctaaggagacaagggctcaacatctttctccagccccggggctagcccaacccgctgcacctgctcaggcttcagcagcaatccccgctgccggtaaagccctggcacaggctcccgccccagcgcctggcccagcccaagggccactcccaatgaaatctccagcccctggtaacgtcgccgcttccaagagtatgcccatttcgattccaaaagcacctcgggcaaatagcgcactgactccacccaagccggaatccgggctgacactgcaagagagcaatacccccggcctccggcagatgaacttcaaatctaatactctcgagcgttccggggttgggctgagtagctacctctcaacagagaaggacgccagtccaaagacttccactagtctcggcaaggggtcattcctggacaagatctcaccatcagttctacgcaactcaagacctcgaccagcttctctagggactgggaaggatttcgccggcatacaggttggaaagctggcggacctcgaacaggaacagagcagtaaacgactgagctaccagggtcaaagccgggacaaactccctagaccaccttgtgtgtctgtcaaaatctcgcctaaaggagtgcctaatgagcacagaagggaggccctcaagaagctgggattattgaaagaatag

SEQ ID NO: 112155 - DNA, 1050 bp, Artificial Sequence
  Description of Artificial Sequence: Synthetic coding sequence
atggccggcccagctattcataccgcccccatgctcttcctggtgctactgctgccccttgaattatccctggccggagcacttgccccgggtactcctgctcggaatctccccgaaaatcatattgacctccccggaccggcgttatggactccacaggcaagccaccatcggcgaaggggaccaggtaagaaagagtggggcccaggcctgccctcgcaggcccaagacggcgcagtggtgacagccacgaggcaggcaagcaggcttcctgaggccgagggcttacttccagagcagagccccgcagggcttctccaggacaaagacctgctccttgggttggcactcccgtatcccgagaaagaaaacagaccaccaggttgggaaaggacccgcaagagatctagggagcataagcgacgccgtgacaggctgcgtttacaccaaggaagagccttggttagaggcccaagtagtctcatgaagaaagctgaactcagcgaggcacaggtgctggacgcagccatggaagagagctccaccagcctggcccccactatgttcttcctcaccaccttcgaggcagcacccgctacggaggaatcactgatcctgcctgttacaagtctcaggccgcagcaggctcagcctcgatcagatggcgaggtgatgccgacgctggatatggctttgttcgactggaccgactacgaagacctgaagccggatggctggcctagcgctaagaagaaggagaagcatagaggaaagctgtctagtgatggcaacgaaacaagcccagccgagggggaaccatgtgaccatcaccaggattgcctgcccgggacctgttgtgacctgcgggagcacctgtgcactccccataacaggggactgaataacaaatgctttgatgactgcatgtgcgtagagggtctgcggtgctatgccaaatttcatagaaacaggcgcgtcacccggcggaagggccggtgcgtggaaccggagacagccaatggagatcagggttcttttatcaatgtgtag

SEQ ID NO: 112156 - DNA, 477 bp, Artificial Sequence
  Description of Artificial Sequence: Synthetic coding sequence
atgtgcttttctcgagcagacgccgccgacaattacccatttggtacctgccagcaaagaaagcttttcccacacttccatccgcccaacctgataggaaataagttcgtgcccttacgcggaagtcctcatcgcggccctgggtgctatttcagcgatgaaatgacgcctcatgccggccggtatcaaaaagtcagtccgcagcaggagaagcataagcaaaactttgccccttttaatgtcctcgttccaagatttaagaattatcccaaggacacttattatcctagtcctggggcctataatcctgagaagaagccccctcccaaaatcgcatggcccatgaaatttggctcgccagactgggcacaggtgccttgtttgcaaaaacgaaccttgaaggcagagctgtccaccgacaaagacttcagaaagcatagaaacagggtcgcttatctgtccttgtactacaactag

SEQ ID NO: 112157 - DNA, 576 bp, Artificial Sequence
  Description of Artificial Sequence: Synthetic coding sequence
atgtgtttcagtagggccgacgcggctgacaattatccctttgggacatgtcaacagagaaaattattccctcactttcatccacccaacttgattgggaataaattcgttcccctacgaggaagtcctcaccgtggccccggatgctatttctccgacggatacgggctggcttacgatctgtcaaaaatcccaaccagcataaaggggtacaccctgggggcccggacagccgtcagatttaaacctatacagaaggagatgaccccccatgcagggcgatatcagaaagtgtcacctcagcaagagaagcataaacaaaatttcgcaccatttaacgttctcgtaccccgatttaaaaattatccaaaggacacttactatcctagcccaggggcatacaaccctgagaagaaacctcctcccaagattgcatggcctatgaaatttgggtcacctgattgggctcaggtgccttgcctgcaaaaacggaccttgaaagccgagctgtctacagataaagatttccggaagcatagaaaccgggtggcctatttgtccctctactacaattag

SEQ ID NO: 112158 - DNA, 2055 bp, Artificial Sequence
  Description of Artificial Sequence: Synthetic coding sequence
atgtgggtcctactccgatctggctatcctctgagaattctgctgcctctacgcggtgaatggatgggcagacgcggattgcccagaaatctcgcccctggcccacccaggaggagatacagaaaagagaccctccaggcccttgacatgccagtgttacccgtgacagcaacagagataagacagtatctacgcgggcacggaatcccatttcaggatggacatagttgcttacgggccctgtcccctttcgcggagtcgtcccagctgaaaggacagaccggtgtgaccaccagcttctcactgttcatcgacaaaactactgggcatttcctgtgtatgacatccctagctgagggatcatgggaggacttccaggcttctgtggaaggtcgcggcgatggagcgcgtgagggattccttctgagcaaagccccagaatttgaagacagcgaggaggtcaggcggatatggaatcgagccatcccattatgggaactccctgatcaggaggaggtgcagttagcagacactatgtttggactcacaaaagtcactgacgatactctaaaaaggttttccgtgagatatctcagacctgctcggagtctggtgttcccctggttttcaccggggggcagcgggctccgtggcctgaagctgctggaggccaagtgtcaaggcgacggagtttcgtatgaggaaaccacaatcccgcgtcctagcgcctatcacaatctgtttggcttgccgttgatatcacgccgagatgccgaagttgtgcttacttcccgggagcttgactctctagccctaaaccagagcactggactgcctaccctcacattaccccgcggcacaacatgcctgccacccgctctcctgccctacctggagcaatttagaaggatcgtgttttggctgggagacgacttacgctcctgggaggcggctaagttgttcgccagaaaactgaatccaaagagatgctttttggttaggccaggcgaccagcagcccaggccattggaggcacttaatggcgggtttaacctcagtcgaatcctgcggacagccctccccgcctggcacaagagcattgtcagcttccgacaactgagggaggaagtacttggggagctctcaaatgtcgaacaggccgcaggactccggtggtctagattccccgacctaaaccgtatcttaaaggggcacaggaagggtgaactcacagtgttcaccggccctaccgggagcggaaaaactaccttcatttctgaatatgccttggacttgtgcagccagggggtcaacacgttgtggggctcctttgagataagcaacgtgagattggccagggtgatgcttactcagttcgccgaaggcaggcttgaggatcaactggacaaatatgaccattgggccgatcgctttgaagacctcccgctctattttatgacctttcacggccagcagagtatccggaccgtgatagacaccatgcagcacgccgtatatgtgtatgatatttgtcacgtaattatcgataacctacaatttatgatgggccacgaacaactgtcaacagacaggattgccgcccaggattacatcatcggagtgttccggaagtttgctacagataacaactgccacgtcaccctggttatacatccgcgcaaagaagacgatgataaagagctccagactgccagcatttttggatctgcaaaagcgtcacaggaggccgacaatgttctgatcctccaggatcggaagctcgttactgggcccggcaagcgttatctgcaggttagcaagaatcgatttgacggagatgtgggtgtcttcccactggaatttaacaaaaattctttgaccttttcaatccccccaaaaaacaaagcccggctgaagaaaatcaaagatgacactgggcccgtggccaaaaaaccctcatctggcaagaaaggagctacgacacagaattccgaaatttgcagcggtcaagctccaacaccagaccaacctgacacctctaagcgtagtaaatag

SEQ ID NO: 112159 - DNA, 1749 bp, Artificial Sequence
  Description of Artificial Sequence: Synthetic coding sequence
atgtgggtgttactacggagcggatatcctctccgaatcttactcccactgcgcggcgagtggatgggaagaaggggactgcccaggaacctcgctcctgggcccccgcggcgccgataccggaaagaaacccttcaagccctagatatgccagttcttcccgtcacggcgacagagattcgccagtacttgaggggccatggcatccctttccaggacgggcactcctgcctgagagcactgagccctttcgccgagagttcccaacttaagggccagaccggcgtgacgacgtcctttagtctttttatcgacaagacaactggacacttcctgtgtatgacttcactcgccgaggggtcttgggaggattttcaagcctcggtagaaggccgaggagacggcgctcgggaaggcttcctcctgtctaaggctcccgagttcgaggactctgaggaggtgaggagaatctggaaccgggccattcctctttgggagctccccgaccaggaggaggtgcaactggctgatactatgtttggcctgaccaaggtaacagacgataccctaaaacgattctctgtgcgatacctgagacccgcaagaagtctggtcttcccctggttttcacccggcgggtctggcctgcgcggtttaaagttacttgaagccaagtgtcagggagacggggttagctatgaagaaactactatccctagacccagcgcatatcataacttgttcggtcttccgctgatatcaaggagagacgccgaggtcgtgttgacctcaagagagctggacagtctcgctctcaatcaatccacgggtctgccgacattaaccctcccacggggcaccacctgtctgccccccgccctgctgccttaccttgaacagtttaggcggatcgtgttctggcttggggacgacctccggtcctgggaggcggccaaactgttcgcgagaaagctaaaccctaaacgatgtttcctggtcagacccggggaccaacagccaagaccactggaagccctgaacgggggcttcaatctctccagaatcctgcgtaccgccctgcctgcttggcacaaatcgattgtgagctttcgccaactgcgagaggaagtactcggagaactatctaacgtggaacaggccgcaggactgagatggtctagattccccgatcttaaccgtatcttgaagggccaccgcaagggggaactcacagtttttacaggccccactggcagcggcaaaaccacttttatatctgaatacgctctggacttgtgctcccagggagtgaatactctgtgggggtccttcgagatcagcaacgtgcgactagctcgcgttatgctgacccaatttgctgagggaaggctggaggaccagctggataagtacgaccactgggcagaccggttcgaggacctccccctttactttatgacatttcacggccagcagagcattcgaactgtcattgacaccatgcagcatgccgtctacgtttatgacatttgtcacgttattatcgacaaccttcagttcatgatggggcatgaacagctttccactgatcgaattgcggctcaggattatattattggtgtgttccgcaaattcgctacggataataactgccacgtgacactagttatacacccacgcaaggaggacgatgacaaggaactgcaaactgcctcgattttcggaagtgcaaaagtgagcggactgtag

SEQ ID NO: 112160 - DNA, 1029 bp, Artificial Sequence
  Description of Artificial Sequence: Synthetic coding sequence
atgccatttctgctgggcctcaggcaggataaggaggcctgcgttggcactaacaaccaaagctacatatgcgataccggacactgctgtgggcagtcacagtgctgtaattactactatgagctgtggtggttttggctcgtgtggaccatcattattatcctctcctgttgctgtgtgtgccaccatcggagggccaaacaccggctgcaggcgcagcagcgccagcatgagattaatctcatcgcctaccgtgaggcacacaactattctgctctccccttttatttccgctttctacctaattatttgctgcccccctatgaggaagtagtcaaccggcctcccacccccccaccaccatattcagcttttcagcttcaacagcaacaactgctgccaccacaatgcggacctgccggggggagcccccccggcatcgaccctactcgcggctcgcagggagcgcagtctagtccattatcagagcccagtcgctcgtccacccgccccccttccatagccgatcccgacccctcggatcttcccgtcgacagagccgctacaaaagcaccggggatggaaccaagcggctccgtggccggcttgggagaactagatcctggcgcttttttagacaaggatgccgaatgccgagaggaactgctgaaggacgatagcagtgaacatggggctcccgattccaaggaaaaaacacctggcagacacaggcgctttaccggggactccggtatagaagtctgcgtctgcaaccgaggccatcatgacgacgatttgaaggagttcaatacgctgatcgacgacgccttggatggacctttagatttttgcgattcatgtcatgtacggcctcctggggacgaagaggagggcttgtgtcaatcaagcgaggagcaggcacgggaacccggccacccccacctgcctcgacctccagcttgcctgcttctaaataccataaatgaacaagacagtccaaactcccagagcagttcctccccttcctag

SEQ ID NO: 112161 - DNA, 1092 bp, Artificial Sequence
  Description of Artificial Sequence: Synthetic coding sequence
atggagaggcggagattgctcggcgggatggcgctacttttacttcaggctctgccgtctcctctgagtgctcgagctgagccaccccaagataaagaggcctgtgtggggactaataatcagtcttacatctgcgatactggtcactgttgtgggcagtcccagtgctgcaactactattatgagctctggtggttttggctcgtatggaccatcattattatactgagctgctgctgtgtatgtcaccacaggagagccaagcatcggctgcaggcccagcagcggcagcatgaaatcaatttgattgcttatagggaggcacacaattattctgcattgcctttctacttcagatttcttccgaactacctgctccctccatacgaggaggtggtgaacaggccccccaccccacctccaccatattcagcgtttcaacttcaacagcaacagctcctgcctccacagtgcggccccgccggcggaagcccccctggtattgatcctacacgaggtagtcaaggcgcacagagcagccctttatcagaaccctctcgttccagtacgcggccaccttctatcgctgaccctgacccctcagaccttccagtcgaccgagccgccacaaaggcaccaggcatggaaccttccggaagtgtggcagggcttggggaattagatccaggcgcttttctagataaggacgctgagtgtagagaggaactgcttaaagatgatagctcagagcatggagcccccgactccaaagagaagactccgggtcgccatcggagatttacaggagacagtggaattgaagtttgcgtgtgcaacagaggccaccatgatgacgaccttaaagaatttaatacccttatcgacgacgctctggacggacctttggatttctgcgacagttgtcatgttagacccccgggagatgaagaggagggattatgccagtcttctgaggaacaggctcgagagcccggccaccctcacttgcctagaccaccagcatgcctgctgctcaacaccataaacgagcaggatagtcctaatagccagagctcctcttccccaagctag

SEQ ID NO: 112162 - DNA, 1056 bp, Artificial Sequence
  Description of Artificial Sequence: Synthetic coding sequence
atggctaccgacgtgcaattagctgattatccccttatgtcgcctaaggctgagctaaagctcgaaaagaagtctgggcgcaaaccccgatctccccgtgactccgggccacagaaggaactggtaatccccggcatagtggactttgaacgcatcaggagagctctcaggaccccaaagccacagacgcctgggacctactgcttcggaagactgtctcatcattctttcttcagtcgccatcatcctcatccccagcacgttactcacatccaagatctgactgggaaaccagtgtgtgtcgtgcgagactttccggctcctctgcctgagtcaactgtgttttcaggttgccagatgggcatcccaacaatttccgtgccgatcggagacccgcagtctaaccgaaatcctcagctgagctccgaggcatggaagaaagaactgaaggaattggcatcccgcgtggccttccttactaaggaagatgagctaaagaaaaaagagaaggagcagaaggaagagccccttcgagagcagggcgcaaagtactccgcggagacgggccggttaataccagcatcaactagagccgtgggacggaggagatcccatcaggggcagcagtcacagagttcctcacgacacgagggagtacaggccttcttactccaggatcaggagctgctggtgctggaactcctctgtcggatcttagaaactgatctgttgagtgcgattcaattctggcttctgtacgcaccccccaaagaaaaggacctcgcactcggactgcttcaaactgccgttgcccagttactgccccagccattagtatccatcccgactgagaagcttctgtcccagctgcccgaggttcatgagcctcctcaagagaagcaggagccgccttgttcacagtctcccaagaagactaagatatcccctttcacaaagtcagagaaacccgaatacatcggcgaggctcaggtgctccagatgcacagtagtcagaacacagagaaaaagactagtaaacctagagctgagtcttag

SEQ ID NO: 112163 - DNA, 321 bp, Artificial Sequence
  Description of Artificial Sequence: Synthetic coding sequence
cagtgtgccgaactctggggaagtgtaaggaaaaattcagataaattcctgctcagccgtaatttgcaccctagtaaagaggagtacaggcagcaaattaaaacgcccggggaggaatggcggcaaatcctcgttcattggcgatcttctagtccacccgatgcattcaagcctgagcaccgtgaggaagacattgaggccgaaggccgcgagctgcgaggcccgaatacatgcacatgtcttgctcaggagcaacctcagggctttagaggtgtgtccgttagtaccacctttaccgctgtcccggatagtctaccatag

SEQ ID NO: 112164 - DNA, 753 bp, Artificial Sequence
  Description of Artificial Sequence: Synthetic coding sequence
atggcaacagacgtgcagctcgccgactacccgctcatgtccccaaaggcggaactcaagcttgagaagaaatctggacggaagcctcggtctccccgcgactcgggcccacagaaagaacttgttatccctggaattgtggactttgagcggatcagaagggctttgaggaccccaaagccacaaacgccgggaacgtactgttttggccgacttagccatcacagtttcttctctcgccaccacccccacccgcagcacgttactcacattcaagatttaactggtaagccagtgtgcgtggtgagagacttcccagccccccttccggagtcgacagttttcagcggttgtcagatgggaatccccactatcagcgtcccaattggagatccccaaagtaatagaaacccacagctcagttctgaggcctggaagaaagagctcaaagagttagctagtcgagtcgcattcctgacaaaagaagacgaattgaagaaaaaagaaaaagaacagaaggaagagcctctgagagagcagggggccaaatacagcgcagagacagggaggctgataccagcaagcactcgggctgttgggcggcgtaggtcccaccaaggacagcaaagccaatcctcaagccgacatgaaggagttcaagccttcttgctgcaggaccaggagcttttgaagaaaacctcactgtgggacagctgccgccagcagtggctttcctcttttccgagtccatag

SEQ ID NO: 112165 - DNA, 951 bp, Artificial Sequence
  Description of Artificial Sequence: Synthetic coding sequence
tcacctaaggccgagcttaaattggagaagaaatccggacgcaaacccagatcgcctcgggactcaggtccacaaaaagaactggtgatcccaggtatagtcgattttgagagaatccgcagggctctaaggaccccgaagcctcagactcccggcacctactgcttcggaaggctgagtcaccatagtttcttcagcaggcatcaccctcacccgcagcacgtgacacacattcaggacctgacaggaaagccagtttgcgttgtacgagacttcccagcaccgcttcccgaaagcactgtgttttcaggttgccagatgggaatccctacaatatctgtgccgatcggcgatcctcagtcaaacaggaatcctcaactgtcttctgcctggaagaaggaactgaaagaactcgctagtagagtggccttcctaactaaggaggacgagctgaagaaaaaggaagacactaccagcctcaattggaactgtaagtcgcgtaggccacaggcgccaggcctgtccggtactgaccttggcgcagctgaattgggcatcaagaaggaacagaaggaggagcctcttagagaacaaggtgccaagtattctgcggagacaggacgacttattcctgcttctacgcgggccgtgggacgacgacggagccatcagggtcagcaaagccagagttcctcacgccacgagggagtacaggcctttttgctccaagatcaggagcttctcggcggcctgacatcccctggggctccagtctccgacccaggaaatcgcctggctaaaaggaacccagtccttgctgccttgaggagcgcccaggggaaacgacctaggtctggaactccagcagactcttctgggagcgcacccagccctgcccctagcttacacccatatcgaaaagcccctaagcccgccagtcgatcagcctag

SEQ ID NO: 112166 - DNA, 498 bp, Artificial Sequence
  Description of Artificial Sequence: Synthetic coding sequence
atgtatataagccctaaagccgagctcaaattagaaaagaagtccggcaggaagccacgatcaccaagagacagcggaccacaaaaggaactggtgatccctgggatcgtcgattttgaacggatccgccgcgcacttagaacccctaagccacagacaccaggcacgtattgcttcggaagactgtctcaccattctttcttttcacgccaccatcctcacccccagcatgttactcatatacaggatctcaccggaaaaccagtgtgtgtggtccgcgattttcctgccccactgcctgagagcacggtcttctctggctgtcagatgggcatccccactatctcggtgcccatcggagacccccaatccaaccgcaatccacagcttagcagcgcatggaaaaaggagttgaaggagctggcgtcccgcgtggcttttttgacaaaagaagatgagctcaagaagaaagaagtgggtgccgagcatcgttcctag

SEQ ID NO: 112167 - DNA, 672 bp, Artificial Sequence
  Description of Artificial Sequence: Synthetic coding sequence
atgctgtgggtgcagagaaaaaggcggaggaaggagacaagtgaatgccccagtgacaaggacaaatcccctgaaagtcataaagctaagaacgagagctggattaagagtcacttttcacggttgagtgaggagaaactggccctggacaacaacgctagtgcctcaggaaatgcaactcagaccgagagcgggtcagaagaagtatcatccactgtgcacatcgagacgttcactacgaggcacggggaagtcgggtcagctctgcaccgcgagagctttacctccagacagaaaacctcgggtcccagcgtgattcaagagatacaccaggagtccggaaaagcccccagcacagacgaggcgacctgggctgcggtggctgcatgcaccaaggaaattgatacccagggacggcatttggcccactctatgctgcagcgggcgatcgcataccagcattcaggacacctggagagtaaagatataaatcaggaagaactgagagccctcgaggaggtagagatgaaactgcaaaagaatttcttaacgcagagggagaacacgatagccggtgccaaccatactcacactttttacgggcacagccatcatagccaccacggacacccaagccaccaatcccattctttgcctaatcggagacactag

SEQ ID NO: 112168 - DNA, 399 bp, Artificial Sequence
  Description of Artificial Sequence: Synthetic coding sequence
atgggacgtacatggtgcggcatgtggaggcggcggagacccgggaggcgctccgcggtccctagatggccccacctgagttctcagtccggcgtggaaccgcctgatcggtggaccggcacccccggatggccctcccgtgaccaggaggcgccaggaagcatgatgccaccggctgccgcccagccgtcggctcatggagccctcgtgcctccagctacagctcacgagccagtggaccatcccgctttgcactggcttgcctgctgctgttgtttgtctctacctggacagctcccactcgcgatacgtttgggctgggacctggatctcgaggcagggccctcctccgggaagctgtgtccacgggcaagaagatggcagcccctgccatcgtag

SEQ ID NO: 112169 - DNA, 537 bp, Artificial Sequence
  Description of Artificial Sequence: Synthetic coding sequence
atggcctcctttttagtttggccgctgagaactgctctgcgaggcggtaaaagctgggccggacccggcgtgggatgtggtggggacggcgccaggggaggtggtgaactcagtttatctaacctagatctgccaggcgctggtgaggccgggttggaacaccatcccctcttaggccatttgttcatatcagccgttcctaggtggccacacctcagttcccaatctggtgtggaacccccagaccgttggacgggcacacccggatggccctcccgcgaccaagaagcccccggcagcatgatgcccccggccgcagcacaaccatcagctcacggtgcgctcgtccctcccgccactgctcacgagcccgtggaccaccccgctctgcattggctggcctgttgctgttgtctgagtctcccagggcaactgcccctggccatcagattagggtgggatctggatctggaggctggcccctctagcggcaagctttgcccacgcgcacgacgttggcagccacttccctcctag

SEQ ID NO: 112170 - DNA, 1350 bp, Artificial Sequence
  Description of Artificial Sequence: Synthetic coding sequence
atgtggaccgctctggtgctgatctggatctttagcttgagcttaagcgagtctcatgccgcatccaacgatccaagaaactttgttcctaacaagatgtggaaggggttagtgaaaagaaacgcatctgtggagactgtggataataaaacaagcgaagatgtaactatggcagctgcatctcccgtgacccttacaaaaggcaccagcgctgctcatttaaattcgatggaggtgacgactgaggatacatccagaactgatgtgtcagaacccgccacctccggcggtgcagcggatggagttacatctatcgcccccaccgctgtcgccagtagcacgactgccgccagcattactacagcagcaagcagcatgacggtggcctctagcgccccgaccaccgctgcttccagcacaacagtggcctcaattgcacccacaaccgccgcgtcttctatgacagcggcgagttctaccccaatgaccctagccctcccagctcccaccagtacttcaaccggaaggacaccctctacaaccgctacgggtcacccaagcctgagcacagccttagcgcaggtaccgaagtcctcagctctgccgcggactgccacattagccactctggcaacccgcgctcagaccgtggcaacaacggcaaatacctccagcccaatgtcaactcgaccctcccctagcaaacatatgccctccgatacagctgcctcaccagttcccccaatgcggccccaggctcagggtcctatctcccaggtgagcgtcgaccaacccgtggttaatacaacaaataagagcactcccatgcccagtaacacgactccggagcccgctcccactcccacggtggtgacgaccactaaggcacaggcaagggaaccaaccgccagtccggtgccagtgccacacacaagtcctataccggaaatggaggccatgtctcctaccacacagccctcccctatgccctatactcaacgtgccgctggccccggcacctcacaggcccctgagcaggttgagaccgaggccacccctggcacagactctaccggacctaccccacgtagcagcggaggcaccaagatgcctgccaccgactcctgccagcccagtacgcaaggtcagtacatggtggtcacgacagagccactaacacaggcagtggtggataagactttgctgttagtcgtcctgctgctaggggttacactatttatcactgtgctggtcctgtttgcactacaggcgtatgagagctacaagaaaaaagattacacgcaggtggactacctgataaacgggatgtatgccgactccgagatgtag

SEQ ID NO: 112171 - DNA, 78 bp, Artificial Sequence
  Description of Artificial Sequence: Synthetic coding sequence
atgtggacggctcttgtgctgatttggatcttttcactgagtttgtctgagtcccacgctgcgtcaaacgatccctag

SEQ ID NO: 112172 - DNA, 3969 bp, Artificial Sequence
  Description of Artificial Sequence: Synthetic coding sequence
atgccagtggtctggccaactctgctcgacctgtcgcgagacgagtgtaaacgaatattgcgcaaactggaactcgaggcatatgccggggtcattagcgctctgcgcgcccagggagacctaacaaaagagaaaaaggatttgcttggcgaacttagtaaggtgcttagcatctcaaccgaacggcatcgcgctgaagtgaggagagccgtcaacgacgagcgtctaacaactatagcccacaatatgtctggaccgaactcctcctcagaatggagtattgagggtagaagattagtacccttgatgccccgacttgtgccccagactgcttttaccgtcacggctaatgccgttgccaatgctgcaatacagcataatgcttcactcccagtgcctgccgaaacagggtctaaggaggtagtttgttactcctatacctccaccacttccactccaacttccactccagttccttcaggatctatcgccactgtgaaatctcctcgtccagcctcgcctgcaagcaatgtggtagtattgccgtctggttccacagtgtatgtgaaatcagtgtcctgctcagacgaggacgagaagcctaggaagcggcgacgaacaaacagcagctcctcctctcctgtggtgttaaaagaggtgccgaaagcagtggtccctgtgtccaaaacgattaccgtgccagtttctggatctcctaaaatgtctaatattatgcagagcattgccaattctttgcccccccacatgtcccccgttaagattacatttacgaaaccttccactcaaactactaacacaacaacacagaaggtcatcattgtcacgacatccccgagtagtaccttcgtacctaacatcctttcaaagtctcacaactatgctgccgtgaccaaactggtccccacttctgtgatcgcaagcactacccagaagccgcctgtggttattaccgcctctcaatctagtcttgtgagtaacagcagtagtggctcgtctagttctacaccgagcccgatacccaatacggtagccgtgacagcggtcgtttccagcacaccatctgtggttatgtccactgtcgcgcagggtgtgtcgacaagtgccatcaagatggcctcaacaagattaccttctcccaagagtttggtgagcgcaccgacacagatccttgcacagtttcctaagcagcaccaacagtcccctaagcaacagctgtaccaggtccagcagcagacacagcaacaggtagctcaaccgagccctgtttcgcaccagcagcagcctcaacagtccccgctgcctcctggcataaagcccacaatacaaatcaaacaggaaagtggtgtgaagattattacccagcaagtacaaccttccaagattctcccaaaaccagtgacagccacactccccacctcttcaaattctcctattatggtggtcagctccaatggcgccattatgactaccaaactggtaacgacacccaccggaactcaggccacctacacacggccgacagtttcaccctccatcggacgaatggctgctaccccaggcgcagcaacatacgtcaaaactaccagcggatcgataatcacagtcgttcccaaatccctcgcaactttgggcggcaaaattatcagctcaaacattgtctctgggaccacaacaaaaatcactactattccaatgacttcgaagcctaacgttatagttgtgcaaaagacgactggcaagggaactacaattcagggcctgcccggcaaaaatgtagtaacaacattactgaacgccggcggggaaaagacaattcaaacagtgcctacaggggccaagccagccattcttaccgccacacggcctatcacgaagatgattgtgacccaacccaaaggcatcgggtctaccgtacagcccgccgcgaaaatcatccccactaaaattgtgtacggccaacagggtaaaactcaggtcttaattaagccgaaacccgtcaccttccaggctacagtcgttagtgagcagactagacagctggtcaccgagacactgcagcaagcctcccgggtggcagaggcgggcaactcctccatccaagagggaaaggaggagccacagaactataccgatagctcctcatctagcaccgagagttctcagagctcacaggacagccagcctgtggtccatgtcatagcctcccgcagacaagattggagcgagcatgagatcgccatggaaacctctcctaccattatttatcaggatgtttcttccgagtctcagagtgcaacttcgacaattaaagctctcctcgagcttcagcagaccacagttaaggagaagctggagtccaaaccacgccagcccaccatcgatttatcccagatggccgttccaattcagatgacgcaggaaaaacggcactctcccgagtccccgtctatcgcagtggtagaaagtgaacttgttgctgaatacatcactacggagagaaccgatgagggtaccgaggtcgccttcccactgctcgttagtcatagatcccagccacagcagccatcgcagccccagagaaccttgctgcagcacgttgcccaatcccagaccgcaacccagacctccgttgtggtcaagtctattcctgcctcatctcctggcgccatcactcacattatgcagcaggctctgtcaagccatacagcttttaccaagcacagcgaagaactaggcaccgaagagggagaggtcgaagagatggatacgctagatcctcagaccgggttgttctatagatccgctctgacacagtcccagagtgccaagcaacagaaactgtctcagccaccccttgagcagacgcagttacaggttaagactttgcaatgttttcaaaccaaacagaagcagacaatccacctgcaggcagaccaactgcaacacaagttgccgcagatgccccagttgtctattcggcaccagaagctgacgccccttcagcaggagcaggcccagccaaaacccgacgtccagcatactcagcaccctatggttgctaaggatcgacagctgccaacactaatggcacagccaccacagacggtcgtacaggtcctggccgtgaaaacgactcagcagctgcccaagctccagcaggcccccaatcaacctaagatctacgtccagccccagaccccccagagccagatgagcctgcctgcttcctcggagaaacagaccgcaagccaggtcgagcaacccatcattacgcagggtagtagcgtgaccaagatcacgtttgaaggcagacagccgcctactgttactaagatcactggaggtagctccgtacccaaactgaccagtcccgtgacatctatttcccccatccaagcctccgagaagactgcagtctcggacatattgaagatgtccttaatggaagcacagatcgacaccaacgtagaacatatgattgttgacccacccaaaaaagccttggcaacatcgatgctgacaggcgaagccggatccttaccaagtactcatatggtggtcgccgggatggcaaacagcaccccccagcagcaaaagtgtagagagtcatgcagcagcccgagcaccgtagggtcgagtctgaccacaaggaaaatcgatccacccgccgtacctgccaccggacagtttatgcggattcaaaacgtcggacagaaaaaagctgaagaaagcccagccgaaattattatccaagccatcccccagtacgctattccctgccattcaagctccaatgtagtcgtcgagcccagcggtctgctggagctgaacaattttacatctcagcagcttgatgacgaagagaccgccatggaacaggatattgactctagcacagaggacggtaccgaaccctcacctagccagtccagcgccgagaggagttag

SEQ ID NO: 112173 - DNA, 3468 bp, Artificial Sequence
  Description of Artificial Sequence: Synthetic coding sequence
atgccagttgtctggccaactcttctcgatctttccagggacgagtgtaaacgcatcctccgtaagttggagctagaggcttatgcaggcgtcatttctgctttacgggcccagggcgacctgacgaaggaaaagaaggacctgttgggtgaattgtcgaaggttctgtccatctcgactgaaagacaccgcgcggaggtacgacgcgcagtgaacgacgagcgactcacgaccattgcccacaacatgtcagggcccaactcttcaagcgaatggtctattgaagggaggcgcctggtgccgctgatgcctagattggttccccagaccgcctttacagtcacagctaatgccgtggcaaatgccgccatccagcacaacgccagtctgcctgtcccggccgaaacaggctccaaggaggtcgtttgctattcttatacatcaacaacctcaactccgaccagcacgcctgtaccatccggaagcattgctactgtgaaatctccaaggcctgcatcccccgcctccaatgtcgtagtcctcccttccgggtccaccgtgtatgtcaaatccgtgtcctgcagcgacgaggacgagaaaccgcgcaagcgacgcaggaccaacagctccagcagctcccccgttgtgctaaaagaagtgcctaaggcagtggtccctgtcagcaaaaccatcactgtgccagtatccggctcccctaagatgagcaacatcatgcagagcatagctaatagcctaccaccgcacatgtcccccgtgaaaatcacatttactaaacccagtactcagacgaccaataccacaactcagaaagttattatagtgactacttcaccaagctccacgttcgtcccaaacatcttgtccaagagtcacaactatgccgcggtgaccaaattagtccccaccagtgttattgccagcaccacccagaagccacctgtggttataaccgcctcccagtcttcactggttagcaattccagctctgggtccagcagtagtacaccgtcgcctatccctaacaccgtggctgtgacagccgtagtctccagcactccttctgtcgtcatgagtaccgtggcacaaggggtgagcacctctgcgatcaagatggctagtacccggctcccctcaccaaaaagtttagtgagtgcacccacccagatcctggcacagttcccgaagcagcatcagcagtcccctaagcagcagctctatcaggtacaacaacaaactcaacagcaagtggctcagccctccccagttagtcatcagcagcagccacagcagtcccccctgccccctggcatcaagcctaccattcagattaagcaagagtcaggagtaaaaatcatcacccagcaggtccagccctccaaaatcctaccgaagcctgtcacggccacccttccaacttcatcgaacagccccataatggtggtgtcttctaacggtgcaatcatgactaccaagctcgtaaccaccccaaccggcactcaggcaacatacacacgccccaccgtgagtccttccatcggtcgaatggctgccacgcccggtgcagcaacctacgtcaaaactacttcagggagcattattactgtcgttccgaaatcccttgctacactggggggaaagattatctcctccaacatcgtctccggtactaccacaaagatcaccactatccctatgacctccaaacctaatgtaattgtggttcaaaagactacgggcaaaggaacaacaatccaggggcttccaggaaagaacgttgttacaactctgttaaacgcagggggggagaaaacaatacagacggtgcctaccggtgctaagcccgccattctgacggccaccagaccaattaccaaaatgattgtaacacagcctaaggggatcgggagtacggtccagccagcggccaagatcattccgactaaaattgtctatggccagcagggcaagacgcaggtcttgatcaaacccaaaccggtcacttttcaggctacagtcgtatccgagcaaactagacagctcgtgaccgaaacacttcagcaggctagtcgggttgccgaggcgggaaacagcagtatccaagagggaaaggaggaaccccagaattacacagattcaagcagctcatctacagagtcgagccagagctcccaggactcacagcctgtagtacacgtgatcgcatccagaagacaggattggagcgagcatgagatcgctatggagacctcacccactattatataccaggatgtgtcaagcgagagccagtcagcaactagtactattaaggcgttgctggagttacaacagacaacggtgaaagagaagctcgagagcaaaccccgtcagcccaccattgacctgtcacagatggccgttcccattcagatgactcaggaaaaacggcactcacccgagagtccatccatcgccgtggtcgagtcggagctggttgcagaatatataacaactgagcgcaccgacgaggggactgaggtcgcgttccccctcctggtttctcaccgatcccagccacagcaacccagccagccacagcgcacgttgcttcagcatgtggcccagtcccagaccgcaacccagactagcgtggttgtgaagtcaattcccgcaagttctcctggtgccatcacacacatcatgcagcaggccctcagcagtcatactgccttcacaaagcatagtgaggagctagggaccgaagaaggggaggtggaggaaatggacaccctggacccacaaactgggttgttctataggtcagccctgactcagagccagagcgctaaacaacagaagctctcccaacctcccctggagcagacgcagcttcaagtgaagaccttgcaatgctttcagactaagcagaagcaaacaattcacttgcaagccgaccagcttcaacataagctgccacaaatgccccagctgtcaatccggcatcaaaagcttacaccgctacagcaggagcaggcccagcccaaaccagatgttcagcacacccaacaccctatggtcgcaaaggatcggcaattgccaactctaatggcccaacccccacagacagtggttcaggtgttggccgtaaaaacgacccagcaattgcctaagctgcagcaggctccaaatcagccaaagatttacgttcaaccccaaacaccacagtcccaaatgtcactccccgccagtagcgagaagcagacagcctcccaggctattccacagtatgcgatcccgtgccattcttcatccaacgtggttgtcgagccgagcgggcttctggagttgaataattttacatctcagcagctcgacgatgaagaaactgctatggagcaagatatagacagctccacagaggatgggacagaaccgtccccaagccagtcttccgctgagagaagttag

SEQ ID NO: 112174 - DNA, 3015 bp, Artificial Sequence
  Description of Artificial Sequence: Synthetic coding sequence
atgccggtcgtctggccaacccttctcgacctgtctcgcgatgagtgcaagcgcatcctgaggaagcttgagctggaagcctacgctggcgtgatctcagctctcagagcccagggggatctcactaaggaaaagaaggacctgctgggcgaactctccaaagtgctgtcaatctcaacagagcggcaccgggcagaggtgcgacgggctgtcaacgacgagaggctgacaactatagcccataacatgtccggtccgaacagctcctctgagtggagtatcgagggcaggagactggtaccactcatgcctcgactcgttccacagacagctttcactgtgaccgccaacgccgtggcaaatgcggccattcagcataatgcctccctgcccgtgcccgccgaaaccggttccaaggagggcgtcagttgcagtgacgaagacgaaaagccaaggaagcggcgaaggaccaattcatcatcctcaagtcctgtggtgttaaaggaagtcccgaaggcagtagtgccagtcagcaagacgattaccgttcccgtgtctggtagccctaaaatgtcaaacattatgcagagcattgctaactctttaccacctcacatgagcccagtgaagattactttcactaagccttccacccagaccactaatacgaccactcagaaagtgatcatcgtgaccacatcacccagtagtacatttgtgccgaacattctgtccaaatcgcacaattacgcagctgttacgaaattggtccccacctcggtcattgccagtaccacacaaaagcctccagtggtcatcacagcatcgcagagcagcctggtcagcaacagcagttcaggttcctcctccagcacaccttctcctatccccaacactgtggcggtgaccgctgtggtgtcctcaacgccttccgtggtcatgtcaacagtggcgcagggtgtctccacctccgctatcaagatggcctccacgcggctcccctctccaaaaagtctcgtgagcgcgcccacgcagatcctggcacagttcccaaaacagcaccagcagagccccaagcagcagctataccaggtgcagcaacagacacagcaacaggtggctcagccttctcctgtgtcacaccaacaacagccccaacaatcacctctgccacctgggattaagcctacaatccaaattaagcaagaaagcggggttaagatcatcacacagcaggtccaaccatccaaaatcctcccaaaacccgtgactgccatcctcactgcgaccagaccaatcactaagatgattgtgactcagcctaagggtatagggtctacagtgcaaccagctgccaagatcattcccaccaagattgtgtacgggcagcaaggaaaaacgcaggttctgattaaaccgaaaccggtgaccttccaggctaccgtggtgagcgagcagaccaggcagctggtgaccgagacactccaacaggcatcccgcgtagcagaggccgggaacagttccatccaggagggaaaagaagaaccacagaactacacggacagctcctcctccagcaccgagtccagccagtcgagccaggtgtcccatcgtagtcagccgcagcaaccatctcagcctcagaggaccctcttgcagcatgtggctcagtcacagaccgcgacgcaaacgagtgtggtggtgaagtcgatacctgcctctagcccaggtgcaatcacccacatcatgcaacaagctctctcgagccatactgccttcacgaaacacagcgaggagctcggcaccgaggaaggagaggtggaggaaatggacactttggatcctcagaccggactgttttacagaagtgcacttacacagtcccagagtgccaaacaacagaaactttctcagcctccgttggagcaaacccagctgcaggtgaaaacactacagtgttttcaaactaagcagaaacagacaatccatcttcaagccgaccagctgcagcataaattgccacaaatgccccagctgagcatcagacatcagaaactgacacccctgcaacaagaacaggcccagccaaaacctgacgtgcagcatactcaacatcctatggtcgcaaaagaccggcagctgccgaccttgatggctcaacccccccagactgtggtccaggtcttggctgtgaaaacaacccaacagcttccgaaactccagcaggcccccaaccaaccgaaaatctatgtgcaaccccaaaccccacagtcccagatgagtttacccgcctcctcagagaagcagaccgcatcccaggtggagcaacccataattactcaaggctcgagtgtgaccaagatcacttttgagggacgacagcccccgaccgtaaccaaaataactggcggtagcagtgtccccaaattgacctccccggtcactagtattagccctattcaggcgtcggagaaaacagctgtctcagacatactgaagatgagtttgatggaggcccagattgacacaaacgtagaacatatgattgtagacccacccaaaaaagccctggctaccagtatgcttacaggcgaggctggtagcttgccatccacccacatggtcgttgctggaatggctaattcaaccccacagcagcagaaatgtcgagaatcctgctcaagtccgtctactgtgggaagctccctgaccaccaggaagattgacccaccagcagtgccagccaccggccagtttatgcgaatccaaaacgtaggacagaagaaggctgaagaatctcccgccgagatcatcattcaggctattcctcagtacgccatcccatgtcattccagtagtaatgttgtagtggagccatctggcctcctcgaactcaataacttcacttctcagcagctggacgacgaggaaaccgccatggagcaggacatagattcttcaacagaggacggaactgagccctcaccctcccagtcgtcagctgagaggtcctag

SEQ ID NO: 112175 - DNA, 3969 bp, Artificial Sequence
  Description of Artificial Sequence: Synthetic coding sequence
atgcctgtggtgtggcctactcttttagatctgtcccgcgatgagtgcaagagaatcctgagaaagctggaactcgaggcttacgccggggtgatctctgctctcagggctcagggcgacttaacaaaagagaaaaaagatctgctcggcgaattatcaaaggttctgagcatttccaccgagcggcacagagctgaggttcggagggccgtaaatgacgagcgactgacaacaatagctcataacatgagcgggcccaattcatccagcgagtggtcaatcgaaggtagacgcctcgtcccgctgatgccacgtctcgtgcctcagacagctttcaccgttactgccaacgcggtggcaaacgccgcaatccaacacaatgcctcgctgcccgtgccggcagagaccggtagcaaggaggtcgtgtgttactcttacacttcaaccacctcaaccccaacttctaccccggtgccttctggatccatcgctacagtgaaatccccacgtccagcatccccagcctcaaacgtggtcgtcctaccttccgggtcaactgtgtacgttaagtccgtgagttgttcagacgaagacgagaaacccaggaaacgacgaaggaccaatagctcctcctcttcacctgttgtgctcaaagaagtacctaaagcggtggtccctgtcagcaagaccattacagttcctgtctctggttctcccaaaatgagtaatattatgcaaagcatcgccaacagcctgcctccccatatgtcccccgtcaaaataacctttacaaagccatctacacagactacaaacactaccacccagaaggtcataattgtcaccacctccccttcttcgacgttcgtgccaaacatcttgagtaaatctcacaactatgctgcagtcactaaactggtccccacctcagtcattgccagcacaacgcagaagcccccggtggtgattacggcctcgcagtcgtcgttagtgagtaactctagctccggttcatcttcatcaaccccatcacccatcccaaatactgtggcggtcaccgccgtggtatcatcaactccatccgtggtcatgagtacagtggcccagggggtgagcacctccgcaatcaagatggcatctacgcgtctgccctcgcccaagagcttagtcagtgcccccacacagattttagcgcagttccctaagcagcaccagcagagcccaaagcagcagctgtatcaggtacagcaacaaacacaacaacaggttgcacagccctctccagtgtcccaccagcagcagccccagcaaagcccactgcctcccggcattaaaccaaccatacaaatcaagcaagaatcaggcgtcaaaatcatcacccaacaggtacagccttccaagattttgcctaaacctgtgacggccaccttgcctacttcttccaactccccaattatggtagtcagcagtaacggagccatcatgacgactaagctcgtgacgacgccaactggaacacaagccacttacactaggccaactgtcagcccctctatcggccgtatggctgcaacgcctggtgcggcaacatatgtgaaaacaacgagcggttcaataatcacagtcgtgcccaaatcactcgctacactgggcggcaaaatcatctcgtccaacatagtttcagggactaccactaagattacgacaatccccatgacctcaaaaccgaatgtgatagtggtccaaaagactacgggcaagggcaccacgatccagggcctgcctgggaaaaacgtggtaaccacactgctaaacgccggcggagaaaaaactatccagacggttcctaccggcgcaaagccagctatactaacagctacacgcccgattacaaagatgatcgtgacccagcctaagggtattgggtctactgtgcaaccggcggctaaaatcatccctaccaaaatagtctacgggcaacagggcaagactcaggtactcatcaagcccaagccggtgacttttcaagccactgttgtgagtgagcagactagacagctggtgaccgaaacactccagcaggcctcaagggtggctgaggctgggaacagtagtattcaggaaggtaaggaagagccccagaattatactgattcttctagcagctcgacggaatcctcgcaaagctctcaggattcacagccagtcgtgcatgtgattgccagtcggcgccaggattggtcggaacatgaaatcgcaatggaaacctctcctactattatctaccaggacgtgtcatctgaaagtcagagcgcaactagcaccatcaaggcactgctcgaactgcaacagaccactgtgaaagagaagctcgaatcgaagccacggcaaccaaccatagatcttagccagatggccgttcccatacagatgacccaagagaaaaggcactcccctgagtctccctcaatcgcagtagtcgaaagcgagttggtcgccgagtacataactactgagagaaccgatgagggtactgaagttgctttcccccttctggtgagccatagatctcagccgcagcaacctagtcagcctcagcgaactttactccagcacgtggcacagtcacagacggctactcagacaagcgtagtcgttaaatcaatccctgccagtagccccggtgcaatcacgcacatcatgcagcaggcgctttctagccacacagctttcacaaaacacagtgaagagctgggcaccgaagagggagaggtcgaggagatggatactctggaccctcagactggactgttctaccgctcagcccttacccagagccagagtgccaagcagcagaagctcagccagccacctttggagcagacacagctccaggtgaaaaccttgcagtgcttccaaactaaacagaaacagacaatacacctgcaggcggatcagctccaacataagctaccacagatgccacaactgtctatcagacatcagaagctcaccccgttgcagcaggagcaggctcagccaaagcctgacgtgcaacatacgcaacaccccatggttgcgaaggatcggcaactgccaacgctcatggcacagccaccacagaccgttgtccaggtccttgcagtgaagactacgcagcagctgccaaagctacagcaggcccctaaccaaccgaaaatctacgtgcagccccagacaccacagtcgcagatgtctttgcccgctagtagtgaaaaacagactgcttcccaagtggagcaaccaatcattactcagggctcctccgtgaccaagatcacattcgagggccgacaacctcctaccgtaaccaaaatcacgggtggatcttctgttcccaaattaacttcgcctgtgaccagcatctctcctattcaggccagtgaaaagacagccgtatcggatattttgaaaatgtccctcatggaggcccagatagacaccaacgtggagcatatgatagtggatccccctaagaaagctctggccacttcaatgcttactggcgaggctggatcactgccatcaacacacatggttgtagcgggcatggctaatagcacacctcagcagcaaaaatgtagagagagttgctctagcccaagcaccgtggggagcagcttgaccactagaaagatagacccacctgccgttccagctaccgggcagttcatgagaatccagaacgttggacagaaaaaagctgaggagtccccagccgaaatcattatacaagccataccccagtatgccattccttgccactcaagttcaaatgtcgtggttgaaccctccggtttgctggaactaaacaactttacctcccaacaacttgacgatgaggagactgccatggaacaggacatcgacagctctaccgaggacgggaccgagccctctcctagccaaagctctgcagaacggtcctag

SEQ ID NO: 112176 - DNA, 624 bp, Artificial Sequence
  Description of Artificial Sequence: Synthetic coding sequence
atggcagtgtttcatgacatgctcctgcaacctttaggcatgttcctctgcctgtccctgcagctgtcatcggccacatttatccgctatagcagcacttgctttacctttgacgaatactacaccattactttggatataaaggcctcgtcgcatatctacgaatcaaatgccgtgtattccgtgtttgtgcctgtgaatgactcagtttacgccgttgtgatgaagaccttggacgagaattcggacagtgctggactatggcagagagccgacaaaaattgttattccaacagtacatactatgtgaaagaccaatatatgaccgtcctagaggcccaatggcaggcgccggagccggagaatattacagaggttgagatccaagctttcaccgtccagattagagccctgcctatactgagcaccctcaagttgcgagagaagctctccacactggccctggccgctaaaatcccacaaagcagcgcctttaaacccttcttcatgattactccaaagagtatcagactggaaggcctcgctaatcaggttttcagcagccctatcactgaggctatctacattctgctggccttccttaccagcactttgctgttttag

SEQ ID NO: 112177 - DNA, 3708 bp, Artificial Sequence
  Description of Artificial Sequence: Synthetic coding sequence
atggatcataccgcctcccagaacgcccaggatctgattgggatcccgcacctgggcgttagcggttcaagcactaaatggcattccgaactctctccaaccgagggaccgcatagtgccggatcttccactcctggctttttgagccccatggccgaactttctcacccctcccctccgcctccggccctgggaagcctactgcagcttcctgatggcagcccatcttggtccatgctggaggttgcttccgggccggctagcactcaacaaatcaaggccggcgtccctggtagggtgcacaacggggttagcctgccaacatttaagaacactgagacggctacacatgaagctgagccacctctgttccagaccgccgaatcaggggcaatagagatgacatcccggaagctcgcatcggcaacagccaacgactcagctaatccactgcaccttagtgccgcgcccgagaatagcagagggcccgcgttgtctgctgaacatacgtcttcgctagtgccaagcctgcatatcacaacgcttgggcaggaacaggccattctgtctggggccgtgcctgctagtcccagcactggaaccgccgattttccctcgatactaacttttctgcaacccacggagaaccatgctagtcccagccctgtgcctgaaatgcctactctgccagctgaaggcagtgatggctctcctccagccacaagagatctgctgctctcaagtaaagtacctaacctgctgtctacgtcctggacatttcctcggtggaagaaagatagcgtgacagcaatcctcggcaagaatgaggaagctaacgtgaccatcccattgcaggcattcccacggaaggaggtgctgtccctgcacacagtgaatggattcgtgtccgattttagtacaggctcggttagctcccctatcatcactgctcctcgcacaaatcctctgccttccgggccccctctcccttctattctgtcaattcaggccacacagacagtgtttcctagtcttgggttctcttctactaagccagaggcttacgctgccgcagtagaccattctggcctccccgcctcagcaagcaaacaggtcagagcaagtccttcatcaatggatgtgtacgactcgctgacaatcggtgacatgaagaaaccagctacaaccgatgtgttctggtccagtttaagcgccgagaccggctcactctcaactgaatctattatttccggcctgcagcagcagactaattacgatcttaatgggcataccatctccactaccagctgggaaactcatctagctcctaccgcacctcccaatggcctgacttccgcagcagacgcgatcaaatcccaggattttaaagataccgctggccacagtgtgaccgcggaaggctttagcattcaggacctcgtgcttggtaccagtatcgagcagcccgtgcagcaatccgatatgacaatggtggggagccatatagatttgtggcccacatccaataataaccattctagagacttccagaccgccgaggtggcgtactactcaccaacaacacgccattccgtctcccatccacagctccaactccctaaccagccagcccaccccttactgctcacctcacccggccccaccagtacagggagcctgcaggagatgttgagcgatgggaccgatacagggtcagagattagttccgacattaactcttctcccgaaaggaatgcaagcactccatttcagaacattctgggatatcattcagccgcagagagctctatatccacatcagttttccccaggacaagtagtagggtcctccgtgcttcccaacaccctaagaagtggacaggcgcagccacgaatgccgccgacacggtatcttccaaggttcagcccacagcagctgctgctgtgaccttgttccttaggaaatcctcaccgcccgcactatcggctgccctcgtagcaaagggcactagttcctcccctttggccgttgccagcgggccggctaagagtagcagtatgaccactttggcaaagaatgtaacaaataaagcagcttcaggacccaaacggacaccaggagccgtgcacaccgctttccctttcacgcccacttacatgtacgcaaggacagggcacacaaccagcacccacaccgccatgcaggggaacatggatactgcatccggcttactctccacaacctacctgcctcgtaaacctcaggccatgcatacaggcctccccaatcccacaaatctcgagatgccacgtgccagtaccccacgcccgctgactgtgaccgctgcattgactagtataacggccagcgtgaaagctaccagactgcccccattgagagccgagaacacggatgcagtccttcctgcagcctcagcggcagtcgtgacgaccggcaagatggcttccaaccttgaatgtcagatgtcctccaaactgctggtaaagacggtgctgttcctgactcagagacgggtgcagatctctgaatcactaaaattttcaatcgcaaagggactcactcaggcccttcgaaaggcatttcatcagaacgacgtttcagcccacgtggatatcctggagtatagccataacgtgactgtgggatactatgccaccaagggaaaattggtgtacttacctgcggttgtgatcgagatgctcggagtttatggggtcagtaacgttacagccgatctgaaacagcatacacctcacttgcaaagcgtggctgtcctggcttctccttggaatcctcagccggccggctatttccagctcaagacagtgctccagtttgtgtcgcaggctgataacattcaatcttgcaagtttgcccagactatggagcaacggcttcagaaggcatttcaagacgctgaacgtaaagtccttaacaccaagagcaatctaactatacagatcgtaagcacaagcaatgcatctcaagctgtgactctagtttacgtcgttgggaaccaaagcacattcctgaatggaactgtggcatcatccctgctgtcacaattatccgctgaactggtggggttttacctgacatatccacctctgactattgccgaaccacttgaatacccgaatctggatattagtgaaaccacccgcgattattgggttattactgtgttgcagggagtcgacaatagcttggttggtctccacaaccagtcttttgctagggtgatggagcaacgcttggcccagctgttcatgatgagccaacagcagggccggcgctttaagagggccactacactggggagttataccgtgcagatggtgaaaatgcagcgcgttccagggccaaaagaccccgctgagttgacgtactacaccttgtacaatgggaaaccattactcggaactgccgcagccaaaattttgagcaccatcgacagtcaacgcatggcattaaccctacaccacgttgtcctgttacaagccgaccccgtggtcaaaaacccaccgaacaatctctggatcatcgctgctgtactggcccccattgctgtggtgactgtcatcattatcatcattaccgccgtgctatgtcggaagaacaaaaacgatttcaagccggatacaatgatcaatcttcctcagcgagccaaacaggttgcccaatag

SEQ ID NO: 112178 - DNA, 5550 bp, Artificial Sequence
  Description of Artificial Sequence: Synthetic coding sequence
atggatcataccgcctcccagaatgcacaagacttgatcggcatcccccacctaggagtctccggaagttccacaaaatggcactctgagctttctcccacagaaggaccccattctgcaggctcctccacaccaggtttcttaagccctatggcggagctctcccacccgtcaccaccgcctcccgccctggggagtctgctgcagctccctgatgggtccccatcctggtctatgctcgaggtggcgtctggaccagcctccacacagcagattaaggctggtgttcccggcagggttcacaacggagtgtcactgcccacatttaagaacacagagactgcgacccacgaggcggagcccccactctttcagactgccgagtccggtgcgattgagatgacgtcaagaaagcttgcttccgcgaccgccaacgactccgccaatcctctccacttgtctgccgcacctgagaacagccgcggccctgctttgagtgcagagcataccagctccctggtgccttccctgcatattacaacactgggccaggaacaggccatcctgtctggggcagtgcccgcttctcctagcacagggacggccgacttcccctccattctgacatttcttcagccaactgagaatcatgcatcaccatcacctgttccagagatgcctaccttgcctgcagaagggtccgatggcagcccccccgccactcgagacttactcctcagttctaaagttcccaacctcctgagcacaagctggacctttcctagatggaagaaggattcagtgaccgcaatcttgggcaaaaatgaagaagctaacgtgacaatcccgcttcaagctttccctaggaaggaagtgctgtcccttcacactgtgaatggcttcgttagtgactttagtaccggatccgtctcttcgcctatcatcaccgccccaagaaccaatcccctgccttcaggccctcccctgccctcaatactgagtattcaggctactcaaaccgtgttcccttccctgggtttctcgagtactaagcccgaggcctacgcagctgccgtggaccactctggattgcctgctagtgcttcgaagcaggtgagagcctctccctcatctatggacgtctacgattctttaaccattggagatatgaagaagccagccaccaccgacgtattttggagctcactctcagcagagaccggcagtctgtcaacagagtccattatctcaggacttcagcagcaaacaaattatgacctcaatgggcacaccatctcgactacatcttgggagactcatttggcccctaccgcgcctcccaatggtcttacgagtgccgccgatgccataaaaagtcaggacttcaaggacacagccgggcactcagtcactgccgaagggttctccatccaggacctagtcctgggcacgtccatagagcagcccgtgcagcaatctgacatgacaatggtcggaagtcacatcgacctctggccaacctccaacaataaccattccagggatttccagactgctgaggtcgcctattatagcccaactaccaggcatagcgtgagtcacccacagctgcagctgcctaaccagccagctcacccactgctgctgacttcccctggacccacttccaccggatcactgcaggagatgctgtccgacggaaccgacacaggcagcgagatcagttctgatattaactcatcccctgaaagaaatgcttccacgcccttccaaaacatccttggttatcactccgcagcggagtcctcaatctcgacaagtgtttttcctcggacttctagcagagttctgagggcgtcccaacacccaaagaagtggactgcagacactgtgtcgtccaaggttcagcctacagccgcagcagctgtgacgctgttcctccgcaaatcatctccccccgctcttagtgcggcgctcgtggctaaggggacatccagcagtccccttgctgtggccagcggacccgccaagtcctctagcatgaccaccctggcaaaaaacgtcacaaacaaggccgcttccggacctaaacgaacgccaggggcagtgcacaccgcttttccttttactcccacgtacatgtacgcaaggaccgggcataccacctcaacccacactgccatgcaaggaaatatggacacagcatctggactcctgagtactacctatctcccgagaaagccccaagccatgcacacaggtcttccgaatcccaccaacttggagatgccccgtgcaagtactccaagacctctgaccgtgactgctgccttgacgtcgatcaccgcatccgtgaaagccacacgtcttcctccattacgggcagaaaacaccgatgctgtgctgccagcagcctccgcagcggtcgtgacgaccggaaagatggcttctaatttagagtgccagatgtcttcgaagctgctggtgaaaaccgtattgtttctcactcaacgccgcgttcaaattagcgagtcacttaaattctcaattgctaagggccttacacaagcgctgagaaaggcgttccaccaaaatgacgtgagtgcccacgtggacatcctggaatactctcataatgtgaccgtgggctactacgcaacaaaagggaaactcgtctatcttccggctgtcgtgatcgaaatgctgggagtgtacggcgtctctaatgtgacagccgacctgaaacagcacactcctcatctgcagtctgtggcggtgctggcctccccatggaaccctcagccagcggggtattttcaattgaaaacagtcctccagttcgtttcacaggccgacaacatccagagctgtaagtttgcccagacgatggagcagagactgcagaaggcttttcaggacgcggaaagaaaagtgttaaacaccaaaagcaacctgactattcagatcgtttcaacctctaacgcttcccaagcagtgactctggtctacgtagttggtaaccagtccacctttctgaacgggactgtggccagttcattattatcccagctgtctgcggagttggtaggattctatctgacctacccgccactcaccattgccgagcctttggagtatccaaatctggacatcagtgagaccaccagggactactgggtcattaccgtccttcaaggggtggataattccctggtgggactgcacaatcagtcatttgccagggttatggaacaacgcttggcccaattatttatgatgtcccagcaacagggacggcgcttcaagagagccactaccctcgggagttatacagttcagatggtgaagatgcagagagtgccaggtcctaaggaccccgcggagctgacatactacacactatacaatggaaagcccctgctgggcaccgctgcagcaaagatcctgtctacaatcgactctcagagaatggctctgacactccaccacgttgtcttattacaggctgatcctgtcgtgaaaaaccctccgaataacctgtggatcatcgctgccgtgctggcgcccatcgcagtcgtcacagtcatcattattatcattaccgccgtgttgtgccgcaagaataagaacgactttaaacctgacaccatgattaatctaccgcagcgggcaaaaccagtgcagggattcgactacgccaaacagcacctgggtcagcaaggagcagacgaggaggtcatccctgtgacgcaggaaaccgttgtactacccctgccaattcgcgacgcaccacaagagcgggatgtggctcaagatgggagtactataaaaacggccaaaagtacagagaccagaaagagcagatctccctccgaaaacggctccgtcatcagtaatgagagcggcaaaccgtcaagtggccggcggtcgccgcagaatgtcatggcccagcagaaagtgacgaaagaggaggcacgtaagaggaatgttcctgctagtgacgaggaggaaggggctgtgctttttgataactcttcaaaagtagcagcagagccttttgacacttctagtggcagtgtccaactgatcgctattaagcctactgcccttccaatggtcccacctacctccgacaggtcgcaggagagcagcgccgtgctgaacggagaagtgaacaaggcgctgaaacagaagtccgacatcgagcattatcgcaataagctccggctgaaagctaaaagaaagggctattacgatttccctgcagtcgagaccagcaagggcctgactgagaggaaaaagatgtatgagaaggctccgaaggaaatggaacacgtactggatcctgactcagaactatgcgccccatttacagagtcaaagaatagacagcagatgaagaactctgtgtaccgaagcagacagtccttaaattctccaagccccggcgaaaccgagatggacctactggttacaagagagagaccacggaggggcattaggaacagcggatatgataccgaacccgagatcatcgaagaaaccaacattgaccgggtgcccgaaccacggggatactccagaagcaggcaggtgaaaggccattcagagacatcgacgctgtcaagccaacccagcatagacgaggtgagacaacagatgcacatgttgcttgaagaggctttttcactggcctcagccggccatgcaggtcaatcacggcatcaggaggcgtacggctcagctcaacacttgccatatagtgaagtcgtgactagcgctcccggcacaatgaccagacccagagccggagtacagtgggtcccaacgtatcgtcccgagatgtaccagtatagcctaccacgccccgcctaccgatttagccagttgcccgagatggtaatgggctcgcctcccccaccagtgccaccccgcacaggccctgtggccgtagctagcctaagaagaagcacaagtgatatcggctccaagactagaatggctgagtccacgggtccagaaccagcacagctgcatgatagcgcctctttcacacagatgtcgagaggtcctgtgagtgtgacgcagctggatcagagtgcactgaactattcgggaaacactgtgcccgctgtgttcgctatccccgccgctaaccggcccggtttcactggctattttatccctactccccctagttcgtacagaaatcaagcatggatgtcctatgctggggagaacgagctccctagccagtgggcagatagcgtgcctctgcctggttacatcgaggcctacccccgatctcgctacccccagagctcaccatctcggctgccccgacagtatagccagcccgccaacctgcatccttctttagagcaggccccggctccctctacagccgcctcccagcaaagcctcgctgagaacgatccctcggacgctcctctcaccaatatcagcaccgccgccctcgttaaagctattcgagaggaggttgcaaaactcgcaaaaaagcagacagacatgtttgagtttcaggtgtag

SEQ ID NO: 112179 - DNA, 5568 bp, Artificial Sequence
  Description of Artificial Sequence: Synthetic coding sequence
atggaccacaccgccagccagaatgcgcaggatctgatcggaattccccacttgggagtgtctgggagttctactaagtggcatagcgaattgagccccactgaggggccacactcagctggctcctctacgccaggcttcctgtcaccaatggccgagctgagccacccctctcccccaccaccagcactagggagcctgctgcagttgccagacggctcaccctcatggtcaatgctcgaagtagccagcggtccagcttccacccagcagataaaagcgggagtgcctggtagagtgcataatggcgtgagtttgcctacctttaaaaacaccgagacggctacacatgaagcagaacccccattattccagactgccgagtcaggagccattgagatgacaagccgcaagttggcaagtgccacagctaatgattctgccaatcctctccatctgagtgccgcgcccgagaacagtcgagggcctgccctctcagcggagcacaccagttccctggtgccgagcctgcacattactacgctcggtcaggaacaggccattctaagtggcgctgtaccagcaagcccctcgaccggcacagccgacttcccctctatactgaccttcctgcaacccaccgagaatcatgctagtcctagccccgttcctgagatgcctacattgccagccgaggggtccgacggctcacccccagccacacgggacctcctgctcagctccaaagtgcctaaccttttgtctacctcatggaccttcccccggtggaaaaaggatagcgtgacagctattcttggcaaaaatgaagaggccaacgtaacgatccctctccaagcattccccagaaaggaggtgttgagcttgcataccgtgaatgggtttgtgagcgacttttcaactgggagcgtttcatctccaataattaccgctcctcggaccaatcctctgcccagtggcccacccctgccgtctatcttgagtattcaggcaacccaaaccgtgttccctagtttaggtttttcatcaaccaagcccgaagcatacgccgcggccgtggaccactccggtttacccgccagtgcttccaagcaggtgagagcgtcccccagtagtatggatgtatacgatagtcttacaataggtgatatgaagaaacctgctaccaccgacgttttttggtcgagcttgagcgcagaaacgggaagcctgtccacagaaagcatcatctcgggattacagcagcaaactaactatgacctgaatggacacactatcagcaccacaagctgggagacccacctggctcccaccgcaccacctaacggacttacttccgcagccgatgctattaagagccaagatttcaaggacaccgctgggcactccgtgacagcggaggggttttctatacaggatctcgtgttgggaacttccatcgagcagcccgtacaacaatcagatatgactatggtaggcagtcatatcgatctgtggccgacgtccaacaataaccattctcgggactttcagacagctgaagtggcctactactctccaaccactaggcactcagtttcacacccacagttacaactgcctaatcagcccgcccatcctttgttgctgacatctcccgggcccaccagtactggctcattacaggagatgctgagtgatggtaccgacaccggctcagagatctcatctgatattaactcatcaccagagagaaatgcttccactccgtttcagaatatactcggttatcatagtgcggcagagtcctcgataagcacaagcgtcttccctcgcacaagctctagggtactgcgcgccagccagcatccgaaaaaatggaccggcgcggccaccaacgcagccgatacggtgagcagcaaggtccagcccacggccgcggccgctgtgacattatttcttcgtaagtcttctccccccgcactgagcgccgctcttgtcgcgaaggggacttccagcagcccattggctgttgcaagtggaccagctaaaagctcctcaatgaccaccttggcgaaaaacgttaccaataaggccgccagcggtcctaagcggactccaggagcggttcataccgcttttccctttacacctacttacatgtacgccaggaccgggcatactacctccactcacaccgccatgcaggggaatatggacaccgctagcgggctgttatcgaccacctacttaccacgaaagccccaggctatgcataccggacttccaaaccctacgaaccttgagatgcctcgcgcctccacaccacggccattgacagtcacagcagccctaacgtctattaccgctagtgtgaaggctactcggctccctcctctcagggccgaaaatacagacgcagtgctaccagccgcatcagccgcagttgtgactacaggcaaaatggcctctaacctggagtgccagatgtcatctaagcttctggtcaagacggtactgttcttgacacaaagacgcgtgcagataagtgaaagcctgaaattcagcatcgcaaagggattaacacaagcattacggaaagcatttcatcagaacgatgtgtctgcccacgtggatatcctcgagtacagccacaacgtgactgtggggtattatgctacaaagggaaaattagtgtacctgccagccgtcgtaatcgagatgctcggcgtctacggggtatccaacgtgactgctgatctaaaacagcatacacctcatctgcagtcagtggctgttttggcttctccttggaacccccagcctgctggctacttccaactgaagacagtactccagttcgtaagccaggcagacaacatccagtcatgtaagtttgctcagacaatggaacagaggctacagaaagcctttcaggacgccgaacggaaggtgctcaataccaaaagcaatctgactatccagattgtttcaactagtaatgctagccaggccgtcacgctcgtgtatgtcgtgggcaaccagtctacattcctcaatggcacggtggcaagctcactgctgtcccagctctctgctgaattggttgggttttatcttacctatcctccgcttactatagctgagcctctggagtaccccaatctcgatattagtgaaacgacaagagattactgggtgattacagtgctccagggcgtggacaatagtcttgtaggactgcacaatcaatcattcgctcgtgtcatggagcagcgcctcgcacagttatttatgatgtctcagcagcagggccggcgtttcaagcgtgccacgacactcggatcatataccgtgcagatggtgaaaatgcagcgggtacccggcccgaaagaccccgctgaactgacctactacacgttatataatggcaagcctctgttgggcactgcagccgctaagatcctatcaactatagactctcaacgtatggccctgactttgcatcacgttgttttgcttcaagctgacccggtcgtgaaaaatcctccgaacaatctttggattatagcagccgtccttgcaccaatcgctgtagtgaccgttattatcataatcattactgccgttctgtgtaggaaaaataagaacgacttcaagccggacactatgattaacctgccgcaacgggcaaagcccgtgcagggattcgactatgcaaagcagcacctcggacagcagggggccgacgaggaagtcatacctgtgacccaagagactgtggtcctaccactgcctatcagagacgccccacaggaacgggacgtcgcccaggacggatccaccattaagaccgccaaatccacagagacccggaaatcccggtccccgtcagagaacggatcagttataagcaatgagtcagggaagccctcctccggacgcagatcaccccagaacgtgatggcccagcagaaggttacaaaagaagaagcgcgtaaaagaaacgtacccgctagcgacgaggaagagggggcggtactctttgataattcctcaaaggtcgcagcagagccattcgacacatccagcggctctgttcagttaatcgccatcaagcctaccgcgctgcccatggtccccccaacttcggacaggagtcaggaatctagcgcagtgcttaacggtgaggtaaataaggcgctgaagcaaaaatccgatattgaacattataggaataaactcaggctgaaagccaagaggaaagggtactatgatttccccgccgtggaaacctccaaaggactgacggagagaaagaagatgtatgaaaaagcgcccaaggaaatggagcatgtcttagatccagactcagagctctgcgcaccatttacagagagcaagaatcgccagcagatgaaaaacagcgtctacaggagccgccagagtctaaacagtccctcgcccggggagactgaaatggatctactggtgacgagagagcgaccgcgtagagggatccggaatagcgggtatgacaccgagcctgagattatagaagagactaacatcgatcgagttcccgaaccaagggggtattctaggtcacgtcaggtcaaagggcatagcgagacaagtacactatcaagtcagccctctattgatgaggtgagacagcaaatgcatatgctcctcgaggaggcttttagtctcgcttcagccggtcatgctgggcaaagcaggcaccaggaagcttacggatcggcacaacatctcccttattccgaagtggtgacaagcgcccctggtacaatgaccagacctcgagctggagtccagtgggtcccgacttatcggcctgaaatgtatcagtactcccttccaaggccggcatacagattcagccagctacctgaaatggtaatgggaagccccccacctcccgtgccgcctcgcacggggccagtggcggttgcatcactgaggcggtcaacatccgatattggcagcaagaccaggatggctgagtcaactggcccggagcccgcgcagcttcacgattctgccagctttacccagatgagtagaggacctgtgtcagtgacccagctcgatcagtcagcattgaattattccggcaacaccgtgccagccgtatttgccatccctgcggctaatcggccagggtttacaggatatttcattcccacacctccaagtagctacaggaatcaggcctggatgagctatgctggagaaaacgaacttccatctcaatgggcagatagtgtgcccttaccgggctatatcgaggcctaccctcgaagccgctatccccaatcaagtccatctcgccttcctcggcagtactcacagcctgcaaacttgcaccccagcctggagcaggccccggccccctctacagccgccagccaacagtctttggcagagaatgatccgagtgatgcaccgctaaccaacatctcaaccgcagctctggttaaggcgataagggaggaggtagcaaagctggcgaagaaacagactgacatgttcgagtttcaagtgtag

SEQ ID NO: 112180 - DNA, 5067 bp, Artificial Sequence
  Description of Artificial Sequence: Synthetic coding sequence
atccctgagggtctttccgccgaacacacctcttcgttggtgccttcgctgcacatcaccacccttggacaggagcaagcaatcctgtcaggcgctgtccctgcaagcccgtctacagggaccgccgacttcccatcaattctgacctttttgcagcccaccgaaaatcacgcttcccctagccccgtgcctgaaatgcccaccctcccagctgaagggtctgacgggtcgcctccagccacaagagatctgctcctttcatccaaggtccccaaccttttgagcacatcatggacattcccccgctggaagaaggattccgtgactgccatactgggaaaaaatgaagaggccaacgtgaccattccgctgcaggcatttccgcgaaaggaagtgctaagccttcacacagttaacgggttcgtctcggacttctcaacaggatctgtcagttcgcctatcatcactgctcctaggacaaatccactgccatccggccccccattgccctccattctgtctattcaggcgacacagactgtgtttcccagcttgggcttttccagtacgaaacctgaggcctacgcagctgccgtcgaccacagcggcctacccgcaagcgcctcaaagcaggtccgagcgtcacccagcagtatggacgtgtatgactcccttactatcggtgatatgaagaagcctgcaactactgatgtattctggtctagtttgtcagccgaaaccggcagcttatctacagaatctatcatcagtggacttcagcaacagaccaattacgatctaaacggccatactatctccacaacatcatgggaaacgcaccttgcaccaactgcaccaccaaacggattgacgtccgctgcagacgcaatcaagtcgcaggatttcaaagacactgccggccactctgtgacggctgaaggattctcgattcaggatctggtgcttggcaccagcatcgagcagccagtgcaacaatcggatatgactatggtgggcagtcacatcgacctgtggcccacgtccaataacaaccatagccgtgattttcagacggccgaagtcgcatattattccccaaccacacgtcatagcgtgagccacccgcagcttcaattaccaaatcaacctgcccaccctctgttgctgacctccccaggccctacatcaaccgggagcctgcaggagatgctttccgatggcaccgacacgggcagcgaaatctcaagcgatataaacagctcgcccgagaggaatgcttccaccccattccaaaatatccttggctaccacagcgccgccgaatcctctatcagtacttctgtctttccacgtacaagttcaagagtgctcagggcatcccagcatccaaagaagtggactgctgacacagtctcgtccaaggttcagcccactgctgcagccgccgttacccttttcttgagaaaatcatctccccccgcacttagtgcggccctggtggccaaaggaacatcatctagcccactggcagtggctagcggcccagccaagtcctcttctatgactaccctcgcaaaaaatgtgacgaacaaagcagcatctggacccaaaagaacgcccggtgccgtccacaccgccttccctttcactcctacatacatgtacgccagaacaggacacactactagcacacacacggctgcccgcaagcacggacactgcttgtggcctgtcgtatacaaccttcctccaagaaaaccgcaggcaatgcatacagggctacctaacccaacaaatctcgaaatgccacgcgccagcaccccccgaccactcactgttaccgctgctttgacctcaatcacagcctctgtgaaggccacacggttaccaccactgagagcggagaacaccgacgcagtgctgcccgcagcctctgctgctgtggtgacgacagggaaaatggccagcaatttagaatgtcagatgagtagtaagctcctggtgaagacggttctgttcctgacccagagaagagtgcagatctccgaaagcttaaagttttctatcgcaaagggcctgactcaagcgctccggaaggcctttcaccagaatgatgtatccgcccacgttgacatcctcgaatattcccataacgtgacagtgggctactacgctactaaaggcaagctggtgtatctgcctgcggtggtcattgaaatgctgggcgtgtacggggtgtctaacgtaactgctgatctcaaacagcacacgccccacctgcagtcggtcgccgtgttggcctcgccctggaacccccagcctgccggttatttccagctgaaaaccgtgttacagtttgtctcgcaagccgataacattcaatcatgcaagtttgcacaaactatggagcaaagactacagaaagcctttcaggacgccgaacgaaaagtcctgaacactaagagcaacctcaccatccagattgtaagcacctcaaatgcttcgcaagcagtaactctggtgtatgtggtaggaaaccaatctactttcctgaacgggaccgtggcttcgagtcttctaagccagctctcagccgagctggtggggttctatctgacatatccacctctgaccatcgccgaaccgctcgagtaccctaatttagatatatccgaaactacacgcgactactgggtaattacggtcttgcagggagtggacaactctcttgtgggactgcacaatcaaagtttcgcacgcgtgatggagcagaggctggcacagcttttcatgatgagccagcagcagggcagacggtttaaacgcgcaaccacactgggatcctataccgtgcagatggtgaaaatgcagagggtacccggacccaaggacccagcagagctcacatattacaccttatataatggaaaacctctgttaggtaccgcagcggctaagattctgagtaccatcgactcacaacgaatggccctgactctccaccacgtggtcctcttacaagctgaccctgtggtcaagaaccctcctaataatctctggattatcgctgcagtgctggccccaattgccgtggtgactgtcattatcatcataatcacggctgtgctatgtcggaaaaacaaaaacgattttaagcctgataccatgatcaatctcccccagagagcaaagccagtccaaggattcgattacgccaagcagcacctgggacagcagggggccgatgaagaagtcattcctgtgactcaagaaacagtagtgctgccgttgcccatacgggatgccccacaggaaagagatgtggcccaagatggaagcactattaaaacggccaagtcaaccgaaacccggaaaagcaggtccccctcagaaaacggctccgtgatctcaaacgagtccggtaagccaagctccggccggaggtccccccagaatgtgatggctcagcagaaggttacgaaggaagaagccaggaaacgcaatgtcccagcttcagacgaggaggagggggccgtattgttcgataactcctctaaagtcgccgcagagcctttcgatacaagcagtgggtctgttcagctgatcgctatcaagcctaccgctcttccaatggtgccccccacaagcgaccggagtcaagaaagctcggctgtcctgaacggggaagtgaataaggctttgaagcagaagagcgatatcgaacattatcggaataaactgcgtttaaaggccaaacggaaaggctattacgattttcccgcggtggaaacatcaaagggtctgacggagcgcaaaaagatgtacgagaaggcccccaaggaaatggaacatgtgctggaccccgattcagagctgtgcgcaccatttaccgaaagtaaaaaccggcagcaaatgaagaactccgtgtatcgcagccgccagtccctcaatagcccctccccaggggagacagagatggatctcctcgtgacgcgtgagcggccaaggcgcggtattcgcaatagcggctatgacacagagccagaaattatcgaggaaacgaatattgacagagttcccgaacctcggggctatagccgttccagacaagtgaagggacatagcgagactagcactctgagctcccaaccgtccatcgacgaggttaggcagcagatgcatatgctgcttgaggaggcattctctctagcttccgccggacacgccggtcagtcccgacaccaggaggcctacgggtctgctcagcacctgccatacagtgaagttgtaacctccgctccgggcactatgacccgcccaagggcaggcgtccagtgggtgccaacctaccgcccggagatgtatcagtattcactgcctcgcccagcctaccggttctctcagttaccggaaatggtaatggggagccccccacctccagtccccccccggaccgggcctgtcgccgtggcctcccttcggagaagtaccagcgacattggttctaagacccgtatggccgagtctacgggtcccgaacccgcacagctgcacgatagtgcttctttcactcagatgagccgcggccctgtctctgtgacgcagcttgaccagagtgcgcttaactatagtggtaacaccgttccagctgtgtttgccatccctgccgccaacagaccaggcttcaccggttacttcatcccaactcccccgtccagctatagaaaccaggcttggatgtcctacgcaggcgagaatgaactgcccagtcagtgggcagacagtgtcccattaccgggatatatcgaggcctaccccagatcacggtacccccagtccagcccctccaggctaccaaggcaatactctcagccagcaaacctccatccttccctggagcaggcccctgctccttccacagccgcaagtcagcagtccttggcagagaacgatcctagtgatgcccccctcaccaatatatcgaccgccgccctggtgaaagccatcagggaggaagttgccaaacttgctaaaaaacagactgacatgttcgaatttcaggtatag

SEQ ID NO: 112181 - DNA, 783 bp, Artificial Sequence
  Description of Artificial Sequence: Synthetic coding sequence
atgatggatccgtgctctgttggagtgcaactgaggactacaaatgaatgtcacaagacttactatacacgacacacggggttcaaaactctgcaggagctttcgtccaacgatatgttgttgcttcagctcagaactggaatgaccttatccgggaacaacaccatatgtttccaccacgttaaaatttacattgaccggtttgaggacctgcagaaatcctgctgcgatccgttcaatatccacaagaaactcgctaaaaagaatctccatgtgatcgatcttgacgatgccacctttctgtcagctaaatttggacgccaactcgtgccagggtggaagctctgccctaagtgcactcagatcatcaacggctctgtcgacgtcgataccgaggaccggcagaagcggaaaccagagtccgacggccggactgcaaaagccctgcgatcccttcagttcacaaaccccggccgacagactgagtttgctcccgagacaggaaagagggaaaagcggcggctgacgaaaaatgctacggctggaagtgacagacaggtcattccagcgaagagcaaggtctacgactctcaaggcctgttaatattttcaggtatggacctctgcgattgcctggacgaagattgtctgggctgtttttacgcttgtccagcctgcggtagtactaaatgcggcgccgaatgcagatgcgaccgcaagtggctgtacgagcagatcgagatcgaaggtggagaaatcatacacaataagcacgccggctag

SEQ ID NO: 112182 - DNA, 507 bp, Artificial Sequence
  Description of Artificial Sequence: Synthetic coding sequence
atgatggacccatgttctgtcggagtccagttaagaacaaccaatgagtgccacaaaacgtattacactaggcacacgggcttcaagacactgcaagagctctcatcgaacgacatgctactcctgcagctaagaaccggcatgacactgagtggcaataacactatatgctttcatcacgtgaaaatttacatcgaccgctttgaggatcttcagaagtcttgctgtgacccctttaatatccataaaaagttagccaaaaagaatttacacgtcatcgatttggacgatgctacatttttatcggcaaaatttggacgccagcttgttcctggctggaaactctgtccaaaatgcactcagataatcaacggctccgtggatgtggatacggaagaccggcagaaaaggaaaccagaatcggatggaagaacagccaaagcgttaaggtctctgcagtttacaaaccctggacgacagaccgagtttgcgcccgaaactggttag

SEQ ID NO: 112183 - DNA, 180 bp, Artificial Sequence
  Description of Artificial Sequence: Synthetic coding sequence
atgagacagttgaagggaaaacccaaaaaggaaacgagtaaggacaaaaaggagagaaaacaagccatgcaggaggcccggcagcaaataaccaccgtcgtactgcctaccctagctgtagtggtcctgctgatcgttgtctttgtttacgtagcaaccagacctactattaccgagtag

SEQ ID NO: 112184 - DNA, 180 bp, Artificial Sequence
  Description of Artificial Sequence: Synthetic coding sequence
atgcggcaacttaaaggcaagcctaagaaggaaaccagcaaagataaaaaggagcgcaagcaggccatgcaggaagccagacaacagataacaacggtagttctgccaacacttgccgtggtcgtcctgctgattgtggtgtttgtttacgtcgccacgcggcctactattaccgaatag

SEQ ID NO: 112185 - DNA, 144 bp, Artificial Sequence
  Description of Artificial Sequence: Synthetic coding sequence
atgcggcagctgaaaggcaagcccaaaaaggagacaagcaaggataagaaagaaagaaagcaggccatgcaggaggccaggcaacagataaccactgttgtactgccaaccctggccgtggtggtactcctgattgtggtctag

SEQ ID NO: 112186 - DNA, 180 bp, Artificial Sequence
  Description of Artificial Sequence: Synthetic coding sequence
atgagacagcttaaaggcaagccaaaaaaggagaccagcaaggacaaaaaggagaggaaacaggccatgcaggaagccaggcagcagattaccacggtggtgctgcctactctcgccgtcgtcgtcctgctgattgtagtctttgtctacgtagcgacgagacctactattaccgagtag

SEQ ID NO: 112187 - DNA, 159 bp, Artificial Sequence
  Description of Artificial Sequence: Synthetic coding sequence
atgcgccaactcaaaggtaaaccaaaaaaggaaaccagtaaagataaaaaagagagaaagcaagcgatgcaggaggctcgacagcagataactactgtcgtgctgcctaccctcgccgtggtggtgctgttaatagtggtcttcgtgtatgttgcttag

SEQ ID NO: 112188 - DNA, 3336 bp, Artificial Sequence
  Description of Artificial Sequence: Synthetic coding sequence
atgcattggctgcctgccggccatgatattaatggagccctcgagcccagcaacatcgacacttcgattctggaagaatacatctctaaggaggacgcctctgatctctgttttcccgacatctcagcgcccgcttcctctgcaagctactcacatgggcagccagccatgcccggaagctcaggtgtacaccacttgtctcccccagggggtggccccagccctggaaggcacgggccactgccccccccgggctatggaacgccacttaactgcaacaacaacaatggaatgggggcggcccccaagcccttcccagggggcacaggcccccccatcaaagcagaaccaaaggctccctacgccccaggtactttgcccgactcgcctcccgactcaggtagcgaagcctacagtcctcagcaggtgaatgaacctcacttgcttcgtactattactccggaaaccctctgccatgtgggcgttccttctcgcctggagcacccaccccccccacccgcccacctgccaggcccaccccccccgccgccgccccctccgcattatcccgttctccagagagatctttatatgaaggcagagccacccatccctcattacgccgcgatggggcaaggcctcgtccctacagacttgcaccacacccaacagtcccagatgctgcatcagctactgcagcagcatggtgccgagttgccaacccacccttcaaagaaaaggaaacattccgaatcgcccccctctactctcaacgctcagatgttaaatggaatgattaagcaggaaccgggcactgtgacggccctccccctccatccaacccgcgccccctcgcctccttggcctccacaggggccactttctcctggcccaggctcgctgccgctcagcattgcccgcgtgcaaactccaccttggcatcctcctggcgcgccgagtcctggtctgctccaagatagcgatagcctaagcgggagttatctggacccaaactatcaatctatcaaatggcagccacatcaacaaaacaaatgggccacgctgtatgacgcgaactataaagagctgcccatgctgacttaccgcgtggacgccgacaagggatttaacttttctgtgggggacgatgccttcgtttgtcagaagaagaaccatttccaagtcactgtgtatattgggatgcttggcgaacctaagtatgtgaaaacccccgaaggtctgaaaccattggactgcttttacttgaagttgcacggagtcaagttggaggctctgaaccagagtatcaatattgaacagtcgcaatcagatcgaagcaaaagaccattcaaccctgtcactgtgaaccttccgcccgagcaagtgaccaaggtaactgtcggccggctccacttctcggaaacaacagccaacaacatgcgcaagaaggggaaacccaaccctgatcagcgctattttatgttagtcgttgccctgcaggcacatgcccagaatcagaactatactctagctgcccagataagtgaacgcataattgtgcgggccagcaaccccggtcagtttgaaagcgatagcgacgtactctggcagcgagcccaagtcccagacacagtattccaccacggacgcgtgggaattaacaccgaccgacctgatgaggccctggtcgtccatggcaacgtcaaagttatgggatctctaatgcaccctagtgatctgcgggctaaagaacatgtgcaggaggtggacacgaccgagcagcttaaacgtatctctcggatgaggctggtgcactataggtacaaaccagagttcgctgcctctgccggcattgaggccacagctccggaaaccggggtgatagcacaagaagtgaaagaaatactccctgaagccgtcaaggatactggcgatatggtcttcgccaacggtaaaaccattgaaaatttcctggtggtaaataaggagcggatctttatggaaaacgtgggagctgtgaaagagctgtgtaaactgactgataatctcgaaactcgaattgatgagctagagaggtggtcacataaactggccaaacttagaagattggactccttgaaatctacgggctcatctggggcctttagtcatgccgggagccagtttagccgggccggtagcgtgccacacaagaagaggcctcccaaggtcgcttctaagagctcatcagtggttcccgaccaggcctgcatatctcagagatttctgcaagggactattatagcgctggtggtagtcatggcgttctcagtagtctccatgtcaacgctgtatgtgctgtcactaaggaccgaagaagatctggttgacaccgatgggcgctcctcacagagcttcggaacaactcaactgcggcagtcccccctgaccacgggactcccaggcattcagccttccttgttgctggtgaccacgtcgctgacctcatcggcccctggatctgcggtccgcactctggatatgtgctccagtcatccttgtccagtgatttgctgctcttctcccacgacaaatcccaccaccggacccagcttgggaccatctttcaaccccggacatgtgctctctcccagccctagcccgtcaacgaacaggtcggggccgagccagatggcgctcctacctgtaactaacattagggctaagagttgggggctcagcgtcaatggcattggacactcaaagcaccacaaatctctggaaccacttgcttcgcccgccgtgcccttcccagggggtcagggaaaggcgaagaatagtccttcattggggttccatggccgcgcgcggcgaggagctctgcagagtagtgtggggccagcggaacctacctgggcacagggccagtctgaacccgtaccttcacttacgtcaatacaagttctcgaaaactccatgagcatcacttctcaatactgtgctccgggagatgcctgtaggccggggaactttacgtaccacattccagtttcatccggcacccctctccatttgagtctgacactccagatgaattcctcctcccctgtgagtgttgtcctgtgttccctgaggagcaaggaagaaccatgcgaggaaggaagtctaccacagagtctgcacacccatcaggatactcagggtacaagccacagatggcccattactattttatcttttagggagtttacataccactttcgtgtggctctgctcgggcaggcaaattgctcaagtgaggcattggcccagcccgcaaccgattatcacttccatttttacaggctttgcgactag

SEQ ID NO: 112189 - DNA, 3456 bp, Artificial Sequence
  Description of Artificial Sequence: Synthetic coding sequence
atggaagtagttgacgaaactgaagcattgcagagattcttcgaaggtcatgatattaatggcgctcttgaaccaagcaatattgacacgtctattctcgaagaatatatttccaaagaggacgcaagtgacctgtgttttcctgacatatccgcaccagcaagctcggcaagctacagtcacgggcagccagcaatgccagggagctctggagtgcaccacctttccccacctggtggtggaccctcacccggtcgccacggccccctgcctcccccagggtatgggacccccctgaattgcaataataacaacggcatgggcgccgccccaaaaccatttcccggaggtaccggcccaccaatcaaggccgaacctaaggccccatacgctcctggtaccctgccggactctccgcctgacagtggttccgaagcatatagcccgcagcaggtcaatgaaccccatctgctcaggacaattactcccgaaacactgtgccatgtgggggtcccaagtagactggagcatcctccaccccctcctgctcaccttcccggcccccctccgccacccccccctccacctcactaccctgtgttgcaacgcgatctctacatgaaagccgagccgccaataccacactatgctgcgatgggccagggactcgtacccactgacctgcaccatacccagcagtcccagatgttgcaccagttgctgcaacagcacggcgcggaactccctacacacccttcgaagaagagaaagcacagtgaaagcccaccctccaccttaaacgctcaaatgttgaatggcatgatcaaacaggagccaggaacagttaccgcgctgcccctgcatccgacccgggctccttccccgccctggcctccacagggtcccctatcacccggccccgggagcttgcctttgtccatcgcccgtgtccagacccccccgtggcacccccctggggcccccagccctggcctgctacaggacagcgattccctgtcgggcagctatctggatccaaactatcagagcatcaaatggcaaccacaccagcagaacaaatgggccaccctttacgacgcgaattacaaggaattgcctatgttgacatacagggtcgacgctgataaaggttttaacttcagcgtgggagatgacgccttcgtgtgccaaaagaaaaaccattttcaggtcaccgtgtacatcgggatgcttggtgaacctaagtacgtgaaaacccccgaaggactgaagccgctggattgtttttatttgaagttgcacggcgtgaaactggaggctctgaatcagtccattaacattgagcagagccagagtgatagaagtaaaaggccgtttaatcccgtcaccgtgaatctgccccccgaacaggtgacaaaggtgaccgtgggtcgactccacttcagtgagactaccgccaataatatgcggaagaaggggaaacctaaccctgatcagagatactttatgctcgtggtagctctgcaggcacacgcccagaaccagaactatacactagcagcccagattagtgaacgcatcattgtgagggcaagcaatccaggacaattcgagtctgactccgatgtactctggcaacgagcccaagtgcccgatacagttttccatcacggacgcgttggaattaacactgaccgccccgacgaggccctggtagtgcacggtaacgtgaaagtgatggggagtctgatgcacccctccgacctgcgtgccaaagagcacgttcaggaggtggacactactgagcagctgaaaaggattagcagaatgaggctggtgcattataggtacaagcctgaattcgccgcttcagcaggcatcgaagccaccgctccagagacaggagtaatcgcacaggaagtgaaagaaattctgccagaggcagtgaaggacactggtgatatggtctttgccaacgggaagaccatagagaacttcctcgttgtaaataaagaacgcatctttatggaaaacgtcggagccgtgaaagagctgtgcaagttaacggataatttggaaacccgcatagacgaactcgaacgatggtcacataagctggccaaattgcgccggttagattcgctgaaatccaccggttcctcaggcgctttttcacatgcgggatcccagttttcgcgcgctggatccgtaccgcacaagaaaagacccccgaaggtagctagtaaatcctctagcgtggtgccagatcaggcttgcatcagccaacggttcctccagggcacaatcatcgctctagtggttgtgatggctttttccgtggtgtctatgagcactctgtatgtgttgagtctgcgcactgaagaagatctggtggacacagacggcagcttcgctgtttccacatcttgcctgcttgcactgcttcgaccccagccacctggtggatccgaggctctttgcccctggtccagccagtccttcggaactactcagttacgacagtctcctctgacgaccggattacccggcatccagcccagcctgctgctggtgaccacttcacttacctcatcagctccaggtagtgctgtgcgcactcttgatatgtgttcctctcacccttgcccggtgatctgttgctccagtcctaccactaatcctactactggcccatcactgggaccaagtttcaatcccggccacgttctcagccctagtccatctccatctacgaaccgctcaggcccttcacagatggccctgctgcccgtgaccaacatcagagcaaagtcctgggggctgtcagtgaatgggattggccatagcaaacaccacaagagcttagaaccattggcaagcccagcagtacccttcccgggtgggcagggcaaagctaaaaacagcccatcactgggatttcatggtagggccaggcggggggcattacaatcttccgtagggcccgcggaaccaacttgggcccagggccagagcgctagtctgctggctgaacctgttccgagcctgactagcatccaggtgttggaaaattctatgagcattacatctcagtattgcgctcccggagacgcttgccgacctgggaatttcacttaccatatccctgtgtctagcggcacccctcttcacctcagtcttacgctccaaatgaattcttcatcccccgtgtctgtagtcctctgctctctgaggtccaaagaagagccctgtgaagagggatccctgccccaaagcttgcatacacatcaagacactcaaggcacatcacaccggtggcccataaccatactaagcttcagagaatttacctaccatttcagggtcgccttgctgggccaggctaattgtagctccgaggcactagcccagccagctaccgattaccatttccacttttacaggctgtgcgactag

SEQ ID NO: 112190 - DNA, 1449 bp, Artificial Sequence
  Description of Artificial Sequence: Synthetic coding sequence
atgctcacatatagggtcgacgcagataagggctttaatttttctgtgggagatgatgcttttgtgtgtcagaagaaaaatcacttccaagttacagtttacattgggatgctgggagagccgaaatatgttaaaacccccgaggggttaaagcctctcgattgcttttatctgaagctccacggactggaggccctcaatcagagcattaacatcgagcaaagccagagcgacagaagcaaacggccgttcaatccagtgacagtgaatctgccccccgaacaagttactaaagttactgtcggcagactccatttttcagaaacaaccgccaataatatgcgcaaaaagggtaagccaaaccccgatcagcgatattttatgctagtagtggccctccaggcacacgcccagaatcagaattatacacttgccgcacaaattagcgaacgcattatagtgcgggcaagcaaccccggacagttcgaaagcgactccgacgtgctgtggcaaagagcccaggtgccggatactgtctttcaccatggcagagtcggcatcaatacggatcggccggacgaagcccttgtggtccatggcaacgtgaaggttatggggtcccttatgcacccatctgatctgcgagcgaaagagcacgtccaggaggtcgataccaccgaacagttgaagaggatcagccgaatgaggctggttcactacagatacaaacccgaatttgcagcttcagccggcatagaagctaccgcccccgagactggggtgatagctcaggaagtcaaagaaatcctcccagaggcagtcaaggacaccggagatatggttttcgccaatggcaagactatcgaaaattttcttgtcgttaacaaagtgtgcgggctgaagtacgttgtatactgcgaggatgacgtgtgtcacctgccagtcctgagtctaggcgccaaagaagcatgggctgtgaaggagctctgcaaactcacagacaaccttgagacccgaatcgacgaactcgagcgatggtctcacaagctcgccaaactgcgccggttagatagtctgaaatcaacaggcagcagtggcgcttttagtcacgctggaagccagttcagtcgagcaggatcagtgcctcacaagaagcgacccccaaaggttgcaagtaaggtaggcagtagctcggtggtgcccgaccaggcttgtatttcacagcggttcctccaaggcaccataattgccctggtggtcgttatggccttccgccatcaccttggtgctcaacctcaggagcagggtccacaaccatgtccgagggagagggccctcgatggggggagctcctcaaacggccatccattcttatggctccagcgcggggtccacgtgcacactgtgagggcggagcccgcccacaggggcggcccaggaaggcactag

SEQ ID NO: 112191 - DNA, 789 bp, Artificial Sequence
  Description of Artificial Sequence: Synthetic coding sequence
atggctgctcccagcggaaccgtgtcagattctgaaagctccaattcctcatcggacgccgaagaactagaaaggtgcagggaagcggccatgccggcctggggactggagcagcgtccacacgtcgctgggaagcctcgtgcgggagctgccaattcacagttgtccacatcacaaccatctcttcggcacaaggtgaacgagcatgaacaagacggcaacgaacttcagaccacacccgagtttagggcacatgtagctaagaaactgggggctttgctggacagcttcatcactataagcgaggcggctaaagaaccagctaaagctaaggtgcagaaggtggccctcgaggatgatgggtttcgcctgtttttcacatccgtgcccggtggaagggagaaggaggagagccctcagcctcgccggaagcgacagccgtccagcagctctgaagactctgacgaggagtggcggcgatgtagggaggctgccgtgagcgcttccgatatcttgcaggaatctgccattcactcccctgggaccgtagaaaaagaggctaaaaagaagcggaagttaaagaagaaggccaaaaaggttgcaagcgtagacagtgccgtggccgccactacaccaaccagcatggccacagtccagaaacaaaaatctggagaacttaacggcgatcaagtaagcctggggacgaagaaaaagaagaaggccaaaaaagcttcagagacctccccttttcccccagccaagtccgctaccgctattcccgccaactag

SEQ ID NO: 112192 - DNA, 666 bp, Artificial Sequence
  Description of Artificial Sequence: Synthetic coding sequence
atgttttgccagaaccctggcgccgctaactcccagttaagcacttctcagccatctcttaggcacaaagtgaacgagcatgaacaggacggaaatgaattgcagactacccctgagtttagggcacacgtggcaaaaaaactgggtgcactgctcgactcgtttatcacgatttctgaggctgcaaaggagccagccaaggcaaaggtgcaaaaagtggcattggaagatgatggtttcagactgttcttcacaagtgttcctggagggcgggagaaggaggagtcccctcagccccgccgaaagagacagccctcctcatcctcatctgaagatagcgacgaggaatggcgcagatgcagggaggctgcagtgtctgcaagtgacattctccaggagagcgccattcactctcccggtacagtggagaaggaggccaaaaagaaaagaaagttgaagaaaaaggcgaaaaaggtcgcttccgtagactcagccgttgccgccaccacccctacttccatggcgaccgtgcagaaacaaaaatctggagagctcaatggcgaccaggtgtccttgggaactaaaaaaaagaaaaaggctaagaaggcgagcgagacaagccccttcccccctgctaagagtgcgaccgccatccccgccaattag

SEQ ID NO: 112193 - DNA, 699 bp, Artificial Sequence
  Description of Artificial Sequence: Synthetic coding sequence
atgccggcctggggcctcgaacaacgcccacatgttgctggcaagccgcgcgccggtgcagccaattctcaattgagcacaagccagccctctttacgacacaaggttaacgaacacgagcaggacgggaacgaattacaaacaacacctgagttccgagcacatgtagcaaaaaagttgggagcactgttggactcttttattactatcagcgaagctgccaaggaaccggcgaaagctaaggttcagaaggtcgccctggaggatgatggctttcgcttattttttacatccgtgccaggtggccgcgaaaaggaagaatctccacagccaagacgcaagcgacagccgagtagcagcagcgaggacagtgacgaagaatggcgcaggtgtcgcgaggcggctgttagtgcaagtgacatactgcaagagtctgctatacactcccccgggaccgtcgagaaagaggcaaagaaaaagaggaagttaaagaagaaagctaagaaggtcgcaagtgtagattctgccgtggccgctacaacccccacctcgatggcaacagtccagaagcagaagagcggagagttgaatggagaccaagtgtctcttgggactaagaagaagaagaaggctaaaaaagcttccgagaccagtccgttccctcctgctaagagcgccaccgccatcccggcaaattag

SEQ ID NO: 112194 - DNA, 1497 bp, Artificial Sequence
  Description of Artificial Sequence: Synthetic coding sequence
atggacgtgaccgaccactacgaggatgtaaggaagatttatgacgattttttgaagaattcgaacatgctggatctcatcgatgtctaccagaagtgtagggccctcacttctaactgtgagaattacaatacggtgagcccctcacagctccttgactttctgtccggcaaacaatacgccgtgggtgacgagaccgatctgtcaattcccactagccccacatctaaatacaatcgcgacaatgagaaagttcaactgttggcgcgcaagatcatcttttcatacctaaatctcctagttaacagtaaaaacgacctcgccgtcgcttacatactgaatattcccgatcgcgggttaggccgtgaagcatttaccgatctgaagcatgccgcccgagagaagcaaatgagcattttcctggtggcgacatcctttatacggaccatcgaacttggcgggaagggctacgctcctcctcctagcgaccccctgcgtacccatgtaaaagggctgtctaacttcatcaacttcatcgataagctggacgagatcctgggagaaatcccaaacccttctatagccggagggcagattttgtcagttatcaagatgcagctgattaagggccagaattctagagatccattctgcaaggccatcgaggaagtggcacaagatctggacctgcggattaagaatataattaacagtcaggaaggggtcgtcgcactctccacaactgacatatctccagcccgcccaaaaagtcatgccattaatcatggcaccgcctactgtggaagagataccgtgaaagcactgctggtgctcctggatgaggaggcggctaacgcaccgaccaaaaacaaggccgaactcctgtatgacgaagagaacactatccaccatcatggtacatctatattgaccttgttccggagccccactcaggtcaacaactcaattaaacccctgagagagagaatctgcgtctcgatgcaggagaagaagatcaaaatgaagcaaacgctcatccgctcacaattcgcttgcacctacaaagacgactacatgattagcaaggataattggaataatgttaatctcgcgtcaaagcctctgtgcgtgctctacatggaaaatgatctgtctgagggcgtgaacccctccgtgggccggtcaaccatcggtacatcctttgggaacgtgcacctggaccgcagcaaaaacgagaaagtttcacgaaagagcacttcccagacgggtaacaaatcatctaagcgcaagcaggtggacctggatggagaaaacatactctgcgacaacaggaatgagcctcctcaacacaagaacgccaaaattccaaagaagtctaacgattcccagaatcgcttatatgggaaactggcaaaagtggccaaaagcaataagtgcactgcaaaggacaagttgatcagcggccaggcaaagctgacccagttcttccgactgtag

SEQ ID NO: 112195 - DNA, 1740 bp, Artificial Sequence
  Description of Artificial Sequence: Synthetic coding sequence
atggctgtgttcaatcagaaaagtgtgagtgacatgatcaaagaattccgaaagaactggcgggccctgtgcaattctgaaagaaccacgctctgtggtgctgactctatgctgctggctctgcagcttagcatggctgagaataacaagcagcacagtggcgagtttactgttagcctatccgatgtgctgctcacgtggaagtatctgctccacgaaaagctgaacctgcctgtcgagaacatggatgttactgatcattatgaagacgtgaggaaaatatatgacgatttcctcaaaaactcgaatatgttggaccttatcgacgtgtaccagaagtgccgagccctgaccagtaattgtgagaactataataccgtctcccctagccagttactggacttcctgtccggtaagcagtacgctgtaggtgatgagaccgatctatcaatccccacctctcctacctctaaatataaccgggataatgagaaggttcagctgcttgcgcggaaaatcatttttagttatctgaatttgttggtaaattcaaaaaacgacttggcagtcgcctacatccttaatattcctgatagaggcctgggacgagaggcttttactgatctcaagcatgctgctcgggaaaaacagatgtccatcttcctggttgccacttcctttatccggacgatcgagctggggggcaagggctatgccccgcctccaagtgacccactgaggacgcacgttaaaggcctcagtaacttcatcaattttattgataagctggacgaaatcttgggggagatcccaaaccctagcatcgcaggaggccagatactttcagtcatcaagatgcaactaattaaaggccagaactctcgcgacccgttttgtaaggcaattgaggaagtcgctcaggatctcgacctcaggatcaagaacataatcaacagccaggaaggtgtagtcgcgctatctactactgatatttcaccagcccggcccaagtcacacgcaatcaaccacggcacagcctattgtggccgtgatactgtcaaggctctactcgtgcttttagatgaggaggcagccaacgctcccacaaagaataaggctgaactgctgtacgacgaggagaataccattcatcatcacggaacatccatactaacactgtttaggtcaccaacccaggtgaataatagcatcaaacctctgagggagaggatatgcgtgtccatgcaggaaaagaagattaagatgaagcagaccctgatcagaagccaatttgcgtgtacctacaaggacgattacatgatttctaaggataactggaataacgttaacttagcctctaaacctctctgtgtgctgtacatggagaatgatctttctgagggagtgaacccaagcgtgggtaggtccacaatcggaacctccttcgggaacgttcatctggaccggagtaagaatgagaaggttagcaggaaatcgacttcacaaacagggaacaaatctagtaagaggaaacaagtcgacctggatggagagaatatactgtgcgacaatcggaacgaacccccacagcataagaacgccaagattccaaagaagtctaacgattcacaaaatagactgtacggtaagctggccaaggttgcaaaaagcaacaaatgcactgccaaagacaagctgatcagtggacaggccaaactgacccagttctttcgcctgtag

SEQ ID NO: 112196 - DNA, 894 bp, Artificial Sequence
  Description of Artificial Sequence: Synthetic coding sequence
atggccgtgtttaaccaaaagtccgtgtcagatatgattaaagaattccgcaagaactggcgagctctctgcaacagtgagagaactactctgtgcggtgccgactccatgctgctggccctccaactcagtatggctgagaacaataagcaacactcgggcgagttcaccgtgagcctcagtgacgtgttactcacttggaagtacctccttcacgaaaaattaaacctgcccgtggaaaatatggacgtcaccgaccactacgaggacgtgaggaagatctacgatgacttcctgaagaacagcaacatgctcgacttgattgacgtgtaccagaagtgtcgcgctttaactagtaactgcgagaattacaacacggtttcaccatcacagctgttggatttcctttccggcaagcaatacgctgtgggcgacgaaacagatttgtccattcccactagccctacctctaagtataatagggataacgaaaaggtgcaactcctggcccgcaagattatcttttcctatttgaatcttctagtgaattcaaagaatgacctagccgtggcttacatcttgaatattccagatcgtgggttagggcgtgaggcgtttaccgacctcaaacacgcagctcgcgagaaacagatgtccatctttttagtagccacgtcttttatccgcacaattgaattgggaggtaaggggtatgctcctccccctagcgatccactgaggacacatgtcaaagggctgagcaattttatcaattttatcgataaactcgacgagatactcggagaaatccctaaccctcggggatgcaagtctatctgctggaagatcaataactggaacgaattttggaagtgtagcagcggccagaagtag

SEQ ID NO: 112197 - DNA, 1497 bp, Artificial Sequence
  Description of Artificial Sequence: Synthetic coding sequence
atggacgtcaccgaccactatgaagatgttaggaaaatctacgatgatttccttaaaaactctaacatgttggacctcatagacgtctatcagaagtgtagagctctgacctcaaattgcgaaaactacaatacagtgagcccaagccagctcctggacttcctatccggaaagcagtatgccgtgggcgacgaaactgacctgagtatccccacttcacccacttctaagtacaaccgcgacaacgagaaggtgcaattgctggcccggaagatcattttctcttatttaaatctacttgttaactctaagaatgacctagcagtcgcctacatcctgaacatccccgaccgaggcctaggtcgggaagcattcactgacctaaaacacgctgcacgggagaaacaaatgagtatcttcctggtcgccaccagttttatcagaactattgagctcggcgggaagggctacgcaccccctccgtcagaccccctgcgtacccacgtcaagggcctcagcaacttcatcaatttcatcgacaaactagatgagatcctgggggagattcccaacccttcaatcgcaggaggccagattctgtctgttatcaaaatgcagctcatcaagggacagaacagtcgcgacccattctgtaaggccattgaagaagtcgctcaggacctcgacctgcgcatcaaaaacattatcaacagtcaagagggcgtcgttgctttaagtaccaccgatatatctccagctaggcccaaaagccacgctataaaccatgggaccgcctactgcggtagggatactgtcaaagcactgctggttctgctggacgaggaagcagcaaatgcaccaactaaaaataaggccgagctgttgtacgatgaggagaacactatccaccaccacgggacctcaatattaactcttttcagaagcccaactcaagtcaataacagcataaaaccgctcagagaacgcatttgcgtgagcatgcaggagaagaaaattaagatgaaacaaactttgatcaggagtcagtttgcgtgtacgtataaggatgattatatgatatctaaggacaactggaacaatgtgaacctggcttctaaacctttgtgcgtcttatatatggagaacgacctgagtgagggggtcaacccaagcgtgggccgtagtacaattgggaccagctttggtaacgtgcaccttgatcgaagcaaaaacgaaaaggtctctcggaagtccacatcccagacaggcaacaaatcttctaaacgaaagcaggtcgatttagacggtgagaatatcctgtgcgataatcgaaacgagcctccccagcacaaaaatgctaaaatccctaaaaaaagcaacgatagccagaatcgtctttacggaaagttagctaaagtggccaagagcaacaagtgtactgctaaggataagcttatttccgggcaggccaagctcactcaattctttcggctttag

SEQ ID NO: 112198 - DNA, 813 bp, Artificial Sequence
  Description of Artificial Sequence: Synthetic coding sequence
atggcccgcttcgctcttaccgtcgtgaggcatggcgaaacaagattcaacaaagaaaaaatcatccaggggcagggcgtagatgaaccactgtctgagactgggttcaagcaagccgcggctgccggtatcttcttaaataacgtgaagttcacacacgcattttcttctgatttaatgcgaacaaagcaaactatgcatggtattctcgagagatctaagttctgcaaagacatgacagtcaaatatgattctaggctgcgcgaaagaaaatatggcgtcgtggagggcaaggcccttagtgagctccgtgctatggccaaggcagccagagaagaatgtcccgtttttactccccctggaggagagacacttgaccaagtgaaaatgcgcggcatagatttcttcgagtttttgtgtcagctgattcttaaagaagccgatcagaaagaacagttttcgcaaggatctccttctaattgtctggaaaccagtctcgccgagattttccccctcgggaaaaatcattcttccaaagtaaactctgactccggcattccgggtttggctgcatctgtgttggtagtgagccacggagcatacatgaggtctttatttgattattttttgacagatcttaagtgcagtttgccggccaccctgagtaggtctgagctgatgagcgtgacacccaataccggcatgtccctgttcattataaacttcgaagaggggagggaggtaaaaccgactgtgcagtgcatatgtatgaatctgcaggatcatttaaacgggctgaccgagacgaggtag

SEQ ID NO: 112199 - DNA, 501 bp, Artificial Sequence
  Description of Artificial Sequence: Synthetic coding sequence
atgtcgaccgtcgggctcttccacttccctactcccttaacaagaatttgcccagctccctgggggttaaggctgtgggagaaactaactctcctaagccctgggatcgcagtgacaccagtccaaatggcgggtaaaaaagattacccagcccttctctcactggacgaaaacgagctggaggaacagttcgttaagggtcacggtcccgggggccaagcgacaaacaagacttcaaactgtgtggtgctcaagcatatcccttcaggcatcgtggttaagtgccaccagacacgcagcgtcgaccagaataggaaacttgctcggaagattctgcaggagaaagttgacgttttctataacggcgagaattcccccgtgcataaggagaaacgggaggccgccaagaaaaagcaggagagaaagaaaagggcaaaggaaactctcgaaaagaaaaaactgctgaaggaactttgggaaagctccaaaaaagttcactag

SEQ ID NO: 112200 - DNA, 501 bp, Artificial Sequence
  Description of Artificial Sequence: Synthetic coding sequence
atgtctaccgtagggttgttccatttccccacaccactgacacggatttgtcctgcaccttgggggcttagactttgggagaaactgactctgctctcccctggaattgccgtgacaccagtccaaatggctggcaaaaaggactatccagcgctgctaagcctggacgagaacgagttggaggagcagttcgtgaagggtcatggtccaggtgggcaggctacaaataagacatcaaactgcgtggtcctcaaacacatcccttctggcatcgtggtgaagtgccaccagacccgctcggtggaccagaacaggaaattggcccgaaagattctccaggagaaagtcgacgtgttctataacggtgaaaattcacccgtccataaagagaaaagagaagctgcaaaaaagaaacaagaaagaaaaaagagagctaaagagaccctggagaaaaagaaactgttaaaagaactgtgggagagctcgaagaaggtccactag

SEQ ID NO: 112201 - DNA, 501 bp, Artificial Sequence
  Description of Artificial Sequence: Synthetic coding sequence
atgagcacagtcgggctgtttcactttccaacacccctgacccgaatctgcccagcaccatggggactacggctgtgggaaaagttgacactactgtctcctggtatcgcggtgactccggttcagatggccggaaaaaaagattacccggctctcctgtccttggacgaaaacgaactggaggagcagttcgtgaaggggcatggccctggggggcaggctaccaacaaaacaagcaactgcgtcgtactcaagcatattccatctggtatcgtagtgaagtgtcaccagacccgcagtgtggatcaaaacagaaaactggcccgaaagattttacaagaaaaagtcgacgtgttttacaacggcgaaaatagtcctgtccacaaggagaaacgcgaggctgctaaaaagaagcaagaacggaagaaacgggccaaagagaccctcgaaaaaaaaaaactcctgaaggagttgtgggagtcttcaaagaaggttcattag

SEQ ID NO: 112202 - DNA, 111 bp, Artificial Sequence
  Description of Artificial Sequence: Synthetic coding sequence
atgagcacagtgggcctcttccactttcctacccctctgacacgcatctgcccagctccttggggccttcggctgtgggagaaacttactctgctgagccccggaatctag

SEQ ID NO: 112203 - DNA, 417 bp, Artificial Sequence
  Description of Artificial Sequence: Synthetic coding sequence
atgagtactgtgggcttatttcattttcccacgccactgactagaatctgcccagccccttggggcttacggttatgggaaaagctcacccttctcagtccgggaatagctgtgacgcctgtgcagatggctggtaaaaaggactacccagccctgctgagcctagacgagaatgagctggaggagcagttcgtcaagggacacggccctggggggcaggcaactaacaagacaagcaactgcgttgtgcttaaacatatcccttcagggattgtggtgaaatgtcaccagaccagatctgtcgaccagaaccgcaaactggctcgcaaaattttgcaagagaaagtggacgtcttctacaatggggaaaactctcccgtccacaaggagaagcgggaagcagccaaaaagaagtag

SEQ ID NO: 112204 - DNA, 291 bp, Artificial Sequence
  Description of Artificial Sequence: Synthetic coding sequence
atgagcactgtcggactgtttcactttcccacacccctcacccggatttgccccgcgccatgggggttgaggctctgggagaaattgactttgttaagccctggcattgccgtgacccctgtgcaaatggccggaaagaaagattatcccgccctgttatctttggacgagaatgaactcgaggagcagtttgtcaagggccatggcccaggggggcaagccacgaacaaaacctccaactgcgttgtgctaaagcatattccttcaggaatcgtagtcaaggtagattag

SEQ ID NO: 112205 - DNA, 423 bp, Artificial Sequence
  Description of Artificial Sequence: Synthetic coding sequence
atgtcccggtttttaaacgtgctaagaagctggttagttatggtctccatcatcgccatgggcaacactctgcaatccttccgcgaccacacattcctctacgaaaagctttatacaggcaaacccaacctagttaacggcctccaggctcgtacttttggcatctggacactgttgagctctgttatccgttgcctttgcgccatcgacatccacaacaagacgctgtatcacattacattgtggactttcctcctcgctctgggacactttctttctgaactctttgtgtatggaacagccgcccctactattggtgtcctggctccactcatggtggcgagcttctctatcctgggcatgttggttggcctgaggtacctcgaggtagagcctgtgagcagacaaaagaagcggaattag

SEQ ID NO: 112206 - DNA, 1443 bp, Artificial Sequence
  Description of Artificial Sequence: Synthetic coding sequence
atgaatcggacaaagggcgacgaggaggagtattggaactcatcaaagtttaaggcgtttacatttgatgacgaagatgacgagctttcccaattgaaagaatctaagcgagccgttaactccctgcgcgattttgttgatgatgacgacgacgacgacctggagagggtctcctggagcggggagcctgttggcagcataagctggagcatacgagagacagctggaaatagcgggtccacccacgagggcagggagcagctcaagagcaggaactcgttctcctcctacgcccagctgcccaagccaacttccacttatagcctgtcttcattctttcgcgccctgtcagacacaccagctaagagttacgcacctgagctcggccgaccaaaaggagagtatcgagattactcaaatgactggtctcccagtgatactgtgagaagactgaggaaaggcaaggtatgtagcctagaacggttcaggagcctgcaagataagttgcaactcttggaggaggccgtgtcaatgcacgacggaaacgtaatcaccgcagtccttatcttcctgaagaggacactaagcaaagagatcctgtttcgagagctggaggtccgacaggtggcgctgcgtcacctgattcacttcctgaaagagattggggatcagaagctgttgttggacctgtttagatttctggaccgtacagaagaactcgcattgagccattaccgtgagcatctaaacatccaggatccagataagaggaaggaatttctgaagacatgtgtgggattgcctttttcagccgaggattccgcccatatccaggatcactatacattactagagcgccagattattatcgaggctaacgaccggcacttggagtccgctggccagactgagatcttcaggaagcacccgcgcaaagcatcaattctaaatatgccattggttacgactctgttctactcttgcttctatcattatactgaagctgaaggcaccttctccagccctgtaaatctaaaaaagacctttaaaatcccagacaagcagtatgtgctgacagcccttgccgcacgggctaagctgagagcttggaatgatgtcgatgctttgttcacgaccaagaactggctgggttacaccaagaaacgtgctccgatcgggttccatcgagtagttgagatcctgcacaagaacaacgctcccgtgcaaatcctgcaagagtatgtgaacttagttgaggatgtggatactaaattgaatctcgctaccaaattcaaatgtcatgatgtcgtcatagacacttaccgtgatttgaaggatcggcaacagctgctggcttatcgctccaaggtggataaggggagcgctgaagaggaaaaaatcgatgctctcctgtcttcttcacagatccgatggaagaattag

SEQ ID NO: 112207 - DNA, 1482 bp, Artificial Sequence
  Description of Artificial Sequence: Synthetic coding sequence
atgaatcggaccaagggggacgaggaagagtattggaattcgtctaagtttaaggcattcacatttgacgacgaggacgacgagttgagccaattaaaggagtccaagcgagcagttaactcattacgcgacttcgtcgacgacgatgacgatgacgatcttgagcgggtctcctggagcggcgaacccgtcgggtcgatatcctggtcgatccgcgaaacggccggcaatagcggatcaacacatgaggggcgcgagcagcttaaatcccgaaactccttctctagttacgcccagcttcctaagccgactagcacatattctctgtctagcttctttcggggcagaaccagacccggcagcttccagagcctgtccgatgcactgagtgatacccctgctaaatcctacgccccggaattgggacgccctaaaggcgaataccgtgattactccaacgactggtcaccctcagatacagtgcgccggctgcgcaaaggaaaggtttgctcactggaacgttttagatcactccaggacaaattgcagctgctggaggaggcagtctcaatgcatgatggaaacgtaatcactgcggtgctcatctttctgaagcggacactgagcaaagagatcctcttcagggaactcgaagtcaggcaggtagcacttaggcatttgattcactttcttaaggaaatcggcgaccagaaactcctgctggacctctttcgcttcctagaccgtacagaagagctggccctgtctcattacagagaacacctgaatattcaagaccccgacaaaagaaaggaattcctgaaaacatgtgtcggcctgccattcagcgctgaggattccgcacatatccaggatcactacacactgttggaacgccagattataattgaagccaacgaccgccacctggagtcagccggccagacagagatcttccggaagcatccacgcaaggcctccattttaaacatgccccttgtgaccacactcttctattcatgcttttatcactacacagaagctgagggaacctttagtagtcccgtgaacctgaagaaaacttttaagattcctgacaagcagtatgtgttgacagctcttgctgctcgcgctaaactgagagcctggaatgatgttgacgccctcttcaccaccaagaactggctcggttatactaagaagcgggcccctatcggattccatcgcgtggtagagatcctgcacaagaacaatgcccccgtgcaaattctccaggagtacgtgaacctcgtggaagatgtcgacaccaagctcaatcttgcaaccaaatttaaatgtcatgatgtggtgatagacacataccgagacttgaaagaccggcagcaattactagcttatagatcgaaagttgataagggtagtgccgaggaggaaaagattgatgccctgttgtcttcatctcagatacgctggaaaaactag

SEQ ID NO: 112208 - DNA, 1335 bp, Artificial Sequence
  Description of Artificial Sequence: Synthetic coding sequence
atgaaccggaccaagggagatgaagaggaatactggaactcctctaaatttaaggcctttacgtttgacgacgaggacgatgagctaagccagttaaaagagtccaaaagagcagtgaacagtcttagggacttcgtggacgacgatgacgacgatgatctcgaacgtgtgagttggagcggagagcccgtcgggtctcggactagaccaggaagctttcagtcactgagtgacgcactgagtgatacgccggcgaaaagctacgcccccgaactcggcagacccaaaggggagtatagagactattccaatgactggtctccttccgatacagtgagacggctgcggaagggtaaggtgtgtagcttggaacgcttccggtccctgcaggacaaattacagctgctggaagaggccgtcagtatgcacgacggcaacgtcataacagcagtgctgatcttcctgaagaggactctctccaaggagattctgtttcgtgagctggaagtccgtcaggtcgctctgcgtcacctcattcatttcctgaaagaaattggcgatcaaaagctcttacttgacctgttcagattcctggacaggacagaggagttggccttaagccactatcgggagcatctcaatattcaggaccccgacaaacgtaaggaatttttaaagacttgcgtgggtctgcccttctctgctgaggactccgcacatattcaagaccattacaccttactggaaagacagatcatcatcgaggccaacgacaggcacctcgaaagtgccggtcagacagagatcttcaggaaacatcctcgtaaggcctccattctcaatatgccactggtcacaaccctgttctacagctgtttttatcattatacggaggccgaggggaccttcagcagtcctgtgaatctcaaaaagaccttcaaaattccagacaagcagtacgtgcttacagccctggcagcgagagctaagctgagggcttggaatgacgtcgacgcactgtttacgaccaaaaattggcttgggtacactaagaagagggctcctatcggatttcatcgtgtcgtggagatcctgcataaaaacaatgctcctgttcagatcctacaagaatacgtcaatctcgtcgaagatgtcgacacaaaacttaatttagctacgaaattcaagtgtcacgatgtggtgattgacacctacagggacttaaaggataggcagcagctgctggcgtacaggagcaaagtggacaaagggtccgccgaggaggagaagattgacgcacttctatcgagctcccaaattagatggaaaaactag

SEQ ID NO: 112209 - DNA, 1482 bp, Artificial Sequence
  Description of Artificial Sequence: Synthetic coding sequence
atgaatcgtactaaaggggacgaggaggaatattggaattcttccaaattcaaagctttcaccttcgacgacgaggatgacgaattgtcacagcttaaggagagcaaaagggccgtcaatagtttgcgcgactttgttgatgacgacgacgacgacgatttggagcgggtaagctggtcgggagagccagtgggctcgatctcttggtccataagagagactgcgggaaacagcggttctacccatgagggccgagagcagctcaaaagccgcaattccttctcctcatacgcacagttaccaaagcctacctctacctattcactaagtagcttcttccgtggcaggacacgtcccgggtcattccagagtctcagcgacgctctctctgatacccctgccaagtcgtacgcaccggagctcgggcggcccaagggtgaataccgcgactacagcaacgattggtctcccagcgatacggtgaggaggttgcggaagggcaaggtgtgcagcctagaaaggtttcgaagcctacaggataaacttcagctgctagaagaggcagtgtcaatgcacgatggtaatgttatcactgccgtcctaatcttcctcaagagaactctctcgaaggaaattttgttcagagaactggaggtgaggcaggtcgcactgagacacttgatacattttctgaaggagattggagatcaaaaactattgctggatctgtttagattccttgatcgaactgaagagcttgcattgtcccactaccgggagcacttaaatattcaggatcccgacaagagaaaggaattcttgaagacctgtgtgggattgccctttagcgccgaggacagcgctcatatccaggaccactacactctccttgaacgccagataataatcgaggctaatgaccggcatttagagagcgcggggcagactgagatcttcagaaaacatccacgcaaagccagcattttgaatatgccactggtaacaacacttttttattcttgtttctaccactacaccgaagccgaaggcactttcagcagccctgtaaacttaaaaaagacctttaagataccagataaacagtatgtgctaaccgccctggccgcaagagccaagctgcgcgcctggaatgatgtcgacgcactttttactacgaagaactggctaggctatactaagaaacgagcgcctattggctttcacagagttgttgaaatcctgcacaagaataacgcgcctgtgcaaattctacaggagtatgtgaacctggtagaggacgtggatactaaactgaatctcgctaccaaatttaaatgtcacgacgtcgtcattgatacctatagagacctgaaagacagacagcagttgctggcgtacagaagcaaagtcgacaaaggatctgctgaagaggaaaagatagatgctctcctaagttcctcccagataagatggaagaactag

SEQ ID NO: 112210 - DNA, 1560 bp, Artificial Sequence
  Description of Artificial Sequence: Synthetic coding sequence
atgaccactggacttatcttattttttcagagcgggaggcctttgggtgccggcgttcggcttgggctggggttaagaatgaacagaacaaagggcgatgaggaagaatactggaactcctccaagtttaaggcttttacgtttgatgacgaagacgatgagttaagccaactgaaggagtccaaacgggcggtgaacagtctgagggactttgtggatgacgatgatgacgacgacctcgagcgggtcagctggagtggggaaccggttgggtctatttcttggtctatcagagaaacagccggcaatagcggctcaactcacgaaggccgggaacagctcaagtctagaaattccttttcgtcgtacgcacagctgccgaagcctactagcacctatagtctttcatccttcttcagggggcgcacacgacccggctctttccaatctctctccgatgctctctctgacacaccggccaaatcctatgcccccgaactcggcaggcctaagggcgaatatcgggattattcaaacgactggtccccttcagacacagtgaggagactgcgaaagggcaaagtttgttctcttgaacgctttcgcagccttcaagataagctgcaactcttggaggaggcagtgtccatgcacgatgggaatgttattaccgcagtgctcatctttctgaagaggactttgagcaaagagatcctgtttagagaactggaggttcgccaggttgccctgagacatctcatccacttcctgaaagagattggagatcagaagttactgctagacctcttcaggtttctggaccgaaccgaagagctggcactctcccattaccgtgagcatctaaacatccaagacccagacaagcgaaaagagttcctcaaaacatgtgtcggactgccattcagcgccgaggactctgcccacattcaggaccactacaccttacttgagcgccagattattatagaggccaatgaccggcacctggagtctgccggccagacagagatatttaggaagcacccgcgcaaggcgagtatactcaatatgccgctggtgactaccctcttctactcatgtttttaccattacacagaggctgagggcactttctcttcccctgtgaatctcaagaaaacatttaagattcccgacaaacagtacgtgttgaccgcactggcagcacgcgctaagctgcgcgcttggaatgacgtcgatgctttgttcaccacaaagaactggttgggatatacaaagaaacgggcaccaataggcttccatcgagtcgttgaaattctgcacaagaacaacgccccagtccaaattcttcaggaatacgtaaacctcgtggaggatgttgacacaaagctgaatcttgcaaccaaattcaaatgccatgacgtggtgatcgacacataccgggatcttaaagaccgccagcagcttctggcctatcgaagcaaagtggacaagggcagtgcagaagaggagaaaatagacgcactactatcaagctctcaaatccgctggaaaaactag

SEQ ID NO: 112211 - DNA, 138 bp, Artificial Sequence
  Description of Artificial Sequence: Synthetic coding sequence
atgaaccgcaccaagggggacgaagaagagtattggaactcttctaaattcaaagctttcacatttgacgacgaggacgatgaactttcgcagctgaaagagagtaagagggccgtcaactcactgcgtgatttttag

SEQ ID NO: 112212 - DNA, 1482 bp, Artificial Sequence
  Description of Artificial Sequence: Synthetic coding sequence
atgaaccgcaccaaaggtgatgaagaagagtactggaacagcagtaaatttaaggccttcacatttgatgacgaggacgacgaactctcgcaactgaaagaatctaagcgcgcagtgaacagtctcagagattttgttgacgatgatgatgacgacgatctggagcgggtttcctggtccggcgagcccgttggctcaatttcttggtccatccgcgagactgccggtaacagcggatccacgcacgaggggagggagcaacttaagagtcggaattctttttcatcatacgcccagctaccgaaacccacgagcacatattccctgagctccttcttccgcggacgcacgagaccaggatcattccaatccctctccgatgctttgagtgacaccccagcaaaaagctatgccccagaactcggcaggcccaaaggggagtaccgagattattctaacgactggagcccaagcgatactgtacgccgattgcggaaagggaaggtctgctcgcttgagagatttcgtagcctacaggataaactacaactgcttgaagaggccgtcagcatgcacgacggcaacgtcataaccgctgttcttatattcctgaagcggaccctctcgaaagagatcctgttcagggagctggaggtgaggcaggtggcactccgacatttgattcacttcttaaaggagatcggagatcaaaagttgttgctcgatttatttcggtttctggacaggacagaagagctggccctgagtcactaccgtgaacacctgaacattcaggaccccgataagagaaaggagtttctaaagacctgcgtcggactgcctttctccgccgaggattcagcccatattcaggatcattacaccctactcgagcgccagattatcattgaagcgaatgaccgtcacctggagtcagccggccagaccgagatctttaggaagcaccctcggaaagcatcaatattgaatatgccactggttaccaccctgttttacagctgtttctaccattacaccgaggctgagggcacattttcgagccccgtgaacttgaaaaagacctttaagattccagacaagcagtacgttttaaccgcccttgctgcccgggccaaactgagggcttggaacgatgttgatgcccttttcaccacgaaaaactggttaggatacactaaaaagagagccccaattggtttccaccgggtggtggaaatcctacacaaaaataacgcaccagtgcaaatacttcaggaatatgtgaatcttgtcgaggacgtcgacactaaactgaacctggccaccaaatttaagtgccatgacgtcgtaatcgacacctatcgcgacctgaaagacagacaacagcttcttgcatatagatccaaagtcgataagggatcagccgaggaggagaagatcgacgctctcctatcgagctcccaaatacgatggaaaaattag

SEQ ID NO: 112213 - DNA, 735 bp, Artificial Sequence
  Description of Artificial Sequence: Synthetic coding sequence
atgtttcgtaggaagttgactgcactggattaccataaccctgccggctttaattgcaaggacgagactgaattccgcaactttatcgtttggctggaggaccagaaaatacggcattacaagatagaagataggggaaatcttcgtaacatccactctagcgactggcccaaatttttcgaaaagtacttgcgggacgtcaactgcccctttaagatccaagaccggcaggaagctatcgactggctactggggttagctgttcggctggagtatggagacaatgccgagaagtacaaggacctagtccccgataactcaaaaactgccgacaacgccaccaagaacgctgagccactgatcaacctagatgtgaacaacccagattttaaggccggggttatggccctcgccaatcttttgcagattcaacgccacgacgactatcttgtgatgctcaaggcaataagaatattagtgcaggagaggcttactcaggatgctgtcgctaaggctaaccagaccaaggaggggctgcccgtcgcccttgataagcacattctgggttttgacacgggagacgcagtattgaatgaggccgcccagattttgcggctgctccatatcgaggaacttagagagttgcaaactaagatcaatgaggccatcgttgccgttcaggctatcatcgccgacccaaaaacagatcataggctgggcaaagtgggtaggtag

SEQ ID NO: 112214 - DNA, 177 bp, Artificial Sequence
  Description of Artificial Sequence: Synthetic coding sequence
atgctgcaatcgatcataaaaaatatctggatcccaatgaaaccctactacacaaaagtctaccaagaaatctggatcggaatggggctgatggggtttattgtgtataaaatccgagccgcagacaaacgatccaaggcacttaaggcctccgccccagcacctggtcaccactag

SEQ ID NO: 112215 - DNA, 228 bp, Artificial Sequence
  Description of Artificial Sequence: Synthetic coding sequence
atgaaactgtacggcacccggggatccgacatcagccacttccagtgtcagatgcttcaaagcatcataaagaacatttggatcccaatgaagccgtactacacaaaagtgtatcaggagatttggattggaatgggcttgatgggtttcatcgtgtataagatcagagcagccgacaagcgctccaaagcactgaaagctagtgcacctgcacctgggcatcattag

SEQ ID NO: 112216 - DNA, 177 bp, Artificial Sequence
  Description of Artificial Sequence: Synthetic coding sequence
atgctccagtcaatcattaaaaatatatggattccaatgaagccctattacaccaaagtttatcaggagatttggataggaatggggctgatgggtttcatcgtgtataagatacgggcggccgacaagagaagtaaagctctgaaagccagtgctcccgcaccgggccatcattag

SEQ ID NO: 112217 - DNA, 177 bp, Artificial Sequence
  Description of Artificial Sequence: Synthetic coding sequence
atgctccaatccatcattaagaacatctggatacctatgaaaccatactatactaaagtgtaccaagaaatttggattggcatggggctcatgggctttatagtctataagattagagctgccgacaaacggagtaaagctctgaaggctagcgcccctgcccccggccaccactag

SEQ ID NO: 112218 - DNA, 2928 bp, Artificial Sequence
  Description of Artificial Sequence: Synthetic coding sequence
atgacacagcagccccaggacgactttgacagatccgtggaggatgcacaagcctggatgaaggccgtgcaggatcagttgcaggtcaatgacaacacccaggggccccgcgcagctctagaagctcggctgtgggagaccgagaagatttgccagctcgaacctgaggggcgggtcagagtggacctagtgcttcgaatggcagaagcgcttctggcatgttgtccgggtgatcagaaacctggaattctggcaagactgaaagatataaaggcccaatgggaagagaccgtgacttacatgactcactgccacagtcgcatcgaatgggtgtggttacactggtctgagtatctgctggccagagacgagttttatcggtggtttcagaagatgatggtaacgctggaacctcacatagaactccagctgggactgaaagagaagcagtggcaactgtcccacgcccaggtgttattgcataacgtggataatcaggctgtgctgctcgaccgtctgcttgaagaggctgcttcattgttcaacagaataggggacccttctgtggacgaggatgcgcagaagcgcatgaaggctgagtatgacgctgttaaagctaaagcccagaaacgtgtcgatctgctggagcaggtcgcccgcgagcatgaagaatatcaagcaggagtggacgaattccagctctggctgaaagctgttgttgaaaaggtaaatggctgcctgggcaggaattgcaaactcccaatcactcaaaggttgtctactttgcaggatatcgctaaagactttcctaggggcgaagagtccctcgaaactttagaagagcagagcgctggggtcattcgcaatacgagtcctctcggcgctgaaaaaatcacaggagagctagaggaaatgagaaaagtgctggaaaagctcagggccctgtgggaggaggaggaagaaagacttcggggcctcctgaggagtcgtggggcctgggagcagcaaatcaagcagctggaagccgagctctcagagttccgaatggtgcttcagagactggcccaggagggtcttcaaccagccgctaaagcagggacagaggatgagcttgtggctcactggcgcagatatagtgcaacacgagccgccctcgcctctgaagagccaagggttgatagactccaggctcagttgaaagagcttatcgtattcccccacaatctgaagccattaagcgattccgtcatagcgaccatccaagagtaccagagcctgaaagtcaaatccgcacgtctgaggaatgccgccgctgtggagctttggcagcattttcagcgaccacttcaggacctccaattatggaaggctttggcccagcgcctgctggaggtaacagcctccctccccgatctgccttcactgcacacattccttccacagatcgaggccgccttgatggagtcttcccgcttgaaggaactgctaactatgctccagctcaagaaggacctgctcataggcatatttggacaggaacgcgcgacggccttgctggaacaggttgccgggagcatgcgagacagggatttgttgcacaactcattgcttcagcggaaatccaaactccaatccctgctcgcgcagcacaaagatttcggggctgcattcgaaccattgcagagaaaactgttagacctgcaagtacgcgtgcaggccgagaaagggctccaacgagacctaccaggcaagcaggcacaattaagccggcttcagggcctgcaagaggagggcctggacctaggcgcacaaatggaggccgccagacccctcgtgcaggagaatcctaaccaccaacacaagatggatcagctatcttctgactttcaggctctgcagagatcccttgaggatcttgtcgacagatgtaggcaatcagtccaggaacattgcactttttctcaccagctcctcgagttgaggcaatggattgtggtcaccacccagaaactcgaggcacaccgaggcgaggccggacctggcgatgccgaaagccaggaggcggaattcgagagactggtggcagagttcccagagaaggaggctcagctttcgcttgtggaggctcaggggtggctggtgatggagaagagctccccagagggcgctgccgtggtgcaagaggagttgcgggaactggcagagtcctggagagccctgagactcctggaagaatctctcctgtctctgataaggaattggcacctacaacgaatggaagtcgatagcggaaagaagatggtgtttactaacaatattccgaaatctggcttcttgatcaaccctatggacccaattccaaggcacagacgtcgagctaatctgctccaggaggaggaaggaagccacgaagattttagtcagttgctcaggaatttcgggcagtggttacaggtggagaacagtaagttggttagaattatcgctatgagaaccagcacagcagaggacctgcggacccgtaagtcaaaactccaggaactggaggcaagagtaccggaagggcagcaccttttcgaaaatctgcttcgcctgggcccagctagggggacctccgatgagctcgaggacctgagataccaatggatgctgtataagagcaaacttaaggacagcgggcacctgctcacgcagtccagtccgggtgagccaaccggcttccagaagacaaggcgctggagagggctgggctccctgttccggagggcatgctgtgtcgcattgcccctgcagttactcctgttgcttttcttactcctcctctttctgcttcccattcgggaagaagataggtcctgcactctggcgaataatttcgcgcgcagctttaccctgatgctgcgttacaatgggccaccccccacctag

SEQ ID NO: 112219 - DNA, 1791 bp, Artificial Sequence
  Description of Artificial Sequence: Synthetic coding sequence
atgactcaacagcctcaagatgatttcgaccggtctgtggaagacgcacaggcctggatgaaggctgtgcaggaccagctgcaggtgaatgataacacacagggaccccgcgccgccctggaggcccggctgtgggaaacagagaagatctgccagctggagccagaggggagagttcgggtagacctggtattgcggatggcagaagccctcctggcatgttgcccaggagaccagaagccagggatccttgcgcgtctaaaagacatcaaggcacagtgggaggaaactgtgacctatatgacacattgtcactcacgaattgagtgggtatggctgcactggtccgagtacttactcgcgagagatgaattctatcggtggtttcagaaaatgatggtaacactcgaacctcatattgagctgcaactgggccttaaggaaaaacaatggcaactgtcccacgcccaggtgctactgcacaatgtggacaaccaagcggtactactggaccgcctgctcgaagaggccgcctcactgtttaataggattggcgacccgagcgtggacgaggacgctcagaagaggatgaaggcagaatatgatgcagttaaggctaaggctcagaaaagggtggacctacttgagcaagtggcaagggagcatgaggagtatcaagccggagtggatgaatttcagctctggctgaaggccgtcgtagagaaagtcaatggctgcctcgggagaaactgtaagctcccaattacccagaggctgtctacactccaggatattgcaaaggatttccctcgcggggaagagagcctagaaaccctggaggagcagtccgcaggtgtcatacgtaatacaagtccattgggtgcagagaaaatcactggcgagcttgaggaaatgaggaaggttctggagaagctcagggccttgtgggaggaggaagaagaaaggctgcggggtttgctccggtcacgcggcgcttgggagcagcagattaagcagctcgaggccgagctgtccgaatttagaatggttttgcagcgactggcccaggagggcttgcagcctgcggccaaggccggaactgaagacgaactggtggcgcattggagacgatatagtgcaactcgggcggcgttggctagcgaggagccgagggtggacagactacaggcacagctgaaagagctgattgtgttcccgcataacctcaaaccactttccgattcggtaatagctaccattcaggagtaccaaagcctgaaggttaaaagcgcccgcttacggaacgctgcagccgtggagctctggcagcactttcagagaccactgcaggacctccagctctggaaggcgctggcacaacgcttactcgaggtgaccgctagtctgcctgacctcccgtctctgcatacctttctgccccagatcgaggccgctctgatggaatcttcacgcttaaaagaattactcacaatgttacagttgaagaaggatcttttgattggaatcttcgggcaggagagagctactgccctcttggaacaggtggcaggctcaatgagggatagagatctgctgcacaattctcttcttcagagaaagagcaaacttcaatctctcctggctcagcataaagactttggtgcggccttcgagcccctgcagagaaaactgttagacctgcaagtacgcgtgcaagccgagaagggacttcagagggatctgccaggtaaacaggcccagctgtctcgcctgcaggtgagaggcctctag

SEQ ID NO: 112220 - DNA, 2913 bp, Artificial Sequence
  Description of Artificial Sequence: Synthetic coding sequence
atgactcagcaacctcaggatgatttcgatcgctcagtggaagatgctcaggcgtggatgaaagcggttcaagatcaactgcaggtgaatgataacacacaaggaccgcgcgcagcactcgaggctcggctgtgggaaactgagaagatctgtcagctcgagcccgagggtagagtgagagtggacctggtgctgaggatggctgaggcactgctggcgtgttgccccggtgatcagaaaccaggtatcttggcaaggctgaaagatataaaagcccagtgggaggagactgtgacttatatgacacactgtcactctcggatcgagtgggtttggctgcactggtcagagtacttgttggcgcgcgatgagttctatcgatggtttcaaaaaatgatggtgactctcgagcctcatatagagcttcagcttggactgaaagagaaacagtggcagctatcccacgcacaggtgctgctccataacgtggataatcaggccgtactgttagacagacttctcgaagaggctgcatccctcttcaacaggattggcgatccatcggttgacgaggatgcccagaaaagaatgaaagcagaatatgacgccgttaaggctaaggcgcagaaaagagtggacttgctagaacaggtagctagggaacatgaggaataccaagctggggttgacgaattccagctatggttgaaagctgttgtggagaaagttaatggatgtctcgggaggaattgcaaattgcccatcacacagcgattaagtacactgcaggatatcgccaaggactttccccgcggcgaagagtctctcgagacgctggaagagcaatctgctggagtcatccgtaacaccagtcccttaggcgcggagaagattactggggaactcgaagaaatgaggaaggttctagagaagctgcgcgccttgtgggaggaggaggaggagagactaaggggactgttgcggagcagaggagcctgggaacaacaaataaagcagcttgaggccgagttgagcgagttcaggatggttctacagaggctggcccaggagggtctgcagcccgccgccaaggccggaacggaggatgagctggtcgcccactggcggcggtacagtgccaccagagccgctctagcatctgaagaacctagggtggatcggctacaggctcagttgaaggagctgatcgtattcccccataatctgaagcctctatccgattctgtgattgccacaatccaggagtaccagtccttgaaagtcaagagcgccagactgcggaacgctgccgcagtcgagctgtggcagcacttccagagacctctgcaggatctgcagttgtggaaggcactagcacagcgtttactcgaagttaccgccagcctgcccgatcttccttccttacacacattcctgcctcagatagaggcggccttgatggaaagctctagattaaaagaactgcttacaatgctacagttgaagaaggatctactgattgggatcttcggtcaggagcgggcaactgcccttctcgagcaggtggccgggagtatgcgcgatagggacctgctacataacagcctactgcagcgcaagtctaagttacagagtctgctggctcaacacaaggatttcggagcggcatttgagccccttcagcgcaagctgctggatctccaagtacgggtacaggccgagaagggtctgcagcgcgatctccctggcaagcaggcacaattgtcaagactccaagggcttcaggaagaagggctggacctcggagcacagatggaagccgctcgcccactagtgcaagagaacccgaatcatcaacataaaatggatcagctaagttcggacttccaggcactgcagaggtcactggaggaccttgtagataggtgcaggcagtccgtccaggagcattgcacttttagccaccagcttttggaattaaggcagtggattgtcgttaccactcaaaagttggaggctcaccggggcgaggctggacctggggacgctgagagccaggaagctgagtttgagcgattagtcgccgagtttcccgagaaggaggcccagctaagcttagtggaggcacaggggtggctggttatggagaagtcaagtcctgaaggagccgccgttgttcaggaagaactacgggagctagcagaaagttggcgagcacttaggctgctagaagagtccttactttccttgatccgcaattggcatctccaacgcatggaggtcgacagcggcaagaagatggtattcacaaataacatccctaagagcgggttcctgatcaatccaatggatccaataccgaggcatcgacgccgcgaggaggagggttctcatgaggactttagtcagctgttgcgcaactttggtcagtggctgcaagttgaaaactccaagctggtgaggattatcgcaatgcgcacaagtacagcagaagatttgcggacaagaaagagcaagctgcaggagctggaagcgcgggtgccagagggccagcacttgtttgaaaatttgctgagactgggcccggctcgcggcacgtcagatgagctggaagaccttcgatatcaatggatgttatacaaatctaagttgaaagattcagggcatttactgacccaatctagtcctggcgagccaaccggtttccagaagactcgacgctggcgggggttaggttccttgttccggcgcgcctgctgcgtggcactgccactgcaacttcttttgctgttgttcctgctgctcctattcctgcttcccatcagggaggaagaccgttcctgtactctggcaaataattttgcccgaagctttaccctcatgctgcgttataatggcccaccgcccacctag

SEQ ID NO: 112221 - DNA, 3471 bp, Artificial Sequence
  Description of Artificial Sequence: Synthetic coding sequence
atgggtaatcttcttagcaaatttagacctggctgtcggagaaggccgctgcctggccccggacgcggagcacccgcgcccttaagcagagatgctagtcctccgggaagggcacactccgttccaacccccaggccttttcgaggactattcaggaggaatgctcgccgcagaccatctgcggcgtccatttttgtcgcacctaaacggccttgccccctccctagagcagccgctgcaccactcggtgtcctgcccgccgtaggttgggggctggctattagaaagacccctatgctgccagctcgcaacccaccccgcttcggtcacccatcaagtgtccgcattcctcccccttccaggatgttcacgttactgctgccatccccaagagagcccgccgtgaaggcccggaagccaatacccgccaccctgctggaggaaactgaggtctgggcccaggagggtccccgaagagtgaagaaagacgaggaccccgtgcagattgaaggcgaagatgatgaaaagcggacaccactctcgtccggcgaagcctcaagcacgagtcggtctcagggcactcagggggacgtggcaagtttcaggtgctctccaggcccacttgagggaaacgtctatcacaaattctcggagaattctatgtccgagaaagcccaagccagcccggcctcctcgtgcctggaaggtccggcgatgccatcaactcactcccaggctgggtgtgctcgccacctgggaaaacccgatcccgacgctaccgcccctcctgagccggcggtgggctgctccctgctgcaacaaaagctggcggccgaagtcctgaatgaggagcctcccccctcctccctggggctccccataccactcatgtctggcaaacgcatgccagatgaaaaacctttctgtatcccaccccggtccgcagcaccacccagggctgctagaaaccgaccttgcaaaaggaagatgagtatcccgctgctgcttcccctacccccctctcttcctctgctgtgggaccggggcgagcttcctcctcctgcaaaactcccatgtctatccgtagagggagacctgcatacccttgagaagagtcccgagtataagcggaatagcaggattctagaggacaagacggagactatgaccaactcgagcattacccagcccgccccctcattctctcagcctgtacagaccaccgactctctccccctgactacctacacaagccaggtaagcgcaccgctcccgatccccgacctggcggacctcgccaccgggccgctgatcctgcctatcccccctctgtctaccactccgaagatggacgaaaagatcgccttcacaattcccaatagtcctctcgccctgccagctgatctcgtacctattcttggagatcaaagcaatgagaagggcggatcatacaacagcgtggtgggcgccgcaccgctgaccagtgatcccccgacccccccttcctctactccctcgttcaaacctccagtgacccgcgagtcccctatttctatgtgtgtggactccccgccgcccttgagctttttgacactcctccccgtaccaagtactggtacttcagtgatcacatcaaaacccatgaactctactagcgtcatttcgactgtcaccacaaatgcttcagcccatctgacgtcccagaccgccgttgatcccgaggtagtgaatatggatactacggctccgagccaggttgttatcttcacatccagcctctcatcccgcgtgtcttccctacctaactcccagatccactgttcagctgagcagcggcaccccgggaagactagcgtctatacttcccctcttccctttatttttcacaacaccactccttctttcaatcagttatttggcaaagaagccacgccccaaccaaagttcgaagctcctgatggacagccccagaaggcctccctgcccagcgcgtgcgtgtttctgtcactgcctattatcccgccaccagacacttccactctcgttaactccgcaagcaccgcatcctcttcaaagccaccgatcgagaccaacgccatgcatacaactcctcctagtaaggctgtgatattacagagtgctagcgtctctaagaaatatttgccattttatctggggctaccaggatcaggcaacactcagcccagcggaaatacagcctccgtgcaggggtcaacatcacttcccgcccagtccgtgcgcgcccccgccaccgccagtaaccacccccttaaccctggcgccactccacagcctaaattcggcgcgcctgacggcccccaacaaaagaccagcctacctagcgcgcacgattttttgtctctgcccataatggtccctccagatacatcaacgctggtatcttcagcctcggccgcatcactcagtaagccagcaatcgacacctcagacatgaacacaactcccccatctaaaacagttatactgcagtcaaccttcgtgtcccggaaggaggagtacattaggttctatatgggcttgccagggagcggcaacacactgcacagcgacagcattgcgtctgcacaggttagcaccagctttccagctcaggccgaccggaggcctacaaccactagctctcatcccctaaatacaggctcaatatcccatagcaccttaggcgctaccgacggacaacagaagtccgattcttctttcattctgggtaatcctgctacccctgccccagtgatcggactgacgagcccctcggttcagccactgtctggctctatcattccccctggcttcgcagagttgactagcccttacaccgctctggggacccccgtcaatgcagagcctgttgaaggtcataatgcatctgcttttcctaacggtactgccaagactagcgggtttcggattgctacaggaatgcccgggacgggcgattcaacgctgttagttgggaatactattcctgggccacaggtcatcatgggacctggcacccctatggatggaggcagtatcgggtttagcatgtctgcaccgggcccttcgtccaccagcggtgaactgaacatcggacaggggcagtccggaacaccaagtacgacttccgtatttccatttgggcaggcagcctgggaccctactgggcactcaatggcggccgcgccccagggcgccagcaacatccctgtttttggatacacctctgccgcggcctacataccaggcctggatccgcctactcagaatagctgctccggaatgggaggagacgggacccgctcaattgttgggggcccttgtgtgcccgcatttcaacagtgtatattacagcacacctggacggagagaaaattctacacatcctccacccattactacggtcaagaaacttatgtccggcgtcacgtatgttttcagctgccctag

SEQ ID NO: 112222 - DNA, 5733 bp, Artificial Sequence
  Description of Artificial Sequence: Synthetic coding sequence
atggcatgttgccataaagtcatgctactgttggatacagctgggggggcagccaggcattcccgggtccgtagagcagccctgaggctgctaacatatctgtcctgtaggtttggcctggccagagtccactgggcctttaaatttttcgactcacagggcgctcgttcccggcctagcagagtcagcgatttcagagaactgggaagcaggagttgggaggactttgaagaagagctggaggcccgcctcgaagatcgcgcccatctgcccggtccagcaccacgagccactcatacacatggggcgcttatggaaactttactggactatcagtgggacagaccagagattacctctcccactaaaccgattctgcggtccagtggacggcgcttacttgatgtggaaagcgaagcaaaggaagcggaggctgcactcggcggactcgttaacgctgtgttcctactcgctccatgtccacattcacagagagaactgctgcagtttgtttcaggctgcgaggcgcaggcgcagaggcttccacctacaccaaagcaggttatggagaagttactgcctaagcgcgtccgcgaggtcatggtcgcacggaagataaccttctactgggtggacaccacagagtggagcaaactctgggaaagcccagaccatctcggatactggactgtgtgtgaactactacatcacggggggggcacagttttgccttctgaatcttttagctgggattttgcccaggcaggtgaaatgctgcttaggtctggcatcaagctctctagtgaacctcacttaagcccatggattagtatgttacccactgatgctactctcaatcgactgctctataattcacctgagtacgaggcctcctttccacgcatggaggggatgttgtttctgccagtggaagctggaaaggaaattcaggaaacgtggacggtaaccctggagcccctggcaatgcaccagaggcattttcagaagccggtgagaatctttcttaagggaagtgtggcacagtggtccctccctacctcttctaccctgggaaccgacagctggatgctggggtctccagaggagagcaccgccactcagcggctcctctttcagcagctcgtcagcaggctgacagccgaagagctccatctcgtggccgacgtggatcccggcgagggccggccaccaatcaccggagttatctcacccctgagcgcatcagcgatgattctcactgtgtgtaggacaaaagaagcagaattccaacgccatgttctgcagacagcggtggctgatagcccccgcgatacggcatcattgttctcagatgtggtggacagcattctgaatcaaacccacgactccctggcggataccgcatcagcagcaagccccgtccctgagtgggcccaacaagaacttggccatactaccccatggagtccagccgtggtcgaaaagtggtttccattttgcaatatatccggggcaagctcagacctcatggagtccttcggcctgctgcaggcagcaagcgccaacaaggaagagagcagcaagaccgaaggcgaattaattcactgtttggccgaactctatcagcggaaatccagagaggaatccacaattgcccatcaagaggattctaagaagaaaaggggtgtccccaggacgccggtgaggcagaagatgaacactatgtgtcgaagcctcaaaatgctaaatgtagccaggctgaatgtcaaggcacaaaagctgcatcctgacggttcacccgatgtcgcaggcgagaagggtatccagaagataccttcgggccggactgttgacaaactggaggatcgcggccgaaccctgaggagctctaagccgaaggactttaaaacagaggaggaactgctttcttacatcagagaaaactatcagaagacagtggctaccggagagatcatgctctatgcgtgcgcacgcaatatgatatcgactgtcaaaatgtttctcaaaagtaaaggtactaaagagttagaagttaattgtctcaatcaggtgaagagctcactcctcaagacatccaagtccttgcgccagaacctagggaaaaagttagacaaggaggacaaggtacgagaatgccagctgcaggtgtttctcaggctagagatgtgtttacagtgtccctctatcaacgagtccacggacgatatggagcaggtggtggaagaggtgaccgacctcctgcggatggtgtgtctcactgaagactcagcctacctcgccgaattcttggaggagatccttcgcctttacatcgatagtattcccaagaccctgggaaatttgtacaacagcttggggtttgtgattcctcagaaactggcaggagtactacctaccgattttttttcagacgattccatgactcaggagaacaaatctccactcctctccgtgccctttctgtcatctgcacgccggtctgtctctggatcgcctgaatctgacgagctgcaagaactgaggactagatctgctaagaaacggcggaaaaacgccctgatccgccacaaaagtatagctgaagtgtcccagaatctccgccagatagagatcccgaaggtatcaaaacgggctaccaaaaaggagaacagccaccccgctccgcagcagccaagccaaccggtcaaagacacagttcaggaggtcaccaaggttcgccggaacctgtttaaccaggagctgctcagtcccagcaagagatcactgaaacgtggtctgccccgctctcactctgtgtctgctgtggacggattagaggacaagctagacaattttaagaagaataaaggatatcataaactgctaaccaagagcgtggcagagacccccgtgcataagcaaatctccaagcgcctcttacaccggcaaatcaagggaagaagcagcgaccctggccccgatataggagttgtagaagaaagcccagaaaagggggatgaaatttcactgaggaggtccccacggattaaacagttatccttttctcggactcacagtgcctctttctatagcgtctctcagcccaaaagcagaagcgttcagagagttcactcttttcagcaggataagtcagaccagcgcgagaatagtcccgtgcagtctattaggtccccaaaatccctgctcttcggcgcgatgtccgagatgatctcgccctccgaaaaggggagtgcacggatgaagaagcgtagccgaaacactctcgatagtgaggttccggccgcctatcagaccccaaagaagtcccaccagaagagcctaagcttcagcaaaaccacgcctcggcgcatttcgcatactcctcaaactcccctctatactcccgagaggctgcagaagtccccggccaaaatgacgcctaccaaacaggctgccttcaaggagtcactgaaagatagctcttcccccggccacgatagtcccctggactccaagataaccccgcaaaagaggcacactcaggctggggagggcacctctctcgaaacaaaaactcctaggacccccaaaagacagggaacccagccccctggattcttgcccaactgcacttggccacacagtgtgaactcgagtcccgaatctccatcgtgtcccgcaccccccacatcttccacagcccaacccagacgagagtgcctgacaccaatcagggaccccctgagaacacccccgcgcgccgcggcgttcatgggtaccccgcagaaccaaacccatcagcagccccacgtactgcgggctgctcgcgcagaagagcccgcgcagaaactgaaagacaaggccattaaaacccccaaacgccctggcaattctacggtgacgtcgtcccctccagtcactcccaaaaagctgttcacaagtccactgtgcgatgtgtctaaaaagtccccattcagaaaaagtaagatcgagtgcccaagtcctggggagctggaccagaaagagcctcagatgtcgccatccgtcgcagctagcttatcctgtcctgtcccctccaccccccccgagctctcccagcgcgctacccttgacactgttccacccccgcctccttccaaggtagggaagcggtgcagaaagacatctgaccccagacggtccattgtcgagtgtcagcccgacgcatccgccactcccggcgttggaacagcagattcccccgctgcccccacagacagcagagacgaccagaaaggactgagcctgtctcctcaatccccaccagagaggcggggctaccctggacctggtcttcgctctgattggcacgccagcagcccactgctaataactagtgataccgagcacgtaactctgctgtctgaagctgaacatcacggaattggtgatctgaagagcaacgtgctgtcggtggaggaaggggaaggcctgagaacagccgacgctgaaaaatcaagcctgtcacaccctggcatccccccctcaccaccctcctgcggccccggatccccactgatgcccagcagggatgtccactgcacaacagacggtcgtcaatgccaggcgtctgcacagcttgataacctgccggcttccgcctggcactctactgactctgcttcacctcagacttatgaggttgaactggagatgcaggccagcggcctgcctaaactgcggattaagaagattgacccttcctccagcctagaagctgagcccttgtccaaagaggaatcctccctgggggaggagtcttttctgcccgcactttccatgccacgggcctcaagatccctgagcaagcccgaacccacctacgttagtccaccatgtccccgacttagccactctacaccaggcaagtcccggggccagacctatatctgtcaggcctgcaccccgactcacggcccttcttccacgcccagtccgttccaaaccgatggggtcccttggaccccttctcctaagcattctggcaagaccactcccgatatcatcaaggattggccaagaaggaagcgggcggtgggatgcggcgcaggttcctcctccgggcggggcgaagtgggcgcggaccttccaggctctctgtccctgctcgagtccgaaggcaaagaccacgggctagagttatcgattcatagaacacccatcttggaagattttgaactagagggggtttgccagctccccgatcagagtcctccccgcaattctatgcctaaggctgaggaagcgtctagttggggccagttcggcctgagctctagaaagagggtgctgctggcaaaagaagaagctgatcgtggagctaaaagaatttgcgacctgagggaggacagcgaagtttccaaatcaaaagagggctctccctcttggtccgcatggcagctgccctctacaggcgacgaagaggttttcgtgagtgggtccacccccccaccatcttgtgctgtcaggagttgcctgtccgcatctgccctgcaggctctcacccagagtcctctactttttcaaggtaagacgcccagcagtcagtccaaagacccaagggatgaggacgtggacgtgctgccctctaccgtggaagacagtcccttcagccgagcattctctcggcggcggccaattagccgcacctatactcgtaagaagcttatgggcacatggttagaggatctgtag

SEQ ID NO: 112223 - DNA, 354 bp, Artificial Sequence
  Description of Artificial Sequence: Synthetic coding sequence
atgaagttgtcctccgctgcagggcaggaaagtcctggccacccccatccaagtccacccgcatggactctgaagaaaccgagcgagtctgttgcacaacgggccatgtgctcggcaagggcatgcccagtggcctgccccgtggggtgtcctattgcatgtccagtctcatgcccagtggcctgccccgtgggctgccctgtcggtagcatggccacagccccccagggcctctcccctcaagagtgggaagccgatcgcgagaccgggtcctcgtctcacgctggtaccacccagtgttcaattcatagtcctagcagttcttcgcgtcacctcagtcgtacacaaacctag

SEQ ID NO: 112224 - DNA, 627 bp, Artificial Sequence
  Description of Artificial Sequence: Synthetic coding sequence
atgagctctgaaccacctcctccataccccgggggccctactgcccctctgctggaagagaagagtggcgcccctcccacacctggccgctctagccccgccgtaatgcagccccccccagggatgcctttgccacctgcggatattgggccccctccttacgagcctccgggacaccctatgccgcagccaggcttcatccccccacacatgtccgccgacggtacctacatgcctccagggttttatcctccaccgggacctcacccacctatgggctactatccacccgggccatatactcccggcccctaccccggccccggtggccatacagcgactgtgttagttccttctggagctgccactacggttactgtgctgcaaggcgagattttcgagggggctcccgtgcaaactgtatgcccgcactgccaacaagccatcactacaaaaatctcgtacgagatcggactgatgaatttcgtccttggcttcttttgctgctttatgggatgtgacctgggctgctgcctcattccctgtctaattaacgattttaaggatgtgacgcatacatgccccagctgtaaagcttacatttacacttataagcggttatgttag

SEQ ID NO: 112225 - DNA, 765 bp, Artificial Sequence
  Description of Artificial Sequence: Synthetic coding sequence
atgtcgctggcaagaggtcatggcgatactgctgcctctaccgcagctcctctgagcgaagagggtgaagtgacaagtgggctgcaggccctagccgtggaggatacaggaggcccctcagccagcgccggcaaagcagaagatgaaggggagggtggacgggaagaaacagaacgcgaggggtctggtggagaggaagctcagggagaggtgccaagcgctggaggcgaagaaccagcagaggaagattcggaggattggtgcgtgccttgttcggatgaggaggtcgaactaccagcagacggccagccttggatgccccccccttctgaaatccagcgactctacgagctcctggctgctcacggtactttggagctgcaggccgagatcctgccacgaagaccgccaacccctgaagcgcaatccgaggaggagcggtcagatgaagagcccgaggcaaaagaggaggaggaggaaaaacctcacatgccaaccgagttcgacttcgatgatgagcccgtaacccctaaagattcgctcattgaccgcagacggaccccaggttcatcggccaggagtcagaagcgcgaggcaagattggacaaagttctgtctgacatgaaacggcataagaaattggaggaacagattcttcggaccggtcgcgacctgttttctttagactctgaagacccatctcctgcctccccccctttgagatcgagcggctcctcactatttccccgccagaggaaatattag

SEQ ID NO: 112226 - DNA, 2010 bp, Artificial Sequence
  Description of Artificial Sequence: Synthetic coding sequence
atgggaagcgaccctagcgctcctggacgcccagggtggacaggaagcctgcttggagaccgcgaggaggccgccagaccgcgccttttgcctctcttgcttgtgttgcttggctgcctcgggctgggcgtcgctgctgaggacgctgaagtgcatgccgagaattggctgcggttgtatgggtatcttccccagcccagccgccatatgtcaaccatgcgctccgctcagatcttggcttctgccctggccgaaatgcagcgattttatgggattcccgtgaccggcgtgcttgatgaggagaccaaggagtggatgaagagacccaggtgcggcgtgcccgatcaatttggtgtgcgagtgaaggctaacctgcggcggcggcgcaagaggtacgcactcaccggccgaaaatggaacaaccaccatctaacctttagcattcagaactatactgaaaagcttggctggtatcattctatggaggccgtgcgcagagcattcagagtctgggagcaagccactccactggtgttccaggaagtgccttacgaagatatccggttgagacgacaaaaggaggcggacataatggtgctatttgcctctggctttcacggggatagttctccctttgacggaaccggcggtttcttagcccacgcttacttccctggcccgggcctaggaggggatacacacttcgatgccgatgagccctggactttctcgtccaccgacctgcatggcaataatctgttcctggtggcagtacacgaactgggtcatgctcttggtctggagcacagcagcaacccaaacgccatcatggctcccttttaccagtggaaagacgttgataactttaaattgcccgaagacgacctgcggggcatacagcagctctacggcaccccggacggacagccccaacctactcaaccacttccgactgttaccccacgacgcccaggtcgacccgaccacagacctccccgccctcctcagccaccccctcccggtgggaaacctgagcgcccaccgaagcctggacccccggtgcagcctagggcaacagagagacccgatcagtacggaccaaatatctgtgacggtgatttcgacaccgtggctatgctgcgcggcgagatgttcgttttcaaaggccggtggttttggagggttaggcataacagggtgctagataactaccccatgcctatcggacatttctggcgggggctgcccggggacatcagtgcagcctacgaaaggcaggacgggcgtttcgtatttttcaaaggagatcgttactggctctttcgcgaggccaatcttgagcctgggtatccccagcctctgacatcctacggcctgggcattccatacgaccggatcgatacagcgatctggtgggagccgaccggccacacctttttttttcaggaggatagatattggcggttcaacgaggagacccagcgcggcgatcccggctacccgaaacccatcagcgtctggcagggcatcccagcgtctcctaagggcgcatttttgtcgaatgatgctgcgtatacctatttctacaaaggtacgaaatattggaaatttgacaacgagagactgaggatggaacccggatatccaaaatctatcctcagagacttcatgggatgccaggaacacgtggagcccgggcctaggtggcctgacgtcgcccggccaccgttcaatcctcatggcggagcagagcctggtgctgacagcgccgagggagatgtcggcgatggcgacggcgacttcggggccggcgtgaataaggatggaggttctagggtcgtcgtgcagatggaagaggtggccagaactgttaatgttgtgatggttctggtgcccctcctcctgctcctgtgtgtgctcgggttgacctacgcactggtgcagatgcagcgaaagggggctccccgcgtattactgtactgcaaacgcagcctccaagagtgggtctag

SEQ ID NO: 112227 - DNA, 561 bp, Artificial Sequence
  Description of Artificial Sequence: Synthetic coding sequence
atgtctgcagctcctttagttgggtactcaagtagcggaagtgaggacgaaagcgaagatgggatgcgcacgagacctggcgatggctctcaccggaggggccaaagccctcttcccaggcagagattcccggtaccggatagtgtactgaatatgttccctgggacggaggaagggcctgaggatgatagcacaaagcacggagggcgtgttcggaccttcccccacgagaggggcaattgggctacccatgtgtacgtcccttatgaggccaaagaagagtttttggacctgttggacgtgctcctcccgcacgcccagacgtatgtgcccagactggtccggatgaaggtctttcatctgtctttaagccagtcagtggtcctgagacatcactggatcttgcctttcgttcaggcactcaaggcgcggatgacaagtttccactcaccccaccctgggcctcactgtctgatcgggacaaaggacgcacctgttacccaagagatcccaaaggatctgggtgccctccggcaggaacctggctcccagaccaggtag

SEQ ID NO: 112228 - DNA, 744 bp, Artificial Sequence
  Description of Artificial Sequence: Synthetic coding sequence
atgtccgctgctccactcgtgggctactcatcgagcggcagcgaagacgagagcgaggacggcatgagaacaaggcctggggacggttcccaccgtagaggccagtctcctttacctagacagcgatttcctgtgcctgactccgtgctgaacatgttccccggaacggaggagggaccagaggacgacagtaccaagcatggcggaagggtgcgtaccttcccacacgaaagagggaactgggccactcacgtatatgttccttatgaggcaaaggaggaatttctggacctcctcgacgtgctgctgcctcacgcacagacgtacgtgccacgactggtgcggatgaaggtatttcacctgagtctctcacagagcgtggtgctccggcaccactggatactgccattcgtccaggctctcaaggctagaatgactagtttccaccggacatttatcggactcgaggtaacatcgggacacgcccagtttctggacctcgtttctgaggtggaccgggtgatggaggaatttaatttgactactttctatcaggaccctagcttccacctctctctcgcctggtgcgtaggtgacgccaggctccaacttgaaggccagtgtctgcaggaattgcaggcaattgttgacggatttgaagacgccgaggtgctgctgagggtccataccgaacaggtcagatgcaaaagtggtaacaagttctttagtatgcccttgaagtag

SEQ ID NO: 112229 - DNA, 642 bp, Artificial Sequence
  Description of Artificial Sequence: Synthetic coding sequence
atgagccctctgccccgacagcgttttccggtgccagatagtgttctgaacatgtttccggggacggaggagggccccgaggatgattctaccaagcatggaggccgtgtgagaacatttcctcacgagaggggtaactgggccacccacgtgtacgtgccgtatgaggctaaggaggagttcctcgacttactggacgtgctccttccccacgcacagagtgtggtcctgcgccaccattggattcttccattcgtgcaggctttaaaagcacgtatgacttccttccacagattcttctttaccgcgaaccaggttaaaatctataccaaccaggaaaagacacggacttttattggactagaggtgacctctggacacgcgcagtttctggaccttgttagcgaggtagaccgcgtcatggaggaattcaacctcacaaccttttatcaggacccctccttccacttgagtcttgcatggtgtgtcggcgatgccagactccagctggagggccagtgcctgcaggagttacaggcgatagtggacggcttcgaggatgctgaagtgctgctgcgtgtccatacagagcaggtgcgctgcaagagtggtaacaagtttttctccatgcccctgaaatag

SEQ ID NO: 112230 - DNA, 1683 bp, Artificial Sequence
  Description of Artificial Sequence: Synthetic coding sequence
atgggctctaccgactcaaaactaaactttagaaaggcagtgatccagctgacaactaaaacccaaccagtggaagctaccgacgacgcctacgacccagtggggtacggcattccctataatcacctgttgttcagcgattatcgggagccactggttgaggaggctgcacaagttctcatcgtgaccctggatcacgattcagcctcatccgcatcccctacagttgatggcacgactactggaacagccatggatgacgctgacccaccaggcccagagaacctcttcgtgaattacctgagcagaatccatcgcgaagaggactttcaatttatactgaagggaatagcacgtctccttagcaacccactcctacagacctatctgcccaacagtacaaaaaaaatccaattccaccaggagctcctggtcctgttttggaaactatgcgacttcaacaaaaaattcttattttttgtcctaaagagcagcgacgtactcgatatcctggtgcctattttgttctttctgaacgacgccagggcagaccagtctagagtggggttaatgcacatcggcgtgttcatccttctgctgctcagcggcgaaaggaactttggggtccggttgaataaaccctacagcattagggtgcccatggatatcccagtgttcactggtacccatgctgacctgctcatagtcgtctttcataagatcatcactagcggccatcagcggcttcaaccattattcgattgcttactgacgatcgtggtaaatgttagcccttacctgaagagcctcagtatggtgacagcaaacaaactgctacatctgctagaagccttcagcactacttggttcctgttctcggccgcccaaaaccaccatctcgtgttcttccttctggaggtatttaacaatatcatacagtatcagttcgacgggaattccaacctggtgtatgccatcatccgtaagagatcaatcttccaccagcttgccaacttgccgacggatccgccgacaattcataaagcactgcagaggagacggcgaacacccgaaccgctgtccaggacaggatcccaggaaggaacaagcatggagggcagtcgtccagccgcacctgccgaaccaggaacactcaaaacatcgctcgtcgcaactcctggcatcgataagctgacggaaaagagtcaggtgagcgaagacggcacattacggagtctggaacccgaaccacaacagtcccttgaggacggttcccccgcaaaaggcgagccatcccaagcgtggcgtgagcagaggagaccttcaacctccagcgcgagcggccagtggtctcctacgcccgaatgggtcttaagctggaaaagcaagttacccctccaaacaattatgaggctgctccaggttctggtgccccaagtagagaagatctgtattgacaagggcttaaccgacgagtcagaaatcttgaggttcctgcagcatggaaccctggtgggactgctgcctgtgccacaccctatccttatcaggaaatatcaggctaactccggcaccgcgatgtggttccgtacctacatgtggggggtgatctatttgaggaacgtggacccgcctgtgtggtacgacacagacgtaaagctctttgaaatccaacgcgtctag

SEQ ID NO: 112231 - DNA, 2367 bp, Artificial Sequence
  Description of Artificial Sequence: Synthetic coding sequence
atgggatctacagactctaagctcaactttagaaaagctgttatccaacttacaaccaagacccagccggttgaggccaccgacgatgctttctgggatcaattttgggctgacacggccaccagcgtgcaggatgtcttcgccctggtgccagcggccgagatcagggctgtgagggaagagtctccttccaacctagcgaccctgtgctacaaggcagtcgagaaacttgtgcagggagctgagagcggatgccattccgagaaggagaaacagattgtgctgaactgttctcggctgctgaccagagtactcccgtacatttttgaggaccccgactggcgtggttttttttggagcaccgttcctggagctgggagaggaggacagggtgaggaggatgatgaacatgcacggcccctcgccgagagcctgcttctggctatagctgacttactcttctgtccagattttactgttcagagtcaccgtaggtctacggtggacagcgcagaagacgtgcactctcttgattcctgcgaatacatctgggaagccggcgtgggttttgcccattccccacagccaaattacattcatgacatgaatcgaatggagctgctgaagctcctgctgacatgtttctccgaagccatgtatctgcctcccgcgccagagagcggctcgacgaacccctgggttcagttcttctgcagcaccgagaatcgccacgccctgccactgttcacatctctactcaatactgtgtgtgcctatgatcctgtcgggtatggtattccctacaaccacctgcttttcagcgactacagagaaccactggtcgaggaggccgctcaagttctgatagtgaccctcgaccatgacagtgcctctagcgcctcgccaaccgtggatgggaccactaccgggacagccatggatgacgctgacccacctggacctgaaaacttatttgtcaattacctctcacgcattcaccgagaggaggacttccagtttattcttaaaggtatcgcacgactgctcagtaatcccctactacagacctacttgcccaattctacaaaaaagattcaatttcaccaagagcttctggtgctattttggaaactgtgtgacttcaataagaagtttctgttttttgtccttaagtcttcagacgtgttggacatcctagtgccaatcctgttctttctaaacgacgccagagcagaccagagcagagtcgggttgatgcacatcggagtgttcatcctcttgctactctctggagaaagaaattttggagtcaggcttaataaaccttattcaattagggtgcctatggacatcccagtttttaccggaacccacgccgaccttctcattgtggtctttcacaaaatcatcacctctgggcaccagcgattgcagcctttatttgattgccttttgacgatcgtcgtcaatgtgtccccttaccttaagagcctgagcatggtcaccgctaacaagcttctccatctgctcgaagctttctctacaacttggtttcttttttccgccgcacagaatcaccatttggtgtttttcctgctggaagtgttcaacaacatcatccagtatcagttcgacggcaacagcaacttggtctatgccattattcggaagagaagtatttttcaccagctggctaatttgccgaccgacccaccaactatacacaaggccctgcagagacgccgaaggacgccagagcccctgagccggactgggagtcaagagggcacgagcatggagggatccaggcctgccgcacccgctgagccgggtactctgaagacctccctggtggcaacaccaggaatcgacaaactgacagagaagtcccaggtcagcgaggatggaacccttagatctcttgaaccagagccccagcagtccctggaggatgggagccccgccaaaggcgaaccgagccaggcctggcgtgagcagcgtagacccagcacttctagcgcttcggggcagtggagcccaacacccgagtgggtgctttcctggaaaagtaaactgcctctgcagacaatcatgcgcctgctacaggtactggtaccccaagtggagaagatctgtattgacaagggactgacagacgagtccgagattcttcgctttcttcagcacggtacactggtgggtctgcttcccgtgccccatccgatcctaattcgcaagtaccaagccaatagcggcacagcaatgtggttccgcacctacatgtggggcgtgatttatctgaggaacgtcgacccgcccgtttggtacgataccgatgttaagctatttgagattcagcgcgtgtag

SEQ ID NO: 112232 - DNA, 810 bp, Artificial Sequence
  Description of Artificial Sequence: Synthetic coding sequence
atgtcttctgaccacctaaataacagcacactcaaagaggcccagtttaaagacctgttcctgaagaaggctgagctggaattcgcacagatcattattattgtcgtggttgtcactgtcatggtggttgttattgtgtgcctcctcaaccactacaaggtgagcacaaggtcctttatcaaccgccctaatcagagtaggcgcagggaggatggattgccccaggaagggtgtttatggccttcagatagtgcagctcctcggctcggggcaagcgagattatgcacgctccaaggtcccgcgatcgatttacagctccatccttcatacagcgagatcgcttcagcagattccagccgacgtacccgtacgtgcagcacgaaatcgacctgcctcctaccatttctctgtctgacggggaggaaccacccccctatcaaggtccatgtacactgcagctcagggatccagaacagcagatggagctaaatcgggaatcagtgagggcgcctccaaataggaccatcttcgactccgatcttatcgacatcgccatgtattccggaggcccttgccccccaagctcaaattcaggcatttcagcgagtacttgttctagcaatggtcggatggaagggccccccccaacctactctgaggtgatgggtcaccatccaggagcatctttcctccatcatcagcgcagcaatgcgcacaggggttctcggctgcagtttcagcaaaacaacgcagagtcgaccatcgtgccaattaagggtaaggataggaagcccggcaatctcgtttag

SEQ ID NO: 112233 - DNA, 921 bp, Artificial Sequence
  Description of Artificial Sequence: Synthetic coding sequence
atgcctgaagctgggttccaagctaccaacgcattcaccgagtgtaagttcacttgcacatccggtaagtgtctctatctgggcagcttggtctgcaaccagcaaaatgactgtggagacaactccgacgaagaaaactgcctactggttactgagcatcccccccccggaatatttaactccgagctcgagtttgcccagataataatcatcgtggtagtggttacagtgatggttgtcgtcattgtatgtttacttaatcattacaaagtgtcaacacgctctttcattaaccgcccaaatcagtctcggcgaagggaggacggattaccacaggaaggatgcttatggccaagcgacagtgcagcgccaagactgggggcctctgagatcatgcacgcgccaagaagcagggacagatttactgcccccagctttatacagagggaccgattttctcgatttcagcccacctatccctacgttcagcatgaaatcgacctgcccccgaccattagtctatctgacggagaggaaccccccccttatcagggaccgtgtactttacagctcagagatccagagcagcagatggaattgaaccgggagtctgtgagggctcctccgaatagaacaatttttgattcagatctgatagacatagccatgtacagtggcggcccctgtccaccatccagtaacagcggcatcagcgctagtacatgttcatccaatgggcgtatggagggcccgcctccgacttatagtgaggttatgggccaccaccccggagccagcttcctgcaccaccaacgaagcaacgcccaccgaggctctagattacagttccagcagaataacgctgaatctaccattgtcccgatcaaaggaaaagaccggaagcccggcaaccttgtgtag

SEQ ID NO: 112234 - DNA, 747 bp, Artificial Sequence
  Description of Artificial Sequence: Synthetic coding sequence
atggcagccgagctagaattcgcccagattatcatcattgtcgttgtcgtaactgttatggtggtcgtcattgtatgcttattgaatcactataaagtcagcactagatcgttcattaacagacctaaccaatccagaaggcgggaggacggactgccacaagagggatgtctttggccatcggactccgcagcaccaaggctgggcgcctctgagataatgcacgctcccaggtcaagggataggttcactgctccatcttttatccagcgcgataggttctctagatttcagcccacttatccctacgtccaacacgagatcgatctgccgcctacaatctctctgtcagatggggaggaaccaccaccctatcaaggaccttgcacgttacaattgagggatccagaacagcagatggaacttaaccgcgaatcagtgagggcaccgcctaatagaactattttcgacagtgacctaattgacatcgccatgtacagcggcgggccctgtccgccctccagcaacagtggtatcagtgcaagtacatgttcgagtaacgggcggatggagggacctccaccaacctatagtgaagtcatggggcatcatccaggcgcctcgttcttgcaccatcagcgcagcaatgctcatagagggtccaggctacagtttcaacagaataatgccgagagtaccatcgtgccaataaaaggaaaagatcgaaaacccggcaacctagtgtag

SEQ ID NO: 112235 - DNA, 756 bp, Artificial Sequence
  Description of Artificial Sequence: Synthetic coding sequence
atgagcagcgatcacctaaataactcaaccctgaaagaagctcagttcaaggatctcttccttaagaaagcagagctggaatttgcccagattattatcatcgtggtcgtggtgactgtgatggtggtggtgattgtttgtctgctgaaccattataaagtgagcacccggagttttatcaaccgtccaaaccagagcaggcggagggaggacgggttgcctcagattatgcacgctccacggtccagagatcgcttcacagctccttcttttatccaaagggaccgctttagtcggttccaacccacttatccttacgtacagcacgaaattgacttgcccccaacaatatcgctaagtgatggcgaggagccacccccttatcaggggccctgtactctccagctccgggaccctgagcagcagatggaacttaatagagagtcagtcagagccccaccaaaccgaacaatctttgactcagacttaatcgatatcgcaatgtattcaggcgggccgtgccctcctagttcaaacagcggcatatctgctagcacgtgctcctctaatggtaggatggagggacctccaccgacgtacagtgaggtcatgggacatcatccgggcgcatccttcctgcatcatcagcgttctaatgcacacagaggctcccgcctgcagtttcagcaaaataatgccgagagcacaatcgtccctataaaagggaaggatcgcaaacctgggaacctcgtgtag

SEQ ID NO: 112236 - DNA, 867 bp, Artificial Sequence
  Description of Artificial Sequence: Synthetic coding sequence
atgcccgaagccggcttccaggcaaccaatgccttcacggagtgcaagtttacctgtacgagcgggaagtgtctctatctgggcagtctggtgtgcaatcagcaaaacgattgcggggataactcggacgaagagaactgtctgctagttacagaacaccccccaccgggtatcttcaactcagagcttgaattcgctcagataattatcattgtggtggttgtgacagtcatggtcgtggttattgtgtgcttgctcaatcattacaaagtctcaacccgatccttcatcaacaggcccaaccagagtaggcgaagggaagacggactaccgcagattatgcacgccccccgttctagggacagatttacagccccttcctttattcaaagagacagattttccagatttcagccaacctatccttacgttcaacacgaaatcgatttgcctcctaccatatctctgtccgatggcgaagagccccctccctaccaaggaccttgcaccttgcagctgcgcgacccagaacagcagatggagctgaaccgggagtcagtacgcgctccccctaatagaacaatctttgattcagatcttattgatatcgcgatgtactccggcggcccttgcccaccctctagtaattctggcatttcggctagcacctgcagtagcaacggtcggatggaagggcctcccccaacgtattcagaggtgatggggcatcatcccggggccagttttttgcaccaccagaggagtaacgcgcaccggggctctaggctccaattccagcagaataacgccgaaagcacgattgtgccgatcaaggggaaagacaggaaacctggaaatctggtgtag

SEQ ID NO: 112237 - DNA, 693 bp, Artificial Sequence
  Description of Artificial Sequence: Synthetic coding sequence
atggcagctgagctggagttcgctcagattatcatcattgttgtagtggtgactgtgatggtggtggtgatcgtctgtctgctgaaccactataaggtctcgacaaggtcttttatcaaccgccctaatcagtctcgacgaagagaggatggcctgccacagattatgcacgctccaagaagccgagataggtttaccgccccctctttcattcagcgagatcgcttttcaaggttccagccaacatacccatatgtgcagcacgaaatagaccttcctcccacaatttcattgtcagacggcgaagagcctccaccctatcagggtccctgcacgctgcagcttcgcgacccagaacagcagatggagctgaatcgggagagcgttcgcgccccgccaaatcgcaccatttttgacagcgatctcattgatatcgctatgtactctggagggccatgccctcctagctcaaattctggtataagcgcctcaacctgctcctccaacggacgaatggaggggccacctccaacatattcagaggtcatgggccatcatcctggtgccagcttcctccaccatcaacggtccaacgctcacagaggcagtcgcctacaattccagcagaacaacgccgaatctaccattgtaccaatcaaggggaaggaccggaagccaggcaacctagtctag

SEQ ID NO: 112238 - DNA, 1119 bp, Artificial Sequence
  Description of Artificial Sequence: Synthetic coding sequence
atggctaagtctaagacaaagcataggctatgctctcaagagtcatcagtcagtgcgttactggcatcttgtacactgagcgggtcaaatagcagtaatagcgacgggtcattccattataaagacaagctgtaccgtagcgcatcacaggcactacaggcctacattgacgactttgacctgggccagatctatccaggcgcttccactggcaaaattaacatagatgaggacttcacaaacatgtctcaattttgtaattatatctacaaaccaaacaatgcttttgagaacctggaccacaaaaagcatagcaactttatctcgtgccgccgtcacactgtgaacgatattgattccatgagcctgacaacagatgatctgctgagactgcccgcagacggaagtttttcatatacgtatgtgggccccagtcaccgcaccagcaagaaaaataaaaaatgcagggggagactgggcagtctggacattgagaagaatccgcattttcagggcccttacacctcaatgggtaaagacaatttcgtgacccccgtcatccggtctaatatcaacggaaaacagtgcggcgataaaatagagttgttgatccttaaggcaaagcggaacctcgaacagtgcaccgaagagctgcctaagagcatgaaaaaggatgatagcccttgcagcctggacaaactggaggcagacagatcttgggagaacattccggttacgttcaagagccccgtgcccgtgaactcagacgactccccacagcagacctcccgggcgaagagcgcaaagggagtgctggaagatttcctaaataacgacaatcagtcttgtacattatctgggggcaagcatcatggacccgtggaagcccttaagcagatgttattcaacctgcaagctgtccaggaacgcttcaatcagaataaaactacagaccccaaggaagagatcaaacaggtttcggaagacgacttctctaagcttcaattaaaggagtctatgatccctattacacgcagcctccagaaggctctgcatcaccttagtcgcttaagggacctggttgacgatacaaatggggagaggtcgccaaagatgtag

SEQ ID NO: 112239 - DNA, 1602 bp, Artificial Sequence
  Description of Artificial Sequence: Synthetic coding sequence
atggcaaaaagcaaaacaaagcacaggctttgctcccaggaatccagcgtgtccgcccttctcgctagttgcacactctccgggagtaattcctctaacagtgatgggtcctttcactataaagataagttatacagatctgcgtcccaggcactccaggcctacatcgacgattttgacctgggacaaatatatcctggggcttcaaccggtaaaattaacatcgatgaggattttaccaacatgtcacaattttgtaattacatttataagcccaataatgccttcgagaacctggaccataagaagcactcgaatttcattagttgccgccgacacaccgtgaacgacattgactctatgagcctgaccacagatgacctgctcagactccctgccgacggttcattctcctacacatacgtaggcccatcgcatcgaacatctaagaagaacaagaaatgtcggggtagactgggtagcctcgacatcgaaaaaaaccctcacttccaaggtccttatacctccatgggaaaggacaacttcgtgacgcccgtaatccgttctaacattaatggaaagcagtgcggcaggctcaagaacccaaagctgatgaatcgaacgaacaattgtatttccgaatcttctctgtccttcccaaagaagagttccttcaaggattcttcagaacattcactcgagaaaaattaccctcggtggttgacaagccagaagtctgacttgaatgtctctggtattacatccattcctgactttaagtaccccgtctggctgcataaccaggatttactgcccgacgcaaactcccagcgggtgtatcaaatttttaaggatgatcagtgctcaccccggcactcacaccaggctcaggggacaagtcggttaatcaacaagctcgactgctttgagtatgcattcgaaccatctaactttagcaactccctgtctgacgacaaggagctggtgaacgagtacaaatgcgattttgaacactctcagtgtcagtgtgagaaccccctgctccctggccaatcaaccaaacccttctctggcgacaagatcgaactcctgattctgaaagccaagcgcaacttggaacaatgcacagaggagcttcctaagtcgatgaaaaaagatgattctccatgcagtctagacaagcttgaagctgaccggagctgggaaaacattcccgtcacatttaagagcccagtcccagtgaatagcgacgattcacctcaacaaacgagtcgggcaaagtcggcaaagggcgtgttagaggattttttgaacaacgacaaccagagctgcacactgtcaggaggcaagcatcatggcccagtggaggctctaaagcagatgttgtttaatcttcaggcagtgcaggaacggttcaatcagaataaaactaccgacccaaaggaagaaattaaacaagtttcggaagacgatttctcgaaactgcaactgaaggagtctatgatccccatcacaagatctctccagaaggccctacatcatctgtctagactgcgagacctggtggatgacactaacggcgagcggtctcctaagatgtag

SEQ ID NO: 112240 - DNA, 522 bp, Artificial Sequence
  Description of Artificial Sequence: Synthetic coding sequence
atggcggccccttctggcgggtggaacggagtgggggcaagcttgtgggcggcgctgctgctcggggccgttgcactccggccagcagaagccgtgtctgagcctacaacagtggcgtttgatgtgcggcctggcggggtagtccacagcttttcccacaacgttggaccaggcgataaatacacctgcatgtttacttacgcctcgcagggaggcacgaacgagcagtggcagatgagcctgggaacaagcgaagaccaccagcacttcacttgcacaatctggaggccacaggggaaatcttacctgtactttacgcagtttaaggctgaagtccgcggggccgagatcgaatatgctatggcatattccaaagctgcgtttgagcgcgagagtgatgtccctctgaagacggaagagtttgaagtgaccaagaccgcagtcgcacacaggccaggtgccttcaaggctgagcttagcaagttggtgatagttgccaaagcctccagaaccgagctgtag

SEQ ID NO: 112241 - DNA, 426 bp, Artificial Sequence
  Description of Artificial Sequence: Synthetic coding sequence
atgacaatcatggtggaggatattatgaaacttctctgctccttgagcggagagagaaaaatgaaagccgctgttaaacactctgggaagggcgctctcgtgacaggcgcaatggcttttgttgggggcctcgtaggtggaccacccggccttgcagttggaggagccgtaggaggattactgggggcctggatgacaagcggccagtttaagcccgttccccagattctgatggagttgccacccgccgagcagcagcggctattcaacgaggctgcagctatcattcgtcacctggagtggaccgacgccgtgcaactcaccgcccttgtcatggggtcagaagctcttcagcaacagctcttggctatgctggtcaactacgttacaaaggagctgcgagctgaaatccagtacgatgattag

SEQ ID NO: 112242 - DNA, 324 bp, Artificial Sequence
  Description of Artificial Sequence: Synthetic coding sequence
atgacaattatggttgaggacatcatgaagctgctttgttctctttccggggaacgcaagatgaaggctgctgtcaagcactctggaaaaggcgccctggtcacgggagccatggcctttgtaggaggactagttggcggacccccaggactggccgtggggggtgcggtgggcgggttactgggcgcatggatgacctctgggcagtttaaacctgtgccacagattctgatggagcttcccccagccgaacagcagcgtctgttcaatgaggctgctgcaattacacgcccttgctcttcttcctgctggccctgctggtag

SEQ ID NO: 112243 - DNA, 459 bp, Artificial Sequence
  Description of Artificial Sequence: Synthetic coding sequence
atggaaagattaaaaagtcataagccagcaacaatgactatcatggttgaagacatcatgaagttactgtgttctttgtctggggaaaggaagatgaaggcagccgtgaagcattctgggaagggcgctttggtgacaggcgccatggcctttgtgggtggtcttgttgggggccctcctggactggccgtcggtggcgctgtcggtggactgctgggcgcctggatgacgtcgggtcaattcaaaccagtacctcagatactgatggagctgccacccgctgaacaacagaggctgttcaacgaagccgcagccataattcgccatttagaatggactgacgctgtccaactcactgctctcgtgatgggatcagaagcccttcaacagcagcttctcgctatgctagtcaattatgtgaccaaagaactgcgggcggagatacagtacgatgattag

SEQ ID NO: 112244 - DNA, 648 bp, Artificial Sequence
  Description of Artificial Sequence: Synthetic coding sequence
atggagaaaaatcctcccgacgatacagggcccgtacatgtgcctttaggtcacattgtagccaacgagaagtggaggggcagccagctggcacaggaaatgcaggggaagataaaactcatctttgaagacgggctgacaccggacttttacctcagcaatcgttgttgcattctctacgtcaccgaagccgaccttgtggccggcaatgggtatagaaagagactggttcgcgtgcggaatagcaacaatctgaaagggatagtcgttgtcgaaaagacgcgaatgagtgaacagtattttcccgccctccagaagttcacagtgctggatttaggaatggttctgctgcctgtggcctctcagatggaagcttcctgccttgtcatccagctcgtccaggaacagactaaggagcctagcaaaaatccgctgctaggaaaaaagcgggcacttcttctgtccgaaccaagcctgttgaggacggtgcagcaaatccctggtgtggggaaggttaaggccccattattactgcagaaatttccttctatccaacagttgagtaatgcctccatcggcgaacttgagcaggtcgtaggccaggctgttgctcaacagattcacgccttcttcacccagcctcgctag

SEQ ID NO: 112245 - DNA, 648 bp, Artificial Sequence
  Description of Artificial Sequence: Synthetic coding sequence
atggagaagaaccctccagacgacactggtccagtccatgtgccccttggacacatcgtggcaaatgaaaagtggaggggaagtcagttggcccaggagatgcagggtaaaatcaaactgatattcgaggacgggctgacgccggatttttatctctccaataggtgctgcattctctatgtgactgaggctgacctggtggccggtaacggttaccggaagcggctggtgagggtgcgcaatagcaacaacctcaagggtattgtggtggtggagaagacacggatgtccgagcagtacttcccggccctgcaaaagtttacagtgttggacctggggatggtgctgctccctgtggcctctcagatggaggcaagttgtctcgtgatccagctcgtgcaagagcagacgaaagaaccctcgaagaatccattgttaggtaagaagagggctctgctactgagcgaaccttctctcctgagaacggtgcaacaaatccctggagttggaaaagtcaaagccccgctgctcctccaaaagttccctagcatccagcaactcagtaacgcgtctatcggcgagctggagcaagtggtgggccaggctgtagcccaacaaatccacgcatttttcacacagccaagatag

SEQ ID NO: 112246 - DNA, 1227 bp, Artificial Sequence
  Description of Artificial Sequence: Synthetic coding sequence
atgtcggaacatgtggaaccagctgccccaggtcccggaccgaatgggggtggtggcgggcctgctcctgctaggggcccacgcacaccgaacctgaaccctaatccactgatcaacgtgcgtgaccggctgttccacgcattgttctttaagatggcagtcacttactcccgactgttccccccagctttccgccggctcttcgaattcttcgttcttctcaaagcgctgttcgttctctttgtgctggcctatatccatattgttttcagccggtcacccattaactgtctggaacatgtgagagacaagtggccacgcgaggggatcctgcgagtcgaagtccgccacaactcctcaagagctcccgtttttttgcagttctgtgattctgggggccgggggagctttcccgggcttgcggtcgaaccaggctctaacctcgacatggaggacgaggaagaagaggagctcaccatggagatgttcggaaattcttcaataaagttcgaattagacattgagcctaaagtctttaaaccaccctcatctacagaagccctgaatgactctcaggagttccccttccctgaaacccccacaaaggtatggccccaagacgagtacatagtggaatactctcttgagtatggcttcttaagattaagtcaggccaccaggcagcgtctttccatcccagtgatggtggtgactttagacccaacaagagatcagtgcttcggtgacagattttccaggttgcttttggacgaattcctcggatatgatgacattttgatgtcctccgtcaaggggctggctgaaaatgaagagaataaggggtttctgagaaatgtcgtaagcggagagcactatagattcgtctccatgtggatggccagaacgagctacctggccgctttcgccattatggtcatttttacactgtcagtgagtatgttactccggtactctcaccatcagatttttgtcttcatcgtggacctgcttcagatgctggagatgaatatggcaatcgcttttcctgcggcccctctgctcacagtgatccttgctctggtcgggatggaggcgattatgagcgaatttttcaatgatactacaacagctttttatatcatcctgattgtgtggctggccgaccagtatgatgcaatttgttgccataccagcaccagtaagcggcattggctgcggataccttag

SEQ ID NO: 112247 - DNA, 1863 bp, Artificial Sequence
  Description of Artificial Sequence: Synthetic coding sequence
atgtccgaacacgttgaaccggccgcccctgggccaggcccaaatggcggcggaggcggtccagcacctgcccgcgggccccggacacccaatctcaaccccaatcctctgattaacgtgagagaccgtctgtttcatgcgctgttttttaagatggcagttacgtacagccggttgttcccaccagccttccgaagactgttcgagttcttcgtcctcctcaaggctctattcgtactcttcgtattggcttatattcatatcgtcttttcacgctcacccatcaactgtcttgaacacgtgcgcgacaaatggccccgggagggcattctgagggtggaggtgcgccacaattcaagccgagctcctgtgttcctgcagttctgtgacagcggcggacgtgggtcatttccgggcttagctgtcgagcctggatcaaatttggacatggaagacgaagaagaggaggaactgacaatggagatgtttgggaactccagtatcaagttcgaactggacatagaacctaaagtcttcaagcctccaagctctacagaagcgttgaatgatagccaagagttcccatttcctgagactcccacaaaagtttggcctcaagacgagtacatcgtggaatatagcttggaatatggcttcctgcgcctgtctcaggccaccaggcagaggctgtcaatccctgttatggtggttacactagacccgactcgcgatcagtgcttcggcgatcgattttcacgacttttattagacgagtttctcggctatgacgatatcttgatgtctagcgtgaaaggactggctgaaaatgaggaaaataaaggctttctacgtaatgtcgtgagcggagagcattacagatttgtgtccatgtggatggcgagaaccagttacctggccgccttcgcaattatggtgatctttactcttagcgtcagtatgcttctacgatacagccaccaccagattttcgttttcatcgtggacctgcttcagatgctcgagatgaacatggctattgcctttcctgctgcaccgctgctgacagtgattctggcactggttggcatggaagctataatgtccgaattcttcaacgacactaccaccgccttctacattatcctgatcgtatggctggccgatcagtacgatgcaatttgctgccatacatccacctccaagcgtcactggctgcgattcttttacctgtaccacttcgccttctatgcttatcactaccgatttaatggccagtatagctcgctagctctggtgacaagttggctattcatacagcattccatgatctactttttccaccattacgaactgcctgccattctgcagcaagtgagaatacaagaaatgctgttacaggcccctccactcggacctgggactccaacagcgttacctgacgacatgaacaacaattccggggcacccgcgacagccccagactccgcaggccaacccccagctctaggtccagtgtcccccggcgcatctggcagcccaggacctgtagccgctgccccgagcagtcttgtggcagctgcagccagtgtggccgcagccgccggcggagaccttgggtggatggccgagacagcagccataattacagacgcatcctttctgagcggtttatccgcctccctcttagaacgccgaccagctagtccactggggcctgccggggggctgcctcacgctccccaggacagcgtcccgccctccgactctgctgcctctgatactacgcctctcggtgccgccgttggtgggccatcgccagcctctatggctccaactgaggccccatccgaggttggtagctag

SEQ ID NO: 112248 - DNA, 447 bp, Artificial Sequence
  Description of Artificial Sequence: Synthetic coding sequence
atggccgcatcaccagcaagacctgccgtgctggccctgactggtttagcgttgctgttactgctgtgttggggcccaggcggtatctccggtaataagctgaagctgatgctccaaaagcgcgaggcacctgtgcctacaaagacgaaggtagctgtggatgaaaacaaagccaaggagtttcttggatccctgaaaagacagaaacggcagctctgggacagaaccagacctgaagtgcagcagtggtatcagcagtttctatacatgggcttcgacgaagccaaattcgaagacgatatcacatactggctgaaccgagatagaaatgggcacgaatattacggtgactactaccaacgccattatgacgaagactcagctattggtcctcggtctccttatggatttcggcacggggcctccgtcaattatgatgattattag

SEQ ID NO: 112249 - DNA, 2964 bp, Artificial Sequence
  Description of Artificial Sequence: Synthetic coding sequence
atgaccccagcattaagagaggcgacagcgaaagggatcagcttttccagccttccatctacgatggagtctgacaagatgctgtatatggagagcccacgtactgtggatgaaaagctgaaaggtgacactttctcacagatgttaggatttccaactcccgaacctacgctcaacacgaattttgtaaatctgaaacattttggctcgccacagtccagcaagcactaccaaactgtattccttatgagatccaactcaacactgaacaaacacaacgagaactataagcagaaaaagttaggggaaccctcttgtaacaagctcaaaaatatcctgtacaatggctctaacattcaactcagcaagatctgcctgtcccattcagaagagtttatcaagaaggagccgctctctgatactaccagtcaatgtatgaaagacgtacaaatcatactggatagcaacattactaaagacaccaacgtcgataaggtacaacttcagaactgcaaatggtaccaggaaaacgcactgttagataaggtgactgatgccgaaataaagaagggtcttctgcactgcactcagaaaaagattgttcccgggcatagcaacgtgcctgtgagctcatccgcggcagaaaaggaagaagaagtgcacgctcggctgttacactgtgtgagtaaacaaaagatcctgctctcgcaggctcgacgcacacaaaagcacttacagatgctgctagcgaaacacgtggtcaaacattatggacaacaaatgaagttgtctatgaagcatcaactccccaaaatgaaaactttccacgagccaacgacgatactgggcaattccctcccaaagtgcacagagatcaagccggaagtaaatactctgaccgctgagaataaactctgggatgacgccaagaacgggttcgcccgctgtaccgcggctgaaatccagcgttttgccttttctgccacgggcctcttgtcacacgtggaagagggcctggattccgacgcaactgacagtagctccgacgacgacctcgatgagtatacattgaggaagaacgtggccgttaattgttcgacagaatggaaatggttagtggaccgtgcacgcgtgggttctagatggacgtggcttcaggctcagatctctgatctcgagtgtaaaatccagcagctcaccgacattcatcgccagatccgcgcctctaaaggtatcgtggttctggaggagtgtcaactgccgaaagacatcctgaagaaacagatgcagttcgctgatcaggccgccagcttaaacatcctgggtaaccctcaggtgccacaagagtgtcaggatccagtgcccgagcaagatttcgagatgtcaccttcaagcccgaccctgttactgagaaatatagagaagcagtccgcgcagcttacggaaattatcaattcattgatagcccccctcaacttgtccccaacgagctcaccgttgtcgtcgaagagctgcagccataaatgcctggcaaatgggatctatcggtctgcctctgaaaatctcgatgaactcagctcatctagttcctggctcttaaatcagaaacacagtaaaaagaagcgtaaagatagaactagactcaaatctagctctctcactttcatgagtacctccgctcgcactcgcccactacaatcgttccataagcgcaagctgtaccgtctgtcgccaaccttctactggacgccccaaactcttccatccaaggagaccgcatttctaaacacgacacaaatgccttgtctgcagagtgcctctacatggtcaagttacgaacacaactccgaaagttatcttttgcgggaacacgttagcgagttggatagctcctttcactccgtgctgtcactacccagtgatgtgcccctacactttcatttcgagacgctgctcaagaagacagagatcaaagggaacttggcagaaaataagttcgtggatgaatacataatttccccaagtcctgtgcatagcacactgaaccaatggcggaacggctatagcccaatatgtaagcctcagattcggagtgaatcatccgcgcagttgttacagggtcggaagaaaaggcacctgagcgagactgccttgggcgaacggaccaaactggaggaaagtgacttccaacacacagagtccggcagccattccaatttcacagctgtttccaatgttaatgtcctttctcgcatacagaactcgagcaggaacaccgcccgcaggagacttcggtctgagagctcttatgacatcgataacattgtgattccaatgtccctcgttgcacccgctaaacttgagaaattgcagtacaaagaaatcctgaccccttcatggcgaatggtggtgttgcaacctcttgatgagtataatcttggtaaagaagaaatcgaggacctaagcgatgaggttttctctttacgacacaagaagtacgaggaaagggagcaggctagatggtccctatgggagcagtcaaagtggcacaggaggaattctagagcttattccaagaatgttgagggtcaggatctgctgctgaaggaataccctaacaatttttcttcttctcagcagtgcgccgctgcatcacccccaggcctcccatcagagaatcaggacctttgtgcatatggactacctagcttgaaccaatcacaagaaactaagagcctgtggtgggagcgacgcgcgttcccacttaagggcgaagatatggctgctttactgtgccaggacgagaaaaaggatcaggtcgaacgttcctccaccgctttccacggagaaatctttggtacttctgtacccgagaatggtcatcaccctaagaagcagtctgatgggatggaagaatacaagacattcggcctgggcctaactaatgtcaagaaaaataggtag

SEQ ID NO: 112250 - DNA, 687 bp, Artificial Sequence
  Description of Artificial Sequence: Synthetic coding sequence
atgtcatatgcagagaaaccagacgagatcactaaagacgaatggatggaaaagctcaataatctccacgtccagcgtgccgacatgaatagactgatcatgaactacctggttacagagggctttaaagaagccgcagaaaaatttagaatggagtccgggatcgaaccctccgtcgatttggagacactggacgagaggataaagattagggaaatgattctgaaggggcagatacaggaagccattgcacttattaactccctgcatcctgagttgctcgacactaaccggtacctgtattttcaccttcaacagcaacatttgatagagctcatcagacagcgggaaaccgaagccgctttggaattcgctcagactcagctggctgagcagggggaggagagccgggaatgtctgacagagatggaacgtacactcgccttgttggcattcgattcccctgaagaaagcccctttggggacctcctccacaccatgcagagacagaaagtctggtctgaagtcaaccaggcagttttggattatgaaaacagggaaagcacccctaagcttgcaaaacttctcaagctccttctgtgggcacaaaacgagctggatcagaagaaagtcaagtaccctaaaatgacagacctgagcaagggtgtcattgaagagcctaaatag

SEQ ID NO: 112251 - DNA, 468 bp, Artificial Sequence
  Description of Artificial Sequence: Synthetic coding sequence
atgtcctacgccgagaaaccggatgagatcaccaaagacgagtggatggaaaagctgaacaatcttcacgtgcaacgggctgacatgaaccgactgatcatgaactacttagtcaccgaaggctttaaggaggcagccgaaaagttccgcatggagagcggcattgagccgagcgtggatctggaaaccctagatgagagaattaaaatccgcgagatgatccttaagggtcagatccagcaggttgtgcatgattgttggcggaaggagagagttttcattctgtcagatctaccgagttctatatccgctgcaagtcatcctccctccagcgctggcagcgccgatgtgttgctgctgttcacgcacagaaccgtcccttgctccgtcgtgggccggcgggaggtggtgcaaggctgtgttcattgcctacgcgtggggactgtagatggccatatggccctgtag

SEQ ID NO: 112252 - DNA, 3534 bp, Artificial Sequence
  Description of Artificial Sequence: Synthetic coding sequence
atggacgtataccctcctagaaggcaggggcttcctcgggcccgctcccctggcgggtcctcaaggggatccccatctgtttcctgtagcaggctgaggcaggtacagtccattctgacgcaatccagcaaaagtagacctgatggcatcctgtgcattctcggaatcgattccaggtataacgagggatgtcgagagctggctaattatctgctgttcggtctttacaatcagaacacaagtgacttcgagaagactggcttctccgaagaagtgttggatgacgtcattattttgattaagtctgattctgttcatttatactgtaatcctgtcaatttccggtatctgctgccatatgtcgcccactggaggaaccttcacttccattgtatgacagaaaatgaatatgaggacgaagaagccgccgaagagtttaagatcactagcttcgtcgatatggtgcgcgactgctcccgtattggcatcccatacagtagccagggccacctgcaaatctttgatatgtttgttgtggagaaatggcccattgtgcaggcgtttgcccttgagggtatcggcggggacgggtttttcacaatgaaatatgaactgcaggacgtgtcccttaatctttggaacgtgtattccaagatggatcctatgtccctggaatccctactctccgacgatctggtggcttttgaacatcagtggacctctttttttgctaattttgacacggaaatcccctttctgctggagctttccgaatcccaggctggcgagccatttcggtcttacttctcacatggtatgatcagtagtcacattacggaaaattcacccaataggcagccctttgtgttattcggtaatcactccacgcgggaaaacctgaatgcaggcaactttaatttcccttcagaaggccatctggttcgaagcactggcccgggcgggtcttttgctaagcatatggtggctcagtgcgtctctccgaaagggccacttgcttgtagccgcacgtacttttttggggcgacccacgtgccctacctagggggggattcaaaactgcccaagaagacagagcagatcaggctactttctcagatttatgccgctgttattgaagccgtcctcgcaggtattgcctgctacgcaaaaacgtctagcctgacaaaagccaaggaggtcgccgaacagaccctgggatctgggttggacagctttgagttaatcccctttaaagctgcactaaggtcaaagatgacatttcatatccatgccgttaataatcaggggcgaattgtcccactggattccgaggactctctcagcttcgtgaaaaccgcctgtatggctgtctatgacattcccgatctactgggaggaaatgggtgtctcggttcagttgtatttagcgagtccttcctaacctcacagatcctggtcaaggaaaaagacggcacagtcacaacagaaacctcttcagtagtgttaacagccgccgttccgcgattctgtagctggctggtggaggacaatgaagtaaaactgagcgaaaagactcagcaggcagttcgcggcgatgagagctttctgggaacgtacttaaccggaggcgagggggcctacctgtattcatcgaaccttcagagttggccggaagaaggaaacgtccacttttttagctctggtctgctgtttagccattgcagacaccgctccataattataagcaaagaccacatgaatagcatcagcttctatgatggagatagcacttcaactgtggctgctctgctcattgattttaaatcttctctgttgcctcacctgcctgtgcattttcatggctcttcaaatttcctgatgatcgcactgtttcccaaatcaaagatctaccaggccttttactccgaggtgttctcactctggaaacagcaagacaacagtggcatttctctgaaggtcattcaggaggatggccttagcgtggagcaaaagcgacttcactcctcagcacagaaactgttctccgctctctctcaacctgctggcgagaaacggtcctctttaaagcttctaagtgctaaactgccggaactggattggttcctgcagcactttgcaatctcaagtatctcgcaggagcccgtaatgcggactcatctccccgttttactgcagcaagccgagattaataccacacacaggatagagtccgacaaagtcataatttctattgtgacagggcttcccggctgccacgccagcgagctctgtgcctttttggtgacattacacaaagagtgcgggaggtggatggtctaccggcagataatggatagctccgaatgttttcatgctgctcactttcagcgctacctgagtagtgctctcgaggcccaacagaataggtccgctcgccagtctgcatacattagaaagaaaacacgcctgctggtcgtgctgcagggatatacagatgtcattgacgtcgtccaggcgctgcaaactcaccccgacagcaatgtcaaggcgtcttttaccattggcgctattaccgcctgtgtggagcctatgtcatgttatatggaacatagatttctttttcccaagtgccttgatcagtgtagccagggtctggttagcaacgtggtgtttacttcacacaccacggagcagcgccatcctctgctcgtacagctgcagagcttaataagagccgccaaccccgctgcagcctttatcttggcggaaaacgggattgtgaccagaaatgaggatatcgaactgatcctgagcgaaaacagttttagctccccagagatgctcaggagccgatacttaatgtaccctgggtggtacgagggaaagttaaacgccggctccgtctaccccctgatggtgcagatctgtgtttggtttggcaggcctcttgagaagacacgcttcgtggccaagtgtaaagcaatccagagctccatcaagccaagtccttttagcgggaatatttaccacatcctgggcaaggtcaaattttcagacagtgagcgcactatggaggtgtgttacaacaccctggcaaactctctgagtatcatgcccgtcctggaagggccaactccgcctcctgactctaaatccgtctctcaagatagttccggacagcaggaatgctatctggtgtttatcggctgttcattaaaggaggactcaataaaggattggctgaggcaaagcgccaagcagaagccccagcggaaggcccttaagactaggggaatgctgacacagcaggaaatccggtctatccacgtaaaaaggcacctcgaaccgctgccagctggctacttctataacgggacacagttcgtgaactttttcggcgataagacagacttccaccctctgatggaccagttcatgaatgattacgttgaggaagccaatagggaaattgagaaatacaatcaggaacttgagcagcaggagtatcacgacctctttgaattaaagccttag

SEQ ID NO: 112253 - DNA, 1488 bp, Artificial Sequence
  Description of Artificial Sequence: Synthetic coding sequence
atggagggctgtttgggacaggagttgttttccaatcatatgttcctgactagcttgagcagccccaatcggcagcccttcgtgctgtttggtaaccactctacacgcgaaaacttaaatgctggcaacttcaacttcccaagtgaaggacacctggttcgaagcacggggccaggcggcagcttcgccaaacacatggtggcccagtgtgtatcgcccaagggaccactggcctgtagtagaacgtatttttttggggctacccatgttccatacctggggggggatagcaagctgccaaaaaaaacagagcagatgctcctgagtcagatttatgccgctgtgatcgaggctgtcctcgccggcatcgcctgctacgctaaaactagctctttaaccaaggctaaggaggtcgccgagcagaccctaggaagcggccttgactcatttgagctgatcccttttaaagctgcgctgcggtctaaaatgacatttcacattcacgctgtgaacaaccaaggaagaatagtccccctggactcggaggattcactgagcttcgtaaagacagcatgtatggccgtttacgatatacctgatctgctggggggcaacgggtgcctcggaagcgttgtattcagtgagtctttcctgacctctcagatcttagtaaaggaaaaagatgggaccgttacgacagaaaccagttccgtggtgctcactgccgccgtaccgagattttgcagctggctcgttgaggataatgaggtgaagctcagcgagaaaacccaacaggccgtgagaggagatgaatccttcctgggcacatatctgacggggggggagggagcctacctgtacagctctaacctgcagtcgtggcccgaagaaggcaacgttcacttttttagttccggccttctgttctcacactgtcggcatagatctattattatttccaaagaccatatgaactcaattagcttctacgacggtgactccacaagcaccgtggcagccctgctgattgatttcaagtccagcttactgccacacttgccggtacacttccacggctccagtaactttctcatgatagccctgttcccaaaatctaagatttaccaggcgttctactccgaggtgttcagtctctggaaacagcaggataacagcggaatctcccttaaggtcattcaggaggacggcctgtccgtagaacagaagagactccattcctccgcccagaagcttttttctgccctgagtcagcctgctggggagaagcggtcgagtctgaagctgctttcagcaaagctcccagaacttgactggtttctgcagcacttcgcgatatcttctatatcccaggagcccgttatgcgcactcatctacctgtgctgctgcagcaggcagagattaacacaacacataggatagagtccgataagatggacggcgtctctcctaaccacggacagctttag

SEQ ID NO: 112254 - DNA, 615 bp, Artificial Sequence
  Description of Artificial Sequence: Synthetic coding sequence
atgggcgaagcagaagtggggggagggggagccgctggtgataaagggcccggggaggccgcaaccagtccagctgaagagaccgtggtctggagccccgaagtggaggtttgtctgtttcacgctatgctgggtcataagccagtcggggtgaaccggcacttccacatgatttgcatccgggacaagttttctcagaacattggacgacaggtacccagtaaggtaatctgggaccacctctcgaccatgtacgacatgcaagcccttcatgaatctgaaatcctccctttccctaatccagagcgaaattttgtgctgcctgaggaaattatccaggaggtgcgtgaaggcaaggttatgatagaggaagagatgaaagaagagatgaaggaggatgtggacccgcacaacggagcggatgatgttttctcctcttcaggaagcctgggaaaggcatccgagaagtctagcaaagataaggagaaaaactcatctgacttagggtgcaaagagggcgcggacaagcggaagaggtctcgcgttacagacaaagtcttgacagctaactctaatccgtcatcaccaagcgccgctaagcggaggaggacgtag

SEQ ID NO: 112255 - DNA, 1278 bp, Artificial Sequence
  Description of Artificial Sequence: Synthetic coding sequence
atgtatccctctaataaaaagaaaaaggtatggagggaggagaaggagaggctcctgaaaatgacgctcgaagaacgaagaaaagaatacctgcgagactacatcccactcaactctattctgtcctggaaagaggagatgaagggaaaagggcaaaatgacgaggaaaatacacaagagaccagccaggttaagaagagccttaccgagaaagtcagtctgtatagaggcgacatcactctcctggaagtggacgccatcgtgaatgcggctaacgcatcactgttaggtggaggcggagtggatgggtgcattcatcgggccgctggaccatgtttactcgccgaatgtcgcaacctcaatggatgcgatacagggcatgccaagattacctgtgggtatgaccttccagcaaagtatgtgatccatactgtgggtccaattgcgcggggccatatcaacgggagccacaaagaggacctggccaactgttataaatcctcccttaaactcgtgaaggagaataacattaggagcgttgctttcccctgcatctcaacaggaatttatgggttcccaaacgagccagccgctgtaatagctctcaacacaatcaaagagtggctggccaagaaccaccacgaagtggaccgcatcattttttgtgtatttctcgaagtcgacttcaagatttacaaaaaaaagatgaacgagttctttagcgtggatgataataatgaggaagaagaggacgtggagatgaaagaggacagcgatgaaaacggccccgaagaaaagcagtccgttgaggaaatggaggagcagagccaggatgccgacggagtcaatacagtcaccgtccctgggcccgcctctgaagaggctgtagaggactgtaaagatgaagacttcgcgaaagatgaaaacataactaagggtggtgaagtgacagatcactccgtccgcgatcaagaccaccccgacggacaggaaaatgactcaaccaaaaacgaaattaagatagagaccgagtcccagtcatcttatatggaaactgaggagctctccagcaaccaggaagatgcggtgatcgtagagcagcctgaggtgatccctctgaccgaagaccaggaagagaaggagggagagaaggcccccggggaggatacgccaaggatgcctggcaagagtgaggggtcgagcgatcttgaaaacacccccggacccgacgccggagctcaggacgaggctaaggagcagcgtaacggcactaaatag

SEQ ID NO: 112256 - DNA, 1248 bp, Artificial Sequence
  Description of Artificial Sequence: Synthetic coding sequence
atggcttttttgatgcacctactggtgtgtgtctttggcatgggcagctgggtaacaatcaatggcctctgggttgaacttcccttgctggtaatggaactccccgagggttggtatctaccttcctatctgactgttgtgatacagctggccaacattgggcctttactggtgactttgttgcatcatttccggccatcctgcttatccgaagtccccatcattttcacattacttggagtaggcactgtgacatgcattattttcgcattcctatggaatatgactagctgggtactggatggccatcacagtatagccttcctcgtcctgaccttttttctcgcactggtggactgtaccagctctgtgacattcctgccctttatgtcacgactgcctacctactatctgacaactttcttcgtgggcgaaggactttcaggtctgctccctgcattggttgccctggcgcaaggttccggactgaccacatgcgttaacgtgactgagatttctgacagcgtcccttcaccagtacctactcgcgaaaccgatatcgcccagggggttccacgggccttggttagcgccttgcctggtatggaggcacctctgtcgcatctagagtctagatacttgcccgcccatttcagcccacttgtatttttcttgctattgagtataatgatggcatgttgtctagttgcctttttcgtgctccagcgtcaaccgagatgttgggaggcctcagtggaggacctgctcaatgaccaggtaactctgcattcaatacggcccagagaggaaaatgatttaggtcccgctggcaccgtggactctagccagggccagggatacctcgaggagaaggctgccccttgctgcccagcccaccttgctttcatttacaccctggtcgcctttgtgaacgctctgactaacggcatgctgcctagcgtgcaaacttatagttgtctcagctatggccctgtagcctaccatttggctgccaccctgtctattgtggcgaatccactggcgagccttgtctcaatgtttctgccaaatcgaagcctgctcttcctgggggtgttaagtgtgctggggacgtgtttcggtgggtataatatggcaatggccgtcatgtcaccttgtcctctgttacaagggcactggggcggagaggtgctgattgtgtccatacgacccgtgggtctcctgccactccggacgcctcacccctag

SEQ ID NO: 112257 - DNA, 1038 bp, Artificial Sequence
  Description of Artificial Sequence: Synthetic coding sequence
atgttgcgtcccgccgggctctggaggctgtgtcgaagaccatgggcagcccgtgtaccggccgagaacttaggacgtagggaggtcactagcggagtgagccctcgaggatctacaagccccaggaccctgaacatctttgatcgtgatctcaagcggaaacagaaaaactgggccgccagacagccagaacctactaaatttgactatctaaaggaggaagtgggttcccgaattgctgacagagtatatgatatacctcggaactttccgctggccttggatcttgggtgcggtagggggtatattgcacagtacttgaataaggaaactatcggtaagttttttcaggctgacatcgctgagaacgctctaaaaaacagctcagagacggaaataccaaccgtgtcagtgcttgctgacgaggaattcctgcctttcaaagaaaatacctttgatctggtggttagctccctgtcactccactgggtgaacgacctgccacgggctctggaacagatccactacatcctgaaaccagatggtgtgtttattggggcaatgtttgggggcgacacgctgtatgagctcagatgttcactgcagctggctgagactgagcgcgagggagggttcagcccacacatttcccctttcaccgcagtgaatgatttaggacatttactgggccgagccggcttcaacacactcactgtcgacacggatgaaatacaggtgaattacccgggtatgtttgagctaatggaagatctccagggaatgggcgagagcaactgcgcctggaaccggaaggcactgctgcatcgggacactatgctcgcggccgcagcggtgtatcgggaaatgtataggaacgaagatggcagcgttcctgcgacgtatcaaatctactacatgatcggatggaaataccacgagagccaagctaggcccgccgagcgcggctctgctacagtgagcttcggagagctgggaaaaattaacaacttaatgccccccggcaagaagagccagtag

SEQ ID NO: 112258 - DNA, 954 bp, Artificial Sequence
  Description of Artificial Sequence: Synthetic coding sequence
atgctgagacctgctgggttatggcgattatgcaggcggccttgggcagcccgggtcccggctgagaacctcgggcgtagagaggttacctctggcgtttccccccggggatccaccagtcctcggaccttgaacatcttcgacagagatttgaaacggaagcaaaagaattgggcggcaaggcagccagagcccacgaaattcgactacttgaaagaagaagtaggaagccggatcgccgatagggtatatgatatccctcggaacttcccactggccctcgacctcggttgcggtcgggggtacatagcgcagtacttgaataaactgcagttattccactgtcgaaaattactcgaatcctttagcaagcttacactacaaaagatgctatgtctgcactgggttaatgatttgcctcgcgctcttgaacagattcactatatactgaaaccagatggggtctttatcggagctatgttcggaggcgatacgctgtacgagctcaggtgctccttacaacttgccgaaactgaacgggagggcgggttttcacctcacatttctccatttacggcggttaacgacctcggccaccttctcggtagggctggttttaacaccctgaccgtagatacagatgaaattcaggtgaattaccccggcatgtttgaactgatggaggatctccagggtatgggcgagtccaattgcgcatggaacaggaaggcgcttttacatcgcgacaccatgctcgctgctgcagctgtctacagggaaatgtatcggaacgaagatggtagtgtccccgctacctaccagatatactatatgatcggctggaagtatcatgaaagccaagctaggccggctgaaagaggatctgcgactgtgtctttcggagagctcggcaaaatcaataatctcatgccaccgggcaagaaatcccagtag

SEQ ID NO: 112259 - DNA, 804 bp, Artificial Sequence
  Description of Artificial Sequence: Synthetic coding sequence
atgcttaggccagcgggcttgtggagactatgccggaggccttgggctgcccgcgttcccgcagagaacctgggcaggcgtgaggtgactagtggtgtgtctccacgaggatcgaccagtcctcgcactctgaatatcttcgacagagatttgaaaaggaaacagaaaaactgggcagcgcggcaacctgaacccacgaaattcgactaccttaaagaagaggtgggctcgaggatcgcagatagagtgtatgatatcccacgcaacttccccttggcccttgatctaggttgcggaagaggatatatcgcacagtatctaaacaaggagaccatagggaagttttttcaagcagacattgcagagaacgccctgaaaaactccagcgagaccgaaatacccacagtaagcgtcctagcagatgaagagttcttgcccttcaaagaaaacactttcgacttggtggtaagcagcctttctttgcattgggtgaatgatctcccaagggcgctggaacagatccactatatattaaagccagacggcgtctttattggggctatgtttggaggcgatacactgtatgaattgagatgctctcttcagttagccgagaccgagcgggagggtgggttctccccccacatttcgccctttactgccgtgaacgacctcgggcatctcctcggacgggccgggtttaataccctgacggtggacaccgacgaaatccaggtgaactacccagggatgttcgagcttatggaggatctgcaggagcaaaaatcccgcatgcttacatag

SEQ ID NO: 112260 - DNA, 771 bp, Artificial Sequence
  Description of Artificial Sequence: Synthetic coding sequence
atgaaactcacccggaaaatggtgctcaccagggctaaggcatcagagctgcatagcgtgcggaagttgaattgctggggatctcgactgaccgatatcagcatctgccaggaaatgcccagtctcgaagtgattactttgtctgtaaacagcataagcacgctggagcctgtgagcaggtgtcagcgactgagcgaactgtacctcagacgaaacaggattccctcgctggctgaattgttctatctgaaagggctgcctcgattacgtgtgctgtggctggccgaaaacccttgttgtggtacatcccctcataggtatagaatgaccgtgctgagaacactccccaggctgcagaagctggacaatcaggccgtcacagaggaggaactgagcagagctctgtccgagggcgaggaaatcacagccgcacctgagcgcgaaggcactgggcacggtgggcccaaattatgttgcaccttgagcagtttgtccagcgccgccgaaaccggcagagatcccctggactcagaggaagaggctacttcaggggcgcaagatgagcgtggtctgaaaccaccatctcggggccagtttccatctctttccgctagggatgcctccagttctcacaggggaagaaatgtactgactgccattctgttacttctgcgagaactcgatgcggaagggttggaggccgttcagcagacagtagggagcagattgcaggcactgcgcggggaggaagtacaggagcatgccgagtag

SEQ ID NO: 112261 - DNA, 654 bp, Artificial Sequence
  Description of Artificial Sequence: Synthetic coding sequence
gtcactcaggggccccagggcctgagggcgtcagggagatcttgtgtcggcccctttctatcccaccttggaagggatcgaacccctggggtcctgactgagctccggtgcgtggtgcccgctagactcacagcgctggagcggagtagaaaacctcgagggcgcggacggggccggtatattaccctattacccgtgcccgaggcagacccaattttagaacgggttccacagcctgaattttgctcctgcgtgaactccatctctacactcgagcctgtatcacggtgtcaacgtctttctgaactctacctgaggagaaatagaatcccatctctggccgagttgttctatcttaagggactgccccggctgcgggtgttgtggctggctgaaaacccttgctgtgggacaagtccacataggtacaggatgacagtccttcggacgttgcctagactgcagaaactcgataaccaggctgtaaccgaggaagaactttcaagagcactcagtgagggcgaagaaattaccgcggcacctgagagggaggggactggccacgggggtccgaaactttgttgcactctttcctcactgtcctctgctgccgagactggccgagatccactagatagcgaagaagaagcatag

SEQ ID NO: 112262 - DNA, 1128 bp, Artificial Sequence
  Description of Artificial Sequence: Synthetic coding sequence
atgaagctgacccgtaagatggtgctaacgcgcgctaaagccagcgagctacacagcgtaaggaaactcaattgctggggatctcggctcaccgacatctccatctgtcaggagatgccatccttagaagtgatcaccctgtcagtaaatagcatctccacccttgagccagtgagcagatgccagcgcctgtcggaactctacctgcggagaaatcgcatccccagcctggcggagctgttctacctaaagggactgccccggctgcgagtcctctggctggccgaaaatccctgttgcggaacatctcctcatcgttaccgcatgaccgtgctcaggactcttccccggctccaaaaactggataaccaagctgtcacagaggaagagctgtcccgcgccctgagcgagggtgaggagatcaccgctgcccccgagagggagggcaccggtcacggggggcccaaactgtgctgcactctctcatcactgagcagtgcggctgagacaggacgagatccccttgattcagaggaggaggctacaggagcccaagatgaaaggggactaaaaccaccatcccggggtcagttcccatccctgtctgcacgcgacgcgagtagctctcacagaggcagggtttctggcggcccactgggcgccgcagcggcctctgcccattgtacccattgcaccgagactgtggggagggaacacggcgcgtctcagggtcccgtcgggagagaacacggtgcctcacaaggcctcgaggagctctgtcccaggggttcctgtgtctgtggcagcgtgaatgcccacacccgcgtcacccgagcaccacatggagcggtccttgcacctcagccgcttttgctatcttggtcagtggagtgcggccctggcccctgttgggctgaaggcaatcggtctcatgtggaggaggtcccacacactaggccgcaggccggactcctgtgttccgacagcccatcagtgcctaacgttctgaccgcaatacttctgctgctgcgtgagctggatgcagaaggattggaggccgtgcaacagaccgttggtagtaggctgcaggctctccgcggagaggaagttcaggagcacgcagagtag

SEQ ID NO: 112263 - DNA, 807 bp, Artificial Sequence
  Description of Artificial Sequence: Synthetic coding sequence
atggccgccgtgcgggtactcgtcgcttcacgcctcgccgcggcttcagcgttcacctccctgagccccggaggaaggactccttcccagagagcagctctccatctgtccgtgccacgaccggccgccagggtggcgttggtccttagtggctgcggtgtatatgatggcacagagatccatgaggcgagcgccattttggtccacttatcacgcggaggggctgaggtgcaaatctttgcgcctgacgtcccccagatgcacgttatcgatcacacaaagggtcaaccttcagagggcgaaagccggaatgtgttgacggaatcagcacgaatcgctagaggaaaaattactgatttggccaacctgagcgccgccaatcatgacgccgccatcttccccggtggtttcggtgccgccaagaatttgtccacatttgccgtggatggaaaggattgcaaagttaataaagaagtcgagagggtgttgaaagaattccaccaggctggaaagccaattggcctctgttgtattgccccggtcctggcggcaaaagtactccgaggcgttgaggttactgtggggcacgagcaggaagagggggggaaatggccctatgcaggaaccgccgaggctatcaaagctctgggcgcaaaacattgcgtgaaggaggtcgtagaagcccacgtggatcagaaaaataaggtcgtgacaactcctgcgtttatgtgtgagactgcactgcattatattcacgacggcatcggggccatggttcggaaagtattagaacttacgggcaagtag

SEQ ID NO: 112264 - DNA, 714 bp, Artificial Sequence
  Description of Artificial Sequence: Synthetic coding sequence
atggcggctgtgcgagttctggtcgcctctagactcgccgctgccagcgcgttcacctccctgtcgccagggggtcggacaccatcccagcgcgccgcactccatctgagtgttcccaggccagctgccagagtcgctctggtgctcagcggatgtggcgtctacgatggcactgaaatccatgaggctagcgctatactggtccacctttcccgtgggggagccgaagtgcaaatctttgcccccgatgtgccacagatgcacgtcatcgatcacaccaaggggcaaccatcagaaggggagtccagaaacgttttgaccgagtctgctcggatcgcccgggggaagattacggatcttgccaatcttagcgcggccaaccatgacgcggcaatattccccggcgggttcggtgccgcaaagaaccttctgtgttgcatcgcaccagtgcttgcagctaaggtattgcggggcgttgaagtgacagtgggacacgaacaggaggagggaggaaaatggccgtatgcaggcaccgccgaggctattaaagcactgggcgccaagcactgcgttaaggaggtagtagaggcccacgtggaccagaagaataaagtggtcactactcctgcgttcatgtgcgagactgctctgcattacatccacgacggtatcggcgccatggtccgcaaggtactggagctcacgggtaagtag

SEQ ID NO: 112265 - DNA, 1023 bp, Artificial Sequence
  Description of Artificial Sequence: Synthetic coding sequence
atggccgagggtggcgagctaatgtctagactcctgtcagagaatgctgaccttaaaaaacaggtgagactgctaaaagaaaatcaaatgctgcgcagacttctatcccaaagttgccaagaaggaggaggtcacgatctcctgccccctagggcccacgcctatccagaggcaggcagcccaggatcaggggtacctgacttcggccgctttaccagcgtagccgataccccatcccaattgcagacgtcttcgttggaggacctcctctgcagtcatgcccccctgtcttcagaagacgacacatcaccgggctgcgctgcccccagccaggctcccttcaaagcgttcctgtctccacccgagccccactctcatcgaggaaccgaccgtaagctgtcccctcttttaagccccctgcaggactccctggtggacaagacgctgctggagcctagggaaatggtacgccctaagaaagtgtgcttctctgaaagtagtctgcctacaggcgacaggacccgtcggtcatattatcttaatgaaattcagagtttcgcaggtgccgaaaaggacgcgagagtcgtcggcgagatcgcttttcagcttgataggagaattctggcatacgtttttccaggtgtgaccaggctgtatggctttaccgtggccaacataccggaaaaaatcgagcaaacctcgaccaagtcacttgacggaagcgtcgacgagaggaaactacgagagctaacacaacggtatttagccctctccgctcgattggaaaagctgggctattcgcgcgacgttcaccctgccttttcagaatttctcatcaatacttacggaatcttgaagcagcgcccggatctgcgcgcaaacccactgcactcatctccagctgctttgcggaagctggtgattgatgtggtcccaccaaaattcttaggcgatagcttgctgttgctgaactgcctctgcgagttaagtaaggaagatgggaaacccttgtttgcctggtag

SEQ ID NO: 112266 - DNA, 561 bp, Artificial Sequence
  Description of Artificial Sequence: Synthetic coding sequence
atggtcagacccaagaaagtgtgcttctcggaatctagcctgccaactggtgatagaacacgtcggagctattacttgaacgaaatccagagctttgccggagcggagaaagacgcacgcgtggtaggtgagatcgctttccaattggacagaagaattctggcatatgtttttccgggcgtcacgaggctgtacggttttactgtcgcgaatatccctgagaagattgaacaaactagcacaaaatccctggatggcagtgtggatgagcgcaaattacgagagctgacccaacgctacctggccctaagtgccagactggaaaagctgggctactcacgggatgtccatccagccttttccgagttcctgatcaatacttatggaattttaaagcagaggcctgacttgagggcaaaccctcttcattctagccccgccgccttgagaaagcttgtgattgatgtggtcccacccaagtttcttggtgactcactcctcctgctgaattgcctgtgcgagctctcaaaggaggacggtaagcccctgttcgcctggtag

SEQ ID NO: 112267 - DNA, 438 bp, Artificial Sequence
  Description of Artificial Sequence: Synthetic coding sequence
atggtccaactcattgctcccctggaggtcatgtggaacgaggcagcagacctgaaacccctggcactgtcgagaaggttggaatgcagtggcggcatcatggcccactactcccctgatctcctaggccctgaaatggaatcacgttatttcgctcaggtgggtctcgaacatctggcaagcagcagccctcctgcctttggttttctgaaatgcctggattattccatctctgtgctgtgctccgccaccagcctcgccatgctggaggacaatcctaaagtaagtaaattggctacaggcgactggatgctgacgttgaagcccaaatcgattaccgtccctgtggagattcccagctcacctctagccggacgaccgcgaaggcggcggcggctacggtgcccccatgatcagcattcacaggggacttgttag

SEQ ID NO: 112268 - DNA, 429 bp, Artificial Sequence
  Description of Artificial Sequence: Synthetic coding sequence
atgatctctactgcgagagtccctgcggataaaccggtgagaatagcttttagcttgaacgacgccagcgatgatactcccccggaggatagtattccgttggtttttcccgaattagatcagcagctgcagccactcccaccatgccacgactctgaagaatcaatggaggtatttaagcaacattgccaaatcgcagaggagtaccacgaggtgaagaaagagatcacactgcttgaacagaggaagaaggagctgatagccaaactcgaccaagccgaaaaggaaaaagtcgacgcagccgaattggtcagagaattcgaagctttgactgaggaaaaccgaaccctgaggctcgcgcagagtcagtgcgtggagcagttagaaaaactgagaatccagtaccagaaaaggcagggatcgagctag

SEQ ID NO: 112269 - DNA, 729 bp, Artificial Sequence
  Description of Artificial Sequence: Synthetic coding sequence
atggtgcagctgatcgcaccgctggaagtcatgtggaacgaggcagctgacctgaagcccttagcgctctctcgtcggttggagtgctcaggcgggattatggcgcactacagtcccgacctgctgggacccgaaatggagtctcgctattttgcccaggtagggctggagcacctggcttcaagctctcctcctgcttttggctttctgaagtgtttagactatagcataagcgtgctgtgttctgccactagcctcgcaatgttagaggataatcccaaggtctctaagcttgctacaggggattggatgctgacccttaaacctaagagtatcacagtaccggttgagataccatctagtcctctggatgacacaccgcctgaggactccatacctctggtgtttcccgagctcgatcagcagctccagcctctccctccttgtcacgattcagaagaaagcatggaggtttttaaacagcactgtcagattgcagaggagtaccacgaggtaaaaaaagaaattacactgttggagcagcggaagaaggagctaatcgctaagctggatcaagctgaaaaagagaaggtcgacgctgcggagttggtgagggaattcgaggccctgaccgaagagaacaggactctgaggttggcccagtcacagtgcgtcgagcagttggagaaactgcgtattcaatatcagaagcgccagggatcctcatag

SEQ ID NO: 112270 - DNA, 429 bp, Artificial Sequence
  Description of Artificial Sequence: Synthetic coding sequence
atgatttctaccgcacgcgttcctgcggataaaccggtacggatcgcgttcagcctgaacgacgctagcgacgataccccccccgaagattctatccccttggtgttcccagagctggaccaacagctgcaaccactcccaccttgtcatgattcagaggagagtatggaggtatttaaacagcactgtcagattgctgaggaataccacgaggtgaagaaagagatcacactgctggaacaacggaagaaggagcttatcgcaaaattggatcaggccgagaaggagaaggtggacgcagctgagttggtgagagaattcgaagcgctgacagaagagaatcgaaccctcaggctagcccaaagccagtgtgttgagcagttagagaagctacgcattcagtaccagaaaagacagggtagctcgtag

SEQ ID NO: 112271 - DNA, 429 bp, Artificial Sequence
  Description of Artificial Sequence: Synthetic coding sequence
atgatctccactgcgagagtgccagccgacaaacccgtgcggatcgctttcagtctcaacgacgcttccgatgatactcctcctgaagactctatccccttggtgtttcccgagcttgaccagcaattacagccgttgccaccctgccacgactctgaagagtccatggaagtattcaagcagcattgccaaatcgctgaggagtaccatgaagtgaagaaagaaatcaccctcctggaacaacggaagaaggagctcattgcaaagctcgaccaagcggagaaagagaaggtggatgccgcggagctggtccgagaatttgaggcgctgaccgaagagaacaggacacttcggctggctcagagtcaatgcgtggagcaactggaaaagttaaggatccagtatcaaaaacggcagggcagcagctag

SEQ ID NO: 112272 - DNA, 429 bp, Artificial Sequence
  Description of Artificial Sequence: Synthetic coding sequence
atgatctcgacagctcgggtacccgcggacaagccagtgagaatcgcattctccctgaacgacgcttcagacgacacacctcccgaggactcaattccgctagtgttcccagaactcgaccagcagctacaaccgctgcctccctgccatgatagtgaagaatctatggaggtatttaaacagcattgccaaatcgcagaagagtatcatgaagtgaaaaaagagattacgctgttggagcaacgaaagaaggagctgattgctaagctggatcaggccgagaaggagaaggtggatgccgccgagttggtgcgcgagtttgaggccctcaccgaagaaaacaggaccctgcgactggctcagtctcaatgcgtggagcagctcgaaaaactacggattcagtaccagaaacgacaaggcagctcctag

SEQ ID NO: 112273 - DNA, 429 bp, Artificial Sequence
  Description of Artificial Sequence: Synthetic coding sequence
atgatcagcaccgcgagggtcccagcggacaaacccgtgcgcatcgccttctcattgaatgatgcaagcgatgacacaccgccagaagactccatcccacttgtgttcccagagctcgatcaacagctgcaaccacttcctccctgccatgactctgaagagagtatggaagtgtttaagcagcactgccagatagccgaggaataccatgaggtgaaaaaagaaattacgctactagaacagcggaagaaagagttaatcgcgaagttagatcaggccgagaaggagaaggtagacgccgctgaactggtccgggaatttgaggccttgaccgaagaaaaccggacgctacgtctcgcacagtctcagtgtgtagagcagctggaaaagttgcgtatacagtaccagaagcgccagggaagctcatag

SEQ ID NO: 112274 - DNA, 429 bp, Artificial Sequence
  Description of Artificial Sequence: Synthetic coding sequence
atgatcagcacagcacgtgttcccgcagacaaacccgtgcggattgcctttagtctcaatgatgcctccgacgatacccctcctgaagatagtatcccactggtgttcccggagttggatcagcagttgcagcccctgccaccttgtcacgactccgaggaatcaatggaagtattcaagcagcactgccaaatcgccgaagagtatcacgaggtgaaaaaagagattactctccttgaacagcgcaagaaagaactgatcgcaaagctcgaccaggccgagaaagagaaagtggacgcagccgagttggtcagagagttcgaggctttgaccgaggagaacaggacactgcggctcgcccagagccagtgcgtggaacaattggagaaattgagaatccagtaccagaaaaggcaggggtctagctag

SEQ ID NO: 112275 - DNA, 729 bp, Artificial Sequence
  Description of Artificial Sequence: Synthetic coding sequence
atggtgcagctgatagccccactcgaagtgatgtggaacgaagcagctgacctcaagccactggctctttcacgccgcctcgagtgctccgggggcatcatggctcactattcgcctgacctactgggcccagagatggaatccagatactttgctcaggtcggtttggagcacttagcctctagcagtccccctgcatttggattcttgaagtgtctggattactctatcagcgtgctgtgctccgccactagtctggccatgctggaggataacccgaaagtgtctaagttggctaccggggattggatgctaaccctgaagcctaaatcaattacggtgcctgtagagattccatcttctccccttgatgacacacctcctgaggatagtattcctcttgtttttcccgaacttgaccagcagcttcagccccttccgccttgccacgatagtgaagaatccatggaagtgttcaagcagcactgccagatcgccgaggagtaccatgaggtcaagaaagagattacacttctagaacagaggaaaaaagaactgatcgcaaaactcgatcaggctgagaaggaaaaggtagatgctgccgagctagtgagggaattcgaagcccttactgaagaaaatagaacactgcgtcttgcccaaagccagtgtgtggagcaactggaaaagctgaggatccaataccagaagcgtcaagggagtagctag

SEQ ID NO: 112276 - DNA, 135 bp, Artificial Sequence
  Description of Artificial Sequence: Synthetic coding sequence
atggtccagcttatcgcgcctttggaggtcatgtggaatgaagccgcggacctgaaacccctcgctctttctcggaggcttgagtgcagcggtggaattatggcccactactccccggacctcctgggaccctag

SEQ ID NO: 112277 - DNA, 285 bp, Artificial Sequence
  Description of Artificial Sequence: Synthetic coding sequence
atgatcagcacggccagagtgcctgcagacaagccagtgcggattgcctttagtcttaatgacgctagtgacgacacccctcccgaggacagtatacccctagtctttccagaactggatcaacagctgcagccgctgcctccatgtcacgacagcgaggagtctatggaagtatttaaacaacattgtcagattgcagaggaatatcacgaagtgaagaaagaaatcaccctgttggagcagaggaaaaaggagttaatcgcaaagctcgaccaggcggagtag

SEQ ID NO: 112278 - DNA, 411 bp, Artificial Sequence
  Description of Artificial Sequence: Synthetic coding sequence
atgcttgtgagcagttctagcctcaccccctttccccctgtgcgtacggcagatgacacccccccagaggattccatacccctcgtctttcctgagttggatcagcagctgcagccactgcccccttgtcatgatagtgaggaatccatggaggtgtttaagcaacactgtcagatcgctgaagagtaccacgaggtaaagaaagagattacccttttagagcagcgaaagaaagagttgatcgctaaactggaccaagccgagaaggagaaggttgacgcagcagagctggtgcgagaatttgaagccttgactgaggaaaaccggacgctgcgcctggcacagtctcaatgtgtggagcagttagagaagctccgcatccaataccagaaacgacagggcagtagctag

SEQ ID NO: 112279 - DNA, 786 bp, Artificial Sequence
  Description of Artificial Sequence: Synthetic coding sequence
atggtggtggtggctgccgctccgaatccagccgatggtaccccgaaggtgctgctgctcagcgggcagcccgcgtctgccgcgggggcccccgccggccaggcattgcctttgatggtgccggctcagagaggcgcatctcctgaggccgccagcgggggactgccacaggccagaaagcgtcaaagattaacccatctgtctccagaggagaaggcgctccgccgcaagctaaagaacagagtcgctgctcagaccgctcgggatcggaaaaaggctagaatgtctgaattggagcagcaggtggtagatctcgaagaagagaaccagaaattgctgctggaaaatcagcttctgagagagaagacgcatggactcgtggtggagaatcaagagctgcgccagcgacttggtatggacgccctcgtcgcagaagaagaggccgaggccaagggaaacgaggtacgccctgtggccgggtccgccgagtcggctgccctgagactgagggcccccctgcagcaggtgcaagcccagcttagcccactccagaatatttctccatggatcctggctgtcttgacgctccagattcaaagcctgatatcctgttgggccttttggacgacgtggacccagagttgctcatccaacgctctgccacaaagtctgccagcttggcgcagctcccagcgatctacgcaaaaagacccagtcccttatcagcctcccttcttatgtcagtggggcaggcatcaaccatcctggaaaccactcatgaactag

SEQ ID NO: 112280 - DNA, 528 bp, Artificial Sequence
  Description of Artificial Sequence: Synthetic coding sequence
atgagcagatcttacaacgatgagctgcagttcctggagaagatcaataagaactgctggaggattaagaagggattcgttcccaatatgcaagtggagggcgtgttttatgtgaacgatgccttagagaaactgatgttcgaagagctgagaaatgcttgccggggcggcggagtaggcggctttctccccgcaatgaaacaaatagggaacgtagcggctctgccgggaattgtccacaggtctattgggctccctgatgtgcacagtgggtatggatttgccatcggaaatatggccgccttcgacatgaacgaccctgaagcggtcgtaagccccgggggggtcggcttcgatatcaattgtggagtcaggctgttacgcaccaacctggacgagagcgatgttcaaccagtaaaagagcagctggctcaggctatgttcgaccatatcccagtgggggtcggttccaagggtgacatgatgagggccgttcattgtcccgagcagaacctggacgtgatctag

SEQ ID NO: 112281 - DNA, 2304 bp, Artificial Sequence
  Description of Artificial Sequence: Synthetic coding sequence
atgagtcacgccgttaccatcgaggagccacaggcacagccccaggtgtctcagactagatatagggaaagatcccgtgcagggtcccacataagctctaaccgagcttacgatttcctttacgatccactgtttatcgtgagttcagaaaaagaccatacccaagcgaacattcaggcaacattgattagatcacgtctccgaaaggttccgagatttaagacaatgttctctaatctcattcattacccacgctacagtctctattggtcaaagagtgatccggtgcccccttttatctcccgggagtggaaaggacacaaagaaaaacaccgtgaagccctgcgacaactgacaaccacagatgcgtctttccaaatgccaaaagaagtgtacgaagatccagaagttacgggaaaaaaccgctacaagtatttcgaaagacctttcctgcctttttttcagcagatgccattcaatgttgtgtatgctgtgtccaaagccgaaccctacactttcccccctacctccacaaagcatctgagcatcccaagtaaatccacagtcggtacacagacggactacagagatgcagacgtgcagaccgatccttactcagccgaatacgtggtgtgccaggattctatacctgaactgctgaccctcgctacccttacctgggggcgggggctacccgccgggcaggccgaggtggaaatgatcgaaagggctagagaaaaacgcgcgtgggaggcaagtctacctgctctgagcgacacctcacaattcgagaagcggagaaagatgatgaatgagatggagcgcaaagagtgggcgtttagagagcaggagatcgaaaagctccaagaaatccgcctggaagtgctgaaggagcttttgcgaaaacgcgaggagaaccaaaatgaggtgaacatgaaacacttgaatgccagatggagcaagctccaggaaggcaaggaagccaaaatggcaaaaattcagagaactcacgtttccacgattaggaagcttgttggtaaaagaaagaacattgagggtaaactggaaaggaggaacattattaaggattattccgactacgcaagccaggtctacggccctttatcccgcctggggtgtttccccgataacaactccgaggacttcgttgtgaagaattattatctcaacacatatgaggggctcgtggaactggaatcgtgcctgcccgactttgtcacacagccacaaattcgagcccccaagcccaaggtgattactaccaaagcgggattccttaagcgggcagcccggctggactacgagttagctgaagtgcacaaggcccttttggataaaaagaataaggtgcttgaagttaaaaagccacctagattcttacagaggaatccaattccacagccacgcttgcctactccgactctcgaaatgacgagcaacgaggaagaggagatggagatggcagtgatctatctgcagaagcttctgcgaggacgtgtagtgcagaatatgatgtttgagggcaaagagaagaggttagagcttatccaggaactgagaacctgccatgcccttcaggaggatgagaagctggttaagaaagccgagaaacaggtgacgctggcactgcaaagacaacgtaacctgcacgagcacaaggtctcactagtcgaaaatcatttggccgggctggagggccgagcccttgccgatatgtttgactttctgtcgaaggaattagtgcggcttcaagaggagcgccgcatccatgcctttgttatgttggctgagagacagaggagggtgagggaagctgaggaatctggacgcagacaggtcgagaagcagaggcttcgcgaagaggatgagatctttaaagaagttgttaaggttcatcattcgaccattagttcatatctggaagacattattttaaacaccgaggcgaataccgcagaagagcaagccagggccgagatcgagaaaatggcggaaaagatcaacgacatcgcttatgagatggaatctcgcagaacctatctgcagtctgaagagatagtagccgagttggtgtactcattccttatccccgaagtccagaaatattttgtgaaagaaaaagtacgcaatgctcagagaaagcacattctcgctgcacaccaaataattcactcctacactgagtctatggtgcagaagaagctcacagaaggagagcaggacgaggcgtctaacgccgccatgcttctcgagaaagaaacccagaatgagaataattcatag

SEQ ID NO: 112282 - DNA, 564 bp, Artificial Sequence
  Description of Artificial Sequence: Synthetic coding sequence
atgagccatgctgtgaccatagaagaacctcaggctcagccgcaggtgtcccagacccggtatagagagcgctctcgagctgggagtcacatcagttctaaccgcgcctatgattttctctacgatccactttttattgttagctcggaaaaagaccacacgcaggcaaatattcaggctacattgatccggtcccgcctccggaaggtccctcgcttcaagaccatgttctcaaaccttatccactatccacgctacagtctgtattggtccaaatcagatcccgtgccaccctttattagcagagagtggaaaggacacaaggagaagcatcgggaggctctgagacagcttactacgaccgacgcctcattccagatgccgaaagaagtctatgaggacccagaggtcacaggcaagaataggtacaagggtcagaaccataccctgttcctacttctgctgttatcaacatacccctcgctccagagcttgctctgggcacttcgcctaattatcggaatgctcacctttaaacaaatacatactctgcaaaacatgtag

SEQ ID NO: 112283 - DNA, 717 bp, Artificial Sequence
  Description of Artificial Sequence: Synthetic coding sequence
atgtctcacgcagtgaccatcgaggaaccccaggctcagccccaagtaagccagacccgctatagagagaggtccagggccggatcccacatttcaagtaatcgcgcttacgacttcctctacgacccactgttcatcgtaagctcagagaaagaccacacgcaagcaaatatacaggcgaccctcatcagatctcgccttcgaaaagttccaaggttcaaaaccatgttttccaaccttattcattatccgcggtactcactctattggtcaaaatccgacccagtgcctccttttatttccagagaatggaaaggtcataaggaaaaacatagggaggcgctgcgacaactgaccacaactgacgccagcttccagatgcctaaggaagtatatgaggatcccgaagttaccggcaagaatcgttataaatatttcgaaaggccattcctgcctttcttccaacaaatgccttttaatgtagtgtacgctgtatctaaagccgaaccttatacctttcctcccacatcaaccaagcatctgtccatcccgtcaaagtccaccgtcggtacacagaccgattatcgagacgcagacgttcagaccgatccctacagtgccgagtacgtggtatgccaggattccattcccgaactattaaccctcgcaactctcacgtggggagagctagtgaatttactgacaatcggcagatag

SEQ ID NO: 112284 - DNA, 654 bp, Artificial Sequence
  Description of Artificial Sequence: Synthetic coding sequence
atggacctagctcaaccctcccagcccgtggatgagcttgagctctcagtcctggaacgacagcccgaagagaacacacccctgaacggggctgataaggtgttcccaagtctggatgaggaggtgcctcccgctgaggcgaataaagaatctccctggagctcatgtaacaagaatgtggtgggtcgctgtaagctgtggatgattatcacaagtatattccttggggttatcaccgtgattataatcgggctctgtctggcagctgtcacatacgttgatgaagacgaaaacgaaatcttggaattgtcaagcaacaaaacatttttcattatgcttaagataccagaggaatgcgtggcggaagaggaactgccgcacctcttgactgaaaggctgaccgacgtgtactctacgtccccgtctctgggccgttacttcacttcagtagagatcgtggactttagcggcgagaatgccacagtcacgtacgacctgcaattcggtgtgccttcggatgatgagaacttcatgaagtacatgatgagcgaagagctcgtgctaggcatcctcttacaggacttccgggatcaaaatatacctggctgtgaatcccttggcctggaccctacctcccttttgttgtacgaatag

SEQ ID NO: 112285 - DNA, 444 bp, Artificial Sequence
  Description of Artificial Sequence: Synthetic coding sequence
atggatctcgcgcagccatcccaaccagttgatgagcttgaactcagcgtgcttgaaagacagcctgaggagaacacaccactgaatggggcggataaagtctttccatctctcgacgaggaggtcccccctgccgaagcaaacaaagaaagcccctggagtagttgcaacaagaatgtggtcggcagatgcaagctgtggatgataattacctctatatttctcggcgttataaccgttataattatcggtctttgtctggccgcagtcacttatgtcgatgaggacgagaatgagattctggagctgagttccaataaaacattcttcattatgttaaaaatccctgaggagtgcgtcgctgaagaggagctgccccacctcttgactgaacgggaagttggtttgaagcccaatccagaggccctggtgggctttgaatag

SEQ ID NO: 112286 - DNA, 753 bp, Artificial Sequence
  Description of Artificial Sequence: Synthetic coding sequence
atggatctggcacagcctagccagcctgttgatgagctagaattgtccgtattggaacgtcaaccagaagaaaacaccccactgaatggagccgataaggtctttccctcgcttgatgaggaggtccccccagctgaagcaaataaggagtcaccctggagttcatgtaacaaaaatgtggtgggacgttgcaagttatggatgataatcacgtcaatcttcctgggggtcatcacagtgatcattatcggactgtgcctggctgctgtcacctacgttgacgaggatgagaatgagatattggagctatccagcaataaaacctttttcattatgctaaaaatacccgaagagtgtgtggccgaagaagagctgccccatctcctgactgagcgaaacgaggtgatggaggccgggctgtgtctcaaggcagtgctctaccaggttttggaaatgaagggaattcactctgtgctgcaaaaacggttctgcgggctgatccaaaaacaccagcaacatcagcgtgggggcgattcattcttgtcacgcttctactcattggcactgtcccctgtcaagcaactgccctcaaccgcgtctgccggctcatcactggacaaggggagaaaacctgctcgagttggcgccattggatcagccggcatgtctcattgctggcgctccctggtattctgcctttttctcttttgtttcgtgctgttctttgaaaccggctctcggtcagtggcttag

SEQ ID NO: 112287 - DNA, 1293 bp, Artificial Sequence
  Description of Artificial Sequence: Synthetic coding sequence
atgtggcgcctcgttccaccaaagcttggcaggttgtcaagaagcttgaaactggccgctcttggctcgctattggtgttaatggtgctgcattcccctagcttgctcgccagctggcagcgcaacgaactgaccgatcggcgcttcttgcagttaaataagtgtcctgcatgcttcgggacttcctggtgccggcgctttctcaatggccaggttgtttttgaggcatggggaaggctgcgcttactggacttcctgaatgttaaaaatgtgtattttgcccagtatggcgaaccacgggagggtgggaggcgtcgtgtggtgctcaaacggctcggatcccagcgcgagttagcgcagctggatcagtcaatctgcaaacgcgctacaggccgccctaggtgtgacttgctgcaggccatgccacgtaccgaattcgcacggctgaacggcgatgtgcggctcctgacgcctgaggcagttgaaggctggagcgaccttgtccattgcccaagtcagcgactcctggacagactggtgcggcgatacgctgaaacaaaggatagcggctcattcctgttacggaatcttaaggacagcgagcgaatgcagctgcttttgactctggccttcaaccccgagccacttgtgcttcaaagtttcccctctgacgaaggctggccattcgcaaaatacctgggggcctgtggacgcatggtcgctgtgaactatgtcggggaagagctttggagttatttcaatgccccttgggagaagagagtggacttggcctggcagctgatggagatcgccgaacagctcaccaataacgacttcgaatttgccttgtatctgttggacgtctcatttgacaactttgcagtggggccgcgcgatgggaaggtgataattgttgatgcagagaacgtacttgttgcagacaagcgccttattagacagaataagcccgagaattgggacgtatggtacgaaagtaagttcgatgattgcgataaggaggcttgcctaagcttttccaaagagattctctgtgcccgggcaactgtggaccataattactatgcagtttgtcagaatctgttgagcaggcacgccacatggagaggaacttcaggaggactgctccatgatccaccctctgagattgccaaagatggcaggctggaggccttactcgacgagtgcgcaaatcccaaaaagaggtatggccgtttccaggctgccaaggagctgagagagtacctggctcagctctccaataatgtccggtag

SEQ ID NO: 112288 - DNA, 666 bp, Artificial Sequence
  Description of Artificial Sequence: Synthetic coding sequence
atgaagtccgagaacgggaccgtggtgggctcctttccgtcagatgaaggctggccattcgccaagtatctgggggcttgcggccggatggtcgctgttaactatgtaggcgaggagctctggtcctattttaatgctccatgggagaagcgagtcgatctggcatggcaactgatggaaatcgccgagcagttgaccaataacgattttgaattcgctctgtacctccttgatgtgagctttgacaactttgctgtgggtcctcgtgatggcaaggtcattatcgtggatgctgagaatgtgctggtggcagacaaaaggctcatccggcaaaacaaaccagagaactgggacgtgtggtacgaatcaaaatttgacgactgcgataaagaggcatgtctctcatttagcaaggagatcttatgtgctcgtgcaacagtggaccacaactactacgccgtatgccagaacctgctctcccggcacgccacttggagaggaactagcggcggcctgctgcatgaccccccttctgaaatcgccaaggacggccgactggaagcccttctcgatgagtgcgccaaccccaagaaacggtatggacggttccaggctgcaaaagagctcagagaatacctggctcagctgtccaacaacgtgcggtag

SEQ ID NO: 112289 - DNA, 5079 bp, Artificial Sequence
  Description of Artificial Sequence: Synthetic coding sequence
atgcgaaggcctcccccactggggcctacaacagcatcgggtcccgagggcaatgtccgcaacctacagaagcggcaggcacccgggccgggcgcagcaggtggatgtggcccagaggccggcggatgcagggagaacaagcagaagcgcaggatggttgcccgagctactcccggccggggagaggtagagagcgacaagtcagtggcagcctcaggggccgggaaggcggcgcgtcggcaagtagaaggacgtcgcggtccagtctcccctagcgacagttcagacccgcggggcctggaggccgcaaaggaagctgaacttcctttacagacagagagacacactaaggagaaacgcaaggtgaccgaggcctcttccgacgatcctcagccaggcctagatctggtgcgcaaggaaagcctcacgagttcggagagcttccagaccgtggagtgtctacagtcactaggaaaggaatccatcatcgaaggcatcaagagacggatccggaacaaaaagctgaaatcgttagaaaaccctcctcttaaaatcactgagaatgaggccacacagaatattaaagttgagttccaggacgagctgtataaaaacactcctaagtactcatgtaacattctgtcaccagaggtggaaaacaacagcgttctcaaactgcgagactgtaactgcttcccgcattcgaaaggatgcaatgacgaaaataatctgccctacaagccagatgggggatgcatgcatgtggctgaaaacttcagtaaaaaagaaaatctgagatcgctggccgaaaagtctgacactaatagcatacctcagttactacaaaccgaggagaacgtgatgggggtgaacaaactcctgccagaagagtccgacctctaccagagcaaaacaaacgggctgctctcttgcctgcaacacgaaaaaaataagtattccattgaggagtctagcgtggggaggaagcctagaaagcggatgaaactgtcggagaaggccgacgagacagtcactgagatgaatttcagcaacgaatataacaaaagtgagctcatgctacaggagaaccaaatgattgctgacgggaaagaggcagaaacgaagtcccctttgaatgtcttaagaaaagtctctcacaacaccgtgagcctgatggaccatctgctgagcgtccccgaaaccgtcgagaaggaaacatcctccgaacatcacgttaatgctgtttttcaaaagacaattgaacccctgctcaaggaggagaccgagaacgcttccgagccattaggctatgagagcatggcttcaaaggaagattttaagagcatgaagtcgttcattggcaagagcccaaatgagtaccacatcgagcgacgttcctcccgcgaagatctgcgttcagcaagcgaggagcttaaactaagctgccagagaacgatccctatgaccgggaaacgaacgtggccatattacagctgcgcccgcatttccgcttggtgttggaagaaggccagcctgccggaatcctcttattttttaagagggtcacaggagtcatgtaggcaagttgacgtccccaagcatcagactaatcaaacccatctcactgactctaagctgcttctgcagagttccctgactgaaactaacacagaatcaagttctaaggagaagttagactcaaacagcaactgtctgagctctgtaagtgctgtcgagccaacgctgatggtgataaaagagcccatcatcaaggacgataagaaaattaagagcgaagagttatctaggcggggttctgaggtcatcagtaataccaccgaggatacccaactaacatccgaaacacagtccctgactggcaataaaaaaaaagctcgggggaacctcacgaaattgaatctgacagcgactagtaaagacggtcaggaggctaataattccgctgggaaaaccatccatagaaaagcgtgtatcgcccagcagacgttcattgtccctgacctggtgaaaatcctaaatacaggacgccttaccaatttcaagattccccttttgaagaacaaatcggaaaagaggaaagaggtgaacgcaaaaagctccgagcgagaagcttattccccactggaactgctcgataatctctcaggtgcggacgtgaggcagaaccgaagcaaagagaatgtgtccatgatgatgctgggtcctcagaccttgtccatccggaatagcgtgacacccgtccaggcctcctcagatagtttttacaataaaaaaagctactcaatcagcccgagctttacaaagcaaggtaataacagcaagccgagcaaccatgtgagtgagcccggcaacatcgtgagtaacaaagaagtcgcttctctcaccgtagaaaataatgcttttagctgcgacccaggctacgtcgaaaagtccccgtccttctgttgtaacgaacaggaaaccttccgccccgtctcctcagaggtcagaggcagaaagatcacgaaaaattttagtgaggtggggttccccgatattctgaaagcctatgaagatgatgtgctgctcattgacgtgatccaagacgaccccgatctattcggagtgtccaacgaaggcgagctttccttcaccagcgaggtaccaaagatctctcaagaacccaatgtggctggagaacatcaaagcaccgactccaaatatatggagacacccgtgaaaaaggaaccctcagatgacctccgtgagttacctgtgctggactgtgggtggataaagccggatatctgtgcatctaacagtgcggagagtgagataaagcgcgatccaaaagacgtcaacacatccttgggagaagttgcgaacgaaacatccgagaatgaaacactcggcgacttttctgaacagattaagggtagtgatcttgatgagaagcatcggttcacggacaaagttattacgaaagaagaaaaagagaatatctacgaggtgtgtaagtcaaaagactctcgcaacgccgacttcatggtgggcgaatgtcagttcgctgtgcccgttcccaaaccgttgtgtttgctggtgcctcctctgaacctttctggtaggcaggaggacactatcctgaacacctggatgaatgatttcagattcctggggaagcactcagttctcaaacttcagaaccccgagacttgtgagatctttaagagagaaaagaatgtcggggtattccagaagtccctcggtctgatgatcccctacaaatactgcaagtttcatttcaacacgctccgggggtgcgaacggccactgtgtaaatttgcgcacgtccccgaacagggggacgaaaaggtttgcatggatgtgttcaagaaatatatcaacataaatgagctctgcctgctgcagagggcagtgaacatttttatggagtattaccggaaatttccacctggggtttactttgatctgcaggtccttaacgatctgctgaactcattattgaaacactgcctgctcaaagaagtgtttcagatagttaatctgagtataatggttaagatgttgccaagtctgaaaattctgttaaacatattcgaatatgttgcaaccatgaagctgcgcaatgccgtgcccgccctgatcgatatattctgcaaattagtcgaggctggaatggttctggatccagaacatttcaattacattgtgaaactgttatatcaggtgcaggccagcaagcaggaaattactgcagtgttggagatgaaatctaggctgcagatgcgccgctttaaaaaaaactggaaatgtgatctggattcggcactgaataaactggagcattgcaaggaaaaaggagactggaccaaactgggaaagctctacataaatgttaagatgggctgtgagaaatttgccgattttcaaactttctgcgcatgcatcgcagagactctcaccaaaaactatgaagacgagcggccggatatacctttctgtgaattcgctgaaaccgtgagcaaggatcctcagaacagcaaagtggataagggggtgttagggcggattggtatcagcgctatgtatttctaccacaagcttttgcagtggtccaagggtcggaaggttctcgagaaactgtatgagctgaagatccactttacttccctcaagggactcatcggacctgagaagctcgcatcccgatgccagatcgtcaacgtggcggctgagatatttctgaagtcgggaagtctagacggagctatttgggtgatgcgggagtctgagtggattatcaacactccactgtggccctgcgacagattagatgtgctgaataggcacaacctgctgtgcaccatcgcacacgagatcctggcgaaaagcctgtatagacagacattcgaagtgctccagaatttacccggcttccagaatagccaggagacagttgaggtgtctcagtatagcctgctctttaacaaacttttagggagttgtattgagtcgtccagcctgggtatgtcttcttcagtggctgagtttatgatcagcaaatctatccccattgacttctctttcctacgacgactgataacgagcttgggaagaagccgattatggctgaaagcgagggcacactacaagtccgccttgagcctgggctgttacccacccctcgaaggcaatttgtaccgaaaactgttactaatccccagctacttgtccgagatcgaaatgctgctggcaattgaaatattcatggtgtcaaacgcctctagtattcagagtccaggcacaagtacccagattctccagatcgtgctgaagaggtgcgaggacaaccaatcaagatccaacgatgattatcaggccgccgtggaacggctaatcatggccgcgagaatttctgacccaaagctattcgtcaagcatatgaccgtgaacgttaataaggaacaggtctattcacttgaacattgctcggcgctcaaatggctgaaggagaatatgaagtgggcaggcaaagtttggctgttctctaatcactag

SEQ ID NO: 112290 - DNA, 207 bp, Artificial Sequence
  Description of Artificial Sequence: Synthetic coding sequence
atggtgtactatccagaattgtttgtttgggtgtctcaagagccatttccaaataaagatatggaaggaaggttgccaaaaggcaggctcccggtgccaaaagaggtgaatcgcaagaaaaacgatgaaacgaacgccgccagcctcacccctctcggatcatcggagttgcggtccccccgtatcagttacctacacttcttctag

SEQ ID NO: 112291 - DNA, 207 bp, Artificial Sequence
  Description of Artificial Sequence: Synthetic coding sequence
atggtctattacccagagctctttgtttgggtaagccaggaaccatttcccaataaagacatggagggtaggctgcccaaagggcgcttgcccgtgcctaaggaagtaaacagaaaaaaaaacgatgagacgaacgccgcctcactgactcccctagggtcaagcgaactccgaagcccccgtatctcatacctgcacttcttttag

SEQ ID NO: 112292 - DNA, 339 bp, Artificial Sequence
  Description of Artificial Sequence: Synthetic coding sequence
atgaaaggagtttggaactactcagccctgagtaggagagaagatgaaactaggacccagcgtagccggatgaccgaccgcgtcccgtgttccaagtgttttcaagtccactgccagatcagcgtgctaaactgcgtatactaccctgaattgttcgtctgggtcagccaggaaccattcccaaacaaagacatggaaggaaggctgcctaagggacgtctgccagtgcctaaggaggttaaccggaagaagaatgatgagacgaatgctgccagcctgactcccctgggcagcagcgaactgaggtctcccaggatctcctatctacatttcttctag

SEQ ID NO: 112293 - DNA, 207 bp, Artificial Sequence
  Description of Artificial Sequence: Synthetic coding sequence
atggtgtactaccctgaactgttcgtttgggtgagccaggaaccttttccgaataaagatatggaaggcagactgcctaagggcagactccccgtacctaaagaagttaatcgcaaaaaaaacgatgaaacgaatgccgcctctctgacacccctgggaagttctgagttacgcagcccccggatctcctacctgcacttcttttag

SEQ ID NO: 112294 - DNA, 207 bp, Artificial Sequence
  Description of Artificial Sequence: Synthetic coding sequence
atggtgtactatcctgagctgttcgtgtgggtgtcccaggagcctttccctaacaaggatatggagggtcggttgcctaagggcagactgcccgttcccaaggaagtgaataggaaaaagaatgacgaaacaaacgccgcctctctcacacctctcggatcaagtgagcttagatcgcccaggattagttatttacactttttctag

SEQ ID NO: 112295 - DNA, 207 bp, Artificial Sequence
  Description of Artificial Sequence: Synthetic coding sequence
atggtctattatcctgagctgttcgtgtgggtttcgcaggagccctttcccaacaaggatatggagggcagactgcccaaggggaggctcccagtgcctaaggaagtgaatcggaagaagaatgacgaaactaacgccgcatcactcacgccattaggctcatcagaattgcgcagtccgcgtataagctatctccacttcttctag

SEQ ID NO: 112296 - DNA, 207 bp, Artificial Sequence
  Description of Artificial Sequence: Synthetic coding sequence
atggtttattaccccgagctgttcgtgtgggtgtcccaggagccatttcccaacaaagacatggaaggccgactacccaaaggaagacttcctgtgccgaaggaagtgaatcgaaagaaaaatgacgagaccaatgccgccagtttgacccccctcggttcttcagagcttagatctcccagaatttcctatctccatttcttctag

SEQ ID NO: 112297 - DNA, 207 bp, Artificial Sequence
  Description of Artificial Sequence: Synthetic coding sequence
atggtgtactacccagagctgttcgtatgggttagtcaggaacccttccctaacaaggacatggaagggcggttgcctaagggaaggctccctgtacctaaagaggtgaacagaaagaagaacgacgagaccaacgcagcatctttgacacctttgggctcatccgagctgcgctcaccccgaatctcatatctgcactttttttag

SEQ ID NO: 112298 - DNA, 207 bp, Artificial Sequence
  Description of Artificial Sequence: Synthetic coding sequence
atggtgtactaccccgagctctttgtgtgggtctctcaggagccctttccaaacaaggacatggagggaagactcccaaaaggccgattaccagtaccgaaggaagtgaacagaaaaaaaaatgatgaaacaaatgcagcctccctcacccccctgggctctagcgaattgcgcagcccccggatctcctatctgcacttcttctag

SEQ ID NO: 112299 - DNA, 18 bp, Artificial Sequence
  Description of Artificial Sequence: Synthetic coding sequence
atggtgtactatccctag

SEQ ID NO: 112300 - DNA, 102 bp, Artificial Sequence
  Description of Artificial Sequence: Synthetic coding sequence
atggtgtactacccagaactcttcgtctgggtctctcaggaacctttcccgaataaggatatggaggggcgactccccaagggccggcttccagtgccttag

SEQ ID NO: 112301 - DNA, 207 bp, Artificial Sequence
  Description of Artificial Sequence: Synthetic coding sequence
atggtctactacccggagctgtttgtgtgggtaagccaggagcccttcccgaacaaagacatggagggcaggctgcccaaaggacgtctgccagttccgaaggaggtcaaccgaaagaaaaacgacgaaacaaacgctgcatcacttacccctttgggcagtagcgagcttagatccccccgaatcagttatttacatttcttttag

SEQ ID NO: 112302 - DNA, 207 bp, Artificial Sequence
  Description of Artificial Sequence: Synthetic coding sequence
atggtctattaccctgaactttttgtttgggtgtcacaggagcctttccctaataaggacatggaggggaggctgcccaaggggagactcccagttccaaaagaagttaaccgaaagaagaatgacgagacaaatgccgccagtctcaccccccttggaagttctgagctgaggtctccccgaatctcgtaccttcattttttttag

SEQ ID NO: 112303 - DNA, 198 bp, Artificial Sequence
  Description of Artificial Sequence: Synthetic coding sequence
atggtgtactatcctgaattgttcgtgtgggtgtcccaggagccatttcctaacaaagatatggagggcagactgcccaagggacggctgcccgtccctaaggaggtgaacagaaaaaagaatgacgaaacaaacgcggctagtctcactcctttgggctcttccgagttgcgctctccccgtataagttatttatag

SEQ ID NO: 112304 - DNA, 735 bp, Artificial Sequence
  Description of Artificial Sequence: Synthetic coding sequence
atgcattacggcgccgccacgcatattcagaactcgaggagccatgggctggagacggtacctgggcatcagagattagaacgcggcgcggggggcgagacccccgaattccccgggtgccacagtcccgcaccgcctgaaaattttggcaatgagctcctcccacttagcgccccactgcaaggccttagcgagggcctgtacccgcctggacgaaacaagactttacctgcaggcgttctacgagagggggccgtgcagtttctgcatcgcggcttgtgtaactccaacctctcatccgaggccagcgctcgaccgtctggtacacaggacgagttacactcctctcgcagaaaaaccggccagacccggagagagggcgcccgcaagcatctcgtttgcagctttcggctatatccgttcacagtgcataccgtgagccccggaaactctcatctagctctgtaccaggtgtttaaagccgtcaaattgtgcccaagtgagactagcttctttctttcccgcaaaagcttaaagagttctgacccatggcacccaccaagcctttcccctaactcctggaacaggcaagccgggtttcgagcatggtccagccatctcattagcctgtcactgacctgttctgattcacagtcgcggcgcgtgtcctctagccagcagccacctctccacagcctttcctcacacagacgggctgcacacgtccctgaatag

SEQ ID NO: 112305 - DNA, 480 bp, Artificial Sequence
  Description of Artificial Sequence: Synthetic coding sequence
atgtaccgcagaaaaagtggctggacaggttgcgcaatcacatgcagcccttgcaccgcgatgacacagctgcggaattgcatgcgcctctcgagaagctgttcactgacctgggagacaccccggtggtatatggctggcagagtcgcgacctccacgtcaggctgtcactgctggatgagccggcgagatctgaccccattgccacacccttctgagcccggggtgctcgactgtctaggcccctgccatctgctccctctcttgtctccaggaagcccttgctgggtgctggggctgcacttcagcttgcacccgccatctgcagcctccgcctctcacgcccttacaattacctccttacctcccggactgctgccatttgtgggcgttgagctgaccgcccatccccaagcacttatgggcaggggtttcccctcaggaatgggcgccgcgggccggcacctgtgtttcctttag

SEQ ID NO: 112306 - DNA, 480 bp, Artificial Sequence
  Description of Artificial Sequence: Synthetic coding sequence
atgtacaggcgtaaatcagggtggaccgggtgtgctattacctgctccccctgtactgccatgactcagctgaggaattgcatgcgtttatcacgttcatgttcccttacctgggagacacctcggtggtacatggcgggcagagtcgcgacctctacctccggatgtcattgttggatgtcccggcgagaccttaccccattgccccatccttctgagcccggggtgctggattgtctcgggccttgccacctccttccactcctctccccaggatcaccctgttgggtactcggactgcattttagcttacacccgccgagcgccgcgagtgcttcacacgcccttactattacatcacttccgcctggtctactaccattcgttggcgttgaactgacagctcacccacaggcactgatggggcgcggctttcccagcggtatgggcgctgctggacgacatttatgcttcttgtag

SEQ ID NO: 112307 - DNA, 480 bp, Artificial Sequence
  Description of Artificial Sequence: Synthetic coding sequence
atgtatcgcaggaagtccggatggacaggctgcgctataacttgctcgccctgcacagccatgacacagcttcgcaactgtatgcgcctctcgcgaagctgtagtctgacatgggaaacacctcgctggtatatggctggaagggttgcaacctcaacgtctggatgtcattgttggatgtcccggcgagacctgactcctttaccgcatccttccgagcccggagtattagactgcctgggcccttgtcatttactgcccttgctctcgccaggctcaccctgttgggtgttgggcctccacttctccctgcatcccccctccgccgcctcagcttctcacgctctaaccatcacaagccttccaccgggcctgttgccgtttgtaggagtggagctcactgcccacccccaggctctcatgggccgcggtttccccagcgggatgggagcggccggccgccacttatgcttcctctag

SEQ ID NO: 112308 - DNA, 480 bp, Artificial Sequence
  Description of Artificial Sequence: Synthetic coding sequence
atgtatcgacggaaatccggatggacggggtgcgccatcacatgttccccctgtacagctatgacacagctcagaaactgtatgcgcctgtctcgttcttgcagcctcacatgggagactccacgttggtatatggcaggacgcgtggccaccagtacctctgggtgccactgctggatgtcacgacgggacctcacaccattgccccacccatcagagccgggagtgctggactgccttggaccatgccatctcttaccgctactgagtcctggatctccatgctgggtcttaggtctgcatttttctctgcaccctccctccgccgcatctgcctcacacgcgctgactattacatcacttccaccagggcttctgcctttcgtcggtgtggaactgaccgcccatccccaggcactgatgggccgcggcttccctagcggaatgggtgcggcaggacgtcacttgtgcttcctgtag

SEQ ID NO: 112309 - DNA, 294 bp, Artificial Sequence
  Description of Artificial Sequence: Synthetic coding sequence
atgtcctccgccccagagcctcccactttcaagaaggagccacctaaagaaaaggagtttcagtcccccggcctccggggggttcgcaccacaacattatttcgcgctgtgaatcccgaactctttatcaagcccaataaacccgtcatggccttcggtctggtgaccctctctctgtgcgtggcatacattgggtatctgcatgcaatccaggagaataaaaaggatctctatgaagcgatagattccgaggggcatagctacatgcgccggaagaccagcaaatgggactag

SEQ ID NO: 112310 - DNA, 768 bp, Artificial Sequence
  Description of Artificial Sequence: Synthetic coding sequence
atgacaaagactagcacttgtatctatcacttcctcgttctgtcctggtacacattcctgaattattatatttctcaggagggaaaagacgaggtaaagcctaagattctggcaaacggagcaagatggaagtatatgactctgctgaatctgttgctgcagactattttttatggggtcacctgtctggacgacgttctgaaacggaccaagggcgggaaagacattaagttcctgacagcatttagagatctgctgtttactacattagcgtttcctgtcagcactttcgtctttctggccttctggattctgtttctttacaaccgtgatctgatttaccctaaggttctggacactgttattcctgtatggcttaatcacgccatgcacacatttatcttcccaattacactcgcggaagtggtgttacgcccgcacagctatccatcaaaaaagactggtctcactttactggccgcggccagcatcgcttatatcagcaggatcttgtggctctacttcgagaccgggacttgggtttatcccgtttttgctaagctgtctctccttggactggctgccttcttctctttgagctacgttttcatagcttcaatttatctgttaggggagaagctgaatcactggaaatgggtgagcgtgcagattttgcaaaggtggcggctcgaatcagtaggaatctgcttccagtggcccgattggaaatccccagctaaacaccaactggtgaagaacattaggtag

SEQ ID NO: 112311 - DNA, 510 bp, Artificial Sequence
  Description of Artificial Sequence: Synthetic coding sequence
atgaccaaaaccagcacctgcatctatcacttcctggtgctctcttggtatacgtttctgaactattatatttcacaggaaggaaaggatgaggtcaagcccaagattcttgccaatggagcccgatggaaatatatgactcttctgaacttattgctgcagaccatcttttatggagtcacgtgtctagatgatgtgctcaaaagaactaaaggcggaaaggacattaaattcctgactgccttccgcgatctgcttttcactacacttgcattcccggtgtcaactttcgtcttcctagccttttggatcctgtttttgtacaatagagatttgatctacccaaaagtgttggataccgtcattccagtctggctcaatcacgccatgcacacatttatctttccaatcaccctggctgaagtagttttgcgaccccacagctatccgtctaagaaaactggcctcactttgctagcggccgccagcatcgcttacatctcccgctag

SEQ ID NO: 112312 - DNA, 693 bp, Artificial Sequence
  Description of Artificial Sequence: Synthetic coding sequence
atgacgaagactagcacttgtatctaccatttcctggttctgtcctggtatactttccttaactactacattagccaagaagggaaagatgaagtcaagccaaagatcttggcaaatggagcccgctggaaatacatgaccctcctgaatctgctgctgcagacaattttctacggggtcacatgcctggacgatgtgctgaagcgaactaaggggggcaaggatatcaagttcctgacagccttccgtgaccttttgtttaccaccctggcatttcctgtgagtactttcgtgttccttgcattctggatcctgttcctctataacagagacctgatctaccccaaggtccttgataccgtaataccagtgtggctcaatcacgcgatgcatacttttatattccctatcactctggcagaggtggtgctgcgccctcatagctaccccagcaaaaagacaggcctcactctgttggccgccgccagcattgcttacattagccgcattctctggctttacttcgagacagggacatgggtgtatcctgtatttgcgaaattgtcgctcctaggcctcgctgccttttttagcctttcttatgtgttcattgcgtctatttacctgctaggagaaaaactcaatcactggaagtggggcgatatgagacaacctcgaaaaaaacgaaagtag

SEQ ID NO: 112313 - DNA, 507 bp, Artificial Sequence
  Description of Artificial Sequence: Synthetic coding sequence
atgactaaaacttcaacctgcatctatcactttctggtgttgtcatggtacacctttctgaattactatataagtcaggagggcaaggacgaagtcaagcccaagattctggctaacggggctcgctggaaatacatgacactactcaacctcctcctccagacaatcttttacggtgtgacttgtcttgatgacgttctgaagcgcactaaaggcgggaaggatatcaaattcctgactgccttccgcgacttattgtttacaactttggcctttcctgtttctacattcgttttcctggctttttggattcttttcctatataaccgagacctgatttatccgaaggtcctggatacagtcatcccagtgtggctgaatcacgccatgcacacgtttatttttcctatcacactggctgaagtagtcttgaggccacacagctacccgagcaaaaaaaccggactgaccctgctagcggccgcttccattgcctatatcagttag

SEQ ID NO: 112314 - DNA, 675 bp, Artificial Sequence
  Description of Artificial Sequence: Synthetic coding sequence
atgagttttgtggaggacgttactataggcgaaggtgaaagcatcccgccggatacgcaattcgtgaaaacctggagaattcaaaactctggcgcagaggcatggcctcctggggtgtgcctgaagtacgtgggtggggaccaattcggccacgttaacatggtgatggtgcggtcactggaacctcaagaaatagctgatgtatccgttcagatgtgtagcccttccagagcaggcatgtatcagggacagtggcgcatgtgtactgcgaccgggctgtattatggcgacgtgatctgggtgatcctctctgtggaggttggggggcttttgggagtgacacagcaactgtctagctttgaaacagagtttaacactcaacctcatagaaaagtggaaggcaactttaatccatttgcgtctccccaaaagaatcggcagagcgatgagaacaatttgaaggatcccggcggaagtgagttcgactcgatcagtaagaatacgtgggccccagctcccgacacttgggctccagcccctgaccagaccgagcaggatcagaatagactgagccaaaattcagtcaacctgtcccccagttcccacgccaacaatctttccgttgtgacttactcgaaaggattgcacggaccttacccctttgggcagtcctag

SEQ ID NO: 112315 - DNA, 897 bp, Artificial Sequence
  Description of Artificial Sequence: Synthetic coding sequence
atggagggtatggacgttgatcttgaccccgaacttatgcaaaaattctcctgtctgggcactactgataaggacgtgttgatctccgagtttcagaggttactggggttccagctgaaccccgccgggtgcgccttctttctcgacatgacgaattggaacctgcaggctgcgattggggcatactacgacttcgaaagccccaacatcagcgtgccttcgatgagcttcgttgaggacgtgacaattggcgagggagagtccatccctccagacacacagttcgtcaaaacatggcggattcaaaacagcggtgctgaagcgtggcctcctggagtttgcctgaaatacgtcgggggtgatcaatttggccatgtgaatatggtcatggtccggtctctagaaccccaagagatcgccgacgttagcgtccaaatgtgttccccgtcccgggctgggatgtaccaggggcaatggcgaatgtgtactgctacaggcctttactatggtgatgtgatatgggttattctctccgtggaagtcggaggtctgctgggcgtgacccaacaactgtcaagctttgagaccgaattcaacacgcagcctcataggaaggtggaaggaaactttaatccttttgcctccccccaaaaaaacaggcagagcgacgaaaacaaccttaaggacccaggcggaagcgaattcgacagcataagcaagaacacctgggcccctgcccctgacacttgggccccagcgcctgaccagacagagcaggaccagaaccggctttctcagaattcagtcaacctgagtccaagctctcacgctaacaatctgagcgtggttacttactctaagggtctgcatggaccctatccttttggccagagttag

SEQ ID NO: 112316 - DNA, 699 bp, Artificial Sequence
  Description of Artificial Sequence: Synthetic coding sequence
atggagggaatggatgtcgatcttgaccccgagctaatgcagaagttcagttgcctcggtacaacagataaggatgtgctgattagcgagttccagagactgctgggtttccagttaaatccggctgggtgtgccttctttcttgatatgaccaactggaatcttcaagccgccatcggggcctattatgacttcgaatcacccaatattagcgtgccgagtatgagctttgtggaagatgtcactattggcgagggtgagtccattcccccggatactcagttcgtcaaaacatggagaattcagaattcagacgtcatatgggttatcttgagtgtcgaagtgggcgggctgctcggtgtcacacagcagctgagcagcttcgaaactgagtttaatacacagcctcacaggaaggtagaaggcaacttcaacccatttgccagtccccagaagaaccgccagagtgatgaaaacaacctcaaggaccccggagggagtgagttcgactctatcagcaagaacacctgggccccggcgcccgatacttgggcgcccgcgcccgaccaaaccgagcaggaccagaacagattgtctcagaactcagtgaacctaagccctagcagtcacgccaataacctgtcggtggttacatattctaaaggactacacggaccttatcccttcggccaaagctag

SEQ ID NO: 112317 - DNA, 126 bp, Artificial Sequence
  Description of Artificial Sequence: Synthetic coding sequence
atgggagacatatacatcacatggattggctgtggtcttgaccgcctccagtgggaaaacgtgagtgccatgattgaagaggtcttcgaggctactgacattaagattacagtgtacactctctag

SEQ ID NO: 112318 - DNA, 459 bp, Artificial Sequence
  Description of Artificial Sequence: Synthetic coding sequence
atggcctcgagcctgaatgaagatccagaaggatctagaattacttatgtcaagggcgatctgtttgcctgtcccaagactgactcactggcccactgcatttccgaggactgccgtatgggcgctggaatcgctgtgttattcaaaaagaaattcgggggtgttcaggagttgttaaaccagcaaaaaaaatctggtgaagtggcggttttgaaaagggatgggcgttacatttattacctgattactaaaaagcgggcctcccacaaaccaacctacgagaatctgcaaaagagcctggaggcaatgaagagccactgtctgaagaatggcgtcaccgacctgtcgatgccccggatcggatgcggactggatcgtctacagtgggagaatgtgagcgccatgatagaggaagtttttgaggcaaccgatatcaagattaccgtttacaccctctag

SEQ ID NO: 112319 - DNA, 459 bp, Artificial Sequence
  Description of Artificial Sequence: Synthetic coding sequence
atggcaagttcgttgaacgaggatcccgagggctcacgtattacctacgtgaagggcgacttatttgcttgcccaaaaaccgatagccttgcccactgtatctcagaggattgccgaatgggggctgggattgctgtccttttcaaaaaaaaatttggaggcgtgcaggagctgttgaaccaacagaagaagagtggagaagtcgctgtcttaaaaagggacggccgctatatctactacctgattacaaaaaaaagggcatctcataaacctacgtacgaaaacttgcagaaaagtctcgaggccatgaaatcacattgtcttaaaaatggagttacagacttgagtatgccacggataggttgcgggctggatagactgcagtgggagaatgtttctgccatgattgaggaagttttcgaagcaactgatataaagattactgtttatactctgtag

SEQ ID NO: 112320 - DNA, 459 bp, Artificial Sequence
  Description of Artificial Sequence: Synthetic coding sequence
atggctagctcgctgaacgaagaccctgaaggatctcgaatcacgtacgtgaaaggagatctcttcgcctgccccaagactgactctctggcccattgcatcagtgaagactgcagaatgggagccgggatagctgttctttttaaaaagaaattcggcggcgtccaagagctgctgaaccagcagaagaagtctggcgaggtcgcagtactcaagcgcgatgggcgctacatatattacctcattacgaagaagagggcaagccataagcctacttacgaaaaccttcaaaaatctctggaagccatgaaatctcactgcctgaagaacggggtaacagatctctcaatgcccaggatcggatgcggacttgaccggctacaatgggagaacgtgtctgcgatgattgaggaagtgtttgaggctaccgatattaaaataactgtgtatacactgtag

SEQ ID NO: 112321 - DNA, 459 bp, Artificial Sequence
  Description of Artificial Sequence: Synthetic coding sequence
atggccagtagcttgaacgaggaccccgaaggctcacggataacctatgtgaaaggggaccttttcgcttgcccaaagacagactccctggcccactgcatttctgaggattgtcggatgggagccggcatcgctgtcctattcaaaaaaaagttcggcggagtacaggagctcttaaatcagcagaaaaaaagcggagaggttgctgtacttaaacgagatggccgatatatttattacctcataactaaaaaaagagcctcccataaacccacgtatgaaaacctgcaaaagtcacttgaagccatgaagtcacattgtctgaagaacggtgtaaccgacctcagtatgccacgcattggctgcgggctggatcgcctgcagtgggagaatgtcagcgcgatgatcgaggaggtgtttgaggctaccgatattaagatcactgtgtataccttgtag

SEQ ID NO: 112322 - DNA, 396 bp, Artificial Sequence
  Description of Artificial Sequence: Synthetic coding sequence
atggcctcatctctgaatgaggatccagaaggctcacgtatcacttatgtcaagggcgacctgtttgcttgcccgaaaactgattctctggctcattgtatcagcgaggactgcaggatgggcgccggtatagccgttctgttcaaaaagaagtttggcggcgtgcaggaattgcttaatcagcaaaaaaagagcggcgaagtggctgtcctcaaaagagacggaaggtacatttactaccttataactaaaaaacgagcaagtcataagcctacctatgagaacttacaaaagtccctggaagcaatgaagtctcattgtcttaaaaacggagtgaccgacctttccatgccccggatcgggtgcggattggatcgcctgcagtgggagaactag

SEQ ID NO: 112323 - DNA, 1371 bp, Artificial Sequence
  Description of Artificial Sequence: Synthetic coding sequence
atggaagctctgggtgacctggagggcccgagagcacctggaggggacgatccagctggtagcgctggggaaacccccggctggctctctcgggagcaagttttcgtgctaatctcagccgctagcgtgaatttaggctctatgatgtgttacagcatactgggccccttttttcccaaagaagccgagaaaaaaggcgcatccaatactatcatcggcatgatcttcggttgcttcgccctgttcgagcttctggcatcactggtcttcggcaactacttggtccacataggagctaaattcatgttcgtggccggcatgttcgtgtcaggtggcgttacaatcctgttcggcgtgctggatagggtccccgatggcccagtttttatcgcaatgtgcttcctggtgcgagtcatggatgccgtgagtttcgcagctgctatgactgcgagcagttcaattctggctaaggcttttccaaataacgtggccaccgtgttaggctccttggaaactttttcaggcctgggattgatcctgggtccccccgtaggcggtttcctgtaccaatcatttggctatgaggtgcccttcattgtccttgggtgcgttgtgctactcatggtaccattgaacatgtatatcctacccaactacgagtctgacccaggagaacatagtttctggaaactcatcgcgttgcccaaggtcggacttatcgccttcgtcatcaactctctttcttcttgttttggttttttagacccaaccctgtcattattcgttctggagaaattcaacctccctgcaggatacgtcggtttagtgtttttaggcatggcccttagttatgcaatctcctcccctctgtttggcctgctctcagataaacgcccacctctgcgcaaatggctgttggttttcggaaatcttattacagcgggttgctatatgcttcttgggcccgtccctatcctccacattaagtcacagctgtggctgctggttctcatcttagtcgtgtcaggcctgagtgccggaatgtccataatccccacgtttccagagattttatcatgtgcgcacgagaatgggttcgaagagggccttagcacactgggcctcgtgagcggtcttttcagtgcaatgtggagtattggggccttcatgggacccaccctcggaggatttttatacgagaagattggatttgagtgggctgccgcgattcagggtctatgggcccttatttcagggttggctatggggctcttctacctccttgagtactctcgcaggaaaaggtccaaaagtcagaatatactcagcacggaggaggagcgcactactctgcttcctaatgagacatag

SEQ ID NO: 112324 - DNA, 324 bp, Artificial Sequence
  Description of Artificial Sequence: Synthetic coding sequence
atggaagctctaggggacctagaagggccgcgagcaccgggcggagatgaccccgctggcagcgccggggagacccctggatggttgtcacgtgagcaagtgttcgtgttgattagcgcggccagtgtgaacctgggatccatgatgtgttattccatcctgggccctttcttccctaaggaagccgaaaagaagggcgcttctaataccattataggaatgattttcggttttcagtttacttcctggatctgcggcaccagcatccccggctacggcaccgttctgtgccacctatttaccacaatttggagcccaaaatag

SEQ ID NO: 112325 - DNA, 324 bp, Artificial Sequence
  Description of Artificial Sequence: Synthetic coding sequence
atggaggcgcttggcgatttggaaggcccccgcgcccccggcggcgacgacccggccggttccgccggcgaaacacccggctggctgtctcgcgaacaggtgttcgtgctcatttccgccgccagcgtaaatttagggtcaatgatgtgctattcgatcctaggaccatttttccccaaggaggctgagaagaaaggtgcaagcaacaccattataggaatgatcttcggatttcaatttacatcctggatctgcggcacatccatccctggatacggcaccgtgctgtgccacctgttcaccacgatttggagtccgaagtag

SEQ ID NO: 112326 - DNA, 711 bp, Artificial Sequence
  Description of Artificial Sequence: Synthetic coding sequence
atgttctgttttgtgcgcgttgcaggcatcctgggcatctggaaactgtcttgcacctattggtctaagatctacgtgtgctcacggaatgtttgcctcagacgctcatacaacagcttgtggggttccttggagaccttcagtggcctggggcttatcctggggcccccagtcggagggtttctgtaccagagctttggctacgaggtgccctttatcgtgctcggttgtgtggtgctgctgatggttcctctgaacatgtacattctgcctaattacgagagcgatccaggcgagcatagcttttggaagttgatagccctgccaaaggtcggactgatcgcattcgtcatcaattcactgtcaagctgtttcgggttcctggatcctaccctgtcattattcgtactcgagaagttcaacctccctgctgggtatgtgggcctggtatttctaggcatggcgctgtcttacgctatatcttccccactgtttggtctcctatcagataaacggccgcctcttagaaaatggctacttgtgttcgggaatctcatcactgcgggatgctatatgctccttggcccagtccctatcctgcacatcaagtcccagctctggctgctggttctcatccttgtagtcagtggtcttagcgcaggcatgtcgattatcccaacctttcccgagatcctgtcttgtgctcagtag

SEQ ID NO: 112327 - DNA, 654 bp, Artificial Sequence
  Description of Artificial Sequence: Synthetic coding sequence
atggatgccccacgtcggttccctaccctggtgcagctgatgcagccaaaagccatgcctgtagaggtcctgggccacctgcccaagagattctcatggttccactccgagtttctgaagaaccctaaagtcgtcagattagaggtctggctagtggaaaagattttcggtagagggggcgaaagaatcccgcacgtccagggcatgtctcagatccttattcacgtcaaccgcctggatcctaacggcgaagcggaaattctagtatttggaagaccttcctaccaggaagacactataaagatgattatgaacttagcggactaccataggcagctgcaggccaagggaagcggtaaggcactcgcacaggacgtggcaacacagaaagctgaaacccagagaagtagtattgaagtgcgggaagccggcactcagcgaagcgttgaggtcagggaagctggcacgcagaggagtgttgaagttcaggaagtggggacacagggatcccccgtggaagtacaggaggctggaacacagcaaagtctacaggccgcaaataagtccgggacgcaaagatccccggaagccgccagcaaagctgtgactcagagatttcgcgaagacgcaagagatcctgtaactaggctctag

SEQ ID NO: 112328 - DNA, 1416 bp, Artificial Sequence
  Description of Artificial Sequence: Synthetic coding sequence
atgcctagcgaaacccacgcgatgctcgcgacactagcccgcgttgcagccctccgccgtacctgcttgttctccggaagagggggaggaagggggctgtggactggcaggccgcaaagcgatatgaataacatcaaacccctggagggggttaaaatactggatttgacccgagtcctggccggaccttttgcaacaatgaacctcggagacctgggggccgaagtgattaaagtggagagaccaggggcaggggatgatacaagaacgtggggacccccttttgtcggaacggaatccacttactatctcagtgtgaaccgaaataaaaaaagtatcgctgtgaacatcaaagatcccaaaggcgttaagattattaaggaacttgctgctgtgtgcgacgtgtttgtcgaaaattatgtgcccgggaagctgtctgccatggggctcgggtacgaggatatcgacgagatcgcccctcacattatctattgttctattacgggctacggtcagaccgggcccatatcacagcgggcaggctacgatgctgtggctagcgccgtgtctggcctaatgcatattactgggcccgaaaatggcgatcccgtacgccccggggttgcgatgactgatctagctacaggcctgtacgcgtatggtgctatcatggccgggctgatccagaaatataaaacaggtaaggggctgttcatcgactgtaacctcttgagttcacaggttgcctgcctgtctcacatcgcagcaaattatctcataggacagaaggaggcgaagaggtggggtactgcacacggatctatagtcccctaccaggctttcaagaccaaggatggttatattgttgtcggcgccgggaacaatcagcagttcgccactgtgtgcaaaattctggatctcccagagctgatagataattctaagtacaagactaatcatctccgggtgcacaaccggaaggagctcatcaagatcctatcagagcgttttgaagaagaactgacgagcaaatggctctatctttttgagggaagcggagtcccttatgggccaattaacaatatgaagaacgtgttcgcagaacctcaaaatgccgtttctggattccagtctttgctccattcattggcccacggaccgtttttacatttgcagggtagtgctcgggtgcttcacaatggacttgtgatggagatggagcaccctacagtcgggaaaatatccgtgcccggacccgcagtccggtactccaaattcaaaatgagcgaagcccggccccctccacttctgggccagcacacaactcacatcctgaaagaggtactgaggtacgacgaccgggctatcggagagctactatctgctggggtggtggatcagcacgagactcactag

SEQ ID NO: 112329 - DNA, 1338 bp, Artificial Sequence
  Description of Artificial Sequence: Synthetic coding sequence
atgcctagcgaaacgcatgccatgctcgctactctcgcccgggttgccgctttacggcggacgtgtcttttctctggcagaggtggagggcgggggctctggaccggaaggcctcagagcgacatgaacaacataaagccgctcgaaggcgtcaagatattggacctaactagggttctggccgggccttttgctactatgaatcttggcgacctgggagccgaagtcatcaaggttgaacgtcctggggctggcgatgatacgcgaacttggggaccaccttttgttggcaccgaatcaacatactatttatccgtgaatagaaacaaaaaaagtatcgcagtgaacatcaaggaccctaaaggcgtgaaaataataaaagagctggctgccgtgtgcgacgtgtttgttgagaattacgtcccaggcaagctcagcgctatgggcctgggttacgaagatatcgacgaaatagctccacacataatctactgctctatcactggatacggccaaacgggtcccatcagccagagagcggggtacgacgctgtggcgtcagccgtatccggtctgatgcatatcacaggccccgaaaacggtgacccagtccgccctggagtggctatgacggatctggccacaggcttgtacgcctacggcgctataatggctggattaatccagaagtacaagaccggcaaggggctctttatcgattgcaacctcctttcctcacaggtggcctgcctgtctcatattgctgcaaattacctgatcggacagaaggaggccaagcgatgggggacagcacacggctccatagttccctatcaagcgttcaagaccaaggacggatacatcgtggtgggcgccggtaacaaccagcagtttgcaaccgtgtgtaagatcctcgacctcccagagctgattgacaattctaaatacaaaacaaaccatttaagggtgcataacagaaaagagctcattaaaatattaagtgagagattcgaggaggaactgacttccaaatggctgtatctgttcgagggaagtggcgtgccgtacggtcctatcaacaatatgaaaaatgtgttcgcagaacctcaggtcttgcataatggtctcgtgatggagatggaacacccaactgtcggcaaaatttcagtgcccggaccagccgtccggtactcaaaatttaagatgtcagaagcacgcccacctcctttgctgggacagcatacaacacacatcctaaaagaggtgctccggtatgacgatcgcgcgattggtgagctcctttccgcgggcgtagtcgatcagcacgagacacactag

SEQ ID NO: 112330 - DNA, 609 bp, Artificial Sequence
  Description of Artificial Sequence: Synthetic coding sequence
atgctggccacactcgcgagagtggctgccctacgccggacttgcttgttttcaggcaggggcggcggccggggtctttggacaggcagaccccagagcgacatgaataatatcaagcccttggagggagtcaagatccttgacctgacgagggttctggcaggtccttttgccacaatgaatttgggagacctcggggcagaagtcataaaagttgagcggccaggagccggcgacgatacgcgtacgtggggccctccatttgttgggaccgagtctacctactacctgtccgtgaatcggaacaagaaatcgattgcggtcaacatcaaagaccccaaaggcgtcaagattatcaaagagctagctgcggtttgcgacgtgttcgtggagaattacgtcccagggaaactcagtgccatgggtctgggctatgaagatatcgacgagatagccccacacatcatttattgttctattaccgagaaaggcttcagccacgtggcgcaggacggtctcgatctgcagacatcaagcaaccttcctgcgttggttagtcagtccgccggcatcacaggaatgagtcaccgtgcttggcccactagctag

SEQ ID NO: 112331 - DNA, 1194 bp, Artificial Sequence
  Description of Artificial Sequence: Synthetic coding sequence
atgccctcagaaactcacgccatgctggccactctggcccgcgtggctgcactcagacgaacctgtctgttcagcgggcgcggaggaggacgggggctctggacaggcagaccacaatctgatatgaacaacattaagcctcttgaaggtgtgaagattctcgatctgactagggtgctggccgggcccttcgctactatgaacctgggcgatctgggtgccgaggtaatcaaggtcgagagaccgggagcaggggacgataccagaacatggggacccccatttgtgggcacggaaagtacctattatctatcagtgaaccgaaacaagaaatctattgcagtgaatatcaaagatccgaaaggggtgaagatcatcaaagaactcgccgctgtgtgtgatgtctttgtggagaactacgttcccgggaagctgtcggcaatggggctcggctatgaggatatcgacgagattgctccccatatcatctactgctccattaccggatacggccagaccggccccatatcacagagggccggttacgatgctgtagcttccgcagtgagtgggttgatgcatattacaggacctgaggtggcatgcctcagccacatcgccgctaattatctgatcgggcagaaggaggcgaagagatggggaacagcgcatggcagcattgtgccttaccaagccttcaaaactaaagacggatatatagttgtgggggctggaaataaccagcagttcgctaccgtctgtaaaatactggacttaccagaactgatcgataacagcaagtataagaccaaccatttaagggtccacaatcggaaagagttaattaagatccttagtgaaagattcgaagaggaattgacgagcaaatggttgtatcttttcgaagggagcggggtgccgtatgggcctataaacaatatgaaaaacgtgttcgcagaacctcaagtgctccacaacggcctcgtaatggagatggagcatccgacagttggcaaaatcagcgtccctggacccgctgtgagatattctaagtttaagatgtcggaggccaggcctccacccctattgggacagcataccacgcatatcctcaaggaagttctgagatatgatgatagggcgatcggggagctgctctcagctggagttgtggatcagcatgaaacgcattag

SEQ ID NO: 112332 - DNA, 540 bp, Artificial Sequence
  Description of Artificial Sequence: Synthetic coding sequence
atgcaacgccagaattttaggccgccaacccccccttatcccggacccgggggcgggggatggggctccgggagttccttccgggggacccccggcgggggcggccctcgcccgccgtcacctcgggacggatacggcagtccccatcacaccccaccttacggcccccggtcccgcccctacggatcaagtcatagtcctaggcacggagggtcgttcccaggaggcaggtttggctccccgtctcctggcggatatccaggtagttacagtaggagtccagctggctctcaacagcagtttggatacagcccaggacagcagcagacacacccccagggaagcccccgcacatccactccctttggttctggccgggtccgggaaaagcgaatgagtaatgaactcgagaactacttcaagccatccatgctcgaggacccatgggccggcctggaaccagtctcagtggtggacatctcacagcagtacagtaacacccaaacattcacaggcaagaaggggcgttatttctgctag

SEQ ID NO: 112333 - DNA, 480 bp, Artificial Sequence
  Description of Artificial Sequence: Synthetic coding sequence
atgaaaatcgtggacgagagggagaaaaacctggacgacaaggcctaccggaatattaaagagctcgaaaactatgcggaaaacactcagtcttcactgctgtatctgaccctggagatcttgggtatcaaggatttgcacgcagaccacgcggcatcccatatcggcaaagctcagggaatcgttacatgcctgagagcaacaccttaccacggaagccggaggaaggttttcctgcctatggatatctgtatgttgcatggtgtgagtcaggaggacttcctgaggagaaatcaggacaaaaacgtccgggatgtgatctacgacattgcctcccaggcccatctgcacctgaaacacgcccggtccttccacaagacagtgcctgttaaggcctttcccgccttcctccaaactgagattaaggacgccgatactcagggggtatgtctcgcccagcccgcaagtttgggcaaatag

SEQ ID NO: 112334 - DNA, 1002 bp, Artificial Sequence
  Description of Artificial Sequence: Synthetic coding sequence
atggccgccagtgctcacggatccgtttggggcccactcaggctcgggattcctgggctgtgctgccggcgtcctcctctggggctctatgcccggatgagacggctgccaggtccggaggtctccggaagatccgtggctgccgccagcggacctggcgcgtggggcaccgaccactattgtctagaattattacgcaagcgagactatgaggggtacctgtgcagcctcctcttgcctgctgagtctcgctcttctgtattcgctctgagagccttcaatgtggagttggcacaagttaaagatagtgtgtccgagaagaccattggcctgatgcggatgcagttttggaagaagacagtcgaggatatttactgcgacaatcctccccaccagccggtcgcgatcgagctctggaaagctgtcaaaagacacaatctcaccaaacgttggctgatgaaaatagtggatgaacgagaaaagaatttagacgataaggcttaccgcaatatcaaggagctagaaaattatgccgaaaacacccaaagttccctgctctatctgaccctggaaattctgggtattaaagacttacacgctgaccatgctgcctcccacatcggcaaggcacagggaatcgtaacctgcctgcgggcgaccccttaccatggctctagaaggaaagtctttctgccaatggacatttgcatgctccacggcgtctctcaggaagactttctgcgtagaaaccaagataaaaatgtgagggacgtgatttatgacatcgctagccaggcgcatttacacctgaagcacgcccggtcattccacaaaaccgttcccgtcaaggccttccctgcgttccttcagactgtttcactggaagacttccttaaaaaaatccagagagtggatttcgacatatttcacccaagtttgcagcagaagaacacactgttgccactatacctgtacatccagtcctggcggaagacctattag

SEQ ID NO: 112335 - DNA, 846 bp, Artificial Sequence
  Description of Artificial Sequence: Synthetic coding sequence
atgcctatcagcataagtcacagctcctggctagtgcaaaggaagagggactatgagggttacctgtgctctcttctgttgcctgcggagtcacggagctctgtgtttgcgctgcgggcgttcaatgtggaactcgctcaagtgaaggattcagtctcggaaaagacaatcgggctgatgaggatgcagttttggaaaaagactgtcgaggatatctactgcgataatccacctcatcaacctgttgctatcgagctgtggaaagccgttaaacggcataatctcaccaaacggtggctaatgaagatcgtagatgagcgtgagaaaaacctggacgacaaagcttaccgcaacatcaaggagttggaaaattatgctgagaatacacagtctagcttgctgtatctgaccctggaaatcctgggcatcaaggatctgcacgccgaccacgccgcttcccacatcggcaaggcacagggaatagttacgtgtctcagggcaactccttaccacggctccaggcgcaaggttttcctccctatggatatttgtatgctgcacggagtttctcaggaagatttccttcgccgaaaccaggataaaaatgtcagagacgtgatatatgatatcgcctctcaggcccatcttcatctgaaacacgctcgctctttccacaagaccgtgcccgttaaggctttccccgccttcctgcagaccgtctctctggaagacttcctcaaaaaaattcagcgagttgattttgatatcttccatccgtccctccagcaaaagaataccctgctccctctctacctatacatccaaagttggaggaagacctactag

SEQ ID NO: 112336 - DNA, 321 bp, Artificial Sequence
  Description of Artificial Sequence: Synthetic coding sequence
atgaaggctaaacgttcacaccaggccgtgattatgagcacaagtctacgagtgtccccgtctatccacggataccattttgacaccgcgtctcgaaaaaaggctgtgggcaatatattcgagaacacagaccaggaatcactggaaagattgtttagaaactccggggacaagaaagctgaagagagggcgaagatcatttttgcaattgatcaagatgtagaggagaagaccagggctcttatggccctcaaaaagcgaaccaaggataaattattccagttcctgaagctcagaaaatactctattaaggtgcactag

SEQ ID NO: 112337 - DNA, 1185 bp, Artificial Sequence
  Description of Artificial Sequence: Synthetic coding sequence
atggccggagccgcgatggctgagagagggagagtgcctccgccagctcctgccccttccactgaaggacttccccgagcctttctccagtccctgagaaccctgtttgacatcctggacgacaggcgtcgaggctgtgtccacctgcgtgaaatcgagtcaaggtggcagggaacagatgcccgcgagttacctagaggagtactcgaaggactgcggcaggttgcccccgcatctggttatctaaccttcgaaaggtttgtcgctgggctgcggacgagccttctcagcgctgacgggggcccaagagaccctaccagagccccagcacgacctggtgatcagccaccaccacccccacagaggctggtgtttgcccccgccgacgaacctcggacagttctcgagcgaaagccgctaccccttggcgtacgggcaccgctggctgggccctctgcagccgcacggagccctgaacagctctgcgctccagctgaagctgcgccatgccccgccgaacctgaaaggtctcagagtgctgcccttgagccgtcaagcagtgcggatgctggcgctgtggcatgtagagccctggaggccgattctggcgacgctaggcgagccccacgtgccagaggggaaagaaggcgccacactatcgccagcggggtggactgcggccttctgaagcagatgaaggagctggaacaggaaaaagaggtgctactgcaaggccttgagatgatggctcgcgggagagactggtatcaacagcagcttcagagggtccaggaaaggcagcgcagactcggccagtcgcgcgcctccgctgactttggggccgcaggttccccccgtcctctggggcgccttctcccaaaggtgcaggaagtggctcgttgcttgggagaacttctagctgcagcttgtgcgagccgcgccctgcctccctccagctctgggccaccgtgtcctgctctgacctcaactagtccgcctgtgtggcaacagcaaaccatcctgatgctgaaggagcaaaaccggctgctgacacaggaggtgactgagaagtcagaacgcataacacagctagaacaagaaaagtcagctctgattaagcaattattcgaagcccgggctctgtcccagcaggatggcggcccactagactctacttttatttag

SEQ ID NO: 112338 - DNA, 1035 bp, Artificial Sequence
  Description of Artificial Sequence: Synthetic coding sequence
atgcgcagaccaagacagggcggtgggggcgctggggggagtgccgccgctagagctcgagcggggggattaggaggcggaagcgttccagcgagagcccggggagcgcccgctgcagcaagggcagcctggcttagagatctgtgtgcacgcatggcaagaccacctagacaacatcctggagtttgggcatctctgttgctcctactgctaaccggccctgccgcgtgtgcagccagtcccgcggacgatggtgccggtcctggggggcggggaccacgaggtcgggctagaggagatactggggcagacgaggcagtcccaaggcacgacagttcttatggtacgttcgccggtgagttttatgacctacgctacctctctgaagagggctatccgtttccaaccgccccaccagtggacccgttcgccaaaatcaaagtggatgactgtgggaagacgaaaggctgctttaggtacggcaagcccggctgtaatgccgagacttgtgattatttcctgtcataccggatgataggcgccgatgttgagttcgaactgtctgcagacacagacgggtgggtggccgtgggtttttcatccgataaaaagatggggggggacgatgtgatggcttgtgtccatgatgacaacgggcgggtgcgaattcagcatttctataacgtcggccagtgggccaaagaaatacaacggaaccccgccagagacgaagaaggcgtctttgaaaataatagggttacttgtagatttaaacggcccgtgaatgtgccaagagatgagactatcgtcgacctgcatctcagctggtattacttgtttgcctggggtcccgcaatacagggttctatcacgcgccatgacatagacagcccaccggccagcgagcgtgtcgtgtccatctacaagtatgaggatatttttatgcccagtgccgcctaccagactttctcaagtcccttttgcttgctcctgatcgtcgccctgactttttatttactgatgggcactccatag

SEQ ID NO: 112339 - DNA, 393 bp, Artificial Sequence
  Description of Artificial Sequence: Synthetic coding sequence
atgtcatcctccgggggtgcccccggcgcatctgcaagttcagcccccccggcacaggaagagggtatgacctggtggtatcgatggctgtgccgtctctctggggttttgggggcagtttcttgcgctatcagcggactgttcaactgtatcaccattcaccccttgaatattgcagccggcgtatggatgatgatggccgtggtgccaatcgtgatcagtctcacgctcacgacacttctaggaaatgcgattgccttcgccacaggggtgctatacgggttgtctgcactcggcaagaaaggggacgccatatcttacgctcgaattcagcagcagcggcagcaagcggatgaagagaagctagccgaaactctggagggcgagctctag

SEQ ID NO: 112340 - DNA, 519 bp, Artificial Sequence
  Description of Artificial Sequence: Synthetic coding sequence
atgtctagtagtggcggggcccctggcgcgtccgccagtagtgccccacccgcccaggaagaaggcatgacttggtggtaccgctggctgtgcagactgtcaggcgtgttaggagctgtgagctgcgccatctcaggactgttcaattgtattacaattcatccgttgaacatagccgcgggggtctggatgatcatgaatgccttcattctattgttgtgcgaggccccgttttgctgtcagtttattgagtttgcgaatacggttgctgagaaagttgataggctgcgctcctggcaaaaggccgtcttttattgcggtatggcggtggtcccaatcgtgatctctctgactttaactaccctccttggcaatgcgatcgcgttcgctaccggagttctctatgggctctctgccttggggaaaaagggagatgccatctcttatgcacgcatacagcaacagcgacagcaggccgacgaagagaaactagcggagactctggagggcgaattgtag

SEQ ID NO: 112341 - DNA, 345 bp, Artificial Sequence
  Description of Artificial Sequence: Synthetic coding sequence
atgctcaccgcggcggggtccacggctgaattgtcagcctgtgcgattagcggcctgtttaattgcattactatacacccgttaaatattgcagcaggagtatggatgattatgaatgcctttattctgcttctctgcgaagcaccattttgctgccagttcatcgaattcgctaataccgtggccgagaaagtcgacaggctgcgcagttggcagaaagccgtgttttattgtgggatggccgtggttccaattgtgatatcgctgactcttacaacgctgctgggcaatgccatcgcattcgctacgggggtcttgtatggcctgagcgccctgggcaagtag

SEQ ID NO: 112342 - DNA, 489 bp, Artificial Sequence
  Description of Artificial Sequence: Synthetic coding sequence
atgagctctagtgctccaccagcgcaagaagagggaatgacatggtggtaccggtggctttgtaggctctcgggagtgttaggcgctgtttcctgcgccatcagtggcctgtttaattgtattactattcatccactgaatatcgccgctggcgtatggatgatcatgaatgctttcattttgctgttgtgcgaggcaccattctgttgccagtttatagagttcgctaataccgtcgccgaaaaggtcgaccgtttaaggtcttggcagaaggctgttttctactgtggcatggccgtggtgcctatcgtaatctcattaacactcactactcttctgggaaatgcgattgcttttgccactggcgtgctgtatggactctccgccctgggaaaaaaaggtgacgcgatatcatatgcaagaattcagcaacaaagacagcaggccgacgaggagaaactcgccgagacactggagggggagctctag

SEQ ID NO: 112343 - DNA, 702 bp, Artificial Sequence
  Description of Artificial Sequence: Synthetic coding sequence
atgagctccagtggaggtgcacccggtgcgagtgcctcatctgcccccccggctcaggaggagggcatgacctggtggtatcggtggctctgccgtctctccggtgtcttgggcgcagttagttgcgccatctccggactgtttaattgcataactatacatcccctgaatattgctgcgggcgtctggatgataatgaatgcttttattttactactgtgtgaagcgcctttctgctgccaatttatcgagtttgctaacacggtcgcagagaaagtcgacagactccggtcatggcaaaaggcagttttctattgcgggatggccgtcgtgccgatcgtgatttctctgaccctgaccacactgttgggcaacgccatcgcattcgccactggagttttgtacggcctgtccgctctcggtaaaaaggcccaaacggaagctggaagcttcgcagcccagcatccgagggaaccaggaccattttcagaaggcacgcggcaggccttcgcaactcctgccgtggttagtggtgaaatccgcatgccagccggggccatgaggagccccatgcccggatcgagctccaggggctctaggaggatgcgtcggagcagcagacgtccttggcggggttcctgcgaagggctgggtgcccccccctcactaagccctttactggctctttgtggtagcaagtag

SEQ ID NO: 112344 - DNA, 576 bp, Artificial Sequence
  Description of Artificial Sequence: Synthetic coding sequence
atgtcaagctccgggggtgcaccgggagcatctgcgtcaagtgcaccccctgcacaggaggaggggatgacttggtggtatcgctggctctgtcgcctgtccggtgtgcttggagccgtaagctgcgccattagcgggttgtttaattgtattactatacacccactgaatatcgccgcaggtgtttggatgatgatggctgtggtcccaatagtcatttctctaacactcacaacactgctaggcaacgccattgcattcgctaccggcgttctgtatgggctttccgccctgggtaaaaaagcccagacagaggccggatcctttgcagctcagcatccccgggagccaggtcctttcagcgagggaacaaggcaggctttcgcaactcctgcggtcgtgtccggggaaatcaggatgccagccggcgctatgagaagccccatgcctggtagttcttctcggggctcaagacggatgaggcggagtagtcgtagaccatggcgcggctcatgcgagggccttggcgcccctcccagcttgtcaccccttctggccttatgcgggtccaaatag

SEQ ID NO: 112345 - DNA, 669 bp, Artificial Sequence
  Description of Artificial Sequence: Synthetic coding sequence
atgagtactctgtgtccaccccccagtcctgctgtcgctaaaacagagattgcgctgagtggaaagtctcctctgctggcagccacatttgcatattgggataatatcctgggacctcgcgttcggcacatttgggcccccaaaaccgagcaggttttgctctccgacggagaaatcacgtttctcgcaaaccataccctgaacggcgagattcttaggaacgccgagtctggtgccatcgatgtaaaatttttcgtgctgtcagaaaagggtgtgatcattgtgagcttgatctttgacggaaattggaatggtgaccggtccacatacgggctcagtattatcctgcctcaaactgagctgagcttttacttaccactacacagagtgtgcgtagatagactgacacacatcatccgcaaaggtcggatatggatgcataaggagcggcaggaaaacgtacagaaaataattcttgaaggcacggaacgcatggaggatcaaggccaatcaatcattccaatgcttactggggaagttatccccgtgatggagctcctctcaagtatgaaatctcattccgtgcccgaggagatcgatatcgcagacacagtcctcaatgatgatgacatcggagactcatgccatgagggatttcttctcaagtag

SEQ ID NO: 112346 - DNA, 669 bp, Artificial Sequence
  Description of Artificial Sequence: Synthetic coding sequence
atgtccaccctttgccccccccccagccccgcagtagcgaagacggagattgccctatcagggaaatcacccctgttggcggctacgtttgcctattgggacaacattttgggcccccgggtcagacacatctgggctccgaagaccgagcaggtgttactgagtgatggcgaaatcaccttcttggcgaaccacacactgaacggcgaaattcttagaaacgccgagagcggtgctatcgacgtaaaattctttgtcctatccgaaaaaggcgtgataatagtatctttgattttcgacggcaattggaatggcgatcggtcaacctacggcctctctattatcctgccccagacagagcttagcttctacctgcccctgcatcgcgtctgtgtggatcggctaacacacattatcaggaaaggccgaatctggatgcataaagaacgccaagaaaacgtgcagaagatcattctggaagggaccgagcgcatggaggaccagggccagtcaatcatccccatgctgacaggagaggtgatccctgtgatggagttattgtcttctatgaagagtcattccgtaccagaggaaattgacatcgccgatacagtgctgaatgacgacgacattggggactcatgccacgagggcttcctcctcaagtag

SEQ ID NO: 112347 - DNA, 1446 bp, Artificial Sequence
  Description of Artificial Sequence: Synthetic coding sequence
atgtcgaccctctgccctccgccctcacctgctgtggctaagacggagatcgccttgtcaggaaagtcacccctcctcgcagccacctttgcttactgggataacattctggggccaagagtgaggcacatttgggctccaaaaactgaacaggttctcctgagtgacggggagatcacatttttagccaatcatacattaaatggagagatactaagaaacgcggaatctggcgccattgatgttaagttcttcgttttgtctgagaaaggagtgatcatagtgtccctgatcttcgacgggaattggaatggcgatcggagtacttacgggcttagcatcatcctgccacagaccgaactgtccttctacctcccactgcaccgggtgtgcgtcgaccggctgacacacattatcagaaaaggcagaatctggatgcacaaggagagacaggaaaatgtgcagaaaatcatcttagagggaaccgaaaggatggaagaccagggacaaagcattattcccatgctgaccggagaagttattcccgtgatggaactgttatcttctatgaagtcgcattctgtgcctgaggaaatcgacatagccgacacggttttaaatgacgacgatataggggactcttgccacgaaggctttctgttgaatgcgatcagttcccacttgcaaacatgcggttgttcggttgtggtcggttcttccgccgagaaagttaataagatcgttcggaccctctgtctgttccttactccagcagagcgtaagtgttccaggctttgcgaggccgaatctagctttaagtacgaaagcggcctttttgtgcagggtttattgaaagatagcacggggagcttcgttttgccatttagacaagtgatgtacgcgccatatcccacgacacatatcgacgttgacgtgaataccgtcaagcaaatgcccccctgccacgaacatatttacaatcagcgtcgttacatgcgttccgagctgactgccttttggagggccacttcggaggaggacatggcccaagacacaattatctacacagatgaatctttcacccccgatctgaatattttccaggacgttttacatagggacacccttgtgaaagccttcctggatcaggtgttccaactcaaacccgggctcagcctgcgcagcacttttctggctcagttcctgctggtcctgcacaggaaagccctgacacttattaaatatatcgaggatgacactcaaaagggcaaaaagcctttcaagtcactaaggaacctaaagatcgacctggaccttacagcggagggggacttgaatatcataatggcactggctgagaagatcaaacccggattgcactcattcatcttcggcagacccttttacacctccgtccaggagcgggatgtgctgatgaccttctag

SEQ ID NO: 112348 - DNA, 168 bp, Artificial Sequence
  Description of Artificial Sequence: Synthetic coding sequence
atgcaaaaccagagcagcacaaatcatcctggcgccagcatgcttatgcacatccacctggatacaagctctttaaagacgctgcacttgggaaccctgttttttttattttatctcgcacttacgcagaacgaggagaatatttgcgacggaaaggtgaccctctag

SEQ ID NO: 112349 - DNA, 225 bp, Artificial Sequence
  Description of Artificial Sequence: Synthetic coding sequence
atgcagaatcagtcttctaccaatcatcccggggccagcatagccctcagccgcccttcattgaacaaagacttcagggaccacgctgagcaacagcacatcgccgcccagcagaaggccgccctgcagcacgcccatgcgcattcctcaggctatttcattactcaggatagcgcattcgggaacctaattctccctgtcctcccccgtttggatccggaatag

SEQ ID NO: 112350 - DNA, 168 bp, Artificial Sequence
  Description of Artificial Sequence: Synthetic coding sequence
atgcaaaatcagagctctaccaatcacccaggagcctccatgttaatgcacatccatctggacaccagttctttaaaaaccctccatctggggaccttgttctttctgttctaccttgcccttacacagaatgaggagaacatctgtgacggcaaagtaacgctgtag

SEQ ID NO: 112351 - DNA, 315 bp, Artificial Sequence
  Description of Artificial Sequence: Synthetic coding sequence
atggccgcgaacagtagcggacagggctttcaaaacaaaaatagggtggccattttggcagaattagataaggagaagaggaagttgctcatgcagaatcaatcctccaccaaccacccgggcgcctcaatcgccctatcccggccttccctcaataaggactttcgcgatcacgctgaacagcagcacatagcggcccagcagaaggctgccttgcagcatgcccatgcacactcgtcaggctacttcatcacccaggactccgcttttggtaatctcatactcccagtgcttcctagacttgatcccgaatag

SEQ ID NO: 112352 - DNA, 2190 bp, Artificial Sequence
  Description of Artificial Sequence: Synthetic coding sequence
atgttctccgctctgaagaagctggttggctccgaccaggctcctggcagggacaagaatatccccgcggggctacagtctatgaatcaggccctgcagcggcgttttgccaagggcgtgcagtacaacatgaaaattgtgatcaggggcgaccgtaacacaggtaaaactgccctgtggcatagactgcagggtcgtccctttgtagaagaatacatccctacccaggagattcaggtgaccagtattcactggagttacaaaaccacagatgatattgtcaaggtggaggtttgggacgtggtagataagggtaagtgcaagaaaagaggagacggcctgaagatggagaacgaccctcaggaggcggagagtgagatggctttggatgccgaattccttgacgtatataagaattgtaatggcgtagtcatgatgtttgatataacaaagcagtggaccttcaattatatacttcgtgagctgccaaaggtgcctacgcacgtgccagtctgtgtgctggggaactatcgtgatatgggcgaacaccgcgtaattttgcctgacgatgtgcgtgacttcattgacaatttggaccggccccctggatccagctactttaggtatgccgagtcttcgatgaaaaacagttttggcttaaagtatctgcacaagttctttaatataccctttctgcaactgcagcgggaaaccctcttaaggcagctggagaccaatcaactggacatggacgctaccctggaagagctctctgtccagcaggagacagaagatcagaactatggcatcttcttggagatgatggaggcaaggtctcgtgggcacgcttcccccctggccgcgaatggacagtcgccttctccaggctcacagagccccgtagtgcctgcaggagctgtgtcaacaggttctagcagcccaggcacccctcaacctgccccacaactgcctctgaacgccgctccaccttcaagcgttcccccagtgcccccatccgaagcactcccacccccagcatgtcctagcgcccccgcaccacgacggtcaattatttcacgcttgttcggaacctctccggcgaccgaggcagctcctcctccgccggagccggtccccgccgccgaggggcctgcgaccgtccagtctgtggaagattttgttccagacgatcggctggaccggtccttcctggaggacacaactcccgcccgagacgaaaagaaggtgggagcaaaagccgcacagcaggattctgactctgatggggaggcattaggggggaaccccatggtggcaggcttccaggacgacgtggacttagaagatcagccccgcggcagtcctccccttcccgccgggcctgtaccatcgcaggatattacccttagcagcgaagaggaggctgaagtcgccgcccccaccaaaggacccgccccagctcctcagcagtgttctgagccagagaccaaatggtcaagtattcctgcttcgaagccgagaagagggacggctcctactcgcacggctgcccctccttggcccgggggcgtgtcagtaagaaccggccccgagaagcgcagttcgacccgcccccccgccgaaatggaaccgggaaagggcgagcaggcttcaagctccgagagtgatccggaaggacccattgcagcccagatgctgagttttgtgatggatgacccagactttgaatctgaaggaagcgatacacaacgccgagccgatgacttccctgtgagggacgatccatctgatgtgaccgacgaggacgaagggcccgctgagcctccccccccaccaaaactccccttacccgcattccgactgaagaacgactctgacttgttcggattaggtcttgaggaggcaggccccaaagaatccagcgaggagggcaaagaagggaagacgccctctaaagaaaaaaagaagaagaagaaaaaagggaaagaggaagaggaaaaagccgccaaaaagaaaagtaagcataaaaagagtaaggacaaggaagaaggaaaagaggagcgcagacgccgtcagcagcgcccacccagatctagggagaggactgctgccgacgaactggaggcgttcctgggtgggggagcccccggcggccggcacccgggtggcggcgattacgaggagctgtag

SEQ ID NO: 112353 - DNA, 1563 bp, Artificial Sequence
  Description of Artificial Sequence: Synthetic coding sequence
atgttcagcgcgctgaagaagctggtgggcagtgatcaggcccccggccgcgataaaaacatccctgccggactacaaagcatgaatcaggctttacagagacgattcgcaaagggggtgcagtataacatgaaaatcgtgatccgaggagaccgcaatactggaaaaaccgcactctggcatcgtttacagggaagacctttcgtcgaggagtatatccctactcaagaaatccaggtgaccagcattcactggagctacaaaacaactgatgacatcgtgaaggtggaagtctgggatgtggtggataaggggaagtgtaaaaagaggggcgatggtctgaaaatggaaaatgatccccaggaagcagaatccgagatggcgctggacgctgaatttctggacgtttataaaaattgtaacggcgttgtcatgatgtttgacataaccaagcagtggacgttcaactatatcctgagggaactgccgaaagtccctactcacgtccccgtgtgcgtccttggaaattatcgggacatgggtgagcatagggtaatactgccagacgacgtgcgtgacttcatcgataatttggatcgcccgcccggttcttcctatttccgctacgccgagtccagtatgaagaactcattcgggctgaagtatctgcacaaattctttaatatacccttcctgcagctgcagcgggagacgctgctccggcagcttgagaccaaccagctggacatggatgccacattagaggagttatccgttcagcaggagaccgaagaccagaattacggtatatttcttgaaatgatggaagcgagaagtcgcggtcacgcatctcccttggcagcaaatgggcagtctccatctccaggctcacaatcgcccgtcgtgccagccggtgctgtgagtaccggttcctcaagccctggcaccccccagcctgcaccccagctccccctgaatgcggccccgcccagtagcgtcccccctgtccccccaagcgaggctctgccaccaccagcttgcccctctgctcctgccccccgcagaagcataataagccggcctcccccctggggctggcgcctgagaggagccctcggaagaagagggcagtggcccccttggggcggaggacgggcctgtcactgtttaggcagacacctgccgctgtaccaccgcttatgccgatgccccgttgccgcagtctgcgcttctgagctggaagaggctggccactggtggtctccgggctgggcgctgcaggtactgggcctccaggcgcagtgcgagcccgccttgcaggagggccgagggcagctggctagtgcccggctgggtgggcaccctgggccacttggcgccgaacctcccgtgtttctgagagacgtgacagaggctcaggagggacccgtccgcgtatgcctgcagcggttgggccgcgggaggctcgccgtgggatgcgctctgccccgccatctcctagcactgagagctcatcttggtcctcaacacgcttacggatccgcatctgggagagaaccctag

SEQ ID NO: 112354 - DNA, 2193 bp, Artificial Sequence
  Description of Artificial Sequence: Synthetic coding sequence
atgtttagtgccctgaagaaactagttggctccgatcaggcacccggacgcgacaaaaacattccagccggcctacagtccatgaatcaggccctgcagcgaagattcgctaagggggttcagtataacatgaagattgtgattagaggcgaccggaataccgggaagactgccctttggcatagactacagggaagaccattcgtcgaggagtatattcccacacaggaaatccaggtaacatccattcattggtcatataaaaccacagacgatatagtgaaagtagaggtgtgggatgttgtcgacaaggggaagtgcaagaagcgcggcgacgggctgaagatggagaatgatccccaagaggctgagtcagagatggccttagacgcagaatttctcgacgtgtataagaattgcaatggagtggtgatgatgtttgacattaccaagcaatggacctttaactacatcttgagggagttacctaaggtaccaacccatgtccctgtctgtgtgctgggtaattatagagacatgggagaacacagagtcattttgccagatgacgtcagggatttcatcgataatctggactcccgacccccaggctcatcatacttcaggtatgccgagagctcaatgaaaaactcatttggattgaagtatttgcacaagttcttcaacatacctttcctgcagctgcagagggaaacgttgcttagacagctcgaaaccaatcagctcgatatggatgctacgctggaggagttatcagtgcagcaggagacagaggaccagaattacggcatcttcctggagatgatggaggcccggtctcgcggccacgcctcacctcttgcagccaatgggcaatccccttctcctgggtctcagtctccagtcgtgcctgctggtgctgtgtcaacaggatccagttctcctggcaccccacaaccagccccccaactccccctgaacgctgcacctccctcctcagtacctcccgtgccaccctctgaagcacttccgcccccagcctgcccaagcgcgcccgctccaaggcggagcatcatctcccgactgttcgggacatcccctgcgacagaagccgctccccccccaccagaaccagtccccgcggctgaagggccagccacagtacagtccgtagaggacttcgtgccggacgaccgtctagataggagttttctggaggataccacccctgcaagggacgagaagaaggtgggcgccaaggcagctcagcaggacagtgactcagacggggaagctctaggtggtaatccaatggtagccggctttcaggatgacgtcgacctcgaggaccagccacgcggctccccacccctgcctgctgggccggtgccctctcaggacattaccctgtcatccgaggaggaggccgaggtggccgctcctactaaaggccccgcacctgccccccaacaatgcagcgagccggagaccaaatggtcttctatccccgcatctaaaccgcgccgggggacagcaccgaccaggaccgccgctcctccttggccgggtggtgtgtcagttcgaaccggcccggaaaagaggagtagcactaggcccccagccgagatggaacctggcaagggggagcaggcgagcagctccgaatctgatcccgaaggtcctatagccgcccagatgctgtctttcgtgatggacgatcctgactttgagagcgagggatctgatacccaaagaagagcagacgactttcctgtgagagacgacccgagcgatgtcacagatgaggacgaaggacccgccgaacctcctccaccaccaaagttgccactacccgcctttcgactcaagaatgattcagacctgtttggcctcggactggaagaagccggcccaaaggagtcatctgaggaaggtaaagaggggaaaaccccatcaaaggagaagaagaagaagaaaaagaaggggaaggaagaagaggaaaaggccgcaaagaagaaaagcaagcacaagaagagcaaggacaaggaggaaggcaaggaggaacggcggaggcgccaacaacggcctcctcgctcccgcgagaggacggcggccgacgaactggaggcatttctcggcggcggggcccccggcggccgccatccgggagggggggactacgaagaattatag

SEQ ID NO: 112355 - DNA, 945 bp, Artificial Sequence
  Description of Artificial Sequence: Synthetic coding sequence
atgtttagtgccctaaagaaactcgtgggctcggaccaggcacctggccgcgacaagaacattccggctggactgcagagtatgaatcaggctttgcagagaaggtttgcaaaaggcgttcaatacaatatgaaaatcgtgattaggggtgatagaaatactggaaaaactgccctctggcatcggctccagggccggccattcgtggaagaatatatccccacacaggagatccaggtcacttccattcactggagctataaaactaccgatgatattgtgaaagtcgaggtctgggacgtggtcgacaaggggaaatgcaagaaacggggggacggcctgaaaatggagaacgacccccaggaggctgagtctgagatggctctggacgccgaattcctggatgtttacaaaaactgtaatggcgtggtcatgatgtttgatattacaaagcagtggaccttcaactatattttgcgagagcttccaaaggtgccaacccacgtaccagtgtgtgtgctgggaaattatcgcgacatgggggagcaccgcgttatcttgcccgacgacgtgagagactttatcgacaacttagacagaccacctggctccagttactttagatatgctgagtcgtcaatgaagaacagttttggactcaaatatctgcacaaattttttaatattccctttctgcagttgcagaaagatgttagacttgcacaggaaaggggatgcgctgtcgtgcttgtttctgaggaagttcgtatgccggcaggctgggactgttgttggggacggttgggttggaaggaggggggctcccagacctgcccggtaccagctcttttaggacggccgcttctgccagccgagccaagtccacaccattgggtggactatagccttgaatcctcccccttgctctcatgctctatcccctag

SEQ ID NO: 112356 - DNA, 1566 bp, Artificial Sequence
  Description of Artificial Sequence: Synthetic coding sequence
atgttcagtgcactgaaaaagctcgtcgggtccgatcaggctccgggacgggacaagaatatccctgctggcctccagagcatgaaccaggctttgcagcggaggtttgctaagggtgtccaatacaacatgaagattgtgattagaggggacagaaacactggcaagacagccctgtggcaccggctccagggtcggcctttcgtcgaggagtacattccaactcaagagatccaggtcacaagcatccattggtcctacaagaccacggatgatatagtcaaagtggaagtttgggacgtcgttgacaaggggaagtgcaaaaagcggggcgatggcttaaagatggagaacgatccacaggaggcagagagtgagatggccctggatgctgaatttttggatgtatacaagaactgcaacggcgtggtcatgatgttcgatataacgaaacaatggacctttaactatatcctgcgcgagctcccaaaagtgcctacccacgtccccgtgtgcgttctcgggaactacagggatatgggggagcaccgcgtgattctacccgatgacgtgagagacttcattgataatctagacagcagaccgccgggaagcagctacttcaggtatgccgagagcagcatgaaaaacagcttcgggctgaaatatctgcataagtttttcaatattccttttctccaactgcagcgcgagaccttactgagacagctggagacaaaccagctcgacatggacgcgaccctggaggagctgtccgtccagcaggagaccgaagaccaaaattacggcatcttcctggagatgatggaggccaggtcaagggggcacgcttccccattggccgcgaacgggcaatctccaagccctggaagccagagtcctgttgttcctgccggggccgttagcacaggctccagctcaccaggcaccccacagcccgcacctcagctccccctcaatgctgcgcctccttcttcagtgcccccagtgcccccaagtgaggcactacctcctcccgcctgcccatctgccccagcgcctcgccggagcattatcagccggcctcctccgtggggctggagactccgcggcgccctgggacgccgaggccagtggccaccctggggcggcggtagggcctgccattgcctggggcgacatctccccctttaccatcgcttatgccgctgccccgtcgcagctgtgtgtgctagtgagctggaagaggcggggcactggtggtcgccaggctgggctttacaggtgcttgggctgcaagcccagtgcgagcctgccttgcaggagggacgtggtcaactggctagcgcccgcctggggggccatcctggtcctttaggggccgaaccacccgtgttcctgcgcgacgtcaccgaggcacaagagggcccggtccgcgtatgcctacaaaggttgggtcgtggccgcttggccgttggctgtgcactccctagacatctccttgctctcagggcccaccttggtcctcagcacgcatatggcagcgcatcagggcgtgaaccttag

SEQ ID NO: 112357 - DNA, 1845 bp, Artificial Sequence
  Description of Artificial Sequence: Synthetic coding sequence
atggaaaacgatccgcaggaggcagagtccgagatggctctggatgcagaattcctggatgtctacaaaaattgcaatggtgttgtgatgatgtttgacatcaccaagcagtggacttttaattatatcttgagagagctccccaaagtacctacgcacgttccagtgtgtgtgctgggcaactacagagacatgggcgagcacagagttatacttccagacgatgtgagagactttatcgacaacctagaccgtccgcccggttcgtcttatttcaggtacgcagagtcctcaatgaagaacagctttggcctgaaatatctgcacaaatttttcaacatcccttttctacaactgcagcgtgagaccctgttgaggcaacttgaaaccaatcagctagacatggacgccacactcgaggaattgtccgtgcagcaggaaactgaggaccagaactacgggattttcctcgaaatgatggaggccaggtcccgaggtcacgccagtccactcgccgccaacgggcaaagcccctcccctggatcccagagcccggttgttcccgctggagccgtaagtaccggctcgagcagtcccggaacccctcagccagctccacaactccctctgaacgccgcgccaccaagtagtgtgcccccagttccacctagtgaggccctgcccccgcccgcatgcccgtctgcacctgcaccccggcgctcgattatcagtcgactgttcgggactagtccagctacagaggccgcacccccacctcctgaacctgtcccggccgctgagggccccgcgacggtccagtcggtggaagatttcgttccagacgatcgattggaccggtctttcttagaggacactacacctgcccgagacgaaaagaaagttggggctaaggcggcccaacaggactcagactcggatggggaagccctcgggggcaatccaatggtggccgggttccaggacgacgtcgaccttgaggaccagccacgcggtagccctccgttacccgcgggcccggtgccaagccaggatattacacttagttctgaggaggaagcagaggtggccgcacctacaaaggggccagcccccgcgccccagcagtgcagcgaacctgagaccaaatggagcagcattccagcgagcaagccccggcgtggtacggcgccaacccggacagccgcgcctccatggcctggtggggtaagcgtacgtacaggccctgagaagcgcagttccacacgtccaccagccgagatggagcccgggaagggcgagcaagctagctcttctgaatccgatcctgagggccctatcgctgcacagatgttgtcatttgttatggatgatcccgatttcgaatcggaggggtccgatactcagagacgcgccgatgacttccccgttcgggacgatccttctgacgtgactgacgaagacgaggggcccgctgaacccccccctcctccaaaactgcctttgcccgcattccgattgaagaatgactcagacttgtttggcctaggtcttgaagaagccggcccgaaggagtcctcagaggagggtaaggagggaaaaacacccagtaaagaaaaaaagaaaaaaaagaagaagggtaaagaagaggaagaaaaggctgccaagaaaaaatcaaagcataaaaaatctaaggacaaggaggagggaaaggaggagcggcgtcggcggcaacagcgtccgccacgctcacgtgaaagaacagctgctgacgaactggaagctttcctaggcggtggcgccccaggagggcgccatcctggtggaggagactacgaggaattgtag

SEQ ID NO: 112358 - DNA, 678 bp, Artificial Sequence
  Description of Artificial Sequence: Synthetic coding sequence
tgagacgacattgtcaaggttgaggtgtgggatgtggtggataaggggaagtgtaaaaagcgcggcgatggactgaagatggagaacgacccccaagaagccgaatcagagatggccttggacgctgagtttctcgatgtttataagaattgcaacggggtcgtcatgatgtttgatataaccaaacagtggacctttaactatattcttagagaactcccaaaggtgccgacccacgttcccgtttgtgtactggggaattatcgggatatgggcgaacatagggttatacttcccgatgacgtgagggacttcatcgataacctcgacaggccaccagggtcatcttactttcgctacgccgaaagtagtatgaagaactcttttggtctgaagtacctgcacaaattttttaacattcctttcctgcagctccagaaggatgttcggttagcccaggaacgaggttgcgctgtggttctggtcagcgaggaggtgagaatgccagctggctgggactgctgctggggcaggctgggttggaaggagggagggtcccagacctgccccgtgcctgcactcctggggaggccactccttcccgctgagccttcgccacaccactgggtggattattccctcgaatcttcccctctcttgagttgttccattccttag

SEQ ID NO: 112359 - DNA, 1416 bp, Artificial Sequence
  Description of Artificial Sequence: Synthetic coding sequence
atgaccgtgggaacagtgaaaattgtcataagaggagatcggaataccgggaagacggccttgtggcatagactgcagggacgcccttttgtcgaagagtacattcctactcaggagattcaggtaactagcattcactggtcgtataaaacaaccgacgatattgttaaagtagaggtgtgggacgtcgtcgataagggcaaatgtaagaagcggggtgatggactgaagatggagaatgatccgcaagaggccgagtccgaaatggcactggacgccgaattcctcgacgtctacaaaaattgtaacggagtagtgatgatgtttgacatcacaaaacagtggacctttaactacatcctgcgcgaactgccaaaagtgcccactcacgtgcctgtatgtgttctggggaactacagagatatgggcgaacaccgcgtgatcctgccagatgatgtgcgggacttcattgacaatctggacaggccccccggttcctcatacttccgatacgctgagtcatccatgaagaactctttcgggctgaagtacctgcacaaatttttcaatataccttttcttcaactccagcgtgagacactactaagacagctggagaccaaccagctagatatggatgctaccttggaagagctatctgtacagcaggagaccgaagatcagaactacggaatttttctggaaatgatggaggctaggtcaaggggtcatgcgagtccactcgcagctaatggacagagtccctcacccggctctcagagcccagtcgtgcccgcgggtgcagtctcgactggcagctcatctccaggcactcctcagcctgctccccaactgccgctgaatgcagcccctccctcgagtgtaccccctgtgcctccctcagaggcactgcccccacccgcatgcccaagtgccccggcacccagacgatccattattagccggctttttggtaccagccccgccacggaagccgctccccccccaccggagcctgtgcccgccgcggagggcccagcaacagtgcagagtgtcgaagatttcgtgcctgacgatagactggaccgctccttcctggaggacaccacccccgcaagggacgaaaagaaggtgggcgcaaaggctgctcagcaggattccgactcagatggagaagccctcggggggaatcccatggtcgcggggttccaagacgatgtggatctggaagatcagcctcggggcagtcctccactgcctgctggccccgtgccatcccaggacatcaccctcagttctgaagaggaggcggaggtggcggccccaaccaaagggcccgcaccggcaccccagcaatgctcagaacctgaaacaaaatggtcgggcgaagcccagcagcaccaggcgccttgttag

SEQ ID NO: 112360 - DNA, 1347 bp, Artificial Sequence
  Description of Artificial Sequence: Synthetic coding sequence
atgtcacacagagcatggctagctctgttacccttggaggtggatggagacgacggcctctgcggcgccggaggtcccgagcattctgggtcctcccagccacaacagcagcaacaacgggctccctgccacctccgggcctcaggcagaggacgcggagcccgcttgttaacccgcttattgccgttctctttcctggaaatgatggaggcccgctccagggggcatgctagccctctggctgctaatggccagtccccctctcccggctctcagagccccgttgttccggccggtgcagttagcacgggctccagtagcccaggtacgccccagccagcccctcagctccctctcaatgccgcacccccttcctccgttcccccagtccctccttcggaagctctgccaccccccgcatgtccttcagcacccgcgcccagaagatccattatctcgcggctgttcgggacatctccagcgacggaggcggcccctccaccacctgagcctgttcctgccgccgaggggcctgccactgtacagtcagtggaagattttgtgccagatgataggcttgacagatcattcctcgaggacaccacacccgctagagacgagaaaaaggtgggggctaaggctgcgcagcaagattccgatagtgatggggaggctcttggaggaaacccaatggtggccggcttccaggatgacgtcgacctggaggatcagcctagggggtctcctcctttgccagccggccctgtcccctctcaggacattaccctctcctccgaggaggaggccgaggttgccgcccctacgaagggccccgccccagctccccaacaatgttctgagcccgagaccaaatggtctagcattcctgcctccaagcctaggcgagggactgcacctactcgtaccgctgctcctccctggcccggcggcgtgtctgtacgcacggggccagagaagcgcagcagcacacgccctccggccgaaatggagcccggcaaaggcgagcaggcctcttcttccgagtccgaccctgagggcccaatagccgcccagatgttatcattcgtgatggatgaccctgactttgagagtgaaggaagcgacacacagcggagggcagacgactttccagtacgggatgaccccagtgatgtaaccgatgaagacgaagggccagccgaaccaccaccaccaccaaaactgcctcttccggccttcaggctgaaaaacgactctgacctgtttggcttaggcctggaagaggccgggcctaaggaaagctcagaagagggtaaggagggaaagaccccctccaaggagaaatag

SEQ ID NO: 112361 - DNA, 648 bp, Artificial Sequence
  Description of Artificial Sequence: Synthetic coding sequence
taaaaaattgtgatcagaggcgacaggaatactggcaagacggcactgtggcatagactccagggcaggccctttgttgaggagtatatccccactcaagaaattcaagtcacctccatacactggtcctataagacgacagatgatattgtgaaagtggaggtgtgggatgtggtcgacaaagggaagtgcaagaaacgcggggatggtttgaagatggagaatgaccctcaggaggctgagtcagaaatggcccttgatgccgagttcctcgatgtctacaagaactgcaatggggtcgtgatgatgtttgacatcaccaagcaatggactttcaattacattctgcgcgaacttcccaaggtgccaactcatgtgccggtttgcgtgctgggaaattaccgtgacatgggtgagcatagagtgatcctgccagatgacgttagggatttcatcgataatctagatagtcggccgcccggtagttcttatttccggtacgctgagtcaagcatgaaaaactcctttggcttaaagtacttacacaagttttttaacatcccattccttcagctgcaggtatctacgcatcatgtaggttggagcgggtgctggagtctgacaagctttcaggtttcccccgtttag

SEQ ID NO: 112362 - DNA, 336 bp, Artificial Sequence
  Description of Artificial Sequence: Synthetic coding sequence
atgtatagcagactgttctatctgaaaagctcatacatcatctactttgaaccattattttctaacgcgattattaatatcctgtcctttataaactccctggcctctcctctcaccattttctgttttgccctgagtgcccaggccctgtctacgatattctacttcagaatctttatcttcatctttcattcatggatcctgttgttccatttttacttcacctgcagctttaagacttatgagcaccagcattccaagatggtgccagcctacaggatgcagtctcccagagcattacctcgcacctacctatatgtctggccatataaatag

SEQ ID NO: 112363 - DNA, 342 bp, Artificial Sequence
  Description of Artificial Sequence: Synthetic coding sequence
atgaacttttacctgctgttagcctcctccatcttgtgcgccttaatcgtcttttggaagtacagacggttccagaggaacaccggggagatgtcttcgaactctactgcgctggccctagtgaggccaagtagttccgggttgataaactccaatactgataacaaccttgccgtatacgacctgagtcgcgatattctaaacaatttccctcacagtattgctcggcaaaaacgcatccttgttaatctctcaatggtggagaacaagcttgtggagctggagcacacactcctgtcaaagggatttcgcggggcatctccccaccggaagagcacttag

SEQ ID NO: 112364 - DNA, 2853 bp, Artificial Sequence
  Description of Artificial Sequence: Synthetic coding sequence
atgacatggcgaatgggcccgaggtttacgatgctgctggccatgtggctcgtatgtggttctgagccccatccccacgccaccatcagggggtctcacgggggcagaaaagttcccttagtgagcccagattcatctcggcccgcccggtttttgcggcataccggcaggagcagaggcattgaacgctcaaccctggaggagcctaacctgcagcctctccagcgaaggcggagcgtgccggtccttaggctagcaagacccacagagccgccagctaggtcagacatcaacggagcggccgtgagaccagaacaaaggcccgccgcgagaggaagtcccagggaaatgatcagggacgagggcagttccgccagaagccgtatgctgcgtttcccttcgggaagcagtagtcctaatatcctggcaagcttcgccggtaaaaaccgggtctgggttatctcagctccccatgcttctgaaggttactatcgattgatgatgtccctgctcaaagacgatgtgtactgcgaactagccgagaggcacattcaacagatcgtcctcttccaccaggctggggaagagggcgggaaggtgcggcggatcacttccgagggacagatcctagaacagcctctcgatccttcactgatccctaaactcatgtctttcctgaagctcgagaagggcaagtttgggatggtcctccttaagaagacactgcaggttgaggagcggtacccataccctgtgagactcgaagccatgtacgaggtcattgaccaggggcccataagacggattgagaaaattcggcaaaagggtttcgtacagaaatgtaaggccagtggcgtagagggtcaggtggtggccgagggaaatgatgggggcggaggagcaggcaggccctccctgggtagtgagaagaaaaaggaggatcccaggagggctcaggtgccccccacacgggaatcaagggtgaaggtcctgcgaaaattagccgccactgcccccgctttaccacagcctccctctacacctagggccaccaccttgcctcccgcccctgcaaccacggttacacgctccacgtctcgtgctgtcacggtggccgcccgtcccatgactacaaccgcattcccaactacacagcgcccgtggacccctagtccttctcaccgaccccccaccaccactgaagtgatcacagcccggagaccatctgtcagtgaaaatttatatccaccgtccagaaaagatcagcacagggagaggccccaaacgacgcgaagacctagcaaggcaaccagtctcgagagctttacaaatgctccccctactaccatcagcgaacctagcaccagggccgcgggccccggcagattcagggataatcgtatggatcggcgagagcatggacatagagatcctaatgtggtacccggccctcctaaaccagctaaagagaaacctccaaaaaaaaaggcccaggataaaatcttgagcaacgagtacgaggagaagtacgacttgagtcgccccaccgcaagccaattggaggacgagctgcaggtggggaacgtgcctttgaagaaggcaaaagagtccaagaagcacgaaaaactcgagaagccagaaaaagaaaaaaaaaaaaaaatgaagaacgaaaacgccgataagctgttgaagagcgagaaacagatgaaaaagtccgagaaaaagtcgaagcaagagaaagaaaaatcaaagaaaaagaaaggaggcaagacagaacaagacggctaccagaaacctacaaataaacatttcacacagagccctaagaagtcagttgcagatctgctgggttccttcgaaggtaagcgccgcttactgctgattactgctcccaaggccgagaataacatgtacgtgcagcagagggatgagtacctcgaaagtttttgtaagatggctaccagaaagatttcagtcataactatttttggccctgtaaacaactccacaatgaagatcgaccatttccagctggataacgagaagcccatgcgggtggtggacgatgaagatcttgttgaccagcgactcatctctgagctcaggaaagaatacggaatgacttacaacgatttttttatggtgctgaccgatgtcgatttgcgcgtcaagcagtactatgaggtcccaattaccatgaaaagtgtctttgacttgatcgatacctttcagagcaggattaaagatatggagaagcagaagaaggagggcatcgtatgtaaggaggataaaaagcagagtctcgagaactttcttagcaggtttaggtggaggcgcagactgttggttataagcgcccccaatgacgaagactgggcatattcgcagcagctttcagccctgtccggccaggcatgcaatttcggcctccgtcacatcacgatcttgaagctgctgggcgttggagaggaggttggcggagtactggagctgttcccaattaatgggtctagtgttgttgagcgagaggacgtgcctgcccacctggtaaaagacataaggaattacttccaagtgagtcccgaatacttcagtatgttattggtcggtaaggatggcaacgtgaagtcctggtatccatctccgatgtggtctatggttatcgtgtacgaccttattgactctatgcagctgaggcgccaggagatggctatccaacagagtctcggcatgcggtgccctgaagacgagtacgcagggtacggctatcactcttatcaccagggttaccaggatggatatcaagatgactatcggcatcatgagtcttaccatcatggctatccatactag

SEQ ID NO: 112365 - DNA, 744 bp, Artificial Sequence
  Description of Artificial Sequence: Synthetic coding sequence
atgctactcctacccctccccctgctgctttttctgctctgttcccgagctgaggcaggagagataattgggggcaccgagtgtaagccgcacagtaggccatatatggcctacctggagattgtcacatcgaacggacccagcaaattctgcggcggattcctgattcgccgaaactttgtgctcacagccgcccattgcgccggacgatctattactgtgactctgggagcccacaacatcacagaggaggaggacacatggcagaaacttgaagtgataaaacaatttcgccatccaaaatacaacacctctaccctgcaccacgatataatgctgctgaagctgaaagaaaaggccagtctcaccctcgcagtgggaacgctaccttttccttcacagttcaactttgttcctcctgggcgcatgtgccgggtggcaggctggggaaggacaggggtcctgaagccaggctcggacaccctgcaggaggttaaactgaggctgatggatccccaggcctgctcgcactttagggacttcgatcacaacctgcagctttgtgtaggaaatccaaggaaaactaagagtgcgtttaaaggagactctggaggtccgttgctatgtgccggggtagcgcagggaatcgtgtcctacggtagatcagacgctaaaccacctgcagtgtttaccagaatcagtcattataggccctggataaatcagatcctacaggccaactag

SEQ ID NO: 112366 - DNA, 210 bp, Artificial Sequence
  Description of Artificial Sequence: Synthetic coding sequence
atgctcggcatcacggtcttggcagccctgctggcgtgtgccactccgggcccgacggtgtggccatgggagaggactacctggcggtggaaaaccaaaaaggacccgtgcctgtgggtgtggacccctagtactagcaccagagacggcatgccttcatgctgtgccatgattttaccaagttctagcctccagagcatgtggagctag

SEQ ID NO: 112367 - DNA, 807 bp, Artificial Sequence
  Description of Artificial Sequence: Synthetic coding sequence
atgctcggcattaccgtgcttgctgcattgctggcatgtgcttcctcctgcggagtcccctctttcccgcccaaccttagtgcacgtgtggtgggcggagaggatgctaggcctcatagctggccatggcagatctccctgcagtacctgaaaaatgatacttggcgccacacttgcggagggacgctcattgcctctaactttgtgctgaccgcagcacactgtatctcgaataccagaacctaccgagtagcggtcgggaaaaacaacctcgaagtcgaggacgaggagggatcactctttgtgggcgtggatacaatccatgtgcataagagatggaacgccctgctgttgcggaatgacattgctctgattaagttggccgagcacgtggaactgtcagataccattcaggtagcatgcctgccagagaaggactctcttctgccaaaggactacccgtgttacgtcactgggtggggtaggctctggaccaacgggcctatcgcagacaagctgcagcagggtttacaaccagtggtggaccacgccacatgcagccggatcgactggtggggttttcgtgtgaaaaagactatggtgtgtgccggaggggacggcgtgatctcggcctgtaacggggatagcggagggccattaaactgccagctcgaaaatgggagctgggaggtgtttgggatagtgagctttggctccagaagaggttgcaatacgaggaaaaagccggtagtgtatactagggtatccgcgtacatcgactggatcaatgagaagatgcagctgtag

SEQ ID NO: 112368 - DNA, 795 bp, Artificial Sequence
  Description of Artificial Sequence: Synthetic coding sequence
atgcttctgttatctttgaccctgtctctcgtactcctggggagctcttggggatgcggaattccggccatcaaacccgccttgagtttttcccagaggattgtcaacggtgagaatgctgtgctgggcagctggccatggcaggtatccctccaggactctagcggcttccatttttgtggagggagcctcattagccaaagctgggtcgtgaccgcggcccattgcaacgtttcccccggacgccatttcgttgtgttgggtgagtacgataggtcctccaatgccgagcctttgcaggtgctctctgtgtcccgagccatcacacatcccagctggaattcaaccacgatgaacaacgatgtcaccctactgaagctcgcgtctcccgcccagtatactactcggatcagcccggtgtgcctggcctcctctaatgaagctctcacagaggggctcacatgcgtgacaacagggtggggccgactctctggagtgggcaacgtgactcctgcccacctgcaacaggtggccctcccgctggttaccgtgaaccagtgccgacaatattggggcagttcaatcaccgatagcatgatttgcgccggcggggccggagcctcttcctgtcagggggacagcgggggccctctggtatgtcagaaaggcaacacctgggtgctaattggcatcgtttcttgggggactaagaattgcaacgttagagccccagcagtgtacacccgagtaagcaaattctccacctggatcaaccaagtgatcgcatacaattag

SEQ ID NO: 112369 - DNA, 795 bp, Artificial Sequence
  Description of Artificial Sequence: Synthetic coding sequence
atgctcttactctctctgaccttgtctcttgttctgctgggttccagctggggctgcggtatccctgctatcaaaccagcgctgagcttttctcagaggatcgtaaacggggagaacgcagtacttggcagctggccttggcaggtaagtctacaagactcatctggcttccatttctgcgggggcagcctgatctcccagtcgtgggtagtgacggctgcacattgtaatgtgtcacctggtagacatttcgtggttttgggtgagtatgatcgcagttcaaatgccgagcctcttcaggttttgtcggtgtcccgggctatcactcacccttcctggaatagtactacaatgaacaacgacgtaacactccttaaacttgcctcccccgctcaatacacaacacgcatcagtccagtctgcctcgcaagcagcaacgaggctttaaccgaagggctcacgtgtgtgaccactggctggggccgccttagcggagtcggtaatgtaacccccgcacatctgcagcaggttgctctgcccttggtgacggtaaatcagtgccgccagtactgggggtcttctataacggattcgatgatttgtgccgggggagctggagcctcgtcttgccaaggagacagcggcggccccttggtttgccagaaggggaacacttgggtactgatcggtattgtgagctggggaaccaagaactgtaatgtcagagccccagccgtgtacactagagtgagtaaattctccacatggatcaaccaagtcattgcctataattag

SEQ ID NO: 112370 - DNA, 792 bp, Artificial Sequence
  Description of Artificial Sequence: Synthetic coding sequence
atggccagcctctggctgttgtcctgttttagtctcgtcggagccgccttcggatgtggggtgcctgccattcacccggttctcagcggtcttagtcggatagtgaatggcgaggacgcagtgcccgggtcgtggccttggcaagtgtccttgcaagataaaacagggttccacttttgcgggggatcacttattagcgaagactgggtggtgaccgccgcccactgcggcgtccgaacttcagatgtagtggttgcaggggaattcgaccagggctccgatgaggagaatatccaggtgctgaagatcgcaaaggtctttaaaaatcccaaattctctattcttactgtgaacaatgatatcacactcctgaagctggcgacgccagctagattcagccaaacagtgtccgctgtctgcttgcctagcgccgacgatgattttcctgctggaaccttgtgtgccacaaccgggtggggcaaaaccaagtacaatgccaacaagacaccagacaaactgcagcaagcagcgctcccgctgctaagtaacgccgaatgcaagaaatcttggggcagacgcatcacagatgtcatgatttgcgcaggtgctagcggggtttcctcttgtatgggggattccggcgggccgctcgtgtgccagaaagatggcgcctggaccttggtcgggattgtcagttgggggtctgatacctgcagtacttcttcacccggggtgtacgccagagtaaccaagctgatcccttgggtgcaaaaaattctggccgccaattag

SEQ ID NO: 112371 - DNA, 1119 bp, Artificial Sequence
  Description of Artificial Sequence: Synthetic coding sequence
atggccgctcctgtaccctgggcctgctgcgcggtgctcgcggcagccgcagcagtggtgtatgcccagagacactccccccaggaggcccctcacgtccaatatgagcggttagggagcgatgtgaccctcccctgtggtaccgctaattgggacgcagccgtgacttggcgggtcaatggcactgatctggctcccgacttgctgaacggctcacaacttgtcctgcatggcttagaattggggcattctggcctctacgcatgtttccatcgggactcatggcaccttcggcatcaggtgctgctgcacgtaggtctgccccctagagagccagtgctttcatgtcggtcaaacacttatccaaaggggttctactgcagctggcatctgccaacccccacttacattcccaacaccttcaatgtaacagttctgcatggctcaaagatcatggtctgcgagaaggatcctgcccttaaaaatcgctgtcacatccgctacatgcaccttttcagcactattaagtacaaagttagcatttctgtaagcaatgctctgggacacaacgccaccgccattacctttgatgagttcacaattgtcaagccagacccacccgaaaacgtggtggcacgcccagtcccttccaatccgcgtagactcgaggttacttggcaaaccccaagcacatggcctgatccggagagctttcccttgaagttctttctgcgctaccggccgttgattttggaccagtggcagcacgtcgaactgtcagacggaacagcacacactatcacagacgcctatgcagggaaggaatacattatccaggtggcggccaaggacaacgagataggcacctggtccgattggtccgtggctgcgcacgcaactccttggactgaggagcctcgccacctgaccacggaggctcaggctgcggagaccacaactagcacaaccagcagtctggctccaccccccaccacaaaaatctgtgatccaggcgaactcgggagcgggggagggccgtccgctccctttttagtgtccgttcctataacactggccctagccgcggccgccgccactgcatctagcttgctcatctag

SEQ ID NO: 112372 - DNA, 1119 bp, Artificial Sequence
  Description of Artificial Sequence: Synthetic coding sequence
atggccgcccctgtgccatgggcctgttgcgcggtgctggccgccgcagcagcagtcgtctacgcccaaaggcattcaccccaggaggcccctcacgtgcagtacgaacggcttggttctgacgttacgctgccctgcggcactgcaaattgggacgcagcggtgacttggcgcgtcaatgggaccgacctggcccccgatctgctgaatggaagccaattggtcttacacgggcttgaattggggcactctggcttgtatgcctgttttcaccgcgattcgtggcacctccgccaccaggtgctgctgcacgttggcttacctccgcgcgagccagtcctctcttgtcggagcaacacatatcccaaaggcttttactgttcatggcacctgcccacaccgacctacatccctaatacttttaacgtcactgttttacatggctcaaagattatggtatgtgaaaaggatccagctctgaaaaacaggtgccatatccgatacatgcacctgttcagcacaataaagtataaggttagcattagcgtgagcaacgctctgggtcataatgcgactgctatcacatttgacgagttcacaatcgtgaaaccggatccgcctgagaacgttgtcgctcggccagtacccagtaaccctcgacggcttgaggtcacttggcagacccccagcacgtggcccgaccctgagagttttcctctgaagttctttttgcgatataggccgctaattctggatcagtggcagcacgtggaactgtctgatggaacagcccacacaatcactgacgcgtatgccggcaaggagtacatcattcaagtggctgctaaagataacgagattggaacctggagcgactggagcgtggcagcacacgctactccctggaccgaagaacctcgacatctaaccaccgaggcccaggctgcagagaccacaacaagcacaacctcctcactagctcccccacctacaaccaaaatctgcgaccctggggaattgggaagcggcggaggtccttctgccccatttttagtgtccgtgccaatcacacttgcactggcagccgctgccgctactgcttctagcctgttgatatag

SEQ ID NO: 112373 - DNA, 771 bp, Artificial Sequence
  Description of Artificial Sequence: Synthetic coding sequence
atggccgccccagttccttgggcctgttgcgccgtgctggccgccgcagcagctgtggtttacgcacaacgccattcaccccaggaagccccccacgtgcagtacgagcggttgggctccgatgtcaccctgccatgtggcactgccaactgggatgccgcggtaacctggcgggtgaacggcacagatctcgctccggatctactgaatggatctcagctcgtgttacatggcctagagctgggacacagcggactatacgcatgttttcatagagattcatggcacctcagacaccaggtgctactgcatgttggcctgccacccagggagcccgtgctctcttgccggtctaacacctaccctaaggggttttattgcagctggcacctgccaactcccacatatatacccaacacgttcaacgtaacagtgctccacgggtccaaaattatggtgtgtgagaaggatcccgccctcaagaatcgatgccatatccgctacatgcacctgttctcaacaataaaatacaaagtgtccatatctgtcagcaatgccttgggtcataacgctacagctattacttttgacgaatttactatcgtgaaaccagatccccccgaaaacgtggtggcacgaccagtaccctctaatcccagaaggttggaggttacttggcagaccccatctacctggccagatccggaatcatttccactgaaattcttcttgcgataccgcccactcatccttgatcaatggcagcactag

SEQ ID NO: 112374 - DNA, 3909 bp, Artificial Sequence
  Description of Artificial Sequence: Synthetic coding sequence
atggagctctatttcggagaatatcaacacgtgcaacaggagtacggagtgcacctccgcctagccagcgacgacacgcagaaatctagaagtagccaaaatagtaaagcgggtagctatggggtctccattagagtgcagggcattgacgggcatccctacatcgtcctgaacaatactgagcggtgtctcgcaggtacttccttttccgaaaacgggcccccattcccgcctcctgttatcaacaacttgccccttcactccagcaacggttcggttcccaaagaaaatagcgaggagctccagcttcctgagaatccctatgcccagccttcgccaataaggaatcttaagcaacccctgctgcacgagggcaaaaacggtgtcctcgatcgtaaggacggtagcgtcaaaccctctcatttgttgaatttccagcgccaccctgaactgcttcagccctatgacccagaaaagaacgaactgaatctgcagaatcatcagccaagcgaatctaactggctgaaaacactgactgaggaaggcatcaacaataagaaaccatggacctgctttcctaagccttccaactcccagcctacatccccgagcctggaggatcctgcaaagagcggggtgacggcaatcagactgtgttcaagcgttgtcattgaggatcccaaaaaacaaacctctgtctgtgtcaacgtacagtcttgcactaaggaaagagtcggcgaggaagccctgttcacatccgggcggccgcttaccgcccactcacctcatgcccatcctgagacaaagaagacccgcccagacgtgttaccattccgaagacaggacagcgctggcccagtgttggatggtgccagatcacgaaggtctagctcgtcaagcacgacccccacttctgccaactcactgtataggttcctattggacgaccaagagtgcgccatccacgctgacaatgtcaacagacacgagaacaggaggtatatcccctttctgccgggaactgggagggatatcgataccggtagtatcccaggcgtcgaccaacttatagagaagttcgaccagaagccaggactgcagaggcgtggccgatcaggcaagagaaacagaattaatactgatgataggaaacggagccgcagcgttgattctgcttttccctttggcttgcagggaaatagcgaatacctcatcgaattcagcagaaacttgggcaagagtagcgagcacctgctcagaccttcccaagtctgtccacagagaccactgagtcaagaacggcgtgggaagcagtctgtgggccgaacatttgccaagttgcagggcgccgcacacggggcaagctgtgctcattcccgccccccgcagcctaacatcgatggaaaagtgttagagaccgagggatcgcaagagagcacagtgatccgcgcgccgtccctcggtgcgcagagtaaaaaggaagaggaggttaagacagctaccgcaactctgatgctgcagaaccgggctaccgccacaagcccagattcaggggctaagaaaatttccgttaaaactttcccttccgcgtctaatactcaggccacaccagacctcctgaaaggccagcaggagctcacccagcagactaacgaggaaacagccaagcaaattctttataactacctcaaggagggatccacagacaacgacgatgctaccaaacggaaggtcaaccttgtttttgaaaaaattcagactctcaaatctagagctgcagggagtgcccaaggcaataatcaagcctgcaattccaccagcgaagtgaaagatctgcttgagcaaaagagcaagctcaccatcgaggtagccgaactccaaaggcagctacagctagaggtgaagaatcagcagaatatcaaggaggaacgggaaagaatgagagctaacctcgaagagctgaggtcccagcacaacgaaaaggtcgaggaaaattcaaccctgcagcagagactggaggaatctgagggcgagttaagaaaaaacctcgaggagctcttccaggtgaagatggaacgtgaacagcaccagacagagataagggacctccaggaccagctgtcagaaatgcatgacgagttagattctgccaaacgcagcgaggaccgcgagaaaggcgccttaattgaggagttgctccaggccaagcaggaccttcaggatcttctgatcgccaaagaagagcaggaagatcttctaaggaaacgcgagagagaactcaccgcccttaagggcgcactcaaagaggaggtttcttcacatgaccaggagatggataagctcaaagagcagtatgacgccgagctacaggcactgcgggaatccgtggaagaggctacgaaaaacgtcgaggtgctcgcgtctcggtccaacacttctgagcaggaccaggcaggtacggaaatgcgggttaagctgctacaagaagagaacgaaaaactacaggggcgctcagaagagctcgagaggcgggttgcgcagttgcagcggcagatagaagatctaaagggcgatgaggcgaaagccaaggagacattgaagaagtacgaaggggagattcgccaactggaggaggccctagttcatgctcggaaggaggagaaggaagctgtgtcagcccgacgggcgttagaaaatgagctcgaggccgcacagggcaatctgagccaaacaacccaagagcagaagcaactgtcagagaagctgaaggaggagagtgaacagaaggagcagctgcgcaggctgaagaatgaaatggagaacgaaaggtggcatctcggcaaaactatagagaagctgcagaaggaaatggccgacatcgtcgaagcttcaaggacttccaccctggaactccaaaatcaattggatgaatacaaagagaagaacaggagagaactggcagagatgcaacggcagttgaaagaaaaaaccttggaagcagaaaaatctcgcttaacggctatgaagatgcaggacgaaatgaggctgatggaggaggagctccgcgactatcaacgtgcccaggatgaggccctgaccaaaaggcagttgcttgaacaaacactgaaggacttggagtacgagttggaggctaagagccacttaaaggatgaccgaagccggctcgttaagcaaatggaagacaaggtgagccagctggagatggaacttgaggaagagagaaacaattccgacctgctctctgagcgtatttctcgctcccgtgagcagatggagcagctgagaaatgaacttttacaggaaagggccgcgcggcaggatctagagtgtgacaagattagcctcgagcggcagaacaaggaccttaaatccaggattatccacctggaaggctcgtatagatcctccaaagagggactggtcgtgcagatggaggcccgcatcgccgagttggaggatcgcctggagtccgaggagagagatcgagccaatttacaattgagtaataggagactcgagagaaaagtcaaggaactggtgatgcaggtggatgatgaacacctctcgctcactgatcaaaaagatcagctgagcttacgactcaaggcaatgaaacgtcaggtggaagaggctgaagaagagattgacagattggaatccagcaagaaaaagctgcagcgagagctggaagagcaaatggacatgaacgaacatctacagggtcagctcaacagcatgaagaaagatctcagattgaagaagctgccatcaaaggtactggatgacatggacgatgacgacgacctttccactgacgggggatctctgtacgaggcccctgtgagttatacttttagcaaggactcgacagtggcctcccagatttag

SEQ ID NO: 112375 - DNA, 2061 bp, Artificial Sequence
  Description of Artificial Sequence: Synthetic coding sequence
atgggagaattcaaagtgcacagggtcagattttttaactacgtcccgagtggtatccgatgcgtggcctataacaatcagagcaaccggctcgccgtctcccgtaccgacggtaccgttgaaatttacaacctgtccgcgaattattttcaggagaagtttttccctgggcatgaaagtagagcaaccgaggcactatgctgggctgaggggcagaggcttttcagcgctgggttaaacggcgaaattatggagtatgacctgcaggccctgaatatcaagtatgctatggacgcgttcggcggaccaatttggtctatggccgccagtccgtcagggagccagctattggtgggctgtgaggatgggtcagtaaaactgttccaaattacaccagataaaattcagttcgagaggaactttgatcgccagaaatccaggattctgagcctatcctggcatcctagcggcacgcatattgcggcaggaagcatcgattacattagcgtttttgacgtgaaaagcggatccgccgttcataaaatgatcgttgatagacagtacatgggagtctcaaagcggaaatgcattgtatggggtgtcgctttcttgtctgacggcacaataatttccgtggactccgccgggaaagtccagttttgggattcagccaccggaaccctggtcaagtcccacctaatagcgaacgctgacgtccagtccatcgctgtcgcagaccaggaggatagttttgtggtgggcacagcggaagggaccgtcttccatttccaactcgtgccagtcacgagcaatagctccgaaaagcaatgggtgcggactaaaccattccagcaccacacacatgatgtcagaacagtggcacattctccaaccgccttaatctctgggggcaccgacacacacctcgtgttcaggccacttatggaaaaagtggaagtgaagaattacgacgctgccctccgaaagatcacatttcctcatagatgcctcatatcttgtagcaaaaaacgccagctgcttctcttccagttcgctcaccaccttgaactctggcggttaggctcaaccgtcgccacaggcaagaatggtgacactttgcctctgagcaaaaatgccgaccaccttttgcacctcaagacaaagggccccgagaacattatctgctcctgcatcagcccatgtggatcttggatcgcttactctactgtctcgcgtttttttttgtaccggctgaactacgagcacgacaacatcagcctcaaaagggtctctaagatgcccgcctttctgagatcggccctgcagatattgttttccgaagatagcacaaagctcttcgttgcatccaaccagggcgcgctccacattgttcaactctcaggcggaagcttcaagcatttacatgcatttcagcctcaaagcggcaccgttgaggccatgtgtctcctggccgtgtctccagatgggaattggctggccgcctcaggcacttccgcaggggtacacgtgtacaatgtaaagcagcttaagctccattgtacggtgccggcctacaacttccctgtgaccgcaatggcaatcgctcctaacaccaataacctcgtgatagcccacagcgatcaacaggtgttcgaatatagcatacctgataaacagtatacagactggagccgaaccgtgcagaagcaggggtttcatcacctgtggctgcagagggacacccccattacacatatctcgttccaccctaaaagaccgatgcacatcctgctacacgatgcatacatgttctgtattatcgacaaatccctgcctctgcccaatgataagaccctcttgtacaacccctttccgccaaccaatgaatcagacgtgattaggaggagaaccgcccatgcttttaaaatcagcaagatctataagcccctgctgtttatggacctgctggatgaaaggacactggtggcggtcgaacgtccgctggacgacatcatcgcccagctacctcctccaattaagaagaagaagttcggcacttag

SEQ ID NO: 112376 - DNA, 1716 bp, Artificial Sequence
  Description of Artificial Sequence: Synthetic coding sequence
atgggagagtttaaggtccacagggtccgctttttcaactatgtaccctctggcatacgttgcgtggcttataacaaccaaagtaataggcttgctgtgagtagaacagatgggaccgtggagatttataacctctctgccaactacttccaagagaagttcttccccggccacgagtctcgagcaactgaagccctctgctgggccgaagggcaacggttgtttagtgctggactgaacggcgagattatggaatacgacctgcaggccctaaacatcaaatatgcaatggacgctttcggcggaccaatatggtcaatggccgcgtccccttcgggaagccaactactggttggctgtgaggacgggtccgtgaagttgttccaaataaccccagacaagattcagtttgagcggaatttcgatagacagaaaagtagaatactgagtctctcctggcaccctagtggtactcacattgcagccggaagtatagactacattagcgtgttcgatgtgaagagcggcagcgccgtgcataaaatgatcgttgatcggcagtacatgggtgtgtcaaaacgtaagtgcattgtgtggggcgtcgccttcctgtcggatggaactatcattagtgtggattccgctggaaaggttcagttctgggatagcgccaccggtacactggttaaaagtcacctgattgcgaatgctgatgtgcagagcatagccgtggcagatcaggaagattcctttgttgtgggcactgccgagggcaccgtgttccattttcagctagtgcccgtgacgtctaatagctctgagaagcaatgggtgcgcacaaaaccgttccagcatcacactcatgatgtgcggactgtggcacatagccctaccgccctcatatctggcggaactgacacacacttggtgtttaggcctctgatggaaaaagtcgaagtgaaaaactacgatgccgcactgcgcaaaataacattcccacacaggtgcctcattagttgtagcaaaaagcgccagctgctactattccagtttgctcaccacctggaactctggcgtctggggtcaactgtcgccaccgggactgtggaagctatgtgcctgctagcagtttctcctgacggtaactggttagccgcatccggtacatccgcaggggtccatgtttataatgtgaaacaactgaaattacactgcacagtaccggcatataattttcctgtcacagcaatggctattgcgcccaatacaaataacctagtcattgcacactcggaccagcaggtttttgagtatagcatccctgataagcagtacacggactggagtcgaaccgttcagaagcagggcttccatcacctgtggctgcagcgcgatacgccaatcacacacatttccttccaccccaagaggcccatgcatatcctgttacatgacgcatacatgttctgcattatcgataaatcactccccctgcccaacgacaaaacacttctttataatcctttcccccctacgaacgagtccgacgttatccggaggagaaccgcacacgcctttaaaataagtaagatctataaacccttgttatttatggaccttctggacgagcgcacactggtcgctgtcgaaaggcctttagacgatataatcgcgcagctgcctccccccatcaagaaaaagaagtttggcacttag

SEQ ID NO: 112377 - DNA, 1023 bp, Artificial Sequence
  Description of Artificial Sequence: Synthetic coding sequence
atggcactgcgcctgctccggagggctgcacgaggcgccgcggcagctgctcttcttagattgaaggcctccctggcagcagatatccctcggctgggctactcgagctctagccaccacaaatacattcctaggcgcgccgttctctatgttcctgggaatgatgaaaagaaaattaagaagatacccagtctgaatgtggactgtgccgtgctcgattgcgaagacggggtagccgcgaacaaaaagaacgaggctcgacttcgtattgtaaagacgttggaagatattgatctcgggccaacggaaaagtgtgtgagagtgaactcagtgtcatccggacttgctgaagaagatctggagacattgttacaatctcgggtcttgccctccagcttgatgctgccaaaagtggagtcccctgaagagattcagtggtttgccgataagttctcctttcacctgaagggaagaaaattggaacaacccatgaatctgatccccttcgtggagacggcaatgggcttgttgaatttcaaagcagtctgcgaggagacactcaaggttggaccccaagtgggactattcctggacgcagtcgttttcggaggggaagattttcgagctagtataggagccacatctagtaaagagacattggacatcttgtacgccagacagaaaatcgtggtgatcgccaaagctttcggcctgcaggccattgatttggtatacatcgacttccgcgacggtgccggactgttgagacagtcaagggagggcgcggctatgggattcacagggaaacaggtgattcaccctaaccagatcgccgtcgtgcaagaacagttctcaccatctcctgaaaagataaagtgggctgaggaactaatcgcggccttcaaagagcaccaacagttggggaaaggggcttttaccttccagggctcgatgatagacatgcctctgttgaagcaggcacagaacacagtgacccttgccacttctataaaagagaagtag

SEQ ID NO: 112378 - DNA, 921 bp, Artificial Sequence
  Description of Artificial Sequence: Synthetic coding sequence
atggctctgcggcttctcagaagagctgctaggggagccgcggcagcagccttgttacgtctgaaggccagtctggctgccgacatacctcggctcggatatagttcctcatcccaccacaaatacatcccacggagagcagtgttgtacgtgcctggaaatgatgaaaaaaaaattaaaaagataccctctcttaacgtcgactgcgcagtgctggactgcgaggatggcgtagcagccaacaagaagaatgaagccaggctgcggattgtcaaaacactggaagatattgacctgggtccaactgagaagtgcgtgcgggtaaattcagtctcatccgggcttgctgaggaggatttagaaacactgcttcagtccagagtgctgccaagctctttgatgctgcctaaggtggagagtccggaagaaatacagtgggctgtgtgtgaagaaaccctcaaggttgggccccaggtcgggttgtttctggacgcagtggtgttcggaggggaggactttagggcttctattggcgcaaccagcagcaaggaaactctagacatcctttatgctaggcaaaagattgtagttattgctaaagcttttggcctccaggcaatagacctggtttatatcgacttccgcgatggcgcaggtttgctcaggcagagcagagagggcgccgctatgggctttaccggcaagcaagtaatccatccaaatcaaatagctgtggtgcaagaacagtttagccctagccccgagaagatcaaatgggcagaagaattgatcgctgccttcaaggaacatcaacagctcggtaagggagcatttacctttcaggggagcatgattgatatgcctctgttaaagcaggctcaaaacactgtcactctcgccactagcatcaaagagaagtag

SEQ ID NO: 112379 - DNA, 921 bp, Artificial Sequence
  Description of Artificial Sequence: Synthetic coding sequence
atggccctgaggctgctgcgtcgggcagcccggggtgccgctgccgcagctctgctgcgcttaaaagcctcactggctgcagatatccccagattggggtacagctcctccagtcatcacaaatatattccacggcgagctgtactgtatgtgcccggcaacgatgagaagaagataaagaaaatcccttcattaaacgtggactgcgccgtgttggactgtgaagacggtgttgctgctaataagaagaacgaggccaggctgcggatcgtgaagaccctggaagacatcgatctgggcccaaccgaaaagtgtgtgagggtcaactcagtgtcctcgggcctagccgaggaggacctggagaccctgctgcagtccagagtgcttccatcttccctgatgctacctaaggtggagagccctgaggagattcaatgggccgtttgcgaagagacactcaaagtcggaccccaggttggcctgttcctggacgcagtggtgttcggaggcgaagactttagggcatccatcggtgcaaccagtagcaaggaaacgctggacattctgtatgcacgccaaaaaatcgtggtcattgcaaaagccttcgggctacaggcaatagacttggtctacatcgactttagagacggcgccggtcttctcagacagtcacgtgaaggagctgctatggggttcacagggaaacaagtaatccatccaaaccagatcgctgtcgttcaggagcagtttagcccatcgcccgaaaaaatcaaatgggctgaggagctcattgctgcatttaaagagcaccagcagctgggtaaaggcgccttcacgtttcagggctcgatgatagacatgccgctgttaaagcaagctcaaaatacagtgacactggctaccagtatcaaggagaaatag

SEQ ID NO: 112380 - DNA, 1023 bp, Artificial Sequence
  Description of Artificial Sequence: Synthetic coding sequence
atggctcttaggctgctccgcagagctgctaggggggccgccgccgccgcactcttaagactgaaagcgagccttgctgccgatattcctcgcctcggatacagtagctcaagtcatcacaagtatataccaagacgagcagtcctgtatgtccctggcaatgacgaaaagaaaatcaaaaaaataccctccctgaatgtcgactgcgctgttcttgattgtgaggatggcgtggccgcaaacaagaagaacgaggcgagactgagaatcgtcaaaaccctggaggacatagaccttgggcctaccgaaaagtgcgttcgggttaattcagtttcatccggcctggccgaggaggatctcgagactctgcttcaatctcgcgtgctcccctccagcctgatgttgccaaaagtggagagcccagaggaaatccagtggttcgctgataagttctcatttcacttgaagggccgtaaactggagcagccaatgaatcttattccatttgtggagactgccatgggattactgaacttcaaggccgtgtgcgaggagacactgaaagtggggccgcaggttggtctttttctagacgcggtcgttttcggtggagaagattttagggcttcaattggagcaacgtcgagtaaggaaacccttgatatcctgtatgcaagacagaagattgtggtgattgcaaaagccttcggtctgcaggctatcgatctggtgtatatcgatttcagagatggcgctggattgttgaggcagtctagggaaggagctgccatgggctttacaggaaagcaggtcatacatcccaaccaaatcgccgttgtacaggagcagttcagtccttctccagagaagattaaatgggccgaagaactcatagctgccttcaaagagcatcagcagttgggcaagggagctttcaccttccaaggatctatgatcgacatgcctctcctgaagcaggcacagaataccgttacgctggccacctccataaaggaaaaatag

SEQ ID NO: 112381 - DNA, 546 bp, Artificial Sequence
  Description of Artificial Sequence: Synthetic coding sequence
aatgaggcacggcttaggattgttaagacccttgaggacattgatctcggtccaacagagaagtgcgtcagggtcaattcagtgagctcgggcctggcagaggaggatctggagaccttactgcagagtcgtgtgttaccttctagcctgatgctgcctaaggtcgaatccccagaggagatccagtggtttgcagataaattctcatttcatctgaaagggcgaaaactagaacagccgatgaacctcattccatttgtcgaaacagcaatgggtctgctgaatttcaaggccgtatgtgaagagactcttaaggtggggccccaggttggcttatttctcgatgccgtcgtgttcggcggcgaggatttccgggcttccatcggggtcaaggatatctctttgagcctttttctctgtgtgtgcgtctatatgtgcgtttatatcttttccctgcccctaaaggacggtcacctgcacaataacgtgtatctgccaaccatgacaatggttttccacgataatggcatggacacaacttcatag

SEQ ID NO: 112382 - DNA, 312 bp, Artificial Sequence
  Description of Artificial Sequence: Synthetic coding sequence
cttcaggctatcgacctcgtctacatcgactttagggacggtgccggtttgctgcgtcagtcgagagagggagccgccatgggattcacaggcaagcaggtcattcaccctaaccagatcgctgtcgtgcaggagcagtttagcccttctccagagaagattaagtgggcggaggagctgatagctgcattcaaagagcaccaacagttgggaaaaggagccttcacatttcagggcagcatgatagatatgcctctgttgaaacaggcccaaaacactgtaactctcgcaacctccatcaaggagaaatag

SEQ ID NO: 112383 - DNA, 270 bp, Artificial Sequence
  Description of Artificial Sequence: Synthetic coding sequence
gaagaactgatcgccgcattcaaggagcaccagcagctgggtaaggttgggaggtactgctgcagttggttatgtattcagccttttcctagtagccctggacaacgatcacagtcgatttcacgagttcccggaagatactgggtgctgggtgcgagatcctgggaatccaagggcgcatttaccttccaagggtcaatgatcgacatgccactactgaaacaggcacagaacactgtcactctggcaactagtataaaggagaaatag

SEQ ID NO: 112384 - DNA, 444 bp, Artificial Sequence
  Description of Artificial Sequence: Synthetic coding sequence
aacgaagctcgcttgaggatcgttaagactctagaggatatcgacctaggtcccacagagaagtgcgtccgagtaaactcggtgtcaagcggccttgccgaggaggacctggagaccctgttgcagtcaagagtccttccttcaagcctcatgctgcccaaggtcgaaagtccagaggagatccagtgggccgtttgcgaggaaacactgaaggtcggaccacaggtggggctgttcctggacgctgtggtgttcggtggcgaagattttcgggccagtattggcgtcaaagatatatcactcagcttgttcctgtgtgtttgtgtgtacatgtgcgtgtacatttttagtcttccactaaaggacggccaccttcacaacaacgtctacctgccaaccatgaccatggtgttccacgacaatgggatggacacaacgagctag

SEQ ID NO: 112385 - DNA, 909 bp, Artificial Sequence
  Description of Artificial Sequence: Synthetic coding sequence
atggcactaagactgctgcgccgggccgctcgaggggccgccgccgcagccctgcttaggctgaaagcgagtttggctgctgacattccacgcctcggctatagctcgagttcacatcataaatacatcccaagaagggcagtcctctacgtacccgggaacgatgaaaagaagataaagaaaatcccctcccttaatgtcgattgcgcagtgctggactgtgaagatggggtggctgcaaacaagaagaatgaggcacgactgaggatcgttaaaaccctcgaggacattgatttgggtccgaccgagaaatgcgtccgagttaacagcgtgagcagtgggctcgccgaggaagatctcgaaaccctcctgcagtctagagtcctgccaagttccttgatgctcccaaaagtggagtcccccgaggaaattcagtgggctgtctgcgaagaaacgcttaaagtgggcccccaggtgggcctgttcctcgacgctgtcgtgtttggaggagaggattttcgggcttctatcggcgcaaccagttccaaggagactctggatattctatacgccaggcagaagatcgtggtcattgctaaagcattcggcttacaggcgattgacctggtctatattgacttccgggacggcgcgggattgctgcgacagagccgcgagggggcagcgatgggcttcacaggtaagcaagtaatccacccaaaccagattgctgtcgtgcaggagcagttttcccctagtcccgagaagatcaagtgggctgaggaacttattgctgcgtttaaggagcatcagcagcttggcaagaccgtcagttgttcagcttcccaggcaggagtgcagtggagagatctgggatcactgcagccccctccccccggatttaagtag

SEQ ID NO: 112386 - DNA, 1401 bp, Artificial Sequence
  Description of Artificial Sequence: Synthetic coding sequence
atggccttattaacagcagctgctagattactcggcacaaagaacgcaagctgcttggttctggctgcaagacatgccagcgcgtcctcgactaatctcaaggacattctcgcagatttgataccaaaggagcaggctagaattaagaccttcaggcaacagcacggcaagactgtggttggtcagattacagtggacatgatgtatggaggaatgcggggtatgaaaggcttggtctatgagacttccgtgttagatcctgacgaaggcattcggttccggggcttctcgatccccgagtgtcaaaagctcttgcccaaggcaaagggaggggaagagccattgcctgaggggctgttttggttgttggtgactggacatatacccaccgaggagcaagtttcttggctaagcaaggagtgggccaagagggcagcactgccgtcccatgttgtaaccatgctagacaacttccctacaaaccttcatccaatgtctcagttgtcggcagccgttaccgccttaaactccgagtcaaactttgcccgggcctatgctcaggggatcagccggactaaatactgggaattaatctacgaggattcaatggacctcattgccaaactcccttgcgtcgctgcaaagatttataggaatctttaccgagagggatccggaattggagccattgattcgaacctcgattggtctcacaactttaccaatatgctcggatacaccgaccaccagttcaccgagctcaccagactctaccttactatccattccgaccacgagggcggtaatgtctcagcccatacctctcaccttgttggaagcgctttgtccgacccttatctctcttttgccgccgcgatgaacggcctggcggggccactgcatggactcgctaaccaggaagtccttgtttggctgacgcaattgcagaaagaagttggtaaagacgtgagcgacgaaaagctccgagattacatctggaacactctcaattccgggagagttgtcccgggctacgggcacgcggtcttgcggaaaaccgatcccagatacacttgccagagagagttcgccttgaaacatctgccgaacgatccaatgttcaagctggtcgcccagctgtacaagatcgttcccaatgtgctgctggaacagggcaaggccaagaatccatggcctaacgtggacgctcatagcggggtcctgttgcagtattacggtatgacggagatgaattattatacagtgttgttcggcgttagccgtgccctaggtgtgcttgcccagttaatctggtctcgtgcactcggcttcccgctggagaggcctaagtctatgtcaacggagggcctgatgaaatttgtagactccaaatccgggtag

SEQ ID NO: 112387 - DNA, 537 bp, Artificial Sequence
  Description of Artificial Sequence: Synthetic coding sequence
atggctctgttgacggcggcagctagactactgggaaccaagaacgccagctgtctggttcttgccgcgcggcatgccagcgcctcaagtaccaacctgaaggatattctggccgatctgattccaaaggagcaggctcgaatcaagacttttcggcagcagcacggcaagacggtggtcggccagatcactgtggatatgatgtatgggggtatgcgtggcatgaagggtctggtctatgaaacttctgtcctggatcctgacgaaggaatccgatttaggggtttctccattcctgagtgccagaaactgctgcccaaggctaagggcggtgaggagcctctaccggagggtctcttttggctcctcgtcaccggccacatccccaccgaggaacaggtgtcatggctgtccaaagagtgggccaaacgtgctgcccttccgagccacgtggtcacaatgcttgataactttcctacaaatctgcacccaatgagccagttgtctgccgccgtgaccgccctaaattccgaatag

SEQ ID NO: 112388 - DNA, 6084 bp, Artificial Sequence
  Description of Artificial Sequence: Synthetic coding sequence
atgttgaagtttaagtacggcgcccgaaatcctctggacgccggcgccgctgagcctattgcaagccgagctagcaggctgaatttattttttcaagggaagccaccattcatgacacaacagcagatgtctcccttgagccgggaaggtatcctggatgcactgtttgtgctgtttgaggagtgcagccagcctgctctgatgaaaattaaacatgtgtcaaatttcgtgagaaagtattccgacactattgctgagctccaggagcttcagccaagcgctaaagactttgaggtgcgttccctcgtgggatgcggccattttgctgaggtgcaggtagtgcgagagaaggcaactggggatatatacgccatgaaggtgatgaagaagaaggcattacttgcccaggagcaggtgtctttctttgaagaagagagaaacattctatcccgatcaactagcccgtggatccctcaactccaatacgcctttcaggacaagaatcatttgtaccttgtaatggagtaccagccaggtggtgacttgctttcgttactgaaccgttatgaggatcaattggatgagaatctaattcagttctatctggccgaactgatcctggccgtgcactctgtgcatctcatgggttatgtacacagggacatcaaacctgaaaatattctggtcgaccgcaccgggcatatcaagctcgtcgacttcggtagtgctgccaaaatgaactctaacaagatggttaatgccaaattacccatcggcactccggactacatggcgccggaagtgttgacagttatgaacggcgatggaaaggggacttatggtctggattgcgactggtggagtgttggggtcatagcctacgaaatgatttatgggagatcaccattcgccgaggggactagcgcccgaactttcaacaacatcatgaactttcagaggtttctcaaattccccgatgatccgaaggtgtcctccgactttctggacctgatacagagtctcctatgtggacagaaagagcgtctcaaattcgagggcctgtgttgtcatccctttttttccaaaattgactggaataatatcagaaactccccaccccctttcgtgcctacacttaagtcagatgacgacacatctaactttgatgaacccgagaagaattcctgggtcagttcatctccctgccagttatctccatccggatttagtggcgaggagctgccttttgtgggtttttcctacagcaaggcactggggatccttggtaggtctgaatctgtggtgagcggtctggacagccccgccaaaaccagttctatggaaaagaaacttcttatcaaatcaaaggaactgcaggactcccaggataagtgccacaagatggagcaggaaatgacgcgacttcacagaagagtctccgaggtggaagccgtcctcagccagaaggaagtcgagctcaaagctagtgaaacccagagatctctcttggagcaggaccttgccacctacattaccgagtgtagctctctgaaacgaagcctggagcaagccagaatggaggtgtcccaggaggatgataaggctctacagctgcttcatgatatacgcgagcaatccagaaaattgcaagaaatcaaggaacaggagtatcaggcccaagtggaggagatgaggctgatgatgaatcagctggaggaggacttggtctctgcaaggcggcgctctgacctgtacgaatctgagctccgggagagccgacttgctgccgaggagtttaaaaggaaggccacagagtgccaacacaaattacttaaagcgaaggatcaaggaaaaccagaagtgggggagtatgctaaactggaaaaaatcaatgccgagcaacagttgaaaatccaagaactccaggagaagctggagaaggccgtgaaagcttccactgaggctacagagcttttgcaaaatatccgccaggccaaggagagagcagaacgcgagctcgaaaagttgcagaatcgcgaggattcctcagaggggattcggaaaaaattagtcgaggcagaggagctggaggaaaagcatcgcgaggcccaggtgagcgctcagcatttagaggtgcacctgaaacagaaggagcaacactacgaagagaagataaaagtgctagacaaccagattaaaaaagatctcgctgacaaagaaacactggagaacatgatgcaacgccacgaggaagaggcccatgagaagggaaagatcttgtccgaacagaaggccatgattaacgctatggattctaagatcagatctctcgagcaacgcattgtggagttgagcgaggcgaacaaactcgctgcaaacagcagtttattcactcagcggaatatgaaggcacaggaagaaatgatcagtgagctgcgccagcaaaagttctacctggaaacgcaggcagggaagctggaggcccaaaacagaaagctggaggaacagttagagaagattagtcaccaggaccactccgataaaaaccgcttactcgaactagagacgaggctgcgggaggtttccctggagcacgaagagcagaagctagagctaaagcgacagctcacagagttgcagctctcactgcaggagagagagagccagctgacagcactccaggccgctagagctgcgttggagagccagctgcggcaggcgaaaacagagctggaggaaactacagccgaagctgaagaggaaatccaggcacttacagcccacagagacgaaatccagcgtaaatttgatgccctccgaaacagttgtactgttatcaccgatctggaagaacagcttaaccagttgacagaggacaacgcagaactcaataaccagaatttttacctctccaagcaattagacgaagcaagcggggcaaacgatgagattgtgcagcttaggtctgaagtggatcatctgcgccgggagattacggaaagggaaatgcagcttaccagccagaagcagactatggaggcactgaagactacctgcacaatgctcgaggaacaagtgatggatttggaagccctgaacgatgagttgctcgaaaaagaacggcagtgggaagcatggcgatccgtgttgggcgacgaaaagagtcagtttgagtgtagggtgcgcgaactccaacgtatgctggacactgagaagcagtcgagagcccgggcagaccagcgtataacagaatcacggcaagtggtagagctggccgtgaaggagcataaggcagaaatcttagcactgcaacaggcgctgaaggagcagaagttaaaagccgagtccctaagcgataagctgaatgacctagaaaagaagcatgccatgctggaaatgaatgcccgctcacttcagcagaaattggaaactgagcgtgagttgaaacagaggctgctggaagaacaggcaaaactccagcaacagatggatcttcagaaaaaccacatctttaggttaacacaaggactgcaggaggctctggatcgcgcagatctccttaaaaccgaacggagcgatttggagtaccagctggagaatatccaagtcctctactcccatgagaaggtgaagatggaggggaccatcagccagcagactaaattgattgattttcttcaggcgaaaatggaccagccggcgaaaaaaaagaaaggcctcttctcgcgtaggaaggaggatccggcactgcctacccaggtgccattgcagtacaacgagctaaagttagctctagagaaggagaaagccaggtgtgccgaattagaagaggctctccagaagacacggattgaactccgaagcgcccgggaggaggctgcacacaggaaagcaacagaccatccgcacccatcaactcccgccacagcaaggcagcagatcgccatgagcgctatcgttcggtcacccgagcatcagccatcggctatgtcccttcttgcaccaccctcgtcaaggagaaaggaatccagtactcccgaagagttctcccgaagactgaaagaacgaatgcatcacaatataccccacagatttaatgtgggattgaacatgagggcaacgaaatgtgccgtctgtcttgatacagtgcactttgggcgccaggcgagcaagtgccttgaatgccaggtcatgtgtcaccctaagtgcagcacatgtctgccagctacttgtggactccctgccgaatacgcaacgcactttacggaggcattttgcagagacaagatgaatagcccaggcctgcaaaccaaggaaccctcctcatcattacatttggagggatggatgaaggtgccacgaaacaataagcgcggccagcaggggtgggaccggaaatatatcgtcctggagggcagcaaggtgttgatctatgacaacgaggcccgggaggccggacagcgtccagttgaagaattcgaactgtgccttccggacggcgacgtttcgattcatggggccgtgggggcttccgagctggctaacactgctaaggccgatgttccatacattctcaaaatggagtcacaccctcacaccacgtgctggccggggagaaccttataccttctcgctccctcttttccagataaacagcgatgggtaactgctctggagagtgttgttgccggcgggagggtgtctagagaaaaagccgaggccgatgccaaactgctcggtaatagtctgctcaaactggaaggcgatgaccggctggacatgaattgtactcttccattcagtgaccaagtagtgctggtggggaccgaagagggcctgtacgccttaaatgtgctaaaaaactctcttactcatgtgcctgggatcggggcagtgtttcagatctacatcatcaaggatctcgaaaaactgctgatgatcgccggggaggaacgagcactgtgcttggttgacgtcaagaaagtaaagcagagtctggcccaatcccacctgcccgctcaaccggatattagtcccaacatatttgaggctgttaaggggtgtcatctgtttggtgcaggcaaaatcgaaaatggtctctgtatttgcgccgctatgcccagcaaagtggtgatcctgaggtacaacgagaatctatcaaagtactgtattagaaaagagattgagacatcggaaccctgttcctgcatccactttacaaactactccatccttattgggaccaataagttctacgaaattgatatgaagcagtacaccctggaggagtttctggataagaatgatcactcactggcccctgctgtctttgctgcctcttccaactcttttcccgtcagcatagtgcaggtcaactccgccgggcaaagggaggaatatcttctgtgttttcatgaattcggagtgtttgttgatagctacggcagaagaagccgtactgacgatctaaagtggtcaaggcttcctctggccttcgcttaccgggagccgtacctgttcgtaacccattttaattcactcgaggtgatagagattcaagcacggagttctgctggaacacccgctcgcgcctacctggatattccgaatcctcgctatctgggacctgccatatcttcaggagctatctacctagcctcgagctaccaagacaaattgcgcgtaatttgttgtaaggggaatcttgtaaaagagagtgggacagaacatcacagaggacccagcactagtaggtcatcccccaataagcgggggccaccaacctataatgagcacataacaaagcgcgtcgcaagctcacccgctcctcctgagggaccctcgcatcctagggaaccctccacccctcaccgttatcgtgaagggcggaccgagctcaggcgggacaaatcaccagggcgccccctggaacgcgagaaaagcccgggcaggatgctctcaactcgccgggagcgtagtcccgggcgcctgtttgaagactcttcgcgtggtcgcctccctgctggggcagtcagaacacctctgtcccaggtgaataaagtgtgggatcagagttccgtgtag

SEQ ID NO: 112389 - DNA, 6210 bp, Artificial Sequence
  Description of Artificial Sequence: Synthetic coding sequence
atgctgaaatttaagtacggcgcaaggaatccactggacgctggtgccgcggaacctattgcctctcgcgcaagcaggctcaatctgtttttccagggaaagcctccctttatgacacagcagcagatgtctccactgtcccgagaggggatactcgatgcactctttgtcttattcgaagaatgcagtcaacccgcactgatgaaaatcaaacacgtctctaactttgtgagaaagtattcagacactattgccgaacttcaggagctgcaaccatccgcgaaggacttcgaggttcgcagcctggtgggatgcggccacttcgccgaagtgcaggtcgtgcgcgaaaaggctaccggggatatctacgcaatgaaagttatgaagaagaaggccctattggctcaggaacaggtttccttttttgaggaggagcggaatattctgtctagatccaccagtccatggattccccagctgcagtatgctttccaggacaagaatcatttgtacctggttatggaatatcagccaggcggggatcttctcagcctacttaaccgctatgaggatcagctggatgagaatctgattcagttttatttagccgagttaatactggccgtacattccgtacacttgatgggctacgtgcatcgcgacatcaagccggaaaatatcctagtggatagaacaggtcatatcaaactagttgactttggtagcgctgccaagatgaattcgaacaaaatggtcaacgctaaattaccgatagggactcctgactacatggcacccgaggttctcacagtgatgaatggtgacgggaagggcacttatggactggattgcgactggtggagtgtgggcgtgattgcctacgagatgatctatggccgcagtccttttgctgaaggaaccagtgctcggacatttaataacattatgaactttcaacggttcctgaagttccccgacgatccaaaagtcagttccgacttcctggacctaattcagtccctcctgtgtgggcagaaagagaggctgaagtttgaagggctgtgttgccatccattcttctcaaagattgactggaataacattagaaactcaccgccacccttcgttcccacgctgaagagcgacgacgatactagtaacttcgacgaaccagagaagaattcttgggtgtcatctagtccatgccagcttagccccagtggtttcagtggtgaggaactacccttcgttgggttctcgtatagcaaagcgctcggcattctgggccggtcagagagcgttgtctcggggttggattcccctgcaaaaacgagcagcatggaaaagaaattgctgattaagagcaaagagctacaagactctcaggacaagtgccacaagatggagcaggaaatgacccggcttcatcggcgagtcagcgaagtggaggccgttctgtcacagaaggaggtcgaactcaaagctagcgaaacccagagatcccttctggagcaggacctggcgacctatattaccgaatgttcctcactgaagcgctctctagagcaagcgaggatggaagtaagccaggaagacgacaaggcccttcagctcctgcatgacatccgagaacagtcacgcaagctgcaagagataaaggaacaggagtaccaggctcaggtggaagaaatgaggctgatgatgaatcagcttgaagaggatctggtttccgctcgccgaagaagcgatctgtatgaaagcgaactgagagaatctagactggccgccgaagaattcaagcgcaaagctactgaatgccaacacaaactcctgaaggcaaaggatcaggggaagcccgaagtgggcgagtacgctaaactggagaaaataaacgctgagcagcagttgaagatccaggaactccaggagaagttagaaaaggcagtcaaggcctctaccgaagcaaccgaactactgcagaacatcaggcaggcaaaggaacgcgccgagagggagctggaaaaattacagaatagagaggattcaagcgaaggcatccgtaagaaactggtcgaagctgaagaaaggaggcacagcctggaaaacaaagtcaaacgcttggagacaatggaaaggagggagaaccggctgaaggacgacatccagacgaagtcacagcagatccagcagatggccgataaaattcttgagctggaggagaaacatcgtgaagcacaagtgtccgctcagcacctcgaggtgcacctcaaacagaaagagcagcactatgaggagaaaataaaggtgctggataaccagataaaaaaagatctcgccgataaggagacactcgaaaacatgatgcagcgccacgaggaggaggcgcacgaaaaaggaaaaatcctgtctgagcaaaaggctatgataaacgctatggactctaaaattcgctccctggaacagcggattgtggagctcagtgaagccaataaacttgcagccaattcatccctcttcacgcagaggaatatgaaggcccaagaagagatgatatccgagttaaggcagcagaaattctatctggagacacaggctggaaagttggaggctcaaaacaggaagttggaggaacaattggaaaagatcagtcatcaagaccactctgacaagaatcgcctcctggagttagagacgcgtctgcgggaggtcagtcttgagcacgaggagcagaagctcgagcttaagcgccagctgaccgaactccagctgagcctgcaggagagagagtcacagctgactgcccttcaggcagcccgcgcagccttagagtcccagctgagacaggccaagacggagctggaggaaactacagccgaggcagaggaggagatccaggctctaactgcccatcgggacgagattcagcggaagtttgatgccctgagaaattcttgcacagttatcaccgatctcgaggaacaacttaatcaactcactgaggataacgctgagctgaacaaccagaatttttacctgagtaaacagcttgacgaggctagcggcgccaatgacgagatcgtgcaattacgcagtgaggttgaccatctgcgtagggaaattactgaaagggagatgcaactgacctctcagaaacagaccatggaggcattgaagaccacttgcaccatgctagaggagcaggtgatggatctggaggcattaaacgacgagctcctcgaaaaggagcgccagtgggaagcctggcggtcagtactgggcgatgagaagagccaattcgaatgtcgcgtcagggaactgcagagaatgttagacacggaaaaacagtcccgagctcgtgccgatcagcgcattactgagtcgaggcaggtagtggagctcgccgtaaaagagcacaaggcggagattctagcccttcaacaagcgttgaaagaacaaaagcttaaggccgaatctcttagcgataaactaaatgatctggagaaaaaacatgccatgctggaaatgaacgcacgatcactccagcagaagctcgaaactgaacgggaactgaagcagaggctgctcgaagagcaggccaagcttcagcagcagatggacctgcaaaaaaaccatatctttagattgacgcagggcctgcaggaagccctggaccgagcggacttgttgaagacagagaggtcagacttggaatatcagctagagaatatccaggtgttgtacagtcacgagaaggttaagatggaaggcactatcagccagcaaaccaaattaatagacttcctccaggctaagatggaccagcctgccaaaaaaaagaagggactgtttagcaggaggaaagaggatcccgccctacctacccaggttcctctccagtacaacgagcttaaactcgccttggagaaagagaaagcgagatgtgcagaactcgaggaagctctgcagaaaacaaggatcgaactacgctctgctcgcgaggaggcagcccaccgaaaagccaccgatcacccgcaccccagtacgcccgccactgccagacagcagattgctatgagcgccatcgttcgatcccctgagcatcagccatccgcaatgtcactgctggcaccccctagtagtagaaggaaagagagtagcacccctgaggagtttagccgtcgactgaaagagcgcatgcatcacaacatcccacaccggttcaacgtgggcctgaatatgagggccacgaagtgtgctgtgtgccttgacacggtgcactttggccggcaagcgagcaaatgcctggagtgccaagtaatgtgtcatccaaaatgcagtacctgcttgcctgctacttgcggactaccagccgagtatgctactcacttcaccgaagccttttgtcgcgataaaatgaattctccgggcctgcagactaaggaaccctccagtagccttcacctggagggctggatgaaagttccccggaacaacaaacggggacagcagggatgggacagaaagtacatagtgctggagggaagcaaggttttgatatatgataacgaagccagggaggcaggccaacgtccagtggaagaattcgagttgtgcctccctgacggagacgtgtctatccacggcgccgtcggagcttcagaactggccaacactgccaaggccgacgttccgtatatcctcaagatggaatctcaccctcacacaacctgttggcccgggaggaccctgtacctccttgcaccctccttcccggacaaacaaaggtgggttacagcccttgagtccgtggtagctggcggcagagtcagcagagagaaagccgaagcagacgctaagttgttggggaatagtttgctcaagctggaaggtgatgaccggctggacatgaattgcaccctcccctttagcgatcaagtagtcctcgtgggcacagaggagggtctatacgctctcaacgtgctcaaaaacagtctgacgcatgtgcctggcatcggcgctgtgttccaaatttacatcatcaaggacctcgagaagctcctaatgatcgcaggggaggaacgtgcactttgcctggttgatgttaaaaaagtgaagcagtccctggctcagagtcacctgcccgcccagcccgacatcagtccaaacatcttcgaggcagtgaaagggtgccatctgtttggagccggcaagatcgaaaacggtctatgcatctgtgccgccatgcctagcaaggtggtgatcctgcgctacaatgaaaatctaagcaaatactgtatccggaaggaaattgaaacctcagaaccctgctcatgcattcactttactaactattccatcctgataggaacaaataaattctatgaaatagatatgaagcaatatactctcgaagagttcttggacaagaatgaccacagcctggcaccggccgtgttcgctgcatccagcaactcctttcccgtcagtattgtgcaggtgaacagtgccggccagagggaggaatacctactgtgtttccatgaatttggggtgttcgttgattcttacggccgcagatcccgcaccgacgacctgaagtggtctagattacccctagcgtttgcctaccgggagccgtacttattcgtgacgcattttaactctctcgaagtgattgaaattcaagcccgaagctccgctggcacccccgcccgggcttacctggatatcccaaatccccggtatctgggcccggcaatttccagtggggctatttacctcgcctcctcttaccaagataagttgcgggtgatctgctgcaagggaaatctggtgaaagagagcggaaccgaacatcatcggggcccatccacctctaggtctagccctaataaaaggggccctccaacttacaatgagcacattactaaaagagtggcctcgtcaccagcacctcctgagggcccgagtcacccacgggaaccgtccacaccacacaggtacagggagggacgcactgagctccgccgagacaagtctccaggtcgccccctggagagagaaaagagccctggcagaatgctgagcacgcgtcgcgagcgatctccggggagactgttcgaggacagctcccgtggccgccttccggcaggtgccgtgcgtactccactgagtcaggttaataaggtctgggaccagtcatcagtgtag

SEQ ID NO: 112390 - DNA, 696 bp, Artificial Sequence
  Description of Artificial Sequence: Synthetic coding sequence
atggaccctgaacatgcaaaaccggaatcctcagaagccccgagcggcaacctgaaacagcccgagacagctgcggcactggcatcatccgggtccgttgtttctagtgtacctaaggctcaacggaacatcagtgcaaagaccgccccacggaagcacccagccgtgagtatccggagtgcccagagcgcggcggctgcaagacctcaagggagcgaagggaccgccccgtctcgaaaagcaacgacgagacctccacctaagcctaccctccctcctcctacccccagtgcccacacggaatccaagcttctcaatgagatggccatcaaggaacgagtggagggacgtgccaaagtaccttataagttcagggatagtctgaagcgatttagcttctcgcctaccggcatgctgaagatactgaggctgtctttaattctcggcgctttagcctgcttcataatcacgcaggcaaatgaaagctttatcaccatcacttcattagagatctgtatcgtcgtcttttttatcctgatctacgttttaacgctgcaccatctgctgacttacctgcactggcccctactggacctcaccaatagcattattaccgcggtctttctctctgttgttgctatactcgctatgcaggaaaagaagagacgccacctcctgtacgttggcgggaggtag

SEQ ID NO: 112391 - DNA, 369 bp, Artificial Sequence
  Description of Artificial Sequence: Synthetic coding sequence
atggaccctgagcacgccaagcccgagagctccgaggcgccttctggcaatctgaaacagccggagacggccgccgccttggcctcctcgggctcagtagacctgacaaactcaatcatcactgctgttttcctttcagtggtggctatactggccatgcaggagaagaagagaagacatcttctttacgtcgggggctccctctgcctgactgccgtgattgtgtgctgcattgacgcttttgtggtgaccaccaagatgcgaaccaatctgaagcggtttctgggggtggaggtagagaggaagctctctcccgcaaaggatgcctacccagaaactggacctgatgctcctcagaggcctgcatag

SEQ ID NO: 112392 - DNA, 351 bp, Artificial Sequence
  Description of Artificial Sequence: Synthetic coding sequence
atggatccagagcacgccaagcccgaaagcagtgaagcaccatcgggcaacctcaaacaaccagaaactgccgccgcacttgacctgacgaacagtataatcacggcagtgtttctgtccgtcgtggccatactggccatgcaagaaaagaagaggcggcacctgctgtatgttggggggagcctgtgtctaaccgccgtcatagtgtgctgcattgacgcctttgtggtgaccaccaagatgcgcaccaatttaaagagatttcttggtgtggaggttgagagaaagctatctcctgccaaagacgcatatcctgagacaggccccgacgctccccagcgccctgcttag

SEQ ID NO: 112393 - DNA, 279 bp, Artificial Sequence
  Description of Artificial Sequence: Synthetic coding sequence
atggatccagaacatgctaagcctgaatcttccgaagccccttccggcaatctgaaacagccagagaccgcggcagcgctcgcctctagtggtagtgtagtgtcctctgtgcctaaagctcaacgaaatatcagtgccaagaccgccccaaggaaacacccggccgtctcgattcgttctgctcagagtgccgccgccgccaggccgcagggtagtgaaggaaccgctccatctcgtattttgccgacagtctcattgcagctttgcagctttcagtag

SEQ ID NO: 112394 - DNA, 861 bp, Artificial Sequence
  Description of Artificial Sequence: Synthetic coding sequence
atggacccagagcacgccaaacccgagtcatcagaggcgcccagcgggaacctaaagcagcccgagacggccgctgcactcgcaagttcaggctcagtagtctcatcagttcctaaagctcaaagaaacattagtgcaaagactgccccaaggaaacatcctgctgtgtcaattagatccgcacagtctgccgcggccgcacggcctcaagggagcgagggaacggctccctcccgcaaggctacaacgcgtccacctcctaagccaaccctcccaccgcccacaccatctgcccacacggaatcgaaactcttaaatgagatggccattaaggagcgcgtggagggacgcgccaaagttccctacaagttccgcgactcactaaagagattctctttttcccctacaggaatgttgaagattctgcggttgtccctgatccttggcgctctggcttgctttatcatcacgcaggcaaatgaatcttttatcacgattacgtcactagaaatttgtatcgtcgtgttcttcatactgatctatgtactcacactgcatcacctactgacatatcttcattggcccctgcttgatctgacgaattcaatcattacggccgttttcctttctgtagtggctatcctggccatgcaggagaagaaaagacgccacctgctctatgtgggcgggagcctttgtctaacagcagtcatagtgtgctgcatcgacgcttttgttgtgacgacaaaaatgaggaccaacctgaagcgattcctcggagtggaggtggagcgaaagttatcgccagctaaagacgcctaccccgaaacaggcccggatgccccacagcgccccgcatag

SEQ ID NO: 112395 - DNA, 510 bp, Artificial Sequence
  Description of Artificial Sequence: Synthetic coding sequence
atggatcccgaacacgccaagcccgagtcctcagaggccccttccggaaaccttaagcagccggagaccgccgccgctttatcgctgattctgggtgccctcgcgtgttttattattactcaggcgaatgagtcgttcataacaattacctcactggagatatgcatcgtagtcttctttattctgatttatgtgctgaccttgcaccacctgcttacataccttcattggcccctcctggatttaaccaactcaattatcaccgcagtgtttctctccgtggtggcaattctggctatgcaagaaaaaaagcggcgccacctgctctatgtgggaggaagcctgtgcttgaccgccgtgatagtgtgctgcatcgacgcctttgtggtgacaacgaagatgagaacaaatttgaagcgcttcttaggcgttgaggtggaaagaaaattatcacctgccaaagacgcttacccagaaaccggacctgacgctccccaacggccggcttag

SEQ ID NO: 112396 - DNA, 345 bp, Artificial Sequence
  Description of Artificial Sequence: Synthetic coding sequence
atggaccccgaacacgcgaagcccgagagtagcgaagctccttcaggtaaccttaaacagcctgagacagcagccgccctctcattgatcttaggcgcactcgcttgtttcatcatcactcaggcaaacgagagctttatcacaatcacttccctcgagatttgcatagtcgtgttctttattctgatatacgtcctgactctacaccatctgctgacttatctgcactggccgctgctcgatcttactaacagtatcattacggccgtatttttaagcgtcgtggcaattctcgccatgcaggagaaaaaacggaggcaccttctttacgtcggggggcgatag

SEQ ID NO: 112397 - DNA, 117 bp, Artificial Sequence
  Description of Artificial Sequence: Synthetic coding sequence
atggacccagaacatgctaaacccgaaagtagcgaggcccctagcggcaacctgaagcaacccgagactgctgcagcgttggaggccgataaagctaatatgagcaattttaattag

SEQ ID NO: 112398 - DNA, 87 bp, Artificial Sequence
  Description of Artificial Sequence: Synthetic coding sequence
atggacccggagcacgctaagcctgagtcttcggaggccccttcaggcaacctcaaacaacccgagaccgcagcagctttgcggtag

SEQ ID NO: 112399 - DNA, 747 bp, Artificial Sequence
  Description of Artificial Sequence: Synthetic coding sequence
atggctcctaaggcggctaaaggcgctaagccggagcccgcccccgccccacctccacccggtgctaaaccagaagaggacaagaaggacggcaaagaaccatctgacaaaccccagaaagccgtgcaagaccacaaagagccctccgacaaaccacagaaagccgtacaaccaaaacatgaagtgggaactagaagagggtgcagacggtacagatgggaactgaaggactcaaataaagagttctggctgctcggccatgcggagatcaagattcgaagcctcggatgcctgatcgcagctatgattctactctcctccctcaccgtgcatcccatactgcggctgattattaccatggagattagcttctttagcttctttattctactttactccttcgcaattcatcgctatattccatttattctatggcccatttccgacctttttaacgatctgatcgcctgtgcctttctggtgggagcagtggtgttcgcagtccggtctagaaggtctatgaatttgcattatctgctggccgtcattctgatcggggctgccggggttttcgccttcatcgatgtgtgcttgcagaggaaccattttcggggtaagaaagctaaaaaacacatgctggtgcctccgccaggaaaagaaaagggcccacaacaggggaaaggaccagaacctgccaaaccgcccgaacccggaaagcctcccggaccagctaaggggaagaagtag

SEQ ID NO: 112400 - DNA, 588 bp, Artificial Sequence
  Description of Artificial Sequence: Synthetic coding sequence
atggctcctaaggctgccaagggcgctaagccggagcctgcccccgcgccaccccctccaggagccaaacccgaggaggacaagaaggacggaaaggagcccagtgacaaaccgcagaaggccgtgcaagatcataaggagccgtccgataagccccagaaggccgtgcagcccaagcacgaggttggaaccagacgggggtgccggagatatagatgggagctgaaggatagtaataaggagttctggctgctgggccacgcagaaattaaaattcggtctttagatctattcaatgatctcattgcctgtgcattcctcgtaggggctgtggtgtttgctgtgagaagtcggaggagcatgaatctacactatcttctcgcggtcatcctgataggtgcagcaggggtctttgcttttatcgacgtgtgccttcagcgaaaccatttcagggggaagaaggccaagaagcacatgttggtcccacctcctggaaaggagaaaggcccgcagcagggaaagggacctgagccagctaagcctcctgagcccggcaaacccccaggtccagcaaaggggaagaaatag

SEQ ID NO: 112401 - DNA, 180 bp, Artificial Sequence
  Description of Artificial Sequence: Synthetic coding sequence
atgtggccacctgaccccgatccagatcctgatcctgagccagcggggggtagccggcccggccccgctgttcccgggctaagggccctcctgcctgctcgcgcctttttgtgcagtctcaaggggccgggcggtttcgtctgcacatggtgctcctgcccacaccagcccctttggtag

SEQ ID NO: 112402 - DNA, 549 bp, Artificial Sequence
  Description of Artificial Sequence: Synthetic coding sequence
atgtggccccccgatcccgatcccgatcctgaccccgagcccgccggtggttcccgacctggtcccgcagttcccggcctgcgggctctgctgcctgcacgggccttcctctgctctttgaaagggcgcttgctactggcagaatcgggacttagctttattacatttatatgctatgtcgcatcaagtgccagtgcgtttcttacagccccactgcttgagttcctcctggctttgtatttcttattcgcagacgccatgcaactcaacgacaaatggcagggcctgtgttggcccatgatggatttcctgagatgtgtgacagccgctttaatttacttcgccatttcaatcactgcaattgccaaatactcggatggcgcttccaaagccgccggcgtgtttgggttttttgctaccatagtgttcgcaaccgacttttacttgatattcaatgacgtagcaaaattccttaaacagggagactccgctgatgaaaccaccgcccataagaccgaagaggaaaactcagatagtgactccgactag

SEQ ID NO: 112403 - DNA, 549 bp, Artificial Sequence
  Description of Artificial Sequence: Synthetic coding sequence
atgtggccacctgatcccgatcccgaccctgaccccgaacctgcggggggttcccgaccaggtcctgccgtgcccggactgcgcgcactactgcccgccagggccttcctttgcagcctcaaagggaggctcctgctggcagagtcaggactgtcattcattacttttatttgttacgttgcatccagtgcctcggcctttctcaccgcccctctgcttgaatttttattagccctgtacttcctatttgccgacgctatgcagctgaatgataaatggcaaggcttatgctggcctatgatggactttctgaggtgtgttaccgccgcattaatctactttgcaattagtataaccgcgattgccaaatactcagacggggcatccaaggccgcaggcgtgtttggtttttttgccactatcgtctttgccactgacttctacctgatcttcaatgacgtggccaaatttctgaagcagggagattcagccgatgagacaacggcccataaaactgaggaagagaacagtgacagcgactctgattag

SEQ ID NO: 112404 - DNA, 549 bp, Artificial Sequence
  Description of Artificial Sequence: Synthetic coding sequence
atgtggcctccggatcctgatccagaccccgatccagaacccgcaggtggttctcgccctggacccgccgttcccgggctgagggctttactgccagctcgggcgttcttatgttctttgaagggcaggctgttgttagccgaatcaggtttgagctttattaccttcatctgctacgtggcgtcatctgcttccgcctttctcactgcccccttactggagtttttgctggccctgtacttcctgttcgccgatgcgatgcaactcaatgataagtggcaaggactctgctggcctatgatggacttcctgaggtgcgtcaccgctgcgctgatttatttcgcaatcagtatcaccgccatcgctaaatatagtgatggcgcctcaaaagccgcaggagtctttggctttttcgctacgattgtgttcgcgaccgacttttatctgatctttaatgacgtagccaagtttctcaagcagggtgattcggctgatgaaacgactgcgcacaagaccgaggaagagaactctgattccgattctgattag

SEQ ID NO: 112405 - DNA, 705 bp, Artificial Sequence
  Description of Artificial Sequence: Synthetic coding sequence
atgcgttcgggggaggaactagacggcttcgaaggcgaggctagcagtactagcatgatcagcggtgctagttcaccctatcagccaactacagagcccgtgtctcagaggcgcggcctggccggcttacggtgtgacccggactatctgcgtggcgccctagggaggctgaaggttgcacaggtcattctcgcccttattgccttcatctgcatcgagacgataatggcctgttcgccttgcgaaggactgtatttctttgagtttgtcagctgttccgcgtttgtggtcacaggagtgcttcttattatgttctcactcaatctgcacatgcgaattcctcaaattaattggaatctgacggacctggtgaacacaggcctgagtgcattcctattcttcatcgccagcatcgtattggccgcgctcaaccatagagccggtgccgaaattgccgccgtgattttcggcttcctggctaccgcagcttatgctgtcaatacgttcctggcggtccagaaatggcgcgtaagtgtgcgtcagcaatctacaaatgattacatccgggctagaacagagtcaagggacgtcgacagcaggcctgaaattcagcggcttgatacttttagctattccactaacgttactgtgcgcaagaagtcgccaactaatctgctgtccctgaatcattggcagcttgcgtag

SEQ ID NO: 112406 - DNA, 627 bp, Artificial Sequence
  Description of Artificial Sequence: Synthetic coding sequence
atgaggagcggggaagagttggacggattcgaaggagaagcttcctcgacatcgatgatctctggggcctccagcccctaccagccaacaaccgaacccgtcagccagcgtcgcggcctcgccggactgcgctgcgatccagactatctaaggggtgcactgggccggctcaaggtggcccaggtgatactagcactgatcgccttcatatgcatagagacaattatggcttgctcaccttgcgagggactctactttttcgaatttgtgagttgttcagctttcgttgtcaccggtgtacttctcatcatgttttcgctgaatttgcacatgcgaataccgcagattaactggaatctgactgacctagtgaacactggtctctctgccttccttttctttatcgccagcatcgtcttggctgccctgaaccaccgggctggggcggagattgctgcagtgattttcggattcctggcgaccgccgcgtacgcagtgaacaccttcctggcagtccaaaaatggagggtgagcgtgcggcagcagagcacaaacgactatatcagagcaaggacagagtcccgcgacgtggatagcaggccagagattcaacgcctcgacacttag

SEQ ID NO: 112407 - DNA, 672 bp, Artificial Sequence
  Description of Artificial Sequence: Synthetic coding sequence
atgctctcagccagagaccgtcgggatagacaccctgaggagggagtggtggccgagctgcagggtttcgcagtcgataaagcattcctgacgtcccataagggtatcctgttagaaacagagctggctcttaccttaatcatttttatctgcttcactgccagtatctccgcctacatggccgccgccctgctggagttctttatcacattggccttcctctttctgtacgcaactcaatactaccagcggtttgataggattaattggccgtgtctactgcaaggtcatggacagtccgggggcccacacccgcttgatcttctcagccactctgccaaggttcagccccagccatggcccgggttgactccccctgggtggcacactcctgcagctgttccgtgggttccggctcccgccccagggttctggagctggttactgtggtttatctgttttcacagtcttggctccagcgattttctgcgatgtgtctcagccattatcatcttcctggttgtgagcttcgccgccgtgacctcaagggacggtgcggcaatcgctgcgttcgtctttggaatcattcttgtctcgatcttcgcctatgatgccttcaaaatttaccgaactgagatggcccctggggccagccagggtgaccagcaatag

SEQ ID NO: 112408 - DNA, 225 bp, Artificial Sequence
  Description of Artificial Sequence: Synthetic coding sequence
atgttgagcgccagagaccgcagggaccgccaccccgaagagggtgtagtagctgagctacaaggattcgccgttgacaaggccttcctgacctctcacaaggggatcctcttagagacagaactcgtgttcggaatcatcctggtgtccatctttgcctacgacgcgtttaagatctataggaccgagatggccccaggggcatcccagggcgatcaacagtag

SEQ ID NO: 112409 - DNA, 471 bp, Artificial Sequence
  Description of Artificial Sequence: Synthetic coding sequence
atgctttccgctcgtgataggagagacaggcacccggaggagggagttgttgcggagcttcaaggattcgccgtggataaagcttttctcactagccataaaggaattctcctggagacagagttagcacttacgcttattatttttatatgtttcacagccagtatctccgcctatatggccgccgccctcctggagttttttattacactggcattcctttttctgtatgccacacagtattatcagcgcttcgaccgaattaactggccatgcctggactttcttcggtgcgtctcagctattatcattttcctggtggttagctttgctgctgttacatcaagggacggggcagccattgctgccttcgtgtttggtattatcctggtctccatttttgcatacgatgcatttaagatctatcgaacggaaatggcacccggcgcttcccagggtgaccagcagtag

SEQ ID NO: 112410 - DNA, 378 bp, Artificial Sequence
  Description of Artificial Sequence: Synthetic coding sequence
atgctgtctgcaagggatcggcgagacagacaccccgaggagggggtcgtggccgagttacaaggttttgccgttgataaggcatttctgacttcccataaagggattcttttggagactgaactggcattgaccttgatcattttcatctgctttacagcatccatctccgcttacatggcagccgcactcctggaattctttattaccctagctttcttgttcctgtacgcaacccagtactatcagaggttcgatcgcattaattggccctgcctcgtttttggcatcattttggttagcatcttcgcttacgatgctttcaagatctatagaaccgagatggcccccggagcaagccaaggagatcaacagtag

SEQ ID NO: 112411 - DNA, 318 bp, Artificial Sequence
  Description of Artificial Sequence: Synthetic coding sequence
atgctgtcagcccgggataggcgcgacagacaccctgaggaaggggtcgtagccgagttacagggatttgccgtggataaggccttcctgacatcccacaaagggatcttgctggagacggaactggactttttgcgctgtgtcagcgcgataatcatattcctagtggttagttttgcagcggtgactagccgggatggagccgccatcgcagcctttgtgttcggcataattcttgtgagcatctttgcctacgatgcctttaaaatttaccgaacagagatggcacccggtgccagtcagggggaccaacaatag

SEQ ID NO: 112412 - DNA, 1326 bp, Artificial Sequence
  Description of Artificial Sequence: Synthetic coding sequence
ccctcacctgccatcggcctattcgcttccatggcagcagtgcttctgggcggcgctagagccagtcggttgttatttcagaggttgctctgggacgtggtccggtcacctatttccttctttgaaaggacccccattggccacctgctcaatagattctcaaaggagacggacacagtagacgttgatatccctgataagctgcggtctctgctcatgtacgcctttggcctcctggaggtctccctagtggttgccgtggcaactcccttacctctctggccgtcctgccattgtttttcctccacgcttggcttcagatggctggctgcaaacgttgagctcctcggaaatggacttgtatttgccgccgcgacctgtgcggtcctgagcaaggcccacttaagcgctggcctcgtcgggttcagtgtgagcgccgctctgcaggtcacacagacccttcagtgggttgttcgcaattggacagatctagaaaacagcatcgtgagcgtcgaacggatgcaggattacgcatggactcctaaagaagccccatggaggctgcccacatgtgcagcacagccaccgtggccccaaggaggacagattgagttccgtgacttcggactgcgttacagaccggagctccctctcgccgtccagggtgtgtcatttaagatccatgccggcgaaaaagtggggattgtaggccgtactggtgctggtaagagctccttggccagcggactactgcggcttcaggaagccgctgaaggtggtatttggatcgatggtgtaccgatcgcacacgtggggctacataccttaaggagtaggataagcatcattccacaggatcctatactgtttcccggctcacttcggatgaaccttgacctgttgcaggagcatagcgatgaggcaatttgggccgcactcgaaaccgtgcagctgaaggcactggtggcaagtctgcctggtcagcttcagtacaagtgtgccgaccggggcgaagatttatctgtgggtcagaaacagctgctttgtctggcccgcgcccttctgcgtaaaacgcagatccttatcttggacgaggccaccgcagcagtggatcctgggacggagctccagatgcaggcgatgttaggcagctggtttgctcagtgtacagtccttctcattgcccacagattacgatccgtgatggactgtgcacgagtgttggtgatggacaaaggtcaggttgcggagtccggcagtcccgcacagctactagcccagaagggcctcttttaccgattggcccaggagtctgggctagtttag

SEQ ID NO: 112413 - DNA, 528 bp, Artificial Sequence
  Description of Artificial Sequence: Synthetic coding sequence
atgagccatggcgctggattagtaagaaccacctgttcatctggctctgcactgggtcctggggccggtgccgcacagccctccgccagccccctggagggactcctggacttgagttaccctagaacacacgcagcccttctgaaggtggctcagatggtgacactgcttattgcctttatatgtgtacggagtagcctgtggactaactactctgcctactcatattttgaggttgttacaatttgcgacctaatcatgatattggctttctatctggtccacctgttccggttctacagggtgctcacatgcattagttggccactctctgagctactgcattatctgatcgggacattgttgctcctgatcgcctccatagtggccgcaagtaagagctataaccagtcaggcttggtggctggtgccatctttggctttatggccacgttcctgtgcatggcttctatctggctaagctacaaaataagctgcgtcacccagtctacagacgccgcagtatag

SEQ ID NO: 112414 - DNA, 429 bp, Artificial Sequence
  Description of Artificial Sequence: Synthetic coding sequence
atgagccacggcgcgggtttagtgagaacgacctgttcttccggcagcgcgctaggcccgggtgcaggcgccgcacagccgtctgcctcccccctggaggggctgctggacctgagttatcccaggacacatgccgctctgctgaaagttgctcagatggtcactttgctcattgcatttatctgcgttcgctcgagcctctggacaaactatagcgcatattcctatttcgaggtcgtgacaatctgcgatctcattatgatcctggccttttatttggtgcacctgtttagattttaccgtgtacttacctgcatttcatggcctctctccatctttggtttcatggccactttcctatgtatggcatccatttggttgtcctataagatctcatgcgttactcagtctactgatgcggctgtttag

SEQ ID NO: 112415 - DNA, 522 bp, Artificial Sequence
  Description of Artificial Sequence: Synthetic coding sequence
atggaggagccccagagggctcgctctcatactgttaccaccactgcatcatctttcgcagagaatttttctacttcctctagcagctttgcttatgatcgagaattcttacgaactttgcctggattcctgattgtagcagagatcgtactgggcttgctggtgtggactctgatcgcgggaaccgaatacttccgagtccccgcattcggttgggtgatgtttgtggccgttttttactgggtattaaccgtgtttttccttatcatatatatcactatgacatacacgagaatcccacaggtcccgtggacgactgtagggctttgctttaatggttctgcattcgttctgtacctttccgccgcagtcgtcgatgcttcttccgtatctcccgagcgcgatagccacaactttaactcctgggcagcaagttccttttttgcctttctggtgaccatttgttacgccggcaacacctatttttccttcatcgcctggcgaagccggacaattcagtag

SEQ ID NO: 112416 - DNA, 363 bp, Artificial Sequence
  Description of Artificial Sequence: Synthetic coding sequence
atgcaggctctacagcagcagccggtcttccctgatctcctgaaagcaatccctgtcagtatacatgttaatgtgatcctgttctccgccatcttgattgtgctgactatggtggggactgctttctttatgtacaacgcattcggaaagccttttgagacgctgcatggtcccctgggcttataccttttgagcttcatctcagggtcctgtggatgcctcgtcatgatcctctttgcttccgaggtcaagattcatcatctctctgagaaaattgccaactataaagagggtacttatgtctataagacacagtcagagaaatacaccacttccttttggctgaccaaaggccatagttag

SEQ ID NO: 112417 - DNA, 699 bp, Artificial Sequence
  Description of Artificial Sequence: Synthetic coding sequence
atgcccagccagcagaagaaaataatcttctgtatggccggcgtctttagtttcgcctgtgcactgggcgtcgtgactgcgctaggaacgccactctggattaaggcgaccgtgttatgcaaaacaggcgctcttttggtgaacgcttccggccaggaacttgataaattcatgggcgaaatgcagtacggtctgttccacggtgagggtgtccgacagtgcggtctcggggctagaccatttagatttagcttctttcccgacttgctcaaggccattcctgtgtcaatccacgttaacgtgatcctgttctctgccatcctgattgtcctgacgatggtgggcacagccttttttatgtacaacgcattcggcaagccttttgaaacgctacacggccctttgggcctgtaccttctgagcttcatcagtggctcctgcggatgcctggtaatgatactcttcgcatccgaggtcaaaatccatcatctgagcgagaaaatcgccaactacaaagagggaacttacgtgtataagacacagtctgaaaagtacacaactagcttttgggtgatttttttttgcttttttgtccattttctaaatggactgctgatccgcttagcaggattccagtttcctttcgctaagagtaaagacgctgagaccaccaacgtcgctgctgacttgatgtattag

SEQ ID NO: 112418 - DNA, 738 bp, Artificial Sequence
  Description of Artificial Sequence: Synthetic coding sequence
atgccttcccagcagaaaaagatcattttttgtatggctggtgtgttctccttcgcttgcgctctgggcgtggtgacggcactcggcacaccgctgtggatcaaggccacggttctctgcaaaactggcgcgctcctggttaacgcttccggccaggaattggataaatttatgggagaaatgcagtatggcctgtttcacggagagggtgttcgccaatgtgggctgggcgcgaggccttttcgcttctcctttttcccagatttgctgaaggccattccggtaagcatccatgtcaacgtgatattgttcagcgcaatcttaatcgtgctgactatggtcggaaccgccttctttatgtacaatgcttttggtaagccctttgagactttacacggcccattggggttgtacctgctctcgtttatctcggtggccctgtggcttccagccacgaggcaccaggcccagggaagctgtgggtgcttggtgatgatactattcgcttctgaagtcaaaattcaccaccttagcgaaaagatagccaactacaaggaggggacatatgtatacaagactcagtctgagaagtataccacgtccttctgggttatttttttctgcttttttgtgcacttcctgaatgggctgctgatccgtctggcggggtttcaatttccctttgcgaaatctaaggacgccgagacaactaatgtggcggccgacttaatgtactag

SEQ ID NO: 112419 - DNA, 348 bp, Artificial Sequence
  Description of Artificial Sequence: Synthetic coding sequence
atgcaggcattgcagcagcagcccgtcttccccgatcttttgaaggccatccccgtgagcatccatgtgaatgtgatactcttcagcgctattctgatcgtcctgactatggtggggacggctttcttcatgtataacgcctttggaaaaccgtttgagactttacatggacccctggggctgtacttgctatcttttatttcgggctcctgcggctgtctcgtaatgatcctgttcgcatcggaagtgaagatccaccatctttcagaaaaaatcgctaactataaggaggggacctatgtctataaaacacaatcggaaaagtatacaaccagcttctgggtctag

SEQ ID NO: 112420 - DNA, 1878 bp, Artificial Sequence
  Description of Artificial Sequence: Synthetic coding sequence
atgaattactcagaaatcgagagtaaagtgcgagaagccactaatgatgatccctggggcccctctggccagctaatgggggaaatcgccaaggccacatttatgtatgaacaattccctgaattgatgaacatgctgtggagccggatgctcaaggataacaaaaagaactggcggagagtgtataagagtctgctcttgctggcatatttgattcgcaacggatctgagcgcgtcgttacctcagcccgtgaacacatatacgacttgcggagcctggagaactatcacttcgtcgacgagcatggcaaagatcaaggcatcaatatcaggcagaaggtgaaagaactggtcgagtttgcacaagatgacgaccgacttagagaagaacgtaaaaaggctaagaagaataaggacaagtatgtcggagtgagctccgattccgtggggggttttcggtatagcgagcgttatgacccggaaccaaaatcaaagtgggatgaggagtgggacaaaaacaaatctgcctttcccttcagtgacaaacttggcgaactgagcgataagattggaagcacaattgatgataccatcagtaaattccgcagaaaggacagggaggacagccctgaaaggtgctccgacagcgacgaggagaaaaaggccagaaggggccgctctcctaagggcgagtttaaagacgaagaagagactgtcacaacaaaacatatccatatcactcaggccactgagactaccacaacaagacataaaaggactgccaacccatcaaaaactatcgacttgggtgctgccgcgcactataccggggataaggccagccccgatcagaatgcctcgacacacaccccacagagctccgtcaaaaccagcgtcccgagctccaaaagcagcggcgacctggtagatttgttcgacggcacatctcaatcaactggcggcagcgccgacctgttcggaggtttcgccgatttcggatcagctgcggcatctgggagcttccctagtcaagtcaccgctacctcaggcaatggggattttggcgactggtctgcattcaaccaggcgccttccggaccagtcgcgtcatccggggagttcttcggatcagccagccagccggctgtggagctcgtcagtggttctcagagcgcactgggcccacctccagcggccagcaacagctcggacctgtttgatcttatggggtcttcccaagctacgatgactagtagtcagtccatgaacttctctatgatgtccacaaacacggtgggcctaggacttccgatgagtcgctctcagcccttacagaatgtttctaccgtgttgcaaaagcctaacccactgtacaaccaaaacactgacatggtccagaagtctgtgagcaaaacactgccctcaacctggtccgacccgagcgtcaacatttccttggacaacctgctgcccggaatgcagccaagtaaaccccagcagccttcactgaatactatgatccagcagcagaatatgcagcagcctatgaacgtgatgactcaaagctttggcgccgtcaacctatcctcccccagtaatatgctaccggtgcgccctcaaactaacgctctgattggcggacccatgcccatgtccatgcccaacgtgatgacgggaacaatgggaatggcccccctgggtaatactccaatgatgaatcagtcaatgatgggaatgaatatgaacattggtatgtcagccgccggaatgggactgacaggtacaatgggcatggggatgcctaatatagctatgacctccggaacagtgcagccaaaacaggatgcatttgccaacttcgccaacttttcaaaatag

SEQ ID NO: 112421 - DNA, 1878 bp, Artificial Sequence
  Description of Artificial Sequence: Synthetic coding sequence
atgctgaatatgtggaaggtgagggagcttgtggacaaggctactaatgtagtgatgaactacagcgagatcgaaagtaaggttcgcgaagccaccaatgatgatccatggggaccgagtggacagttaatgggggagattgctaaagcaactttcatgtatgagcagtttcctgagctgatgaatatgctttggagcaggatgcttaaagacaataaaaaaaattggcgaagggtgtacaagagccttctgctgctggcctatctcattaggaatgggagcgagagggttgttactagcgctcgtgagcatatttatgatcttcgtagcctagagaactaccattttgtggatgagcatggcaaggaccagggtattaacatcaggcaaaaggtgaaagaactggtggagtttgcccaggatgacgatcgactccgcgaggagagaaagaaagctaagaaaaacaaagataaatacgtgggtgtatcatcagactcagttggagggtttcgatactccgaaaggtacgatccagagcccaaatccaaatgggatgaggagtgggacaagaataaaagcgcttttcccttttctgacaagctgggggaactcagcgacaagatcggcagcacaattgacgataccatttcgaaatttagacgcaaggacagagaagacagccctgagcgctgttcagactcagacgaggaaaagaaggctcgaaggggtaggtcaccgaagggagaattcaaagatgaggaggagaccgtgacgacaaagcatatccacatcacacaagctacagaaacgacgaccaccaggcacaaaaggacggccaatccgagcaaaactatagatctgggcgcagcagctcactatacaggagataaggcttcccccgatcagaacgcctctactcatactccccagtccagcgtgaagaccagcgttccttcctctaagagcagcggagacctcgtggacctgttcgacgggacaagccagagtacagggggctccgcggacctgtttgggggatttgctgattttggatcggcggctgcatctggctcgttcccttcccaggtaacagctacaagcggcaacggcgacttcggtgactggtcagcttttaaccaggccccgtccggcccagtggcctcttctggtgaatttttcggtagtgccagtcagcccgctgtcgaactcgttagtggatcccaatccgctttgggtccacctccagctgcgagcaatagcagtgatctattcgatctcatgggtagcagccaagcaaccatgacctctagtcagagtatgaactttagcatgatgagcacgaacaccgtcggtctaggcctgcctatgtctcgtagtcagaatacggacatggtccagaaatccgttagcaaaacactaccctctacatggtctgatcccagtgtgaatatctccttggacaaccttctcccgggcatgcagccctcgaaaccccagcagcccagcctgaacaccatgatacagcaacagaacatgcagcaacccatgaacgtaatgacccagtcatttggagcggttaacctgtcctctccctccaacatgctgccggtgcggcctcaaaccaatgccctaattggtggcccaatgcctatgagcatgcccaacgtgatgactggcaccatgggcatggcaccattgggcaacacacccatgatgaaccagagcatgatgggaatgaatatgaatatcggcatgtcggcagcagggatggggttgaccggcaccatgggtatggggatgccaaacattgcaatgacctccggcacagttcaaccaaaacaagacgcttttgcaaacttcgccaacttttccaaatag

SEQ ID NO: 112422 - DNA, 1878 bp, Artificial Sequence
  Description of Artificial Sequence: Synthetic coding sequence
atgaattatagcgagatcgaaagtaaggttagagaggctaccaacgacgacccctgggggccttcgggacagttgatgggcgagattgccaaggcgacctttatgtatgagcagtttccagaactcatgaatatgttgtggagccgcatgctcaaggataacaaaaaaaattggaggagagtatacaaatctttacttttgctggcttatctgataagaaacgggtctgagcgggtggtcacttctgctagagaacacatatatgatctgaggtccttagagaactaccactttgtggatgagcatggtaaggatcagggcataaatatccgacaaaaggtcaaagagttggtcgagttcgcacaagacgatgacaggctccgcgaagagaggaagaaagccaaaaagaacaaggataaatatgtgggagtgtcttcggactctgttggcgggttccgttactccgagcgctatgatccggagcctaagtcgaagtgggatgaagagtgggacaagaataagtctgctttccccttttctgacaaactgggggagctttctgacaaaataggcagtacaattgatgacaccatttccaagttccgcagaaaagaccgcgaagatagccccgaaagatgctcagacagcgacgaggagaaaaaggccagacgtggtagatcaccgaagggggaattcaaggacgaggaggaaaccgtgactacaaagcatattcatatcactcaggccacagaaaccaccacgaccaggcataaaagaacagcaaatccatcaaaaaccatcgacctgggcgccgcggcgcattacacaggtgataaagcttcgcccgatcagaacgccagtacacacaccccacagtcctccgtcaagacctccgtcccgtccagcaagtctagcggggatctggtcgatcttttcgatggtacatcccagtctaccgggggatcagctgatctctttggaggctttgccgattttgggtctgccgctgctagcggatctttcccaagccaggtcacagcaacctccggcaatggagacttcggtgactggtctgcatttaaccaggctccgagtgggcccgttgcttcatcaggagaattttttggcagcgcatctcagcctgcagttgaactggtctcaggttcgcagtctgctctcgggcccccccccgctgcttctaattccagcgatcttttcgacctgatgggctcttcacaggcaacaatgaccagctcccaatccatgaacttcagcatgatgagtaccaacacagtgggccttggtctccctatgtcacgttcccagcccttgcagaacgtcagcacagtactgcaaaagcccaacccgctctataaccaaaatactgacatggtgcagaagagcgtctcaaagacgttaccttccacttggagcgacccttccgtgaacatatccctggacaacctgctcccagggatgcagccatcaaaaccacagcaaccgtcactgaatacaatgatccaacagcagaatatgcagcagccaatgaacgtcatgacgcagagctttggcgcagtaaacctgtcaagtccaagcaatatgctcccagtgcgaccccaaacaaacgccctgataggtggccccatgcccatgtcaatgcccaacgtgatgaccggcacaatgggcatggcccctctcggcaatacacccatgatgaaccaaagcatgatggggatgaacatgaacatcggaatgtcagccgcgggcatggggctcacagggactatgggtatggggatgcccaatatcgcaatgacctctggcacagtgcagccaaagcaggacgcattcgcaaactttgcaaacttcagcaagtag

SEQ ID NO: 112423 - DNA, 1878 bp, Artificial Sequence
  Description of Artificial Sequence: Synthetic coding sequence
atgaactattctgagatcgaaagtaaagtgagagaagccaccaacgatgatccctgggggcccagcggccaactgatgggcgagattgctaaagccacatttatgtacgagcagttcccagagctgatgaacatgttatggtctcggatgctgaaagataacaagaaaaactggcgtagagtgtataagtctttacttttactcgcctatctgatccgtaacgggtccgaaagggtggtgaccagcgctcgagaacacatatatgatctgcgcagcctcgaaaattatcatttcgtagatgagcacggtaaggaccagggcattaacattcggcagaaggtcaaagagcttgtggaatttgcacaggatgatgaccgcctcagggaagaaaggaagaaggcaaagaaaaacaaggataagtatgtgggcgtgtcttcagactcagtggggggcttccgctacagcgagcgatacgatcctgagcctaaatcaaaatgggacgaggagtgggataaaaataagagcgcttttcctttttctgacaaactaggtgagctctccgacaaaatcggatcaactatagacgataccatcagcaagtttaggaggaaagacagagaagattccccagaacgttgcagtgacagtgacgaggaaaagaaggcccgtagaggcagatctccgaagggggaattcaaagacgaagaggagacagtcacaaccaagcacattcacataactcaggcaaccgagacaactacaactcgccataaacgtaccgccaatccttccaaaaccattgacctcggtgccgcggcccactatacaggagacaaggcctctccggaccagaatgccagcacccatacgccccagtcctcagtcaagacgagcgtgccgagttctaaatcctcgggcgatctcgttgacctgtttgacggcacctctcaatctacaggaggctcagctgacctctttggcggatttgccgattttgggtcagcggcagcttccggcagcttcccctcacaagtgactgccacaagtggtaacggcgactttggcgattggtcagctttcaatcaggcccccagcggccccgtagcctcttccggggagtttttcgggagcgctagccagccagcagtagagctggtgtccgggagccagagtgccttaggccccccccctgctgcctccaatagttccgatctcttcgatctgatggggagctctcaagctacaatgacctcgagccagtctatgaatttttctatgatgtccacaaacacagtcggtttgggactccccatgtccaggtcccagcccttgcagaacgtgagcaccgttctgcagaagccgaatcccctttataatcagaataccgatatggtgcaaaaaagcgtgagcaaaactttgccctctacatggtctgacccatcagtgaatatatcattggataacttgctgccagggatgcaacccagtaagccccagcagccttcgctgaatactatgatccagcagcagaatatgcagcagccgatgaacgtgatgacccagagtttcggcgcagttaatctctctagtcctagcaatatgttacccgtgcgaccccaaaccaatgcgctgatcggaggccccatgcccatgtcgatgcccaacgttatgaccggaactatggggatggctcccttgggtaatacacctatgatgaatcagtcaatgatggggatgaacatgaatatcggcatgtcagccgcaggtatgggcctcactggtacgatggggatgggcatgcccaacatcgccatgacatccggcacagtgcaacctaaacaggacgcatttgccaattttgcaaatttttcaaaatag

SEQ ID NO: 112424 - DNA, 1932 bp, Artificial Sequence
  Description of Artificial Sequence: Synthetic coding sequence
atgttgaacatgtggaaggttcgggaactcgtagacaaagccaccaatgtcgtgatgaattacagcgaaattgagtctaaagtgagagaggcaaccaacgatgacccatggggcccttccgggcagctgatgggcgaaatcgcaaaggctacctttatgtacgaacagtttcccgaactgatgaacatgctgtggtctagaatgctcaaagacaataaaaagaactggcgccgagtgtacaagtcgctcctcctgctcgcttacctcattaggaatggaagtgagcgcgtcgtgacaagcgctagggagcatatctacgacctccggtccctagagaactaccattttgtcgacgagcatgggaaagaccaggggatcaatatccgacaaaaggtgaaggaattagtagaatttgctcaggatgatgaccggctgcgtgaggaaaggaaaaaggccaagaagaataaggacaagtacgtcggggtgagttccgattccgtgggcggatttcggtatagtgagagatatgaccctgagccaaagagtaagtgggacgaggaatgggacaaaaataaatccgccttccccttcagtgacaagctcggggagctgtccgataagatcggctccacaatcgacgacacgatctccaagttccggaggaaagaccgggaggatagtccagaacggtgctcagactcggacgaagagaagaaagctagaagagggcgcagcccaaagggggagtttaaagacgaggaagagactgttacgaccaaacacatccacattacgcaggccaccgaaacgaccacgacccggcataaacggactgcgaatccgtccaagaccattgatcttggcgctgctgcccactatacgggggataaagctagtcccgaccaaaatgcctccactcacactccgcagtccagtgttaagacaagtgtcccaagcagtaagtctagcggtgacttagtggacctttttgatggcacttctcaatcaaccggagggtcagcagacttatttggggggttcgcagacttcggctccgccgccgcaagcgggtctttcccgagtcaggttacagcgacctccggtaacggtgactttggcgattggtcagctttcaaccaagcacctagtggtccagtggcatcatcaggcgaattctttggcagcgcctcccagcctgctgtcgaactggtgtccggttctcagagcgctctgggcccccctcccgccgcaagcaatagttctgacctcttcgatttaatggggagttcccaggccacaatgacaagcagccagtcaatgaattttagcatgatgtcaaccaataccgtcggcttgggtctgcccatgagtaggagccagcccctgcagaacgtatccaccgtcctccagaagccaaacccactctacaatcagaacaccgatatggtgcagaagtctgtcagcaaaacactgccctcgacatggagcgaccccagcgtcaatataagcttagataacctgctaccagggatgcagccttccaagccacaacagccatctcttaataccatgatccagcagcagaacatgcagcagcccatgaatgtgatgacccagtccttcggcgccgtgaatctgagctccccctccaatatgcttcctgtgcgaccccagacaaatgcgctgattggcggaccaatgccaatgagtatgcccaacgtgatgactggtaccatgggcatggcccccctggggaataccccaatgatgaaccagagcatgatgggaatgaacatgaacatcggaatgtctgccgcagggatgggactgactggaaccatgggaatggggatgcccaatatagctatgacgtctggaaccgtgcagcctaaacaggatgcatttgcaaatttcgccaacttttcaaagtag

SEQ ID NO: 112425 - DNA, 5028 bp, Artificial Sequence
  Description of Artificial Sequence: Synthetic coding sequence
atggcgcaaatactgccaatccgcttccaagagcacctgcagctacaaaatctgggtatcaaccccgctaacataggtttctctactctgacgatggagtccgacaaattcatttgtatcagggaaaaagtgggggagcaggcacaggtcgtgatcattgatatgaatgatccctctaatcctatccgccggccaatttctgcagatagtgccatcatgaacccagcctccaaggttattgccctgaaggcgggaaagaccctccaaatctttaacatcgagatgaagtccaagatgaaggcccatacaatgacggacgatgtcaccttttggaagtggatcagcctgaatactgttgcactggtgacggacaacgctgtctaccattggagtatggagggcgaatcccagcccgttaagatgtttgacagacatagtagcttggcaggctgccagatcataaattataggactgacgcaaaacaaaagtggttgctgctaacaggaatctcagctcagcagaaccgtgttgtgggtgcaatgcagctctatagcgtagatcgaaaggtttctcagccaatcgagggccacgcagccagcttcgcccagtttaaaatggagggcaacgccgaggaaagcactcttttctgcttcgctgtccggggccaggcaggaggcaagcttcacattatcgaagtaggcactccccccaccggcaatcagccctttccaaaaaaagcagtcgatgtattctttcccccagaggcccagaacgatttccccgtcgcaatgcaaatttcagaaaagcatgacgtggtatttctaattactaagtatggctacatccatctctatgatttggaaactggtacctgcatttacatgaatcgaattagcggcgaaacaattttcgtaaccgccccacacgaggcaactgctgggataataggagtgaacaggaagggacaggtgttaagtgtttgcgtggaagaagagaacattattccatatattacaaatgtgctgcagaacccagatttggccttgcgcatggctgttcgaaataatttagctggcgccgaggaactcttcgcccggaagttcaacgccctgttcgctcaaggcaattactctgaggccgccaaagtggctgctaatgcccccaagggtattctgcggaccccagacaccattagacgcttccagtctgtacctgctcaacctggccagactagccccctcctgcagtacttcggtatcttgttggatcagggtcagctcaataagtatgagtcactggagctgtgtagacccgttctccagcagggtcgcaaacagctgcttgagaagtggctgaaagaagataagctggagtgtagcgaagaactgggcgacttagtcaagtctgtggatccaactcttgctctgtcagtgtacctgagagcaaacgtgcctaacaaggttatccagtgtttcgctgagaccggacaggtgcaaaaaatcgtactgtatgccaagaaagtggggtatacccccgactggatctttctcctccgcaatgttatgaggatttcacccgatcaaggccagcagtttgctcagatgcttgttcaggatgaagagcccctggcagatatcacccaaattgttgacgtcttcatggagtacaatctgattcagcagtgtactgcatttcttctcgacgcactgaagaacaaccggcctagtgagggaccgctccagacccggctgctggaaatgaacctcatgcatgctcctcaggtagctgatgctatcctcgggaatcagatgtttacccattatgaccgcgctcatattgcacaactctgtgagaaggccgggttactccagcgcgcgctggaacacttcacggatctttatgacatcaaacgggcagtagtccacacacatttactgaatccagagtggctggtgaattattttgggtccttaagtgtagaagatagcctcgagtgtctgagagccatgctgtcagcaaatatccggcaaaatctgcaaatttgtgtccaggtcgcttcaaaataccacgagcagctctccacacagagcttaatcgagctctttgaatcctttaaatcattcgagggtctgttttacttcctgggcagtattgtgaatttctcccaggaccccgacgtacattttaagtacattcaggcggcatgcaagacagggcaaattaaagaagtcgaaaggatttgtcgagagtctaactgttacgaccccgaacgagtgaaaaatttcctgaaggaggcaaaactgacagaccagctgccactgatcattgtgtgcgatcgtttcgatttcgtccatgaccttgtactgtacctgtatcgcaataatttacaaaagtatatcgagatctatgtccagaaggtgaaccccagcagactcccagttgtgattggagggttgctagacgttgactgctccgaggatgtgattaagaatctcatcctcgtggtacgtggccaattcagcacagatgagttggtggccgaagttgaaaagcggaatagactgaagctgctactcccttggctggaggctaggatacacgaaggttgtgaagagcccgccacgcacaatgcccttgccaagatctatattgacagcaataataaccctgagagatttttgcgggagaatccgtattacgacagtcgtgtcgttggaaagtactgcgagaaaagagatcctcatcttgcatgcgtggcctatgagaggggacagtgtgatttggaactgatcaacgtgtgtaatgagaactcactgttcaaatccctgtcgagatatcttgtgcggaggaaggacccagagctatggggcagtgtactgctggagtctaacccctaccgaaggcctttgattgaccaagtggttcaaaccgctctttccgagacacaggatcctgaggaagtatctgtgaccgttaaggcttttatgaccgcagacctacccaatgagttaattgagctcctcgagaaaattgttctggacaattctgtcttttcagagcatcgtaaccttcaaaacctcttgatcctgacagccattaaggccgatcgaacacgggtaatggaatacatcaatagactggataattacgacgccccggacattgccaatatagctatctcaaatgaactctttgaggaagccttcgccatttttcggaagttcgatgtcaacacatcagcagtacaagttttgatcgaacatatcggcaatctcgacagggcttacgaatttgctgagcggtgcaatgaacccgctgtgtggagtcagctggccaaggcccagctgcagaagggcatggttaaagaagcaattgattcctatatcaaagctgacgatccttctagttatatggaagtggtacaggctgctaacacctcaggaaactgggaggagttggtcaaatatctccagatggctaggaaaaaagcccgagaaagctacgtggaaaccgagctgattttcgcgctggcaaagaccaatagactggccgagctcgaagagtttatcaacggccctaacaacgctcacatccaacaggttggtgatagatgttatgacgagaaaatgtatgacgccgcaaagctgctatataataatgtttccaacttcggccgtcttgcaagtacactggtccatctcggggaataccaggcagcagtggatggagctcgcaaggccaacagcacccgaacatggaaggaggtgtgcttcgcctgcgtggatggcaaggagtttcgtctcgcccagatgtgcggtctccacatcgttgtccacgcggacgagctcgaggagcttattaactactaccaagaccggggctatttcgaggagttgataactatgctcgaggccgcattgggccttgaacgcgcccacatgggaatgtttactgaacttgcaatcctgtactcaaagttcaaaccccaaaagatgcgcgaacacttggagcttttctggagcagagtgaacatccctaaggtgctgagagctgccgaacaggcccatttgtgggccgaacttgtattcctgtacgacaagtacgaagaatatgacaatgcaattatcaccatgatgaaccaccctacagatgcatggaaagaaggccaatttaaggatattattacgaaggttgcaaacgtagagttgtactaccgagctattcaattctacctagagtttaagcctctccttcttaacgacctgctaatggtgttatcacctaggctggatcacactagagcagtaaactactttagtaaagttaaacagttgccacttgtcaaaccttatttgaggtctgtgcagaatcacaataataaatctgtgaacgagagcctgaacaatctgttcattaccgaagaagattatcaggcccttcgcacatcaatcgatgcatatgacaacttcgacaacatctcattggcccagcgtcttgaaaagcatgagctcatcgagttccggcgcatcgcagcatacctgtttaagggcaacaatcggtggaaacaaagcgtagagctctgtaaaaaggactctctatataaggacgcaatgcagtacgcaagcgagagcaaagatactgaacttgcagaggaactcctgcaatggtttctgcaagaagagaagcgcgaatgtttcggcgcctgccttttcacttgttacgatctgctcagaccagacgtcgtcttagagaccgcatggaggcacaatataatggattttgccatgccctactttatacaagtcatgaaggagtacctaaccaaagtggataagcttgacgccagtgagagtctgcggaaggaggaggagcaggcgacagagacccagcccattgtgtacggccaaccccagctgatgttaactgctggaccaagcgtggccgtcccgccccaagctccttttgggtacggctatacagcccctccctatgggcagccgcagcccggatttgggtattcaatgtag

SEQ ID NO: 112426 - DNA, 4923 bp, Artificial Sequence
  Description of Artificial Sequence: Synthetic coding sequence
atggctcagattcttcccgttaggtttcaagaacacttccagctgcagaacctcggaatcaatccagctaacattggattctccactctgaccatggagtctgataaattcatatgtataagggagaaggtgggggagcaggcccaggtgaccattattgatatgtctgatcccatggccccaatacggaggccaatttccgcagagagcgcgattatgaaccctgctagtaaagttatcgctttaaaggcaggaaagactttgcagatctttaacatcgagatgaagtcaaaaatgaaagctcacaccatggccgaggaagtaatattctggaagtgggtgagcgtgaacactgttgcgctggttacagaaactgctgtctaccattggagtatggagggtgactcacagccaatgaaaatgttcgataggcacacctcattggtgggctgtcaagtgatccactacagaacagatgaataccagaagtggctcctgctagttgggatctctgcccaacaaaatcgtgtagtgggggcaatgcaactctattccgtcgaccgcaaagtaagccagccaatcgaggggcatgcagccgctttcgctgaattcaagatggagggcaatgccaaacctgctaccctgttttgcttcgcggtcaggaatcccaccgggggaaagctgcatatcatcgaggtggggcaacccgctgcgggaaaccaacctttcgtgaaaaaggcagtggatgtattcttcccgcccgaggcccagaacgactttcccgtggccatgcaaatcggcgcaaaacacggcgtgatctacctcatcactaagtatgggtatctacacctgtacgacttagaaagcggtgtttgcatatgtatgaatcgcatctctgccgacaccattttcgtgaccgcgcctcacaaaccaaccagtggaatcatcggggttaacaagaagggtcaggttctgagcgtttgcgttgaagaagataacattgtgaactacgcaaccaacgtcctgcagaacccagatcttgggcttcgattagcagtaaggagtaacctggctggggccgaaaagctgttcgtgagaaagttcaacacgttatttgctcagggctcttacgcagaagccgccaaggtggccgcctcagcccctaaaggtatcctgagaacacgtgaaacagtacagaagttccagtcaatacccgctcagtccggacaagcaagccctttattacagtacttcggtatccttttggaccagggacaactgaacaaactggaaagcttagagttgtgtcacctggtgctccagcagggcagaaagcagctattggagaagtggctgaaggaagataagctggagtgctcagaggagttaggcgacctcgtcaagaccacagacccgatgctggctctttctgtatacctccgcgcaaacgtgccttctaaggtcattcagtgttttgcagagacaggtcaattccaaaagatcgtgctgtacgccaaaaaagtcgggtatacacctgactggatcttcctgctgcgtggggttatgaagatcagccctgagcagggacttcagttttccagaatgttggtgcaggatgaggaaccacttgcaaacattagtcagattgtagacattttcatggaaaattctctaatacagcagtgtacatcctttcttctagatgcccttaagaacaacagaccggccgagggcctcctgcagacatggctgctcgaaatgaacctcgtccacgcgcctcaggtggcagacgccattctgggcaataagatgttcacacactatgacagagcccacattgcacaactgtgtgagaaagccggcttgttgcaacaggccctggaacactatacagacttgtacgacataaagcgggccgtagtgcatacgcatcttctcaatcctgaatggcttgttaactttttcggatcgttatccgtcgaggattcagtggaatgcctccacgccatgcttagcgcgaacataaggcagaatctgcaactgtgcgtgcaggtcgcgtctaagtaccacgagcagcttgggacccaagccctggtggaactgtttgaatctttcaagtcttataagggcctgttttactttcttggttctattgttaatttcagccaggaccctgatgtgcatttgaaatacatccaagccgcatgcaagaccggccagattaaagaagtggagcgtatttgtcgggagagtagttgttataaccccgagagggtgaaaaattttctgaaggaagccaaacttacagaccagctccccttgatcattgtatgtgacagattcggctttgtccacgatctcgttctgtatctgtatcggaataatctgcagaggtatatcgagatttatgttcagaaagtgaacccatccaggactccagcagtgattggcggactgcttgatgtcgattgctccgaggaggtcatcaagcatttgatcatggctgtgcggggccagttttcaactgacgaactagtggccgaagtggagaagagaaacaggctcaagctgctgttgccctggctggagagtcagattcaggaagggtgtgaggaacctgccacccacaacgctctggcaaagatttacatcgactcaaataacagccccgaatgttttctccgggaaaatgcctactatgactccagcgtcgtcggacggtactgtgagaaacgagatcctcatctggcatgtgtagcatatgaaaggggacagtgtgacctggagctgatcaaggtctgtaatgagaactccttgttcaaatccgaggctcgttatctggtgtgcagaaaggaccctgagctttgggctcacgtgctggaagagaccaatccatccaggcgccagctgatcgatcaggttgtgcagaccgcattgagcgagacacgtgatcctgaggagatcagtgtcaccgtcaaggcattcatgactgccgacctcccaaacgagctcatcgaacttttggagaaaattgtgctggataactctgttttttcggaacatcggaacctgcagaacctccttatcctcaccgctatcaaggccgaccggacccgcgtaatggagtatatcagcaggctcgacaattacgacgctctcgatattgcgagcatcgctgtgtcttccgctctctacgaggaggcctttaccgtttttcataagtttgacatgaacgcttccgctatccaagtactcatcgaacatattgggaacctcgaccgggcgtacgagttcgctgaacgatgcaacgaacctgcagtctggtctcagctggcacaggcacaattgcagaaagacctggtcaaagaggccatcaactcctacattcggggggacgatccatcatcttacctggaggtggtgcagtcggcctcacgttctaataattgggaagatttggtaaaattcctccagatggcccggaagaagggccgagagagttacattgaaacggagctgatctttgccctagccaagacctccagggtttccgagctcgaggatttcattaacggacccaacaacgcccacatccagcaggtgggcgatcgatgttacgaggagggtatgtacgaggcagctaagctgctatactccaacgtgtccaatttcgcaagactcgccagcaccctagtgcatctcggagaatatcaggcagccgtagataactctcggaaagccagttcaaccagaacatggaaggaggtatgcttcgcatgcatggatggacaggaattccggttcgctcagctgtgcggcctgcacatcgtcatacacgctgatgagttggaagaactgatgtgttactatcaagacagaggatatttcgaggaattgattctcctcctagaagccgcactcggcctggaacgcgctcacatgggcatgttcacggagctcgctatcctttactccaaatttaagccccagaaaatgttggaacacttggaattgttttggtcccgcgtaaatattccaaaggtgttgagggccgcagagcaagctcacctctgggcggagctggtgtttctgtatgacaaatacgaagaatacgacaacgccgtactgacaatgatgagccatcccaccgaagcttggaaagaaggtcaatttaaagacatcatcacgaaagtggccaatgtggaactctgttatcgggctcttcagttttacctagactataagccactgctgattaacgacctgttgttggtgctgtccccgaggctcgaccatacttggacggtttctttcttcagtaaagctggacagctgcctctggtcaagccatatttgagaagtgtccagtcgcacaacaacaaatccgtgaacgaggcacttaatcatctcctgaccgaggaggaggattaccagggtctgcgggcctctatagacgcatacgataattttgataatatttccctcgcgcagcagcttgaaaagcaccaactcatggagtttagatgcattgccgcatacctgtataagggcaacaattggtgggcccagagcgttgaattgtgtaaaaaggaccatctgtataaagacgccatgcagcacgctgcagaatcaagagatgccgaacttgcccagaaacttctgcagtggttcctcgaagaaggaaaaagggaatgttttgcggcatgcctatttacctgctacgacttactccggcccgatatggtcctggaactcgcctggcgccataacctcgtcgacctagccatgccgtactttatccaggttatgcgtgagtacctgtcgaaggtggacaagctagatgcgttggagagtctcagaaagcaggaggagcacgtcacagagcctgcccccctggtgtttgacttcgatgggcacgaatag

SEQ ID NO: 112427 - DNA, 4752 bp, Artificial Sequence
  Description of Artificial Sequence: Synthetic coding sequence
atggctcagattctgcctgtgcgcttccaggagcatttccagctgcagaatctaggtataaatccagcaaacatcggcttttcaactctgacgatggaatccgataagttcatttgtatacgagagaaggtgggggagcaggcccaggtgaccatcatcgatatgagcgatcctatggccccaatccgacgccctatctccgccgagtccgccattatgaacccagcctctaaggtcatcgccttaaaggcaggaaagacgctgcagatcttcaatatcgaaatgaagagtaagatgaaagcacacaccatggctgaggaggtgattttctggaagtgggtgtctgtgaacaccgtcgcactggtgaccgaaaccgccgtttatcattggagcatggaaggagatagtcagccaatgaagatgttcgaccggcacactagtttggtgggatgtcaagtgatccactacagaaccgatgagtaccagaagtggctgctcttagtcgggatctctgctcagcaaaatagggtcgtgggtgccatgcagctgtactccgtagataggaaggtcagtcagccaattgaagggcacgcggccgcctttgctgagtttaaaatggaagggaacgctaaacccgctacactgttctgctttgccgtgcgcaacccaaccggagggaagctccatataatcgaagtggggcaacctgccgccggcaatcagcccttcgtaaaaaaggctgtggatgtcttcttccccccggaagcacagaatgactttcctgtggccatgcaaattggggctaaacacggcgtcatttacctgattacaaaatacggctatttacacctttacgatctggaatccggagtttgtatttgcatgaaccgaatctctgctgacaccatattcgttactgcgccccacaagcccacaagcggaatcattggagtcaataagaagggccaggtcctctcagtttgcgttgaggaggataatattgtgaattacgccactaacgtgctccaaaatcccgacctaggacttcgattggctgtgcgatctaatctggcgggcgccgaaaagttgtttgtcaggaagtttaatacccttttcgctcaggggtcttacgctgaggcagccaaggtcgcggcttccgctccaaaggggatcctcagaactagagagacggtgcagaagtttcagtctatcccagcacagagtggtcaggccagtcctttattgcagtatttcggtatcctactggaccaaggacagttgaacaaactggagtctttggaactctgtcatctggtactgcagcaaggtcgtaagcagctgctcgagaaatggttaaaggaggataagttggagtgttctgaggaactcggtgatctggtgaagactactgaccctatgctggctctgtcagtatatctgcgcgcaaacgtcccatccaaggtgatacagtgtttcgccgaaaccggacagttccagaaaatcgtgctgtacgctaagaaggtggggtatactcctgactggatttttctgctgcgtggagtaatgaaaatttccccagaacaagggctccagttctctcgtatgttagtccaagatgaagagccacttgcgaatatctcacagatcgtggacatatttatggaaaattctctcattcagcagtgtaccagttttcttcttgatgcattgaaaaacaacaggccggctgaggggctgctgcagacttggctattagagatgaatctggtgcacgctcctcaggtcgcagatgctatcctgggtaacaagatgtttactcattacgatcgggctcacatcgcacagctctgcgagaaggcaggcctgcttcagcaggccctggaacattatacagacctgtacgatattaagagagccgtcgtacacacccatctcttgaatccagagtggttggtgaattttttcggtagtctctctgtggaggatagcgtggagtgtttgcatgcaatgttgtctgctaacatcaggcagaacttacagctttgtgtacaggtggcttcaaagtaccatgaacagctcggcacgcaagccctggtcgagttgttcgaatccttcaaaagctataaagggctgttttacttcttaggatccattgtgaatttctcacaggaccccgacgtccacctgaaatatattcaggctgcgtgtaagaccggccagatcaaagaggtggagagaatttgtagagaaagctcttgctataatcctgagcgcgtcaagaactttctcaaagaagcgaaacttacagatcagctccccctcataattgtctgcgacaggttcgggtttgtgcacgacttggttctctatttataccgcaataacttacaacgctacatcgaaatatatgtacagaaagttaacccttctcggacacctgcagtgattggcggactgctggatgtggactgttccgaggaggtgatcaagcacttgatcatggctgtgcgtggccagttcagtacggacgagctggtagctgaagtcgagaaacggaatcgcctgaagttgctgctcccgtggctggaaagccagatacaagaaggctgtgaagagccagccacgcataatgcattggccaagatctatattgatagcaataacagcccggagtgtttcctacgggagaatgcctactacgattcttctgtggttggaagatactgtgagaaaagggatccccatctggcttgcgttgcatacgaaagaggccagtgtgacctcgagctgatcaaggtgtgcaatgagaacagtctcttcaaatcagaagccaggtacctcgtctgtcggaaggatccagagctgtgggcccacgtactcgaagagaccaacccctctaggcgccagctcatagaccaggtagtccaaacagctctatccgagactcgtgaccccgaggaaatttctgtcactgttaaagcgttcatgactgctgacttgccaaatgagctgattgagttgctggagaagattgtgttagacaacagcgttttcagtgaacatagaaatttgcagaacctcctgatcctcacagcgatcaaagccgacagaaccagggtgatggagtatatatcaagattggacaattatgatgccctggacatagcttccatcgccgtctcttcggccctgtacgaagaggcctttactgtctttcataagtttgacatgaacgcctctgctatccaagtgcttatagagcacattggaaatctggatcgggcatatgagtttgctgaaagatgcaacgaacctgctgtatggtcccagttggcacaggcccagctgcagaaagacctagttaaggaggccattaactcatacatccggggcgatgaccctagcagttatctggaagtcgtccagagcgctagcagaagcaataattgggaggacctggttaagttcctgcagatggctcgaaaaaaggggcgggaaagttacatcgaaaccgagctcatcttcgccttagctaaaacatctagggtgagcgagctggaggattttattaacggtccgaacaacgcacacattcagcaggtgggcgacagatgctatgaagaaggtatgtacgaagcggccaaattactctactcgaatgtatctaattttgctaggctggccagcactcttgtgcatctaggcgagtatcaagccgccgtggataattcccgcaaagcctcctcaacccgtacttggaaggaagtctgcttcgcctgtatggatggacaggagttccgcttcgcacagctttgcgggcttcatattgttatacacgccgacgaactggaagagctgatgtgctattaccaagatcgaggctatttcgaggaactgatcctacttctagaagccgccctggggttggaaagggctcatatggggatgttcactgaattagccattctatacagcaagtttaaaccccaaaaaatgctagagcatctggaattattttggtctagggtcaatatccccaaggtgttacgtgcggcagagcaggcccatctgtgggccgaacttgtgttcctgtacgataagtacgaagagtacgacaatgcggtcctgacaatgatgagccatcccaccgaggcctggaaggagggacagtttaaagatatcatcacaaaagttgccaacgtagaactgtgctatagagcccttcaattttacctggactataagcccctgctgattaacgacctactcctggtcctgagcccacgattagaccacacctggaccgtgtcatttttctctaaagcaggacagctgccacttgtgaagccttacctccggtctgtccagtcccataacaacaaatccgtgaacgaagcactcaatcatttgctgacagaagaggaggattaccaggatgctatgcaacatgcagcggaatcccgtgacgccgaattggctcaaaaattactccagtggttcttagaagaggggaaaagagagtgtttcgccgcttgcctttttacatgctacgacctactaagacctgatatggtgctggagttagcgtggcgacacaacttagtggatctcgcaatgccgtacttcattcaggtgatgagagagtaccttagcaaagtagacaagctggatgccctcgaatcactgagaaagcaggaagagcacgtgaccgagccagccccactggtcttcgatttcgacggtcatgagtag

SEQ ID NO: 112428 - DNA, 4923 bp, Artificial Sequence
  Description of Artificial Sequence: Synthetic coding sequence
atggctcagatactgcctgttcgctttcaggagcactttcagctgcagaacctgggaatcaatcctgcaaacattggcttttccaccctcacaatggaatcggacaaatttatttgcatacgggagaaggtaggggaacaggcccaggtgacaattatcgatatgtctgacccaatggcaccaattcggcgccctatcagcgccgagtcggcaatcatgaaccctgcatcaaaagtcattgcacttaaagctggaaaaacactgcagatctttaatatagagatgaagagcaagatgaaagctcataccatggcagaagaagtaatattttggaaatgggtgagtgtgaatactgtggctctagtgacggagacggctgtttaccattggagcatggaaggggactcccagcctatgaagatgttcgataggcatacatcactggtgggctgccaggtgatacattaccggaccgacgaataccagaaatggctgcttctggtggggatctctgcccagcagaaccgtgtcgtaggagcaatgcagctgtattcagtggacaggaaagtcagccagccgattgagggccacgctgctgctttcgcagagttcaaaatggaagggaacgctaaaccagccacacttttctgctttgctgtgaggaatcccactggcggaaagctgcatatcatagaggttggacagcccgctgccggcaatcaaccattcgttaaaaaggctgtggacgtattctttcctcccgaggctcagaatgacttccccgtcgctatgcagattggcgcgaaacatggagtgatctatcttatcacaaagtacggttatttgcatctttacgacctggaatccggtgtgtgtatttgtatgaaccgcatcagcgccgataccatctttgtgacggccccccataaaccgaccagcgggataataggcgtaaacaagaagggccaggtgctcagcgtttgcgtcgaggaagataacattgtcaactacgccacaaatgtgctccagaacccagacctgggtctgaggctcgcagtgcgctctaatcttgctggcgcagagaagttattcgtccggaaattcaacacactgtttgcccaggggtcttatgccgaggctgccaaggtagcagcctccgcccccaagggaatcttacgcacccgcgaaactgtccaaaagtttcagagcatccctgcacaaagcgggcaggctagtcctctgctgcagtattttggcatactccttgaccaaggccagctgaacaagctagagagccttgagttgtgtcacctggtgctccagcagggcagaaagcaactgttggaaaagtggctgaaggaggacaagctcgagtgctccgaggaattgggggacctggtgaaaacaaccgacccaatgttggctttgtccgtatacttgcgcgctaacgtcccgtctaaggtaatacaatgtttcgccgaaaccggtcagttccaaaagatagtgctttatgctaagaaagtggggtacaccccagattggatcttcctgctcaggggcgtgatgaaaatctcaccagaacaagggcttcagttttctagaatgttggtccaggacgaggagcctttggccaacatcagtcagatagtggacatttttatggagaatagtctcatccagcagtgcaccagcttcctgctggatgctctaaaaaataaccgcccagccgaaggacttctccaaacttggctgttggagatgaacttagtgcatgccccacaagtcgctgatgccattctgggcaacaagatgttcacacactatgatagagcacacattgcacagctatgtgagaaagccgggctgctgcagcaagcactagagcattatactgatttgtatgatatcaaacgtgccgtggtgcacacacacttacttaacccagagtggcttgtcaacttctttgggagcctgtccgtggaagactcggtggagtgcctacacgctatgctgtccgcaaacattcggcagaatctccaattgtgtgtgcaagtggcctccaaatatcacgagcagctaggaacccaagctctggtcgaattgtttgagtctttcaagagttacaagggccttttctatttcctgggctccatcgtgaatttttcccaggaccccgacgttcacctcaagtatattcaggctgcatgcaaaaccggccagattaaagaggtagagcgcatttgccgagagtccagttgctataatcccgaaagggtaaagaacttcttaaaggaggccaagctgactgaccaactgccattaatcatcgtctgcgacagattcggcttcgtgcacgatctggtcttatacttgtaccggaacaatctgcagcggtacatagagatatacgtccagaaagtcaatccttcacgcacccctgccgttatcggcgggctgcttgatgtggattgctctgaagaagtgatcaagcacttgataatggccgtgcgaggtcagttttccactgacgagctggtggcagaggtcgagaaaagaaataggctcaagctgctgctgccatggctggagtctcagatacaggaggggtgcgaggagccagcaacccacaatgcgctggctaaaatctatatagattccaacaatagtccggaatgttttttgagagaaaacgcgtattacgattcatccgttgtgggacggtattgtgaaaagagggatccccacctagcatgcgttgcctatgagagagggcagtgcgacctagagctgatcaaagtgtgcaacgaaaacagcctgtttaagagcgaagctaggtatctagtgtgccgcaaggaccccgagctttgggctcatgtgctcgaagagacaaatccgagcagacgccagctcatcgaccaggtggtccaaacggccctttccgaaactagagatccagaggaaattagcgtgaccgttaaagcgttcatgaccgctgacctgcccaacgaacttattgaacttctggagaagatagtgctggacaacagcgtattctctgaacataggaacttgcagaaccttttaattctgactgcaatcaaagccgaccgcactagggttatggagtacatctccagacttgataactacgacgctctcgacattgcttccattgcagtttcgagcgccctgtacgaagaggcatttaccgtattccacaagttcgatatgaacgcctctgcgatacaggtgctgattgagcacattggtaatctggaccgggcctacgagttcgctgaacggtgcaacgaacccgctgtgtggtcacaactcgctcaggctcaactacagaaagaccttgttaaagaggccatcaacagctacatcaggggggatgacccttctagctacttagaggtcgtgcaatcagcatcacgttcaaataattgggaggatctggtgaaattcctgcagatggcgagaaagaaaggcagggagagctatattgaaacagagctcatctttgccctcgccaagacatcccgagtctcagagttagaggatttcattaatggtccaaacaacgcacacatccaacaggtgggcgatcggtgttacgaggaggggatgtatgaggcggctaagctcctctattccaacgtatctaattttgctcgccttgcttccacattggtgcatttgggtgagtaccaggccgccgtagataatagccgcaaagctagctctacgaggacatggaaagaggtgtgctttgcctgcatggatggacaggagttcaggttcgcacagctgtgcggtctccatattgtcattcatgcagacgagctcgaagaattaatgtgctattatcaggatcgcggctacttcgaggaattgatcctgcttctggaggccgctctggggctggaaagagcccatatgggaatgttcacggagctggccatattgtatagcaagttcaaaccacagaaaatgctcgagcatttggagctgttctggtcacgcgtgaatatacccaaagtacttcgagcagccgagcaggcccacctgtgggccgagttagtcttcctctacgacaaatatgaagaatatgataatgcagtactgaccatgatgtcgcatcccaccgaggcatggaaggaagggcagttcaaggacattattacaaaagtcgctaacgtcgagctatgttaccgcgccctccagttctatctggactataagcccctgctaatcaatgatctactgttggtcttgagccctcgcctcgatcacacatggacagtgtcgttcttcagtaaagctggacaactccctctcgtcaagccatatctgcgctccgtgcagtcccacaacaacaaaagtgtcaacgaggcactgaaccatttactgacagaggaggaagactatcaggggctcagagccagcattgatgcatacgacaatttcgataacatttctttggcacagcaattagagaagcatcaactcatggagttccggtgtatcgctgcttatctatataaggggaataactggtgggctcagagtgtggaactgtgcaaaaaagaccacctgtacaaagacgctatgcaacacgcggctgagagtagggacgctgaactagcccaaaagcttctccagtggtttcttgaagaaggtaaacgggagtgtttcgccgcctgcttgttcacttgctacgacctactgcgacccgatatggtgctcgaattggcgtggcgacacaacctcgtagacctggccatgccatattttattcaggtgatgagagagtacctgagtaaagtggataagctcgacgcgttggagtcattaagaaaacaagaagagcacgttactgagccggctcctctggtgtttgattttgacggccatgaatag

SEQ ID NO: 112429 - DNA, 747 bp, Artificial Sequence
  Description of Artificial Sequence: Synthetic coding sequence
atggccgaattggatccttttggggcccctgcaggcgctcccggagggccagctcttgggaacggtgtcgcgggggccggcgaagaggatcccgcagcagcattcctcgcgcagcaggagagtgagattgctgggatcgagaacgacgaggccttcgctatcctggacggcggtgcccctggcccccaaccacacggagagcccccgggcggtcccgacgccgtagacggtgtgatgaatggtgagtattaccaggagtcgaacgggccaaccgactcttacgccgctatctcccaggtggaccgactgcagagtgagccagaatccatacgaaagtggcgggaagagcaaatggagagacttgaggcactggacgcgaactcccggaaacaagaagctgaatggaaggagaaagcgattaaagaactggaagaatggtacgccaggcaagacgagcaattgcaaaagacgaaggcaaacaatcgggtggccgatgaggccttttacaaacagccgtttgcagatgtaattggatacgtgaccaatattaatcacccttgttacagtctcgaacaggcggcggaagaggcctttgtcaatgacatcgacgaatcaagtccgggaaccgaatgggaaagggtggcacgcctgtgcgattttaatccaaaaagttctaagcaggcgaaagatgtcagccgcatgcgctcagtcctcattagcctgaagcaggcccctcttgtccactag

SEQ ID NO: 112430 - DNA, 657 bp, Artificial Sequence
  Description of Artificial Sequence: Synthetic coding sequence
atggccgagctggacccgtttggggccccagccggcgcccctggaggccctgctctcgggaatggcgtggctggagctggggaggaggatccagctgcagccttcctggcgcagcaagagtccgaaattgctggaatcgagaatgatgaagcatttgccattttggacgggggagcccctggtccacaaccacatggcgaacctcccgggggccccgacgccgtcgacggtgtaatgaatggagagtactaccaggagtcgaacggccccaccgacagctacgcagctattagccaggtcgacagattgcaatctgagcctgagagcatacgcaaatggagggaggagcaaatggaacggttggaggcactcgacgctaactcaaggaagcaggaggccgaatggaaggagaaggcgatcaaggagctggaagaatggtacgcgagacaggatgaacaactgcagaaaaccaaggctaataaccgcgcagctgaggaagccttcgtaaacgatatcgatgagagttcaccagggacagagtgggaacgcgtcgcacgcctttgcgacttcaaccctaagagttccaagcaggccaaggatgtttccagaatgcgttctgtgcttattagcctcaagcaggcacccttggtgcattag

SEQ ID NO: 112431 - DNA, 711 bp, Artificial Sequence
  Description of Artificial Sequence: Synthetic coding sequence
atggctgagctcgatccgttcggcgctccagcaggagctcctggcgggccagctttgggcaatggggtcgctggggccggagaggaagacccggccgctgccttcttggcccagcaagaaagcgagatcgccggcatcgagaatgacgaggcattcgctattctcgacggaggagcaccagggccccagccccacggagagcctccaggtgggcccgacgcggtggacggcgtaatgaatggtgagtattaccaggagagcaatggcccaactgactcgtatgcagctattagccaggtggatcggctgcagagcgagccagagtcgatccgaaaatggcgggaggagcagatggagcgtttagaggccctcgacgccaactcacgtaagcaggaagcggagtggaaagaaaaagccataaaggagctcgaggagtggtacgcgcgccaggacgagcaactccagaagacaaaagccaacaacagagttgctgacgaggccttctacaaacaaccctttgctgacgtgataggttacgtcgctgccgaagaggcgttcgtgaacgatatagacgaaagcagcccagggactgagtgggaacgcgtcgctaggttatgcgatttcaatccgaaaagtagtaaacaggctaaagacgtgtctcgcatgcgctcagtgttgattagtcttaaacaggctcccctggtccactag

SEQ ID NO: 112432 - DNA, 747 bp, Artificial Sequence
  Description of Artificial Sequence: Synthetic coding sequence
atggccgagcttgacccttttggcgcgcccgctggggccccgggaggcccagctctgggaaacggtgtcgctggagccggcgaggaagacccagccgcagcattcctggcccagcaagagtctgagattgccggcattgaaaacgatgaagcctttgcaatattggatggtggagccccggggccgcagccccacggtgagcctcccgggggacccgacgcagtcgatggagtcatgaacggcgaatactatcaggagtccaacgggccaaccgacagttatgccgctatatctcaggttgatcgcctgcaatcagagcctgagagcatcaggaaatggagagaagagcagatggagaggctagaggcactggacgctaattcccgtaaacaggaggcagagtggaaggagaaggctattaaagagttggaggaatggtacgctcgtcaggatgagcagctgcaaaagaccaaggccaataatagggttgccgacgaggccttttataagcagccatttgctgacgtcattggttacgtcaccaatattaaccacccttgctactcgcttgaacaggctgctgaagaggcttttgtcaacgacattgacgagagctctccgggaacggagtgggagcgagtcgcgcggttatgtgatttcaacccgaagtcttcaaaacaggcaaaagatgtcagccggatgcgctccgtgctgatatccctgaaacaggcgccactcgtccactag

SEQ ID NO: 112433 - DNA, 693 bp, Artificial Sequence
  Description of Artificial Sequence: Synthetic coding sequence
atggcggagctcgatcctttcggagccccggccggtgcacccgggggcccggcactcggtaacggggtagccggggccggagaagaggatcctgcggccgcattcctggcccaacaggaatctgaaattgccggcatcgagaatgacgaggcatttgcaatcctcgacggcggcgcccctggccctcagccacacggcgagcccccaggcggtcctgacgccgttgacggggtgatgaacggggagtactatcaagagtccaacggaccaacagacagctacgcggcaatttcgcaggtagatcgtttgcagtccgagcccgagtctattcgtaaatggcgggaagagcagatggaaaggctcgaggctcttgatgccaacagtcgcaagcaggaagccgaatggaaggaaaaagctataaaggagctcgaggaatggtacgcacgacaggacgagcagctgcaaaagacaaaggccaataacagcactaacatcaaccacccctgctactcgctggagcaagccgctgaggaagcctttgtaaatgacatcgatgagtctagtccagggaccgagtgggaacgagtggcccgcctgtgcgacttcaacccgaagtcatcaaagcaggccaaggatgttagcagaatgagaagcgtgttgatcagtctgaaacaggctccacttgtacattag

SEQ ID NO: 112434 - DNA, 693 bp, Artificial Sequence
  Description of Artificial Sequence: Synthetic coding sequence
atggcagaattagatccctttggtgccccagctggcgcacctggaggccccgccttaggcaacggtgtagcaggcgctggcgaagaggaccccgctgcagcttttctggcacagcaagagagtgaaattgcaggaattgagaacgacgaggctttcgctatactcgatggtggagctcccggccctcagcctcacggcgagccccctggcgggcccgacgctgtcgatggcgtgatgaatggggagtattatcaggaatcaaatggtccaaccgactcttacgctgcaataagccaggtggatcgcctccagtccgaaccagaaagtatcagaaagtggcgggaggaacagatggagagactcgaggcactcgacgccaattcccgcaagcaggaggccgaatggaaggaaaaggccattaaggagctggaggaatggtacgcgcgccaggatgaacagctgcagaagaccaaggctaataacagcacaaatattaaccacccatgctactccctcgagcaggctgccgaggaggccttcgtgaatgacatcgacgagtcatctccaggtacagagtgggagcgcgtcgctcgcctctgcgacttcaaccccaagagctccaaacaagccaaggatgtctctaggatgaggagcgtcctgataagtttgaagcaggcacccttggttcactag

SEQ ID NO: 112435 - DNA, 501 bp, Artificial Sequence
  Description of Artificial Sequence: Synthetic coding sequence
atggcagaactggacccatttggagcccctgcaggagctcctggtgggccagccttgggaaatggcgtagcaggcgcgggtgaggaagacccagccgccgcatttctggcacagcaggaatctgagatcgccggtatcgagaatgatgaggcttttgccattctggacggcggggcacccgggcctcagccccacggcgagccgcccggaggacccgacgcaaattctaggaagcaagaagcggagtggaaggagaaggccattaaggagctggaggaatggtatgcacggcaggatgagcaacttcaaaaaactaaggccaataatagagccgcggaggaagcatttgtaaacgacatcgacgaaagcagcccgggtactgagtgggagcgagtggctaggctgtgcgacttcaatccaaagtcaagtaaacaagccaaagacgtctcaaggatgcgctccgtattgataagcctcaagcaagctcccctggtgcattag

SEQ ID NO: 112436 - DNA, 690 bp, Artificial Sequence
  Description of Artificial Sequence: Synthetic coding sequence
atggcggatgacttcggcttcttttctagcagtgaatctggagcccctgaagccgcggaggaggatccagccgcagcttttctggcacagcaggagtctgagatcgcaggaattgaaaatgacgagggcttcggggcacctgccggcagccacgccgctcccgctcagccaggccctacctccggtgctgggagcgaggatatggggaccactgtgaacggagacgtttttcaagaagccaacggcccagccgatggttacgcagctattgcccaggcagatcggcttacacaggaacccgaatctattcgaaaatggcgcgaagaacaacgcaagagactgcaagagttggacgccgcatctaaggtgaccgaacaggaatggagggagaaggccaagaaggatttagaagaatggaatcaacgacaatctgaacaggtggagaagaacaaaatcaataaccgcattgccgacaaggcattctaccagcaaccagatgcagatataatcgggtacgtcgcctccgaggaagctttcgtgaaagaatctaaggaagaaacccctggcactgagtgggagaaggtggcgcaactgtgcgacttcaatcccaaaagcagtaagcagtgcaaagacgtctcaaggctcaggtcagtactgatgtccttgaaacagactcctctaagtcgctag

SEQ ID NO: 112437 - DNA, 636 bp, Artificial Sequence
  Description of Artificial Sequence: Synthetic coding sequence
atggccgacgattttggatttttctcttcttctgaaagcggcgcccctgaggctgcggaggaggatcctgctgcagcattcctggcccagcaggaaagcgaaattgcaggaattgagaatgatgaggggttcggggcccccgccgggtcacacgcagccccagcccagcctggtcccacatcaggagctggctccgaagacatggggactacagtgaacggtgacgtgttccaggaggccaacggacctgccgacggatatgccgctatcgcccaggcagaccgactcacacaggagccagagtccataaggaagtggagagaagagcagcggaaaagactgcaagagctcgatgccgcctccaaggtcaccgagcaggagtggcgcgagaaagctaagaaggatttggaagaatggaatcaacgccagagcgaacaagtcgagaagaataagataaacaatcgcgcgtccgaggaagcttttgttaaggaaagtaaggaagagacgccggggaccgaatgggaaaaagtcgcacaactgtgtgatttcaacccgaaatcttcaaaacaatgtaaggatgtctctcgtctgaggagcgtgctgatgagcttgaaacagaccccattgtcgaggtag

SEQ ID NO: 112438 - DNA, 405 bp, Artificial Sequence
  Description of Artificial Sequence: Synthetic coding sequence
atggccgatgatttcgggttttttagtagctcagagagtggcgctccagaggctgccgaggaggaccctgctgccgcattcctcgcacagcaggagtctgagattgctgggattgagaatgacgaaggttttggagcccccgcaggcagtcatgctgctccagcccagcccggtcccacttcaggtgcaggcagcgaggatatgggcacaaccgtcaatggggatgtattccagcctgtacatcaccagcgggtgcagctgcagacacagctgcccattcagccgaaggatgagccggctcataactattctagtagcatctggcacagccagggccagggccagaaaggtcctgcaggactgcgcctgccgactagtgctcagatcctctccccctttccctag

SEQ ID NO: 112439 - DNA, 636 bp, Artificial Sequence
  Description of Artificial Sequence: Synthetic coding sequence
atggcaaatgctggcttgcagctcctggggttcattttagcattcttgggttggattggcgcaatcgtgtcaaccgcattaccgcaatggaggatctactcctacgctggagataatatcgttacagcacaggcaatgtatgaaggactgtggatgtcatgcgtcagccaaagtaccggacagatccaatgcaaggttttcgactcactgctgaatttatccagcactctgcaggctacaagagccttgatggtggttggcatcttacttggagtgattgccatattcgtggccaccgtggggatgaagtgcatgaaatgcttggaagatgatgaagtacagaagatgagaatggccgtcatcggcggagccatctttttgctggcggggctggccattttggtggcaaccgcctggtacggaaacagaatagtgcaggagttctacgacccaatgacaccggtgaacgcccggtacgaattcggccaagcactgttcacgggctgggctgctgctagtctttgtcttctaggaggagccctgctctgttgttcttgcccaaggaagaccacctcctaccccaccccccgcccatatccgaagccagctccgagttcaggaaaggattacgtatag

SEQ ID NO: 112440 - DNA, 501 bp, Artificial Sequence
  Description of Artificial Sequence: Synthetic coding sequence
atgtatgaggggctttggatgtcctgcgtgtcccagagcacaggacagattcagtgtaaggtgttcgatagcttgctgaatctttccagcacgctgcaggctacccgtgctctgatggtcgtgggcattctgctaggcgtgatcgccatttttgtggccacggtgggtatgaagtgcatgaaatgtctggaagacgacgaagtgcagaagatgaggatggccgtgataggaggcgcgatatttctgctggctggcctggcaattctggtggctacggcctggtatgggaatcgtatagtgcaggaattttacgaccctatgacgcctgttaacgctcgatatgaattcggtcaagctctgttcacaggatgggcggctgcatctctgtgccttctgggcggagctctgctgtgttgttcttgtcctcggaaaacgacgtcctatccaactccccgaccatatccaaaaccagcaccgtccagtgggaaggactatgtctag

SEQ ID NO: 112441 - DNA, 624 bp, Artificial Sequence
  Description of Artificial Sequence: Synthetic coding sequence
atggtcgctacatgcctgcaagtggttggctttgttacaagctttgttggttggatcggcgtaatcgtcaccacctctacaaatgattgggtggtcacgtgcggttatactataccgacttgtcggaaactggatgaactgggcagcaagggtctttgggcggattgcgttatggccacaggactgtaccattgcaagccactggtcgacattcttattctcccgggttacgtccaggcctgccgcgcactcatgatcgctgcctctgtgctggggctgcccgctatcctgctgttgctcacagtgctgccctgcatccggatgggccaagaacctggcgtggctaagtatcggcgcgcccagttggccggagttctcctgatcctactcgccttgtgcgcactggtggctacgatctggttccctgtttgcgcacatcgtgaaacaaccattgtctcatttgggtactctctgtacgccgggtggattggagctgtgctctgcctcgtcggaggatgcgtaattctgtgttgcgccggggacgctcaggctttcggcgagaaccgtttttattatacggcgggatctagttcccccacgcacgccaagagcgcgcatgtctag

SEQ ID NO: 112442 - DNA, 498 bp, Artificial Sequence
  Description of Artificial Sequence: Synthetic coding sequence
atggtggctacatgcctgcaggtggtgggattcgttactagctttgttggctggatcggcgtgattgtgaccacgagtactaacgactgggttgtgacttgtggatacacaatccccacatgccgcaaactggacgagctgggatctaaggggctctgggctgactgcgtaatggccactggcctctaccactgtaaaccactggtggacatcctcatcctgcccggctatgtgcaggcctgtcgtgctttaatgatcgccgcaagcgttttgggcttaccagccattttattactcctaaccgtgcttccatgcatacggatgggacaggaacccggagtcgcaaaataccgccgcgctcaattggccggtgttctcctcatcctgctggggtgtcagttgctgtgggccaagacagaatcaagccttcattctcaacacctcgtacaattcaaacagaaatatctagaggactttagctatctgcagggcgattag

SEQ ID NO: 112443 - DNA, 498 bp, Artificial Sequence
  Description of Artificial Sequence: Synthetic coding sequence
atggtggctacttgcctgcaggtagtgggcttcgtcacaagcttcgtgggctggattggcgttatcgtcactaccagcacaaacgactgggtggtgacttgcggttacacaatcccaacctgcaggaagctcgatgaactgggaagcaagggtctgtgggccgactgcgttatggccaccggactgtaccattgtaaacctttggtcgacatcctgatcctgcccggatatgtgcaggcttgccgggccctgatgatcgccgcatcagtgctgggcctccccgcaatcttgctgctgctgacagtgttgccttgcattagaatggggcaagagcctggtgtggcaaaatatagaagggctcagctcgctggtgtcctgctgatcctgctgggatgccagctcctctgggctaaaactgagtcgagcctacattcgcagcacttggtgcaattcaagcagaagtaccttgaagacttctcgtacctccaaggggactag

SEQ ID NO: 112444 - DNA, 720 bp, Artificial Sequence
  Description of Artificial Sequence: Synthetic coding sequence
atggcatccactgctgtccaactgctagggtttctgttgagcttccttggaatggtggggacactaattactaccattctgccacattggcgccgaacagctcacgttggcacgaacattttgaccgctgtgtcctacctgaagggattgtggatggagtgtgtgtggcatagcacaggcatttatcagtgtcagatttaccgaagtttattggctttgcctcaagacctgcaggccgcgagagcattaatggtgatcagctgcctgctgagtggcatcgcctgtgcatgcgcagtgatagggatgaagtgcaccagatgcgcgaaaggcactcccgccaagactacatttgccatcttgggtggaacactctttatactggcaggcctgctgtgcatggtggctgtctcttggacgacaaatgacgtagtacaaaacttttacaatcctctgctcccatcaggcatgaaatttgaaatcggccaagctttgtatctgggattcatttcatctagcctgtcgctgatcggcggaacactgttgtgtctgtcgtgtcaggatgaggctccttaccgaccataccaggcccctccgagagcaaccacaactacagcaaacacagcccccgcatatcagccacccgctgcctacaaggataaccgagccccatccgtcacgagcgccacccatagtggttacagactcaatgattatgtttag

SEQ ID NO: 112445 - DNA, 720 bp, Artificial Sequence
  Description of Artificial Sequence: Synthetic coding sequence
atggctagtactgcagtgcagctcctcggatttctgttgtcattcctgggaatggtgggcacactgatcacaactatactgccccattggcggcggaccgcacacgtcggcaccaacatcctcacagcagttagttatctgaaagggctgtggatggaatgcgtgtggcatagtaccgggatttaccagtgccagatctatagaagcctgctcgcgctgccccaggacctgcaggcggccagggccctcatggtcatcagttgccttctcagcgggattgcctgcgcttgtgccgttattggaatgaagtgcactagatgcgcaaagggaacacccgcgaagaccacttttgctatcctgggggggacactcttcatattggccggcctactctgtatggtggcagtgtcttggaccaccaacgatgtggtacaaaatttctataaccccctcctgccatctggtatgaagtttgaaatcgggcaagcactgtatttagggtttatttcctcatccctctccctcataggcggtactctcttgtgcttaagttgccaagatgaagcaccctacagaccctaccaggccccgcccagagcaacgactaccacagcaaataccgcacccgcctatcagccaccagctgcctataaagacaacagagctccatcagtcacgtctgccacccattctggatacaggcttaatgattatgtgtag

SEQ ID NO: 112446 - DNA, 720 bp, Artificial Sequence
  Description of Artificial Sequence: Synthetic coding sequence
atggcttccacggctgttcagctgctggggttcctgctgtcattcctggggatggtgggaacactcatcactactattctcccccattggagacgcacagcccacgtgggtaccaatatcttaaccgcggtgtcatatcttaagggtctatggatggagtgcgtatggcactctaccgggatctaccaatgccaaatctaccgcagcctgctcgctcttccccaagacctgcaagcagccagagcactcatggtaatctcatgtctattaagtggtattgcctgcgcctgcgccgttatcggaatgaagtgcacacgctgcgcaaagggaacccctgccaaaaccacttttgcgatactggggggcaccctgttcattctggccgggctgctgtgtatggtggcggtgtcttggacgacaaatgatgtcgttcagaatttctacaacccgctccttccgtcgggaatgaaattcgagatcggacaggcgctgtatttgggatttatcagtagtagccttagtttgattggcggtactttactgtgcctctcctgtcaggatgaggctccatatagaccataccaggcgccgccccgtgcaactactaccactgctaataccgcacctgcataccagccacccgcagcgtacaaggataatagggctccatctgttacttctgccacacactcagggtaccgactcaatgattatgtgtag

SEQ ID NO: 112447 - DNA, 720 bp, Artificial Sequence
  Description of Artificial Sequence: Synthetic coding sequence
atggccagtaccgctgtgcaactgctgggcttcctcctgtcatttctcggcatggtaggcacactgattacaacgatcctgcctcactggcgacggacagcgcatgtcggtactaatatcttgacggccgtgtcctatctaaaaggcctatggatggagtgcgtttggcattccactggtatctaccagtgccagatctatagatccctgctggcgctgcctcaggatttacaggccgccagagcgctgatggttatctcttgcttgctctctggtattgcctgcgcgtgcgctgtcataggcatgaaatgcacccgctgcgccaaggggacccccgccaagactacatttgcaattctggggggaacgctatttatattagcaggcctgctctgcatggtagcagtgtcctggacaaccaacgatgtggtgcagaatttttataatcccttgctgcctagcgggatgaagtttgaaatcggtcaggccctgtatctggggtttattagcagcagccttagcctcattggaggcacactcctctgtctgagctgtcaagatgaggctccatacaggccataccaggcccccccaagagccactaccacaacagccaacaccgcccccgcctaccagccccctgctgcttacaaagataaccgtgcacctagcgtgacttcagcaactcatagcggatacagacttaacgactatgtatag

SEQ ID NO: 112448 - DNA, 720 bp, Artificial Sequence
  Description of Artificial Sequence: Synthetic coding sequence
atggccagtaccgccgttcagctgctgggttttctgctaagcttcctgggaatggttgggaccctcataacgacaatactcccgcattggaggcgcactgcgcatgtgggcaccaacatcctgacggccgtcagttatctgaaaggactctggatggaatgcgtctggcattccacaggaatatatcagtgccagatctatcgaagtctgctggccctgccacaggaccttcaggctgctcgcgccctgatggtgatctcctgtctgctcagcggtattgcctgtgcctgtgccgtcataggcatgaagtgcactcgctgcgcaaaaggcacgcccgcaaaaactacattcgctatacttggcggaaccctctttattttagcagggcttctgtgcatggtggcagttagctggaccacaaatgacgtcgtgcagaatttctacaatccgctactcccatcagggatgaaattcgaaatcggccaggctctgtatttggggttcataagtagctcccttagtcttattggcggaaccctactgtgcttgtcgtgccaggacgaagccccctacagaccttaccaggcccccccaagggcgacaacgacaacagcaaacacagcccctgcctaccaacccccagcggcatacaaggacaaccgcgctccctccgtgactagcgccactcattctggatataggctcaacgattacgtgtag

SEQ ID NO: 112449 - DNA, 918 bp, Artificial Sequence
  Description of Artificial Sequence: Synthetic coding sequence
atgacttcccgcaccccacttttggtgactgcctgtctttactacagctactgtaatagccgccacctgcagcagggcgttcgaaaatctaagcggccagttttctcccattgccaggtgccagagactcagaaaacggatacgcggcacctgtcgggagcgagggccggcgtgtgcccatgctgccaccctgacggcttacttgctactatgagggatctgttgcagtacattgcctgtttctttgcattcttctccgcagggtttctgattgtggcaacctggactgactgttggatggtcaatgccgacgattctcttgaggtctccacaaagtgccgagggctgtggtgggagtgcgtcaccaacgccttcgatgggatcagaacatgcgacgagtacgacagcatcctcgccgaacacccactgaagctggtggtcactcgcgctttgatgatcacggcagatatactcgccggctttggatttttgaccttactgttagggctcgactgtgtaaagttcctccccgacgaaccgtacattaaagtgcggatttgctttgtagcaggggcaacattgctcatcgctggcactcctggcattatcgggagcgtttggtacgcagttgatgtgtatgtcgaacgaagtactttggttctgcacaatatattcctcggtatacaatataaattcggatggtcatgctggctgggaatggccggctcactcggatgtttcctggccggagccgtactgacctgctgcttgtatctttttaaggacgttggccctgaaaggaactacccatattcccttcgaaaggcgtactcagccgccggcgtaagtatggcaaaatcatattctgcgccgcgtaccgagacggccaaaatgtacgccgtggatacaagggtttag

SEQ ID NO: 112450 - DNA, 360 bp, Artificial Sequence
  Description of Artificial Sequence: Synthetic coding sequence
atgacctcccggacacccctcctcgtgaccgcctgtctatattactcgtactgcaattcacgtcatcttcagcagggtgtaaggaagtcaaagcgccccgtcttctcccattgtcaagttccagaaacacagaaaaccgacactaggcatttgtcaggcgctagggcgggcgtctgcccctgttgtcatccggacggcttactcgccactatgcgtgatctgcttcagtatatagcatgtttctttgccttcttttccgccggctttctcatcgtggctacttggaccgattgctggatggtgaatgcagacgatagcttggaaatgctggacttgagagagaccattctgattccctag

SEQ ID NO: 112451 - DNA, 675 bp, Artificial Sequence
  Description of Artificial Sequence: Synthetic coding sequence
atggcgaattcaggcctccaattattggggtactttctagccctgggaggttgggttggtataatagcttccactgcacttccgcagtggaaacagagctcctacgctggggacgcaattatcaccgccgttggactgtacgaaggactctggatgtcttgtgctagtcagtccacgggccaggtgcagtgtaagctttacgattcacttttagcactcgacgggcacatacagtccgcccgcgctctaatggtcgtcgcggtgttactaggcttcgtggccatggtgttgagcgtggtcggcatgaagtgcacccgcgtcggagatagtaatcccattgctaaaggaagagtggctatagcgggcggagcgctgttcattctggcaggcctgtgcacactcaccgccgttagttggtatgccactctggtgacacaggagttctttaatccatccacccccgtgaatgcaaggtatgagttcggacccgccctattcgtgggttgggcgtcagcgggactcgctgttcttggtgggagtttcctttgctgcacatgccctgagccagaaagacccaattcgtccccacagccgtataggcctggtccctcagcagctgctagagagccggtggtaaagctcccggcttccgcaaagggccctttgggcgtttag

SEQ ID NO: 112452 - DNA, 636 bp, Artificial Sequence
  Description of Artificial Sequence: Synthetic coding sequence
atggcaaatagtggactacagctgttgggatatttcctagctctcggggggtgggtggggataatagcttccaccgcgctgcctcagtggaagcagagcagctacgcaggggatgcaatcataacggccgtcgggttgtacgaggggctgtggatgagttgcgctagccagagtacaggccaggtgcagtgcaagttatatgacagtttgctggccctggacggccacatccagagtgccagggcacttatggtggtcgccgtcttgttggggtttgtggccatggtgctctccgtcgtcgggatgaaatgtacccgcgttggtgactccaatccaattgccaagggtcgggtggccatcgccgggggggcattgttcatcctggccggactatgtacattgacagcggtgtcgtggtatgccaccttggtgactcaggagttttttaacccttccactcctgtcaatgctagatatgaatttggtccagcattgttcgtcggttgggccagtgcgggcttggctgtactgggaggatccttcctgtgttgcacttgtcccgaaccagagcgtcccaatagcagtccccagccgtacagaccgggcccctctgctgctgctagagagtacgtatag

SEQ ID NO: 112453 - DNA, 657 bp, Artificial Sequence
  Description of Artificial Sequence: Synthetic coding sequence
atggctaacagtgggctccaactgcttggatatttcctggccctgggcggctgggtggggatcattgcatctacagccctgccacagtggaaacagtcatcttacgcaggggatgcaattatcactgcagtggggttatacgaggggctgtggatgtcctgtgcctcacagtccacaggccaggtgcagtgtaagctgtacgattccctgcttgcactggatggacacatacagtctgcgcgggctctgatggtggtcgctgttttgttgggttttgttgcgatggtactttccgttgtgggcatgaaatgcactcgagtaggagattctaaccccatcgccaaaggtcgggtggcaatagctggtggagccctgttcatcttggcaggaatgaatttggcacagccatgcagttgggcggggcctcaacttgcatggccttgttgggccgcaccttcctccgctgctcacgccaggagccagcgagaccccactgctgcccatagcccgattggcttggatccccttctgctccctgaatccacttccgaactgcgccttccctggcctgcaccccaccctgtggcaccactcccatccatacagcccgcaagccagcatcctggacagggtcactgggggatcggctgggcttag

SEQ ID NO: 112454 - DNA, 663 bp, Artificial Sequence
  Description of Artificial Sequence: Synthetic coding sequence
atgtcaatgggattagagatcacaggaactgcactagccgtgctgggctggctgggtaccatcgtctgctgcgcactacccatgtggcgagtctcggcatttatcgggagcaatattattacctctcagaacatctgggagggtctgtggatgaactgcgtggttcagtcgaccggacagatgcagtgcaaggtgtacgattctctgcttgccctacctcaggacctgcaggccgcaagggctctgattgtcgtggccatcctgcttgctgcgttcggccttctggtcgctctggtaggcgcccagtgcactaactgtgtccaggatgacaccgctaaggctaaaattactatcgtggctggggtccttttcctgctggccgccttgctgactctagtgcctgtgtcatggtcagctaacaccattattagagacttttacaatccggtggtcccagaagctcagaagcgggagatgggcgccgggctctatgtgggctgggctgccgcagcgctccagctgttgggcggagccttactgtgttgctcttgccctccccgcgagaagaagtacaccgctacaaaagtcgtgtactcggccccaagatcaacaggtcctggggcctccctcggaacaggatacgatcggaaggattacgtctag

SEQ ID NO: 112455 - DNA, 630 bp, Artificial Sequence
  Description of Artificial Sequence: Synthetic coding sequence
atggccagcatgggtctacaggtgatgggaatcgcccttgccgtgctgggatggctggcagtaatgctgtgttgtgctctgcccatgtggcgggtaacagcctttataggcagcaatatcgtgacaagccagactatttgggagggactgtggatgaattgtgtggtgcagagtacgggccagatgcagtgtaaagtgtatgatagtctccttgcactgccccaggacttacaggcggcgcgcgccctcgttatcatctctattatcgttgcagctttaggtgtactgttgtccgtagtgggcggcaagtgtacaaattgcctcgaggacgagagtgcaaaggctaaaaccatgatcgtagctggcgtggtatttttgcttgcagggctgatggttatcgtcccggttagttggaccgcccataatattatccaggacttctacaatccgctggtcgcctccggtcagaaacgggagatgggtgcatccctgtacgtcggatgggctgctagcggactactgttactggggggtgggctgctatgttgcaattgtcctccccgaactgacaaaccctattccgcgaagtattccgccgctaggagcgccgccgctagcaattacgtgtag

SEQ ID NO: 112456 - DNA, 630 bp, Artificial Sequence
  Description of Artificial Sequence: Synthetic coding sequence
atggcaagtatgggactgcaggtaatgggaatcgcactagccgtgctgggatggttggcagtgatgctgtgctgtgcccttccaatgtggagggtcaccgcattcatcggttcgaatatagtgacaagccagaccatttgggagggactctggatgaattgcgttgttcagtctaccggtcaaatgcagtgcaaggtttacgactccctgctcgctctgcctcaggacctgcaggccgcccgggccctcgtgattatctcgattatagtagcagccttgggcgtgttgctcagcgtcgttggtgggaagtgtaccaactgcctcgaggatgagtccgcaaaggccaaaactatgatcgtggcaggggtcgtgtttcttctggcagggctgatggtgatcgtgccggtttcttggactgcccataacataattcaggatttctacaatccacttgtggcctccggccagaagcgtgagatgggagcttcgctgtacgtgggctgggctgcctcaggtctcctcctgctgggcggggggctgctgtgttgcaattgtccccctaggaccgacaagccttattctgccaaatactccgccgcgagatctgctgcggcatcaaattacgtgtag

SEQ ID NO: 112457 - DNA, 630 bp, Artificial Sequence
  Description of Artificial Sequence: Synthetic coding sequence
atggccagtatgggactgcaggtgatgggcatcgccctggctgtgctgggctggctcgcagttatgctctgttgcgcattaccgatgtggagggttacagcttttattggctcaaacattgtgacatcccagaccatatgggaaggactctggatgaactgtgtggttcagtctactgggcagatgcagtgcaaagtttacgactcactcctggccctgccacaagacctgcaagcagcgcgggccttggtgattatctcaattattgtggccgcactcggagtcctgttaagcgtggtggggggaaaatgtaccaattgcctggaagatgagtccgccaaagccaagaccatgatcgttgcaggtgtggtgttccttttagctggcctgatggtgattgttcccgtgtcctggaccgcgcacaatattatccaagacttttataatcccctcgtggcctctggacagaaaagggaaatgggggctagcttatacgtcggctgggcagcctccgggctgctcctgctggggggtgggctcctgtgctgcaactgtccccctaggacagataaaccctatagcgctaagtacagtgcagcacgcagcgcggctgccagtaattacgtctag

SEQ ID NO: 112458 - DNA, 591 bp, Artificial Sequence
  Description of Artificial Sequence: Synthetic coding sequence
atggctagcatgggtctccaggtgatgggcatcgcactggccgtgcttgggtggttggctgttatgctgtgctgcgctcttccaatgtggagggtgacagccttcattggcagtaacattgttacaagccagagcaccggtcagatgcagtgcaaggtgtatgatagtctgctggctttgccgcaggacctgcaggcagcccgcgctcttgtcatcatcagcattattgtggcagcactgggcgtcctccttagcgtcgtgggcggcaagtgcactaactgtttggaggatgagtctgctaaggccaaaaccatgatcgtagctggagttgtgtttcttctggcaggactcatggtgatcgtccccgtcagttggactgcccacaacatcatacaggacttctacaacccacttgtggcgtctggacaaaagcgtgagatgggggcaagcctgtatgtggggtgggccgcgagcggcctgctattactgggaggaggcctgttgtgttgtaattgtccccctcgaacagacaagccgtactcagctaagtacagtgcagccaggtccgcagccgcttcaaattatgtctag

SEQ ID NO: 112459 - DNA, 912 bp, Artificial Sequence
  Description of Artificial Sequence: Synthetic coding sequence
atgactagagctaggattggttgcttcggacccggcggtagggcaagagggacggaaagcgcccctgagcccagtaagagggttcccccaggtcggtcctggcagacgcaagaggtgcgacaaacaaggggagccaatgggctgggaccccgtgccgggtcggccggggctaaggcaccgggacctgcacagggcgctgctcaacacgggctgggcggatcagccgggctgagggtgagggtgtccccgcttgcaatgggatccgccgcccttgagatcctggggctagtgctgtgcctagtgggatggggcggcttgattctggcctgtggtttgccaatgtggcaggttacggcatttctcgatcacaacattgtcaccgctcaaaccacctggaaggggctgtggatgagctgtgtcgtgcagtctacaggtcatatgcagtgcaaagtctacgatagtgtactggctctgtccaccgaggtgcaggctgcccgggctctcacagtgtccgctgtcctgttggcgttcgtcgccttgtttgttacccttgccggggcccagtgtaccacgtgtgtcgccccaggccctgccaaagccagggtggcactgacagggggggtgttgtatctgttctgtgggctcctggctctggtgcccctgtgttggtttgccaatattgtggtaagagagttctatgatccctcagttcccgtttcacagaagtacgaacttggtgctgccctgtacattgggtgggccgcaacagccctgctcatggtgggtggatgtctgctgtgctgtggcgcctgggtttgcacggggcggccagatctgtcctttccagttaagtactccgctccccggagacctactgctacgggcgactacgataaaaagaactatgtgtag

SEQ ID NO: 112460 - DNA, 912 bp, Artificial Sequence
  Description of Artificial Sequence: Synthetic coding sequence
atgactcgggcgcgcatcggttgctttggtcctgggggaagggccagaggtacagaatctgctcctgaaccttcaaaaagggttccccccggcagatcctggcagacccaggaggttagacagacgaggggagcaaacggcctgggtcctagagctggttcagcaggcgccaaagcgcctgggcccgcccagggcgcggcgcagcacggcctgggtggatccgccgggctgcgggtcagggtcagccctttagccatgggcagtgcagccttggagatactggggttggtcctctgcctggtaggctggggaggcctgatactcgcatgtgggctgcctatgtggcaggtcacggctttcctcgatcataatattgtcacagctcagacaacttggaaaggattgtggatgagctgtgtggtacagtcgacaggccatatgcagtgtaaagtgtatgactccgtgttagctctgtccaccgaggtacaagccgcccgcgctttaaccgtgtctgccgtgctactggcgtttgtggccctgtttgttacactggccggggctcagtgtaccacatgtgtcgcccccgggccggccaaagctcgggtggccctgaccggtggggtgctatacctcttctgcggactgctcgccctggtcccactgtgctggttcgccaacatagtggtccgggaattctacgacccttccgttcctgttagtcagaaatacgagctgggcgccgccttatacattggatgggctgccactgccctgctaatggttggtggctgcctgctctgttgtggagcttgggtgtgcacaggaagacccgacttatcgtttccagtcaaatatagcgccccccgtcgcccaacggcaaccggggactatgacaaaaaaaactacgtatag

SEQ ID NO: 112461 - DNA, 912 bp, Artificial Sequence
  Description of Artificial Sequence: Synthetic coding sequence
atgacacgcgcccgtattggctgctttggccccggaggacgggccagggggaccgagtctgcgcctgagccttccaaaagagtccctcccgggagaagctggcagacccaggaggtgcgccagactcgcggcgccaacgggttaggcccacgtgctggcagtgccggcgctaaggcacctggacctgcacagggcgctgcccagcacgggctagggggttctgctgggctcagagtgagagtgtccccattggccatgggaagcgcagcgctggaaatactcggactggttttgtgtttagtcggctggggtggcctgatcctggcttgcggactgccaatgtggcaggtgacggcattcctggaccacaatattgtgacggcccaaaccacctggaaagggctgtggatgtcctgtgtggtgcagtccaccggtcacatgcagtgtaaagtgtacgatagcgtccttgccctgagcacagaagtgcaggccgcccgagcactgacggttagcgctgtgctcctcgcatttgtggcattattcgtcacactggccggggcccagtgtacaacttgcgtcgccccagggccagccaaagctagggtcgccctgactggaggggttctttacctgttctgcgggctactggccctggtaccactttgttggttcgctaatatcgtcgtcagggaattctacgatccttctgttcccgtatcacagaagtacgagctaggagccgccctttacatagggtgggctgctactgctctactgatggttggtggatgccttctttgttgcggcgcttgggtgtgcacaggcagaccggacctgagtttccccgtgaaatactccgctccgaggaggcctactgctaccggcgactacgacaaaaagaattacgtttag

SEQ ID NO: 112462 - DNA, 1086 bp, Artificial Sequence
  Description of Artificial Sequence: Synthetic coding sequence
atgggagaggaggccaacgacgataagaaacctactactaagtttgagttggagcgggagacagaactacggtttgaggtggaggctagccagtcagtccagctggagcttctcacagggatggcagaaatattcgggacagaattgacacgaaataaaaagttcacatttgatgccggtgctaaggttgctgtgtttacctggcatggctgctcggtccagctgagcggcagaaccgaggtcgcatacgtgtcaaaggataccccaatgctcctgtatctcaatacacacactgcactggagcagatgcgcagacaggctgaaaaggaggaagaacggggccctagagtcatggtcgttggacctactgacgtcggaaaaagcaccgtgtgcagactgttactgaattatgccataacctccaggctagcagatgtattcaatcagaggtgcgaggtcaaccggagggctagtgtgagtggatgtgtgattaatacatgtggatgggttaaagggtcggggtatcaggccctcgtgcacgcagcttcagccttcgaagtggatgtggttgttgtgctggatcaggagcggctgtacaatgagctgaagcgagatcttcctcacttcgtcaggactgtgctccttcccaaaagcgggggggtggtcgaacggtcaaaagactttagacgcgagtgtcgtgacgagaggattagagagtacttctacgggttccggggatgtttttacccacacgcatttaacgtgaaatttagtgacgtgaagatttacaaagtgggagcacccacaattccagacagctgtctgcccctgggaatgagtcaggaagataatcaactgaagctcgtcccggtgacacctgggcgtgatatggtgcaccacttgctgagtgtaagcactgcagagggaaccgaagaaaatttgtccgaaacttccgtggccggctttattgtcgtgaccagtgttgatctcgaacaccaggtctttacagtgctgagtcccgcccccaggcctctgccgaagaattttcttctgattatggacattcgtttcatggatcttaaatag

SEQ ID NO: 112463 - DNA, 810 bp, Artificial Sequence
  Description of Artificial Sequence: Synthetic coding sequence
atgcaagaaatcattgcctcagtggaccatatcaagttcgacctggagattgccgtcgaacagcagctcggagcccagccactgccttttccaggaatggacaagagtggggccgcagtttgtgaatttttcctcaaggccgcctgtggcaagggaggaatgtgccctttccggcatatcagcggtgaaaaaaccgtggtgtgcaaacattggctgcgtggcctctgtaagaaaggcgaccaatgtgagttcctgcacgagtacgatatgaccaaaatgcctgagtgctacttctactcaaaatttggggaatgctccaacaaggagtgtccttttttgcacatagatcctgagtctaagataaaggactgcccttggtacgacagaggcttttgcaagcatggccccctttgccggcaccgacacacacggcgggtcatctgtgtcaactacctggtgggcttttgtcccgagggtcccagttgtaagtttatgcatccccggttcgagctacccatgggcacaactgaacaacccccattgcctcagcagacacagccaccagccaaacaatccaataatccacctctgcaaagatcctccagcctcatccagcttacgtcacagaatagctcaccgaatcagcaaaggacacctcaggtgataggggtaatgcagagccaaaactccagcgctggcaacagggggcccagacccttggagcaggtgacttgctataaatgcggggagaaagggcattacgccaaccgctgtacaaagggccacctggcttttctgtctggacagtag

SEQ ID NO: 112464 - DNA, 735 bp, Artificial Sequence
  Description of Artificial Sequence: Synthetic coding sequence
atgcaagaaatcatcgcatctgtcgatcacattaagttcgatcttgagatcgctgtggagcaacagctgggcgcgcagcccctaccttttccaggtatggataagtcaggggccgctgtgtgcgagtttttccttaaagctgcttgcggcaagggaggaatgtgtccatttcgccacattagcggggaaaaaacagtggtttgtaagcattggctccgcggtctgtgtaaaaagggcgaccagtgtgagtttctccatgaatacgatatgacaaaaatgcccgagtgctatttctactccaaattcggagagtgttctaataaagaatgtcccttcctgcacatcgatcctgagtctaaaataaaggattgtccctggtacgatcgaggtttttgcaagcatggcccactgtgccggcacaggcacacgcgcagagtgatttgtgtgaactacttggtcggattctgccccgaaggcccatcctgtaaattcatgcacccccggttcgaacttcctatgggtacaaccgagcaaccgcctttaccccaacaaacgcaaccaccagcaaaacaacgtaccccccaggtgatcggcgtaatgcagagccagaactcaagcgccggcaacaggggcccacgacccctggagcaagtgacatgctacaaatgcggagagaaaggacattacgctaatagatgcacaaaaggccacctggcattcttaagtggccagtag

SEQ ID NO: 112465 - DNA, 636 bp, Artificial Sequence
  Description of Artificial Sequence: Synthetic coding sequence
atgcaggaaataatcgcaagcgtagatcatattaagtttgacctggagattgcagtggagcagcagctgggcgcccaacccctgcccttcccgggcatggataaatctggcgccgccgtgtgcgagttctttttgaaagcggcatgcgggaaaggcggtatgtgcccgttcagacacatttcaggggaaaaaacagtcgtgtgtaaacactggctacgcggcttgtgcaagaagggcgatcagtgtgagttcttgcacgaatacgatatgaccaagatgccagagtgctatttttacagtaagtttggacctttgtgccgccatcgacacacaaggcgcgtgatctgcgtcaattatctggtcggcttctgtcctgaaggcccgtcatgtaagtttatgcaccctaggttcgaactaccaatgggaacaactgagcagccaccactgccacagcagacgcagccgccggcgaaacggacacctcaggttataggcgtcatgcagtcccagaactccagtgcggggaaccgaggcccccgtcccctggagcaagtgacctgctacaagtgcggggaaaaaggccactacgcaaacagatgcacaaaaggtcatctcgctttcttgtctggccagtag

SEQ ID NO: 112466 - DNA, 1767 bp, Artificial Sequence
  Description of Artificial Sequence: Synthetic coding sequence
atggctgatggcgtcgaccacatcgacatatacgccgatgtgggagaggagtttaaccaggaagcagaatatggtgggcacgatcagatcgatctgtatgatgacgtgatttcaccctccgcaaataacggagacgcacccgaggacagggattatatggataccctgccacccactgtgggagacgatgtcggcaagggtgcagccccaaatgtggtgtacacatatacgggcaagaggatcgccctgtacattggaaaccttacttggtggacaactgatgaagatctcacagaagctgtgcactccctcggagtcaatgacatattggaaatcaaattctttgaaaatcgggccaacggccaatctaagggattcgcccttgttggcgtcgggagtgaggcctcatcaaagaagctcatggatcttctgcccaagcgggagttacacggccaaaaccccgtggtcacaccatgtaacaaacagttccttagtcagtttgagatgcaatcccgcaagaccactcaatcagggcagatgtcgggagaaggcaaggccggtccacccggaggttcctcccgcgccgcatttccccagggcggtcgcggcagaggccgctttccaggagcagtaccaggcggagacaggtttccggggccggctggaccgggcggcccccctccaccattccctggcaacctgattaaacatcttgtgaagggcactcgtcccctgtttcttgagactaggataccatggcacatgggtcactctattgaggagattcctatctttggcctcaaggccgggcagacgccgccaagaccaccactaggacctcccgggcctcctggcccaccaggtcctccaccgccaggacaagtgctgccacctcctttggccggaccgcccaatcggggtgaccggccacctccccccgtgctgttccccgggcagcccttcgggcagcccccactcggacctctgccccccgggccgccgccgccagttcccggctatgggcctccccctggtcccccacctccccaacagggaccaccccctccgccgggtccctttcccccgaggccacctggccctttgggccctccccttacactagctcctcctccacacctcccaggaccccccccgggtgcccctccccctgcgccgcatgtgaaccctgcgttttttccaccacctaccaactctggcatgcctacgagtgatagcagaggcccccccccaacagacccttacgggcggccgccaccttacgacaggggtgactacggcccccctgggcgggaaatggacacagctcggacaccacttagtgaagcagaatttgaggaaattatgaaccgcaatcgagcaatctcatcaagcgctatcagccgggccgtcagtgacgccagcgccggggattatgggtctgctattgaaaccttagtcacggccatttctctcatcaagcagagtaaagtttcagccgacgatagatgtaaagtcctgatcagctccctgcaggattgtctacatggaatcgaatcgaaatcctacggatcgggatctcgccgcgagcggtcgcgcgagagggaccacagccggagcagggaaaaatctcgacgccacaaatcacggtcaagagacaggcatgacgattactacagagaacgctctagagaacgtgagcgacacagagatcgcgatcgcgatcgcgatcgggagcgggacagggagagagagtacagacaccgctag

SEQ ID NO: 112467 - DNA, 1656 bp, Artificial Sequence
  Description of Artificial Sequence: Synthetic coding sequence
atggcagacggggtcgaccacatagacatctatgccgatgttggcgaggagttcaaccaggaggcagaatatggcggccacgaccaaattgatctctatgacgacgtgatcagtccatccgcgaataacggcgacgctcctgaggaccgagattatatggacactctgcctccaaccgtgggcgacgatgtcggcaagggagccgcacctaatgtagtgtatacttatacgggcaaacggattgcactttatattggaaacctcacctggtggacgacagatgaggatctaactgaggctgttcacagtctgggagttaacgatatactggaaattaagtttttcgagaaccgggccaacggccagagtaaggggttcgctctcgtgggggtgggaagcgaggcatcctcgaaaaagcttatggacctgcttccgaaacgggaactccatggccagaatcccgtcgtgactccttgtaataagcaatttctaagtcagttcgaaatgcaatctcgcaaaacaacacagtctggacagatgtccggagaaggcaaggctggcccacccgggggtagctcacgtgccgcgttcccgcagggtggaagaggccgaggtaggttcccgggggcggtgcccggtggagatagattccccggacccgccggaccaggcgggccccctcccccgttccctgcaggacaaacgcctccacggccacctctcggtcctccaggcccaccaggccctcccggcccacctcctcctggtcaagtgctccctccccctctcgccggacctcccaaccggggagatcggccccctccacccgtactgtttcccgggcaaccgttcggccagcccccattggggcccctgcctccagggcctccgccacctgtcccaggttacgggcctccgcctggacctcctccacctcagcagggacccccacctccccctggaccatttccccctcgaccaccaggacccctggggcctccactaactctggcaccacctccacatcttcccggccccccccctggggccccaccacccgcccctcatgtgaaccccgccttttttcccccccccactaactcagggatgccaacctccgactctcgcgggccgccaccaaccgacccatatggtcgtcctcctccgtatgaccggggagattacggccccccaggaagagagatggacacagcccgtactcccttaagcgaggcggagtttgaggagatcatgaacagaaatcgggcgattagttcatcggccatctcacgggccgtctcagatgcttctgccggtgattatggatcagctatcgagacactagtgaccgcaatatccctgataaagcagagcaaagtgagcgcagacgaccggtgtaaagttctcatcagttctctccaggactgtctccacggcattgagagcaagagttacggatcaggctctagaagagagcgaagtcgagaacgagatcacagccggtccagagaaaaatctcgtaggcataaatcccgatcacgcgaccgacatgatgactattaccgggagcgatctcgtgaaagagagaggcaccgggatcgagacagagatcgtgacagggagcgcgatcgggaacgcgaataccggcataggtag

SEQ ID NO: 112468 - DNA, 1437 bp, Artificial Sequence
  Description of Artificial Sequence: Synthetic coding sequence
atggcagacggtgtggaccatatcgacatctacgcagacgtaggggaggaattcaatcaggaggcagaatatggggggcatgatcagatcgacctgtacgatgacgtgatctcccccagcgccaacaacggcgatgctcccgaggacagagactacatggatacgctacctcctactgtcggcgatgacgttggcaaaggcgctgcacccaacgtcgtctacacctacactggcaagcgcattgccctttacattggtaacctgacttggtggacaactgacgaagatctcacagaagcagtacattctctcggtgtaaacgatattctggaaattaaattctttgagaaccgggctaacggccagtctaagggatttgctctggtgggtgtcggatcagaagctagctcaaagaaactgatggacctactcccaaaaagagagctccatggtcagaatccagtcgttaccccgtgcaataagcagttcctgagccagttcgaaatgcaatccaggaagaccactcagagtgggcagatgtctggtgagggaaaggctgggccgcctggggcaggcccacccaataggggggataggcccccacctcctgtgctctttccaggccagcctttcgggcagccgccgcttggacccctaccacctggcccgcccccccccgtacctggttacgggccacctccaggtccccctcccccccaacaagggcctcctccaccaccaggcccatttccaccacggccccctggtcctctgggccctcccctaacacttgctccacccccccatctgcccgggccacctcccggagctccacccccagcacctcacgtgaaccctgcttttttccccccacctactaactccggtatgcccacgagtgatagtcggggaccaccgccaacagacccctacgggcgaccacccccatatgatcgaggtgactacggcccacccggccgagagatggacacagctcgaaccccactgtctgaagccgaatttgaggagatcatgaaccgaaacagggctatctcttccagtgccatttctcgggccgtgagcgacgcgagtgcgggagattatggctcagccatcgagaccctggtgactgcgatctctttaataaagcagtcaaaggtttcagccgatgacagatgtaaagtgctcatctcctcattgcaagactgcctccatgggattgaatcaaaaagctatggaagcggtagccggagagagaggagcagggaaagggaccacagccgcagccgtgaaaagtccaggcgccataagtcccggtcccgagaccgtcacgatgattattacagggaacgatctcgagagagagagcgccacagagatagagacagggacagggatagagaacgtgacagagaaagggaatacagacacagatag

SEQ ID NO: 112469 - DNA, 1851 bp, Artificial Sequence
  Description of Artificial Sequence: Synthetic coding sequence
atgtcgtccctggctgtgcgcgacccagccatggaccgatcgctacgctccgtgttcgtggggaatatcccgtacgaagcaacagaggaacagctcaaggatatcttctccgaagttgggagcgtggtcagtttcagactggtgtacgacagagaaaccggcaagccaaaagggtatggtttttgcgagtatcaggaccaggaaaccgccctcagcgcaatgcggaacctgaacggacgggaatttagcgggagagctctgcgggtggataacgccgccagtgagaaaaacaaggaagaattgaagagcctgggacctgcagctccaattattgacagtccgtacggcgatcctatcgatccggaagatgcccctgaaagcatcactcgagctgttgccagccttccaccagagcagatgttcgagttaatgaaacagatgaagctctgcgtgcaaaactcccaccaggaagcccggaatatgctcttacaaaatccacagctggcgtacgcccttctgcaggcacaggtggttatgagaattatggaccctgaaatcgctctcaagatattgcaccggaaaatccacgttacaccacttatccccggaaagtctcagtcggtcagcgtgtccggaccagggccgggcccaggcccgggactgtgcccgggccctaacgtgctactcaatcagcaaaacccccctgcacctcagccccaacatttggctcgccgcccggtgaaagatattcccccccttatgcagacccccatccaggggggcataccagcccctggccctattcccgctgccgtgcccggagctggtcccgggtctttaacacccggaggagcgatgcagcctcagttgggtatgcctggcgttgggccggtgccacttgaaaggggacaggtgcagatgtcagaccctagggccccaattcctcggggtcctgttactccaggtggcctaccacctagaggactgcttggcgacgcccccaatgaccctcgcggtgggacgctgctgagcgtaaccggagaggtggaacctcgcggatatcttggtcccccgcatcaaggcccacctatgcaccacgcctccgggcatgacactaggggaccaagctcgcatgagatgcgaggcggacccctgggtgacccacggctgcttatcggggaaccccgcggccccatgatcgatcagaggggcttaccaatggatgggagggggggccgagattctcgagctatggagactcgggcgatggagactgaggtgctggaaacgcgggtcatggaaagaaggggaatggaaacgtgcgcaatggagacacgaggaatggaggcccggggcatggatgctcggggtctcgaaatgcggggcccggtcccgagctcccgcggtcccatgacaggtggcattcagggtccgggaccaatcaacattggagccggtggaccacctcaaggtccgagacaggtccccggaatttcgggtgttgggaaccctggcgccgggatgcaggggaccgggattcagggtactggcatgcagggagcggggatccagggagggggtatgcagggggcaggtattcagggggtttcgatccaagggggaggcattcaggggggaggtatacaaggtgccagcaagcagggggggtctcagccaagcagcttcagccctgggcagagccaagttacccctcaggatcaggagaaagcagctctgattatgcaggtgcttcagttaacggccgatcagatagctatgttgccaccagaacagagacagtcaatcctgatcctgaaggagcaaatccagaaatcaactggagccagctag

SEQ ID NO: 112470 - DNA, 2541 bp, Artificial Sequence
  Description of Artificial Sequence: Synthetic coding sequence
atgctctttaccgtgagttgcagtaaaatgtcttccatcgtcgacagggatgacagctctatctttgacgggcttgtggaagaggacgacaaagacaaagcaaaacgtgtctccagaaacaaaagtgagaaaaaaaggagagatcaatttaatgtgctcatcaaggaactgggctccatgctgcccggtaacgcccgaaagatggataaatccacggtgttgcagaagagcatcgactttctccgtaagcacaaagagatcacggctcagtccgacgcttctgaaattagacaggattggaaacctacctttctctctaacgaggagtttacccaactgatgctggaagcgctggacggattttttttagctattatgactgatgggtccatcatctacgtcagcgagtctgtaactagtctgctcgagcaccttccatccgatctggttgaccagagtatctttaactttataccagaaggtgaacatagtgaggtctacaagatcctctctactcacctcctcgagtcagattcacttacccccgagtaccttaagtccaaaaaccaactggaattctgttgtcacatgctgagaggcaccattgatccgaaagaaccctcgacatatgaatatgtgaaatttattggcaatttcaaaagcctgaatagcgtgagctcctctgcacataacgggttcgagggcaccattcagaggacacatcgacctagttacgaagatcgtgtttgttttgttgctacagttcgattggctacccctcagttcattaaggaaatgtgcaccgtagaggaaccgaatgaagaatttacaagcagacactccctagagtggaagtttcttttcctggatcatcgggcaccccccattatcgggtacctgccctttgaggtgctgggcacatccggctacgactattaccatgtggacgatctggagaatctcgccaagtgtcatgaacacctgatgcagtatggaaaaggcaagtcatgctattatcgcttcttgacaaaagggcagcagtggatctggctgcagacgcattactatatcacgtaccaccagtggaacagtagaccagagttcattgtgtgtacccacacagtggtctcttatgccgaggtgagggccgagaggcgacgagaactaggcattgaagagtcactgccggagactgccgccgacaagtctcaggactcaggcagcgacaatcgcatcaatactgtctccctgaaggaggccctggagcgttttgatcatagtccaactcccagcgcttcctcccgctcaagcagaaaaagcagccacactgcggtctctgatccatcctccacccccaccaagatccccaccgacacatctaccccaccccggcaacatcttcctgcgcacgagaagatggtgcagcggaggtcgagttttagcagccaatcgattaattcacaatccgtgggctcctccttgacccagcccgtcatgagccaagctaccaatttgcccatacctcaggggatgagtcagtttcagttcagcgctcagttgggagcgatgcagcatcttaaggatcaactggagcagcggacccgtatgattgaggctaacatccataggcagcaggaggagctccgcaagatccaggagcaacttcagatggtccacggccagggcctccagatgttcctccagcagagcaaccctggactgaattttggctccgttcagcttagtagtgggaacagttcgaatattcaacagctggctcccatcaatatgcaaggacaggtggtgcctacaaaccagatccagagcgggatgaacaccggccacatcggtaccacccagcacatgatccagcagcaaacgctccaatcaacatctacccagtctcaacaaaatgtgctgtccggacattctcagcagacttctctgccatcccagacacagagtactctcaccgctcctctgtacaacacgatggtgatctcccaacccgccgccggctctatggtgcagatccccagcagcatgccacagaactctacacagtccgctgccgtcacaacatttacccaagacaggcagatccggttttctcagggacagcagctcgtgactaagctggttaccgccccagtggcatgcggagccgttatggtgccatcaactatgctcatgggtcaagtggttaccgcatacccaacgtttgccacccagcagcagcaatcgcagacactgagcgttactcagcagcagcagcagcagagctcccaggaacagcaactaaccagcgtgcaacagccctctcaggcccaattgacccagccccctcagcaattcctgcaaacttctcgtttgctccacggtaatcccagcacccagttgattttgtccgcagccttcccactccagcaatccacatttcctcaaagtcaccaccagcagcatcagagccagcagcagcagcagttgtcaaggcacagaacagattctctcccagatccctccaaggtgcagccgcagtag

SEQ ID NO: 112471 - DNA, 1278 bp, Artificial Sequence
  Description of Artificial Sequence: Synthetic coding sequence
atgggtgaagaagctaacgatgataaaaagcctaccaccaaattcgagctggaacgggagacagaactgcgcttcgaggtggaggcttcccagagcgtgcagctggagctgctgactggcatggcagagatcttcggaacagagctaacaaggaataaaaaattcacatttgacgccggggcaaaggtggcggtgtttacatggcatggctgtagcgtccagctgtctggcaggaccgaggtcgcctacgtgagcaaggataccccaatgctgctgtacttgaatacccacacagccctcgagcagatgcggcgccaagccgagaaggaggaagagcggggaccacgagtgatggtggtggggcccaccgatgtgggcaaaagcacagtgtgccggctgctgctcaactacgctgtgcgactgggaagaaggcctacgtacgtcgagttggatgtaggccagggaagcgtgtcaatccccgggacaatgggcgcgctgtacattgaaaggcccgcggatgtggaggagggcttcagcatccaagcacccctcgtctatcacttcgggagtacaactcctggcacaaatataaagctttacaataagatcacatcccggttggccgacgtctttaatcagcggtgtgaagtcaaccggagagccagcgtgtccggctgtgtcatcaacacttgtggttgggttaaagggagcggctatcaggccctcgttcacgctgcctctgcatttgaggtggacgtcgtcgtggttctggaccaggagcgactttacaatgaactgaaaagggatttgccacatttcgtacgaaccgtgctgcttcctaagtctggcggtgtcgttgagcgctctaaggacttccgcagggaatgccgggatgaacgaatccgggagtatttctatgggttccgggggtgcttctacccacacgcattcaatgtgaaatttagcgatgtgaagatttacaaagttggagcacccacaattcccgattcgtgtctgccactgggaatgagccaggaggacaatcagctgaaactggtaccagtcactcctggcagggatatggtgcaccatctacttagtgtttcaacagctgagggcacggaggaaaatctaagcgagacctccgtcgcaggctttattgtcgtgacctcagttgacctagagcaccaggtgtttacagttctgagcccagctcccagacctttgcctaagaatttcctgctgattatggacatcaggtttatggatctcaagtag

SEQ ID NO: 112472 - DNA, 1311 bp, Artificial Sequence
  Description of Artificial Sequence: Synthetic coding sequence
atgaccgatctgcattcctcctatactgaggaaatgggggaggaagccaatgatgacaaaaaacccactacaaagttcgaactcgaaagagaaactgagttgaggtttgaagtggaagccagccagagcgtccagctggagttactcactgggatggctgagattttcggcactgaactgaccagaaataaaaagtttacattcgatgccggcgcgaaagtagcggtgtttacctggcatggatgctctgtacagctgagcggccgcacagaagtagcttacgtttccaaggacaccccaatgctgctgtatttgaatacacacaccgcgctcgagcaaatgagaaggcaggccgagaaagaggaggagcgcggcccaagggttatggtggtggggccaaccgatgtgggaaagtccacagtctgtcggctgctactgaactatgctgttcggctaggccggcgaccaacttatgtcgagttggatgtcggccagggaagcgttagtattcccggtactatgggcgctctatatatcgaacgcccagccgatgtggaggaggggttcagcatccaggcgcccctggtttaccacttcggctccaccacaccgggaaccaacataaagctgtacaacaaaatcacttcccgcttggctgatgtgtttaaccagcgctgtgaagttaacaggagagcgagtgtgagcggatgtgttataaacacctgcggttgggtgaagggatccggctaccaagcactggttcacgcagcctccgcctttgaagtggatgtcgtcgtcgtactggaccaggaacggttgtataacgaactcaaacgggatctgccgcattttgtccgaacagtgctgctccctaaaagcggcggggtggtagagagatcgaaggacttccgtagggagtgtcgagacgagaggatccgggagtacttctatggctttcgggggtgcttttacccacatgctttcaatgtcaaattctctgatgtgaagatctacaaggtgggagctccgaccataccagattcttgtctcccgttggggatgtcgcaagaagataatcagctgaagctcgtgcctgtaactccgggcagagatatggtacaccacctgctgtcagtcagcaccgcagaggggaccgaggaaaacctgtcagagacttctgtggccggatttatagttgtcacttccgtggacctggaacaccaggtgttcacagttctcagtccagccccgcgaccactgcccaaaaattttttgctgatcatggacatccgtttcatggacctgaagtag

SEQ ID NO: 112473 - DNA, 279 bp, Artificial Sequence
  Description of Artificial Sequence: Synthetic coding sequence
atgggggaggaggccaatgatgataaaaagcccacaacaaaatttgaactggagagagagacggagttgcgctttgaagtggaagcgagccagtcggtccagctcgagctgctcaccggaatggctgagatcttcggaacagagctcaccagaaataaaaagtttacctttgacgctggtgcaaaagtggccgtttttacctggcatggttgttcagtgcaactttccgggcgcaccgaggttgcctatgtgtcaaaggatactccgatgctgctgtag

SEQ ID NO: 112474 - DNA, 1278 bp, Artificial Sequence
  Description of Artificial Sequence: Synthetic coding sequence
atgggcgaagaggccaatgatgacaagaaacctaccaccaaattcgagctggagagagagaccgaactccggttcgaggtcgaggcatcccagagtgtacagttagaactgctgactggaatggctgagattttcggcacagagttgactagaaataaaaagtttacattcgacgcaggggccaaagtcgctgtgttcacctggcatggttgcagcgtacagctgagtgggcggaccgaggttgcatatgtgtctaaggatacccccatgcttctgtacctgaatactcacacagccctggaacagatgcgtaggcaggccgagaaggaggaggagcgcggtccaagggtcatggtggtgggtcccacggatgtcggcaagagcaccgtatgtaggctgttgcttaactacgcagttcgcctgggccgacggccaacgtacgtggagctagacgtgggccaggggagcgtttctattcccggtacgatgggcgctctctacatagagagacctgccgacgttgaggagggcttctctatccaggcgcccctagtgtatcattttggttccaccacccccggcactaacatcaagctgtataataagattacgtcccgattggctgacgtcttcaatcaacggtgtgaagttaacagaagagccagcgtctcgggctgcgtgatcaacacatgtggatgggtgaagggatctggataccaggctttggtgcatgctgcctcagcctttgaggtagatgtagtggtggtcctagaccaggaacgactctacaatgagctgaagcgtgacttgcctcattttgttagaacggtcctgctgcccaagtcagggggcgtcgtggaacgttccaaggatttccgccgagagtgcagagacgagcgcatcagagagtacttctacggattccgcggatgtttttacccacatgctttcaatgtgaaattctctgacgtgaaaatctacaaggtgggtgcaccgacaattcccgattcttgcctaccactcggaatgagccaggaggataaccagctgaagttggtacccgtcacccccggccgggacatggtccaccacttactctcggtctcaacagcggagggcacagaagagaatctatcagagacctcagtggcgggttttatagtcgtgacatctgtagatctggaacatcaggtgtttaccgtcctaagccccgcgccaagacctctgcccaaaaactttctgctgatcatggatatacgttttatggacctcaagtag

SEQ ID NO: 112475 - DNA, 399 bp, Artificial Sequence
  Description of Artificial Sequence: Synthetic coding sequence
atgggcgaggaggccaacgacgataaaaagcctaccactaagtttgagctcgaaagggagacagagttgagattcgaagtcgaggcaagtcagtccgtacaattggagttgcttacaggaatggccgagatcttcggcacggaactgactagaaacaaaaagtttactttcgatgccggcgcaaaggtggcagtgttcacctggcatggctgctcagtgcagctttcgggcaggactgaggtggcttatgttagcaaagatacacccatgttactgtatttgaatactcatacggccctcgagcagatgaggagacaagccgaaaaggaggaggagaggggtcctagagtgatggtagttggcccaactgatgtcggcaagagcacggtctgcaggtag

SEQ ID NO: 112476 - DNA, 834 bp, Artificial Sequence
  Description of Artificial Sequence: Synthetic coding sequence
atgtggccgggcattctagtaggcggcgcacgggtggcttcttgccgttatcctgccctggggcctcgcctggccgcccatttcccagctcagaggccaccccagagaaccttgcagaacggcctcgccctgcaaagatgcctacatgccacagctacaagggcactgcctctaatccccatagtggtcgaacagaccgggcgtggcgaaagggcctatgacatttatagtcgccttctacgcgagcgaatcgtgtgtgtgatgggcccaatagatgactccgtcgctagtctcgtcatagctcagctgctgtttttgcagagtgagtccaataagaagcctatccacatgtacatcaattccccgggaggcgtggttacagcagggttagcgatttatgatactatgcagtatatccttaatcccatctgtacctggtgcgtggggcaagcagcgtccatgggcagcctgctccttgccgctggcacacctgggatgcgccatagtctgcccaacagcagaatcatgattcatcagccgtcaggcggcgctagaggacaggcgaccgatatcgccatccaagccgaagagattatgaaactaaagaaacaactctataatatttatgcgaagcataccaagcagagccttcaggtgatagaatctgccatggaacgagacagatatatgagccctatggaggcccaggagtttggaatcctcgataaagtcttggtgcacccaccccaggacggtgaggacgaaccaactctagtccaaaaagaaccagtagaggcggctccggctgccgagcctgtccccgcaagtacgtag

SEQ ID NO: 112477 - DNA, 1617 bp, Artificial Sequence
  Description of Artificial Sequence: Synthetic coding sequence
atgtggtcggggagatcatcttttacatccctggtcgtgggtgtattcgtagtctatgtggtacacacgtgttgggtgatgtatggaatagtctatactagaccttgctctggggatgctaactgtattcagccataccttgcccgtcgccccaagctgcagctctctgtgtacactaccacaagaagtcatctgggagcagaaaataatattgatttggtactgaacgtggaggatttcgacgtggagtctaagtttgagaggaccgtcaacgttagtgttccaaagaagacacgaaataatggcacactctacgcatacatcttcctgcaccatgccggagtgctgccttggcatgatgggaagcaggtgcaccttgtgtccccattaactacctatatggttccgaaacctgaggagattaacctcttaaccggagagagtgatacccagcagattgaggctgagaagaaacccacttccgctttggacgagccagtgagccactggcggccaaggcttgcattaaatgtgatggccgacaactttgttttcgacggtagctcactgccggccgacgtccacagatatatgaaaatgatacagctgggaaaaacggtccattatcttcccatcttatttatagaccaactgagtaatcgggtaaaggatctgatggtgatcaacaggtctacaacggaactgccattgaccgtatcctatgacaaggtgtctttggggcgtctcagattttggatccatatgcaggatgctgtctattccctgcagcaatttgggttctccgaaaaagatgcagatgaggttaagggaatctttgtagatactaatctctacttccttgcactaactttcttcgtggccgctttccatctcctcttcgacttcctggcattcaagaacgacatcagcttctggaagaagaagaaaagcatgattggaatgtctactaaggcagtgctgtggcgttgctttagcacggtagttattttccttttcctcctagatgagcaaacgtcactcctggttttggttcccgctggcgttggcgctgctatagagctgtggaaggtcaagaaagccttgaagatgacaattttctggcgggggttgatgcccgagttccagttcggaacatattccgaatcagaacggaagacagaggagtatgatactcaagcaatgaagtatttgtcctatcttctgtatcccctctgtgtgggcggcgccgtctacagtctcctgaacatcaagtataagagctggtactcatggttgatcaactctttcgttaatggggtgtacgccttcggttttttattcatgctgccccagctgtttgtgaattataaattgaagagcgttgctcacttgccatggaaagccttcacctacaaggcatttaacacttttatcgatgacgtatttgcatttattattaccatgcccacctcacatcgactcgcctgttttcgggatgacgtggtcttcctcgtttacctctatcaaaggtggttgtatccagtggataagcggcgggtaaacgagtttggagaaagctatgaggaaaaggctacccgggcccctcacactgactag

SEQ ID NO: 112478 - DNA, 1509 bp, Artificial Sequence
  Description of Artificial Sequence: Synthetic coding sequence
atgtggagcggcagatcaagtttcacatcactggttgtgggagttttcgtcgtttacgtggtacatacgtgctgggttatgtacggaatcgtctatacccgcccatgttcaggcgatgctaactgcattcagccatacctggcaaggcggcccaagcttcagctaagtgtttacaccacaacccgctcacacttaggtgctgaaaataatatcgacctcgtccttaacgtagaggactttgacgtcgagagcaagttcgaaaggactgtaaacgtatcagtcccaaaaaagacacgaaataatggaaccctgtacgcctacatcttccttcatcacgccggcgttctcccctggcatgatggtaaacaagtccatcttgtaagtcccctcacgacgtatatggttcccaagcctgaggaaatcaatctactgacaggagagagtgatacccagcagatcgaggctgaaaaaaagccaacctccgcactggatgagcccgtgtcacattggaggcccagactggccctgaacgtcatggcagacaactttgttttcgatggtagcagcctccccgcggatgttcatcgatacatgaaaatgatccaattggggaagacagtgcattatctgccgatacttttcatagatcagctttccaatcgggttaaagatctcatggttattaatcgcagcacaacagaactgccactcaccgtcagttacgataaggttagcctgggccgcctgcggttttggatccacatgcaagacgctgtctactccctgcaacagtttggcttcagcgaaaaggatgccgacgaagttaagggcatctttgtagatacaaacttatatttcctcgcactaacattttttgtggcggcctttcacctgttatttgatttcttagcattcaagaacgatatttctttctggaagaagaagaagtctatgatcggtatgtctaccaaactctggaaagttaagaaggccctgaaaatgaccatcttctggcgaggactgatgccggagtttcagtttggcacctacagcgaatctgaacgcaaaactgaggagtacgacacccaagccatgaagtacctctcatatcttctctaccctttatgcgtgggcggagccgtgtattctcttctcaatatcaagtacaaaagctggtactcttggctaattaacagcttcgtgaatggggtgtacgcctttgggttcttgttcatgctgccccagcttttcgttaactataagctcaaaagtgttgctcatctaccttggaaagcgtttacctataaggcttttaatacctttatcgatgacgtgtttgcctttatcatcacaatgcccactagccacaggctcgcttgctttagggatgacgttgtcttcctcgtgtatctttaccagcgctggctttaccctgtggataaaagaagagtgaatgagtttggcgaaagctacgaagaaaaggctacaagagccccccatacggactag

SEQ ID NO: 112479 - DNA, 1350 bp, Artificial Sequence
  Description of Artificial Sequence: Synthetic coding sequence
atgatgaaaactctgctattgtttgtcggcctcctgttaacatgggagtcaggtcaggtgttgggggatcaaaccgtctctgacaatgagcttcaggagatgtcgaatcagggcagcaaatacgttaataaggaaatccagaatgcagtaaacggggtgaaacagatcaagactctgatagagaagaccaacgaggaaagaaaaacgttgctgtcgaacctggaggaggctaagaaaaagaaggaggatgccttgaacgaaaccagggaaagtgaaacaaaacttaaggaactgcccggggtctgtaacgagaccatgatggccctctgggaagagtgcaaaccctgcctgaaacaaacttgtatgaagttctatgccagggtgtgtagatctggatctggactggtgggccgacagttggaggaatttcttaaccagagctcacctttttatttttggatgaacggggatcggattgattcactgttggagaatgaccggcagcagacacatatgctggacgtaatgcaggatcacttctcgagggccagctctattatagacgagctcttccaggaccgctttttcacacgagaaccccaggacacctaccactacctgcccttcagcctgccccatcgtaggccacattttttcttccctaaaagccggatcgtgcgctctctgatgcccttctccccctatgaaccactgaacttccacgctatgttccagccttttctggaaatgatccacgaggcacagcaggccatggatattcactttcactcccctgccttccagcatccacccaccgagtttattagagagggtgacgacgataggacagtctgcagagagatccgacataattcaacagggtgtctcagaatgaaagatcaatgcgataaatgccgggaaatactgtccgtagactgctccacaaataaccctagccaggccaaattgagacgcgaattagatgagtccctgcaagttgccgagaggcttacaaggaaatataacgaactgctaaagagctatcagtggaaaatgctcaatacgtcaagcctcctggagcagctcaatgaacagttcaactgggtcagtcgtctagccaacctgacccaaggggaagaccagtattatttaagagtgacaactgtcgcttcacacaccagtgactctgacgtcccctctggcgttacagaagtggtggtgaaattatttgactccgaccctatcacggtgaccgtgccggtggaagtgtcacgcaagaatcctaaatttatggaaacagtcgccgaaaaggccctacaagaataccggaagaaacacagagaagaatag

SEQ ID NO: 112480 - DNA, 825 bp, Artificial Sequence
  Description of Artificial Sequence: Synthetic coding sequence
atgcaggatcacttctctcgcgcatcgtctatcattgatgagctcttccaggatcggttcttcactcgtgaaccacaagatacataccactatttgccgtttagtctccctcataggaggccccactttttcttcccaaaaagcagaatcgtccgttcactcatgccctttagcccttacgaaccactgaatttccacgcaatgttccagccctttttagagatgatccatgaggctcagcaggccatggacatccactttcatagtccagctttccaacatcctcccaccgagttcatccgggagggagacgacgacagaactgtctgcagggaaatccggcacaacagcactgggtgcttgcggatgaaggaccagtgtgataaatgccgagagatcctctcagttgattgcagtaccaataacccttctcaggccaaactgcggcgtgaactcgatgaaagcttgcaagtcgctgaaagactgacacggaaatataacgagttacttaaaagctatcagtggaagatgctcaatacgtcctcactattggaacaactcaacgaacagtttaactgggtgtctagacttgcaaacctgacacagggtgaggatcagtactacctgcgggtgacaacagtggcatctcacaccagtgattccgacgtgccatccggggtaactgaagttgtcgtgaagctttttgatagtgatcctattaccgtgaccgtccctgtggaggtgtctcggaagaacccgaagtttatggaaactgttgcagaaaaagccctccaggagtaccgcaagaagcacagagaggaatag

SEQ ID NO: 112481 - DNA, 1350 bp, Artificial Sequence
  Description of Artificial Sequence: Synthetic coding sequence
atgatgaagacactgcttctcttcgtgggacttctccttacctgggagagcgggcaggttttgggtgaccagacagtgtctgataacgaactgcaagaaatgtctaaccaaggttccaagtacgtgaataaagaaattcaaaatgctgtgaatggggttaagcagattaaaaccctgatagaaaagaccaatgaggaacggaagacgcttttgagcaacctcgaggaagccaagaagaagaaagaggacgcattgaacgaaaccagagaaagcgaaaccaagctcaaagagctgcccggggtgtgcaatgaaactatgatggcgctttgggaggaatgtaaaccctgcctcaaacagacgtgcatgaagttctacgcaagagtgtgtcggagcggtagcgggctagtcggccggcagctcgaagagttcctgaaccagtcctcccccttctacttctggatgaacggggatagaattgattccctgttagaaaatgatcgccagcagacccacatgctggatgtcatgcaagatcattttagtcgcgcttcttccatcattgacgaactcttccaggatcggttctttacaagggaacctcaggatacataccattacctgccattcagtctgccccatcgaaggcctcatttcttcttcccgaagtctagaatagttcgaagtctgatgccattctccccttatgaaccgctgaacttccatgctatgttccagccattcctggagatgattcatgaagctcagcaggctatggacatccattttcactctcccgctttccagcacccccccaccgagtttataagggagggcgatgacgataggacagtgtgtagggagattaggcataattccacaggctgtcttcgcatgaaagaccagtgcgataagtgcagagagatcctctctgttgactgttctactaacaaccccagtcaagcaaaattgcgaagagaactggatgaaagcctgcaggtagcagagaggcttaccaggaagtataacgaactcttgaagagctatcaatggaaaatgcttaacacctctagcctcctggagcaattgaacgagcagtttaactgggtgagtcgactggcaaacctcacacagggagaagatcagtactacctgcgtgtcaccaccgtggcctcacacacatctgattctgacgtgccatctggtgttacagaggtggtggtgaaactcttcgattccgatcctatcaccgttaccgtgccagtggaggtatctagaaaaaatcccaagtttatggaaacagttgcagagaaggccctgcaggaatacaggaagaaacatcgagaagagtag

SEQ ID NO: 112482 - DNA, 615 bp, Artificial Sequence
  Description of Artificial Sequence: Synthetic coding sequence
atgatgaagacgctgctcttattcgtcggtttactgctgacatgggagtctgggcaggttctgggagaccaaacagtatccgataacgagcttcaggaaatgtctaatcagggtagcaagtatgtcaacaaagaaattcagaacgccgtgaatggcgtcaaacaaatcaagaccctcatagaaaagacaaacgaggaacggaagaccctgctttctaacctggaagaggccaaaaaaaagaaggaagacgctttgaacgagacaagggagtctgaaacgaaactgaaagagctccccggtgtctgtaatgagaccatgatggccttatgggaggaatgtaagccgtgcctcaaacagacatgtatgaagttttatgcacgcgtctgcagatcaggctccggcctggtcggtagacagctggaggaatttctcaaccagagctcaccgttttacttttggatgaatggggatcgcattgattctttgcttgagaatgacaggcaacaaacacacatgctggatgtgatgcaggaccattttagtagagcttcgagtataattgacgaactattccaagatcgatttttcacaagggaaccccaggatacttattag

SEQ ID NO: 112483 - DNA, 1350 bp, Artificial Sequence
  Description of Artificial Sequence: Synthetic coding sequence
atgatgaagactctgctgttattcgtggggttactgctgacatgggagtcggggcaggtgcttggagaccaaactgtgagtgataacgaactccaggagatgtcgaatcagggaagtaaatatgttaataaggaaatccagaatgcagtgaatggtgtcaaacagataaagacccttatagaaaagaccaatgaagaacgcaagaccctgctgtccaacttggaggaagcgaagaagaaaaaagaagatgcactcaatgaaactcgcgaaagcgagaccaaactgaaagagctgcctggggtttgtaacgagaccatgatggccttgtgggaagagtgcaaaccctgcctgaagcagacttgcatgaagttttacgcgcgggtctgcagatcgggaagtgggctcgtcggacggcagttagaagagttcctcaaccagtcatcaccattttacttttggatgaatggagatagaatagactccttactggaaaatgataggcagcaaacacatatgctcgacgtaatgcaggaccacttttctcgggctagtagcattatcgatgagctctttcaggatcgcttcttcacgagggagccacaagacacgtaccattatcttccattcagtttgccacatcggcgccctcactttttcttccctaaatccaggatcgtgagatcactgatgccgttctccccatacgagccactcaattttcacgcgatgtttcagccgtttctcgagatgatccacgaggcacaacaggcgatggacatccattttcattctcctgccttccagcaccctcccaccgagttcatccgtgaaggcgatgatgatcggactgtatgcagggagattcggcacaactcaactgggtgtctccgtatgaaagaccagtgcgacaagtgccgggagatcttgagcgtagactgctcaaccaataatccaagtcaggccaaactccgtcgagaactcgacgagtccctgcaagtagcggagcgcctgacgcgcaaatacaacgagctacttaaatcttaccagtggaaaatgctcaacacatcatctctgttggagcagcttaatgaacagttcaactgggtctcgcgactggccaacttgactcagggggaagatcagtattacctgagggtaacaacggtggccagccatacatcagactccgatgtgccatctggagtgaccgaggtagtggttaagttgtttgacagcgatccgattaccgtgaccgtaccagtggaagtctcgcgtaaaaaccctaagttcatggagacagtggccgagaaagccctgcaggaatatcgcaaaaaacacagagaggagtag

SEQ ID NO: 112484 - DNA, 816 bp, Artificial Sequence
  Description of Artificial Sequence: Synthetic coding sequence
atgatgaaaacgctgcttttgtttgttggactgttactgacctgggaatcaggccaagttctgggtgatcaaacagttagcgataatgagctgcaggaaatgtccaatcagggctctaaatatgtgaacaaggagattcagaacgccgtaaacggtgtcaaacagataaaaactttaatcgaaaaaacaaatgaagagcggaaaaccctattgtcaaacctggaggaggctaaaaagaagaaggaggatgccctgaatgaaaccagggagtccgaaacgaagttgaaggaactgcctggggtttgcaacgaaacgatgatggctctgtgggaggagtgtaaaccatgcctcaagcagacatgtatgaaattttacgcgcgtgtttgcagaagtgggtcgggccttgtcgggaggcagttggaagagtttctgaatcagtcttcaccattctatttttggatgaacggcgacaggatagattccctcttggaaaatgacaggcagcagacgcatatgctggacgtgatgcaggatcattttagtagggcctccagtatcattgatgagttattccaagatagcttgatgcccttctcgccgtatgagcccctgaatttccacgcaatgttccagcctttcctcgaaatgatacatgaagctcaacaggccatggatatccacttccactcccctgcctttcaacatccgcccacagaattcatacgggaaggagacgatgacagaaccgtgtgcagggagattaggcacaacagcaccggctgcttgaggatgaaggaccagtgcgataagtgctag

SEQ ID NO: 112485 - DNA, 1383 bp, Artificial Sequence
  Description of Artificial Sequence: Synthetic coding sequence
atggaggcctgtaaggatagcaggataggggggatgatgaaaacactgctcttattcgtcggtctgcttctgacctgggagagtggacaggtgcttggtgatcaaaccgtgagcgacaatgaactgcaggagatgtccaaccaggggtcgaagtatgtgaacaaggaaatccagaatgctgttaatggcgtcaagcagatcaagacgctgatcgaaaagacaaatgaggagcgtaaaacccttctttctaatctggaagaggccaagaaaaaaaaagaagacgctctgaacgagacccgggagagcgagactaagctcaaagaattgcctggggtgtgtaatgaaacgatgatggcactgtgggaggagtgcaaaccttgcttaaagcaaacttgtatgaagttttacgcgcgggtctgtagatcggggagcgggctcgttggtcggcaattggaggagttcttgaatcaatcctcccccttctacttctggatgaatggagacaggatcgatagccttctggagaacgacagacaacagacccatatgttagacgtcatgcaggaccattttagcagagccagcagcatcattgatgaactctttcaggacagattctttactagggagcctcaagatacatatcactacttgcctttttcccttccgcatcgcaggccccactttttctttccaaagagccggattgtcagaagcttgatgcctttctcaccatacgaaccactgaatttccatgccatgttccaaccgttcttggagatgattcacgaagctcagcaggctatggatatccactttcattcccccgcatttcagcatcctcctacagagttcatacgtgagggtgacgacgatcggacagtctgccgcgagatccggcacaactccaccggttgtctgcggatgaaggaccagtgtgacaaatgtagagaaatcctctcagttgattgttccactaataacccctcacaggcgaaactgaggagggagctcgacgaatcacttcaggtggctgagcgcctgactagaaagtacaacgaattactaaagagctatcagtggaagatgctcaatactagttccttgctggaacagctgaacgagcagtttaattgggttagtcgcctggctaatcttactcaaggagaggatcagtactaccttcgtgtcaccaccgtcgcatcacacacctcagactctgacgtacccagtggtgttacagaggtggtagtgaaactgttcgattccgaccccatcacagtcactgtccctgtcgaagtctccaggaagaatcctaagttcatggagaccgtcgcagagaaagccttgcaggaatatcgcaagaagcaccgagaggaatag

SEQ ID NO: 112486 - DNA, 1506 bp, Artificial Sequence
  Description of Artificial Sequence: Synthetic coding sequence
atgcaggtctgttcacagcctcagagaggctgcgtacgtgagcagtcggcaatcaatacagcacctcccagcgctcacaacgccgcaagccctgggggcgcccggggccacagggttccactgactgaagcatgtaaggattctagaatcggcggcatgatgaagacgctgttgctctttgtgggactcctgctgacttgggagtccggccaagtcctgggggatcaaacagtgtccgataacgagctgcaggagatgtccaaccaggggagcaagtatgttaacaaggaaatccagaacgccgtgaacggggtcaaacagatcaaaaccctcatcgaaaagactaatgaagagaggaaaacactgctgagtaaccttgaggaggccaaaaaaaagaaggaggacgccttaaacgaaacacgggaatccgagactaagctcaaagaactgccgggcgtatgtaacgagacaatgatggccctgtgggaggagtgcaagccctgtctcaagcagacttgcatgaagttctatgcacgggtgtgccgcagcggttcagggctcgttggccgccagctcgaggagttcctgaatcaatccagccccttctacttttggatgaatggggacagaatcgattcattacttgagaatgaccgacagcaaacacacatgctagacgtgatgcaggatcattttagccgggctagtagcatcattgatgagctgtttcaggatagattctttactagagagccccaggacacgtatcactacctgccattcagcctgccacaccgccggccccactttttcttcccaaagtcacgaattgtgaggagcctcatgcccttcagcccgtacgagcctctcaatttccacgccatgttccagccatttctggagatgatccacgaggcgcaacaggcaatggatattcactttcattctcccgcctttcagcatccgcctactgagtttattagagaaggagatgatgaccgcacggtctgtcgggagattcgccacaatagcaccggatgtctgcgcatgaaggatcaatgtgataaatgcagagagatcttaagcgtggattgtagcactaataatccttcccaggcaaagctaaggcgggagcttgacgagtcactgcaagtggctgagcgtttgacacggaagtataatgagctgctgaaatcctatcaatggaaaatgcttaacaccagcagtttgctcgaacagctgaacgaacagtttaactgggtctccagattggccaaccttacccaaggggaggaccagtattatctgcgggtgactacagtagcttcccacacctcagacagcgatgtcccctctggcgtgaccgaggtggtggtcaaactatttgatagcgaccctattacagtgacagtaccagtggaagtctccagaaagaatccaaaattcatggagacagtcgccgaaaaagccctgcaggagtatcggaagaagcacagggaggagtag

SEQ ID NO: 112487 - DNA, 894 bp, Artificial Sequence
  Description of Artificial Sequence: Synthetic coding sequence
atggaagcatgcaaggactctcgaatcggcggaatgatgaaaaccctgctgcttttcgtgggactgctcttgacctgggaatctgggcaggtgttgggcgatcagaccgtgagcgataacgaacttcaggaaatgtcgaaccaggggagtaaatacgtgaacaaagagattcagaacgccgtaaacggggtgaaacagattaaaacattaatcgagaagaccaacgaagagcgaaaaaccttgctcagcaaccttgaggaggctaaaaagaaaaaagaggacgctctaaatgaaacacgggagtccgaaactaagttgaaagaactgccaggggtttgtaatgaaacaatgatggccctgtgggaggaatgtaaaccctgcctgaaacaaacgtgtatgaaattttatgctcgcgtgtgccggtccggcagcgggctggtggggcgccaactcgaagagttcctgaatcagtcctcacccttttatttttggatgaatggcgatagaatcgacagtttactagaaaatgataggcagcaaactcacatgctcgacgtcatgcaggaccacttctcccgggcgagttccatcatcgatgaactgttccaggaccggttctttaccagagaaccgcaggatacttatcactatctgccatttagtttgccacaccggcgcccccactttttcttccctaagagtcgcatcgtccggtccttgatgcctttttctccatacgagccccttaatttccatgcaatgtttcaaccattcttggaaatgatccatgaagcgcagcaagccatggatatacatttccattctccagcatttcagcatccgccaacggagtttatccgagagggagacgatgaccgcacagtgtgtcgatag

SEQ ID NO: 112488 - DNA, 2040 bp, Artificial Sequence
  Description of Artificial Sequence: Synthetic coding sequence
ctcggacaattcgagcaaccgactggatatatggaaaatagcgtgtcatattcggctatcgaggacgtgcagctgctgtcctgggagaacgcccctaaatattgtctgcaactgactataccgggaggtaccgtcctgcttcaggcagcaaatagctacctgcgcgaccaatggttccacagtctgcaatggaaaaagaaaatttataagtacaagaaggtcctgagtaacccaagtcgctgggaagtagtcctgaaggagattagaaccctggtggacatggccctgacgtccccactccaggatgatagcattaaccaagctcccctggaaatagttagtaaactgctgagtgaaaataccaatctaactacacaagaacatgagaatatcatcgttgccatcgctcccttactggagaacaatcacccgcccccggacctttgtgaatttttctgcaaacactgtagggaacgccctcgctcgatggttgtgatcgaggttttcacgcctgtggtccagagaatcctaaaacacaatatggacttcggcaagtgccccagattacgactcttcacacaggaatatatactcgctctgaacgaattgaatgcagggatggaagtcgttaagaagttcatacagagcatgcacggtccaaccgggcattgtcctcacccgcgcgttttacctaatcttgtggccgtgtgcttagctgctatatacagttgctacgaagagttcatcaatagcagagacaactctccttccttgaaggagatcagaaatgggtgccagcagccgtgcgatcggaaacccaccctgccacttcgactgctgcacccgtcccctgacctggtgagtcaagaagccaccctgtcagaagcccgtctgaagtccgtggtcgtagcatcctcagagattcacgtcgaagttgagaggacttccacagccaaaccagctttaaccgctagtgctggaaatgattccgaacccaacctgatcgactgcctcatggtcagtcccgcttgttctaccatgtccatcgagctcggtcctcaggccgatcgcaccctcggttgctatgtggagatactgaagctgctttctgattatgatgactggcggccgtctcttgcctcactccttcaacctattcccttccctaaagaagccttggctcatgagaaattcacaaaggaactcaagtacgtgatccaacgcttcgcggaggatccacgacaagaagtgcactcctgtctgttgagtgtacgtgcggggaaagatggatggttccagttatacagccctggcggggtcgcatgcgacgatgacggtgagctatttgcttctatggtccatattctaatgggttcgtgttacaaaacgaagaagtttctactaagcctcgccgaaaacaagttgggcccatgcatgcttctggctttgagaggaaaccagacaatggtagagattttgtgtcttatgcttgagtataacatcatcgataataacgacacacagctgcagatcattagcactctcgagtctacagatgtgggcaagcggatgtatgaacaactgtgcgatagacagagagagctgaaggagctccagcgaaagggcggccctacgcggttgactctgcctagcaaaagcacagatgctgacctcgccaggctcctgagttcagggagttttggtaacctagagaacctgtcgctcgcgtttacgaatgtcacttcggcttgcgcagagcacctgatcaaactcccctcactgaagcagttaaacctgtggtcaacgcagttcggagacgcgggactgaggttgctgagtgagcaccttaccatgctgcaagttctcaatctgtgcgagactcctgtcaccgatgccggcctcctcgccctgagcagcatgaaatcactgtgctccctgaacatgaacagcaccaaattgtctgccgatacatacgaagacctcaaggcaaaacttcccaacttgaaggaggtggatgtccgctataccgaggcttggtag

SEQ ID NO: 112489 - DNA, 2322 bp, Artificial Sequence
  Description of Artificial Sequence: Synthetic coding sequence
atggacgtgactagctcctccggtggtggcggcgacccgagacaaatcgaggaaactaaaccgttgctgggaggcgatgtttctgcccctgaagggacaaagatgggggctgtgccatgtagaagggccctgctgctttgcaatggtatgagatacaaactgctgcaggagggtgatatacaggtctgcgttatccggcacccccgcacttttttgagcaagatcttaactagtaaatttctaaggcgctgggaacctcaccatttgactctggctgataactctctggcctctgccaccccgacaggctatatggagaacagcgtctcttacagtgctatcgaagatgttcagctcctgagctgggaaaatgctcctaaatattgcctgcagttaactattccaggggggacggtgcttctccaagctgctaactcttacctgagggatcagtggttccactctctgcaatggaagaaaaagatctacaagtataaaaaggttttgagcaaccccagtcgatgggaggtggttctaaaggaaattcgaactctcgtcgatatggcgctcaccagccccttgcaggatgattccatcaatcaggcgccgctcgaaatcgtctcgaagctgctgtctgaaaataccaatctaactacccaagaacacgaaaacatcatcgtggctatagctccactcctggagaataaccatcctcctccagacctgtgcgagttcttctgcaaacactgcagagagagacccaggagcatggtggtcatcgaggtctttacgcccgttgtgcaacggattcttaagcataacatggactttggcaaatgtcctcggctgaggctcttcacccaggaatatattcttgcgctgaacgagctaaatgctgggatggaggtagtcaaaaaatttatacagagcatgcacggccccactggacactgtcctcacccccgcgtcttgcccaacctggtcgcagtgtgcctggcagctatctattcttgctatgaagagtttatcaacagccgggacaatagtccctctttgaaggaaatacgcaatggttgccagcagccttgcgatcgcaagcccacactcccactccggctgcttcatcccagcccggaccttgtctcgcaggaggccacactgtccgaagctaggctcaagtccgttgttgtggcaagttctgaaatccatgtggaggttgagcgaacaagtacagctaaaccagcactgacagcaagcgcagggaatgattccgagcctaacttgattgactgtttaatggtaagcccagcctgcagtaccatgtcaatagagctgggaccgcaggctgaccggactctcggatgttatgtcgagattctcaaacttttgagcgactacgatgattggcgaccctctcttgcttcactgctccagcccattccttttccaaaggaggcactagcacacgaaaaattcacaaaagaactgaaatacgtgatccagaggttcgcagaggacccgaggcaagaggtgcattcctgcctgctttctgtgcgcgcgggcaaggacgggtggttccagctgtacagccccgggggcgttgcttgcgacgacgacggtgaactgttcgcgagcatggtgcacatacttatgggaagttgctataaaactaagaagttcctgctgtccttggcagagaacaagctgggcccatgcatgttactggcccttagaggcaatcaaacaatggttgaaattctttgcctcatgctggaatataacatcatagacaacaacgacacacagttgcaaataatatctaccctcgagtccaccgacgtcggcaagaggatgtatgaacaactctgtgaccgccagcgcgaactgaaggagttgcaaaggaaggggggccccaccaggctcaccttgcccagcaagagtacggacgccgaccttgcccgactgttgagctctggcagcttcggtaacctggagaacctctcgctggccttcaccaatgtgacttcagcttgcgcagagcaccttattaagcttccctcgctgaaacaacttaacctctggtcgacacaattcggggatgccggacttagattgctttctgaacacctcacaatgttgcaggtgttgaatctttgtgagacaccagtgactgatgcagggttactagccctgtctagcatgaagtccttatgctcgctcaatatgaattccacaaaactttccgctgatacctatgaagacctcaaagcaaagcttccgaatctgaaggaggtggacgtgcgctatacagaagcgtggtag

SEQ ID NO: 112490 - DNA, 2040 bp, Artificial Sequence
  Description of Artificial Sequence: Synthetic coding sequence
atgggtcaggccgctgaaccgactgggtacatggagaatagtgtgtcgtattccgctatcgaagacgttcagcttctcagctgggaaaatgcccccaaatattgccttcagctgactatccctggtggcacggtgctgctgcaagcggccaactcttatttgagggaccagtggttccacagcttgcagtggaaaaagaaaatatataagtataagaaggttctgagcaaccccagcaggtgggaggttgtcctgaaagaaatacgcactctcgtcgatatggccctgacaagtcctctgcaggacgactccatcaaccaagcacccctggagatcgtgtccaagcttctgtcagagaacactaatttgaccacccaagaacacgagaacatcatcgtcgcaatagctcctttgctggaaaataaccaccctccacctgatctctgtgagttcttttgcaagcactgccgcgaacgcccgcgctctatggtcgtgatcgaggtgttcacccccgtcgtccagagaatactgaagcataacatggattttggaaagtgcccaagattacggttgtttacccaggagtacattttagcgctcaatgaactgaacgcaggtatggaagtcgttaagaaattcattcagtcaatgcacgggccaaccggccactgcccccaccccagggttctccccaatctggtggcggtgtgcctggcagccatctactcgtgctatgaggagtttattaattccagagacaacagcccctcgctcaaggagatacgaaatgggtgccagcagccatgcgacagaaagcccactctaccccttagactgctacaccccagtccagaccttgtgtcacaggaggccactcttagtgaggctcggctgaaatctgtggttgtcgcatcgtccgagatacatgtggaggtggagcgcacgagcacagcaaagccagccctgaccgcatcagccgggaacgatagcgagccaaatcttatcgactgcttgatggtgagcccggcttgttccaccatgtcaatcgagctagggccccaggccgaccgcaccctgggttgctacgttgaaattttgaaattgctgtccgactatgacgattggcgcccgtccttggcctctctcttgcagcccatccctttcccaaaggaggccctggcgcacgagaagttcaccaaagagctcaagtacgttatccagcggtttgccgaagacccacgtcaagaagtgcattcttgccttctctccgtgcgcgcaggcaaagatgggtggttccaactctatagcccaggcggggtcgcttgtgacgatgacggggaacttttcgccagcatggtccacattctgatgggctcatgttataaaaccaagaagttcctgctctcactggccgaaaacaagctcggtccttgtatgctgttagccctccgaggaaatcagacaatggtggagattctttgcttgatgctagaatacaacatcatcgacaataatgatactcaactccagataattagcactctcgagtcaactgacgtcggcaagaggatgtacgagcagctgtgcgaccggcagcgggaactcaaggagctccagagaaagggaggaccgacccgcctcacgctgccttcgaaatcaactgatgccgatctcgctcgactcctgtcaagcgggtccttcgggaacctcgaaaacctgtctctggcctttacgaacgtgacttcagcatgtgccgagcatcttattaagctcccctctttgaaacagctcaacctttggagcacccaattcggggatgctgggctaaggctcttgagcgagcatcttactatgctgcaggtgctgaacctgtgcgagacacccgtaaccgacgccggtcttctggcgctgagttctatgaagtctttgtgctccctgaatatgaatagcactaaactgtccgctgacacttacgaagatctcaaggcaaaactgccaaatctcaaagaggtcgatgttagatacaccgaagcctggtag

SEQ ID NO: 112491 - DNA, 1761 bp, Artificial Sequence
  Description of Artificial Sequence: Synthetic coding sequence
atggcactgacatcccccttacaggacgacagtattaatcaggctccactagagattgtgagcaaactcctatccgagaacacaaacttgaccacccaggaacacgaaaacattatagtggccattgctcccctcctggagaataaccacccacccccagacctatgtgagtttttctgcaagcactgtcgggaaagaccacgttcaatggttgttatcgaggtttttactcccgttgtccaacgcatactgaagcacaatatggactttggcaaatgtccacgtctcaggctcttcacccaggaatacattctggcactgaacgaactgaacgcggggatggaggtggtgaagaagtttatccagagcatgcatggccctaccggccattgcccacatcctagggtattacctaacttagtagctgtgtgcttggcggccatatatagctgttatgaggaatttataaactcccgtgacaatagtccatccttaaaggagatccggaatggatgtcagcagccttgtgatcggaaacccactctgccgctccgcctgctccatcctagccctgacctggttagtcaagaggccaccttgtctgaggctagacttaaatccgtggttgtggcctcttctgaaattcacgtcgaagtggaacgcacctcaactgcaaaaccagcattgactgccagcgcgggaaacgactctgaacccaacttgattgactgtctcatggtgtcccccgcttgctcaactatgtctatagagctgggcccacaggccgatagaactttaggctgttacgtcgagatactgaagctgctgtctgactacgacgactggagaccgtcactggccagccttctgcagccaattccctttccaaaggaggcattggctcatgagaagtttaccaaagaactaaagtatgtgattcagcgcttcgcagaggatcccaggcaggaggtccacagttgcctgctaagcgttagggcaggcaaagatgggtggttccagctctactctccgggtggggttgcttgtgacgacgatggcgagctgttcgcaagtatggtgcacatactgatggggtcctgctacaaaacaaaaaagttcctgcttagcctcgcagaaaacaaacttggtccctgcatgttgctggcgctgaggggcaatcagaccatggttgagatcctgtgtttaatgctggagtacaacataatcgataacaacgacacccaactgcagatcattagtactttagaaagcactgatgttggcaagagaatgtatgagcaactttgcgataggcagagggagctcaaagaattacagcgcaaaggagggccaacccggctgactctgcccagcaaaagcacagatgccgatcttgcccgcctgctgtcctccgggagtttcggtaacctggaaaatctgtccttggcgttcactaacgtgaccagtgcctgtgccgagcatctgatcaaactaccatccttgaaacaattgaatctgtggtccactcaatttggtgatgccggactccggttactttctgagcatctgaccatgctgcaggtgcttaatctttgcgagaccccagtaaccgatgctgggctcctcgccctgtcaagtatgaaatccttatgttcactgaacatgaatagcacaaagctcagcgccgacacttatgaggacctaaaggctaaattgcctaatctgaaagaagtggacgtcaggtataccgaagcctggtag

SEQ ID NO: 112492 - DNA, 312 bp, Artificial Sequence
  Description of Artificial Sequence: Synthetic coding sequence
atggcccattacaaggcagctgactccaagcgtgaacagtttcgccgttatctggagaagagtggcgtgcttgatacattaacaaaggttctggtcgccctatatgaagagcctgaaaagccgaactccgccctggatttcctcaagcatcatttaggggccgccacccccgaaaaccctgagattgagctcttacgcctggagctcgccgaaatgaaggagaagtacgaggcaattgtggaagagaacaagaagttgaaagctaagctagcacagtacgaaccaccgcaggaggaaaagagggctgagtag

SEQ ID NO: 112493 - DNA, 1695 bp, Artificial Sequence
  Description of Artificial Sequence: Synthetic coding sequence
atggccgtgttccggagcgggttgcttgtgctcaccacgccattggcgagcctggcaccccggcttgcgagcattctgacaagtgccgctcggcttgtaaatcacacgctgtacgtgcacctgcaaccgggcatgagcttggagggacctgctcaaccccagtccagccccgtgcaggccacatttgaagtattagacttcatcacacatttgtatgcaggcgccgacgtacatagacacttggacgtgcgcatacttctcacgaatattcggaccaagagtaccttcctcccccctctccctacttcagttcagaatctcgcacacccccccgaggtggtattgaccgactttcaaaccctggatggctcccagtataatcccgtcaaacagcagctggtgcgctatgcgaccagctgttactcttgctgcccaaggctggcctctgtgctcttgtacagcgactacggtattggcgaggtccccgttgagccgcttgacgtgccactcccatctaccattaggcctgcaagcccagtggcagggtcccccaagcagccagtccgcggatactaccgaggcgccgttggaggcacctttgacaggttgcacaacgctcacaaagttttgctctcagtcgcttgcatccttgcgcaagagcagcttgtcgtaggcgtggctgacaaggatttacttaaatctaagctgctccctgaactccttcagccatacaccgagcgggtcgagcacctgtcagaatttctggtagacatcaagcctagcctgacttttgatgtgatcccacttctagacccatacgggcccgctggctcagatccctcccttgaattccttgtagtctcagaagagacttacaggggcggtatggctattaataggtttagactggaaaatgacctagaggaactcgcgctgtaccaaatacaactactgaaagatctgcggcacactgagaatgaagaggacaaggttagttcttcctcattccgccagaggatgctcggcaatctgctcagacctccatacgaacggccggaacttccaacttgtctctatgtgattggacttactggcattagtggctccggcaaaagctcaatcgcacaaaggctgaaggggctgggggccttcgtaatcgattccgaccatttgggacatagggcatatgcccctgggggacctgcctaccaaccagtcgtggaggcctttggcaccgacatcctgcacaaagatggtatcattaaccggaaggtattaggtagtcgtgttttcggaaacaaaaaacagctgaagatcctgacagacattatgtggccgattatagccaaactggcccgtgaagagatggaccgcgccgtggctgaaggaaaaagggtttgcgttatagatgccgctgtgctgcttgaagctggatggcagaatcttgtgcacgaagtttggaccgctgtgatccccgaaacggaggccgtgcgacgcatcgtggagcgcgatggcctgtctgaggccgctgcccagagcagattgcagtcccagatgtccggtcagcagctagtagaacaatcccacgttgtcctgtcaaccctgtgggagcctcatatcactcagcgacaggtagaaaaagcttgggccctgctgcagaagcgcatccccaaaacacatcaggcactggactag

SEQ ID NO: 112494 - DNA, 1695 bp, Artificial Sequence
  Description of Artificial Sequence: Synthetic coding sequence
atggcagtctttaggtccggcctcctcgtgctcactacgccccttgcgtccttggcccctcgactcgccagcatattgacatctgcagcgaggcttgttaatcatactctctacgtgcacctacagcctggaatgtcgctggaaggccccgcacaaccacagtcaagtcccgtccaggcgacattcgaagtcctagattttattacccacctctacgccggagccgatgtccacagacatctggacgtgcggatcttactcactaacataaggaccaaaagcacgttcctgccccccctccctacaagtgtacagaacctggcccacccgcccgaagtggtactgactgacttccaaacactcgatggctctcagtacaaccctgtgaagcagcagctggttcgctatgccacttcgtgctacagttgctgtccgagactggcctctgtgttgctctactcagactatggtatcggtgaggtcccagtagaacctctggacgtgcccctcccctcaacaatccggcccgcctctccagtggccgggtcacctaagcaaccagtacggggctattatcgaggggcggtcggcgggaccttcgatagactgcacaacgcccacaaagtgcttctgtctgtggcgtgtattctcgctcaggaacaactagtggtgggtgtggcagataaggacctgctgaagtcgaagcttctgcccgagctgttacagccatatactgagagggtagaacatctatcagagtttctggtcgacatcaaaccatctctgacttttgatgttattcctctgttggacccctacggtccagcgggttcagatccgtctctggaatttctggtagtgtccgaggagacctacaggggaggcatggccatcaaccggttcagattggagaatgacctggaagagctcgccctgtatcagattcagctgctcaaggatctcagacatactgagaacgaggaggacaaagttagcagcagcagcttcaggcaacgaatgctaggaaacctattgcgcccaccttacgaacgtcctgagctgcccacctgtctgtatgtgattggcctgaccggaatctcaggcagcggaaaatcttccattgcacagaggctgaaagggctcggcgcctttgtgatcgacagtgatcatctcggacatagagcctatgcacccggtgggcctgcctatcagcctgttgttgaagccttcggaacagatattctgcacaaagacggtatcatcaaccgcaaggtgctgggcagcagagtgttcggaaacaagaaacagttgaaaatcctgacagacatcatgtggcccataattgctaaactggccagagaggaaatggatcgggctgtggctgagggcaagcgggtgtgtgttatcgacgcggccgttttgttagaagcaggctggcagaacttggtgcatgaagtgtggaccgcagtgatccctgagacagaggccgtgcgccggattgtggaacgcgacgggttaagcgaggcagccgctcagtccagacttcagtcccagatgagcggtcagcagctggtcgagcagtcgcacgtggtgctgtctactttgtgggaaccgcatataacacagcgtcaggtggagaaagcctgggctcttctacagaaaagaattccaaaaacccatcaggcgcttgactag

SEQ ID NO: 112495 - DNA, 1782 bp, Artificial Sequence
  Description of Artificial Sequence: Synthetic coding sequence
atgcgcacgccccggcttagagcacagcctcggggcgcagtctaccaggccccctcgcccccgcctgccccagtgggactcgggtctatggcggtattccgttctggacttttagtcttgaccacccccttagcctctctggcaccacgcctggcgtcaattctcacaagcgctgctaggctggtcaaccatacactgtatgtgcatcttcagccaggtatgtcattagagggcccagcccagcctcaatcttccccagttcaggccacatttgaggtcttggattttatcacccacctgtatgcaggagccgatgtgcatagacatctggatgtacgaattctgctgactaacatcagaacaaaatcaactttcctcccgccactgcctaccagtgtccagaatctggcccacccacctgaggtcgtgctgactgactttcagactttggatggctcccagtataacccagtgaaacagcagctggtgagatatgcaacatcttgctacagctgctgcccgagactggcttccgtcttgctttactccgattacggcattggagaagtcccagtggagcccttggatgtgcctctgccatctaccattcgacccgcgagtccagtcgcaggatcgcctaagcaaccggtaaggggctactatagaggggccgtcggcggaaccttcgatcggctccacaacgcccacaaggtccttctgtccgtcgcttgtatcctcgctcaagagcagctggtcgtgggggtagccgacaaggatctgttaaagagcaagctcctgccagaactgctgcaaccctacacagagagggtggaacatttgtcagaattcctggtcgatataaagccctcattgacctttgatgtcattcctctactggacccctatgggcccgctggctctgacccctcactcgaatttttagtcgtgtccgaagagacatatcggggcggcatggcgatcaacaggtttcgcttggaaaatgacctggaagagctcgccctgtatcaaatacagctgttgaaggacctgaggcacacagaaaatgaagaggacaaggtatccagctccagctttagacagaggatgctgggaaatctgttgagaccaccatacgagcggccggaactgcccacttgcttgtacgtgatcggactcacagggatcagcgggtccgggaagagtagcatcgctcagaggcttaaaggcctcggagcctttgtgatcgattcagaccacctcggccatagagcgtatgccccgggcggaccagcctatcagccagtggtagaggcctttggcaccgacattctgcacaaggatggtatcatcaataggaaagtgctgggaagtagagtcttcggtaataaaaagcaattaaagatcttaacagatattatgtggcctatcattgccaagttggccagagaggagatggatagggctgtcgccgagggtaaaagggtctgcgtaatcgatgctgctgttctcctggaggccggctggcaaaacctggtccatgaggtctggacagctgtcatccccgagaccgaagctgttaggaggatcgtggaacgcgacgggttgagtgaggccgccgcccagagtaggcttcagagtcagatgtccgggcagcagttggtcgagcagtcacacgtggtgctcagtactctgtgggagccacacatcacacagagacaggtggagaaggcatgggccctcctgcagaagcgaattcccaagacacatcaggcgttggactag

SEQ ID NO: 112496 - DNA, 528 bp, Artificial Sequence
  Description of Artificial Sequence: Synthetic coding sequence
atggccgtgttccgctccgggctgttggtactcacaactcccctcgcatccctagcaccccggctggctagcattctaacctcagccgcgcgacttgttaaccatacactgtacgtgcacctgcagccgggaatgtctctggaaggtccagcgcaaccccagtcctctcccgtacaggcgacgttcgaggtcctggactttatcacccatctgtcgccaagtcccgcccatctctcccccgagtcgaggcctccagcccgtagtagggtagaccggttccccgacccaggatggaagcctgtgcagcctggacaaaccgcagcatctgctctgcggcaccaactcctgcaactgctttcagctactggactcggggccgctattctcagactgtgggatcgcagatcggcaagaggcgctcctggctgccccctgactctgcatgatcaggcaagcttcccccgggggcgagtaagtaaagctgcaggagcatggctcctcccctggagatgccgatggcatgtctag

SEQ ID NO: 112497 - DNA, 810 bp, Artificial Sequence
  Description of Artificial Sequence: Synthetic coding sequence
atggcaattaaccgctttcgtctcgagaacgatttggaagagctggcattgtatcagattcagttactcaaagacctgcggcacaccgagaacgaggaggataaggtcagctcttccagctttcggcaacggatgcttgggaatctgctgcgacctccctacgaacggccagaactgcctacctgtctgtatgtgatcgggctcaccgggatcagcggcagcggaaagagttccatagctcagcgcctcaaaggcctcggtgctttcgtcatcgactccgatcaccttgggcacagggcctacgcccctggagggcctgcgtatcagccggtggttgaagctttcgggacggatatcctgcacaaggatggtataattaatcgtaaggtgctgggcagtagagtattcggcaataagaaacaattaaagatcttgaccgacatcatgtggccaatcatcgctaagttggcacgcgaagagatggaccgtgctgtagccgaaggtaagcgcgtttgtgtcatagacgctgccgtgttactcgaagccggatggcagaacctggtgcacgaggtgtggacggcggtgatccccgagaccgaggcagtgcgcagaattgttgaacgtgatgggttgagcgaagcggccgcacaaagtagattacagagccaaatgtccggccagcaactcgtggagcagtcccacgtcgtgctgtctacgctgtgggagcctcatatcacgcagaggcaggtggaaaaggcttgggctttgctgcaaaagcgaatcccaaaaacccaccaggcccttgattag

SEQ ID NO: 112498 - DNA, 1782 bp, Artificial Sequence
  Description of Artificial Sequence: Synthetic coding sequence
atgcggacccctcgcttgcgcgcacaaccacggggcgcagtgtatcaagcaccatcacctcctcccgccccagtgggactgggcagtatggccgtcttccgctccggcttgcttgtgctgaccaccccacttgccagcctggcccctcgcctggcgagcatcctgacgagcgcggccagactggtcaatcatacactctatgtgcacttgcagcccggcatgagcctggagggacccgcacaaccacagtcctctcccgttcaggctaccttcgaagtgctggattttataactcatctgtatgcgggagcggatgtccataggcatctagacgtgcgtatcctactgacaaatatccgcactaagtcaactttcctaccacccctgcctacctcagtgcagaacctcgctcatccgcccgaagttgtgctgaccgactttcagaccctagacggctcccagtacaaccctgttaaacagcagctggtgaggtacgcaacaagctgctatagttgttgtcctaggctcgcgtcggtgctgctctactcagattacggcattggagaggtgcctgtggaaccgctggacgtcccactcccctcaaccatccgcccggctagccccgtggcaggctctccaaaacagcctgtccgcggatattaccggggcgccgtcggggggaccttcgataggctgcataatgcccacaaagtgcttctcagcgttgcatgtatattagcccaggaacaactcgtcgtcggggtggccgataaggacctccttaaatccaagttgcttccggagctgctccaaccctacacagagagggttgaacatctctccgagtttctcgtggacattaaaccgagcttgacttttgatgtcataccgctcctggatccttacggaccggctggatccgatccaagcctcgagtttcttgtggtgtccgaagagacctacagggggggaatggctataaatcggttccgattggaaaacgacctggaggagcttgcattataccagattcagcttcttaaggacctcagacacacagagaacgaggaagacaaagtgtccagctcctcatttcgacagcggatgctgggaaacctgttgcgtccgccgtacgaacgtccagagctaccaacttgcctctacgtcatagggctcaccgggatcagcggatccgggaagagttctattgcccagagactgaagggtcttggcgcatttgtgatcgactctgaccatctcggacaccgtgcgtatgccccggggggccctgcatatcagcctgtggtcgaggcttttggaacagatatcttgcacaaggacgggataataaatagaaaggtgctcggctccagagtgttcggtaacaagaaacagctcaaaattctgacagatattatgtggcccatcattgccaaactggcccgcgaagagatggaccgcgcggtggcagaggggaagcgagtgtgtgttattgacgccgcagtgctcctagaggccggttggcagaacctggtccacgaggtgtggactgccgtgattccagaaactgaagccgtccgccgcatcgtggagagagatggtctgagcgaagctgccgcgcaaagccggctgcagtcccaaatgagtggacagcagctggtggaacaatcacatgtcgttttatccacgctgtgggagccccacataacacaacgtcaggtcgagaaggcatgggccctgcttcaaaaaagaatacccaaaacgcatcaggctctggactag

SEQ ID NO: 112499 - DNA, 429 bp, Artificial Sequence
  Description of Artificial Sequence: Synthetic coding sequence
atggctactaagattgacaaggaagcatgtcgagccgcgtacaatctggtaagggacgacggaagcgccgttatctgggtcaccttcaaatacgacggctcaactattgtccctggggagcagggcgctgagtaccaacactttatccagcagtgcacggatgacgtgcggctgttcgcttttgtgaggttcacgacaggggacgccatgtccaaacgttctaagttcgctttgatcacgtggattggtgagaatgtatctggactccagcgagccaaaaccggcacagataagactttagtcaaggaggtagtgcaaaactttgccaaggaatttgtgatctccgacaggaaggagttggaggaggatttcatcaaatctgagctgaagaaggctggcggggccaactacgatgcgcagaccgagtag

SEQ ID NO: 112500 - DNA, 1731 bp, Artificial Sequence
  Description of Artificial Sequence: Synthetic coding sequence
atgaggggccctaactccggcacagaaaaaggccggctagtgatacctgagaaacagggattcgacttcctctgcatgcccgtgtttcaccctagattcaagcgtgaattcatccaggagccggccaagaatcggcctggaccgcaaacgcggtcagatcttctgctctctgggcgcgccttcctgctgcctctgaatcaggaagacaataccaacctcgcgcgagtgcttactaatcacatccatactggtcaccattcctccatgttttggatgagagtcccattagtggcccccgaagacttgcgagacgacatcatagagaatgctccaaccacccacactgaggaatattccggcgaggaaaagacctggatgtggtggcacaacttcagaaccctgtgcgattatagcaaacgcattgcagtagcactggaaatcggcgcggatctaccatccaatcacgtaatcgaccggtggctgggggagcccatcaaggctgccatcttaccgacatcaatattcctcaccaataaaaaaggcttccctgtgttgagtaaaatgcaccagcgactgatctttcgcctgctcaaactggaggttcaattcattataacaggcactaatcatcactccgaaaaggagttctgcagctatttgcagtatctggagtacctctcccagaacagacctccacccaacgcctatgagctgttcgccaaaggctatgaagactatctacagtccccacttcagcctctaatggacaatctcgaaagccagacttatgaagtttttgaaaaagatcccattaagtattctcagtaccagcaggcaatttacaagtgtctcctggatagggtcccggaggaggagaaggacacgaacgttcaggtcctaatggtgctcggagctggacggggtccgctcgtcaacgcctctttgcgggcagccaaacaggcagacagacggatcaaactctacgccgtggagaaaaatcctaacgctgttgtgacgttggaaaactggcagtttgaagaatgggggagtcaggttacagtcgtcagcagcgatatgcgggagtgggtggcgccggaaaaggccgacattattgtctcagagttactggggagcttcgccgataacgaactgagccctgagtgtcttgatggcgcccaacatttcctcaaggacgatggcgtgagcattccaggagaatatacttcgtttttagcccccatatcgtcctccaagctctacaacgaagtgagggcgtgtagagaaaaggaccgggaccccgaggcccaatttgagatgccctacgtggtcaggttacataacttccatcaactatctgccccacagccttgcttcactttttctcacccaaacagagatcccatgatagacaacaacagatactgcactctagaatttcccgtcgaggttaatactgtcctccatggcttcgccggctattttgagactgttctgtatcaggacatcacgttgagcataaggccggagacacactcccctggtatgttctcttggttccccatcctattccccattaagcagcctattacagtccgcgaaggacagactatttgcgtgaggttctggcggtgtagcaattcaaagaaggtgtggtatgagtgggcggtgacagcgccagtctgctctgcgattcataacccaactggcaggtcatataccatcggcctgtag

SEQ ID NO: 112501 - DNA, 1206 bp, Artificial Sequence
  Description of Artificial Sequence: Synthetic coding sequence
atgctgggcatcggtacagagggacctcacgtcgggcttgtgcaggcctccgagcacccaaagatcgaattttacttgaaaaatttcaccagtgcgaaggacgtgctgtttgccattaaggaagtcggattccggggtggcaattcaaataccgatatcaccctagagaagtacctcttcgtgatgctgaaacgttctgagaaccaacagacttatctcatgaacgccgacgtagccgagcggatgagctcgaccacagttgattctgaggagcgtctgctacggggtaaggccctcaagcacaccgcccagaagttctttacagtggatgccggcgtacgaaagggaatacctaaagtggtggtggtgttcatcgatggatggccatcggacgatatcgaggaagcaggcattgtggctcgagaattcggcgtgaatgtgttcattgtgtccgtggcaaaacctatccccgaggagttgggcatggtgcaggacgtgacatttgtggataaagccgtgtgtaggaacaacggcttcttctcgtaccatatgccaaattggtttggaactactaaatatgttaaacctttggtacaaaaactgtgtacacatgaacagatgatgtgtagtaagacctgctacaattctgtaaatatcgcctttttgatcgacggcagtagttctgtgggagactccaacttcagactgatgctagagttcgtaagtaatattgcaaagacctttgagatctctgatattggggctaagattgctgcagtgcagtttacatatgaccagaggacggaatttagtttcacagattattccactaaggagaacgtactcgccgtgataaggaacatccgctacatgagcggggggacggctacaggggatgcgatatcttttaccgtgaggaacgttttcggtcctatcagggagtccccaaataaaaacttcttggtgatagtcactgacggacagtcatatgatgacgtccagggacccgctgcagctgctcatgacgccggcatcacgatctttagcgtgggagtggcatgggcgccactcgatgatctgaaggatatggccagcaagcccaaggaatcccacgcatttttcaccagagagtttaccggactggagcccatcgtgtctgacgtgattcgaggcatttgccgggactttttggagtcccagcagtag

SEQ ID NO: 112502 - DNA, 1653 bp, Artificial Sequence
  Description of Artificial Sequence: Synthetic coding sequence
atgagtgccgcatggattcccgcacttggtctgggagtctgtctgctgctgcttccaggcccagcggggtccgagggcgccgcccccatcgccataacctgtttcacaagaggcctggatatcaggaaggagaaagctgacgtcctctgtccaggggggtgtcctctagaggaattctcagtctatgggaacatcgtgtatgcctccgtgtctagtatttgtggtgcagcggtccatcggggcgtgatctccaattctggtgggcctgtcagagtttacagtcttcccggcagagagaactacagtagcgtggatgcaaatggcatccaatcgcagatgctctcacgttggtccgcttcttttacggtgacgaagggaaagtcgtcgacacaagaggccactggtcaggctgtgagcacagcccacccacccacaggcaagaggctgaaaaaaacgcctgaaaagaagacagggaataaggattgtaaagctgatattgctttcctgattgatgggtccttcaatatcggccagcggagattcaatctgcagaaaaacttcgtcggcaaagtggcccttatgctgggcataggaacagaaggtccgcatgtgggtctcgtgcaggcatctgaacacccgaaaatcgagttctacttaaaaaactttactagtgcgaaagatgtcctgttcgctatcaaagaggtgggattccgcggtggaaactcaaacactgggaaagccctaaagcacactgcccaaaagttcttcaccgtggatgccggcgtgcgcaaaggaattccaaaagtggtggtcgtatttatcgatggctggccctctgacgatatagaagaagcgggcatcgtggcgcgggaatttggggttaatgttttcatagtctctgtagcaaagcccattcctgaggagctcgggatggtccaagatgtgacctttgtggacaaagctgtttgtcgtaataatggtttcttcagttaccatatgcctaattggttcggcaccaccaaatacgtgaagcccctcgtgcagaagctttgtacccacgagcagatgatgtgtagcaagacttgctataacagtgttaatatagccttcctcattgacggctcctcgagtgtgggggactctaactttcgactgatgctcgagttcgtgtccaacatagccaagacatttgaaatcagcgatataggagccaaaatcgcagccgtgcagtttacctatgaccagagaacagaattttcttttaccgactactccacgaaggaaaacgtgcttgccgtaatacgcaacatccggtacatgagtggaggcactgcaaccggcgacgctattagctttacggtcaggaatgtgttcggacctattcgggagtctccgaataaaaactttcttgtgatagtgactgacggtcaaagctatgatgatgtccagggcccagctgccgcagcccacgatgctggaataaccattttttccgtcggcgtggcctgggcccccttggatgatttgaaagacatggcatctaaaccaaaggagagccatgcattctttacaagggaattcacagggctggaaccgatagtatctgacgtgattcgcgggatatgccgcgacttcctcgaaagccagcagtag

SEQ ID NO: 112503 - DNA, 732 bp, Artificial Sequence
  Description of Artificial Sequence: Synthetic coding sequence
atgctgtctcgttggtcagcatctttcacagttaccaagggcaagagctctacacaggaggccacgggccaggcggtttcaaccgcgcacccacctacagggaaaagactgaagaaaacaccggagaaaaagactgggaacaaggattgtaaggccgacatcgccttcctgatcgatggttcctttaacatcggccaaagaaggttcaatctgcagaaaaacttcgtgggtaaagtcgccctgatgctcggaatcggaactgaagggccccacgtcggtctggttcaggcatctgaacacccaaaaatcgagttttacctgaaaaactttacatcagccaaggatgtactgttcgcaattaaggaggtcggttttcgggggggtaatagtaatactggcaaggcccttaagcacaccgcccagaaatttttcaccgtcgatgccggcgtcaggaaggggattcctaaagtggttgtagtgtttattgacgggtggccgagtgacgacatagaggaagcaggtattgtcgcgagggagtttggtgtcaacgtgttcatcgtctcagtagccaaacctatccctgaagaactcgggatggttcaagatgtcacctttgtggacaaagcggtttgcagaaacaatggattttttagctaccatatgccaaactggtttggcaccacgaagtacgtctcactgtggtaccgctcctgtgctctgatgaacaagtag

SEQ ID NO: 112504 - DNA, 1278 bp, Artificial Sequence
  Description of Artificial Sequence: Synthetic coding sequence
atgggtcccaggagactcctcctggtcgcagcttgttttagtctgtgcgggccgttactgagtgcccgaacacgtgcccgtaggcctgagagtaaggccaccaatgccacgcttgatcccaggagctttcttttgagaaatcctaatgacaaatatgagcccttctgggaggatgaagaaaaaaatgagtcgggcctgactgaatacagactagtaagcattaataaatcctcacccttgcagaaacagcttccagcattcatttccgaggatgcttcgggatacctgacaagttcttggttgaccctgttcgtcccaagcgtgtacacaggcgttttcgttgttagtctccccctgaacattatggcgatcgtggtgtttatacttaagatgaaggtgaagaaacccgccgtcgtctacatgttgcatttggccacagccgatgtgctctttgtcagtgtgcttccctttaagatcagttattatttttccgggtctgactggcagtttggcagtgagctctgccgcttcgtcactgcagcattttactgtaacatgtatgcctcgatactgctgatgaccgttatatccattgatcggttccttgcagtggtttaccccatgcagagtctgtcctggcgcactctcggacgcgccagctttacatgcctcgctatctgggcactggctattgcaggagtggtcccattgttgctaaaggagcagaccatccaggtgcccggcctaaacatcacaacgtgtcacgatgtgctgaatgagactctgcttgagggttactatgcttattatttttctgcctttagcgctgtttttttttttgtcccccttatcattagcaccgtgtgttacgtctctatcatccggtgtctttcctcttccgcagtcgcgaacaggtctaaaaaatccagagccctgtttctcagcgccgctgtgttttgcatctttatcatttgttttggtcccactaacgtcttactaattgcgcattattccttcctgagccacacctccaccaccgaggcggcttatttcgcttatctcctatgcgtttgtgtctcttcaatatcttgctgcatagatccgctgatctactactatgccagttcggagtgccagcggtacgtgtattctatcttatgctgcaaagagagttcagatccttcttcttacaattctagcggacaacttatggcatctaaaatggatacatgctcctctaacctgaacaatagcatctataaaaagctgctgacatag

SEQ ID NO: 112505 - DNA, 1194 bp, Artificial Sequence
  Description of Artificial Sequence: Synthetic coding sequence
atgaggtctccatcagccgcttggcttttgggcgccgccatattgctggccgccagcttatcttgttccggtaccatccagggtacatcccgctcctccaagggcagatcgctcatcggaaaggtggacggcacatcgcatgtgacaggtaagggggtgaccgttgaaactgtgttctccgttgatgagtttagtgcaagcgtcttaacagggaaactcaccactgtgtttctacccatcgtctacaccatcgtctttgtggtcgggctgccgtcaaacggcatggccctctgggttttcctatttagaacaaagaaaaaacatccagcggtgatctacatggccaaccttgctttggcagacctcctctctgtgatttggttccccctgaaaatcgcttaccatatacacggtaacaactggatttatggcgaggccctctgcaacgtactaatcggctttttctacggtaacatgtattgctccattcttttcatgacttgcttatctgtccagagatactgggtgattgtaaatccaatggggcactcccggaaaaaagcaaacatcgctatcgggattagccttgcgatctggctgctgattctgttagtcactatcccactgtacgtggtcaagcaaactatctttattccagccctgaatataactacatgtcacgatgtcctacccgagcagcttttggtgggggacatgttcaactacttcttatctctcgctatcggggtgttcctatttccggcgttcttgacggcctctgcctacgttctgatgataagaatgctacgctctagtgctatggacgagaactctgaaaagaagagaaaaagggccatcaagttgatcgtcactgtgctcgcaatgtacctcatctgttttactccgtccaaccttctcttggtggtgcattactttttgatcaagtctcagggacagagccacgtgtatgcgctgtatatcgtagctctctgtttgagtaccctgaatagctgtatcgacccatttgtctactacttcgtgtcacatgacttccgcgaccatgcaaaaaacgccctgctctgccggtccgtgcgtaccgttaagcagatgcaggttagccttacatctaagaagcacagccgtaagagctcatcctatagctcatccagcactacggtaaagacatcatactag

SEQ ID NO: 112506 - DNA, 1125 bp, Artificial Sequence
  Description of Artificial Sequence: Synthetic coding sequence
atgaaagcccttatctttgctgccgcaggcttattgttgctcctgcccaccttctgccaaagtggcatggagaacgatacgaacaatttggccaaaccaaccctcccgatcaagacctttcgcggggctccgcccaacagtttcgaagaattccccttcagcgcccttgaggggtggactggtgccacaattactgtaaaaatcaaatgtcctgaggagtcggcctcccatttacacgtcaaaaatgcgacaatggggtatctcacatccagtctaagcaccaagctgataccagccatttatctgcttgtgttcgttgttggagtccctgccaatgccgtcacactgtggatgctgttctttcgcacaagaagcatctgtacaactgtattctacactaacctggccatcgccgacttcctgttctgtgtcaccctgcccttcaagatcgcctatcatctcaatgggaataactgggtgtttggagaagtcctgtgccgtgcgactacagtcatcttttacggaaatatgtactgtagtattttgctgcttgcttgcattagtattaatcggtatctcgcaattgtgcacccttttacttatagagggctccccaagcacacatacgcacttgtgacctgtggactcgtatgggcgaccgtgttcttgtacatgttaccgttttttatcctcaaacaggagtactatctggttcagccagatattacaacttgtcatgatgtgcataacacctgtgagtctagcagccccttccagctgtattacttcattagtctcgccttctttgggttcctgattccgttcgtgttaattatctattgctatgctgcaattattaggactctgaatgcatacgaccaccggtggctgtggtatgtgaaggctagtctactcatactggtgatctttacgatttgttttgccccctcgaatatcatactgatcattcatcacgctaactactattataataatacagatggattatatttcatttatctcattgccctttgtctgggatcactgaatagttgccttgaccctttcctgtacttcttaatgagcaaaactaggaatcacagcaccgcttacctcaccaagtag

SEQ ID NO: 112507 - DNA, 1059 bp, Artificial Sequence
  Description of Artificial Sequence: Synthetic coding sequence
atggaaaatgataccaataacctggcaaaaccaacgctacccatcaagactttccggggtgccccgcccaacagctttgaggagttcccctttagtgccttggagggttggacaggcgccactatcaccgtgaagataaagtgcccagaagagagtgcatctcatctacatgtaaaaaatgcaaccatgggatacctgactagttccttgtctaccaagcttatcccagcaatataccttctagtcttcgtcgttggtgtgccagccaatgctgtaaccctttggatgttgttctttcgtacacggtccatttgtactaccgtcttttatactaacctggcgatagctgacttcctcttctgcgttactctaccctttaaaattgcttaccacctcaatgggaacaattgggtgtttggggaagtcctgtgcagggctaccaccgtgatattttacgggaacatgtattgttcaatcctattgcttgcatgcataagtataaataggtatcttgcaatagtgcaccctttcacttacagaggcctcccgaagcatacttacgctctggtgacttgtgggcttgtgtgggctacagttttcctctacatgttgccctttttcatattgaagcaggagtactatcttgtccagccagacatcacgacctgtcatgacgtccacaatacctgtgaatcctcttctccgttccagctttattattttatctctctggccttcttcggctttttgatacctttcgtgctcatcatctattgctatgccgctattattcgcaccctcaacgcctatgaccatcgctggctctggtacgtgaaggcctcgctgcttattctcgtaatatttaccatctgcttcgcaccatcgaacatcatcttgatcattcatcacgcgaattactactacaataatactgatggtctgtacttcatatatttgattgcactgtgccttggctccctcaattcatgtttggatccttttctgtactttctgatgtctaagactcgcaaccattctacagcctatttgaccaagtag

SEQ ID NO: 112508 - DNA, 1158 bp, Artificial Sequence
  Description of Artificial Sequence: Synthetic coding sequence
atgtggggacggttactgctgtggcctctggtgctggggttctctctttcgggaggcacacagacaccgagcgtgtacgacgagtctggcagcacgggagggggggatgatagtacaccatcgattctacccgcgccccgcgggtaccccgggcaagtttgcgctaacgactctgatacactggagcttcctgattcctccagagccctgcttcttggctgggttccaacaagactggttcccgccttatacggtctcgtcctggtggtgggacttccagctaacggtctggccttgtgggtgttggctactcaggcccctcgcctgccttcaacaatgctgctcatgaatcttgccgcagcagacctgctgttggcattggccttgcctcccagaattgcataccatctcaggggacagcgatggccgttcggcgaggcagcctgcagactggcaacagcagctctgtatggccacatgtacggcagcgtgctgctgcttgcagctgtgagtcttgatcggtacctggccctcgtccatcctttgagagcacgggcacttagaggacgacggcttgccctgggcctctgcatggctgcgtggctcatggctgccgcgctcgccctcccactgacacttcaacgccagacctttcgtctcgctagatccgatcgggtcctctgtcacgacgctctcccactggatgcacaagcatcccactggcagccagccttcacctgccttgccctgctgggctgcttcctgcctctgttggcaatgcttctgtgttatggggcaacgttacataccctcgctgctagcggtagaagatatggccatgctctccgcctgactgccgttgttctggccagcgctgtcgcctttttcgtcccttccaatctccttttgcttcttcactattccgatcctagtccctctgcttggggcaatctgtatggggcctacgttccttccctagcactaagcaccctaaactcctgtgtagatcctttcatttactattacgtgtccgccgagtttcgtgataaggtccgcgcgggattgttccagcgctcgcccggggacacagtcgccagcaaggcctctgctgaaggtgggtctcgcgggatgggcacgcactcctccctgctgcagtag

SEQ ID NO: 112509 - DNA, 1848 bp, Artificial Sequence
  Description of Artificial Sequence: Synthetic coding sequence
atgcgggccttattactgttgggcttccttctcgtgagcctcgagtccactctctcaatacccccttgggaagcccctaaggaacacaaatacaaggcagaagagcacaccgtcgtgctgacagtcacaggcgagccatgtcattttcccttccagtaccacagacagttataccataaatgtacacataaggggcgcccagggccacagccctggtgtgcgacaaccccaaatttcgatcaggaccaacggtggggctactgtctggaaccaaagaaagttaaggaccattgcagtaagcatagtccttgtcaaaagggtgggacttgcgtaaacatgccatccggaccacactgtttgtgccctcaacatctgactggcaaccactgccagaaggagaagtgcttcgaaccacagctcttgaggttctttcataaaaatgagatctggtacaggaccgaacaggccgccgtggcaaggtgtcagtgtaagggaccagatgcccactgtcaacgactggcaagccaagcatgccgtactaacccgtgcctgcatggggggcgttgcttggaagtggaaggccataggttatgtcattgtccagtgggctacactggggccttctgtgacgtggacactaaagcgtcttgctatgatggtaggggtctgtcttacaggggactggcaagaacgaccctctcgggcgctccatgtcagccctgggcctctgaggccacctatagaaatgtaacagccgagcaggccagaaattgggggttgggtggacatgctttctgccggaacccagacaacgatatccggccctggtgcttcgtgctaaatcgggaccgactgtcatgggagtactgtgatctggcacaatgccagacaccaacacaagcggcgccccctacccctgtaagtccacggttacatgttccattaatgccggcacaacctgctccccccaagccccaaccaaccacacgcacccctcctcagagtcaaaccccgggtgctttgcccgcaaagcgggagcagccaccctccttgactcgcaatggtccgctgtcttgtggacaaaggctcaggaagtcacttagtagcatgacaagagttgtaggagggctcgttgccctgagaggcgcgcacccatatatcgcagctctctactggggtcactccttctgcgccgggagtctcatcgccccatgctgggttctgactgcggcacactgtctccaggatcgaccagcaccggaggacctgaccgtggttctgggacaggagcgaaggaatcactcatgcgaaccatgccagaccttggccgttcgctcttaccgcctccacgaggcgttttcgccagtgagctaccagcatgacctggccttactgcggctgcaggaagacgccgacggcagttgcgctctgctgagcccatacgtccaacctgtatgcttgccctcaggggctgcccgtccgagtgagacaacattgtgtcaggttgccggctgggggcatcagttcgagggtgcggaagaatacgcctcattccttcaggaggcgcaggttccattcctctcactggagcgatgcagtgcccctgatgtgcacggatctagcattctgcccggcatgctgtgcgctggctttctggaaggaggaacggatgcctgccagggcgactcaggtggacccctagtgtgcgaagaccaagcagcagagcgtcggctgacactccagggaatcatttcttggggaagcggttgcggcgaccgcaacaagccaggagtgtacaccgacgtggcttactatctggcatggatccgcgagcacacggtgtcttag

SEQ ID NO: 112510 - DNA, 1986 bp, Artificial Sequence
  Description of Artificial Sequence: Synthetic coding sequence
atgcgccttaaaaacctcaccttcatcataatcctgataatctctggcgagctgtacgccgaagagaaaccatgcggttttccccacgtcgaaaatggccgcattgcacagtattattatacttttaagtcattctactttcccatgtccatagataagaaattatctttcttttgtttggccgggtataccacggagagcggtcggcaggaggaacagacaacatgtacaaccgagggttggagcccagaaccgagatgttttaagaaatgcacaaagccggacctatctaatggctacatttccgacgtcaagttgctttataagattcaggagaatatgcggtatggttgcgcctccggttataagacaacaggcggcaaggatgaggaggtggtccagtgcctttctgatgggtggagttcgcagccaacatgccgcaaagagcatgaaacctgcctcgcacctgagctctataatggcaactattcaaccacacaaaagaccttcaaggttaaagataaagtgcaatatgaatgcgctactggctactacaccgctggtggaaagaaaacagaggaagtcgaatgcctgacttacggttggagcctgacacccaaatgtaccaagttgaaatgctccagcctcaggctgatcgagaacggatatttccacccagtgaagcaaacatacgaagagggagacgttgtgcagttcttttgtcatgaaaattattacttgagtggttcagatcttattcagtgttataattttggctggtacccggaatctcccgtatgtgaaggacgcagaaaccgctgccctcccccgcccctacctattaactcaaagatacagactcattccacaacctatagacacggcgagattgtgcacatcgagtgcgaactgaattttgagattcatgggtctgccgaaatccgatgtgaggacgggaagtggactgagccgcccaagtgcattgagggccaggaaaaggtggcctgcgaggaaccgcctttcatagaaaacggcgcagcaaacctgcactccaagatatactacaatggagataaagtgacctacgcttgtaaaagcggctatcttttgcacggcagtaacgagatcacctgcaatcgggggaagtggacattaccccccgaatgtgtggagaacaatgagaattgcaaacatccccctgttgtcatgaatggcgccgtggccgatggaatcctggcctcttacgcgactgggagcagcgtggagtatagatgtaacgagtactatctgcttcggggatctaaaatcagcagatgcgaacagggaaaatggtcgtccccccctgtgtgtctggagccatgtaccgtgaacgtcgactacatgaatcgcaataacattgagatgaagtggaagtacgagggtaaagttctgcacggtgatctgatcgacttcgtgtgcaagcaaggatacgacctctccccactaaccccactctctgaactcagcgtgcagtgtaatcggggcgaggtcaagtaccctctctgcacccgcaaagagagtaaagggatgtgtacttccccccccctgatcaagcatggagtgattatcagttccaccgtggatacatacgagaatgggagctcagtagagtaccgctgttttgaccaccactttctagaagggagcagagaggcatactgcttagatggtatgtggactactcctcctctatgtttggagccttgcactttatcattcactgagatggaaaagaacaacctgcttctcaagtgggacttcgacaacaggccccatatactgcatggagagtatatcgagttcatttgccggggagatacttatcccgcagagctctatattaccggttcaatcctgaggatgcagtgcgatcgtggtcagttgaaatatccaagatgcattccaaggcagagtacgctgtcctatcaagagccactacgcacgtag

SEQ ID NO: 112511 - DNA, 3675 bp, Artificial Sequence
  Description of Artificial Sequence: Synthetic coding sequence
atgttgaccaagtttgagacaaaatccgcacgggtgaaaggcttgtctttccacccaaagcgtccatggattctcacctcgctgcacaacggagtgattcaactgtgggactaccgcatgtgtaccctcatcgacaagttcgatgagcacgacgggcctgtcaggggcatcgattttcacaaacagcagccacttttcgtttctggaggtgatgattacaaaattaaagtgtggaactataaactgcgacggtgtcttttcaccttgcttggccatctggattacatccgcacaacattttttcatcacgaatatccctggatcttgagtgcatccgatgaccagactatacgcgtatggaattggcagagccgtacctgtgtgtgcgtgctgacaggacataatcactacgtcatgtgcgctcagtttcatcccacagaagacctggtagtatcagctagcctcgaccagacagtgcgtgtgtgggacattagcgggctacgcaagaagaatctctcacccggagccgtcgaatcagatgtgcggggcatcacaggggttgatctctttgggactactgacgctgttgtgaagcatgtgttagaggggcatgaccggggagtaaattgggccgcctttcaccccaccatgccccttatagtaagcggggcagatgaccgtcaggtgaagatctggagaatgaacgaaagtaaggcgtgggaggtggacacctgtagagggcattataataacgtgtcttgcgcagtgtttcatccccgtcaggaactgattctctccaacagcgaggacaagagcattcgggtttgggacatgtccaaacggactggcgtgcagaccttcagacgcgatcatgatcgattttgggtgttggccgcccatccaaatctgaatctatttgcagctggacatgatggagggatgattgtctttaagcttgaacgagagcggccggcctatgccgttcacggtaatatgctgcactacgtgaaggaccggttcttaagacaactggacttcaatagcagcaaggacgtggctgtgatgcaattgagatcagggtccaaatttcccgtctttaacatgtcttacaaccccgcagaaaatgccgtcttgttgtgtactcgggcaagcaatctggagaactctacatatgacttgtacacaatcccaaaggatgcggattctcagaaccctgacgcacctgagggtaaaaggtctagtggcttgacggccgtgtgggtcgctagaaatcgctttgctgtgttggacagaatgcactccctgctcataaagaacctaaagaacgagattactaaaaaggttcaggtacccaattgcgacgagattttttatgccgggactggcaaccttctgctgagggatgctgactccattacacttttcgacgttcaacagaagagaactctcgctagcgtgaagatttctaaggttaagtacgtgatctggagtgccgacatgtctcatgtcgccctgctcgccaagcacgcgattgtgatttgcaataggaagcttgatgctctgtgcaacatacacgaaaatattcgagtaaaaagtggcgcctgggacgagtctggggtgtttatctataccacttcgaatcatattaagtatgctgtgacaacaggtgatcacggcatcatacgaacactcgaccttcccatctacgttacgagagtcaaaggcaacaacgtgtactgcctcgaccgagaatgtagaccaagagtactgaccattgatcccacagagtttaagttcaagctggccctcattaatcgcaagtatgacgaggtactacacatggtgaggaatgccaagcttgtgggtcagtccataatagcatatcttcagaagaaaggctaccctgaggtagcactccacttcgtgaaggatgaaaagacccggttttccttggctctagagtgcggaaacatcgaaattgcccttgaagccgccaaagcactagatgacaagaactgttgggaaaagctcggcgaggtggcactgttacagggcaaccaccagatcgtggaaatgtgctaccaaagaaccaagaatttcgacaagctgagctttctctatttaataactggcaacctcgagaaactccgcaaaatgatgaagatcgctgagatcagaaaggacatgtccggccattatcagaatgcactgtaccttggcgatgttagcgaacgcgtgcgcatcctgaagaattgtgggcaaaagagcctggcttacctgaccgctgccacacacggtctggacgaagaggctgaaagcttgaaggagacctttgacccagagaaggaaacgatccccgacatcgatccgaacgcaaagctacttcagcccccagcccctatcatgcctctggataccaattggcccctgctcacggtaagcaagggattctttgaaggcacaatcgctagcaaaggtaaagggggggcgttagccgccgatatcgatattgacaccgtggggaccgagggctggggtgaagacgcggagttacagctggacgaggatggcttcgtggaagcgaccgagggtctcggcgatgatgccttgggcaagggtcaggaagagggtggcggttgggacgtggaggaagatctggaacttccacctgaactcgacattagtcccggcgctgcaggcggcgccgaggatgggttttttgtgcctccaacaaagggtaccagcccaactcagatttggtgcaacaactcgcaactcccagtcgatcacatcttggctggttcctttgagactgcaatgcgcctgctgcacgatcaagttggcgtcattcagtttgggccctacaaacagctgttcctgcagacatacgctcgggggagaacgacctaccaggccttaccatgcctgcccagcatgtacggctatccaaataggaattggaaagacgcagggctgaagaatggagtgcctgcagtggggctgaagcttaatgacctcattcaaaggctgcaactgtgttatcagcttactacggtggggaagtttgaagaagctgtggagaagttccggtctatccttttgtcagttcccttactcgtggtcgataataaacaagaaatagccgaagcccagcagctcatcactatttgtagggaatatatcgtgggcttgtctgtggagacagagagaaagaagctgcccaaagaaacactcgaacaacagaaacggatatgcgagatggcggcctactttactcactccaacctgcagcctgtgcatatgatattggtattaaggactgctctgaacctgtttttcaagttgaaaaattttaagaccgctgctacatttgcacgccgactgttagaactgggccccaagcccgaggtggcccagcagacccggaagatcctaagcgcctgtgagaagaaccctacagacgcctatcaactgaactacgatatgcacaacccatttgatatctgcgccgcttcctaccgccctatctatagaggtaagccggttgagaagtgtcctctgagcggggcttgttattctcctgaattcaaaggtcagatttgtcgggtgaccactgtaacagagatcggcaaggacgtaatcgggctgagaatcagccccttgcaatttaggtag

SEQ ID NO: 112512 - DNA, 3702 bp, Artificial Sequence
  Description of Artificial Sequence: Synthetic coding sequence
atgttaaccaaatttgagactaagtccgcccgcgtaaagggtctgtcgtttcatccaaagcgcccatggattctcacctccttacacaacggtgtcatacagttgtgggactatcggatgtgcaccctgatcgataagttcgacgaacatgatggccctgtgagaggcattgacttccacaagcagcagcccctgtttgtaagcggtggggacgactataaaatcaaagtctggaactacaagcttaggcgatgcctgttcaccttactgggtcacctcgattatatccggaccacctttttccatcacgaatacccctggatcctgtcagcctctgatgatcagacgatacgggtttggaattggcagagccgcacatgtgtatgtgtgctgaccggacataatcactacgtcatgtgtgctcagtttcatcctaccgaggacctagttgtgtcagcttcccttgaccagaccgttcgtgtgtgggatatttccggtttacggaagaaaaatttatctcccggggccgtggaatccgacgttcgcggcatcaccggggtggatcttttcggaacaacagatgccgtggtgaagcacgtgttggaagggcacgatagaggcgtcaattgggctgccttccaccctacgatgccactcatcgtgagtggcgcagacgatcggcaggtgaaaatatggagaatgaacgagagcaaggcttgggaagtggatacttgccgtggacactataacaatgtctcctgtgccgtctttcaccccaggcaggaattgattctgagcaactctgaggataaatctattagagtgtgggatatgtctaagcggactggggtccagaccttccgacgggaccatgacaggttttgggtgctggccgcacaccctaatttgaacctcttcgcagcaggtcacgatggcgggatgattgtctttaaactagaacgggagcggccagcatacgccgtccacggcaacatgctccactacgtcaaagacagattcttgcgtcagctagacttcaatagctccaaggatgttgcggtgatgcagctgcggagcggctctaaattccccgttttcaacatgtcctataaccctgctgagaacgctgtactcctttgcacgcgggctagcaatctggaaaatagcacctacgatctgtacacaatcccaaaggacgcagatagccagaacccggacgcgccagagggaaagcgctcctccggactcacagcggtctgggtggccaggaaccggttcgcagtgctggacagaatgcacagcttgcttatcaagaatctgaagaacgaaatcactaagaaagttcaggtgcccaactgcgatgaaatcttctacgcaggcactggcaacctgcttctgcgggacgcggactcaatcactctgttcgacgtgcagcagaaacggacactagctagtgtgaaaatcagtaaggttaaatacgttatttggtctgcagatatgtcacacgtggccttgctcgccaaacacgaacatagctgccctctgccccttacggctattgtgatctgcaataggaagctggacgctctgtgcaacattcacgagaatattcgggtgaaaagtggagcgtgggacgagagcggcgtcttcatttataccactagtaaccatataaagtatgcagtgaccacaggggatcatggaatcataagaactctcgacctgccaatttatgtaactcgagttaagggcaacaacgtttattgcttagatagagaatgcagaccgagggtgctcacaattgacccaacagagtttaagtttaagctcgccctgatcaatcgcaagtacgatgaggtccttcatatggtgcggaatgcgaagttggtcggtcagtctatcatcgcctacttgcagaagaaaggctacccggaagtcgctcttcattttgttaaggacgaaaaaaccagattttcactggccctcgaatgtggaaacattgagattgccctggaggcagcgaaagccctcgacgataagaattgttgggagaaactgggtgaggtggccctcctgcaaggtaatcaccagatagttgaaatgtgttatcagcggaccaagaactttgacaagctctctttcctgtatttaattaccggaaatttggagaaactgagaaaaatgatgaaaattgccgagatccgcaaggatatgagcggacactaccagaacgcattgtacctcggcgatgtgtccgaaagagtgaggatcctgaaaaactgcggccagaaatctttagcttatttgacggcggcaacccatggcttagacgaagaagccgaaagtctcaaggagacgttcgaccccgaaaaagaaactatacccgacattgacccaaatgctaaactattgcagcctccagcccccattatgcctctcgacacgaattggccactcctaacggtctcaaaagggttcttcgagggcacaattgcctccaagggaaaaggcggcgccctggcagccgatattgatattgacaccgtgggcaccgagggctggggtgaagacgctgaactccagcttgacgaggacggattcgtagaagctactgaaggccttggagacgatgctctgggaaaaggtcaagaggagggaggcggctgggacgtggaagaagacttagaattgccacccgaactggacatttctcccggggccgccggaggcgccgaggacgggttttttgtcccccctaccaaaggaacctccccaacgcagatctggtgtaataatagtcagttgccagtcgaccacatcttggctggatcatttgagactgccatgcggttactgcatgatcaggtcggggtaattcaatttggtccctataagcagctgttcctgcagacatacgcccggggacgcaccacctaccaggccttgccatgcctgccgagcatgtatggatatccgaacagaaattggaaagatgctgggcttaagaacggagtgcccgccgtcgggttaaaacttaatgaccttattcagaggctacagctgtgctaccagctgaccacggtgggaaagtttgaagaagccgtggaaaaatttcgctctatattgttaagcgttcccctgttggtggttgataacaagcaggaaattgcagaggcccagcagcttataacaatctgtcgtgaatacatcgtgggcctgtctgttgagactgagcggaagaagctgcctaaggaaactctggagcagcagaagcggatttgcgaaatggcggcatactttacccactcaaacctccagcctgttcacatgatactcgttttgcggactgccctgaatctgttttttaagctgaaaaatttcaaaactgcagccaccttcgctcggcggctcctcgaactgggacccaagcccgaagtggctcagcagacccggaaaatactgagtgcctgtgaaaagaatccgaccgatgcataccagctgaactatgacatgcataatccctttgacatctgcgcagcctcctatcgacccatttacagaggaaagcctgttgagaagtgcccactgtccggggcctgttatagccctgagttcaaaggccagatctgtagggtcaccaccgtgactgagatcggtaaagatgtcattggcctacgcatctcaccactgcaatttcgatag

SEQ ID NO: 112513 - DNA, 2862 bp, Artificial Sequence
  Description of Artificial Sequence: Synthetic coding sequence
atgaccgcagcagaaaacgtctgctatacgttgataaatgtgccaatggactccgagccacctagtgagatctccctgaagaacgacttggaaaagggcgacgtcaagagtaaaaccgaagccctgaagaaggtgattattatgatattaaatggggagaaactgcccggcctcctcatgaccattatacgcttcgtcctcccattgcaggatcatacaatcaagaagctcctgctcgtcttttgggaaatagtaccaaagacaacccccgacggcagacttctgcacgagatgatcctggtttgcgatgcctatcgtaaagacctccaacacccaaacgaatttataagaggaagtactcttcgattcttgtgcaaacttaaggaggcagaactcctggagccccttatgccggccatacgcgcctgcctcgagcaccggcactcctatgtgagaaggaatgcagtccttgctatatacaccatctatagaaatttcgagcatctcatccctgacgcaccagagcttatccatgattttttggtcaacgaaaaagacgccagctgcaagcgcaacgctttcatgatgctgattcacgcagaccaggacagggccttagattatctgtccacttgcatagatcaggtccagactttcggggacatcctgcagctagtgatcgtcgagcttatctacaaagtatgtcacgcgaacccctctgaacgggcccgctttatccgatgcatatataatctcctccagagcagctctccggccgtgaagtacgaagcagcggggacattagtcacactgagctctgctcccaccgctattaaagcagcagctcagtgttacatagacctgatcattaaggagagcgataataacgttaaactcattgtactggatcgactgatagagttgaaggagcatcctgcccatgagcgagtgctgcaggatctggtgatggacattctgagagttctgagtactccggatttggaagtgagaaagaaaaccttgcagctcgctctagacctagtgagtagcagaaacgtggaagagctagttattgtcttgaaaaaggaagtcataaagacaaataacgtgtccgaacacgaagatactgataagtataggcagttgttggtccgtactctccactcatgttcagtccgctttccagacatggcagccaacgttatccccgtgctgatggagtttctgagtgataacaacgaggccgcagccgcagatgtgctggaattcgtgagggaggcaattcagagatttgacaatctcagaatgcttattgtggagaagatgctggaagtattccatgcaataaagagcgtcaagatctacaggggtgccctatggatccttggcgagtattgtagtaccaaagaagacatccagagtgtcatgactgagattcggcgatcacttggggaaattccgatcgtggaaagtgaaatcaagaaggaggcgggggagctcaaaccggaggaagagatcacagttggccccgtgcaaaaactcgtgaccgaaatgggcacctatgctactcagagtgctctcagctccagccgcccaaccaagaaagaggaggacagaccaccactcagaggattccttctggacggtgacttcttcgtggcggcctccctcgcgaccaccctgaccaagattgcactgcgctacgtcgccttggttcaagaaaaaaagaaacagaatagttttgttgcggaagccatgctcctgatggctacaatcctgcatctgggcaagtcatctctgccaaagaaaccaattacagacgacgatgtggacagaatcagtctgtgcttgaaggtactgtccgaatgctccccgctcatgaacgacattttcaacaaagagtgtaggcagtccctcagtcacatgcttagtgccaagttagaggaggaaaaactgtcacagaaaaaagaatctgagaaacgcaatgtgacagtacagcccgatgaccctatatcctttatgcagctgaccgccaagaacgagatgaattgtaaggaggatcaattccagctttctttactagctgcaatgggaaacactcagaggaaagaggccgcagaccctttggcaagcaagcttaacaaggtgacacaattaaccggattctcggaccccgtttatgccgaagcgtacgtgcacgtgaatcaatacgatatcgtcctcgatgttctggtcgtgaatcagacctcagacacattgcagaactgtactttggagcttgccacactgggggatctcaagctcgtggagaagccctctccgctgacactagcacctcatgacttcgcaaatattaaagccaatgtcaaggtggcaagcacggagaatggcataatatttggcaacatcgtgtacgatgtcagcggagcggcctccgacaggaattgcgtggtgctatccgacattcacattgacattatggactacattcaacccgccacgtgcactgatgccgaatttagacagatgtgggcggagttcgagtgggaaaacaaagtcacagttaacaccaacatggtcgacttaaacgattacctacagcacattttgaaatccacaaacatgaaatgtctcaccccagagaaagccctttctggttattgtggcttcatggcagcaaacctctatgcccggagcattttcggcgaagatgcattggctaacgtttccatcgagaaacccatccaccagggcccggatgctgcagttacagggcacatcagaatcagagcgaagagtcaggggatggcattgtcattgggtgataaaatcaatttatctcagaagaaaaccagcatttag

SEQ ID NO: 112514 - DNA, 2862 bp, Artificial Sequence
  Description of Artificial Sequence: Synthetic coding sequence
atgaccgcagccgagaatgtgtgctacacactaatcaacgtgcctatggatagcgagcctcccagtgagattagtctcaaaaacgatttagagaagggggatgtgaagtccaagaccgaagcccttaagaaagtgattataatgatactgaacggtgagaagcttcctggactcctcatgactatcatccggtttgttctcccacttcaggatcacacgattaagaaattgctgcttgtgttctgggagatcgtccccaagacgacacctgacgggaggcttcttcacgagatgatcctggtgtgcgatgcgtaccgtaaggacctgcagcaccccaacgagttcatcagaggatcaaccctccggtttctttgtaaactgaaggaggcggaactcctcgagcctctcatgccggctatccgcgcctgcctcgagcacagacactcctatgtccgccgcaacgcggtcctggctatttatacaatctatcggaactttgagcacttgattccggacgcccctgaactaatacatgattttctcgtaaacgagaaggatgcctcatgcaagcgcaatgcctttatgatgctgatccacgcggatcaggacagggctttagactatcttagtacctgtatcgaccaggtgcagactttcggggacatccttcaactggtgattgtcgaattaatctacaaggtgtgccatgctaacccgtctgagcgcgctcgatttattagatgcatttacaaccttctccaatctagcagccccgccgtgaaatacgaagccgcggggactctggtgaccctgtctagcgcccccaccgcgataaaagctgctgcccaatgctacatcgaccttatcatcaaagagtctgacaacaatgtgaaactgatcgtgttggacaggctcattgagctgaaggagcaccctgcccatgaacgcgtgcttcaggacctcgtcatggacattctgcgtgtactaagcacccctgaccttgaggtgaggaaaaaaacgctgcaattggccctggacttggtctcttcgcggaatgtggaggagctcgtaatcgtcctcaagaaggaagtgatcaagacgaataatgtatccgagcatgaagacaccgacaagtaccggcaactgctcgtgcgaacattacactcatgtagcgtgaggttccccgatatggcagcgaatgttattccagtattgatggagtttctctctgacaataacgaagccgcagcagctgacgttctggagtttgtcagagaggccattcagcgcttcgataaccttagaatgctgatcgtcgagaaaatgctggaagtgttccacgccatcaagagcgtgaagatttacagaggtgctttgtggatcctgggcgagtactgcagtacaaaggaggacatccagtctgtgatgacagaaatcagacggtctcttggagaaatccctattgttgagagcgagataaagaaggaggccggagaattgaaacctgaagaagaaatcaccgtgggccctgttcagaagttggtcacagagatggggacttacgcaacacagtcagcccttagcagctcacgcccaacgaaaaaggaagaggatcggcctccgttgcggggatttctcctggatggcgacttcttcgtggccgcttctctggctacaaccctcaccaaaattgcccttaggtacgtcgcattggtgcaggaaaaaaagaagcaaaacagcttcgtggccgaggctatgctgttgatggccacgatcctgcacttgggtaagagttccctgccaaagaagcccattaccgacgacgatgtcgatcggattagcctgtgcctcaaggtgcttagcgaatgctctcctctgatgaatgatattttcaacaaggagtgcagacagtccctcagccacatgctgtcagccaagctcgaggaggagaagctgtctcagaaaaaagagagtgagaaacgaaatgtgactgtgcagccagacgacccaattagcttcatgcagctcacagccaaaaatgaaatgaactgcaaagaagaccagttccagcttagcctgctggctgcaatgggtaacacccagcgtaaagaggccgcagaccctctcgcatcaaaactcaataaagtcactcagcttaccggattctctgatccagtttacgcagaagcctacgtccatgtcaaccagtatgatattgtgctggacgttctcgtggtcaatcagactagcgataccctccagaattgtacccttgagttggccacactgggcgatctcaagctggtggagaagccgagcccccttacgctggctccccatgacttcgcaaatatcaaagccaacgtcaaggttgcctcaaccgaaaatggaattattttcggcaatattgtctatgacgtgtctggtgccgcatccgacagaaattgcgtggttctctcagatattcacattgatataatggactatatccagcccgccacatgtactgatgcagaattcaggcagatgtgggccgagtttgaatgggagaacaaggttacggtgaataccaacatggtggatctgaatgactatctgcagcatattcttaaatcaaccaatatgaaatgcctcacccctgaaaaagctctcagcggttactgcggcttcatggcagcaaacctctatgcacgctcaatctttggcgaagacgcgctcgctaatgtcagcattgaaaagccaatccaccagggacctgacgccgccgtaactggacacatacggattagagccaagtctcaaggcatggctctgtctttgggcgacaaaatcaacctttctcagaaaaagacctctatctag

SEQ ID NO: 112515 - DNA, 2721 bp, Artificial Sequence
  Description of Artificial Sequence: Synthetic coding sequence
atgcccctcagactggacatcaaacgcaagctcacagcgcggtccgaccgtgttaaaagcgttgatctccatcccactgaaccttggatgctcgcttctctgtacaacggctcagtttgcgtgtggaaccatgaaacccagacattagtcaaaaccttcgaagtgtgcgacctgccagtacgtgcagctaagttcgtcgcacggaagaattgggtggttaccggagccgatgacatgcaaatccgggtgttcaactacaacacactcgagagagtgcatatgtttgaagcccactcagactatatccgctgcattgccgtgcaccctacacagccttttattctgacaagctcggacgatatgctgatcaaactctgggattgggacaaaaagtggagctgctcacaagtgttcgagggacatacgcactacgtgatgcagattgtgattaatccgaaggataacaatcagtttgcgtcagccagcctcgaccgtaccattaaagtgtggcaacttggatcatcttcccccaacttcacactggagggacacgaaaagggagtaaactgcatagactactattcaggcggcgacaagccctatttaatctctggagctgatgatcgactggttaagatttgggactatcagaataagacctgcgtgcagacgctggagggacatgctcagaatgtttcctgcgccagctttcacccagagctccccattataatcaccgggtccgaggatgggacagtgcggatatggcattcgtcgacctatagattggaatccaccctgaattacggtatggaacgagtgtggtgcgtggccagcctgcgaggttcaaataacgtggcactgggctatgatgaaggtagcattatcgtgaaacttgggcgcgaggagccagctatgtcaatggacgctaacggtaaaattatctgggcaaaacactctgaagtccagcaggcaaacctcaaagcgatgggagatgcagagattaaggacggagaacggcttcccttagccgttaaggatatgggatcctgtgagatttatccacaaactattcagcataatccaaatggaaggtttgtggtcgtgtgcggcgacggggagtatatcatttacactgcaatggccctccgcaataagtccttcggcagcgcccaagagtttgcatgggcccacgattcatctgaatatgccattagggagtccaatagcatagtgaaaatcttcaagaattttaaggagaaaaaaagttttaagcctgactttggagccgagagcatttacggtggatttttgctgggcgtgcggagcgtgaatggcctcgctttctatgactgggataatacagagctgataagacgcattgagatacagcctaagcatattttttggagtgactccggtgagttggtttgtattgctactgaagaatccttttttattctaaaatatctgtcagagaaagtgctcgcagcccaggagacacatgaaggagttacagaagacggcattgaggatgcgtttgaggtgctgggagagattcaggaaatcgtgaaaacaggcctgtgggttggggactgctttatctacacatcctccgtgaataggctaaactactacgtgggtggcgaaatcgtcaccatcgcacatctcgatcgaaccatgtacttgctgggatatatccccaaggacaatcgtttgtacctgggtgataaagaattgaacatcattagctatagcctgctcgtaagtgtgctggagtatcagactgctgtgatgcgcagggacttctctatggccgacaaggtgcttcctaccattcctaaggagcagcggaccagggttgctcactttctggagaagcaagggttcaaacagcaggctctcaccgtcagtacggacccagaacaccgatttgagctcgctctgcagctgggtgagcttaagattgcttatcagttagctgtggaagcagagagcgagcagaagtggaagcagctcgctgagctggccatatctaagtgtcagtttggactggcccaagaatgtcttcaccacgcccaggactacggcggcttgctactcctggccaccgcctcgggtaatgcaaacatggttaataaattggccgaaggcgccgaaagagacggcaagaacaatgtggcctttatgtcctatttcctgcagggcaaggtggacgcctgtctggagttgctaatcagaacagggagacttccagaagctgcctttctggccagaacgtacctgcccagtcaggtgtcgcgggtggttaagctctggagggaaaatctcagcaaagtcaatcagaaagcggcggagtccctggctgatcccacagagtacgaaaacctgtttcctggattgaaggaggccttcgtagtagaagagtgggttaaggaaacccacgctgacctttggcccgccaaacaataccctttagttacaccgaacgaagagagaaatgttatggaagaggggaaagactttcagccctcaagatctacggctcagcaggagctcgatgggaagccagcaagtccgacacctgtcattgtggccagccacactgcgaataaagaggagaagtcattgcttgaactggaagtagacctagataacctggagttggaggacatcgatacaactgacattaacctggacgaagacatactggatgactag

SEQ ID NO: 112516 - DNA, 2634 bp, Artificial Sequence
  Description of Artificial Sequence: Synthetic coding sequence
atgcttgcatcactgtataacggatcagtgtgtgtgtggaaccacgaaactcagaccctggtgaagacctttgaagtgtgcgatctgccagtgagagctgcaaagtttgtggcgaggaaaaactgggttgtcacaggtgctgatgatatgcaaatacgcgtcttcaattataatacacttgagagggtgcacatgttcgaagctcactccgactacattcgttgcattgccgttcacccaacacagccgtttatcttgaccagtagcgatgatatgcttatcaaactttgggactgggacaagaagtggtcttgtagccaggtgtttgaaggacacacgcactacgtgatgcaaatcgttattaacccgaaagataataatcaatttgccagcgcctctctagaccgaacaataaaagtgtggcaactcggcagtagcagccctaattttaccttggaaggccacgaaaagggagtcaactgtatcgactattatagcgggggcgacaaaccttatttgatttcaggcgcagacgatagactggtgaagatatgggactatcagaacaaaacttgcgtccaaaccctggagggtcatgctcaaaacgtgtcatgtgcatctttccaccccgaattgcctatcatcataacagggtctgaagacggtacagttcggatctggcactcttcaacttatcggctggaaagcacattaaattacggaatggagagggtatggtgtgtggcttctctaagggggtcaaataacgtggccctcggatatgacgaaggatccattatcgtcaagctgggcagggaggagccggcaatgagtatggacgctaatggaaaaataatatgggccaaacactccgaggtccagcaggctaacctaaaagccatgggtgacgcagagataaaggatggggaaagactgccacttgccgtaaaggacatgggcagttgtgaaatatacccacagaccatacagcacaacccgaacggccgctttgttgtggtttgcggagacggcgagtacattatctataccgcaatggcactccgcaacaaaagtttcggctctgcacaggaattcgcttgggcccacgattcaagtgagtatgccatacgggagtccaattccattgtgaaaatttttaagaacttcaaagaaaagaaaagcttcaaacccgatttcggagccgagtccatctatgggggctttttgcttggagtgaggagtgtgaacggactggctttttatgattgggataatactgagctgatcagaagaattgagatccaacctaagcatattttctggtcagattcaggagagctggtttgcatagctactgaagagtccttttttattctgaagtacctaagtgagaaagtcttagcggcccaggaaacacatgaaggagtgaccgaggacggcattgaagatgccttcgaagtcctgggtgagattcaagagatcgttaaaactggcctgtgggtaggagactgcttcatttatacctccagtgtgaataggctgaactactatgtgggaggcgagatcgtcaccattgcacacctcgaccggaccatgtatctgctaggctacatccccaaggacaatcgcctgtatctgggggacaaggagcttaacatcattagttattcattactggtcagtgtcctggagtaccagaccgctgttatgcgccgtgacttcagcatggccgataaagtcttgcccacgattcccaaggagcaaagaactcgcgttgcacatttcctggagaagcagggtttcaaacagcaagccctgactgtttccactgaccctgagcatcggttcgaactggcgcttcagctgggagaacttaagatcgcataccagctcgcagtggaggccgagagcgagcagaagtggaagcagctggctgaacttgccattagcaaatgtcaatttggtctagcgcaggagtgcctacaccacgcccaggattacggcggcctgctgctgctggccactgctagcggaaatgccaacatggtcaataagctggccgagggcgccgagagagacggcaaaaataatgtggcttttatgagctattttttgcaaggtaaagtggatgcttgtctggaacttctaatccggacaggacgcttgcccgaggcagccttcctcgcaagaacatatctgccatcacaggtttcacgcgtcgtcaaactgtggcgggagaatctgtctaaggtcaatcagaaagccgcagagtccctagctgatcctaccgagtacgagaacctgttcccgggactcaaggaggccttcgtggttgaagagtgggtcaaggagacccacgccgatctttggcctgctaaacagtatccactggtcacacccaacgaggagaggaacgtgatggaggagggcaaagactttcagccctcaagatccacggcacagcaagagctggacggtaaacccgcttcccctacacccgtcatcgtagcttcccacacggccaacaaggaggaaaaatcactgctcgagttggaggtggacttggataatttggagcttgaggacatcgacacaacagatattaatctggatgaggacattctcgatgactag

SEQ ID NO: 112517 - DNA, 927 bp, Artificial Sequence
  Description of Artificial Sequence: Synthetic coding sequence
atggcccctcccgcaccagggcctgcaagtggtggaagcggtgaggttgatgaactgttcgatgttaagaacgcattttacataggatcttatcaacagtgtatcaacgaggcccaaagggtcaagctttcaagtccagagagagacgtcgagcgcgatgtgtttctttatcgcgcttacctagcccagaggaaatttggcgtagtccttgacgagattaaaccgtcaagtgccccagaactgcaggctgtgcgaatgttcgccgactacctggcacatgagagtcggagggactccatcgtggcagaactggatagagaaatgagccggtccgtcgacgtgactaacaccacgttcctgctaatggcggcctcaatctatctgcatgaccaaaatccagatgcagcgctgcgggcattacatcagggggactcactcgaatgcactgctatgacggtgcaaatcttgttaaagttggatcgtctcgaccttgcaagaaaagaactgaaacgtatgcaggacctggatgaggacgctaccctgactcagcttgcaactgcatgggtgtcattggccaccgggggtgagaaactgcaggatgcctactatatcttccaggagatggcagataagtgctcaccaaccctgctgctgttgaatggacaagcagcatgtcacatggcccaggggcgctgggaggctgccgagggcctgctgcaggaggcgctggacaaagatagcggctacccagaaacgctggtgaatctcattgttctttcacaacatctgggaaaaccccctgaagtgactaatagatacctttcacaactaaaggacgcccacaggtcacatcccttcattaaggagtatcaggccaaggagaacgactttgacaggcttgtcctccagtacgctccatctgcttag

SEQ ID NO: 112518 - DNA, 771 bp, Artificial Sequence
  Description of Artificial Sequence: Synthetic coding sequence
atggctcctccggcacctggcccggccagtggagggtccggtgaagtcgatgagctgtttgacgtgaagaacgccttctacataggtagttatcagcagtgcatcaacgaggcccagcgcgttaaactctcttcccccgagcgggatgttgaaagggacgtatttctttatcgcgcctatctggcccagaggaaattcggtgttgtgctggatgagataaaacccagctccgcacctgaactacaggccgttcgaatgtttgccgactacctcgcccatgaaagtcggcgagacagtatagtggctgaactcgaccgggaaatgtctcgatcagtggatgtgacgaataccactttcttgcttatggcggccagcatctacctgcatgaccagaacccagacgctgctctcagagcactgcaccaaggcgactcattagagtgcacggcgatgacagtgcaaatcctgctgaaacttgacagactcgatttggcccggaaagagctgaagagaatgcaggatctggatgaggacgcaacattgacccagctggcaacagcctgggtaagcctggcaacagactcgggctacccggaaacccttgtcaacctcattgtgcttagccagcacctgggcaaaccaccagaagtgacgaatcgatacctcagccagctaaaggacgcacaccggtcccatcccttcataaaggaataccaagctaaagaaaatgactttgatagacttgtactgcagtacgccccatcggcctag

SEQ ID NO: 112519 - DNA, 774 bp, Artificial Sequence
  Description of Artificial Sequence: Synthetic coding sequence
atggcacctccggcgcctggacccgcctccggagggtctggcgaagtggacgagttgttcgacgtcaaaaacgcattttatataggctcctaccagcagtgcataaatgaagcccagagagtgaaactgagtagccctgagagagacgtggagcgtgacgtgtttctgtacagggcgtacctcgcccagcgtaagttcggcgtggttctggatgagattaaaccttcctccgcacctgaactacaggcagtaagaatgtttgcggattatctcgctcatgagtctcggtccactgccatgaccgttcaaatactgctgaagctggacaggctggacctggcccgaaaggaactgaagcggatgcaagacctggacgaggacgccaccttgacccagttagctacagcttgggtctctctggcaaccgggggcgagaaattacaggacgcctactacattttccaggagatggccgacaaatgttcacctacccttctattactgaacggtcaggccgcctgccacatggcccaggggcgctgggaggcggcagaagggttgcttcaggaagccctggataaagattcaggatacccagagaccctcgtcaatctgattgtgcttagccagcatctgggaaagccacctgaagtcacaaaccgctacctctctcagctaaaagacgctcacaggtcacacccatttatcaaagagtaccaagccaaggaaaatgattttgacagactggtactgcagtacgcaccgtctgcttag

SEQ ID NO: 112520 - DNA, 924 bp, Artificial Sequence
  Description of Artificial Sequence: Synthetic coding sequence
atggcgcctcccgctccggccgggctgaggggcagcggagaagtggacgaattgttcgatgtgaaaaatgcattttacatcggcagctaccaacaatgcattaacgaagcacaacgagtgaagctgtccagccccgaaagggatgtggaacgtgatgtgttcttatacagggcataccttgcacagagaaagttcggcgtggtactcgacgagatcaaaccctcaagcgcacctgagctacaggcagtccgcatgtttgctgattaccttgctcacgagtcacgacgcgactccattgttgcggaacttgacagagaaatgagcagaagtgttgacgtgactaacaccaccttcctgttgatggcagccagtatctacctgcatgatcagaatccagacgcagctctgagggccctccatcagggggactctttggagtgtaccgctatgaccgtacagattttgcttaagctggatcggctggacctggccaggaaagaactgaaaaggatgcaggatttggatgaggacgctactcttactcaactggctaccgcatgggtgtcactggctaccggcggggagaagcttcaagatgcctactatatcttccaagaaatggccgataagtgctccccaaccctgctcctgttgaacggccaggccgcctgccacatggcccaaggcaggtgggaggccgctgagggactgctgcaggaggcactggacaaggactcagggtaccccgaaaccctcgtcaatctcattgtccttagccaacatctggggaaacccccagaggtaactaacagatatctgagtcagctgaaggatgcgcatcgaagccacccgtttattaaggagtaccaagccaaagagaacgactttgaccggcttgtcctccaatatgccccgagtgcgtag

SEQ ID NO: 112521 - DNA, 741 bp, Artificial Sequence
  Description of Artificial Sequence: Synthetic coding sequence
atgataaagaagtttgataaaaaagatgaggagtccggctcaggctccaatccctttcagcacctcgaaaagagtgccgtgcttcaggaggcaaggatctttaacgagacccccataaatccccggaggtgcctccatatcctgaccaaaattctgtacctgcttaaccagggggagcattttggtaccaccgaggcaactgaagcgttttttgctatgactcgcttgtttcagagtaatgaccagaccctgagacgcatgtgctatctcaccatcaaagaaatggcgacaatcagtgaagacgtaattatcgttacctcctccctcacgaaggacatgaccggcaaagaagacgtttacagaggacctgcgattagagcattgtgccgcatcactgacggcacaatgctccaggcgattgaaagatacatgaagcaggccattgtagacaaggtctcaagcgtctccagcagcgcccttgtgagttcgctccacatgatgaaaattagctacgacgtcgtcaagagatggattaatgaagcccaggaggcagcctccagcgacaacatcatggtgcaataccatgcactcggggtcctgtatcatctgcgcaagaatgaccgcctggctgtcagcaagatgttaaataagttcaccaagtctggcctcaagtcccagtttgcttactgcatgctaattcgcatcgccagccggcttctcaaggagacggaggatgggtag

SEQ ID NO: 112522 - DNA, 468 bp, Artificial Sequence
  Description of Artificial Sequence: Synthetic coding sequence
taagccggcagcttcagttgtaccatgaagttcactgtgagggattgcgacccaaacacgggcgtccctgacgaggatggttacgacgacgaatacgtgctggaagatctcgaggttacagtgagtgaccacatccaaaaggtgctgaagcccaattttgcggctgcctgggaagaagtcggtgatacctttgagaaagaggagacgtttgctctgagcagtactaagacactggaggaggcagtgaacaatatcattaccttcctggggatgcagccctgcgagagaagcgataaggtgcctgagaataagaactcccactctctctatcttgcgggcatattcagaggaggctatgatcttctggtccgcagtagactagccttagccgacggggtgacaatgcaagtcacagtgcggtccaaggagagaacgcccgtggatgtgattctggcgtctgtaggctag

SEQ ID NO: 112523 - DNA, 741 bp, Artificial Sequence
  Description of Artificial Sequence: Synthetic coding sequence
atgattaaaaagtttgataaaaaggatgaggagtcaggttcgggcagtaatcctttccagcatttggaaaagtctgccgtcctgcaggaagcacgaatcttcaacgagactcctattaatcccagacggtgtctccatatattgacgaaaatcctatacctcttgaatcagggggagcattttggaaccacggaggccacagaggcattcttcgcgatgactagactatttcagagcaatgatcaaactctgagacggatgtgctacctgaccattaaagaaatggccaccattagcgaggatgtcattatcgtgacttcgtccctaacgaaggacatgacaggcaaagaggatgtgtacagaggaccagctattagagccctgtgtaggatcacggacggtacaatgctgcaggccatcgaacgctatatgaaacaggcgatcgttgacaaggtctcttccgtttcatcaagcgcgcttgtaagtagcctgcacatgatgaagatcagttacgatgttgtgaaaagatggatcaacgaagctcaggaggccgcgtcttctgacaatattatggtgcagtaccatgccctgggagtgttgtatcatctgcggaagaacgaccgtctcgctgtgagcaaaatgctgaacaaatttactaagagtgggctaaagtcacagtttgcttactgcatgttgatcagaattgccagtaggctcctcaaggaaacagaggacgggtag

SEQ ID NO: 112524 - DNA, 1080 bp, Artificial Sequence
  Description of Artificial Sequence: Synthetic coding sequence
atgtattttaaaagggctgcacgcgccttccccgtgctgctcaccggagcaggcaaaactacactgctcaactacattttgaccgagcagcattctaaaagagtcgcagtcatcctgaatgagttcggagaagggtcggctcttgaaaagtccctggccgtatcgcaaggcggcgagctgtacgaggagtggttagagcttaggaacggttgtctgtgctgcagcgttaaagatagcggcttgcgggctattgagaatctcatgcagaaaaaagggaagttcgattatattttacttgagacaacgggattggccgaccctggggctgtggcgtccatgttctgggtggacgccgagctgggctccgacatttacctagatggcatcattacaattgttgattcaaaatatgggcttaaacacttaacagaagagaagccagatggtttaattaatgaagctacccggcaggtggcgctggcggatgcaatcctgataaataagacagatctggtccccgaagaggacgtcaagaagctgagaaccacaatccggagcatcaatggactggggcagatcctggagacccagagatcccgtgttgacttgtcgaacgtgctagacctgcacgccttcgactctctgagtggcatctctctgcagaaaaaactgcagcacgtgccaggaacccagccacaccttgatcagtccatcgtcactataacctttgaagttcccggtaatgcaaaggaagaacacctgaacatgtttatacagaacctgctgtgggagaagaatgtacgtaacaaggacaaccattgtatggaggtgatccggttaaaaggcctggtgagcatcaaggacaagtctcagcaggtgatcgtgcaaggtgtccacgagctctacgatcttgaagaaacgcccgtgtcttggaaggatgacacagaacggactaataggttggttcttctgggtcgtaatctagacaaggacatactgaagcaactgtttatcgcgactgtcacggaaactgaaaagcaatggactacaaggtttcaggaagatcaagtgtgtacatag

SEQ ID NO: 112525 - DNA, 1188 bp, Artificial Sequence
  Description of Artificial Sequence: Synthetic coding sequence
atgctgccagctgtgggcagcgctgatgaggaggaagaccctgcagaggaagactgccccgagttagtcccgatagagacaacacaaagcgaggaagaggaaaagtccggattgggcgctaagattcccgtcacaattatcacgggttatctgggggcaggtaaaaccacacttttaaactatatcctcactgaacaacactccaagcgagttgcagtgattctgaacgaatttggagaaggttctgctctcgaaaagtcgttagctgtttcccaagggggggagctgtatgaggagtggctggaactgaggaatggctgtctgtgctgcagtgtcaaggactcgggtctgagggccatcgagaacctgatgcagaagaaaggtaaatttgactacatcctgctggagactacgggcttagccgatccgggcgccgtagcttccatgttctgggtggacgccgagctgggtagtgatatttacctcgatggaataattacaatcgtggattcaaagtatgggctgaagcacttgaccgaggagaaaccagatggactgatcaacgaagcgactaggcaggttgctctggcggacgctattctgataaacaaaacagatctcgtgcccgaggaagacgtgaaaaaacttcgcactacaatccgatcaattaacgggcttggacagattctagaaacacagaggagtagggtcgacttatctaatgtgttagacctgcatgctttcgattcgctttccggtatctctctgcaaaaaaaattgcagcacgtgcccgggacccagcctcatctggatcagagtatcgttacaataaccttcgaagtgccaggtaatgccaaagaggagcatctcaacatgttcatccagaaccttctttgggaaaaaaacgtgagaaataaagataatcattgtatggaagtgatcagactgaaaggcctggtgtctattaaagacaagtctcaacaagttattgttcaaggagttcatgagctctacgacttggaagaaacgcctgtttcctggaaggatgacacagaaaggaccaaccggttggtcctgctgggcagaaacctggacaaggacattttgaagcagctgttcattgctacagtaactgagactgagaaacagtggacgacacgttttcaggaagaccaggtgtgtacttag

SEQ ID NO: 112526 - DNA, 543 bp, Artificial Sequence
  Description of Artificial Sequence: Synthetic coding sequence
atgctgcctgccgtgggatcggcggacgaagaggaggatccggccgaggaagactgtcccgaactggtccctattgaaaccacccagtccgaagaagaagaaaaatcagggctcggcgccaaaataccagttacaatcattacagggtatctgggagccggtaagactacactcctcaactatattttgactgaacagcactccaaacgggtagccgttatacttaatgaatttggtgagggatccgcattggaaaagtccctcgcagtgtctcagggcggggaactctacgaagagtggctggagttgcgtaacggttgtttgtgctgcagcgttaaagactctggcttgcgagccatcgaaaatctgatgcagaagaagggcaagtttgattatattttactagagaccacaggtctggcagaccctggggcagtcgccagtatgttctgggtcgatgcagagctggggagcgacatttacctcgatggcatcatcaccattgtggacagtaagtacggattgaaggtgaagtaccactag

SEQ ID NO: 112527 - DNA, 1044 bp, Artificial Sequence
  Description of Artificial Sequence: Synthetic coding sequence
atgctcccagccgtcgggtctgctgatgaagaagaagatcctgccgaagaagattgcccagagctggtgcctattgagacaacgcagagcgaagaagaagagaagtcaggactcggagcgaagatccctgtgactatcattaccggctatctgggggccggaaagaccactctgttaaattacatcttgacagagcaacactccaaacgagtggcagttatcctgaatgagttcggggaagggagtgccctcgaaaaatcactcgcagtcagtcagggtggagagctctatgaggaatggttggagttgagaaacggctgcctctgttgctctgtgaaggatagtgggttgcgggcaatcgaaaacctaatgcaaaagaaaggcaaatttgactacattctgttggaaaccactggcctggccgatccgggagccgtggcctctatgttttgggtcgacgctgaactcggcagtgacatctatctcgacgggattatcaccatcgtggattctaagtacggactgaagcacctgactgaggagaagcctgatggtctgatcaacgaggccactcgtagcatcaacggacttggacaaatacttgagacccagcgatcctcactgcaaaagaagttacagcatgttccgggcacgcagcctcacctggaccagagcattgtcacaataacatttgaggtgcccggtaacgccaaggaagagcacctgaacatgttcattcagaacctactttgggagaagaacgtgaggaataaggacaatcactgtatggaggttattagattgaaaggactcgtcagcattaaggataagagccagcaggtgatagtgcagggggttcacgaactgtatgatctcgaggaaaccccggtcagctggaaggatgacaccgaaagaactaaccggctggtactgctggggcggaacctggataaggatatcctgaagcagctttttatagccacagtgacagagacggagaaacagtggactacccgctttcaggaagatcaagtgtgcacgtag

SEQ ID NO: 112528 - DNA, 753 bp, Artificial Sequence
  Description of Artificial Sequence: Synthetic coding sequence
atgttgccagcggttggcagcgccgatgaggaggaggaccccgctgaggaggactgtcctgagctagtgccaattgaaactacccagtcggaggaggaggagaagagtggcttgggcgcaaagatccccgtgaccattatcactggctacttgggcgccggcaagactacactgctaaattatatcctgacagagcagcacagcaaacgtgtcgctgtaatcctgaacgagttcggcgaaggttctgcgctagagaaaagcctggcggtaagtcaggggggcgaactctatgaggaatggctcgagctaaggaacggctgcctgtgttgcagcgtaaaagatagcgggcttagggctattgagaatctaatgcaaaagaagggcaagtttgactatattttgttagagacgacgggtctcgccgaccctggagcagtggctagcatgttttgggtggacgccgagttaggttccgacatctatctcgacgggatcattactatagtagactccaagtacggacttaagcacctaaccgaggaaaaacccgacggcttaatcaatgaggccacccggcaggtggcactggccgatgccatcttaattaataagacggatctggtacccgaagaggatgtaaagaaactacgtaccacaatacgctatgagatgataagtgttctgtcagcatacagatctatgctctatactcagaatatcttttattctgactgctgcccggtggaaacatag

SEQ ID NO: 112529 - DNA, 234 bp, Artificial Sequence
  Description of Artificial Sequence: Synthetic coding sequence
atgtacttcaagcgtgcggcccgtgcttttccagtgctgctgaccggagcgggaaaaactactctgctgaactatattctcaccgagcagcatagtaagagggttgccgtgatccttaatgaattcggggaaggatcggcactggagaaaagtctggccgtctctcaggggggagaactgtatgaagagtggctggagctgcgcaacggttgcttatgttgtagtgtcaaatag

SEQ ID NO: 112530 - DNA, 342 bp, Artificial Sequence
  Description of Artificial Sequence: Synthetic coding sequence
atgttgcctgccgttgggtccgccgatgaagaagaggatccagctgaagaagattgtccagaattggtcccgatcgaaaccacacaatccgaagaagaagaaaagtcagggttaggcgccaaaattcctgtgactataatcacaggttatctaggagctggcaaaacaactcttcttaactatatactgactgagcaacacagcaaacgggtggcggtcatccttaatgaatttggtgaggggtctgctctggagaagtcgttggcggtctcacagggcggagagctttatgaagaatggctggagctaagaaatggatgtctctgttgttcagttaaatag

SEQ ID NO: 112531 - DNA, 1131 bp, Artificial Sequence
  Description of Artificial Sequence: Synthetic coding sequence
atgttgcctgcggtggggagtgcagacgaggaagaagacccagctgaggaggactgccctgagctggtccctatcgagacaactcagtcggaggaggaggaaaaaagtgggctcggggccaaaatacctgtcacaattatcacgggatacctgggggcaggcaaaaccacccttttgaattacattctcaccgaacaacacagcaagagagtggctgtcattctcaacgagttcggcgagggaagtgccctggaaaaatcattagcggtcagccagggtggtgagttatacgaagagtggctggaacttcggaacggatgcctctgttgctccgtcaaggatagcggactccgggcgatagaaaatctcatgcagaaaaagggaaaatttgattatatcctcttagagacaactgggttggctgacccgggagctgttgcgtctatgttctgggtggacgctgagctgggctccgacatatacctggacgggattataacaatcgtcgattccaagtatggcctgaagcacctgacggaggagaagccagatggcctcatcaacgaagccaccaggcaagtagccctggccgatgcaatcctgataaataagactgacctggtgccggaagaggacgtgaaaaagttacggactacaatccgcagcattaacgggctcgggcagatcctggagactcagaggtcatccctgcagaagaagcttcagcatgtccccggtacacagcctcacctggaccaatccatcgtcaccataacttttgaggtccctgggaatgcgaaagaagagcacctaaacatgtttatccagaatttactgtgggagaagaacgtgaggaacaaggataaccattgcatggaggtgataagacttaagggtctcgtcagtatcaaggacaaaagtcagcaggtgattgttcagggggtccacgagctgtacgacctggaggagacaccggtgagctggaaagacgacacggaacggacaaaccgcctagtgctgctgggaagaaatctggataaagacattctgaagcagctttttatagcaactgtgactgaaaccgaaaaacagtggaccacacgctttcaggaggaccaggtatgtacttag

SEQ ID NO: 112532 - DNA, 483 bp, Artificial Sequence
  Description of Artificial Sequence: Synthetic coding sequence
atgctccccgcggtgggctcagctgacgaagaggaggatccggcggaggaggattgcccagaattggtaccaatcgagacaactcagtcggaagaggaggagaagtccggactaggtgcgaaaatccccgtcaccataatcaccgggtatctcggagcaggtaagactacgctgctaaattatattctgaccgagcaacactccaaaagggttgccgtgattctcaatgagttcggagaggggagcgccctggagaaatcacttgcagtctcccagggaggtgagctgtatgaggagtggctagagctcagaaatggctgcctgtgctgctcagttaaggatagtgggcttagggcaatcgaaaacctgatgcagaaaaaaggcaagttcgactacatcctgctggaaacgaccggcctggcagatcccggcattatcacaatcgtagactctaaatacggcctcaaggtgaagtatcactag

SEQ ID NO: 112533 - DNA, 441 bp, Artificial Sequence
  Description of Artificial Sequence: Synthetic coding sequence
atgtattttaaacgtgccgcgcgggcctttccagtgctcttgaccggggcaggcaagaccaccttactcaactatattctgacagagcagcactccaagagagtcgcggtgatcctaaacgagttcggcgaaggatcagctcttgaaaagtccctggctgtcagccaggggggggagttgtacgaggagtggctggagctgagaaatgggtgtttgtgttgctccgtcaaggattccggcctgcgcgcgatcgagaacctgatgcagaagaaaggtaaattcgattacattttgttggagactacaggtctagccgacccaggagccgtagctagtatgttctgggtagatgccgaactcgggtccgatatatacctggacggcatcatcaccattgtggactcaaagtatgggttgaaggctaagaattggaccacatag

SEQ ID NO: 112534 - DNA, 1188 bp, Artificial Sequence
  Description of Artificial Sequence: Synthetic coding sequence
atgttacccgccgtgggctccgctgatgaggaggaggaccccgccgaagaggattgccctgagttggtccccatggaaacaacccaatctgaggaagaagaaaaaagtggcctcggagctaaaatccctgttactatcattactggctacttgggcgctgggaagacaacccttctgaactacattttgacagaacagcactctaaacgtgtggcagtgattcttaatgagtttggagagggaagcgccttggaaaaatctctggccgtaagccagggcggtgagctgtatgaggagtggctggaattgcggaatggctgtttatgctgttcggtgaaggataatgggctccgcgctatagagaacctaatgcagaagaagggaaagtttgactatattctgctggagaccacgggactcgcagacccaggcgcggtggcttccatgttttgggtggacgctgaactaggaagtgatatatatttggacggtattattacaatcgtcgattcaaagtacggtctgaagcatttagccgaggagaagcccgacgggttaataaacgaagcaacacgacaggtggcactagcagacgcaatactgattaacaaaaccgatctcgtccccgaggaagacgtgaagaaactgagagcaactattcggagtataaacggcctgggacagatactcgaaactcaacggagcagagtggatctgtcaaatgtcctcgacctacacgccttcgacagcctgtccggaattagcctgcagaagaagctccagcacgtgccagggacccaaccccatctggatcagagtatcgtcactataaccttcgaggtgccaggcaacgctaaggaagagcaccttaacatgttcatccagaacttgctgtgggaaaagaacgtccggaataaagacaaccactgtatggaggtgatcagattaaagggattggtgtctatcaaagataagtcccagcaggtgattgtgcagggggttcatgaactgtacgatctcgaggaaacccccgtctcgtggaaagatgataccgagagaacgaaccgtttggtcctcttgggaaggaacttggataaagacattctaaaacagctctttatcgccaccgtaacagagaccgaaaaacagtggaccacacactttaaagaagatcaagtgtgcacttag

SEQ ID NO: 112535 - DNA, 543 bp, Artificial Sequence
  Description of Artificial Sequence: Synthetic coding sequence
atgctgccagccgtggggtccgccgacgaggaggaggacccagcggaggaggattgccccgaattagtacctatggaaaccacccaatccgaggaggaggagaagtccggactgggcgctaagattcctgtcacgatcatcaccggatacctgggcgctgggaagacaactttgctgaactatatcttaacggagcagcattcgaagagagtggccgtaattctgaacgaattcggcgaaggtagtgctctggaaaagtccctggccgtatctcagggcggagagctctacgaggagtggttagagctaagaaacgggtgtctttgttgttctgtgaaggacaacgggctccgtgccattgagaatctgatgcagaaaaagggaaagtttgactacatactgcttgaaactaccggcttggccgacccaggagcggtcgccagcatgttttgggtcgatgccgaattgggaagcgacatttatcttgatggaatcattaccatagtggactctaagtatgggctgaaagtaaagtaccactag

SEQ ID NO: 112536 - DNA, 1131 bp, Artificial Sequence
  Description of Artificial Sequence: Synthetic coding sequence
atgcttcctgcggtggggtcggccgacgaagaagaggatcccgccgaggaggactgcccagaactggtgcccatggaaacaacccagtctgaagaggaagaaaagtctgggctgggggcgaagattcctgtcaccattattaccgggtacctaggcgccggcaagaccaccctgctgaattacatattgacggagcagcactctaaaagggtcgccgttatcctcaatgagtttggggagggcagtgcactggaaaaatccctggcggttagccagggcggcgagctctacgaagagtggttagaactgcgaaatgggtgcctgtgttgctctgttaaggataacggactccgtgcaatagagaaccttatgcagaaaaaagggaagttcgactacattctcttagagactaccggactggccgatccaggagctgttgcctcgatgttctgggtcgacgcagaactcggctccgacatctatctggatggcattatcacgatagtggacagcaaatacgggctaaaacacttagccgaggagaagcctgacgggcttattaatgaagcaactcggcaggtggcactcgccgacgcaatcctcatcaataaaacggacctcgtcccagaagaggacgtgaaaaaattgcgagccactattcgctcaataaacggccttggacagatcctggagacacagcgtagttccctccaaaagaagctacaacacgtacccgggactcagcctcatctcgaccagagtatcgtaacaataacatttgaagttcccggcaacgcaaaggaagagcacctgaacatgtttatacagaacctgctgtgggagaaaaacgttcgcaacaaagataatcattgcatggaggtgattcgccttaaggggctagtgagtattaaagataagtcgcagcaggtaatcgttcagggcgtgcacgaactctacgacctcgaagagactcctgtgtcttggaaagatgacaccgagcggaccaacagactcgtcctcctgggccggaatctagacaaagatatcctgaagcagctatttatagccactgtgaccgagaccgaaaagcagtggacaacccactttaaagaagatcaggtgtgtacttag

SEQ ID NO: 112537 - DNA, 1080 bp, Artificial Sequence
  Description of Artificial Sequence: Synthetic coding sequence
atgtacttcaaaagagccgcaagggcgttcccagtgctcctgactggagcgggcaaaacaacactgctgaactatattctgaccgagcagcattccaaacgggtggccgtcatcctcaacgagttcggagaaggcagcgcactcgagaagtcactcgcagtgtctcagggaggcgaactgtatgaagagtggttggagctaagaaacggatgcttgtgctgttctgtcaaggataatggcttacgcgctatcgaaaacctcatgcagaaaaaggggaaattcgattatattctcctagagaccaccggtctcgccgaccccggagccgttgcgagcatgttttgggttgatgccgagctcgggagtgacatttatctcgacggcattataactatcgtggactctaagtatgggcttaaacatctggcagaggagaagcccgacgggctcattaacgaggctacccgacaggtcgccctcgcagacgccattctcattaacaaaaccgatctcgtccccgaagaggatgtaaagaaactccgcgccactattaggtcaatcaacgggctcggtcaaattcttgaaactcaacggtcccgagtcgatttgtccaacgtactcgacctacatgccttcgactctctctccggtataagtctccaaaaaaagctccagcacgttcctggcacccaaccgcatctcgatcaatcaatcgtaactatcactttcgaagtgcctgggaatgccaaggaggaacatctcaacatgttcatccagaaccttctgtgggaaaaaaatgtgaggaataaagacaatcattgcatggaggtgattagattgaagggacttgtctccattaaggataagtcgcaacaggtgattgtgcagggggtccacgagctttacgatctggaggagactccggtgtcttggaaggatgatactgaacggactaaccgccttgtccttctcggacgcaatttggataaggacatcctgaagcagctgttcattgccacggtgacagagactgaaaaacagtggactacccactttaaggaagaccaggtgtgtacgtag

SEQ ID NO: 112538 - DNA, 483 bp, Artificial Sequence
  Description of Artificial Sequence: Synthetic coding sequence
atgctgcccgctgtcggatccgccgatgaggaagaagacccagcggaggaagactgcccggaactagtgcctatggagaccactcagtccgaagaggaggaaaaaagtgggctgggagccaagatcccagttactataatcactggttatctgggcgccggaaaaaccaccttactgaattatatactgactgaacagcattctaagcgggtagccgttatcctcaatgaatttggagagggctccgctctcgaaaagagtctagcagttagtcagggtggagagttgtacgaagaatggcttgagctacgcaatgggtgcctgtgttgctccgtcaaggataacgggcttcgggccatagagaacctgatgcagaagaagggtaagttcgattacatcctgctggaaaccacaggccttgcggatcctggaatcatcacgatagtagattctaagtatggccttaaggttaagtaccactag

SEQ ID NO: 112539 - DNA, 1188 bp, Artificial Sequence
  Description of Artificial Sequence: Synthetic coding sequence
atgcttcctgcagtcggctctgtggacgaagaagaggacccagcagaagaggactgtccagaattggtacccatcgagacgacacaaagcgaagaggaggaaaaaagcgggctcggcgcaaagatacctgtgaccatcattacagggtacctgggagcgggcaagaccacactgcttaactatatcctgacagagcaacattcaaagagggtggccgtgattttaaatgagtctggcgagggctctgctctggaaaagtctctggcagtgtcacaggggggcgagctgtacgaagaatggctggaactgaggaacgggtgtctctgctgttccgtcaaagacaacggcctgcgcgcaatcgagaacctgatgcagaagaaaggcaagtttgacgatattctgctggaaacaaccggactggccgatccaggagccgtcgccagtatgttctgggttgacgccgagcttggatctgacatctatcttgatggcattataactattgtggatagtaagtacgggctgaaacacctgaccgaggaaaagcccgacggtcttattaatgaggcaacaagacaggtggcactagcggatataatcctcatcaataagactgaccttgtacccgaggaggacgtcaagaaattgcgcacgactatccgctctattaatggcctcggacagatacttgaaacacagagaagtcgggttgatctgtccaacgtattggacctgcacgccttcgactcgctgtcaggcatcagtctgcagaagaagctgcagcacgtgccaggtacacagccacatctggatcagtctatcgtaacgatcaccttcgaagtccccggcaatgcaaaagaagaacatcttaatatgtttatccagaacctgctgtgggaaaaaaatgtgcgcaataaggacaaccactgtatggaagtgattaggctgaaggggttggtctcaatcaaagacaagtcccagcaggtgattgttcagggcgtgcacgagctatacgatctggaggagacccctgtgagctggaaggatgatacagaacggaccaaccggctggtcctgattggacgcaacttagacaaggacatcctgaaacagttgttcatagccacagtgacggaaactgagaagcaatggacaacccactttaaagaagaccaggtgtgcacatag

SEQ ID NO: 112540 - DNA, 258 bp, Artificial Sequence
  Description of Artificial Sequence: Synthetic coding sequence
atggaagtaatacgcctgaaaggcttggtgtctataaaagataagagccaacaggtcatagtccagggagtgcatgagctctacgacctagaggaaaccccagtctcctggaaggacgacactgaaagaaccaacaggctcgtacttatcggccgtaatttagataaagacattttaaaacagctcttcatcgctaccgtgacagaaacagagaaacagtggaccacccacttcaaagaggatcaggtgtgtacatag

SEQ ID NO: 112541 - DNA, 258 bp, Artificial Sequence
  Description of Artificial Sequence: Synthetic coding sequence
atggaggtcattcgcctgaaaggccttgtctccattaaggataaaagtcagcaggtgattgttcagggagtgcacgagctctacgatctcgaagaaaccccggtttcttggaaagatgatactgaacgtacgaatcggctggtcttaattgggcggaatctcgataaagacatcctcaaacagctgttcatcgccacagtgactgaaaccgaaaagcagtggacaacccacttcaaggaagaccaggtatgtacctag

SEQ ID NO: 112542 - DNA, 132 bp, Artificial Sequence
  Description of Artificial Sequence: Synthetic coding sequence
atgtttattcagaacctgctctgggagaagaacgtgcggaacaaagacaatcattgcatggaggtcatcagactgaaggtccagttcactgttgccgatttttggactaagtcatttagttggctgttgtag

SEQ ID NO: 112543 - DNA, 1128 bp, Artificial Sequence
  Description of Artificial Sequence: Synthetic coding sequence
atgctccctgctgtcgggtctgtagacgaagaagaggatcctgctgaggaagactgcccagagctggtccccatcgaaaccacgcagtctgaggaggaagagaagtctggtctaggtgccaagattcctgtgacaatcatcaccggatatctcggcgctggaaaaactactcttctgaattatatactcacagagcaacacagcaaacgcgtggctgtgatcctgaacgagtccggcgagggcagtgcattagagaagagcttagccgtctctcagggcggtgaattatacgaagagtggcttgagctgcgaaacggctgtttgtgttgcagcgtgaaggataacggtctcagggctatcgagaatctaatgcagaagaagggcaagtttgatgatatccttctcgagaccaccggcttggcggacccaggtattattacaattgtggactctaagtacgggctgaaacacttgaccgaggagaagcctgacggactgattaatgaagctaccagacaggtggcccttgcagatataatcctgatcaataaaacagatctggtgcctgaagaggacgtaaagaaactacggacaacaattagatcaatcaacggccttggacaaatcttagagactcaacggtctagagtcgatctatcgaatgttcttgatttgcatgccttcgactccttatcagggatttccttacaaaaaaagttacagcacgtgcccggaacacaacctcacctggatcagtcaattgtcactataacatttgaagtccccggaaatgcaaaggaagagcacctcaacatgttcatccaaaacctcctgtgggaaaagaacgtgcgcaataaagataaccattgcatggaggtgataaggctgaagggccttgtatccataaaggacaaatctcagcaagtgatagtgcaaggagtccatgaattgtacgacctcgaggaaaccccagtttcatggaaggatgacaccgaacggacgaatcgacttgtgctgatagggcggaacctggataaggatatactcaaacagctgtttattgccacagttactgagacagaaaagcagtggacgacacattttaaggaggaccaggtctgcacctag

SEQ ID NO: 112544 - DNA, 1080 bp, Artificial Sequence
  Description of Artificial Sequence: Synthetic coding sequence
atgtacttcaagagggcccctagagcctttcccgtattgctaacgggcgctgggaagaccactctgctcaattatatactaacagaacagcattccaaaagggtcgccgtgattctcaacgagagtggagagggctccgctttggaaaaatccctggcggttagtcaaggcggcgagctgtacgaggaatggctcgagcttcgcaacggctgtctgtgttgctccgtgaaagataacggcctacgggcaatagagaatctcatgcagaagaagggcaaattcgatgatatcctgttggaaacaaccggactggctgaccctggcgccgttgcaagtatgttctgggtcgacgccgagctcggatccgacatctatctcgacggtatcataacgatcgtggacagcaaatacgggctgaagcaccttacagaagaaaaacctgacggcttgatcaacgaggccactaggcaggtcgcactggccgacatcatactcattaacaaaactgacttggtccctgaggaggatgtaaaaaagctgagaacaactattcgcagcataaatggccttgggcaaatcctcgaaactcaaagatcccgcgttgacctgtcaaacgtccttgatctgcacgcttttgattcactgagcgggatcagcctgcagaagaagctccagcacgtgcctggaacacagccgcatttagatcaatcgatagtgacaattaccttcgaggtccctggaaatgccaaggaggagcatttaaacatgttcatacaaaacctactatgggaaaaaaatgtgagaaacaaggacaatcactgcatggaggtgatccggttgaaggggttggtgtctatcaaggataagtctcagcaggtgatagtccaaggcgtgcacgaattgtatgacctggaggagacccccgtatcttggaaggacgacaccgaaaggacaaataggctggtgctgatcggcaggaatctggataaggatatccttaagcagctctttatcgctaccgttactgagactgagaaacagtggaccacccattttaaagaggaccaagtgtgcacgtag

SEQ ID NO: 112545 - DNA, 234 bp, Artificial Sequence
  Description of Artificial Sequence: Synthetic coding sequence
atgtattttaagcgcgctccccgcgcctttccagtgctcctgacgggcgccggaaaaacaacgctgcttaactatatcctgacagagcagcactcaaaaagagtagcagttattctgaacgaatccggtgaagggtccgcactggaaaagtctctggcagtgagtcaggggggagaactgtatgaagagtggctggaactcagaaatggttgcctgtgctgcagcgtgaaatag

SEQ ID NO: 112546 - DNA, 1131 bp, Artificial Sequence
  Description of Artificial Sequence: Synthetic coding sequence
atgttgccggctgtgggatcagttgatgaagaagaagaccccgctgaggaggattgtcccgaactggtcccaatagaaactacccaaagtgaggaagaggagaagtccgggctcggtgctaagatccctgtgacaatcatcaccggctatttgggcgctgggaaaacaacgctgctaaactatattctgactgagcagcattcaaaaagagtggctgttattttgaatgagtcaggtgaggggtcagctctggaaaaatccctcgccgtatcacaggggggggagctgtacgaagaatggcttgagctaaggaacgggtgtctgtgttgctcagtgaaggataatgggctgcgtgccattgaaaacctgatgcagaagaaaggaaagtttgatgacattttgctggaaacaactggactcgccgatcccggagccgtggcatctatgttctgggtagacgctgagttggggtctgacatatacttagacggcatcatcaccatcgtggactccaagtacggcttgaaacatctcacagaggaaaaaccggacggtctcatcaacgaagctactcgccaagtggctctagctgacattatcctcattaacaaaaccgatctcgtgccagaggaggatgtcaaaaagcttcggacaaccataaggtctatcaatggcctgggacaaatcctggaaactcaaagaagcagcttgcaaaagaagctccagcacgtgccgggtacccagccacacctggaccagtcaatcgtgacaataacgttcgaggtgcccggaaacgccaaagaggaacatctgaatatgtttatccagaatttactttgggagaaaaatgtgaggaacaaggacaaccactgcatggaggtaataagactaaaaggactggtgtctatcaaagacaagtcccagcaagtgattgtgcagggcgttcacgaactctacgatttggaggagactcccgtttcgtggaaagacgacaccgagcggaccaataggttagtactcattggcagaaatctggacaaggatatacttaaacaactgtttattgccactgtgacagagactgagaaacagtggaccacacacttcaaggaagaccaggtttgcacctag

SEQ ID NO: 112547 - DNA, 225 bp, Artificial Sequence
  Description of Artificial Sequence: Synthetic coding sequence
atgtacttcaaacgtgctccaagggctttccccgtgctgctaacgggcgccggcaaaacaaccctgctgaactacattctcacagagcagcactccaagagggtagcggtgattctcaacgaaagcggcgaggggagtgcccttgagaagagccttgctgttagccagggaggagagctgtatgaggaatggctcgagctgcgcaatgggtgtctctgctgttag

SEQ ID NO: 112548 - DNA, 543 bp, Artificial Sequence
  Description of Artificial Sequence: Synthetic coding sequence
atgttacccgccgtaggaagcgtcgatgaggaagaagaccccgccgaagaagactgccctgagctggtgcctattgaaactacccagtcagaggaggaagaaaaaagcggccttggagctaagatcccagttaccattattactggatatctgggcgctggcaagactaccctgttaaattatatcctgactgagcagcatagcaagagggtggccgtgatcttaaacgagagtggtgagggctcggccctggagaagtccctggcagtatctcagggtggagaactttatgaagaatggctagaactgaggaatggctgcttgtgctgctccgtgaaggacaacggcctgagggctattgagaacctgatgcagaagaaggggaagttcgatgacattctgttggagaccacgggcttggcggacccaggagccgtggcctctatgttctgggtcgatgccgagctgggaagtgatatttacttagatgggatcataaccatcgttgactcaaaatacggactgaaggtgaagtatcactag

SEQ ID NO: 112549 - DNA, 1044 bp, Artificial Sequence
  Description of Artificial Sequence: Synthetic coding sequence
atgttgcctgcagtcggaagcgtggatgaagaagaagatcctgccgaggaggattgccccgagctggtccctattgaaaccacccaaagtgaagaagaggagaaatccggcttgggggccaaaattcccgtaaccattattacaggatacctcggcgctggaaagacgaccctgctgaattacatcctcactgaacaacatagcaaaagggtcgccgttatcctcaacgaaagcggcgaaggctctgctttggaaaagtccctggcagtgagccagggtggagaattgtacgaggagtggcttgagttgagaaatggatgcctttgctgctctgtgaaggacaatggactgcgggccattgagaacctgatgcaaaagaaagggaagtttgatgatatcctgctcgaaactaccggcttggcagatcctggagcagtggcatcgatgttttgggtggatgcagaactcggcagtgatatctaccttgatggtataattactatcgtggacagtaaatacgggctgaagcatctcacagaggagaagcccgacggcctgattaacgaagcgacgcggtcaattaatggcctagggcagatcctggagacgcagcgaagcagccttcagaagaaacttcagcatgtgcctggcacacagccccatttggatcagtccatagtcaccatcacattcgaagttcctgggaatgccaaagaggagcacctgaatatgttcatccagaatctgctgtgggagaagaatgtccgcaataaagacaatcactgtatggaagtcatccgcctgaaggggctggtctcaataaaagacaagagtcagcaggtcattgtgcaaggcgtgcacgagctgtacgacctggaagagaccccagtgtcttggaaagatgatactgaaagaacaaaccggctggtgttaatcggaaggaaccttgataaggacattcttaagcagctctttatcgcaaccgtgactgaaactgagaaacagtggaccacacactttaaagaggaccaagtgtgtacctag

SEQ ID NO: 112550 - DNA, 987 bp, Artificial Sequence
  Description of Artificial Sequence: Synthetic coding sequence
atgcttggttctagggccgccggctttgcgagaggactgcgcgcagtcgcactggcctggctgcctggttggcggggtcgatcgttcgcccttgcacgcgccgcaggcgctcctcatggcggcgaccttcagccaccagcctgccccgagccgcgggggcgacagctgtcccttagcgccgcagccgtggtggacagcgctcctcgcccccttcagccttacttgcggctcatgaggctggacaagccgattggcacttggttgttatacttaccatgtacctggtcgattggcttggcggcagagcccggatgtttcccagactggtacatgctaagtctcttcgggaccggagccattctgatgaggggcgctggctgtactattaatgacatgtgggatcaagactacgacaaaaaagttactaggacagcgaacagacccattgctgccggtgacatctcgacctttcagagttttgtgtttttaggcggacagttaactcttgccttgggggttttgctttgcctgaactattatagcattgctctaggtgccggctctctcttactggttatcacatacccactgatgaaacgcatcagctattggcctcagctggctctgggcctcacgttcaattggggggcccttctgggctggagcgctatcaagggaagttgcgacccatccgtgtgtcttcctctttatttctctggcgtgatgtggacgctgatctacgacaccatttatgcccatcaggacaaaagggacgacgtcctgattgggcttaagagcacagcattgagattcggagagaataccaagccctggctttcaggtttttcggtcgcgatgctgggggccctgtctctggtgggggttaattccgggcagacagcgccttactacgcagcgcttggggccgtgggcgcccatttgacccaccagaaatggggactggagattctgcccaggctggtgtag

SEQ ID NO: 112551 - DNA, 1266 bp, Artificial Sequence
  Description of Artificial Sequence: Synthetic coding sequence
atgacccccatttcccaggtccgcatgaggaaggggagtgctcataccgctgcgcagcccggacgattgggcctacaccccgctggagcgacagcacatgcatgcagagggatgacatcaattcgggctcgccccggactcactagcgccatgctcggaagtcgcgccgcaggtttcgcccgggggctccgggccgtggctcttgcctggctgcctggctggcgaggacgatcatttgccctggccagagccgcaggcgccccccatggaggagacctgcagcccccggcctgccctgaaccacggggtcgacaactatcactatccgctgctgctgtggtggattccgcccccaggcctttgcagccctacttacggctgatgcgtctcgataagcccatagggacttggctgctgtatctcccctgtacttggtccatcgggttggccgcagagcctgggtgcttccccgactggtatatgttgtcattgttcggaaccggcgctattctgatgaggggggcaggctgtacgatcaatgacatgtgggaccaggattacgacaagaaggttactcggaccgctaatagaccgattgcagccggagatatctctactttccaatcctttgtcttcctcggaggccagctcactctggccctgggggtgcttctctgcctaaattattatagcatcgcactgggggccggatctctcctacttgtaatcacatacccactgatgaaacggatttcctattggccgcaactcgccttgggtctgacattcaattggggggcgctgttaggatggtccgcaatcaagggatcctgcgaccccagcgtatgtctccccctgtacttttcgggcgtgatgtggacactgatttatgataccatttacgcgcatcaagataagcgcgatgatgtgctgattggactgaaatcaacagccctgaggtttggcgagaacactaagccctggctgtctggtttctccgtcgcgatgctgggagcactgtccttggtaggcgtgaatagcggtcagaccgctccatattatgctgccttgggcgccgtgggggctcatctgacacatcagatttacactctcgatattcacaggcccgaagattgctggaacaagtttatatctaatcgaacacttggtctgatcgttttcctgggaatagttctaggcaatctctggaaggagaaaaagaccgacaagactaaaaaaggaatcgagaataagattgagaattag

SEQ ID NO: 112552 - DNA, 1155 bp, Artificial Sequence
  Description of Artificial Sequence: Synthetic coding sequence
atgacctcgatcagggccaggccaggcttgacaagcgcaatgcttggctcacgcgcagccggctttgccaggggtctccgggccgtagcgctcgcttggcttccaggctggcgaggtagatctttcgctttggcacgagccgccggagctccccacgggggagacttgcagccgcctgcctgccctgaacctagggggcggcaactttccctgtcagccgcagcggtggtcgattcagcgccacggccacttcagccgtacctgagactgatgcgcctggacaagcccatcgggacatggctgctgtatttgccatgcacatggtccattggcctcgcagcagagcctgggtgcttccctgactggtacatgctcagtctgttcggaacaggggccatactgatgcgcggggccggctgcaccataaacgatatgtgggaccaagactacgataaaaaagtgactcggacggctaataggcccatagccgccggagatatttccacctttcaaagctttgtgtttctcggcggacagctgaccctcgccttgggagttctgttgtgtcttaactactactccatcgcactaggggctggttccctcctgctcgtgataacatacccgctaatgaagaggatctcatactggccgcagctggctcttggcctgacctttaactggggggcgctattaggctggagcgctatcaaaggcagttgcgatccgtcagtgtgcctgccactttacttctctggagtcatgtggactctgatctacgataccatctacgcccatcaggataaacgggacgatgtgttaattggtctgaagtctactgctcttcgtttcggagagaataccaaaccgtggctcagcggctttagcgtagctatgctgggcgccctaagcctggtgggggtgaactccgggcagaccgccccatattatgccgccctgggcgccgtcggtgctcatctgactcaccagatatacacattggatatccatagacccgaggactgttggaataagtttatcagtaaccggacccttggcctgatcgtcttcctcggtatcgttttaggtaacctgtggaaggagaaaaagacggataaaacaaaaaaaggaattgaaaataaaattgaaaattag

SEQ ID NO: 112553 - DNA, 798 bp, Artificial Sequence
  Description of Artificial Sequence: Synthetic coding sequence
atggccacactgcttcggccggtattacggcgcctttgcggactccccggtctgcaacggcccgccgcggaaatgcccctgagggctcgcagtgatggcgccggaccattatacagccaccatctgcccacttcacctctccagaagggcctgctggcagcgggaagtgctgccatggcactgtataatccataccgtcatgatatggtcgccgtcctcggcgagactaccgggcaccggactcttaaggttttgcgggatcaaatgaggcgggaccccgagggcgcccagatcctacaggaacgcccccggatctcgactagtacattggacctgggaaaactacagagtctgcccgagggtagtctcggtagggaatacctgcggtttctggacgtgaaccgtgtgagtcccgatacaagggcacccaccaggttcgtagatgacgaggaactcgcctatgttatccagcgttatcgcgaagtgcatgacatgctgcatacactcttgggtatgccaacaaacattctgggggagatcgttgtgaaatggtttgaggctgttcagacagggctgcccatgtgcatcctgggcgcctttttcggtcccatccggctcggcgcccagtccctgcaggtcctcgtgtccgagctgatcccatgggctgttcagaatggccgccgcgcaccatgcgtactgaacctgtattatgagaggcgctgggagcaatcactgagagccttaagggaggagctgggaataacggcacctcctatgcatgttcagggtctggcctag

SEQ ID NO: 112554 - DNA, 456 bp, Artificial Sequence
  Description of Artificial Sequence: Synthetic coding sequence
atggccactctgctgaggcctgtgttacggaggctttgcggacttccagggttgcagcgaccagccgcggagatgccgcttcgggcccgatccgacggagctgggccactgtactcacatcacctgcctacatcaccattacagaaaggactcttggcagctgggtctgccgcaatggccctgtataacccataccgccacgatatggtggctgtgcttggcgaaaccaccggtcacagaacactgaaggtcctgcgtgatcagatgagaagagatccggagggagcccaaatactccaggaaaggccccgcatcagcacaagtacattagatttgggcaaacttcagtccctgcccgagggctctctagggagagagtatttacgatttctggatgtcaatgtaagcttccagctgctctgtatttggcagtcccccgaccgtactgaagagtag

SEQ ID NO: 112555 - DNA, 654 bp, Artificial Sequence
  Description of Artificial Sequence: Synthetic coding sequence
atgtcctgcgccggagctgcggcggccccccggctctggagacttcggcccggcgcaaggcggtccttgagtgcatatggccgacgcacctccgtgagatttcgctcctccgggatgacacttgacaatatcagccgcgccgcggtcgatcggatcattcgggtagaccatgcgggcgaatatggggcaaatcgcatttacgctgggcagatggccgtgttgggcaggactagcgtagggccagtgatccagaagatgtgggatcaggaaaaggaccatcttaagaaatttaatgaactaatggtgacatttagggtgcgacccacagtgctgatgccactgtggaatgtgctcggcttcgccctaggagccggtactgcccttctggggaaagagggggcgatggcctgtacagtggctgtagaggaatctattgcgcaccattacaataatcagatccggacgctcatggaagaagaccccgagaagtacgaggagctgctccaactgataaagaaattccgggacgaggagttggaacatcatgacattgggcttgaccacgacgccgagctggcccctgcatacgccgtgctgaaatcaatcatacaggccggttgcagggtagcaatctacctcagcgaaaggctctag

SEQ ID NO: 112556 - DNA, 540 bp, Artificial Sequence
  Description of Artificial Sequence: Synthetic coding sequence
atgactctggataatatcagcagagccgccgtggatagaattatccgagtggaccacgctggggagtacggcgcgaaccgcatatatgccggacaaatggccgtgctcggccgcacgtcggtcggacctgtgattcagaagatgtgggatcaagaaaaggaccatcttaagaagtttaatgagctgatggtcacatttcgggtccggcccaccgtcttaatgcctctttggaacgttctcggctttgcgctgggcgctggaaccgcgctattgggaaaagagggtgcaatggcctgcaccgttgcggttgaagagtcaatcgctcaccattacaataatcagattcggacgcttatggaggaggaccccgagaaatatgaagagttactgcagctcatcaaaaagttcagagacgaggagctggagcatcacgatataggcctcgatcacgatgcagagctagcacctgcgtatgcagttcttaaatcaatcattcaagcgggctgtcgggtggccatctacctttccgagcgactgtag

SEQ ID NO: 112557 - DNA, 957 bp, Artificial Sequence
  Description of Artificial Sequence: Synthetic coding sequence
atggccgccgccgcagtatccggagccctgggtcgcgccggatggcgtctgctacagctgaggtgtctacccgttgctaggtgccggcaggccttagttcccagagcctttcacgcaagtgccgtgggactgagatcctcggacgagcagaaacagcagccccccaactctttctcacagcagcactccgaaacacagggggctgaaaagcccgaccctgaatcgtcacactcccccccgcgatatacagatcaaggaggagaagaagaggaggactatgagagtgaagagcagctccaacacagaatcttgaccgccgcactggaatttgttcccgcccatggctggaccgcggaggctatcgctgaaggtgcccagtccctcggcctctcctcagctgcggccagcatgtttggaaaggatgggtctgagctcattctccactttgtgacacaatgcaatactcggttaactcgagtgttggaggaagaacaaaaacttgtgcagctggggcaggctgaaaaacgcaagactgaccagttcctgcgcgatgcggtggaaacacggctcaggatgttgattccttacatcgagcactggccacgcgcactcagtattctcatgctgccccacaatattccaagttcactgagcctcctcacgagtatggtcgacgacatgtggcattacgcaggtgaccaatccacagactttaactggtacacaagacgtgcaatgctcgccgctatttacaacactaccgaactcgtcatgatgcaggatagtagccccgacttcgaggacacgtggcgctttttagagaatcgagtgaatgatgcgatgaatatgggtcacactgcgaagcaggtgaagtccacaggagaagctttagtgcagggccttatgggggccgcggtcactctaaagaatttgacgggtctgaaccagaggagatag

SEQ ID NO: 112558 - DNA, 1743 bp, Artificial Sequence
  Description of Artificial Sequence: Synthetic coding sequence
atgttcgctgggttacaggatctcggtgtggctaatggcgaggacttaaaggagacgctaacaaattgcacagaaccactaaaagcaattgagcaatttcaaaccgagaatggcgtattactgccgagtctacagtcagccttacccttcctggacctgcacgggacacccaggctcgagtttcaccaatctgtgtttgacgagctgagagataagttgcttgagcgggttagcgcgatcgcctcagaggggaaggctgaagaacggtataaaaagttggaggatctactcgaaaaatcattttctttggtcaagatgcccagcctgcagcccgttgtgatgtgcgtcatgaaacatctgcccaaagtgccagaaaaaaaattgaaactggtgatggctgacaaagagttataccgggcctgcgccgtggaagtgaaacgccaaatttggcaggataatcaagcgctcttcggtgacgaagtctctccccttttgaagcagtatatccttgagaaggagagcgctcttttcagcaccgagcttagcgtcctccataactttttcagcccttctccaaaaacccggaggcagggtgaagtagttcagcgcttgacccggatggtcggtaaaaacgtcaagctatatgacatggtgctgcaatttctgcgtaccctgtttctgcgcacaagaaacgtgcattactgcactctgcgggccgaattgttgatgtctctgcacgatttagatgtaggtgagatttgcactgtcgacccctgccacaagttcacctggtgtctggatgcatgtatccgggaacgcttcgtagattctaaacgagctagagaactccaaggttttctcgatggcgtcaagaagggccaggagcaggtgttaggagatctatcaatgatactgtgcgatccttttgccattaacactttggcattaagcactgtaaggcatctacaagagctggtgggtcaggaaactttgccccgtgatagcccagacctgctgctcctgctgcgccttctggcactgggccagggtgcatgggacatgatcgacagccaagtgtttaaagagcccaagatggaagtggaactgattacacggtttttgccaatgctcatgtcttttctggtcgacgactataccttcaacgtagaccaaaaactgcctgccgaggagaaggcaccagtttcataccctaacacgcttccggagtcttttaccaaattcctgcaggaacagaggatggcctgtgaagtgggcctgtactatgtgctccatatcactaaacaaagaaacaaaaacgcgctgctgcgcttactgcctggcttagtggaaacttttggcgatctggcattcggcgatatctttctacacctccttactggcaatctggctctgctggccgatgaatttgctctggaggacttttgttccagtctgtttgatggcttcttcctgactgccagcccaaggaaagagaacgtgcatcgacacgccttaagattattgatccatctccacccccgggtagcaccatccaagctggaggctttgcagaaggccttggagcccacaggacagtccggcgaggccgtcaaggagctgtactcacaactgggcgaaaaattggaacagcttgatcacagaaagccatcccctgctcaggcagccgagacccctgcattggaactgcctctccctagcgtccccgcgcctgcgccgctgtag

SEQ ID NO: 112559 - DNA, 501 bp, Artificial Sequence
  Description of Artificial Sequence: Synthetic coding sequence
atggcctccggtgtaaccgttaacgatgaggtgatcaaggtgttcaatgacatgaaagtacggaaatcatccacgcaggaggaaattaagaaaaggaagaaagcagttcttttttgtctctcagacgataaacgacagatcatagtggaagaagctaagcaaattctggtcggggatattggcgacactgtggaggacccatacacaagcttcgtaaagctccttcccctcaacgactgtcgttatgccttgtacgatgccacttacgaaacaaaagaaagtaagaaagaggatcttgtgtttattttctgggccccggaatccgcccccttgaagtcaaaaatgatttatgcttcaagtaaggatgcgatcaagaagaaatttacggggatcaagcacgagtggcaggtgaatggccttgatgacattaaggacagaagtacgctcggtgagaagctgggaggaaatgttgtggtatctttggagggaaagccgctctag

SEQ ID NO: 112560 - DNA, 501 bp, Artificial Sequence
  Description of Artificial Sequence: Synthetic coding sequence
atggcttccggagtgacagtgaatgatgaagtgattaaggtgtttaacgacatgaaagttcgaaaaagctccactcaggaagagattaagaagcggaagaaggccgtcctgttttgtctgtctgatgacaaacggcagatcatagtggaggaggccaaacagatcctagtcggggatatcggggatactgttgaggacccctatacttctttcgtcaagctgctgcctctcaatgactgtaggtacgcactgtatgatgctacttacgagacgaaggagtcaaagaaggaggacttggtgtttattttttgggcccctgaaagcgcccctctcaagtctaaaatgatatacgcctctagtaaggacgcaatcaagaaaaagtttacaggcataaagcacgaatggcaggtcaacggcttagacgatatcaaggatcgaagtactctgggcgaaaagctcggtggaaatgtggtggtcagcctcgagggcaaacccctctag

SEQ ID NO: 112561 - DNA, 1722 bp, Artificial Sequence
  Description of Artificial Sequence: Synthetic coding sequence
atgagaaggtacgatagaggcttaaaaaccctcgagaacctgttagcaagcatccgaaagggaaatgccatagacgaggcagatatcccccctcccgtggccatcggcaaaggtcctgcttcaactcccacatactcaccagcccctacgcaacctgcaccgcgaatagcatccgccccagaaccgagagtgactctggaaggaccaagtgcaaccgcccccgcatcaagtcctggcctggcaaaaccgcagatgccccctgggccatgctcacccggacctctggcccagttacagtccagacagcgggactacaaactggctgcattgcacgccaaacaacaacagctggcttttttggaagggcgcaagaaacagctcctccaggctgcgctgagagctaaacagaaaaatgacgttgaaggagcgaagatgcatttgcgacaggccaagggcctggagccaatgcttgaagcatctcgcaatggcctgcccgtggacataacgaaggtacctccagcccccgttaacaaagatgatttcgccttggtccagaggcccggccccggtctctcccaggaagcagcccgtaggtacggagaacttacaaagctaatcagacagcagcacgaaatgtgtctcaatcatagcaaccagttcacccaacttggcaatattacagagaccacgaaattcgaaaaattggccgaagattgcaaacggtcgatggatatcctgaaacaagctttcgtgcgaggcttgccaactcctactgcccggttcgaacagagaaccttttccgtaataaagatattcccagacctgagttcgaatgatatgttactttttatcgtgaaagggatcaacctgcccactccaccgggtctgtcacccggcgacctggatgtgtttgttcgtttcgacttcccttaccctaatgttgaggaagctcagaaagataagacatctgtgatcaagaacacagattcacccgagtttaaggagcagtttaagctgtgtatcaatcggtctcacagaggcttcagacgagccatacagaccaagggcatcaaattcgaggttgtgcataaaggcgggctgtttaagacagatcgggtactggggactgctcaactgaagctggacgccctagaaatcgcatgcgaagtaagagagatcttggaagtgctggacggcagaaggcctaccggcggccgactggaagtgatggtgcgaatccgggagcctctgacggcacaacagctggagactactaccgagcgttggctcgtgattgatcctgtcccagcagctgtccccacggtggctggcccaaaaggcaaggcgccccccgtacccgctccagccagggaaagcggaaatagatctgcacgacccctgcacagcctgagtgtgctcgccttcgatcaagagcgccttgaacggaaaatcctcgcactccgccaggcccggcggccagtgccacccgaggttgcgcaacagtatcaggatatcatgcagaggtcacagtggcagagagcacagcttgagcagggaggagtgggcattagaagggagtatgctgcccagttagagaggcaattacagttttatactgaagctgcacggcggcttgggaatgatggatctcgcgatgccgcgaaagaggctctgtatcgacggaatcttgtggagagcgagctgcagcggcttcggagatag

SEQ ID NO: 112562 - DNA, 2856 bp, Artificial Sequence
  Description of Artificial Sequence: Synthetic coding sequence
atgcacaagcggaagggtcctccgggaccgccagggcgaggagcggcagcagcacgacagctgggattactggtcgacctgtcacccgacggcctgatgattcctgaagacggtgccaacgatgaggagctggaggctgaattcctggcactggtgggaggccaaccccctgcgctggagaaactcaaagggaagggccccctgcccatggaagccatcgagaagatggcctcactgtgtatgagagacccagacgaagacgaagaggagggaaccgacgaagatgacctggaggccgacgacgacctgctggcggagctgaatgaggttttaggtgaggagcagaaggccagcgaaaccccacctcccgtagcccaaccgaaacccgaggcaccccatcccgggttagaaaccacattacaagagcggctggccttataccagacggcaatcgagagcgcgcggcaagcgggagatagtgcgaagatgcgccgctatgatcgtggcctcaaaactctcgaaaacttgctggcaagcatccgtaagggaaacgcaatcgacgaggccgacatacctccccctgtggcaattggaaagggtcccgcaagcacccccacctatagccccgctcccactcagccggccccgagaatcgcatctgcacctgaaccccgtgtcacattggaaggacctagcgcgaccgcgcctgctagctcgcccggcttggccaagccccaaatgccacccggaccgtgcagtccaggccctctggcacagttacagagcaggcagcgggattacaaactggccgccttgcatgctaaacagcagggggatactaccgcagctgctcggcatttcagagtggcgaaatcattcgatgccgttctggaggccctctctcgcggggaaccggtggacttgagctgcctgcccccgccacccgatcagctgccccccgaccctccatccccccccagtcagcctccgacaccagctacagccccttcgaccaccgaagtccctccgcccccacgtaccctcctggaggccctggagcaaaggatggagcggtatcaagtggccgccgcacaggccaagtctaaaggtgaccagcgaaaggcacggatgcacgaacggatcgtaaaacagtatcaagacgccataagagctcataaggcaggtcgggcagtggacgttgccgagctgccagtaccccctggctttccccctatccagggactggaggccacaaaacctacccagcaaagcttggtaggggtccttgaaacggctatgaagctggccaatcaggacgagggcccagaagacgaagaggacgaggtcccgaagaagcagaattcacccgtcgcccccacagcccagccaaaggcgcccccgtccaggaccccccagagcggctccgcacccaccgctaaggcacctccaaaggccacgagcacccgggcccaacaacaactggccttcttggaaggtagaaagaagcaactgctgcaggccgcactgcgggctaaacagaagaacgacgttgaaggtgcaaagatgcatctaagacaagccaaagggcttgaaccaatgctggaggccagcaggaatgggctgcctgtggacattaccaaagtcccacctgcaccagtcaataaggacgattttgcccttgttcagcgacctggcccgggcttaagtcaagaggccgcccggcggtacggcgaattgacaaaattgatccggcagcagcacgagatgtgcctgaaccactcgaatcagtttacccagctgggtaatatcacagaaacaacgaagtttgaaaaactggctgaggactgtaagaggagcatggatatattgaagcaggcttttgtgaggggactgcccacgccaacggctcggttcgagcagaggactttttcagtcatcaaaatcttccctgacttgtcgagcaacgacatgctgctttttatagtgaaggggattaacctaccgactccacctggcttgtcacctggtgacctggacgtctttgtgaggtttgacttcccatacccgaacgtcgaagaggcgcagaaagataaaacctccgtcatcaagaatactgacagccccgaatttaaggaacaattcaaactgtgtatcaataggtctcaccgaggatttcgccgggcgatacaaactaaggggattaaatttgaagttgtgcacaaggggggcttgtttaagacagatagagtcctgggtacagcccaattgaagctcgacgcccttgagatcgcatgtgaggtccgcgagattctcgaggtgctagatgggaggaggccaaccggagggaggttagaggtgatggtacggattcgtgaaccactcacggcgcagcagctagagacgacgacggaacggtggttggttatcgaccccgtccctgccgcagtgcctacccaggtggccggcccaaaggggaaggcccccccggtgcccgcccccgcacgcgagtctggaaaccgcagtgcccggccattgcatagtctgtctgtgttggcctttgatcaggagcggctcgaacggaaaatactggctcttagacaagcgagaaggccagtgcctcccgaggtagcccaacagtatcaggatattatgcagcgatctcaatggcagcgggctcagctcgagcaaggaggcgtgggtattaggagggagtacgcggcacagctcgagcgacagctgcagttctacacagaggccgcccggcgactgggcaatgatgggtcccgcgatgccgccaaggaggcactgtatagacggaaccttgtggagtcggagctgcagagactgcgaaggtag

SEQ ID NO: 112563 - DNA, 711 bp, Artificial Sequence
  Description of Artificial Sequence: Synthetic coding sequence
tggcactctcctgacggcctcatgattccagaagacggcgcgaatgatgaggaactcgaagcagaattcctagcattggtgggaggacaacctcctgcgctagagaaactcaaagggaagggaccactgcctatggaggcaatcgagaagatggccagcctgtgtatgcgggaccccgatgaggacgaggaagaggggacagacgaggacgacctcgaggcagatgatgacctcctggccgagctgaacgaagtgctgggagaggaacagaaggcatctgaaactcctccacctgtggctcaaccaaagccggaggctccacatcctgggttagaaacaacgcttcaggaacgcctcgcgttataccagacagctatagagagtgccaggcaggccggtgactcagcaaaaatgcgtcgatacgacagaggtctcaagaccctggaaaatctcctggcatccattcggaaggggaatgctattgatgaggccgatatacccccaccagtagcgataggtaagggccctgcatctacccccacttattcccccgctcctacccagccagctccacgcattgcctctgcacctgagcctagagttactctcgaaggacccagtgctaccgccccggccagtagtcctggccttgccaaaccacaaatgcctcccgggccctgttccccaggtccgctggcccagctgcagtag

SEQ ID NO: 112564 - DNA, 1116 bp, Artificial Sequence
  Description of Artificial Sequence: Synthetic coding sequence
atgccccccggtccatgctctcctgggcctctagcacagttacagagtcgacaaagagactataaactcgcggctttgcacgccaagcagcagggcgacacaaccgccgctgctcgtcacttccgcgtagcaaaaagctttgatgcggttctggaggcactaagtcgtggagagccagtcgacctttcctgtctcccgccgccccctgatcagctgcccccagaccccccaagcccccccagtcagcccccaactcccgccaccgccccaagtacaaccgaagtccctccccctcccagaactctgctggaggctctcgaacaaaggatggagcgctaccaggttgccgccgcccaagccaaaagtaagggcgaccagcgcaaggccagaatgcatgagaggattgtgaagcagtatcaagacgccattagggcacataaagctgggagggctgttgatgtggctgaactgcccgtgccaccaggcttcccaccaattcaggggctggaagctaccaagccgacccaacagtctttagttggggttctggagacagcgatgaaattggccaaccaggatgaaggcccagaggatgaagaagatgaggtccctaagaagcagaattctcccgtggctcctactgcacaaccaaaagcccctccaagtcgcacgcctcagtcaggctctgcacccaccgctaaagcaccacccaaggccaccagtactcgggcccagcaacagctcgccttcctggaaggaaggaaaaagcagttgctgcaggcagccctgcgagcaaagcaaaagaacgatgttgagggggcgaagatgcacttaaggcaggccaaaggcctcgagccaatgctggaggcctccagaaacgggctaccagtggatatcacaaaggtgcctccagccccggtcaacaaggacgactttgccctggtgcagcgcccaggtccaggcctgtcccaagaagcagctagacgctatggggagttgacaaaactgattcgtcaacagcatgagatgtgtctgaatcatagtaaccagttcacgcagttaggcaatatcaccgaaaccactaaagcaaacatggtgaagccatgcttctactag

SEQ ID NO: 112565 - DNA, 4539 bp, Artificial Sequence
  Description of Artificial Sequence: Synthetic coding sequence
atggttagcgaaaagtcccacttggggaatccgcaggagccagtgcaagaagagccgaaaacaaggctcctgagcatgacagtccgcagggggcctcgctcacttccgcctatacctagtactagtagaaccgggtttgctgagttttccatgagaggcagaatgcgggagaaattgcaagctgctcggagtaaggcggagtctgcactgcttcaggaaattcctaccccaaggccacggcgcctgcgttctccctcaaagaaagagttggaaaccgaattcggcactgagcccggcaaggaggttgagcggactcaacaggaagttgactcccagagctattcacgtgttaagttccacgattcagcgcgtaagataaagcccaagccacaagtgcccccaggcttcccaagcgcagaggaggcatataactttttcacttttaactttgaccctgagccggaggggagcgaagaaaagcctaaggcccgacacagggccggaaccaaccaagaggaggaagagggggaagaagaggagccaccagcccagggaggaggtaaggaaatggatgaggaagagctgcttaatggggatgatgccgaggactttctgcttggcctcgatcatgtcgccgacgactttgtcgccgtacgtcccgctgactatgagagtatccacgatcgactacaaatggagcgggaaatgctctttattccctctagacagaccgtcccaacctacaagaaattacccgagaacgtgcagccccggttcctggaagacgagggactgtacaccggagttagaccagaggttgctaggacaaaccagaatattatggaaaatcgcctgctgatgcaggacccagaaagaaggtggttcggcgatgatggccgcattctcgctctcccaaaccctataaagccatttccttcaaggccacccgtgctaactcaagagcagtctattaaggccgagctggagacactgtataagaaggctgttaaatacgtccacagttcccagcacgtgataaggtctggcgaccctcctggaaactttcagctggacatagacattagcgggctgatcttcacacatcacccctgcttctctagagagcatgttcttgctgcaaaattggcccaactgtacgatcagtacctggcccggcaccagcgaaacaaggctaagtttctgaccgacaagctgcaggcgctgcgaaatgccgtccagactggccttgatcctgagaaacctcaccaatctctggatactattcaaaagaccattaacgagtacaaatcagagatcaggcagacaagaaaattcagggacgcagagcaggagaaggacagaacactgctgaagaccataatcaaggtttggaaagaaatgaagtcactgcgcgagttccaacgcttcaccaacacccccctcaaactcgttctgcggaaggagaaagctgaccagaaggccgacgaggaggcctacgaagctgagattcaggccgaaatttctgagctcctagaggagcacaccgaggagtacgcacagaagatggaagaatataggacatctctgcagcagtggaaggcctggcgcaaagttcaacgcgccaagaagaaaaagagaaaacaggccgctgaggaacacccaggggacgaaatcgccgagccttacccagaggaggaccttgtgaaaccttctccacccgaacctacggacagagccgtaattgagcaggaggtgcgcgagcgagctgcacagagtaggaggcgcccttgggaacctacactggtgcctgaactgtctcttgcaggatcagtgaccccaaatgatcagtgccccagagccgaagtgagccgtagggaagatgtgaaaaagcgctctgtgtatctgaaagtcctgtttaataacaaggaggtaagccggactgtcagccggcctctgggcgccgatttccgcgtccatttcggccaaatcttcaatctgcagattgtcaattggcctgaaagtctcacgctgcaggtgtatgagactgtggggcactcttctcccacactgctcgctgaagttttccttccaataccagagacaaccgtggtgactgggcgcgctcccaccgaggaagttgaattctccagcaatcagcatgtaactctcgatcacgagggagtgggctctggagttccatttagcttcgaggcggacggcagtaaccaattgactctcatgactagcggaaaagtcagccattccgtggcatgggcaattggcgagaacggaattccgttgataccacccctgagccagcagaacatcggtttcaggtccgccctcaagaaggctgacgccatctcgtccattgggacatccggtctcacagatatgaaaaagctcgcgaagtgggccgctgagagcaaactggaccccaacgatccaaataacgcccccctcatgcagctgatatcagtcgcgacgtcgggtgagagttatgttcctgatttcttccggttggagcagctgcagcaggagttcaactttgtctcagatcaagagcttaacagaagtaaaagatttaggctcctgcacttgcgctctcaggaagtccccgagtttaggaactataaacaggtgcctgtgtacgatcgtgaaatcatggaaaaggtgtttcaggactacgagaagcgccttcgtgaccgcaatgttatagaaaccaaggaacatatagatacccaccgtgctatagtggctaaatacctgcaacaggtgagagaatctgtcataaaccggtttctcatcgctaagcagtatttcctgctggcggatatgatcgtggaggaggaggtgccaaacatcagtattctggggctcagcctgttcaaacttgccgaacagaagagaccccttagacctaggcggaaagggcgcaagaaagtgacagctcaaaacctctctgatggagacatcaagctgctggtcaatatcgtcagggcatacgatatcccggtccgaaagcccgccgtgagcaaattccagcagccgagccgatctagccggatgttctcagaaaaacacgctgcaagcccatcaacctatagtcccactcacaacgccgattaccccctcggccaggtgctcgtgcggccttttgtggaagtaagtttccagcggaccgtatgtcacactacgacagcagaagggcccaaccccagctggaatgaggaattagagcttcccttcagggcaccaaacggagactattctactgcttccctccagtccgttaaggatgtggtgtttattaatattttcgatgaggtgctgcacgatgtgctcgaggatgatcgcgagagagggtccgggatacatacaagaatcgaacggcactggttaggctgtgtcaaaatgccgtttagcacaatatactttcaggcgcggttcgagtcccaggaagacgagaaattgttgcaggcaactgagaagtttcaagccgagtgcgcactgaagttccctaatcgccagtgtttaacaacagtgattgacatttccggcaagaccgtgttcataactcggtatctaaagcctttgaatcccccacaagaactgcttaacgtctacccgaacaacttgcaggccactgctgaactggtggcgcggtatgtttctctgataccgttcttgccagacaccgtgtcctttggcggcatttgcgacctctggagtacttctgaccaattcctcgatctgcttgcaggggacgaagaggagcatgcagttctgctctgcaattattttctctccctgggcaaaaaagcatggcttctcatgggaaatgctattcccgagggacccacagcctacgtcctcacgtgggaacaggggcgttatctgatttggaatccctgctcggggcacttttacggccagtttgacactttctgcccattgaagaatgtgggctgcttgatcggccccgataacatttggttcaatattcaacgttatgaaagtcccttacgtatcaatttcgacgtaacacgtcctaaactatggaagagcttcttctccaggagcctgccatacccaggattgagcagcgttcagcctgaagagctgatctatcagcgctcagacaaagcggcagcggccgagctgcaggatcggattgagaagatcttaaaagagaagatcatggattggaggcctcgacaccttactcgctggaataggtattgcacttctaccctacggcactttctcccccttcttgagaaatctcaaggagaggatgtggaggacgatcaccgtgcagagctcttaaaacagctcggggactatcgcttctctggatttcccctgcacatgccttatagcgaagtaaagcctttgatagacgcagtgtactccaccggggtgcacaatattgacgtccctaacgtggagttcgccctggccgtatatatccacccttatccgaaaaacgttctgtctgtgtggatctacgtcgccagtctcattcgaaaccgatag

SEQ ID NO: 112566 - DNA, 4863 bp, Artificial Sequence
  Description of Artificial Sequence: Synthetic coding sequence
atgaacccacgggaggagaaagtgaagatcatcaccgaggaatttatcgagaacgacgaagacgcagacatgggacgacagaacaaaaatagcaaagtaagaaggcagccacggaaaaagcagccccccacggcggtaccaaaagagatggtgtcagagaagagtcatctcggtaatccgcaggaacctgtgcaggaggagccaaagaccagacttctttcaatgaccgtgcggcggggcccccgaagcctcccgcctatccccagtacctcacgtactggctttgctgaattctcaatgcgggggaggatgcgcgagaagttacaagccgcaagatctaaggcagagtcagccctcctccaagagatccctaccccacgacctcgtcgcttgcggtcaccctctaagaaggaactcgagaccgagttcgggaccgagccaggtaaagaagtggagcggacccagcaggaggtcgattcgcaaagttatagtagggttaaatttcatgactcggccagaaaaatcaagcctaagccccaggtccctcccggttttccatcagcagaggaagcttacaatttcttcactttcaattttgaccccgagcctgaaggtagcgaggagaagccaaaggctaggcacagggcaggtaccaaccaggaagaagaagagggcgaagaggaggaaccgccagcccagggaggtggcaaggagatggatgaggaggaacttcttaacggcgatgacgccgaggatttcctcttgggactggaccacgtcgcggatgattttgtggctgtgcggcccgcagattatgagagcatccacgataggctccaaatggaacgggagatgctgtttatcccatcgaggcagacagtgcccacctacaaaaagctgccggaaaatgtccaacctcggtttttggaggacgaaggcctgtatacaggtgtacgacctgaggtggcgcgcactaaccagaatatcatggagaatcgactgctaatgcaggacccagaaagaagatggtttggcgatgacggacgcattctggcactcccgaatcccatcaaaccatttccttctaggcctcccgtgctgactcaggagcaaagcatcaaggccgagctcgagaccttgtataagaaagctgtcaagtacgtccactcatcacaacatgtgataaggagcggcgacccccccggcaactttcagctcgatatcgacatttcagggttaatcttcacccatcacccctgcttcagccgagaacatgtgctggccgcaaagctggcacagttatacgatcagtacttagccaggcaccagcggaataaggcaaagttcctgaccgataaacttcaggcattgcgtaatgcggtccagactggactggatcccgaaaaaccgcatcagtctctcgataccattcaaaagacgataaatgaatacaagtcagagatacgtcagacaaggaaatttagagacgctgaacaggagaaagatcggaccttgctgaaaacaatcatcaaagtttggaaggagatgaagagcctcagggaatttcagcgctttactaacacaccactcaaactggtgttgcggaaggaaaaggcggaccaaaaggccgacgaggaagcttatgaagctgagattcaggctgagatatccgaattgttagaagaacacacagaggaatatgcgcagaaaatggaggagtataggacttctctccagcaatggaaagcttggaggaaggttcagcgcgccaaaaaaaaaaaaaggaagcaagccgcagaggaacaccccggtgacgaaattgctgagccctacccagaagaagacctcgtaaagccctccccccccgagccaactgaccgagccgtcatagagcaggaggtgcgagagcgtgccgcccagtcccgacgtcggccttgggaacccacactggttccggagctctccttggccggaagcgtgaccccgaatgaccagtgcccaagagccgaagtgtcccggcgagaggacgttaagaagaggagtgtctatctgaaagtgctgttcaataacaaggaagtaagcagaaccgtctctcgtccactcggggctgatttccgcgtccactttggtcagatctttaacctgcaaatcgtcaactggcccgagagcctgacgctgcaggtttatgagacggtgggccattcctcgcctaccctgctggcagaggtgtttctgcctattccagaaacgacagtcgtgactggaagagctccaacggaagaggtggagttcagctcgaatcagcacgtgacactcgatcatgagggcgtggggtcaggcgttcccttttcctttgaagccgacggctcaaaccaacttacgttgatgacctccgggaaagtgtcacacagcgtggcatgggcgataggggagaatggcattcccctgattccccctctgtcccagcagaacattggatttaggtccgcccttaagaaggctgatgccatctcctccatcggcacctccggtctaacggacatgaaaaagctggccaagtgggcggcggagtcgaagctggatcccaacgaccccaacaacgcccctttgatgcagctgatcagcgtggctactagcggcgaaagttatgtaccagatttctttagacttgagcagctgcaacaggagttcaactttgtaagcgaccaggagttaaacaggagcaagcggttcagactcctgcacttgagaagtcaggaggtgcctgagttcagaaactataagcaggttcctgtgtatgacagggagatcatggagaaggtcttccaggattatgaaaaacgcctgcgcgacaggaacgttattgagacaaaagagcatattgatacccaccgggctatcgtcgctaagtatctccagcaggtccgggagtccgtgatcaataggtttctgatcgctaagcagtacttcctactggcagacatgatcgtcgaggaggaagtgccaaatatctccattctgggactgagcctctttaagctcgccgaacagaaaagacccctaaggccacggagaaagggacgaaagaaggtgaccgcccagaatctgtccgacggcgacatcaagctccttgtgaacattgtaagggcatatgacattcccgttcggaagcccgcagtcagcaagttccagcagccttccaggtcctccaggatgttcagcgagaagcacgctgcctcgcctagcacatacagccccacacataacgcagattatcccctgggacaggtgctggtacggcccttcgtggaggtctctttccagcgcaccgtctgtcatactacgactgccgagggacccaatccttcttggaatgaagagttggaactgcccttcagagcaccaaacggtgactattcaacagcctctctgcagagcgtcaaagacgtagtgtttattaatatttttgatgaagtgctgcacgacgtgttggaggacgatcgggaaagggggtccggcatccatacacgaattgaaagacactggctggggtgtgtaaaaatgccatttagtacaatttactttcaagctcgcatcgatggcacgttcaagatcgacatacctcctgtgcttctgggctatagcaaggagcggaacatgatcctggagcggggttttgattcagtgagatctttgtccgagggctcatatattacactcttcatcaccatcgagccgcagctggtgcccggggagagcattcgggagaaatttgagagtcaagaagacgagaagctattgcaggccactgaaaaattccaagccgaatgcgctttgaagtttccaaataggcagtgtctgacgacagtgattgacatcagcggcaagactgtgtttatcacccgctatctaaaacccttaaaccctccccaagagcttttaaacgtgtacccaaacaacttacaagctacggcagagctcgtcgcgcggtatgtatcattgattccattcctccccgacactgtctccttcggcgggatatgtgacttgtggtcaacctccgatcaatttcttgacctgctcgcgggggatgaagaagagcacgctgtcctgctgtgtaattacttcctgtcattgggaaaaaaggcatggttactcatgggcaacgctattccggaaggaccaaccgcttacgtccttacctgggagcagggccgatatctgatctggaatccgtgtagcggccacttctacggccagttcgacaccttctgccctctgaagaatgtcggatgtctgatcgggcccgacaatatctggtttaacatccagcgctacgagtcccctctgcgaattaacttcgacgtgacgcgtcccaaactgtggaagtccttctttagtaggagccttccatatccaggcttatcatcggtccaacccgaggaactcatttaccagaggagcgacaaagcagccgccgcggaacttcaggacagaatcgaaaaaattttgaaggagaaaattatggattggagaccacggcatctgacccgctggaatcgctattgcacatcaacccttcgacatttcctacccctcctggagaaaagccagggcgaggacgtagaagatgaccacagagctgagcttctaaaacagttgggggactataggttttccggttttccactgcatatgccctattcagaagtgaaacctctgatcgatgctgtctactctactggtgtgcacaatatcgacgtaccaaacgtggagtttgccttggcggtgtacatccacccatatcctaaaaatgttcttagcgtgtggatatacgtcgccagcttgatcagaaaccgttag

SEQ ID NO: 112567 - DNA, 4863 bp, Artificial Sequence
  Description of Artificial Sequence: Synthetic coding sequence
atgaaccctcgggaggagaaagttaaaattataacagaagagtttatcgaaaatgatgaggacgcagatatgggccggcagaacaaaaactccaaagtgaggcgccagccccgcaagaagcagccgcccactgccgtgcccaaggagatggtttccgagaaaagccacctgggaaacccccaagaaccagtgcaggaagaaccaaagacaagactgctttcgatgacagtgcgaaggggcccccggtccttacctcctatcccaagtaccagccgcaccgggttcgccgagttctccatgcgtggaaggatgcgggaaaagttgcaagccgccaggtccaaggctgagtctgcactacttcaggagatcccaacacctcgaccacgacgcctgcgatccccgagcaaaaaagagctagagaccgagtttggtactgaacccggcaaggaggttgaacgcacgcagcaggaggtggactctcagtcttactccagggtgaagtttcacgatagcgctcgcaaaataaaaccaaagcctcaagtgccgccgggtttccctagtgccgaggaagcttacaatttttttacctttaattttgaccccgagccagagggtagtgaagagaaaccaaaggctcggcatcgtgcaggcactaaccaggaagaagaggagggggaagaagaagagcctcctgcacagggaggagggaaggaaatggacgaagaggagctcctcaacggtgatgatgcggaggacttcctgctgggccttgaccacgtggccgatgactttgtagctgtacggccagcagattatgaatcaattcacgaccgcttgcagatggagcgggagatgctctttatcccatcgaggcagactgtgcctacctacaaaaagttaccagagaacgtacagcctaggtttctagaggacgagggtttgtacacaggagtccgcccagaagtggcacgtacaaatcaaaacatcatggaaaacaggttactgatgcaggatccagagcgacgttggtttggcgatgacggtcgtatcctggctttgcctaatccgatcaagcctttcccaagccgcccaccagtgttgacccaggagcagtctatcaaggcggagcttgagacgctgtataaaaaggctgtcaagtacgtgcactcatcccagcacgtcatccgttctggcgatccccccggcaatttccaacttgacatcgatattagcggtctgatttttacacaccatccctgtttcagcagagagcacgtcttggctgcaaaattggcccagctgtatgaccagtacctggcacgccaccagcgaaataaggccaagtttctaaccgacaagctccaagccctgcgcaatgccgttcaaaccgggttggacccagagaaaccccatcagtccctggataccattcagaagaccatcaacgaatacaagtccgagattagacagaccaggaaattccgggatgcggaacaggagaaggacagaactcttctgaaaacgattatcaaagtgtggaaggagatgaagtctttgagagaatttcagcgcttcactaatacccctctgaagttggttttaagaaaagagaaagccgaccagaaggctgacgaggaagcctacgaggcagagatacaggccgagatctccgagcttttagaggaacacaccgaagaatacgcacaaaagatggaagaatatcggacatctttacagcagtggaaggcttggcgaaaggtacagcgagcaaagaaaaaaaaaagaaagcaggccgcagaggaacatccaggcgacgaaattgccgagccctacccggaagaggacctcgtgaaaccttcccccccagaacctaccgatcgggcagtcattgagcaggaagtccgtgaacgcgctgcacagtccagaaggaggccatgggaacctacactggtgccggaactgtccctggccggaagcgtgacaccaaatgaccagtgccctagggcagaagtgtctcgtcgcgaagacgtgaagaaacgctctgtctacctgaaagtgcttttcaataacaaagaggtcagccggacagttagtcggccattgggagctgattttagagtccatttcgggcagatatttaatttacagattgtgaactggcccgagagtctgaccctccaggtgtacgaaaccgttggacactcctctcccaccctgctcgctgaggtgttcctccccatcccggaaacgaccgtggtaacaggaagggcgcccactgaagaggtggaattttcttctaaccagcacgtcacccttgatcacgaaggcgtcggaagcggggtccctttttcttttgaagcggatgggtctaatcagcttaccctcatgaccagtggcaaagtgagtcactcagtggcttgggctattggtgagaacggtattcctctaatacccccgttgtctcagcagaacatcggcttccgtagcgctttaaaaaaagccgacgccataagcagtatcggcacctccggattgacagacatgaagaaactggctaaatgggctgctgaatccaaactggacccaaatgatcctaataacgctccactaatgcagcttatctcagtcgcaacaagtggggagtcttatgtgcctgatttcttccgcttggaacagctgcagcaggaattcaactttgtgagcgatcaggaactgaatcgctcaaagcgcttcagactgcttcacctgcggtctcaggaggttccggaattccgcaattacaagcaggtgccggtttatgatagggaaatcatggaaaaagtcttccaggactacgaaaagagattgcgggaccggaatgtgatcgaaaccaaagagcacattgacactcatcgtgctattgtggccaaatatctacagcaggtcagagaaagtgtcattaatcgctttcttattgccaagcaatactttcttttggcggatatgattgtggaggaggaggtccctaacatcagcatcctgggcttgtccctgtttaagttagccgaacagaagaggcccctccgccctcgcaggaaaggacgaaaaaaagtgactgcccagaacttgagcgacggcgacattaaactcctcgttaatatcgtgagggcctacgatatccctgtgcgcaaaccggcggtcagcaagtttcaacagccttctcgttccagcagaatgttttccgagaagcatgccgcgtctccatccacatactcccccacccacaacgccgactatcctctcgggcaagtgctggtgcgcccctttgttgaagtcagttttcaacggaccgtctgccacactacgaccgcagagggtcctaacccttcatggaacgaagaactcgagcttcccttccgtgcacccaacggcgactactcaaccgcatcactgcaaagcgttaaggacgtggtgttcattaacatctttgacgaggtgcttcatgatgtgctcgaagatgatcgggagcgcgggtcagggatccacacgagaattgagagacactggcttgggtgcgtgaagatgcccttttcgaccatctacttccaagcacggatcgatggcacattcaagatagatatcccaccagtcctcctcggctactcgaaagaacgcaacatgattcttgaaaggggatttgattcagtacggtccctcagtgagggaagttatataacactgtttataaccattgagccccagcttgtccccggagagagcatccgggagaaattcgagtcccaagaggacgagaaactgcttcaagctacagagaaatttcaggccgaatgcgcccttaagtttccaaaccggcagtgtctgacgacagtgatcgatatctccgggaaaacagtgttcataaccagatacctgaaacctctgaatcctccacaggagctgttgaatgtctaccctaacaatctccaagccactgctgagttagttgcccgctatgtgtcactcattccatttcttcccgatactgtgagtttcggtggcatctgtgacctttggtctacatccgaccaatttcttgacttgctcgcaggagacgaagaagagcatgccgtgcttttgtgtaactacttcctctccctcggaaagaaggcttggctcctaatgggtaacgctattccagaaggacctactgcctacgtgttgacttgggagcaggggcgatatttaatttggaacccctgcagcggccacttttatgggcagttcgacacgttctgtcctctcaaaaatgtgggttgtctgataggccccgacaacatttggttcaatatacagcgatatgagtcaccattaagaattaatttcgatgtgacccgccccaagctgtggaagtcgtttttttcgagatcactcccctatcccggtctgtcttccgtgcagcctgaggagctgatctaccagcgatccgacaaggctgcggcagcagaactgcaggaccggatagaaaagattttgaaggagaagattatggactggcgtcctaggcatctgacaagatggaatcgctattgcacgagcactcttaggcacttccttcctttgcttgagaaaagccagggggaagacgtggaggatgaccaccgggccgagctgctcaagcaattgggcgactaccgctttagcggcttccctctacacatgccttactcagaggttaagccactcatcgatgcagtctacagtaccggagtacataatatcgacgtccccaatgtggagttcgccttggccgtttacattcacccataccccaagaatgtcttgtctgtatggatctacgtagcatccttgatcaggaacaggtag

SEQ ID NO: 112568 - DNA, 4539 bp, Artificial Sequence
  Description of Artificial Sequence: Synthetic coding sequence
atggtttccgagaagagccacctcggaaatccacaagagccagtccaggaagaacctaagacccgactgctgtctatgacggttcgcagagggccacggtccctgccaccaatcccatccacctcccgaactgggtttgcagagttttccatgcgcggaaggatgcgggagaaactccaggcggcccgttctaaggctgaaagcgccttgttacaggagatcccaaccccgcgaccccgcagactgcgctcccccagcaagaaagaactggagactgagttcggaactgaacccggcaaggaagttgaaagaactcagcaggaggtggactcacagtcttacagccgggtgaagttccacgactcagcacggaagatcaagccaaagccgcaagtgccccccggctttcctagcgcagaggaggcctacaacttctttactttcaatttcgatccagagccagagggatccgaggagaaaccgaaagcccgacacagggccggcacaaaccaggaggaggaggaaggggaggaagaggaaccaccagcccagggagggggaaaagagatggacgaagaagagctcctcaacggagatgatgccgaggatttccttttgggattggaccatgtagcagatgactttgtcgctgtcaggccggctgactacgagagcattcacgaccgactacaaatggaaagggagatgctgtttatcccatccagacagacggtccccacttacaagaaacttcctgagaacgttcagccccgattcctggaggacgagggtttatacactggggtgagacctgaggtagctaggacgaaccagaacataatggaaaaccgcctcctgatgcaggaccctgagcgccgctggtttggtgatgatgggcggattctcgcccttcctaatccaattaaaccttttcccagtagaccgcctgtgttgacccaggagcagtcgattaaagcagaacttgaaaccctctataagaaagccgtgaagtatgttcacagctcgcagcacgttattcgctccggtgatccgccaggtaactttcagctggatatcgacatttctggacttatcttcactcatcacccttgcttcagtcgcgagcacgttctggcagccaagttagcacagctgtacgaccagtacttggcacggcatcagcgcaacaaagccaagttcctgacggacaagttgcaggcccttcgtaacgcagtgcagaccggactcgacccggaaaaacctcatcagtcactggataccatacagaagactatcaatgagtacaagagtgagattcggcagacccgcaagtttagagacgccgagcaggagaaggaccggaccctgttaaaaactataatcaaggtgtggaaagaaatgaagtccctgcgcgagtttcagaggttcactaacacaccactgaagctcgtgctgcggaaggaaaaggcagatcaaaaagccgacgaggaggcctatgaagctgaaattcaggctgaaatctccgagttgttggaggagcacacagaggaatatgcacagaagatggaggagtatagaacatctctccagcagtggaaggcctggcgtaaagtgcagagagcaaagaagaagaaaagaaaacaggcagctgaggagcatccgggcgacgaaattgcagagccatatcccgaagaagatttagtaaagccatctccccccgagcctactgatagggcagttattgaacaagaagttcgtgaacgggcagcccagagtcgccggcggccatgggagcccaccctcgtaccagaattatcactggccggaagcgtcactcctaacgaccagtgtccccgggccgaggtatccagacgggaggatgtgaagaagcggtccgtgtatctgaaggtgcttttcaataacaaagaagtcagtcggaccgtttcacggcctttaggagcggactttagggttcactttgggcagatctttaacttacagatcgttaattggcccgaatccctcactcttcaggtttatgagactgtcggccactcttcaccaacgttgttggctgaagtcttcctgcctatacctgaaacaactgtcgtgaccgggagagcacctactgaagaagttgagttttctagcaatcagcacgtgactctcgaccacgagggtgtaggatctggggtgccctttagtttcgaggcagatggtagcaatcaacttactcttatgacaagcggaaaggttagtcacagcgtagcatgggccattggggaaaacggaatacccctcatccccccactctcacagcagaacataggcttccgctccgcccttaagaaagccgatgcaatttcctctatcggaacaagtgggctgactgatatgaagaagctggccaagtgggcagctgagtctaaactcgacccaaatgacccaaacaatgctcctctgatgcagctcattagcgtggcaacgtcaggtgagtcctatgtacctgattttttcaggctcgaacaactgcaacaggagtttaactttgtgagcgatcaggagctgaataggagcaagaggtttcgcttacttcatctgcggagtcaggaggtgcctgagttcaggaactacaagcaagtgccggtgtacgaccgtgagatcatggaaaaagtcttccaggattatgagaagcggcttcgcgatcgcaacgtcattgagaccaaggagcacatcgatacgcatcgggcaatcgtcgctaagtatctccagcaggtgcgcgaaagtgtgatcaaccggttcttgattgcaaaacagtattttcttttggccgatatgatagttgaggaggaagtgccgaatatcagtattctgggactcagcctcttcaagctcgccgaacagaagcgccccctcagaccacgccggaaaggtcgcaaaaaagtcaccgctcagaatctgtccgatggggatattaaactgctcgttaatatagtgagagcatacgatatacccgtgcgcaaaccggctgtctcaaagttccagcagccgagcagatcctccaggatgttttccgagaagcacgcagcctccccatccacatacagccccactcacaatgctgattatcctctcggccaggtgttggtgcggccttttgtagaagtaagtttccagagaactgtctgccacaccaccaccgcagaagggcccaacccgtcctggaacgaagaactcgagctacccttcagggcccctaatggtgactatagtacagcctcactccagtcagtgaaagatgtcgttttcattaatattttcgacgaagtgctacacgatgtgctggaggatgatcgggagcgcggctcgggtattcatactcgtattgaacgccactggctcgggtgcgtaaagatgcccttctctacaatttactttcaagccaggtttgaaagtcaagaggatgaaaaattattacaagcaaccgagaagtttcaggccgaatgcgccctcaaatttcccaatcgacaatgtctgaccacagtgattgatatctcagggaaaacagtctttatcactagatacctaaagccgttgaacccaccacaggagctgcttaatgtctatcccaataatcttcaagccactgcggagctagtcgccaggtacgtgtctctgattccatttctcccagatacagtttcctttgggggtatctgcgatttgtggagtacctcagaccaattccttgatctgctggccggtgatgaagaggagcatgctgttctgctgtgcaactattttctctccctagggaaaaaggcctggttgctcatgggcaatgccatcccagaaggacctaccgcgtatgtgctgacctgggagcagggacgctatttaatttggaatccttgtagcggacatttttacggtcaattcgatacattttgcccgctgaagaatgtgggttgcttaattggaccggataatatttggtttaatatccaaaggtatgagagcccgttgcgcataaatttcgatgtaacaagaccaaagctgtggaaaagcttcttcagccgatcgctgccctacccagggctcagctccgtgcaacctgaagagctcatttaccaaaggagcgataaagctgctgccgccgaattacaggataggatcgagaagattcttaaggagaagataatggattggcgcccccggcacctgactcggtggaatcggtactgcactagtactctgcggcactttcttcccctattagagaaaagccaaggggaggatgtagaagatgaccatcgggccgagcttcttaaacagctgggggactaccgctttagcggattcccactacatatgccttacagcgaggttaaacctttgattgacgcagtttactccacgggcgtgcacaatattgacgtccctaatgtggagtttgcgttggccgtgtatattcatccctaccccaaaaatgttctgagcgtgtggatctatgtggcttctctgattcggaatcgctag

SEQ ID NO: 112569 - DNA, 369 bp, Artificial Sequence
  Description of Artificial Sequence: Synthetic coding sequence
atgaatcctcgcgaagaaaaagtcaaaattattacagaggagtttattgagaatgatgaggacgccgatatggggagacagaataaaaattccaaagtccggcgacaaccacggaaaaaacagaagcccacaccattttcaagggcatgctggcagattttgccacacctaagtgctggcgtgcccctgctagggtgggagcatcctgtccagggcaaatcctttcaggccactaattgttgccctcagggtaacggagtaaggaagatccctccttggcagcctcctggtgcttgcgccggtggtgctcaggacccgcctcccgaatacgacagcccagagcgaccaacagagagggcaggttgctag

SEQ ID NO: 112570 - DNA, 4863 bp, Artificial Sequence
  Description of Artificial Sequence: Synthetic coding sequence
atgaatccacgggaggagaaagtcaaaatcatcactgaggagttcatcgagaatgatgaggacgcggatatgggccgccaaaataaaaattcgaaagtcaggcgccagcccaggaagaagcagccacctacagcagtccccaaggagatggtatctgagaagtctcacctgggtaacccccaggagcctgtccaggaggagcctaagactcgcctgctctctatgaccgtgcggcggggacctcgctctcttccccctatccccagcacttctcgcaccggctttgcggaatttagcatgcggggtagaatgcgggagaaattgcaggccgccaggagcaaggccgagagcgctctcctgcaagaaatcccaaccccgcgacctagaagattgcgcagtccatccaaaaaagagttagagaccgagtttggaactgagcccggaaaggaggtggagaggacacagcaggaagttgattcccagagctatagcagagtgaagtttcatgactccgcgcgtaagattaaaccaaagcctcaggttccccctggtttcccctccgccgaggaagcctacaatttctttacattcaatttcgaccctgagcctgagggctccgaggaaaaacccaaggctaggcaccgagcgggtaccaaccaggaggaggaggaaggggaggaggaagagccacctgcccagggcggggggaaagaaatggatgaggaggaactgctgaacggagacgatgctgaggattttctcctcggactggaccacgtggctgatgactttgtggcggtgcggcccgcagattacgaatctatccacgaccgattacagatggagcgggaaatgctctttatcccctccagacagaccgtcccaacctataaaaaattgccagaaaatgtccagccgcggttccttgaagacgaaggcctttatactggggttaggcctgaggtggcgaggacaaatcagaacatcatggaaaatcgcttgctgatgcaggaccccgagcgccgatggtttggagatgacggaagaatcctggccctaccaaaccccataaaaccatttccttcccggccccctgtgctaactcaggaacagtccatcaaagcagagttagagacattgtataagaaagccgtgaaatacgttcatagtagccagcatgtgattcggtccggcgatcctcctggtaatttccagctagatatcgatatcagtggcctcattttcacccaccacccttgcttttcccgggagcatgttctggctgctaaactcgcacagctctatgaccagtacctggcaaggcatcagaggaacaaggctaaattcctgacagataagttacaagctctgagaaatgccgtgcagaccggattagatcctgaaaaaccacatcagagcctggacactattcagaagacaattaatgagtataagagcgagattaggcagactcgaaaatttagagacgcagaacaggaaaaagacagaactcttttaaaaaccatcatcaaggtgtggaaggagatgaagagtctgagggagtttcaaagattcacaaatactcccctgaaattggtcctgcggaaagagaaagcagaccagaaggccgatgaggaggcatacgaggctgagatccaggccgaaattagcgagctgcttgaggaacatacagaagagtacgcccagaagatggaggaatacaggacttccctgcagcaatggaaggcctggagaaaggttcagcgggcaaagaaaaagaaacggaaacaagccgcagaggagcacccaggtgatgagatcgccgagccgtatccagaagaggatctggttaaaccctcgccacctgaaccaactgatagggccgtgattgaacaggaagtgagagaacgcgcagcccagagcagaagaagaccctgggagcccaccctcgtgccagagctgtcactcgccggtagtgtgactccgaatgatcagtgcccccgggccgaggtgtctcgcagagaggacgtgaagaagcggagcgtgtacctgaaagttctgtttaataacaaagaagtcagcagaacagtatcgagacctttgggggccgacttccgggtccacttcggccagatctttaatctgcaaattgtgaactggcctgaaagcttgacacttcaagtctatgagaccgttggacacagttcacccaccctgcttgctgaggtgttccttccaatccctgaaaccactgtggtgaccggtagagctccaactgaagaagttgaattcagctctaaccagcacgtcaccctggaccacgaaggggtggggtctggcgtgcccttcagcttcgaagccgacggatccaatcaattaacgctgatgacttctggaaaagtgtcacattcagttgcatgggctattggagagaatggcattcccctaattcccccgcttagccagcagaatatcggctttagatcagcattgaaaaaggccgatgctatttcctccatcggcacaagcgggctgaccgacatgaagaaattagcaaaatgggccgctgagagtaaactggacccaaatgatccgaacaatgctcctttaatgcagctgatttccgtggccactagtggggagagctacgtccctgatttcttcaggttggagcagctgcagcaagaatttaattttgtctccgatcaagaactcaatcgttcaaaaagatttcgcctgctccatctacgttcccaggaggtcccagagtttaggaattacaagcaggtgccagtttacgatcgcgaaattatggagaaagtgttccaggattacgagaagaggctgcgggatcgtaatgtaattgaaactaaggaacatatagatacgcacagagcaatcgtcgctaaatatctacagcaggtacgtgaatcggttatcaaccggttcctaatcgctaaacagtacttccttctggccgacatgatcgtggaagaagaagtgcccaatatctccattcttggactttcactctttaaactggccgagcagaaacggcccctgaggccccgacggaagggtcgcaaaaaagtgacggctcagaatctatccgatggcgacattaaacttctggtaaacattgtaagggcttacgacatccccgtcagaaaaccagctgtctctaaatttcagcaaccaagccgctcgagtaggatgttctcagaaaaacatgccgcctctccctcaacttattcccctactcacaacgccgattatccactgggtcaggttctggtgcggcctttcgtagaggtatcttttcagcggactgtttgtcacacaaccacagcggaaggcccaaacccctcttggaacgaggagctggagctgccctttcgagcacctaatggcgactactccacggcctcactgcagtccgtcaaagacgtggtgtttatcaatatctttgacgaagtgctgcatgatgtgttggaggacgatcgcgagcgtggttctggaatacatacgagaattgaacgccattggctgggttgcgtgaaaatgccctttagtactatttactttcaggcgaggatcgatgggaccttcaagatcgacatcccgcccgtgctgctcggctatagtaaggagcgcaacatgattctggaacgcggtttcgattccgttagaagcctgtccgaaggctcttatatcaccctctttatcactattgaacctcagttggttccaggagaatcaatcagggagaagttcgaaagtcaggaggatgaaaagttgctccaggccacagaaaagtttcaagctgaatgcgcactcaaatttccaaataggcaatgtctcaccacagtaatcgacatttccggcaaaactgtctttatcactcgctacctaaagccgctgaacccaccccaggagcttttaaatgtgtacccaaacaacctgcaggcgacggcggaactggtagcccggtatgtgtccctgatcccattcttgccagacactgtgagctttggcggcatttgcgacctgtggtcaacaagcgatcagttcttggacttactagcgggggatgaagaggagcatgccgtgctgctgtgcaattactttctgagcctgggcaaaaaggcttggctccttatgggtaacgccattcctgagggccccacagcgtacgtcctgacctgggagcagggccggtatctgatctggaacccctgctccggccacttctatggtcagttcgacacgttttgcccattgaaaaacgtcggttgcttgatcggccccgacaatatttggtttaacatccaaagatatgagagcccgctccggattaacttcgacgtgaccaggcccaagttatggaaatcattctttagcagaagtctcccctaccctggactgtcatctgtgcagccagaagagcttatctaccagagatccgataaggcagctgccgctgagttacaggatcggatagaaaagatccttaaggagaaaattatggattggaggcctcgacacctgacccggtggaataggtactgcacatccaccttgagacacttcctgcctctccttgagaaatctcagggagaggatgttgaggacgaccatagagccgagcttttaaaacagctcggcgattaccgtttctctggtttccctctccacatgccatactcagaagtgaagcctctgattgacgcggtgtattctacaggcgtgcacaatatcgacgtcccaaacgtagaattcgcattggcggtctacatccacccgtaccccaagaatgttctgagcgtttggatttacgtcgcttccttgatccggaataggtag

SEQ ID NO: 112571 - DNA, 369 bp, Artificial Sequence
  Description of Artificial Sequence: Synthetic coding sequence
atgaacccacgcgaagaaaaagtgaaaataattaccgaggaatttattgagaacgacgaagatgcagacatggggcgccagaataagaattcaaaagtgcgacgtcagccacggaagaaacaaaaaccaacacccttcagtagggcatgctggcagattctgcctcacctgtccgccggtgtgcccctcttagggtgggagcaccccgtacaggggaagtccttccaagcaaccaattgttgcccgcagggcaacggcgtcaggaagataccaccctggcagccccccggcgcctgcgcgggaggagctcaggacccgccgccagagtacgactcccctgagagacccactgagcgggcaggatgttag

SEQ ID NO: 112572 - DNA, 4539 bp, Artificial Sequence
  Description of Artificial Sequence: Synthetic coding sequence
atggtaagtgaaaaaagccatctaggtaacccccaggaacccgtgcaggaggaaccaaaaacacgcttgttgagtatgactgtaagaagaggacccaggagtctcccacccatacctagcacaagccgtaccggctttgccgagttttccatgcggggccggatgagagaaaagctccaggccgctagatctaaggctgagagcgcactcctgcaggagataccgactccccggccgcgccgcctgaggtccccttcaaagaaagagctcgagacagagtttggaaccgagccagggaaagaggttgaacgaacccaacaggaggttgatagccagtcttacagccgggtgaagttccacgactcggcccggaagattaagccaaagccacaagttcctcccggattcccttccgcggaggaagcttacaactttttcaccttcaattttgatcctgagccagagggctctgaagaaaagcctaaggctagacatcgagcggggaccaatcaagaagaagaggaaggtgaagaggaggaaccaccggctcagggcggtggaaaagaaatggacgaagaagaactgctgaacggcgacgacgctgaggactttctccttggtctcgaccacgttgctgacgactttgtcgccgtcagaccagctgattacgagtccatccacgaccgcctgcagatggaacgggaaatgctgtttataccgtctcgccagactgtaccaacttataagaagctgccagaaaacgtacaacctcgattcctggaggacgaagggctgtacaccggtgtgcgccccgaagtagcgcggaccaatcagaatattatggagaacagactgcttatgcaggatccagagagacgctggttcggcgacgacggacgcatcctggccttgccaaatccgataaagcctttccctagcaggcccccagtgctgacgcaggagcagagtataaaagcagaactggagactttatacaaaaaagcagtcaagtacgtgcactcatcacagcacgtgattaggtcgggcgacccgcccggtaacttccaactggacatcgatatcagcgggctcattttcacccatcatccatgtttcagtcgagagcatgtgctagctgcaaaattggctcagctctatgaccagtacttggcgagacaccagcgaaacaaggctaaattcctcaccgacaaattgcaggcattgcgtaatgctgtacagacaggactcgatcccgagaaaccacatcaatccctcgataccatccagaagacgatcaacgaatacaaaagcgagatcaggcagacccggaagttcagagacgcagagcaggagaaggaccgtacattgttgaagactatcatcaaagtatggaaggagatgaaaagcttgcgcgaattccagcggtttacaaataccccgctcaagctggtcttgcgaaaggagaaggcagaccagaaggcagatgaagaagcctacgaggcagagattcaggccgagatcagcgagttgctggaagaacacactgaagagtatgcacaaaaaatggaagaatacagaacaagcctacagcagtggaaggcatggcgaaaggtgcaaagggccaagaagaaaaagcgcaaacaagcggctgaagaacatcctggggatgagatcgccgaaccctaccccgaggaggatctggttaaacctagccctcctgagcctactgatcgagccgtcattgaacaggaggtaagagaaagggccgcacagagccgtcgccgaccgtgggaaccaacactggtgccagagctgtctctggcaggaagcgttacaccaaacgaccagtgcccccgagctgaggtcagtaggagggaagatgtgaagaaacggtcggtgtatctcaaggtgctcttcaataacaaggaggtgtctagaaccgttagccggcccttaggtgctgactttcgtgtccattttggccagatcttcaaccttcagattgtgaattggccggaatcattaactctccaagtgtatgagaccgtagggcactcctccccaacactcctcgctgaagtgttccttcccatacctgagacaacagtagtaacaggccgcgcacctacagaggaagtggaattctcatccaaccagcacgtaaccttggatcacgaaggagtaggctccggagtgccattctccttcgaggcggatggttcaaaccagcttacactgatgaccagcgggaaagtgagccactccgtcgcctgggctattggcgagaacgggattcccctgatccctcctctcagtcagcagaacataggttttcgcagcgcactgaagaaagctgacgccatttcaagcatcggtaccagcgggctgaccgacatgaagaagctggccaaatgggctgccgaatcgaagctggaccccaacgaccctaacaacgccccactgatgcaactcatttcagtggcaaccagcggggaatcctacgtgcccgactttttcagactggagcagctgcagcaggagtttaatttcgtgagcgatcaggaattgaaccgctctaagaggttcaggctactgcacttacgatctcaagaggtgccagagttccggaactataaacaggtgcctgtctatgaccgggagataatggaaaaagtgtttcaggattatgagaagaggcttagggatcgtaatgtcatcgagactaaggagcacattgatactcatagagccatcgtggcaaagtaccttcagcaggtcagggagtccgtgatcaacaggtttctaatcgctaagcagtacttcctgcttgccgacatgatcgtcgaggaggaggtgcctaacatctcgatacttggtctgagtttgttcaagctcgccgagcagaaaaggcccctgcggccccgcaggaaagggaggaagaaggtgacagcccagaatctgtcggatggggacattaagctcctggttaacatcgtgcgcgcatacgacatccctgtgcggaagccagccgtatcaaagtttcagcagccgtcaaggtcaagtaggatgtttagcgagaagcatgctgcttccccctccacgtatagcccaacgcataacgctgattacccgctaggccaagttcttgtccgtcccttcgtcgaggttagctttcagcgcactgtctgccacacgacaaccgccgaaggccccaaccctagttggaacgaagaactggaactgccattcagagcgcccaacggcgactactcaaccgccagcttacaatcagtcaaagacgttgtgtttatcaacatttttgacgaggtgctgcacgatgtactcgaggacgaccgcgaacgagggagcgggatccacactcggattgaacggcactggttagggtgcgtgaaaatgcctttttctaccatctacttccaagcccggtttgaaagtcaagaagatgaaaaattactgcaggccaccgaaaaatttcaggctgaatgtgcacttaagtttcctaatagacagtgtctgacaaccgttattgatatttctggcaagactgtgtttattaccagatatcttaagcccctgaatccgccacaagaattgttaaatgtctacccaaacaacctccaggcaaccgcagagttggtggccagatacgtgtccctcatacccttcctacccgacacagtgtcctttggtggtatttgtgatctctggtctacctccgatcagttcctggatctgctggccggagatgaggaggaacacgccgtcctgctgtgcaactacttcctaagtttaggtaagaaggcgtggctgctgatggggaacgccatcccagagggcccgaccgcctatgtgctcacatgggaacagggacggtatcttatttggaacccctgtagcggacacttctacgggcagtttgataccttctgtcctctgaaaaacgtgggctgtctgattggtcctgacaacatttggttcaacattcagcgctatgagagtcctctgcgaataaatttcgatgtgaccagacccaaactctggaaatcttttttcagccgttctctgccatatcccggactctctagcgtacagcccgaggaactgatatatcagcggagcgataaggcggctgcggcagaactacaagatcggatcgagaagatactgaaagagaagattatggactggagaccgcgtcacttgacgcgatggaacagatactgtacctcaaccctccgtcatttcttaccgctgctggagaagtcacagggtgaggatgtagaggacgaccacagggcagagctgctgaagcagctgggcgactaccgcttcagcggattccccttacacatgccttatagcgaggtcaaaccactgatcgacgctgtttacagcaccggtgtacacaatatagacgtgcccaacgttgagttcgcgctcgccgtttatatccacccttaccccaagaatgtgctgagtgtgtggatttacgtcgcaagcctgattcggaacaggtag

SEQ ID NO: 112573 - DNA, 369 bp, Artificial Sequence
  Description of Artificial Sequence: Synthetic coding sequence
atgaatccccgagaggaaaaagtgaaaattatcacagaagaattcatcgaaaacgacgaggatgccgacatgggtcgccagaataagaattcgaaggtgagacgacagcctaggaaaaaacagaagcctacccctttctcccgtgcatgctggcagatcttgcctcatctttctgcaggagtaccattgcttggctgggagcaccctgtccaagggaagtctttccaagcgactaactgctgtccacagggtaacggggtcaggaaaatccctccctggcagccccctggtgcttgcgctggcggggcgcaagatcccccccctgagtatgatagtcccgagcggcccactgagcgagcaggatgctag

SEQ ID NO: 112574 - DNA, 1767 bp, Artificial Sequence
  Description of Artificial Sequence: Synthetic coding sequence
atgaatccaagagaggaaaaagttaaaatcattaccgaagagttcatcgaaaatgatgaggatgccgatatgggacggcagaacaagaatagcaaggttcgcaggcagccacggaagaaacagccacccactgcggtgccaaaggagatggtgtccgaaaagtcccatctaggaaatccccaggaacctgtgcaggaggagcccaagacacggctgctttccatgaccgtgagacgcggtcctaggagcctccctcccattccatcgaccagccgaacaggctttgcagagttctcaatgcgcggacgcatgagagagaagctgcaggctgcaagatctaaagcagagagcgccctattgcaggagattccaacgccaagacccaggcgattacggtcaccttccaagaaggaactggagacggagtttggcaccgaaccagggaaagaggtcgaacgcacccagcaagaggtagactctcagtcctacagccgcgttaagtttcatgacagtgctcggaaaatcaaacccaaaccccaggtgcccccgggatttccatccgccgaagaagcatacaatttcttcactttcaattttgacccggaacccgaggggtctgaggaaaagcctaaggcacggcaccgcgccgggaccaaccaggaggaggaggagggggaagaggaggaacctcctgcccagggtggtggcaaagagatggacgaggaggagcttctgaacggtgatgatgctgaggacttcctcctggggctcgaccatgtggccgatgactttgttgcagttcggcctgcagactatgagagcatccatgatcgcctacagatggagagagagatgctgttcatcccctcaagacagaccgttccaacctataagaagctcccggagaatgtccagccacgcttccttgaggatgaaggactgtatacaggggtgcgtcccgaggtggcgcgtactaatcagaatatcatggagaataggttactgatgcaggatcccgaaaggaggtggttcggcgacgatggaagaatccttgcattgcctaatcccatcaaaccattccctagcaggccccctgtcctgacacaggagcagtccattaaggctgagctcgagaccctctataagaaagccgtaaaatacgtgcactccagccagcacgtaatccggtccggtgatccccctggcaacttccagctggatatcgacatttcaggactgattttcacccaccatccttgcttctccagagaacacgtactggccgccaagctcgctcagttatacgaccaatacctcgctaggcaccaaagaaacaaggccaaattcctgacagacaaacttcaagcactccgaaacgccgttcagacaggtttagacccagaaaagcctcaccagtcactggacacaatccagaagaccatcaacgagtataaatcggaaatcaggcagacaaggaagtttcgggatgctgaacaagagaaggatcggaccctgctaaagacgattataaaggtttggaaagaaatgaagtcgctcagggaatttcagcgtttcacaaatacaccgctgaaactcgtgctacgaaaggagaaagcggaccagaaagcagacgaagaagcctatgaagcagagatacaggcagaaattagtgagttgcttgaggaacatacagaggagtacgcacaaaaaatggaagaatacaggaccagccttcagcagtggaaggcttggcggaaagtccagtag

SEQ ID NO: 112575 - DNA, 336 bp, Artificial Sequence
  Description of Artificial Sequence: Synthetic coding sequence
atgaacccccgcgaggagaaagtcaaaatcattaccgaagaattcatcgagaatgacgaggacgctgatatgggcaggcaaaacaagaacagcaaagtacgtcgccagccccgaaagaaacaacctccaaccgctgttccaaaggaaatggttagtgagaagagccacctcggcaacccccaggagcccgttcaggaggaacccaagactagactgctatctatgaccgtgagacgggggccccggagagagctggtcgtcaaaaaatctttgggacggcctggcacagttactcacgtctgcaacccatcaaccctcgaggggcgaggagggtag

SEQ ID NO: 112576 - DNA, 882 bp, Artificial Sequence
  Description of Artificial Sequence: Synthetic coding sequence
atggccctggtcagtgcagactccaggatcgccgaactgctgactgaattacatcagctcattaagcagacgcaggaagagcggtcccgtagcgaacacaatctcgttaatatccagaagacacatgaacgtatgcagaccgagaacaaaattagtccatactaccgaacgaagttgcgcggtttgtatacaaccgcaaaggctgacgccgaggctgagtgcaatatcctccgaaaagccttagataagatagccgaaattaagagtctcctggaagaacggcgaatcgcagcaaagatagcaggattatataatgactccgagccacccagaaagactatgagaaggggcgttctgatgaccctccttcagcaatcggccatgacgctgccactgtggattggaaagcccggggacaagccgcctccgttgtgcggggccattccagcgtcaggggattatgtggctcggcccggcgataaggtggcggcaagggtgaaagccgtggatggcgatgaacaatggatccttgccgaggttgttagctactcacacgcgaccaataagtacgaggtcgacgatattgacgaagagggcaaagagcggcacactttgagccgtaggagagtgatacccttgccccagtggaaagccaacccagaaacagaccccgaggccctttttcagaaagaacagttagtactggcgctgtacccacagactacctgcttttatagagctctaatccatgctccaccacagaggcctcaggacgactattctgtactctttgaagacacttcctacgcagacggatattccccacccctaaacgtggctcagcggtatgtcgtagcgtgtaaggagcccaagaagaagtag

SEQ ID NO: 112577 - DNA, 843 bp, Artificial Sequence
  Description of Artificial Sequence: Synthetic coding sequence
atgaacgatagatcctcaagacgacgcactatgaaagacgatgaaaccttcgaaatttctataccttttgacgaggctcctcacctggaccctcaaatattctattctctgtcccccagtcggaggaacttcgaggagccacctgaagccgcttcttcggcgctggcgctcatgaatagtgtgaaaacacaattgcatatggcgctggaaagaaattcttggctgcagaagagaatcgaagacttggaggaggagcgcgattttcttcgctgtcagcttgacaagttcatttcatcagctcgaatggaggctgaagaccactgcaggatgaagccaggtccgcggagaatggaaggcgactcccgcggcggggcgggcggcgaagcttcggacccggaaagtgcagccagcagcctgtccggcgcaagcgaggaagggagcgcctcagagagaaggagacagaagcaaaaaggaggcgccagcaggcggcgctttgggaagccgaaggctcgagagagacagcgcgtaaaggacgcagacggtgtgctgtgtaggtataagaaaatcctcggaaccttccagaagctgaagagcatgtcaagagcattcgagcatcaccgggttgacaggaataccgtggcattgaccaccccaattgccgagctcctgatcgtggcccccgagaaattggccgaagttggtgagttcgatccaagcaaggagcgtttactggaatattcaagacggtgcttcctcgccctggacgacgaaacccttaagaaggtccaggccttaaagaagtccaagctcctgctgcctatcacctaccgctttaaacggtag

SEQ ID NO: 112578 - DNA, 495 bp, Artificial Sequence
  Description of Artificial Sequence: Synthetic coding sequence
atgatgctgacgcaggcgcccagtagtgtagtccggtcgcgtaactccaggaatcatacggtcaactctggggggtcatgtctgagtgcgagcactgtcgctatccccgcgatcaacgattcatccgcagccatgtccgcctgcagtacgatctctgcccaaccggcatctagcatggacacccagatgcattcacctaagaagcaggagcgcgttaataaacgtgtgatttggggaattgaggtggccgaagagctgcactggaaaggctgggagcttggcaaggagacaacaaggaatctggtgctgaaaaaccgaagcctgaagcttcagaagatgaagtaccggtaccaatacaaaggctctaggactcaatgtcatagcctcgagccacggaaacaggcgctgtttaagaccaagcaaaataaacagaaaaaacccttgacttgtcacatcaaggctagcgagtgtcttaagtacgttcagtacgagtag

SEQ ID NO: 112579 - DNA, 495 bp, Artificial Sequence
  Description of Artificial Sequence: Synthetic coding sequence
atgatgcttacgcaagccccttcgagcgtggttagatccagaaacagcaggaatcacaccgtcaactcgggaggctcgtgcttgtccgcttccaccgtcgccatacccgccatcaatgactctagtgctgccatgtctgcatgttccactatcagcgcccaaccagccagtagcatggacacccagatgcatagtcctaaaaagcaggaaagggtgaataaacgcgttatatggggaattgaggtggctgaagaactccattggaaaggatgggagctggggaaggagaccacaagaaatctggtgctcaagaaccgctctctgaaattacagaagatgaaatacaggtatcagtataaggggtccaggacccagtgtcactctctcgagccccggaagcaggccctgttcaagaccaagcagaataagcagaagaagcctctcacctgtcacattaaggcgtctgaatgtctcaaatacgttcagtacgaatag

SEQ ID NO: 112580 - DNA, 5778 bp, Artificial Sequence
  Description of Artificial Sequence: Synthetic coding sequence
atgttcactctgactggttgccgattagtggaaaaaacccagaaggtggagaaccccagtgtcagcttcgcctcatctttccctctgattccgctgctgctgcgagggaagtctgtacaaaaaaagcaggcagagagtaagtctcagatcaagctgcatactcagagcgctccttttggtctgtgcccgaaggatatgatgctcactcaggccccgagttctgtggtgagatccagaaatagtaggaaccataccgtgaattctgggggttcttgtctctccgcctctacggtcgcaataccggcaataaatgatagcagcgcggccatgagcgcttgttctactatttccgcccaaccagcttctagcatggatactcagatgcattctccaaagaagcaggagcgagtcaacaagagagtcatttgggggatagaggttgccgaagagctgcattggaaaggatgggagctgggcaaggagaccacccgtaaccttgtcctgaaaaaccgatctctaaaactacagaagatgaagtatcgacctcctaagacgaaattttttttcacagtcatcccgcaacccatcttcctgtctcccgggataactttaaccttgccaatcgtgtttcgccccctggaagctaaagaatatatggatcagctctggttcgaaaaagcagagggcatgttctgtgtcggcctccgcgcaacactgccctgccatagactaatttgccggcctccttcgctgcagcttcccatgtgtgccgtcggtgacaccaccgaggcttttttttgtctggacaatgtgggcgacctgccgactttcttcacctgggagtttagctcacccttccagatgctgcctgcaactgggctgttggagcccggccaggccagtcaaatcaaagtcacctttcagccactgacagccgtaatttatgaggtccaggcaacatgctggtatggtgcgggttcccgccagcgcagctccatccagcttcaagctgtggccaagtgcgcccaacttctcgtctcaatcaaacataaatgtccagaagatcaggatgccgagggcttccagaaactgctttatttcggctctgtggctgtcggttgtactagcgagcggcagatccgcctgcataacccatccgctgtgaacgcaccctttcgcatcgaaatctctcccgatgaactagctgaggaccaggcattttcttgccccacagcacatgggatcgttctcccaggtgaaaagaagtgtgtgagtgtgtttttccaccctaagacgctggatacacggacagtcgattactgctcaataatgccttccggatgtgcgtcgaagaccctgctcaaagttgtgggattttgcaggggtcccgccgtttcactccagcattactgtgtgaacttctcctgggtgaacctgggcgaaaggtccgaacagcctctgtggatagaaaaccaatccgactgtactgcccattttcaatttgccatcgattgcctggagtcagtattcacaattcggccagctttcggaacccttgtcggtaaagcacgtatgacattacactgcgccttccagccgactcaccctattatttgctttcgccgtgtggcttgtctgattcaccaccaagacccactgttcctggatctaatggggacatgccatagtgattctaccaaaccggcgattctgaaaccacagcacctgacttggtatcggacgcacctggctcgcggactcacactctacccccctgatatcttggacgctatgctgaaggagaagaagctggcccaggatcaaaatggagctcttatgatcccaatccaggaccttgaagacatgcccgccccccagtatccatatatcccccccatgacagagtttttcttcgatggtactagtgacatcactattttcccgcctcccatttcagtcgagcccgtggaagtcgacttcggcgcctgtcctggccctgaagcaccaaaccccgtgccattatgtctgatgaaccacaccaagggcaagatcatggtggtgtggaccaggcggagcgactgccccttctgggtcacacccgagtcctgcgatgtgccacctcttaagtcaatggcgatgagattacatttccagccgccacaccctaattgtctgtatactgtcgaattagaggcttttgccatttacaaggtactgcagagctactccaatattgaggaagattgtaccatgtgtccctcctggtgtcttaccgtgcgagcaaggggccactcgtacttcgctgggttcgagcatcatatacctcagtattcactggacgttcccaagctgttccctgccgtgagtagcggtgaaccaacttataggagcctgcttctggtcaacaaggactgtaaacttttgactttttcactggctccacaacgcggaagtgacgtaatcctgcgaccaacgtccggcttggtggcgcctggggcacaccaaataatcctaatttgcacctacccagagggatcctcctggaagcagcacacgttttacctccaatgtaatgcaagccctcagtaccttaaggaggtgagcatgtattctagggaggagcctttgcagctcaagcttgacacccataagtccctgtacttcaaaccaacatgggtgggctgctcaagcacatctccattcactttcagaaatccttccagacttcctttgcaattcgaatggcgggtgtcagagcagcatcgcaaacttcttgcagtccagccatcgagagggttgatacagccaaacgaacggctgacccttacttggaccttctcacctcttgaagagaccaagtatttattccaagtgggaatgtgggtgtgggaagccggcctgagcccaaatgccaatcctgccgcaacgacgcactatatgctgcgattggtcggagtcggcttaacctcttccctgagtgcaaaagagaaggagctggcctttggcaatgtcctagtgaatagcaagcagagccggtttttagtactgctaaatgatggaaactgcacactttactataggctctatctggaacaggggagtccggaggcagtcgataatcatccgctggcactacagctggataggacagaaggttccatgcctccccggagtcaggatacaatctgcttgacagcgtgtcccaagcagagaagccagtactcttggaccattacatattccctcttgagccaccgggataataaagccggggagaagcaggagctgtgttgcgttagtctggtggctgtgtatcccctgctttccattcttgacgtctcctcaatgggcagcgcggaaggtatcacgcggaagcacttatggcgactgtttagccttgatctccttaactcctatctggagagggatcccaccccttgcgagttgacctataaagtccctaccaggcactcaatgtctcaaatacctcctgtgctgacacccttaagacttgactttaatttcggtgctgcaccgttcaaggcacccccaagtgtggtcttcctcgccctcaaaaatagcggtgtagtcagcctggactgggcctttttgctgcccagcgaccaacgtattgatgtggagctgtgggcagagcaggctgaactgaacagcacagagctccaccagatgcgggtgcaggacaattgtctgtttagcatttctcctaaggccggatcgttgagccctggccaggagcagatggttgaactgaagtattcccacctgttcatcggcacagaccacctgccggtactgtttaaggtgagtcacggaagagagatcttgctaaacttcattggcgtaactgtaaagccagagcagaagtatgtgcattttacctctaccacacatcagtttatcccaatccctatcggagacacattgccaccaaggcagatctatgaactgtacaacggaggatccgttccggttacatacgaggtccagacagacgtcctcagccaggtacaggagaaaaactttgatcacccaattttttgttgcctcaacccgaagggcgagatccaaccgggcagcaccgccagagtgttgtggatcttctcacctatagaagccaaaacatacactgtcgacgtgcctatacacatcttgggttggaattctgccctgatccatttccaaggtgtcgggtacaatccgcatatgatgggagacacagctccatttcataatatttccagctgggataattctagcattcactccaggttagtggttccagggcagaacgtctttctgtcacaatcgcacatcagtttgggcaatatcccggttcagtctaagtgttctagactcctctttctgaataatataagtaaaaacgaggaaatcgcctttagctggcaaccttctccactggacttcggggaagtaagcgtctcgcctatgatcggggtagtcgcacccgaggaaacagtgcccttcgttgtgacactcagagcttctgtccacgcctccttctattccgccgatttggtttgtaagctctacagtcagcaactcatgcgtcagtaccacaaagaactgcaggaatggaaagatgaaaaagtgcgccaagaggtggaattcactataacagacatgaaagtcaagaaacgcacatgctgcacagcatgtgaacccgccaggaaatataagacattgcctcccattaagaatcaacagtctgtgtcccgacccgcctcctggaaattgcagactcctaaggaggaggtgtcatggccttgtcctcagccaccctctccagggatgctgtgcctcggtctaacggccagggcacacgcaaccgactatttcctcgccaatttttttagcgaattcccttgccacttcctgcatagggagttgcctaaacggaaggccccccgggaagagagtgaaacctccgaagagaagtcacccaataagtgggggcctgtgtcaaaacaaaagaagcaactgttagtggacatccttacaaccataataagaggactgttggaggataagaacttccatgaggccgtggatcaaagtctggtggagcaggtgccttatttccggcagttttggaacgaacagagtaccaaatttatggaccagaagaatagtctgtacctcatgccaatcctgcctgttccaagctcttcctgggaagacgggaaaggtaaacagcccaaagaagataggccggaacactaccccggcctgggtaaaaaagaagagggcgaggaggagaagggcgaagaggaagaagaagagttagaggaagaggaagaggaagaggaggagaccgaggaagaggagctgggtaaagaagagatcgaggaaaaggaagaagaacgggatgagaaggaggagaaggtgtcctgggccggcattggccctaccccacagccggaaagccaggagagtatgcagtggcaatggcagcagcagttgaacgtgatggtcaaagaggaacaggagcaagacgaaaaggaagccatccggaggttacctgcttttgctaatctgcaagaagcgctgttggaaaacatgatccaaaatatcttggtggaggcatcacgcggtgaggtggtcttaacatctagacctagagtcatcgccctccccccgttctgcgttcccaggagcctcacgcctgatacactgctgccgacacagcaggcagaggtcctccacccagttgtgccgctaccgacagatcttccctag

SEQ ID NO: 112581 - DNA, 2190 bp, Artificial Sequence
  Description of Artificial Sequence: Synthetic coding sequence
atgctaacccaggcacccagctctgtggttcgttctaggaattcccggaatcacacagtcaacagcggtggcagctgcctgtcagcgtccacggtggccatacctgccattaacgactccagcgcagccatgtccgcctgttcaacaatcagtgctcaacctgcctcttctatggatactcaaatgcattctcctaagaagcaggaaagagtgaacaagcgcgttatctgggggatcgaggtggcagaagagctccattggaagggttgggaactcgggaaggagacaacacggaaccttgtattaaaaaacaggtcactgaagcttcagaagatgaaataccgccctcctaaaaccaagtttttctttacagtcattcctcaaccaattttcttgtctccaggtattacccttactctaccgattgtctttcgccctctggaggccaaagagtatatggaccaactgtggttcgaaaaggccgaaggtatgttctgcgtcggtcttagggccacactcccgtgtcaccgcttgatttgccggccaccatccctgcagctccccatgtgcgccgtaggtgacaccacggaggcatttttctgcctcgacaatgtgggagacctgcctactttctttacctgggagttctcatctcctttccagatgctgcctgcaacaggcctcctggagcccggacaagcaagtcaaattaaagtgacgttccaaccgttaacagcggtgatatacgaagtgcaagcaacatgttggtacggggccggcagccggcaacggtcctctatccagctgcaggctgttgctaaatgtgcccaacttttggttagcatcaagcacaagtgccccgaagaccaagacgccgaaggcttccaaaagctgctgtacttcgggagtgttgctgtcggttgtacatcagagagacagattaggttacacaaccccagtgctgtaaatgccccttttcggatcgaaatcagcccagacgagctcgcagaggatcaagcgttttcctgcccaaccgctcatgggatcgtcttgccaggggagaaaaagtgtgtctccgtgtttttccaccccaaaacactggatacaagaacagtggactattgttccataatgccgtcagggtgcgccagtaaaaccttacttaaggtcgtgggcttctgccgggggccggctgtaagcctacagcactattgcgttaattttagctgggtgaacctcggagagcgctcagagcaaccattatggatcgaaaaccagagcgactgtaccgctcactttcagttcgcaatagactgtctggagagcgtcttcactatccggcctgctttcgggaccttggttggcaaggctaggatgacactccactgcgcttttcagccaacacatcccatcatctgtttccgcagagtggcatgtctgatacatcaccaggacccattgttcctcgacctgatgggcacctgccattccgattcaactaagcccgccattctgaagcctcaacacctgacctggtaccgcacccacctggctcggggtctaacgctatatccacctgacatcctggacgcgatgcttaaagagaaaaagcttgctcaagaccagaacggcgctctaatgattccaatccaagacctagaggacatgcccgcccctcagtacccatacattccccccatgaccgagttctttttcgatggaaccagcgatattacaatctttccccctccgatcagtgttgaaccggtggaagtcgacttcggggcttgccctgggcccgaggctccaaatccagttccattgtgtttgatgaatcatacaaaggggaaaattatggttgtttggacaaggcgcagtgactgtcctttttgggtcacccctgagtcctgtgatgtcccccccttgaaaagtatggccatgcggctgcacttccagccaccccatcctaattgcctgtatacagtagagcttgaggctttcgccatctataaggtgtgcgcaaggaacgaacgtgaagagtgtggcgtcagtgcacgctcgctctctgggctggtaggctggcaggaggtaaccgaagggagcttccgtctgcacccgctgcgcgcgaggctctccttgggctggaccgtcacacccatgagcctgtctccaccgaaactccttgcctag

SEQ ID NO: 112582 - DNA, 5778 bp, Artificial Sequence
  Description of Artificial Sequence: Synthetic coding sequence
atgttcaccctgaccgggtgtcgcttggtggagaagactcagaaggtggagaacccttctgtgagctttgcctcttcctttcccctgatcccattactgctgaggggcaagtctgttcagaagaaacaggccgagtctaaaagtcagataaagctgcatactcagtccgctccatttgggctgtgcccgaaggatatgatgctcacccaggccccttcctcagtcgtgcgtagcaggaacagccgcaatcacactgtgaacagcggcggttcctgcttgtccgctagtaccgtcgcaatcccggcaatcaatgattctagcgctgccatgtcagcctgtagcaccatcagcgctcagcctgccagttctatggacactcagatgcacagcccaaagaaacaggaacgagttaataaacgggtgatttggggaattgaggtcgcagaggaactgcattggaagggatgggagctgggcaaagaaactacccggaacctggttttaaagaatagaagtctcaaacttcagaagatgaaatacagaccacccaagaccaagtttttcttcactgtaatcccacaaccaatttttctgtctccgggaatcacactgacactgcctattgtgtttcgccctttagaagccaaggagtatatggatcaactgtggttcgaaaaggccgaggggatgttttgtgtgggactgcgagctaccctgccgtgtcaccggctcatttgtagaccacctagcctgcaactgcccatgtgtgccgtcggcgatactaccgaagcatttttctgtctggacaacgtcggtgatctccccacattcttcacctgggaattctcgtcaccattccagatgttgcccgcgaccggtctcctggagcccggacaggctagccagatcaaggtgactttccagcccctgaccgctgtcatctacgaagtgcaggccacatgctggtatggagccggctcgagacagcggagcagcattcagttgcaggccgtggcaaagtgcgctcaattgcttgtgtccatcaaacacaagtgcccagaagatcaggacgctgaaggctttcagaagctactgtacttcgggagcgtggccgtgggctgcacttccgaacgccagatccgcctgcacaatccatccgcggtgaacgccccctttagaattgagatctcgcctgacgaacttgccgaggaccaggccttcagttgccccaccgcccacggaattgtcctgcccggtgaaaagaagtgcgtgtccgtctttttccatccaaaaacccttgacacacgcaccgtcgattactgctccatcatgccttccggatgcgcttccaagaccctgttgaaagtagtcggcttctgtcgcgggccggctgtgtcactacaacactattgtgtcaacttttcctgggtcaaccttggcgagcggagcgagcaacccttatggatcgaaaatcaatctgactgcacggcccatttccagtttgcaatagattgcctggaaagcgtgttcactatcagacctgccttcggtaccctggtcggtaaggctagaatgacactgcattgcgcgttccagcctacacatccgatcatatgttttaggagggttgcgtgcttgatccaccaccaagatcctttgttcctggacctaatgggaacctgtcattctgattcaacaaaacctgctatccttaaaccccagcatttgacatggtatcgaactcacctggctcggggtttgacgctataccctccggatattctcgatgctatgttaaaagagaagaagctggctcaggaccagaatggagctctcatgatacctatccaagatttagaggatatgcctgccccccaatatccatatatccctcccatgactgagttcttcttcgacggaacatctgacattacaatctttccgccacccatctctgtggaacctgtagaggtggacttcggcgcgtgcccaggtcccgaggcccctaaccccgttccactctgtctgatgaatcacactaaaggaaaaattatggtcgtgtggacacgacggtccgactgtccgttctgggtgacccccgagagctgtgacgttcccccactcaagtccatggccatgcgattacactttcaaccccctcatccaaattgcctgtatacagtagagctggaggcattcgctatctataaagtgcttcagagctacagcaacatagaagaagactgcactatgtgcccctcatggtgcctgactgtgagagcacgaggccacagctattttgccggttttgagcaccacattccccagtactcgctggatgtccccaagctttttcccgccgtgagctctggcgaacctacgtataggtccctgctgcttgtcaacaaggattgcaagctgctgacattttcgttggccccccagcgcggctcagatgttatcttacgtcccacctcaggcctggttgctcctggcgcccaccagattatcctcatatgtacttatcctgagggttcaagttggaagcagcatactttttaccttcagtgcaatgcaagtccgcagtatttgaaagaggtgtctatgtattcacgggaagaacccctgcagctgaagctggatacccacaagagcttatactttaaaccaacttgggtgggatgctcatccaccagtcctttcacatttagaaatcctagcaggttgcccctccagttcgaatggagagtttcagagcagcaccgcaaactcctcgcggttcagccctcacgagggttgatacagcctaacgaaaggttaactctaacctggacctttagccctctggaagagactaaatacctgttccaggtcggcatgtgggtttgggaggccggcctgtctccaaatgcaaatcctgccgccaccacccattacatgctgcgactggtgggagttggactgactagttctcttagcgcgaaggagaaagaattggccttcggcaatgtgttagtaaacagtaaacagagccgatttctcgtcctattgaatgatggcaactgcactctgtactacagactgtacctcgagcagggttcccccgaggccgtagacaatcaccctctggccttgcagttggaccggaccgaaggctcaatgccaccgcgaagtcaggataccatctgcctgacagcatgccctaaacagagatctcagtattcctggactatcacatactctctgctcagccacagggacaataaggcgggtgaaaagcaggagctttgctgcgtgtccctggtggccgtttaccccctcctgtcaattctggacgtgtcctcaatgggcagtgctgaaggtataaccagaaaacatctgtggcggctgtttagtctggacctgctgaactcgtatcttgaaagggatcctaccccctgtgaactcacttataaggttcctacgcggcattccatgtcacaaatcccacccgtcctgacaccactcaggctcgacttcaattttggcgccgccccctttaaagccccaccctcagtggtgttcctggccctgaaaaacagcggtgtggtgagtttggactgggcctttctgttgcccagcgaccagagaatagatgttgagttatgggctgaacaggctgaactgaactctacagagttacatcagatgcgggtccaggataattgcctcttttcaatctctccaaaggccggctcgctcagtcctggacaggagcagatggtcgaattgaaatatagtcacctgtttatcggtaccgatcatttgccagtgctgtttaaagtgagtcatggcagagaaattctgctgaactttatcggggtgacggtaaaacctgaacagaaatatgtccatttcacctcaacaacacatcaattcatccccattccaatcggagacaccttaccccctaggcagatctatgagctatataacggcgggtccgtacctgtgacctacgaggtacaaactgacgttctgtcccaggtgcaagaaaagaactttgatcatcccattttctgctgtttaaaccccaagggagaaatccagcctggaagtaccgccagagtcctttggatattctcacccatcgaggctaaaacctacacggtagatgtgccaatccatatcctggggtggaattcggctctcatacatttccagggtgtcgggtataacccgcatatgatgggtgacaccgctccttttcacaacatctcttcatgggataactctagcatacactctcgcctcgtggttccaggacagaacgtattcttatctcaaagtcacatttcgctcgggaacattccagtccagagtaagtgctcaagactcctgtttctgaacaacatctccaagaatgaagaaatcgcttttagctggcagccttcgcctctggatttcggggaggtgagcgtgtcaccgatgatcggagttgtggctcccgaggaaacggtccctttcgtggtgacactgcgcgcaagtgtccacgccagtttctattcagccgacctcgtgtgcaagttgtactcccagcaattgatgaggcagtaccacaaagagctgcaggaatggaaggacgaaaaagtccgacaggaggttgaattcacaatcactgatatgaaggtaaagaaaagaacatgctgcacggcgtgcgagcccgccaggaaatataaaaccctccctcctattaaaaaccagcaaagcgtgtcccgcccggccagctggaaactgcagaccccgaaagaggaggtgagttggccttgcccgcaacctccatcccccggtatgctctgcctaggcctgaccgcaagggcacacgccactgattacttccttgctaacttcttttcagagtttccctgtcattttctacaccgggaactccccaaaaggaaggcccccagggaagaatcagaaacttccgaggaaaagtcacccaacaaatggggccccgtatccaaacagaaaaagcaactcttggtcgatattttgactaccattatccgaggactgcttgaagacaagaactttcacgaagccgtggaccagtccttggttgagcaggtaccttatttccgacagttttggaatgagcagtccaccaaatttatggatcaaaagaattctctgtacctcatgccaatactcccggtgccatcatctagctgggaggacgggaagggaaagcagcctaaagaggacaggccagagcactatcccggattgggaaaaaaagaggagggggaggaggaaaagggggaagaagaggaggaggagctggaggaggaagaggaagaggaagaggagacagaggaggaagagcttggtaaggaggaaattgaggagaaggaggaggagagagatgagaaagaggaaaaagtttcctgggcaggaatcggccctactccccagcccgagagtcaggagtccatgcagtggcagtggcagcagcagcttaatgtgatggttaaggaagagcaggagcaagatgaaaaggaggccattaggaggctacccgctttcgccaatctccaagaagccctgttggaaaacatgatccaaaacattctggtggaagcctcccgcggcgaagttgtattgacctcaagacccagagtaattgctcttccacccttttgcgtccctcggtcccttacccccgataccctactgcctactcagcaagctgaggtcttgcatcccgtggtgccactgccaactgacctaccttag

SEQ ID NO: 112583 - DNA, 5778 bp, Artificial Sequence
  Description of Artificial Sequence: Synthetic coding sequence
atgttcacactcacaggttgtaggttggttgagaaaacacagaaagtcgagaaccccagtgtgagtttcgcctcctctttccccttgattcccctgctcctacgcggcaaatccgtgcaaaaaaaacaggccgaatctaaaagtcagattaagctgcacacccagtccgcacccttcggcttgtgccctaaagacatgatgctgacccaggctccgtcttcggtggttagatctcgtaattcaaggaatcacacagtcaactccggcgggagctgcctttctgctagcaccgtggcaattcccgctatcaatgactcttcggctgctatgtcggcatgttccaccatctccgcccagcccgcatccagcatggacactcagatgcacagccccaagaagcaggagcgtgtgaacaagagagtgatctggggcatcgaagtcgccgaagagctgcattggaaggggtgggaactgggcaaagagacaacacggaacctggtgttgaaaaacagatcactgaaactccaaaaaatgaaataccgcccacccaaaacaaagttcttctttacggtaatcccccaacccatatttcttagccccggcatcaccttgacccttccaatagtgttccgccctctcgaggccaaagaatacatggatcaactgtggttcgagaaggctgagggcatgttctgcgtaggcctgagagctacgctcccgtgtcacaggctgatctgtcgcccaccttcactccagctgcccatgtgtgctgtgggagacaccacggaggcattcttctgcctcgataacgtgggagatttaccgaccttcttcacgtgggaatttagcagccccttccagatgctgccagcaactgggctgctggagcccggccaggcctcccagattaaagtgactttccagcctctgacagccgtaatttatgaggtgcaggccacctgttggtacggcgccggaagcaggcagcgttcctccattcagctgcaagccgtcgccaagtgtgcacagcttctagtctccattaagcacaaatgtccagaggaccaggatgccgagggctttcagaagttattatatttcggcagtgttgcggtcggttgtacatctgaaagacagatccgactgcacaatccctccgccgtcaacgcacctttccgaattgaaattagcccggatgaactggccgaggaccaggcttttagctgcccaacagctcacggaatcgtgctgcccggggaaaaaaagtgtgtttcagtcttcttccatcccaagactctagatacaaggacggtggattattgttctattatgccgtcagggtgtgccagcaaaactctgttaaaggtagtgggtttctgtcggggtcccgccgtttccctgcagcactactgcgttaatttcagctgggtaaatctaggggagagaagtgaacagcccctttggattgaaaatcaatcagactgcacagctcatttccagttcgctattgactgtttggagtcagtcttcaccattcgacctgcctttggcacactagtgggcaaagcaagaatgaccctccattgtgcttttcaacctacccatccaatcatttgtttccgtcgggtagcttgtctgatccatcaccaagacccactctttctcgatctaatgggtacctgccattctgattctacgaagccagccattttgaaaccacagcacctgacctggtaccgcacgcacctggcccgtgggctgaccctgtatccccctgatatcttggacgccatgctcaaagagaagaagttagcccaggatcaaaacggagctctgatgattcctattcaagaccttgaagatatgcctgcccctcaatacccgtatatacctccaatgacagaatttttctttgatgggacaagcgatatcacaatcttcccgccaccaatatcagtcgagcctgtagaagtagactttggagcttgtcccggtccagaagcgcccaatcccgtgccactgtgtctgatgaaccacacaaaagggaaaatcatggttgtctggacccggaggagtgactgtccattttgggtgactcccgagtcttgtgacgtccctcccctgaaaagtatggccatgaggctgcacttccaaccgcctcatcccaattgcctgtacacagtcgagctggaggctttcgcaatttacaaagtcctgcagtcttatagtaatattgaagaggactgcactatgtgcccttcttggtgtctgaccgtgcgcgccagggggcactcttacttcgcaggtttcgaacatcacattccgcagtacagcctagacgtgccaaagctatttccagctgttagcagtggtgagcccacctacagaagcctcctgctagtgaacaaggattgcaaactgctaaccttctccctggcgccacagcgcgggtcagacgtgatcctgcggcccacctccggtctcgtggcccctggtgctcaccagatcattcttatctgtacgtatccggaggggtcatcttggaaacagcacacattctacctgcagtgtaacgcaagcccccagtacttaaaagaagtgtcaatgtacagcagagaggagccactgcagttaaaactggacactcacaaatctctctattttaaaccaacctgggtgggttgctcaagcacgtctcccttcacatttagaaaccctagcaggctcccattacagtttgaatggcgcgtgtctgaacagcatcgtaagctgcttgccgtgcagccctcacggggcctcatccaacccaacgagagactcaccctcacttggacgttcagtcccttggaggagaccaagtacttgttccaggtcggtatgtgggtgtgggaggctggtcttagcccaaacgccaaccctgcagccactacacattacatgctacgtttggtcggcgtggggctcacgtcttccctttcggccaaggaaaaggaattggcattcggaaacgtgctcgttaattcaaaacagtcccgatttctcgtgctcttaaatgatggtaactgtaccctctactacaggctgtatctggagcagggctccccagaggcggttgacaaccacccgttggcgctgcaactagaccggacagaaggaagcatgcctccccgctcccaggacaccatctgtctaaccgcatgtcctaagcaaaggtcccagtactcatggaccattacttacagcctgctttcccacagggataataaggccggggaaaagcaggagctgtgttgcgtttccttggttgctgtgtatccattactgtcaatcttagatgtgagtagcatgggatccgcggaaggcattacgcgcaaacatctctggagactattctcgcttgatctgttaaactcataccttgagagggatcctacaccctgtgagttgacatacaaggttccaactcggcattcgatgagccagattccacccgttctcacccccttgcgcctggatttcaactttggggctgccccattcaaagcccctccatctgtcgtgtttctggccctcaaaaactcgggggtggtcagtctggactgggcattcctgctgccctcagaccaacgaatagatgtggagttatgggctgagcaggccgagctgaattctacagagctgcatcaaatgcgcgtgcaagataattgcctgttctctatttctcccaaggccggcagtcttagccctgggcaggagcagatggtggagttaaagtactcgcatctctttatcggtacagaccatctgcctgtgcttttcaaagttagccacggtagggagattctgctgaatttcattggagtaacggtgaagcctgagcagaagtatgtacatttcacaagtacaactcatcaattcattcccataccgatcggggataccctgccgccgcgacagatctacgagctgtataatgggggatccgttcctgtcacatacgaagtacagacggacgtgctctctcaggtccaggaaaagaacttcgatcaccctatattttgttgcttgaatcccaagggtgaaatacagccgggtagcacagctagagtcctctggattttctccccgattgaagcaaaaacatataccgtggatgtgcctattcacatcctcggctggaattcagctctcatccacttccaaggtgtagggtataacccacatatgatgggcgacactgctccctttcataatatttcatcgtgggataattcctccatccactctcgcttagtggtgccaggacagaacgtcttcctttcacagtcccacatttctctcggcaacatcccggtccagtccaaatgctcccgcctgctctttctgaataacatttccaaaaacgaagagattgcattttcctggcagccaagccccctggattttggggaggtcagcgtttcccctatgatcggtgttgtcgctccagaggagacagtgcctttcgtcgtcaccctgagggcaagcgtccacgcaagtttctactccgcagatctggtgtgtaaactgtacagccagcaactcatgcgccagtatcacaaagaactgcaggaatggaaggatgaaaaggtaagacaggaagtagagtttaccattacggacatgaaagtcaagaagagaacatgttgtacagcttgcgagcctgcgcgcaaatataaaaccctacctcccataaaaaatcagcagtctgtgtcgcggcctgccagctggaagttgcagaccccgaaggaggaggtgtcctggccctgcccacaaccaccgtcaccaggcatgctgtgccttggattgactgcacgcgctcatgctacggactatttccttgcaaacttcttctccgagttcccttgccatttcctgcatcgagagctcccaaagaggaaagcaccgcgagaggagagcgagacatccgaagagaaatcacctaataagtggggcccggtgagcaagcaaaagaaacaattactcgttgatatactgactaccataatacgcgggttgctggaagacaagaattttcacgaagcagttgaccagtcactagttgaacaggtgccttacttccgccagttttggaatgagcagtcaacaaaattcatggatcaaaaaaactcgctatatcttatgcctattcttcccgtcccgtccagttcgtgggaggatgggaaaggtaaacaacctaaggaagaccgaccagaacactacccagggctgggaaaaaaggaagaaggagaagaggagaaaggagaagaggaggaagaggagcttgaggaagaggaggaggaggaggaagagaccgaggaggaagaattggggaaggaggaaatcgaagaaaaagaagaagagcgggacgagaaagaagagaaggtgagttgggctgggatcggtccaacaccccagccagaatctcaggagtccatgcagtggcaatggcagcaacagcttaacgtgatggtcaaggaagaacaggaacaggatgagaaagaagccatcagacggcttcccgcttttgccaacctccaagaagcgctgttagaaaacatgatacaaaatatcctcgtggaggcctctagaggagaggttgtcctgacgtcgcgcccgcgcgttatagcgttgcccccattttgcgtaccccgtagcctgacaccagatacactgctcccaacgcagcaggccgaagtcttgcaccctgtagtgccactcccaactgatctgccatag

SEQ ID NO: 112584 - DNA, 816 bp, Artificial Sequence
  Description of Artificial Sequence: Synthetic coding sequence
atgactctgcactgcgcctttcagcctactcaccctataatttgctttcggcgcgtggcctgtctcattcatcatcaggatcctctcttcctcgacctgatggggacttgtcatagtgactcaactaaacccgcgatcctgaagccccagcatctgacatggtaccggactcatcttgccagaggtctcactctctacccgcctgacattttggacgctatgctcaaggagaaaaaactggcccaggaccagaacggggccctaatgattcctatccaggacctggaagatatgcccgctccacaatacccctacatcccccctatgactgaattcttctttgacgggacctcagacattaccatttttccacctccgatatccgtggagcccgtggaagtggattttggcgcatgtccgggtcccgaggctccgaacccagtgcccttgtgtctgatgaaccacaccaagggcaagatcatggtagtgtggacacgccgatctgactgtcctttctgggttacccctgagtcatgcgatgtgccccccctaaagtcaatggcgatgcggctacactttcagcctccacacccaaactgcctgtatacagtggaactggaggcctttgctatatacaaagtctgcgctcggaacgagcgagaagagtgcggcgtctctgctaggtctctgtctgggcttgtaggatggcaggaagtcaccgaaggctctttccgattgcacccgctcagggcccgcctgtctttaggctggaccgtgacccccatgtccctgtccccaccaaaacttctggcatag

SEQ ID NO: 112585 - DNA, 543 bp, Artificial Sequence
  Description of Artificial Sequence: Synthetic coding sequence
atggcagccttggatttacgcgcagagttggattctcttgttttacagcttctaggagatctggaggagctggaaggcaaaagaacggtcttaaatgccagggttgaagaggggtggctgtctcttgctaaagcaagatacgctatgggggctaagagtgtcggacctctgcagtatgcctctcatatggaaccccaggtgtgtctccacgcatccgaagcccaggagggactacaaaagttcaaggtggtgagggcaggcgtacatgcccctgaggaagtgggacctcgggaggctgggttgcggcggagaaagggccccactaaaacaccagagccagagagttctgaagctccacaagaccctttaaattggttcggtatcctcgtccctcacagcttaaggcaggcccaagccagctttcgcgatggattgcagctcgccgctgatattgccagcctgcagaatcggatcgactggggtcgtagtcaactcaggggactgcaggaaaaactcaagcagttggaaccgggagctgcatag

SEQ ID NO: 112586 - DNA, 567 bp, Artificial Sequence
  Description of Artificial Sequence: Synthetic coding sequence
atgggaacacccttggatggtggttcacgcgtacccatcgggtgtcccgccaagcttaggagggtgactaggaagaaggtggcacctgaccttgaaggctggctgtccctcgccaaggcccgatacgccatgggcgctaaatccgtggggccactgcaatatgcgtcacacatggaaccccaggtctgtcttcatgcctccgaagcacaggagggcttacagaagttcaaagtcgtgcgtgccggggtccacgctccagaggaggtcggtcccagagaggccggactaaggcggagaaagggaccaacaaagactcctgagcctgaaagcagtgaagccccccaggatcctctaaattggttcggaattctagttccgcattccctgcgtcaggcccaggcgtctttccgtgatggcgtgctggaggccaagaaacgaaagtgcttcctcgaacgagttatccagtgtgtagtgtccccagccgcagaacaggaagcggaggacgagtcctgcccggaggactgggctgccgctgtgccagccgagacatctgctaaagccatttag

SEQ ID NO: 112587 - DNA, 855 bp, Artificial Sequence
  Description of Artificial Sequence: Synthetic coding sequence
atgtccgataacaaggaaagaaaaagccagggcttccctaaggaggacaaccaagataccagttcgctggcagatgctgtcgagaaggttgccaaacagcagcagagccaagccagcgagatcgaaaagaataagaaggtgctctttaacctgaagaacgagctgcacgagctggaaaaagagattgcagcaattagcgccgagacaaaggaaaccgagcgccagatctatcagcaggactcagcaatagaaaatacaaagctgcactgcgattccctcgaaacccagattaaatccctgcactccgaaaatgtaaaactgaagttcgacattgagaccgctcaagaagacttcgaagaacatatgattaaatacaatgcatattacgccaaaatcaaagcccataaaaactctctgggcgaagtggagtccaaatggagtttcatgacggaactccacgagaagcgcgactttgtcaagaaacttaaaactatgaaggaggaactgatgcaggatttgcagaatccaggaggtaatcgcatcacacaggtgcaggaagacataactaatttaaaagacaagataatcactgtgaaggagtcaattatcgagaagacctgctttttagaggaggaaaaaaagacacatgagaagctgaggaaggagatagagagtctcgccccaagtcccagactggagtgttcttccgcaatctcagcacactgcaaactgtgcctgccagggtctcgacactcccctgcctcagccagtggcgtggcaggaactactggtgcctgccaccatacccaactgattttttgtatatttagcagggatggagtcagcccctgttag

SEQ ID NO: 112588 - DNA, 822 bp, Artificial Sequence
  Description of Artificial Sequence: Synthetic coding sequence
atgtcagacaataaggagaggaaatcccagggttttcctaaggaggataaccaggacacctcctccctcgccgacgcagtggagaaagtagccaaacagcagcagagccaggcgagcgagattgaaaaaaataaaaaagtgctgttcaatctgaaaaacgaactacacgagctggaaaaggagattgccgctatatctgccgaaactaaagaaacggaaagacagatttatcagcaggattcagctatcgaaaataccaaactccactgtgatagcctggagacccagattaagtccctccactccgagaatgtcaagctgaagtttgacatagaaaccgcccaagaagattttgaagagcatatgattaagtacaatgcctactacgccaagattaaggcccataaaaatagcctgggggaggttgagtctaaatggtccttcatgacagagctgcatgaaaagcgcgatttcgttaagaaactgaaaactatgaaggaggagctcatgcaggacctacaaaatcctggtgggaacaggattacacaggtacaagaagatatcaccaatctaaaagataagatcatcacagtgaaagaatcaattattgaaaagacgtgcttcctggaagaagaaaaaaagactcatgaaaagctgcgcaaagagattgaggtgcaacataagcgctatgacgccattctgaaacgcttacattgccaggtgaataaactccagtctaatcgccgacagtggcagtggaatatccagcagctcgagaaaacagccgcagagctcaggaaatgcatcggcatgcaggaatag

SEQ ID NO: 112589 - DNA, 1536 bp, Artificial Sequence
  Description of Artificial Sequence: Synthetic coding sequence
atgagtaaagtggcgcgcagtagcagcgagtctgatgtgcagttatgggagaccgaggaagacgacatgaccgagggcgatctggggtatggcttaggccgcaagcctggcggcatctacgagatcgaattttcccatcggtccaggaagaggtccgacggaaaaaattttagcccaccgcctttcccacgcaaaggcgaggaacggaatgaggccagttttcaatactcgaaacataaaagtcagcaggacacgtttcctcaggtctcacggatctcaaattaccggcgccagagctccactgttgacagtaactctgagctttcaaatgaagagctgaggcaatgtcttaatgaaacacttgaggaagtcgaaatgctcaagacggagctcgaggcgtcccagaggcagctcaggggcaaagaagaagcgcttaaaatcctgcagtctatggctatcttaggaaaagccacatctcatactcaggcggttctgcaaaagacgatggaacagaataggagcctggagaaggagattaacgccctccagtgggaaatcgagttcgaccacaataggttcaaaaatatagaagagtcctggattcaaaagtatgacaggctcaattgcgagaatgctgttttaaaggagaatctcaaggtcaaaacagaggagattaaaatgctgaaaagcgacaacgcggtcctgaatcagagatacctcgaggctcttgctatgctcgatataaaacagcagaaaatggcccaagaaaacatgtgctgcgacaagtctgggttcgctgaagcctcaggtctggagcttgccgtgctgggggcgtgcctttgccacgggccgggtggcaatccttgctcttgtgcccgaatggccgccagcaccaggaaactgctgcttcagctcaagcaagagttggagatcttacagaaatctaaggaagaagcctatgtcatggcagatgctttccgaatcgccttcgagcagcagctcatgcgcaagaatgaccaagctctacagcttacgcagatggacaagatgcacaaaaaggcaaccaaatggatgaattggaagcacctgaaagaggacgggtttccttctccccgttctaaaaaaacttttgggcagcggttgctggggatgctaccttcggagaactcgtctaagcggatggaagaccaggacagccctcaagaggtgttgaaaatgctcatcgacttactcaacgacaaagaagaagccctggcgcatcagcggaaggtgtcttatatgctggcccgtgctttggaggacaaggacacggcctccaatgaaaataaggagaagaaccccataaaggaaaattttccattcaataacccctggaggaagacttctgaatttagcgtgcttggggatcccattcactccagcgtgtgcatcctcaattctgttggttgtatctgttccatccagcacagccaaatcgatccaaactatcgcacccttaaacggtcccactcccttccatcatcaattattttttag

SEQ ID NO: 112590 - DNA, 1536 bp, Artificial Sequence
  Description of Artificial Sequence: Synthetic coding sequence
atgtccaaagttgcaagatccagctccgaatccgacgtccagctgtgggagaccgaggaagacgacatgacagaaggcgatctagggtacggattgggccgtaaacccggggggatctacgaaatcgagttcagccacagatctcgtaagcgttcagacggtaagaactttagccctccaccgttcccaagaaagggcgaagagcgcaatgaggcatcttttcagtactccaaacataaaagtcagcaagacactttcccacaggtttcacggatttccaattatcggcgacagagcagcacagtcgactctaactctgaactgtccaacgaggagttacgccagtgtttaaatgagacgctggaggaagtcgagatgctcaagacggaactggaggcgtcccagaggcagttacgcggcaaggaagaagccctgaaaatcctgcagtctatggcaattcttggcaaggcgacatcccacacccaagctgtgctgcagaaaacaatggaacaaaaccgcagtctggaaaaagagattaacgctttgcagtgggagattgaatttgatcacaacaggttcaagaatattgaagaaagctggattcagaaatatgacagactgaactgtgagaacgcagtgcttaaagagaatctgaaggtcaagacagaggaaattaagatgcttaagtcagacaatgccgtgttaaaccagcgctacctggaggcattggcaatgctcgatatcaaacagcaaaagatggcgcaggagaatatgtgttgcgacaaaagcggttttgccgaggcttcaggattggaacttgccgtgctgggcgcctgtctttgccatggacccgggggtaacccctgcagttgtgctcgtatggcagcatcaactcgcaagctgcttcttcaactgaagcaggaattggagattttacagaagtccaaagaagaagcatatgtcatggcagatgcctttcggatcgcctttgaacagcagctgatgcgtaaaaacgaccaggccctgcaactgacacagatggacaaaatgcacaagaaagccaccaaatggatgaactggaagcatttaaaggaggatgggttcccctcccctcgaagcaagaagacctttgggcagcgcttgttgggcatgctgcctagtgaaaacagcagcaagagaatggaagatcaggatagcccacaagaagtgctaaagatgcttatcgatctcctgaatgataaagaggaagctctagcacatcagcgaaaagtgagttatatgctggccagagccctcgaagacaaagatacagctagtaacgagaataaggaaaaaaacccgatcaaggaaaatttcccctttaataacccttggcggaagacatctgagttctcagtccttggcgatccgattcattcgagcgtgtgtattctgaatagcgtgggctgtatatgctcaattcagcactctcagatcgatccgaattataggactctgaagcggtcccacagcctcccaagttccataattttctag

SEQ ID NO: 112591 - DNA, 1161 bp, Artificial Sequence
  Description of Artificial Sequence: Synthetic coding sequence
atgctcaaaactgaacttgaggcaagtcagcgccagctaagggggaaagaagaggcattaaagatccttcagagcatggcaattctgggaaaagctacctcacatactcaggctgtgctgcagaagactatggaacagaaccgctccctcgagaaggagataaacgctctccagtgggagattgagtttgaccacaacagattcaagaatatagaagaaagctggatccagaaatacgaccgcctgaattgtgaaaacgctgtactgaaagagaacctgaaagttaagacagaagagataaagatgttgaagagtgataatgcggtgttgaaccagagatacctggaggcccttgcaatgcttgacatcaagcagcaaaaaatggctcaagagaatatgtgctgtgataagagtgggtttgccgaggcgtcggggctcgaattggcagtcctaggcgcctgtctttgtcatggccctggcggtaacccttgcagctgtgcccgcatggcggccagcacccggaagctactcctgcagcttaagcaggagctggaaattctgcaaaaatccaaggaagaagcctacgtgatggctgatgccttcaggatcgcttttgagcagcagttaatgagaaaaaatgatcaggccctacagttaactcagatggacaaaatgcacaaaaaagcaacaaaatggatgaactggaagcacctaaaagaagacggtttcccttccccgcgctccaaaaaaacttttggacagcgactgcttgggatgttgccaagcgaaaattcttcaaagaggatggaagaccaagactctccacaagaagtgctcaaaatgttaatagatctgttgaacgacaaagaggaagctctcgcacaccagaggaaggtctcttatatgctagccagagctctggaagataaagacacggcgtcaaacgagaacaaagagaagaatccaatcaaggagaactttccattcaacaacccatggagaaagacctctgaattctcggtgctgggagatcccattcacagctccgtttgtatcctcaacagcgtcggttgcatttgctctatccaacacagccagattgaccccaattatcgaaccctgaagaggagccattctctgcctagtagtatcattttttag

SEQ ID NO: 112592 - DNA, 3465 bp, Artificial Sequence
  Description of Artificial Sequence: Synthetic coding sequence
atgcaagctatggagggagaagtgttactgccagccctgtacgaagaggaagaagaggaggaggaagaggaagaggaagttgaagaagaggaggagcaggtgcagaaaggggggagtgttggctccctcagcgtgaacaaacatcgtggactttctctgaccgaaaccgaattggaagagctaagggcacaggtgctgcagctggttgcggagctcgaagagacgagagagcttgcagggcagcacgaggatgattctctcgagctgcagggcctgctggaggacgagcggctggcgtctgcacaacaggccgaagtattcactaaacagatccagcagttgcagggagaacttaggtccctgcgggaggagatttcccttttagaacatgaaaaggaaagcgaactcaaggagatagaacaggaacttcacctggcgcaggccgagatacagtcacttagacaggccgcagaagactccgctacagaacatgagagtgacattgcctccctacaggaggatctctgtcgaatgcaaaacgaactcgaagatatggagaggatcaggggagactacgaaatggagattgcttctctgcgcgccgaaatggagatgaaatccagcgagcccagtggaagtctgggactgagcgactattccggacttcaagaggagctgcaggaattacgggaaaggtaccatttccttaatgaggaataccgagctctgcaagagagcaattcttccctgaccgggcagttggcagacctagaatcagagagaacccaaagggcaaccgagaggtggcttcagtcccagaccctgtcaatgacctcagccgagagtcagacatcagagatggatttcttggagcccgacccagagatgcagctgctgcggcaacagctgagagacgctgaggagcaaatgcatggaatgaaaaacaaatgtcaagaattgtgctgtgaactggaggagctgcagcaccataggcaagtgtctgaagaggagcaacgtcgcctacagcgggaactgaagtgtgctcaaaatgaagtcctccgctttcagacttcccatagcgtgacccagaatgaggaacttaaaagcagactgtgcacgcttcaaaagaaatacgacacatctcaggatgagcagaacgagctgctcaaaatgcagctccagctgcagacagaactaaggcagctcaaagtgatgaaaagcactcttgtagagaaccagagcgaaaaagagttactctgtcgtctgcagaaactacatctacagcaccaaaacgtaacctgcgagaaagagaagttactggaaaggcagcagcaattgcaggaggagctgcaatgtcacgaagcagaacttcaacacttacgagatacagtcgcttcattcaaggaatctaacgagaaagataccgaaacgcacgctcaacttcaggaaatgaaacagctatatcaggcatccaaagacgaactcgagagacagaaacacatgtacgaccaattagaacaggatctgctgctttgtcagcttgagctgaaagagctgaaagcaagtcacccgattccagaggacaagggtaaatgtgcgaacaagtgcgacacccttttatctcggcttaccgagctacaggaaaaatataaagcctcccagaaagagatgggacagcttcagatggagcagtgtgaacttctggaggatcagagacgaatgcaagaagaacagggacaactacaggaagagctccatcggttgaccctacctctgcccaagtccggactgctcctcaaatcccaagagctgctaaccaagttagaagatttgtgcgagctgcagctgctgtatcaaggcatgcaggaggaacagaagaagcttatccagaatcaagattgtgtgctgaaggagcagctggagatccatgaagagctaagaagatttaaggagtcccacttccaagaggtgctggaaaaccccgacgatagtaagctggccaaaagcagcaagtgcaaccgtaataagcagagcaagctgctgatggagcagatgcaggccctacaggtaatgtatgacgcggggcaagctaagcaagagttactgcagcaggaacaaggccgtcttctagaagagagaaagaggttacaagccgacctgcagctctgtctggaggagatgcagctcctccaagttcagagcccgtccattaaaatgagtctggaaagctacgggaaatcttatgggtctatggtgccatcaaacgaaaactgtaggaagacctacgatactacagtggatgacaatgagtcctactataagtcctacacatccactcaaactagctccaagagtttcctgaagtcttatgactcgtccacgagcgctagcgaggcttatggcaagagctattgtaccacctctaactctagtatcacttataagaagagctatggctctacgtcaagcagtgatacatgtcaaaaaagctttgtctcttcctgcactgacgaggagcccgctgaaccagaggatatggaacgcttcgaggaaatggtcgtgaaagtcctgatcaaactccaggctgtgcaagctatgtatcagatttcacaggaggagcactcgcagcttcaggagcagatggagaaactcctagctaaacagaaggatctgaaagaggagctcgacgcatgcgaaagagagtttaaagaatgcatggagtgcctggagaagccaatggctccacagaacgacaagaacgaaatcaaggaactccagacaaaactccgggagttacagttacagtaccaggcctccatggacgagcagggcaggctgctcgtggtccaggagcagctggagggccagcttcagtgttgtcaagaggaactgcgccaactgcgtgagaagcgaccgagtgttgttaaagaggctcggggcaaaaatgcgaacaagaatatgaataagaatgccaatggggttaaaatgaaaaaagtaactaagccttgtagcgatacatcagagagtgacctggaaacccggaaatctctggaggtagtcctttactataaggctagccagaggaaattggatggccttgcaaaggaggaggagaagaaagaagaaatggaggaagagaagaaacaggtgaaagaggaagcaaaggagcagtgtggcgacgaactggtagcggagcccgccgatcctgaggaagccaaatctacagaagaccaagaagaaaatgaagaggataaggaggaggaagagaaagaggaggacagcgaggaggaggaggatgacgcagatagctccctcgagtcacccgaggagaataatccactgcggctcagcgagagcaagaaatcctcaccgacacccaatccccctattttttccctcccgctcgtcgggttagtggtgatctccgccttgctttggtgttggtgggccgagacaagttcatag

SEQ ID NO: 112593 - DNA, 2874 bp, Artificial Sequence
  Description of Artificial Sequence: Synthetic coding sequence
ctccgcgcactcgaaggagaggtcttactcccagccctgtacgaggaagaggaagaggaggaggaagaggaagaagaggtggaagaagaggaagaacaggtacaaaagggaggctcagtgggtagcctgtccgtaaacaagcatagggggctgtcactgaccgaaaccgagctagaggaacttcgagcacaggtgctgcagttagtggccgaattggaggaaactagagaactggcagggcagcatgaagacgatagtctggagctacaggggttgctggaggacgagcggcttgcgagcgcccagcaagccgaggtgttcaccaaacaaatccagcagttgcagggcgagctgagatcactgagagaggagatctcactcttggagcacgaaaaggaaagcgaattaaaggaaattgagcaggaactgcaccttgcccaagccgagatacaaagcctgagacaggccgcggaggactccgccacggaacatgagtctgacattgcatcactacaggaggacctgtgcagaatgcagaatgaactggaagatatggaacggattcggggggattacgagatggaaatagcttccctgcgggctgagatggaaatgaagtcttccgagccgagtggcagtcttggcctcagtgactactcaggactgcaggaagaacttcaagagcttcgagagaggtatcattttttgaacgaagaataccgggccctgcaggagtctaattcttctttaacagggcagctagctgatcttgagagtgagaggacccagagggcaaccgagcgctggctgcaatcacagactttaagcatgacatccgcagagagccagacttccgaaatggactttctagagcctgatccagaaatgcagttgctgaggcaacaattgcgggatgccgaagagcagatgcacggtatgaagaacaaatgccaggagctgtgctgcgagcttgaggagctgcagcaccatcgccaagtgagcgaagaagaacagaggagactgcagcgcgaacttaagtgtgctcagaacgaggtcctgagattccagacgtctcacagtgttactcagaacgaggagctcaaaagtaggttgtgtactctgcagaagaaatacgatacatcccaagatgagcagaatgaactactgaagatgcagttacaactgcagactgaactgcggcagctgaaagtgatgaaatccacacttgtggagaaccagtccgagaaagagctcttgtgtagactccagaaactccacctacagcaccagaatgtcacctgtgagaaagagaagctactcgaacgtcagcagcaactgcaggaagagttgcaatgccacgaggctgagctccaacatcttagggatacagtggccagttttaaggagtcaaacgagaaagacacagagacacacgcccaactgcaggaaatgaagcagctgtatcaggccagcaaggacgaactcgagcggcaaaagcacatgtacgaccagcttgagcaggatctccttctttgtcagcttgagctgaaagagttaaaagcttcgcatcccatccccgaggacaaggggaagtgtgcaaacaagtgcgacaccctgctgagtcggctcaccgagctgcaggagaaatacaaggccagccaaaaggagatgggacaactgcaaatggaacaatgtgaacttctggaagaccaacggcggatgcaagaagagcaaggccagctacaggaggagctccaccgactcacactgcctctgccaaaatcaggcctgttactaaaatcgcaagaactgctgaccaaactggaggacctctgcgaactccagctcctctaccagggaatgcaagaagaacagaagaagcttattcagaatcaagactgtgtgcttaaagaacagcttgaaatccatgaggaactgaggcgcttcaaagagtctcatttccaggaggttcttgagaaccccgacgattcaaagctcgctaagagcagtaagtgcaataggaataagcaaagcaagttgctgatggagcaaatgcaggccctacaggtaatgtatgacgcggggcaggccaagcaagagctactccaacaagagcagggccggctgttagaggaacgaaagcgactacaagcagacctgcaactgtgcctggaagagatgcaactcctccaggtacagtctccctcaatcaagatgagtctcgagtcctacgggaagagctacggatccatggtgccttcaaacgagaattgccgcaagacgtatgatacgactgtcgatgacaacgagtcatactacaaaagttacacatcgacacaaacatctagcaagtcgttcctcaaatcatacgacagctccactagtgcgtccgaggcgtatggaaagtcttattgcacaacatcaaattcgagcattacctataagaaaagctatggatctaccagttcaagtgacacctgccagaaaagtttcgtgtccagttgtaccgacgaggagcctgcagagcctgaagatatggagagattcgaggagatggtggtcaaggttcttatcaaacttcaggctgtgcaggccatgtaccagatcagccaggaggagcactctcagctgcaggagcaaatggagaaactgttggctaaacaaaaggacctgaaagaggagctggacgcatgcgaacgcgagttcaaggagtgcatggagtgtctagagaaacctatggctcctcaaaacgataagaacgagaatatgtttggcctgtggaagccaatggtatttcttgccatcgccgccgttgcactctatgtgctgccaaatatgagacaacaggagtcggagttttgcttaatggagtag

SEQ ID NO: 112594 - DNA, 1305 bp, Artificial Sequence
  Description of Artificial Sequence: Synthetic coding sequence
atggaggctggcgcaggagctggcgccggcgcggcgggatggtcttgccccggccccggccctactgttactacactgggctcctacgaggcctcagagggctgtgaaaggaagaagggacagcgttggggatcacttgaaagacgcggaatgcaggcaatggaaggcgaagtgctgctgcccgcactatatgaggaagaggaagaagaggaagaggaggaagaagaagtggaagaagaggaggaacaggtacagaaggggggctcagttggttccctctccgtgaacaaacaccgcggcctgtcactgaccgaaacagagcttgaggaactgagagcccaggtcctacagctggttgctgaattggaagaaacccgggagttagccgggcagcacgaggacgattccttggagctgcaggggttactggaagatgagagactggccagtgcccagcaggcggaggtgtttactaagcagattcagcagcttcagggcgaactgcgcagcctgcgcgaggagatctctctactagagcatgaaaaagaaagtgaactcaaagagatagaacaagagctccacctggcacaagctgaaatccagtccctccgccaggccgccgaggacagtgcaacagaacacgaatctgacattgcttctctgcaagaggatttatgccgtatgcagaatgagctagaagacatggaaagaatcagaggtgactatgagatggagattgcctcacttagggctgagatggaaatgaaatcatctgaaccatcagaagagttgcaggagctgcgggaaagataccattttcttaatgaggagtaccgtgccctgcaggagtctaattcttcgctgaccggacaactggcggatcttgagtctgaacggacacagagagccaccgagagatggctacagtcgcagacgttaagcatgacctctgcagagagtcagacgagcgaaatggattttctggaacctgatcctgagatgcagctgctgaggcagcaactgagagatgctgaagagcagatgcacggaatgaaaaataagtgtcaagagctgtgttgcgaattggaagaactccaacaccatcggcaggtgtctgaggaggaacaacgtcgcctgcagcgtgagctgaagtgtgcccaaaacgaggtcctgagatttcagacttcacacagtgtgacccagtcctctcccacgcccaatcctccaatcttctcactgcctttagttgggttggtggtgatcagcgcgctcctgtggtgctggtgggccgaaaccagcagctag

SEQ ID NO: 112595 - DNA, 3474 bp, Artificial Sequence
  Description of Artificial Sequence: Synthetic coding sequence
ctgcgcgcgttggaaggtgaagttttgctgccggccctatatgaggaggaggaagaagaagaggaagaggaagaagaggtggaagaagaggaggagcaagttcagaaggggggttcggttggtagcctgtcagtgaataaacatcgcggactgagtcttacagagacggagctcgaagagctaagagctcaggttctccagctggtcgccgagctggaggaaacccgagagctggctggacagcatgaggatgacagcttggaactccaaggtttactggaggatgagcgattggcatcggcacaacaggctgaagtgttcactaaacagattcagcagttacagggagaacttaggtcgcttagagaagagatctctctgctggagcatgagaaggaatctgagctaaaggagatagaacaggagttacacttggcccaggcagagattcaatcactgcgacaggcagccgaagattccgcaactgagcatgagtctgatatcgcttctctccaagaagatctgtgccgcatgcagaatgaactggaagatatggagagaatcaggggcgactatgaaatggagatagcaagtctgagagcggagatggaaatgaagagctctgagccatctggcagcctcgggctttctgattatagtgggctacaggaagagcttcaagagctgcgcgagcgttatcacttcctgaacgaggagtaccgagccctccaagaatcgaattcttctctgaccggccagcttgcagacttggagagcgagaggacgcagagagcaactgaaaggtggttacagtcccaaacccttagtatgaccagcgctgagtcccagacctcagaaatggacttccttgagcctgatccggagatgcaactgctccggcaacagctacgagatgccgaagaacagatgcatggcatgaaaaataagtgccaagagctgtgctgcgaactggaggagctccaacaccatcggcaggtgtcagaagaggaacagcgacgtctacagcgtgagctcaaatgtgcacaaaacgaggtgctgcgcttccagacctctcattcagtaacccagaatgaagaactgaaaagccgcctctgcaccttgcagaaaaagtatgacacctcacaggacgaacaaaatgagctcctgaagatgcagctgcagctgcaaaccgaacttcgccagctgaaagtcatgaagagcaccctagtagaaaaccaatccgagaaagaactgctgtgcagactccaaaaattgcacctccagcatcaaaatgtcacctgtgagaaagaaaaactgctcgagcgccaacagcaactgcaggaagagctgcagtgccacgaagccgagctccagcatcttcgcgatacagtggccagcttcaaggaatccaacgaaaaggacactgagacgcacgcgcagctgcaggaaatgaaacaactgtaccaagcctccaaagacgagttagaacgacagaagcatatgtatgatcaacttgagcaagatctgcttttgtgccagttggagcttaaagagttgaaggccagccatcccatccctgaggataaagggaaatgtgcgaataagtgtgacaccctgctcagccgacttacagagctgcaggaaaagtacaaggctagccagaaggagatggggcagctgcaaatggagcaatgcgagctcctggaggatcaacgtcggatgcaagaagagcagggccaactgcaggaggagttgcaccggctcactctcccactgccgaagtctgggctactactaaaaagccaggaattgcttacaaaactagaagatctttgtgagctgcaattactttaccagggaatgcaggaagaacaaaagaagctgatccagaatcaggattgcgtgttgaaggagcaactcgaaattcacgaggagctgcgccgtttcaaggagtcgcacttccaggaggtactcgagaatcctgatgacagcaagttagcgaaatcatctaagtgcaacagaaacaagcagagtaaactgttgatggaacagatgcaggcactccaagtgatgtatgacgctggtcaggcgaaacaggaactgctacagcaagagcaaggtcgtctccttgaagagcgaaagcgtttgcaggcagacttgcaattatgcctggaggagatgcaactattacaggtccagagccccagcatcaagatgtcgttggagagctacgggaagtcatacggttcgatggtaccatcaaatgaaaattgcagaaagacctacgacacaactgtggatgacaatgagtcttattataagagctacacgagtacgcagacctcctcaaagagtttcctgaagtcttacgatagctcaactagtgcctccgaagcctacggaaaatcctactgtactacatctaatagctctatcacctataaaaagagctacggtagcacttcctcatcggatacgtgccagaaatcatttgttagtagctgcacagatgaagaaccagcggagccagaggatatggaacgttttgaagagatggtggtgaaagtgttgattaaactccaagccgtccaggctatgtatcaaatttctcaggaagagcactcgcaacttcaggaacagatggagaaactcttagcaaaacaaaaagacctcaaggaggagttggatgcctgtgagcgcgaattcaaagaatgcatggagtgcttagaaaaacctatggcaccccagaatgataaaaacgaaatcaaagagttgcagacaaagttgagagagctgcagctccaatatcaggctagtatggacgaacagggccggttgttagttgtgcaggagcaattggagggacagttacagtgctgtcaggaagaactcagacagttgcgagagaaaaggccttcagtcgtcaaagaggcccggggtaagaatgcgaataaaaacatgaataagaacgcaaatggagtgaaaatgaagaaagtgaccaagccttgcagtgacacttctgagtcggacctagaaacccgcaaaagtcttgaggtggttctgtattacaaggccagtcagcgcaaactggacggtctcgccaaggaggaggagaaaaaggaagaaatggaggaggagaagaaacaagttaaagaggaggccaaagaacagtgcggtgacgagctcgtagcagagccagctgatcctgaggaagctaaatcaacagaggaccaggaagagaacgaagaagacaaggaggaggaggagaaggaggaagacagcgaggaggaggaggatgatgccgacagctccctagagagtcccgaggagaataatcccctgcgattatcagagagcaaaaaaaatatgttcggcttatggaaacctatggtcttcttggccatcgccgctgtggctctctacgtcctgcctaatatgcggcagcaggagagcgagttttgcctgatggagtag

SEQ ID NO: 112596 - DNA, 309 bp, Artificial Sequence
  Description of Artificial Sequence: Synthetic coding sequence
atgcaggccatggagggcgaggtcttgttgcctgctctatacgaagaggaagaggaggaggaagaggaagaggaggaggtagaagaagaagaggagcaggtgcaaaaagggggctcagtaggctcattgtcagtgaataaacataggggtctttcattgacagaaactgaattggaggaactacgtgcccaggtactgcagctggtggccgagcttgaagagacaagagagctcgctggacagcacgaggacgacagcctcgaactgcagggtctgctggaagatgaacgcttggcttccgcccagtag

SEQ ID NO: 112597 - DNA, 1341 bp, Artificial Sequence
  Description of Artificial Sequence: Synthetic coding sequence
atggaggctggtgcaggcgccggcgctggggctgccggctggtcttgtcctgggcctgggcccacggtgacaacacttggatcctacgaagcctccgaaggctgtgaaaggaagaaggggcagaggtggggctccctagagcgtagaggcatgcaggccatggaaggcgaggtactgctgccagctctgtacgaggaggaagaggaggaggaagaggaagaagaggaggttgaggaagaagaggagcaggtgcagaaaggggggtctgttggatcactgagcgtgaataagcatcgaggattgtctctgaccgagaccgaacttgaagagctcagagctcaagttcttcagcttgtagctgaacttgaggagacccgagagctagccggacagcacgaggacgattctctcgagttgcagggtctcttagaggacgagcgcttggctagcgcccagcaggcagaggtttttactaaacaaatccagcagctgcagggagaactgaggtctctgagggaagaaatcagccttctggagcatgagaaagaatctgaattgaaggaaattgagcaggagctgcacctggcacaggccgagatccaaagcttacgacaggctgctgaggactcagccactgaacacgagtccgatatcgcgtccctccaggaggacctgtgcagaatgcaaaatgaactcgaggacatggagcggatccggggtgactacgaaatggagatagccagtttgagagccgagatggaaatgaagtccagtgagccaagcggaagcttgggcttgagtgactactccggcctgcaggaggaactccaggaacttagggagaggtaccactttctgaatgaagaatatagggcattgcaggagagcaactcttcactgacaggccagctcgctgacctggagtcagagaggacgcagcgagccacagagcgatggctgcagtctcagacactgagcatgacatcagccgagagccagacatcggagatggatttcctggagcccgaccctgaaatgcagctactacggcaacaattgcgagatgccgaagagcagatgcatgggatgaagaacaagtgtcaagagctgtgttgcgagctggaggagctccagcatcacaggcaggtgtcagaagaggaacagcgacgcctccagagggaactgaagtgcgcccagaacgaagtcttacgttttcaaacctctcattctgtgacgcagagctctccaactcctaacccccctattttctccctcccactggtgggcctggtggtgatttccgccctgttgtggtgttggtgggccgaaactagctcttag

SEQ ID NO: 112598 - DNA, 21 bp, Artificial Sequence
  Description of Artificial Sequence: Synthetic coding sequence
atgcaggccatggaggggtag

SEQ ID NO: 112599 - DNA, 414 bp, Artificial Sequence
  Description of Artificial Sequence: Synthetic coding sequence
atgcaggccatggagggggaggttctgctgcccgcactttacgaggaggaagaagaggaggaggaagaggaggaagaagtggaggaagaagaagagcaggtccaaaagggaggatctgtgggcagtttgtcagtgaataagcatcgagggctatccctgaccgagacagaattggaggaactccgggcccaagtgttgcagttggtcgctgagctggaagagactagggagctggctgggcaacacgaggacgatagcctggaactgcaagggcttctggaggacgaacggctggcgagcgcccagcaagcagaagtgttcacaaagcagattcagcaactacaaggcgagctcagaagtttacgagaagagataagcctcttggagcatgagaaagagtcagaactcaaatag

SEQ ID NO: 112600 - DNA, 192 bp, Artificial Sequence
  Description of Artificial Sequence: Synthetic coding sequence
atgcaggctatggaaggcgaggtactgctgccggccctgtacgaggaggaggaggaggaagaagaggaagaagaggaggtggaagaggaagaggagcaggttcagaaaggcgggtctgtcggttctctttccgtgaacaagcataggggactcagcctaactgaaactgagcttgaggaattacgggcttag

SEQ ID NO: 112601 - DNA, 870 bp, Artificial Sequence
  Description of Artificial Sequence: Synthetic coding sequence
atggccggtgcggggcgcggcgcggccgtcagcagagtccaagccggacctggttccccacgcagggctcggggtcgccaacaggtccagccactcgggaaacagagacccgctccatggccgggcctgcggtctaaagaaaaaaaaaaggttaactgcaaaccaaaaaaccaggatgaacaagaaattccatttaggcttagagagataatgagatcgaggcaagaaatgaaaaacccgataagcaacaaaaagcgcaaaaaggcagctcaagtgacattccggaaaaccctggaaaaggaggcgaaaggtgaggagccggacattgccgttccaaaattcaagcagaggaagggtgagtcagacggggcatatatacatcggatgcagcaggaggcacagcacgttctgttcctatctaagaatcaggcaattcgacagccagaggtacaggcagctccgaaggaaaagagtgaacagaagaaagctaagaaagctttccagaagagaaggttagacaaagtgagaaggaagaaagaggaaaaagctgctgacaggctggaacaagaattgctcagggacaccgtcaaattcggggaggtggtgcttcaaccaccggaactgactgcccgcccacagagaagtgtttcaaaagatcagcctggcagacgctctcagatgctgcggatgctgctctctccagggggggtctctcagcctctcacagcctcactcgccagacagcgcattgtggaggaggaaagagagagagctgtgcaggcctatcgggcattgaagcaaaggcaacaacagttgcacggagagcgcccccacctgacatctaggaaaaagcctgaacctcagctgtag

SEQ ID NO: 112602 - DNA, 1656 bp, Artificial Sequence
  Description of Artificial Sequence: Synthetic coding sequence
atgccattaagcaccgccggaatcctgagcagctcttccgctgcctctaaccgatctcggaacaaagctcggtatagaaccaaggctgtgtccagcgaggtggatgagtccttgtttggggacataaagagccccgcgcagggccagtctgattctcctatcgttcttctacgagataagcatacactccagaaaaccctgacagctctaggtctggatagaaagcccgagaccattcaacttattacacgggatatggtgcgggagttaatcgtgcctaccgaggacccctccggggagtcattgatcataagtcctgaagaatttgaaaggatcaaatgggctagccatgtgctcacgcgggaagagctggaagcaagggaccaggccttcaaaaaggaaaaggaagccactatggacgccgtgatgacacgtaagaagataatgaaacaaaaggagatggtctggaataacaacaaaaagttaagtgatctggaagaggtagccaaagaacgcgcccaaaatttgttgcaacgtgccaacaagcttagaatggagcaagaggaagagctcaaagatatgagcaagatcatcctaaacgccaagtgtcacgcaatacgagatgcacaaattctggagaagcagcagattcagaaggagcttgataccgaggagaagaggctcgatcagatgatggaggtggaacgacagaagtctattcaacggcaggaagagctcgagaggaagcgccgggaagagagaattcgcggacggcgccagatcgtggaacaaatggagaagaatcaagaggaaagatcgctgctcgccgagcagcgcgagcaagaaaaagagcagatgttggagtacatggagcagttacaagaggaggatcttaaagacatggaacgaagacagcagcaaaaactgaagatgcaggctgaaataaaacggattaacgatgaaaaccaaaaacagaaagctgaattgttagctcaggaaaaactggccgaccaaatggttatggagttcacaaagaagaaaatggcccgcgaagcagagttcgaggcggagcaggagagaattagaagggagaaggaaaaagagattgcaaggctgcgagcaatgcaggaaaaggcccaggattatcaagccgaacaggatgcactgcgtgccaaaaggaaccaggaagtcgccgacagggagtggagacgcaaggagaaggaaaatgcccgcaagaagatggagaccgaggcagagctcagaaagagtaggctcgagcaggtggcttttaaagagcatgcgctagccgtacaggtgcagagggatcgtgacgagttcgaaaggattctcagagcgcaacgcgagcaaatcgagaaagaacggctcgaggaggaaaagaaggcaacaggacgtctgcagcacgccaatgagttgagacgacaagtgcgggaaaaccagcagaaggaggtgcagaatcgtattgctacattcgaggagggaaggaggctcaaagaagaagcccaaaaaagacgtgaacgcatagatgagattaagcggaaaaaactggaggagcttagggctactggcctaccagagaaatattgcatagaagccgagcggaaggctaatattctgcccgcaacatccgttaattag

SEQ ID NO: 112603 - DNA, 1401 bp, Artificial Sequence
  Description of Artificial Sequence: Synthetic coding sequence
atggttagagagctgatcgtgccaaccgaggatcctagcggcgagtctcttattatttcacctgaagagttcgaaaggataaagtgggcttcgcacgttcttacccgcgaggagttggaagctcgggaccaggccttcaagaaggagaaagaggcgaccatggacgcagtcatgacccgtaaaaaaattatgaagcagaaggaaatggtgtggaacaacaacaagaagctgtcagacttggaggaagtggctaaggagcgggcccagaatttgctgcagcgtgccaacaagctcaggatggagcaggaagaggaactaaaagatatgagcaagatcatcctgaatgcgaagtgtcacgccattagagatgctcagatactcgagaagcagcagatccaaaaggagctggacaccgaagaaaaacgcctggatcagatgatggaagtcgaacggcaaaaatcaatacaaaggcaggaggagctggagcgcaaaaggcgggaggagcgtattcgtgggcgtcgccagattgtagaacagatggagaaaaatcaggaagaacgatccttactggcggaacagcgcgaacaagaaaaggagcagatgctcgagtatatggagcagctgcaggaagaagatctgaaggatatggagcgaagacagcaacagaagctgaaaatgcaggctgagatcaaacgcatcaacgacgagaatcagaagcagaaagctgaactcttggcgcaggaaaaactggcggaccaaatggtgatggagttcactaaaaagaagatggctcgagaggctgaattcgaagcagagcaggaaagaattagaagagaaaaggagaaggagatagcccgtctgcgagctatgcaggagaaagcacaggactatcaggccgagcaggacgctctgcgcgcgaagcggaaccaggaagtggcagaccgcgagtggaggagaaaggagaaggaaaacgcaaggaagaagatggagacagaggccgaattacgtaagtccaggctggaacaagttgccttcaaagaacacgcactggccgtgcaggtgcaacgcgacagagacgaattcgaaaggatcctgcgggcacaacgggagcagatcgaaaaagagaggctggaagaggaaaaaaaagcaacgggtaggctgcaacatgcaaatgagctgcgccgtcaggtccgcgagaaccagcagaaggaagtgcagaaccgcattgccaccttcgaggaagggcgcaggctcaaggaggaagcacagaaaagaagggaaagaattgacgagattaagcgtaagaagctcgaggaactgagggccacggggcttcctgagaaatactgtattgaggcagagaggaaagccaatatcctgcccgcaaccagtgtgaactag

SEQ ID NO: 112604 - DNA, 1884 bp, Artificial Sequence
  Description of Artificial Sequence: Synthetic coding sequence
atggaggaggccgatcgtatattaatccattccttgaggcaggcaggcacagctgtgcctccggacgttcaaaccctgagggcctttacgactgagctagtggtcgaggccgttgtgagatgtctgcgagtaatcaatccagccgtgggaagcggactcagcccactgttaccgctggcgatgtcagcaaggttcagactcgccatgtcactcgcacaggcttgtatggacctgggctatcctcttgaactcgggtatcaaaacttcttgtatccttccgaacccgacctccgagatctgctgcttttcctcgccgagagactgcctacagatgcctcagaggacgccgatcagcctgctggggattccgcaattcttctgcgagcaattggaagtcaaatccgcgaccaactggccctgccctgggtcccacctcatctgcggacacctaaactgcagcacctgcaaggttcagctctccagaagcccttccacgcctcccgcctcgtggtccctgagctttcctctcgcggagaaccacgcgaatttcaggcctcccctctgttactgccagtaccgacccaggtgcctcagcctgtagggcgtgtggctagtctgcttgaacaccacgcacttcagctatgccagcagacgggccgggatcgccctggagatgaggactgggtgcaccggaccagtcgcctcccgccacaagaggacaccagagcccagagacagaggcttcagaaacagttaaccgagcatctgagacagtcatggggactgttgggcgccccaattcaggcacgcgatctcggtgaattgttgcaggcctggggggcaggcgccaagactggggctcccaagggaagccgcttcacacacagcgaaaagtttacatttcaccttgagcctcaggcccaggcaactcaggttagtgatgtgccggcaacatcaagacggcccgaacaggtgacgtgggcagcccaggaacaagagctcgaaagccttagggagcagctggagggtgtaaaccgctcaattgaggaagtggaggccgacatgaagacactcggtgtatcgtttgtgcaggctgagtctgagtgcaggcactccaagctaagtacggctgagcgtgaacaggcccttcggcttaagtctagagcagtggaattgctgccggacgggactgccaacctggcaaagctccagctggtggtggagaacagcgcccaaagagttatacacctcgcaggacagtgggagaagcatagggtgcccttactagctgagtaccggcaccttcggaagcttcaggattgtagggagctcgagtctagtcggcgtctggcagaaatacaggagctgcaccagtccgtccgggccgccgcagaggaggcgaggaggaaagaggaggtgtacaagcaactgatgtcagagctggagacattaccacgcgatgttagtcgccttgcatacacccagaggatcctcgagatcgtgggcaatatcaggaaacagaaagaggaaataacgaagatcttgagtgataccaaagaactccagaaagagatcaactctctgagcggcaagttagaccgaacatttgctgtcacagatgagctggtgtttaaggatgcaaaaaaagacgatgcagttcggaaagcctacaaatacctcgccgctctgcacgagaattgcagtcagctcattcagacaattgaggacacaggcactattatgcgggaggtgcgcgatctggaggagcagatcgagaccgaattgggaaagaagacactgtctaatctggaaaaaatccgtgaggactacagggcccttcgccaggaaaacgcaggcctgctgggccgcgtcagggaggcctag

SEQ ID NO: 112605 - DNA, 1743 bp, Artificial Sequence
  Description of Artificial Sequence: Synthetic coding sequence
atggaagaggcggacagaattctcattcacagcctgcggcaggctggcactgcagttcctcccgatgtccagactctgagagctttcactaccgagctggtggtagaagctgtcgtacggtgcttgagggtgatcaaccctgcggttggatccgggctatctccattgctgcccctggccatgtctgctagatttagacttgctatgagtctcgcccaggcatgtatggacctcggataccctctagaactgggttatcagaatttcctctacccctctgaacccgatcttagagatctcctgctttttctggctgaacggctcccaacagacgcttctgaagacgccgaccagccggccggcgattccgccatcttactcagggctatcgggagtcaaatcagggatcagttggcgctgccatgggtgcctccgcatctgcgcacacctaagctccaacatcttcaggggtccgccctgcagaagccatttcacgccagtcggcttgtcgttcccgaactgtcctcccgcggcgagcctcgcgaattccaggccagccccctgctcctcccagtgcccacccaggtcccacagccagtggggagggttgcatcgctgctcgagcatcacgcactgcagttgtgccagcagaccggacgagatcgtccgggcgacgaagactgggtccacagaacgtcccggttgccccctcaggaggatacaagagcacaaaggcagcggttgcagaaacagttaactgagcaccttaggcagagttggggtctactgggtgcccctatccaagcccgagacctgggcgagcttctacaagcatggggggccggtgccaaaaccggcgcccccaagggtagtcgttttactcactcggagaaattcacctttcatctggagccacaagctcaggcaactcaggttagcgacgtcccggctacatctcggcggcccgagcaggtgacctgggctgcacaggaacaagaattagaaagtctccgggagcagctggagggcgtgaatagatccatcgaagaagtggaagccgacatgaagacactgggagtgtcatttgtccaggctgaatctgagtgccgacattccaagctaagcacagctgagagggaacaggctctgcgactaaagtctagagccgttgagctgttaccagatggaacggccaatctggccaaactgcagctagtggttgagaactcggcccagcgagtcatccatctggccggacagtgggagaaacacagagtcccgttactggccgagtaccggcacctacgcaagctgcaggactgccgcgagcttgagtccagcaggagactggctgagattcaggagcttcatcagtccgtccgcgccgccgccgaagaagcccggagaaaagaggaggtgtataagcaattaatgagcgagctagaaacacttcctcgagatgtctccaggctagcatatactcaacgcattctggaaatagtcggtaatatccgaaagcagaaagaagagatcactaagattctcagcgacactaaagaacttcaaaaggagattaacagtctctctggcaagcttgatagaaccttcgcggtgaccgatgagttggtcttcaaggacgccaagaaggatgacgccgtgcgcaaggcctacaaatacctcgcggccctccattttatcggagatggcaccgttgggtggggtccctggatccctaataagtag

SEQ ID NO: 112606 - DNA, 603 bp, Artificial Sequence
  Description of Artificial Sequence: Synthetic coding sequence
atggatgacaagaaaaaaaaaagaagcccgaagccatgtttagcccaacctgcgcaggcaccgggaacactgcgaagagtgcccgtgcccacgtctcacagtgggtcacttgcactgggtctacctcacttgcccagccctaagcagagagccaaattcaagcgcgtggggaaggagaagtgtcgcccagtcttggccggcggcggtagtgggtccgccgggacccctttgcagcatagctttctgactgaggtcacggatgtatacgaaatggaagggggtctcctgaacctcctcaatgactttcactccggaagattgcaggcgtttggtaaggaatgttcgttcgaacagctggagcatgttcgggagatgcaggaaaagcttgcaagactgcacttcagtctcgatgtttgcggtgaggaagaggacgacgaagaggaagaagatggagtcacagaaggattgcctgaggaacagaagaagactatggccgatcggaatctggatcagctgttgtctaacttagaggacctctctaattcaatccagaaactccatctggctgagaatgccgagcccgaggagcagtctgctgcttag

SEQ ID NO: 112607 - DNA, 690 bp, Artificial Sequence
  Description of Artificial Sequence: Synthetic coding sequence
atgtgggcagccggcagatggggacccaccttcccctcatcgtacgctgggttttcagctgattgtcgccccagatcaaggccttcatccgactcatgtagtgtgcccatgaccggagcgcgcggacagggccttgaagtggtgcgcagcccaagccctccattaccactgtcttgttcaaacagcacccgatctctcctcagtccccttggacaccaaagttttcaatttgatgaggacgacggggacggggaggacgaggaggacgtggatgatgaggaggatgtcgacgaggacgcacatgattctgaggcgaaagtggcaagcttgagaggcatggaactacagggctgtgcctcaacgcaagtagagtccgagaacaatcaggaggaacagaagcaggtgcggctgccagaatcgagactcactccttgggaggtgtggtttatcgggaaggaaaaggaggaacgggacaggctgcagttgaaagctcttgaggaactcaatcaacagctagaaaagcgcaaggaaatggaagagagagaaaagagaaagataattgcggaagagaagcataaggaatgggttcagaagaagaacgagcaggtccgtaggggcaagtggattcataccctaactagcctgcttcagaacatctcctcgtactatacttccctcccacggttttag

SEQ ID NO: 112608 - DNA, 1122 bp, Artificial Sequence
  Description of Artificial Sequence: Synthetic coding sequence
atgtgggcagccggtcgctggggccctacgtttccttcaagctacgctgggttctctgcagattgccggccgaggagcagaccatcatcagactcttgcagcgtgccaatgactggggcgcgaggccagggcttagaagtggtgaggagcccgagtcctcccctccccctgagctgtagcaactcaacccggtctctgctaagccccttgggccaccagtctttccagtttgacgaggatgatggagacggggaagacgaggaggacgtggacgacgaggaagacgtggacgaagatgctcacgatagcgaagcaaaggtagccagtcttagggggatggaactccagggctgtgcttctactcaggtcgaatctgaaaataaccaggaggagcagaaacaagtgagactcccagaaagtcgactcaccccatgggaagtgtggtttatcggcaaagaaaaggaggagcgtgataggctgcagttgaaggccctggaggagctaaaccagcagctggaaaagcggaaggaaatggaagaacgtgaaaagagaaagataatagccgaagaaaaacataaggagtgggtacagaaaaagaacgaacagaagaggaaggagcgcgaacagaagatcaataaggagatggaagagaaagccgcaaaggagttggaaaaagaatatctacaggaaaaagctaaggaaaaataccaggagtggcttaagaagaagaatgccgaggagtgcgagcggaagaagaaagagaaggaaaaggagaagcaacagcaggccgagattcaagaaaagaaagaaattgccgaaaagaaattccaagaatggctggagaacgccaaacacaaaccgagacccgctgcaaagagctatggctacgccaatggtaagcttactgggttctattctggcaacagttatcctgagcccgccttctataatccgataccatggaaaccgattcacatgccacccccaaaagaggccaaggacctgtcgggacgcaagagcaaacggccagtgattagccagcctcacaagtccagttccttggtgattcacaaggctcgatcaaacctctgtctaggaaccttatgccgaatccagaggtag

SEQ ID NO: 112609 - DNA, 2268 bp, Artificial Sequence
  Description of Artificial Sequence: Synthetic coding sequence
atggaatacatcttcccaaacaccggcgtgctttggagttggcttattaacattttgtgcaatcggcgcatcgtctggttcacctccagccaactgcctagaggcccacctgcttcgagcggaggacatagctttcacacgctgcgggaaagatccgagagtcgactgttcgtggagtcctacgctgctgcctggcagcctcctggcacctctggcggcgcctcttgttgttccagccttagcgcccaagtgatgtccagcgagttcctagctgagctgcactgggaggacggcttcgccatccctgtggcaaacgaagaaaacaagctgttggaagatcaactttctaaattgaaggacgagcgcgccagcctgcaggacgaactccgcgagtatgaggagagaattaattccatgacctctcactttaaaaatgtcaagcaagaactgagtattacccagtctttgtgtaaagcacgtgaacgcgagacagaatccgaggagcacttcaaagccattgcccaacgcgaattgggacgtgttaaggatgaaattcaaagactggaaaacgaaatggcatcgattctggaaaaaaagagcgacaaagaaaacggcatcttcaaagccactcaaaagttagacgggctgaagtgtcagatgaactgggatcagcaggctctcgaagcatggctggaagaatcagctcacaaagactcagacgcactgacgctgcagaaatacgcccagcaggacgacaacaagatcagagcgctgacactacagctggaaagactcacccttgagtgcaaccaaaaaaggaagatactggacaatgagctcactgaaactatatctgctcagctcgagctggataaagccgctcaagacttccgcaagatccacaacgaacgacaggagctgataaagcagtgggaaaacaccattgagcagatgcagaaaagggacggagacatagacaattgcgccctcgagttggcccgaattaagcaggaaactcgggaaaaggagaatttggttaaggaaaagatcaagttcttagaaagcgagatcgggaataatacggagttcgaaaagcggataagtgtcgcagacaggaaactcctgaagtgtcggaccgcatatcaggatcatgaaacttcacggattcagcttaagggagaactggattctctgaaagccactgtgaaccggacttcctccgatctggaagccctccggaagaatatcagtaagatcaagaaagatatccacgaggagaccgccaggctccagaagacgaagaaccacaacgagattatccagacaaaactcaaagagattacagagaagactatgtcagtcgaagagaaggcaactaacctggaggatatgttaaaagaagaggaaaaggatgtgaaagaggtcgatgtgcagctgaacctaattaagggtgtgctgttcaaaaaggcacaggaactgcaaacagagaccatgaaggagaaggccgtgctttctgagattgagggcacgagatcctctctgaaacacctgaaccaccagttgcagaaactcgactttgagacacttaagcagcaagagatcatgtattcccaggactttcatattcaacaagttgagaggaggatgagtcggttgaagggcgaaattaacagtgaggagaagcaagctctggaggctaagattgtagagctgcgcaaaagcctggaggagaaaaagagcacatgcggattgctggagacgcagatcaaaaaactgcataatgatctttatttcattaaaaaggcacacagcaagaattcagacgaaaaacagtccttgatgactaagattaacgagttaaacctgttcatcgatcgatccgaaaaagagctcgataaagcgaaaggcttcaagcaggacctgatgattgaggataacctcctgaagttagaagtcaaacgcaccagagagatgctacactctaaagccgaggaggtcctctcccttgaaaagaggaagcagcaactctacaccgcaatggaggaaaggacagaggagatcaaggtacataaaaccatgttggcgagccagatacggtacgtggaccaggaacgggagaacatttctacagaattcagggaacggctctcaaaaattgagaagctgaagaatcggtacgaaatcctgactgttgtgatgctgccccctgagggggaggaggagaaaacgcaggcctactacgtgattaaagtgatgagtatgtcctag

SEQ ID NO: 112610 - DNA, 2826 bp, Artificial Sequence
  Description of Artificial Sequence: Synthetic coding sequence
atgtccagcgaatttctggcggaattgcattgggaggatggcttcgctatcccggtcgccaacgaggagaataaactgctcgaagaccaattgagcaagctgaaggatgagcgagcgtcattgcaagatgagcttagggagtatgaagagcgtataaacagcatgacgtcccattttaaaaacgtgaagcaggaactatccatcacacagagcctgtgcaaggcgcgggaacgagagaccgagtctgaagaacactttaaggctatcgcccaaagagagctcggacgcgtgaaggacgaaatccagcgattagagaatgagatggcatcgatactggagaagaagagcgataaagaaaatggcatcttcaaggctacgcagaagctggatgggctaaagtgtcaaatgaattgggaccagcaggcgctggaggcatggctggaggagagcgcccacaaagacagtgacgcactcacactgcagaaatacgctcagcaagatgacaataaaatcagggccctgaccctgcaactcgagcgtctgactttggagtgtaatcaaaaaaggaagattctggacaatgaactgactgaaactatatcagcacaattggagttagataaggccgcgcaggatttcaggaagatccataatgagcggcaggaactgattaaacagtgggaaaacaccatagaacagatgcaaaaacgggatggcgatatcgataattgcgccctggagctggcaagaatcaaacaagaaacacgggagaaggagaatcttgtgaaggagaagattaaatttcttgaatcagagatcggcaataacacagagttcgagaagaggattagcgtggccgaccgtaagttactgaagtgccgcacagcctatcaagaccatgaaacttctcggattcagctgaagggcgagttagactcactgaaagccaccgtgaatcgcacaagctccgacctggaggctttgagaaagaatatttctaagatcaagaaagatatccatgaggagaccgccaggttacaaaaaactaagaaccacaacgaaattatacaaaccaaactgaaagagatcaccgaaaagaccatgtcggtcgaagaaaaggctactaatctggaagatatgctgaaagaggaagaaaaagacgtgaaggaggttgatgttcagttgaacctgattaaaggtgtgttatttaagaaggcacaggagctgcaaaccgaaacaatgaaggaaaaggcagtccttagcgagatagagggtacaaggtcctcactcaaacacctgaaccaccagttgcagaaactggatttcgagacgctaaagcagcaggagattatgtattctcaagacttccacatccagcaagttgaacgccggatgagcaggctgaaaggagagatcaattccgaggaaaaacaggctcttgaggctaagatagttgaactacgaaaatccctcgaggagaaaaagtcaacctgcggactactggagacacaaatcaaaaaactccataatgatttgtactttatcaagaaagcacattcaaaaaatagtgacgagaagcagtcattaatgacaaagatcaacgagctgaacctgttcattgaccgaagcgaaaaagaattggacaaagccaaaggattcaagcaagatttgatgatagaggacaacctcctcaaactagaagtaaaacggacccgagaaatgctgcacagtaaagcggaagaggtgttgtctttggaaaaacgcaagcagcagctatataccgcaatggaggagcgcactgaagagataaaggtgcacaaaaccatgctggcctcccagattaggtacgtcgaccaggagcgagaaaacatctcaactgagtttcgggagaggctcagtaagatcgaaaaactgaaaaaccgttacgaaatcctgactgtcgtgatgctccccccagaaggagaagaagaaaaaacccaggcttattacgtgattaaagctgctcaggagaaggaggagctccagcgcgagggcgattgtctggacgccaaaattaacaaggcagaaaaggagatttatgcactcgagaacaccttacaggtgctgaattcttgtaacaataattataaacagtcgtttaaaaaagtaactcccagttcggacgagtacgagctgaagattcagctcgaggaacaaaagagggccgtagacgagaagtatcgctacaagcagagacagatcagagagttgcaggaggatattcaatccatggagaataccctagacgtcatcgagcacttagctaacaacgtgaaagaaaagctctcagagaaacaggcttatagcttccaactgtccaaagagaccgaggagcaaaagcccaagctggagcgagtgaccaaacagtgcgctaagctgacaaaggaaataaggctactgaaggatactaaggacgaaaccatggaggagcaggacattaaactgcgggagatgaagcagttccacaaggtcatcgatgagatgctggtggacattatcgaagaaaatactgagatcagaataatcttgcagacgtactttcaacagtctgggctggaattaccaacagcctccacaaagggaagtcggcaatcctctagatccccatcccacacatccctgtccgctcggtcatcaagaagcacgtccacttctacctcccagtcctctataaaggtgttggagctaaagtttcccgcctctagctcgctagtgggtagtccttcgcgtccttcatccgcctcttctagctcttctaacgtcaaatccaagaaatcctcaaaatag

SEQ ID NO: 112611 - DNA, 1740 bp, Artificial Sequence
  Description of Artificial Sequence: Synthetic coding sequence
atggccgagcctggaggggccgccggacgtagccatcccgaggacgggagcgcaagcgaaggggagaaagaaggcaataatgaaagccacatggtgagtcctcccgaaaaggacgatgggcagaagggggaggaagctgtagggagcacagagcaccctgaggaggtgacaacacaggccgaggccgctatcgaggagggagaagtagagactgagggcgaggcagcggtcgagggtgaggaggaggccgtgagttatggagacgccgagtctgaagaggagtattattataccgagacaagctccccagaggggcagatcagcgctgccgatacgacatacccttactttagtcctccacaggaattgccgggggaggaagcctacgactctgtcagcggagaagctggactgcaaggattccaacaggaggcaaccggtccacccgaaagtcgggaaaggagggttacatcacccgagccgagccacggggttctgggcccctccgagcagatgggtcaggttacttcgggacctgctgtaggtcggcttaccggcagcacagaagagccccaggggcaagtcttgcctatgggggtgcagcaccgatttcgcctaagccacggcagtgacatcgagagcagcgacttggaagagttcgtgagccaggagcctgtcattcccccaggcgtgcccgacgcacacccccgtgagggtgacctcccagtgttccaggatcaaatccaacaaccaagtacagaagaaggagcgatggcggagagggtcgaatccgagggctccgacgaagaagccgaggacgagggaagtcagctcgttgttctggatcctgaccatcccttgatggtcagatttcaggccgcccttaagaattacctgaatcgtcaaatcgagaagctgaagttggacctccaggaattggtggttgcgacaaaacagagcagggcccagcggcaagagcttggggtgaacctgtacgaggtgcagcagcatctggtccatcttcagaaactgctcgaaaaaagtcacgatagacatgccatggcctctagtgaacggcgccaaaaagaagaggagctgcaggccgctcgtgcactgtacacaaaaacctgcgctgcagccaatgaagaaaggaagaaactggccgcactgcaaactgagatggaaaatttggccttacacctgttctatatgcagaacatcgaccaagatatgagagatgacatcagagtgatgacacaggtcgtgaaaaaggccgagaccgagcgaattagagccgagatcgaaaaaaagaagcaggacctgtatgtggatcaattgacgacgcgcgcacaacagctggaggaagatatcgcgctgtttgaagcccaatatctcgcccaggccgaagatacgaggatcttaaggaaggcagtcagtgaggcttgtaccgagattgacgctataagtgtggagaaacggcggatcatgcagcagtgggcaagctccctggtgggaatgaaacatcgcgacgaagcacaccgggctgttctcgaggctctcagcgtgtccctggagaggttcccaagccagaacattaacactgcgcggagccgactctcgacgacttggcacagtgccggcattctcctgcgaggctcattcctgcccggggctagtcgcgcgtttgccagcgtgtgctacggaggggccgcggttgacaatcgcatccgggaatgttag

SEQ ID NO: 112612 - DNA, 1437 bp, Artificial Sequence
  Description of Artificial Sequence: Synthetic coding sequence
atggcggagcctggaggggccgcaggaaggtcgcatcctgaggacgggtcagcctcagaaggcgaaaaagagggcaacaacgaaagtcatatggttagcccacctgaaaaggatgatggacagaaaggggaggaggccgtcggctcgaccgagcaccccgaggaggtgacaactcaggccgaggctgctattgaagagggagaagtggagactgaaggagaggccgccgtggaaggtgaggaggaggctgtgagctatggggacgcagagagtgaagaagagtattattacaccgagaccagtagtcccgagggacagatcagcgccgctgacactacctatccttatttctctccaccgcaggagctgcctggggaagaagcctacgattctgtttcgggtgaggccggactccaagggttccagcaggaggccaccgggcccccagagtcccgagagcgccgcgtgacgagtccggagccatctcatggtgtgctggggcccagcgaacaaatgggtcaggttacctctgggcccgccgtgggacgattgaccggaagtacggaggaaccgcagggccaggttttgccaatgggcgttcagcaccggtttcggttatcccacgggagcgacatcgagagtagcgatcttgaagagtttgttagccaggagcctgtgattcctccaggggtccctgacgcgcaccccagggagggtgatttgccggtcttccaagaccaaattcagcagccttctactgaggagggggcaatggcggagcgtgtggaatccgaagggtccgatgaggaagccgaggacgagggatctcagctggttgtcctggatcctgatcatcccctgatggtgcgctttcaagcagccctcaagaattacctgaacaggcaaattgagaagttgaaactggatctgcaggagctcgtcgtcgccacaaaacagtcgcgcgcccagcggcaggaactgggcgtgaatctgtacgaggtacagcagcacttggtgcacctacagaaactgctggaaaaatcccacgatcggcacgccatggcgagctccgaacgtaggcagaaggaagaagaactccaagccgcgagggctttatataccaagacctgcgcagctgctaatgaggagcgcaagaagctcgcggcacttcagacagagatggagaatctggcgctccacctgttctacatgcagaatattgaccaagacatgagggacgacatacgggtcatgacacaggtggtcaagaaggctgaaactgagagaatccgggccgagatcgagaagaagaaacaaggcgtgggcgacacaggcgctgcttttatcccaaagacaacacagggggatcaggtaagcggacgaggaaagaaaaagcccggcacagtagtagctcgggtcagtcctgcagagctctag

SEQ ID NO: 112613 - DNA, 3093 bp, Artificial Sequence
  Description of Artificial Sequence: Synthetic coding sequence
atggctgagcctggaggggcagcaggacgctcccaccccgaagacggctcagcgtcagagggagaaaaagagggcaataacgagagccatatggtgtcgccacccgaaaaggatgacggccagaagggagaagaggccgtggggtccacagaacacccagaggaggtgaccacccaagccgaggccgctatagaggagggagaagtggagaccgagggcgaagcagctgttgagggtgaggaggaggccgtcagctacggagatgctgagtctgaggaagaatattactacactgaaacctcctctcccgaagggcagatatccgccgccgataccacatatccgtacttctctccgccccaggaattgccaggtgaagaagcttatgattctgtgtcgggagaggcagggctgcagggcttccagcaagaagccaccggtccaccggagtccagggagagacgggtgaccagtcccgagccgtctcacggggttctcggcccttccgagcagatgggccaggtcacaagtggaccggctgtcgggaggctcaccggctctaccgaagagccccagggtcaggtcctccctatgggggttcagcacagattcagactcagccacgggagcgacatagaatcctcggacctggaggagttcgttagtcaggagccagtcattcccccaggggtccccgacgctcatccacgggaaggagatcttcctgtgtttcaggatcagatacagcagccatctactgaggagggagccatggcagagagagtcgagtcagagggttctgacgaagaagcggaagacgaaggatctcaactggtggtgctggatcccgaccaccccctcatggttaggttccaagccgccttgaagaattacttgaacaggcaaatagagaaactgaaactcgacctacaggagctagtcgtagcaacgaaacagtctagggcccagagacaggagctgggcgtgaacctctatgaagtccagcagcatctggttcatttacaaaagctgctggaaaagagccacgaccggcacgcaatggcctctagtgaacgccggcaaaaagaagaggagctgcaggcggcccgcgccctatacaccaagacctgtgccgcagccaatgaagaaagaaagaaattggccgctctgcaaactgagatggagaacctggcgcttcacttgttttatatgcagaacattgaccaggacatgagagatgatattagagtgatgactcaagttgttaaaaaggccgagactgagaggataagggctgagattgagaagaaaaaacaggatttatatgtagaccagcttaccacaagagcacagcagttagaagaggacatcgcgctcttcgaggcacagtacctggcacaggcggaggacaccagaattttaaggaaggccgtttctgaggcctgcaccgagatcgacgccatttcagttgaaaagcggcgtataatgcagcagtgggcaagcagtcttgttggcatgaaacatagggatgaagcgcatcgtgcggtcctcgaagcacttagagggtgccagcatcaggccaaaagtaccgatggcgaaatcgaagcatacaagaagtcaatcatgaaagaggaggagaaaaatgagaagctcgcatctatcctgaaccgcactgaaaccgaggccacgctgctgcagaaacttactacacagtgtctcaccaagcaagtggccttgcagagtcagttcaatacctataggctgaccctccaggacaccgaggatgcgctgtcgcaggaccaactggaacagatgatactcacagaggagcttcaggccatcagacaagcgattcagggagagctcgagctgcggaggaagactgacgcggcaattagagagaaactccaggagcacatgacaagcaataaaaccaccaagtatttcaaccaactcatactacgtttgcagaaggagaagaccaatatgatgacccatcttagcaagattaatggagatattgctcaaaccaccttggatattacccacacttcttcgcggttggacgcccatcagaaaaccctggtagaacttgaccaagacgtgaagaaggttaacgaactgattaccaatagtcagagcgaaatatcaagacggaccattctgatcgagcgaaagcagggccttattaacttcctaaataagcaactcgagcgtatggtaagcgagttaggcggagaggaagttggtcctctcgagctggaaatcaagcgcctatcaaaactgatagacgagcacgatggcaaggccgttcaagctcaagtaacgtggctgaggcttcagcaggaaatggtgaaggtgacgcaggagcaagaggaacagctagccagcctcgatgcgagtaaaaaagagctgcacataatggaacagaaaaagctccgggtggaatcaaagatcgagcaggagaagaaggagcagaaggagatcgaacatcacatgaaggatctggataatgaccttaagaagctaaatatgctgatgaacaagaatagatgttcctccgaagaactggagcaaaataacagagtaaccgaaaacgagttcgttcgcagcctgaaggcatctgaaagggagacaattaaaatgcaggataagctgaatcaattgtctgaggagaaggccacacttcttaaccagctagtggaagccgagcaccagattatgctgtgggagaagaaaattcaacttgccaaggagatgcggtcttcggtggatagcgagattggacagaccgaaatccgcgctatgaaaggtgagatccatcgaatgaagaagtattgtagaaccacacaggacgcccaccgccacgtacacgaacagcacgggacacatgcaggcacttgtactaagaacaccggtagagctcaggctagggcccgaaccactagggacgctagaggacatgtgcatgagcagcatgggaccagagcggggacttgtacgaacaacactgggcgcgcccaagcccgcgccagaacccgggatgcccgcagacatgtccacgagcacaggacccacacagcccgtgcctag

SEQ ID NO: 112614 - DNA, 3429 bp, Artificial Sequence
  Description of Artificial Sequence: Synthetic coding sequence
atggccgaacctggaggcgccgccggacgctctcacccagaggacggcagtgccagcgaaggcgaaaaggaaggcaacaatgagagtcatatggtgtccccacccgagaaagatgacggccaaaagggtgaggaggcggttggttccacggagcaccccgaggaggttacaacacaggcagaggctgctatcgaagaaggagaggtggagacagaaggtgaagcagctgtcgagggggaggaagaagctgtcagctatggcgatgccgagagcgaggaggaatactattacacggaaacatcaagtcctgaaggccagatttcagccgcagacactacctatccttacttttctccgccacaggagctgcctggagaggaagcctatgacagtgttagcggtgaggctggtctccagggtttccagcaggaggcaacaggtccacccgagagccgggaacgccgggtcacctcaccagagccttcacatggcgttctggggcccagcgagcagatgggccaggtcaccagtggacctgctgttggaagactgaccggctctactgaagaaccccagggtcaagtcctgccaatgggagtccagcaccggttccgcctgtcacacggctcggacattgaatcttctgatctagaggagttcgtgagtcaagaacctgtcatcccaccgggggtgcccgacgcccacccacgggagggggacctgccagtctttcaggaccagatccagcagccatcgacagaagaaggggctatggccgaaagggtggagtcagaaggttcggacgaagaagccgaagatgaggggagccaactcgttgtgctggaccccgaccatccactgatggttcggttccaggccgcactgaagaattacctgaaccgacagattgagaaactaaaactcgatctgcaggaactcgtcgtcgctacaaaacagtccagagcccagagacaggagctgggcgtgaacctttatgaagttcagcaacatctggtacatcttcagaaactccttgaaaagagccacgacaggcacgcaatggcgtccagcgaacggcgccaaaaagaggaggagctgcaggcagctcgggctctatacaccaaaacgtgtgctgcagcgaatgaggagcgtaagaaactggcagctttgcagacagaaatggaaaacctggccttgcatctgttttacatgcaaaacatcgatcaggacatgagggatgacatccgggtgatgactcaagtggtcaagaaggcggaaacggagagaatccgagctgaaatcgagaagaaaaagcaggacttatacgtagatcagctgaccacacgggcacagcagctcgaggaggacatcgctttgttcgaggcccaatatcttgcccaggccgaagatactcgtattcttcggaaggctgtctcagaagcttgtaccgaaatcgacgcgatatccgtcgagaaaaggaggatcatgcagcagtgggcctcatctctagtgggtatgaagcaccgggatgaggctcaccgcgctgttcttgaagctctgagaggatgtcagcaccaggcgaaaagtaccgacggggaaatcgaagcctacaaaaaatccattatgaaggaggaggagaaaaatgaaaagctcgcaagcattctgaacagaactgaaacagaggctaccctgctgcagaaactaacaacccagtgtctgacaaaacaggtggctctgcaatcccagtttaacacttaccgcttgacattgcaggatacagaagatgccctgtcccaggaccagctagaacagatgattcttaccgaggagttacaggctataagacaggcaatccaaggagagctagagctgagacgcaaaacagacgccgcaatccgtgagaaactgcaggaacatatgacttccaataagacgaccaagtattttaatcagcttattctgagacttcagaaagaaaaaaccaatatgatgacccatctgagcaagattaatggcgacatagcacagaccaccttggacataacccataccagtagtcgcctcgacgcgcatcagaagaccttggtcgaacttgaccaggatgttaagaaggtgaatgaactcatcactaattcccagtctgagatcagcagaagaactatactgatagaaaggaaacaggggctgattaactttctgaataaacaattagaacgcatggtctctgagctggggggagaagaagtggggcctctggagcttgagattaaacgtctctccaaacttattgatgaacatgatggaaaggccgtgcaagctcaggtcacctggctaaggttacagcaggaaatggtaaaagtaacccaggaacaggaggagcaactggccagtttggacgcatccaaaaaagaattgcacatcatggagcagaagaagttgagggtggagtcaaaaattgagcaggagaaaaaggaacagaaggaaatcgaacaccatatgaaagatctggacaatgaccttaagaaactcaacatgctgatgaacaaaaaccgctgtagctccgaagagttggagcagaacaaccgagtgactgagaatgagtttgtacgcagcctcaaggctagcgaacgcgagacaatcaagatgcaagataagctgaatcagctgtctgaggaaaaggctacattacttaatcagttggtcgaagctgagcatcaaatcatgctgtgggaaaagaaaattcagctcgcaaaggagatgcgaagtagcgtcgattctgaaatcggtcagacagaaatccgcgccatgaaaggcgagatccatcggatgaaggtgcgtctcggtcaactactgaaacaacaagagaaaatgatccgggccatggaactggccgttgcccgccgcgagaccgtgacaactcaggcggagggccaacgaaaaatggaccgcaaagcactcacacgcaccgactttcatcataagcagctcgaactgcgaaggaagattcgagatgtgaggaaagccacagatgagtgtactaagacggtgctggagctcgaagagacacagaggaacgtctcatcctcattgctggaaaaacaggaaaagctctctgtcatccaggccgacttcgatacccttgaagccgacctgactcgtctcggggccctgaagcggcagaacctgagcgaaatagtcgctcttcagacccgactgaagcacttgcaggccgttaaggaaggccgttacgtgtttctgttccgatccaagcaatctctggtcctggagcgacagcgtctggataaacgtcttgccctcattgctaccatcttggatcgcgttagagacgaatatcctcagttccaggaggccctgcataaagtgtcacagatgatcgccaacaagctggaatctcccggcccgtcttag

SEQ ID NO: 112615 - DNA, 921 bp, Artificial Sequence
  Description of Artificial Sequence: Synthetic coding sequence
atggctgaggtatctatcgaccagtccaaattgccgggagtgaaggaagtctgtcgggactttgctgtgctcgaggatcatactctggctcattctctgcaggagcaggagatcgagcatcatctagcgtctaacgtgcagcgcaatcgcctggtgcagcacgacctgcaggtcgccaaacagttgcaggaagaagacttaaaagcccaggcccagttgcagaagagatataaggatctcgagcagcaggactgcgagatcgcccaggagatccaagagaaactggcgattgaggcagaaagaagaagaattcaggaaaaaaaagatgaggatattgcgcggctgctgcaggaaaaggagctccaggaagaaaaaaagcgcaaaaaacacttccctgagtttccggccacacgggcctatgccgattcatattactatgaggatgggggcatgaaaccacgagtaatgaaggaagccgtgtctactccctcacgcatggctcaccgtgaccaggaatggtacgacgccgagattgcaaggaaattgcaggaggaggagctccttgctacccaggtggacatgcgagcagctcaggtggcacaagacgaggagatagctaggctgctgatggctgaggagaagaaggcctacaaaaaggcaaaggaaagggagaagtccagcttggataagcgaaagcaagatcctgagtggaagccaaagacggctaaagctgccaactcgaaatctaaagagagcgacgaaccacaccattcgaagaacgagcggcccgcgcgcccccctcccccaataatgaccgacggcgaggacgccgattatacccattttaccaaccagcaaagttccacacggcatttttccaagagcgagtcatcccataaaggcttccactacaaacactag

SEQ ID NO: 112616 - DNA, 1449 bp, Artificial Sequence
  Description of Artificial Sequence: Synthetic coding sequence
atggcagaggtcagcattgatcagtcaaaacttccaggggttaaagaagtctgtcgggactttgctgtcctggaagaccacactttggctcattccctgcaggaacaggagatcgagcatcacttggctagcaacgtgcaacggaaccgcctggtccaacacgatcttcaggtggccaaacagctgcaggaagaagatctgaaggcccaggcacagctgcagaaacgctacaaggacctggaacaacaagactgtgaaatcgcgcaagagatacaagagaagctggcgattgaagccgaacggaggaggatccaggagaagaaggatgaagatattgccaggctactgcaggagaaggagcttcaggaagaaaagaagcggaaaaagcacttcccagagttccctgccaccagggcgtatgctgattcttattattacgaggatggtgaccagcccggatcacgcagagcgcgagagcttggttcaggcttcagtcgcccgtgtcggttacagagggatggcaaaaccgtgaaacacaagaaggagaagcctgagcacccgctggaaaatttggaggagccagagcagcactgcagcagtaaaaggagtcttagtagctcttcctctggcaaagggcgcgacaatccacatatcaacaacgaacaacacgagagaaaacggtcgacacaagagagacctaggcgacctctgctgccgaccatcagcggcgaggtgttcctgagtacggaatgcgatgattgggagacaaagatcaaccaccagacccggaactgggaaaaacaatccagacaccaagacagactctctccaaaaagcagtcaaaaggctggactgcactgcaaagaagtggtgtacgggcgggatcatggccagggtgagcaccgaaagagacgccatcgccctcgaacccctccattctccgaatcagaggaacagcttcacttacacgacgcaggtatgaaaccccgggttatgaaggaggctgtgtccactccaagtcgcatggcccaccgggatcaagagtggtacgatgcagagatcgcacgaaaactgcaggaagaagaacttctggcaactcaagtcgacatgcgagctgcacaggtggcccaggacgaggaaatcgctagacttttgatggccgaagagaagaaggcgtataagaaggccaaggaaagggaaaaatcatccttggataaacggaagcaggaccctgagtggaaaccaaaaacagctaaagctgccaactcaaagagtaaggaatcagatgaaccacatcactccaaaaatgaaagacccgcacggccacctccaccaatcatgactgatggagaggacgcggattatactcatttcactaatcagcaatcttccacaagacatttctccaagtccgagagctcgcataagggcttccactataagcattag

SEQ ID NO: 112617 - DNA, 1425 bp, Artificial Sequence
  Description of Artificial Sequence: Synthetic coding sequence
atggcggacagtgccagtgaaagcgatactgatggcgccggcggcaacagctcaagctccgctgcaatgcaatcatcctgttcctcaacctccggaggaggcgggggcggcggcggtggcggcgggggggggaagtctggtggcattgttatcagcccattccgtctagaagagttgacaaacagactcgcaagcctccaacaggaaaacaaagtgctcaagatcgagcttgaaacttataagctgaagtgtaaggctcttcaggaagagaatcgggacttgcgcaaagctagtgtgaccatccaggctcgggccgagcaagaagaggagtttatctccaatacactgtttaagaagatccaggctctgcagaaggaaaaggagaccttagcagtgaattacgagaaggaagaggagttcctgaccaatgagttatcacgcaagctgatgcagctgcaacatgagaaggctgaactggagcaacatctggagcaggaacaggaatttcaagtgaataaactgatgaaaaaaattaaaaaactcgagaatgacaccatctctaaacagcttactctcgagcagctcagaagagaaaaaattgatctggagaacacccttgaacaggaacaagaggcgttggtcaatcgcctgtggaaacgtatggataagctcgaggccgaaaagcggatactgcaagagaaactagaccaacctgtgagtgcacccccttctccacgagatatttctatggagatcgacagtcctgaaaatatgatgcggcatattcgcttccttaagaacgaagtcgagcgtctgaaaaagcaacttagggctgcccagctgcagcattcagagaagatggctcagtatctcgaagaggagcgtcacatgcgcgaggagaatctgcggctgcaaaggaaacttcaacgggagatggagcggcgcgaagccttatgcaggcagctgagtgagagcgagagttcgctggagatggatgacgagagatattttaacgaaatgtccgcccagggactgaggccccggacggtctctagtcccatcccttataccccttccccaagttcctcacgcccaatcagccctggcctttcctatgcctctcacaccgtgggctttactcctcctacctctttaaccagggctggcatgtcttattataacagccccggccttcatgtccagcacatgggcacatctcacggcattactaggcctagtccccggcgttcgaactcgcccgataagttcaagagacctacacctccccccagtcccaatactcaaaccccggtgcagccgccccctccgcccccacctccacccatgcagccaaccgtgccctccgcggccacctcccaaccaacaccttcccagcatagcgcacacccgagttctcagccctag

SEQ ID NO: 112618 - DNA, 2055 bp, Artificial Sequence
  Description of Artificial Sequence: Synthetic coding sequence
atgaacccacctgcggcatttctcgcgggccggcagaacatcggctctgaagtcgagatttcaactattgaaaaacagcgtaaagagctccagctgctgattggtgagctgaaggatcgagacaaagagctcaacgatatggtcgccgtgcaccagcagcaactgctatcctgggaggaggacagacagaaggtgttaaccttagaagagcgatgtagtaaactggagggtgaacttcataagcgaacagaaattattaggagtctgacaaaaaaggttaaggccctcgaaagcaatcagatggagtgccagactgccctgcagaagactcagttgcagctgcaagagatggcccagaaggccacacacagctctctactttccgaagatctcgaggctcgtaatgaaacactatcaaacactctggttgaactgagcgcacaggttggccagttgcaggccagagagcaggcgctaaccacaatgataaaactgaaagacaaggacatcatcgaagcagtgaatcatatagctgactgcagcggaaaatttaagatgctggaacatgctcttcgagacgccaagatggctgagacttgtatcgtgaaggaaaaacaggattacaaacagaaactaaaggctctcaagattgaggtgaacaagcttaaagaggacctgaatgagaagacaacagagaataacgaacagcgggaggagatcattcgccttaaacaggaaaaaagttgtcttcacgatgagttgctgttcaccgtggaaagagaaaagcggaaagacgaactcctgaatatcgccaaaagcaaacaggagcgcactaacagtgagctgcacaacttgcgtcagatctacgtaaagcagcagagcgatttgcagtttctaaactttaacgttgaaaacagccaggagctcatccaaatgtatgactcaaagatggaggagagcaaagcactcgactcgagtcgcgatatgtgcctgtctgatctggagaacaatcaccctaaggtcgacatcaagcgggaaaagaatcagaaaagtctctttaaggatcagaaattcgaagccatgctagtgcagcaaaaccgctccgacaagtcaagctgcgacgagtgcaaagaaaaaaagcaacagattgataccgtgttcggagagaaatcagtgatcaccctgagctcaatcttcacaaaggaccttgtggagaaacacaacctgccttggtcccttgggggtaaaacgcagatcgaaccggagaataaaattacgctgtgtaagatccacacgaaaagccctaaatgccacggaaccggcgtgcagaatgaggggaagcaacctagtgaaactcctactctctctgatgaaaaacagtggcacgatgttagtgtgtacctagggctcaccaattgcccgtcgagtaagcatccagaaaaacttgacgttgagtgccaggatcagatggagagatccgaaataagctgttgtcagaaaaatgaagcttgtctcggagagagcggaatgtgcgattcaaagtgctgtcacccatccaatttcatcattgaggcacccggccatatgagtgatgttgaatggatgagtattttcaagccgagcaagatgcagcgtatcgtgagactgaaaagcggctgtacatgtagcgaaagtatatgtggcacacagcacgattctcccgcttctgagctgatcgcaattcaggatagccatagcctggggtccagcaagagcgccttacgggaggatgagacggagagctcctcaaacaaaaaaaatagccccacctcgctgctcatttataaggatgcaccggctttcaacgagaaggccagcatagttctacctagccaggatgactttagtccaacatcgaaactgcagagactgcttgcggaatctcgtcagatggtcaccgacttggagctgtctacactcctcccaatctcacacgagaatctgaccggcagcgccactaacaaatccgaggtgccagaggaatccgcgcagaagaacacgttcgttagctattag

SEQ ID NO: 112619 - DNA, 1338 bp, Artificial Sequence
  Description of Artificial Sequence: Synthetic coding sequence
atgcctaattcctccccaaaagatcccaccaccgccagtggcaacggaagcaaggtggaacgggaaaagcgcaaagatgaacttctaaacatagccaaatccaagcaggagcggacaaattccgaactgcacaacctcagacagatatacgtgaaacaacagagcgatcttcaatttctcaatttcaacgtggaaaattctcaggagctcattcaaatgtacgactcaaaaatggaggagagcaaagccctagacagttcacgtgacatgtgcctcagcgacctagagaataaccaccctaaagtggatattaaacgggaaaagaatcagaaatcgcttttcaaggaccagaaatttgaagccatgttggttcagcaaaataggtccgataagtcctcatgcgacgagtgtaaagagaagaagcagcagattgatactgtgtttggcgagaagagcgtgattacattgtcgagtatcttcactaaagaccttgtcgaaaagcataatcttccatggagcctaggcggtaaaacccaaatagaacctgaaaacaaaattacactgtgtaaaatccacacgaagtctccaaagtgtcacggcaccggggtgcagaatgaagggaagcaaccaagcgagacaccaacgctatcggacgaaaagcagtggcacgacgtgagcgtatatctggggctcaccaactgccctagtagtaaacatcctgaaaaactcgacgtcgaatgccaggatcaaatggaaaggagcgaaatatcttgctgtcagaaaaatgaagcctgtctcggcgaatctggaatgtgcgatagtaagtgttgccacccatcaaactttatcatcgaagcgccaggacacatgagcgacgttgaatggatgtcaatctttaagccatccaagatgcagaggattgtgcgacttaagtctggttgcacgtgctccgagagtatatgcgggacccaacacgacagcccagcctcagagctgatcgcaattcaagacagccactcactaggatcctcaaagtccgccctccgcgaggacgagaccgaatctagcagcaacaaaaagaatagtcctactagtctattaatctacaaggacgcacctgcatttaacgaaaaagcctctattgtcctgccgagccaggatgatttttctccaacctctaagttgcagaggctactcgccgaatccaggcaaatggtcaccgatttggaactgtcaacgcttcttcctattagtcacgagaaccttacaggtagtgccacaaacaaatccgaagtgccggaagagtcagcccagaaaaatacgtttgtgtcatattag

SEQ ID NO: 112620 - DNA, 2049 bp, Artificial Sequence
  Description of Artificial Sequence: Synthetic coding sequence
atgaacccaccagctgcgtttctggctggccgccagaacattggctctgaagtggagatctccaccattgagaagcagcgaaaagagctgcaactgttgattggcgagctcaaagacagagacaaagaattaaacgacatggtcgccgtccaccagcaacaactcttgtcgtgggaagaggacaggcaaaaagtacttacgctggaagaaagatgtagcaaactggaaggggaattacacaaacgtaccgagattatcaggagcctcactaaaaaagtcaaggcacttgaaagtaatcaaatggagtgccaaactgctcttcagaagactcagttgcaactccaggaaatggcccagaaagctacgcacagcagtcttctgagtgaggatctggaggctaggaatgagacacttagtaatacgttggtggagctaagtgctcaggtagggcaactgcaggccagagaacaagctctaaccaccatgattaagttgaaagacaaggatatcatcgaagccgtgaatcatatcgccgactgctccggcaaatttaagatgttggagcatgctctccgcgacgccaaaatggcagaaacttgcatcgtcaaagaaaagcaggattacaagcagaagctcaaagccctgaagattgaggtaaacaaacttaaagaagatctcaacgagaagactaccgagaacaacgaacaacgggaggaaatcataagactcaaacaagaaaaatcctgcctccacgacgagctgctatttaccgtggaaagagagaagagaaaagatgagttactaaacattgccaaatctaagcaggagcgcacaaactcggaactgcacaacctcaggcaaatctacgtcaagcaacagagcgacctgcaattcctcaactttaatgtggagaattcacaagaactgatccagatgtacgattctaaaatggaggaatctaaagctctggactccagccgggacatgtgcctctctgacttagaaaacaatcatcccaaagttgatatcaagcgtgaaaagaaccagaaaagtctattcaaggaccagaaattcgaggcaatgctggtccaacagaatagatccgacaagtccagttgcgacgagtgtaaagaaaagaaacagcagatcgacacagtctttggagaaaaaagtgtcatcacgctgtcgtcaatctttaccaaagacctggttgaaaagcacaacctgccgtggtcactaggtggcaagacacagatcgagccagagaataagataactctttgtaaaattcacacaaagagtccaaagtgtcatggcactggggtgcagaatgagggaaaacagcctagcgagacccccaccctatcggacgaaaagcaatggcatgacgttagcgtgtacctgggccttacaaactgccctagctctaagcatcctgaaaaactagacgtggagtgccaggatcagatggaaaggtcagaaatttcatgctgccaaaaaaatgaggcctgccttggggagtctggaatgtgtgattctaaatgttgccacccctctaattttatcattgaggctcccggacatatgtcagatgtcgagtggatgagcatcttcaagccttcaaagatgcaacggatcgttcgcttgaagtctggatgcacctgctccgaaagcatctgcggcacccagcacgatagtcctgccagtgagttaattgccatacaggacagtcatagcctgggaagtagcaaatcagctctaagggaggacgagacagaatcctcatcaaacaagaaaaacagccctacctcgctgctcatttacaaagacgcccctgctttcaatgaaaaggcatccatcgtcctcccatcacaagacgatttctccccgacatccaagcttcagagacttctggcggaatctagacagatggtgacagatctcgaactgagtactctgctcccaatttcacatgaaaacctgaccgggagcgctactaatatcagccatctgtgcgggagacagaaagctgacaccaacaccgaatag

SEQ ID NO: 112621 - DNA, 1494 bp, Artificial Sequence
  Description of Artificial Sequence: Synthetic coding sequence
atgcctaaaaaggaaaagatggccaaaacaccactaagtgatgaaaaacaactgctcctgttccagcaaaaactgctagcagaggaggagatggcaaagaagaaggagcggctattaagccaatttcttaaagacaagttggcgaaagaggaacataatagtgcactgaacctgaataaaataaatacccagtggcgaacggtgctacgcgaggttaaaacccgggaactacataaagacatcgagatcttgtctcaaacttttgaacgggtggtggattgtaaggacaacgtgattaaaagcctggccaaagatctgagcgaagctgaagagcagtacgctcacgcgctgagaagtcatctgcacaatgttgatcagctgcttgccttgcaaagacatagactgagtttactcgaggagtcatacaacatggaactggaggccctgaccaaagagtttgagaccgaacggaaaaccattatcgaccagcatgaaaaggagattcactacctgcaagacatctttatggccatggaacagaactacatcgactccgagtacgaaagcaaactggagtttcagagcatgtggaacgacctcaaaaatatgaacttggaggaaaaacactttctgagactgcacttagagaatagagtagaggacctctggcggaagtttcaggatgtgctcaagaattataccgatgcgaccgaggacagaaaggctgctttcgagacactgcaggtgaaagacgaaaaaagcagcaaggaaatcgaagtgcagatgaaaaagatccagaaactgcaagatgccattactataagcaaaggtaaaattatgattcacagccgcgaatctgaagatgagaaccggtacattaggaacgacaaggaactcgtgttagtgcagcttcgcaaactgaaggcccagagaacacaggcccgcgcagcatcacagaagaacctcgtgcggcttaccctagaatccaatgccactctgaaagcccttcggaaaatcgtcgacaaaggagagaagattctaaagctcgcagaaatatgccgtaagttcgaaacagaggaggaaaaggtgctacccttttattcttccgtcctgactcctaaagaacaggagggtatacaaaagaacaacctggaagagctcaccgaggagctgacgaaggtgatggtggactatatcggaatggaaaatttctggaagcgctacaataaagtgaaactggaacagctgtcacttcaacaccgcagggcccagcttttggacatcaacggtaagcttcgggagatgctgaaacagtacctggacggaatttctgtcagcgatgaggtcctctcccagcttaatcccttattcatcgttaattatcagtctaacttgctgcagccgctgtcaattaggatcgcacacccaggaagcacgagtcccagtgcgccctggcgcgatcaacggaggtccttttttctggggagctcatag

SEQ ID NO: 112622 - DNA, 1455 bp, Artificial Sequence
  Description of Artificial Sequence: Synthetic coding sequence
atgcccaagaaggagaagatggctaagacacccctgtccgatgaaaagcaactcctccttttccaacaaaagcttctcgcggaggaagagatggccaaaaaaaaggagcggctgctcagccagtttctgaaggacaagctggccaaggaggagcacaacagtgccttgaatttgaacaaaattaatacacagtggagaaccgtcctgagagaagtcaaaacccgtgagttgcacaaggacatcgaaatccttagccagactttcgagagggtggtcgactgtaaggacaacgtgatcaagagtttggcgaaagacttaagtgaggcagaggaacagtacgcccatgcactccgatctcacctgcacaatgttgatcagctgctggccttgcagaggcatagactttcactgcttgaggaaagttataatatggagctcgaagctttaaccaaagaatttgagaccgagcggaaaactataattgatcagcacgagaaggagattcattacttacaggacatttttatggcaatggagcagaactacatcgactctgaatatgagtctaagctggagtttcagtcaatgtggaacgacctcaagaacatgaacttggaggaaaaacacttcttacgtcttcaccttgagaatagagtggaggacttatggcggaagttccaggacgtgctcaagaactacacagatgcaactgaagataggaaggcagcatttgagaccttgcaggttaaggacgaaaagtcaagcaaagagatcgaagtgcagatgaagaagattcagaaactgcaagacgccatcacaatcagcaaggggaaaatcatgatccactcacgcgaatctgaggacgaaaacaggtacatccggaacgacaaggaattagttctagtgcagctgaggaagctgaaagcccaaaggactcaagctcgcgccgcaagtcagaaaaatctggtgaggcttacactggagagcaacgcaacactcaaggccctgagaaaaattgtggacaagggtgagaaaatcttgaaactggctgagatttgccgtaaattcgaaactgaggaggaaaaagtgctacccttctactcctctgtgcttacccccaaggagcaggagggaatacagaaaaataatctcgaagaactgacagaggaattaactaaggtgatggtagactatatcgggatggagaacttttggaagcgttataataaggtcaagttagagcagctgagcttgcagcacaggagagcacagctcctcgatattaatgggaagctgcgagaaatgttgaaacagtatctggatggcatttccgtcagtgacgaagtactgtctcagctcaatccactgtttattgtgaattaccagtctaacctgcttcaacctctgtccatacggattgcacaccctggagacaaacagcaccccactacatag

SEQ ID NO: 112623 - DNA, 3240 bp, Artificial Sequence
  Description of Artificial Sequence: Synthetic coding sequence
atggagagcaattttaataccgaaagctcatctacgtttacactgcaaagttcaagtgagactctttttagcatccagttgctcgacttcaaaacttctcttctggaagctcttgaagaactgaggatgagacgcgaagcagagattcattatgaagagcagattggaaagatcattgtcgaaacccaggaactgaagtggcaaaaagaaacactgcagaaccagaaggagacactggccgaacaacataaagaggccatggccgtatttaagaaacagcttcagatgaagatgtgcgccctggaagaggagaagggcaaatatcagctcgctacagaaattaaagagaaagagatagaagggctgaaagagacactgaaagctcttcaagtgagcaagtatagcctgcagaagaaggtcagcgagatggagcaaaaggtgcagctgcatcttttggccaaagaagactaccataagcagttatctgagatagaaaagtactacgctactatcactggtcagttcggactagtaaaagagaaccatgagaagctggagcagaatgtgagggaggccattcaatctaataaacgcctttccgccctcaacaagaaacaggaggctgaaatatgcagcctcaagaaggaacttaagaaggctgcctctgatttaatcaaaagtaaagtgacgtgtcaatataagatgggagaagaaaatatcaacctgaccattaaagagcagaagttccaggagcttcaggagagactcaatatggaactggaattgaatgaaaagatcaatgaggagataactcatattcaggaggagaaacaagatatcattatctcattccagcatatgcagcagcttctgcggcagcagatccaggccaataccgaaatggaggccgagcttaaggtcttgaaggaaaacaatcagacactagagagagacaacgagctccagagagagaaagttaaggagaacgaggaaaagttcctcaacctgcagaatgagcacgagaaggctctcgggacctggaagaggcacgcggaggaacttaatggggagataaataagattaagaacgaactctcttctctgaaggaaacccacatcaagctccaggaacactacaataagttgtgcaatcaaaagacttttgaagaagataaaaagtttcagaacgtccccgaagtgaacaacgaaaatagtgaaatgagcaccgagaagtccgagaatacaatcattcagaaatacaataccgagcaggagatcagagaggagaatatggagaatttctgcagcgataccgagtacagagagaaagaagagaaaaaggaggggagcttcattgaggagattattatcgatgatctgcaactgtttgagaaaagctttaaaaacgagatcgacaccgtggtgagccaggacgaaaatcagagtgaaatttccttgtcaaagacactgtccttagacaaggaggttatatcacagggacagaccagcaacgttaccgacaataggaaaagcgtcaccactgagataaaggataagatctgcctcgaaaaagataatggatgcaccgaatttaagtcgcctaataatcattttgtggtgcttgacaccgccatcgagaccgagaaaattcacctggagagaacgagaggcctggacgtgcatcatacagatgtaaatcttgaagtggagaacaataagaccagtttcaactccatccttaacgagacggcccataacacttatcacaacaacaataaagacgtatccgagaatgagcccttcaagcagttcagactcctgcctggcactcgagaacacgcgctggagaaagagataacgaactccgaccaaacgaaggccgacctggactccagtctcgatatcaaaaagaacccagtcccctgccagaagtattccctgaggaactctagcaatgtgatgctggacgacaaacagtgcaagatcaaacagatccaactgctaacaaagaagtcagagtgtagcatcctgctgagcaagcagacctctgacttcctgcaggtttgcaacgatactcttgagaagtcagaactgactgtgccatgcgacattgtgattgaccatcacgtgtcatatgccgctttcagcgcaaattcaaaactcctcctgaagaattctgataaaaacgtgcattctatgagcatgttagtgaaaccgaattccagtcccggtggcaaaaccatgtgcaaaaatatgagcgacatgcaaaactcacagttcaacaactgtctcgggtacctcgagaatacaaacgtgaatatcagtcatctccacctgaacaacgagaactcacatgcctctcaggctaaggatgtgaagaccgcggttcatatgaaaacttgcaccgaaacggagttttctaataagaaaaaccagattgacgagaatcaggtgacagaggcaaccaagaacgatctgtttctgtttgtgtctatcaatgagcgccagcatacactgctcaataacacagagaaaaccgaatcattaaacgacattgtttccgggaaaatgttctcggaagggcagttggaagaaagtcactcattccacatagaaccatccggcgatttggtcaatagaagtggtagaagcaccttcgacctttccaccagcgacaagaagacagagaagacccccgtgtacatgaattttagtgatccaggtccctggagtaaggttaaccacatagagtcccagacagcttcttcttccacgccctgcatctctttgttgctaaaagaacggcctctcgacccctccgaaaacaaaaagattatatccatggctctttgcaagaacataggcgtggacgacgtaggcaaggatatcggaccggacaccacctcaattaaccgagttgcagataccctgaacaattggagtatacacccggatcctaaaggcgaacccagcgaggaaaaaaacgctatggccaaaactttctatgattcctctttcccaacggagcacgtcaagacaaaaccattaatcagcacgccactgcagtcccatctgcaggccattaagacaacgaaaaatacatctggagatgatgattggcagtctttgatcacaaatcagctgaataaaagcgagaacctgttatcacttgagaatgacaaccagccaaagaaaagaaaggccgaggaaacactcgagaaaaacaaccggctaaagtag

SEQ ID NO: 112624 - DNA, 1617 bp, Artificial Sequence
  Description of Artificial Sequence: Synthetic coding sequence
atgctgcagataggtgaggacgtggattacttgctcatccctcgggaggtgcgcctggccggtggcgtatggagggtgatcagcaagcctgccacaaaagaagccgaattccgcgagcggctgactcaattcctggaagaggaggggagaactttagaggacgttgctagaattatggagaaatcaacacctcacccaccccagccaccaaaaaagcccaaggaacctagggtgcgccggagagtgcagcagatggtcactcccccaccaagactagtcgtgggcacctatgacagttcaaatgcgagtgatagcgaattttccgacttcgagaccagccgggacaaatcccgccagggcccaaggaggggaaaaaaggttcgcaagatgccagtgtcctatttagggagcaaattccttggctctgacctcgaaagtgaggacgacgaagagctcgttgaggcctttttgaggcgccaggaaaagcagcccagcgcccctccggcgcggcgccgggtcaatctgcccgtgcccatgttcgaggacaacctcggcccccagctatccaaggctgatcgctggcgcgagtacgtcagccaggtgagttggggcaagctgaagcgaagagtgaaagggtgggcacccagagccggtccgggagtgggcgaagctcgactcgccagcacagccgttgagagcgcaggcgtgagcagtgctccagaaggtacaagtccgggagaccgccttggaaatgcaggtgacgtgtgtgtcccccaggcatcacctcggagatggcggccgaaaattaattgggccagtttcagacgccggaggaaggaacagactgcaccaaccggccaaggcgccgatattgaagccgaccaggggggggaggccgccgacagtcagcgggaggaggcaattgcggatcagcgtgaaggggctgcaggcaatcagagggccggagcccctgctgaccaaggcgcagaggccgctgacaatcagcgcgaagaggcagccgacaatcagcgggctggagcccccgcggaggagggcgccgaagccgccgacaaccagcgagaggaggcggctgacaaccagcgcgctgaagcccctgccgatcagcgtagccaggggacggataatcaccgcgaagaagctgctgacaaccagcgcgcggaggctcccgcagatcaggggtcggaagtgaccgacaatcaaagagaggaagccgtgcacgatcagcgagaacgcgctcctgcagtgcagggagccgacaaccaaagagcccaggccagagctggccagcgggccgaggccgcccataaccagcgagccggcgctcccggtatccaagaagcagaggtgtcagccgctcaggggaccacaggcaccgctcccggcgcaagggcccggaagcaggtaaaaactgtgcgcttccagacaccaggcaggttttcttggttctgtaagcgtcgcagagccttctggcacactcctagactgcccacactgcccaagagggtgcctcgagccggggaggctagaaatctccgcgtcctgcgggcggaagctagggccgaggccgaacagggtgaacaggaagaccagctgtag

SEQ ID NO: 112625 - DNA, 975 bp, Artificial Sequence
  Description of Artificial Sequence: Synthetic coding sequence
atgctgcagatcggcgaagacgttgattacctgttgatccccagagaggtcagactcgccggcggcgtttggagggtcatcagtaaaccagccacgaaggaggccgagttcagggaacggctcactcagtttctggaagaggagggcaggaccctggaagacgtggctcgtatcatggaaaagagcacgccacatcctccccagccacccaagaagccaaaagagccacgcgtgcgccgtcgagtgcagcagatggtcactcctccaccccggctcgtagtgggaacttacgactcttcgaatgcttctgattccgagttttccgactttgagacaagcagagacaaatcgaggcaggggccacggagaggcaaaaaggttcgcaagatgcccgtgtcgtatcttggatcaaagttcctgggttctgacttagagtcagaagacgacgaagaactagttgaagccttcctgaggcgccaagggctgcaggtgatccgaggccaaggaccccagctaactcgcggccagcgcctgcagataatcaggggaaaacgccttcaaatcattcgtggtcagggtccacagctcaggcggggacaacggctgcagataacgcgcggcaagcgccttcagataatccgggggcagagaccccaattaactcgcgggcaccgggcgcagatcaccacagggaagaggctccagatcatcaggggccggaggccacagctcacaagagggcagcgtctgcagattatcaaagggaagcgcccttatatgactagaggcaagggtccgcagctgagtagggttcagatcatccgcggccatcggcctggactggcccggggtcagcgtttgcatatcatccggggccaaggcccgcaggtctcaaggaaactgaagagccaactgccgaaagggccacaggaacagttacaggaaccgggcccgggcaatagatccagacagtag

SEQ ID NO: 112626 - DNA, 5532 bp, Artificial Sequence
  Description of Artificial Sequence: Synthetic coding sequence
atggagaatgaaattttcaccccgctgctagagcagtttatgaccagcccactcgtcacctgggtcaaaacttttggccccctggccgcgggcaacgggactaacctcgacgagtacgttgctttagtggacggagtgtttctgaaccaagtgatgttacagattaatcctaagttggagagtcaacgagtgaacaagaaagttaacaatgacgcctctttgagaatgcacaatctctcaatcctggttcgccagattaagttctactaccaggagaccctccaacaacttattatgatgagcctcccaaatgtcttaatcatcgggaaaaatccattttcagagcagggcactgaagaagtgaagaaattacttctgttgctcctcggttgtgcagtacaatgccaaaaaaaagaggagttcatagaaaggatccagggcctggactttgacaccaaagcagcagtagcagcccatatccaagaggttacacataatcaagagaatgtgtttgatctccagtggatggaagtgaccgacatgagccaagaggacatagaacccctgctgaagaacatggctctgcatctgaagcgcttgatcgatgagcgcgatgaacactctgagacaatcattgagctgagtgaggaacgcgacgggctccatttcctccctcacgcttcctcaagtgcccagtctccttgcggtagcccaggtatgaaaagaacagagtccaggcagcatttgtcagtggagctcgccgacgctaaggccaaaatcaggcggctgaggcaggagctggaagaaaagacagaacagctgttggattgcaaacaggaactcgaacagatggaaatagagcttaagcggttgcagcaggagaatatgaacctgctgtccgatgccaggagtgctaggatgtaccgtgacgaattagacgcactgcgcgagaaagcagtccgagtcgacaagcttgaatccgaggtttccagatacaaggaacgcctccacgatattgagttttacaaggcgagggtggaagaactaaaggaggataaccaggtgttgctggagacgaaaactatgctggaagaccagctcgagggaaccagggctcgttcagataagctgcatgaactggagaaggagaacctccagttgaaggcgaagctacacgatatggaaatggagagggatatggaccgcaaaaaaatagaagaattgatggaagagaatatgacgctggagatggcccaaaaacagtccatggatgagtccctgcacctggggtgggaattggagcagatatcgcgtacatccgaactgtctgaagccccgcagaagtccctcggacatgaggttaacgagctgacaagcagcaggcttttaaaattagaaatggagaaccagagcctgaccaaaacagtggaagaactgcgtactaccgtggattccgttgaaggtaacgcgtcgaagatccttaagatggagaaagaaaaccagaggctttctaaaaaagtggagatcctcgagaatgagatcgttcaggagaaacagtctcttcagaattgtcagaacctttcaaaggacctgatgaaagaaaaggcgcagctggagaagacgatcgagacgctcagggagaattccgaaagacaaatcaaaattctggaacaggaaaacgagcacctaaatcagacagtgagttcccttagacagcgatcccagattagtgccgaggcccgagtgaaggacatagagaaggaaaacaaaatactgcacgaatccatcaaggagacttcatctaaactgagtaaaatcgaatttgaaaagagacaaatcaagaaagaactggaacattacaaggagaagggagagcgagcggaagaactggagaacgagcttcatcacctggagaaggagaacgagttgctgcagaaaaaaatcaccaacttgaaaatcacatgtgagaagatcgaggcccttgaacaagagaattccgagctagagagggaaaataggaaacttaagaagactttagattctttcaagaatctgaccttccagcttgagtcgctggaaaaggagaattcccagctggatgaggaaaacttggagctccgcaggaacgtcgagagtctgaaatgcgcctccatgaagatggctcaattgcagctggaaaataaggaattggaatccgagaaagaacagttgaaaaaggggctagagctcctgaaagccagtttcaagaagactgaacgactggaggtatcgtaccaaggcctagatatagagaaccagaggcttcagaagacactggagaattctaataagaagatccagcagctggaatctgaactccaggatcttgagatggagaatcagaccttgcagaagaacctggaagaactgaagatctctagcaagagactcgagcagctcgagaaagaaaataaatctctcgagcaggaaacctcacaactggagaaggacaagaagcagcttgagaaggagaacaagcgcctccgtcagcaggcagaaatcaaggacactaccctggaagagaataacgtgaagataggcaatctggaaaaagagaataagaccctgagtaaggagattggaatttacaaagaatcctgcgttaggctcaaggaactcgaaaaggagaataaagagttagtgaagagggccaccatcgacatcaagaccctggtcacccttcgagaagacttagtctccgaaaaattgaaaactcagcagatgaataatgaccttgaaaaacttacccatgagctggaaaagatcggcctgaacaaggagcggcttctccatgatgagcaatcgacggacgactctcgctacaagctgctcgagtccaaattggagtccactctgaagaagagtctcgaaatcaaggaggaaaaaatagctgctcttgaggctaggctcgaggagagcacgaattataatcagcagctgcgccaggagctgaaaacagtgaaaaagaactatgaggcactgaagcaacgccaggatgaagagcggatggttcaatcctctccccctatctctggcgaggacaataagtgggagagggagagccaggaaacaaccagagagttactcaaagtaaaggatagattgattgaagtagaacgcaacaatgctaccctgcaggccgaaaagcaggctctgaagacccagttgaaacagcttgagacgcagaataacaatctgcaggcacagatcctcgccctgcaaagacaaaccgtgagtctgcaggaacagaacacaacccttcagactcaaaacgccaaacttcaggtcgagaatagcacattgaatagccagtccacctccctcatgaaccaaaatgctcagctgttgatccagcagtcatcgctcgaaaacgagaatgaaagcgtgataaaggagagggaagacctgaagagtctctacgacagtctgatcaaagatcacgaaaagctggaactactgcatgagcggcaggccagcgagtacgagtccctgatttcaaaacacggtacactcaagtcggcacataaaaatttggaggtagagcaccgggatctggaagacagatacaatcagttgttaaagcagaaaggtcagctcgaagacttagaaaaaatgcttaaggttgaacaggagaaaatgctgctcgaaaacaaaaatcacgaaaccgttgccgccgagtataagaaattatgcggagaaaacgatagactgaatcacacttactcacagctccttaaagaaacagaggtcctacagacagaccacaaaaacttgaaaagtctacttaataactccaaattggagcaaacccgcctcgaggccgaatttagcaagttgaaggagcagtaccagcagctggacataacctcaaccaagcttaacaatcagtgtgagctgctctctcagctgaagggaaatctggaagaggagaacagacatttactagaccagatacagacactcatgctccagaacagaactttactggagcaaaatatggagtctaaagacctattccacgtagaacaaaggcagtatattgacaaattgaatgaactaaggcggcagaaagaaaagctggaggagaagatcatggatcagtataagttctacgatccgtccccaccaaggagaagaggaaattggatcactttaaagatgcgcaaactgattaagagtaagaaggacataaatcgcgagagacaaaagtccctcacgctcaccccgactagatccgattcaagcgagggattcctgcagctgccccatcaggactcacaagatagcagctctgtcggaagcaattctttagaggacggacaaacgttggggacgaagaagagtagcaccatgaatgatctagtccagtctatggtcctggccgggcagtggacaggaagcacggagaatttagaagtgcctgacgacatatctaccgggaaaaggaggaaggagctgggtgctatggccttcagtactacggctattaacttttccacggttaatagttcggctgggtttcgaagcaaacagctggtgaacaataaggacactacttccttcgaagacataagcccacagggggtgtccgacgattccagtaccgggagtagagtgcacgcatccagacccgcctcactagacagcgggagaacatccacgagtaactctaataataacgcttccttgcacgaggtgaaggccggtgccgtaaacaaccaatcgcgcccacagagccattcaagcggcgagttttcactcttgcacgaccacgaagcttggtcctccagcggaagtagcccaatccagtatctgaagcgccagactaggagctcacctgtactacaacacaaaattagtgagaccttggagagccgacatcacaaaatcaaaacaggaagtccagggtccgaggtggtcacattacagcagtttttggaagaatccaataagctgacatctgttcagatcaagagcagcagccaggaaaatctgctggacgaagtaatgaaaagcctttccgtgagctctgactttctaggcaaagacaaaccggtgagctgtggactcgctagaagtgtcagcgggaaaacacccggggacttctacgatcgccgaacaactaaacctgaattccttcggccgggaccaagaaagaccgaggatacgtatttcatctcgtctgcaggcaagcccaccccagggactcagggcaagatcaaactagtgaaagagtcgtctttatctaggcaaagcaaagatagcaacccctacgcaaccctgccccgggcttcctcggttatttctactgccgagggcactacgaggaggacctctattcatgatttcctgaccaaggactcacggttgccaatctctgtcgatagtcctccagccgcagccgactctaatactacagccgctagcaatgtcgataaggtacaggagagcaggaattcaaaaagccggagtagggaacagcagagcagctag

SEQ ID NO: 112627 - DNA, 5613 bp, Artificial Sequence
  Description of Artificial Sequence: Synthetic coding sequence
atggagaacgaaatctttacaccccttcttgagcagtttatgacttcgcccctggttacatgggttaagacctttggaccattggctgctggaaatggcaccaacttagatgaatatgttgccctggtggacggagtgttcctgaaccaggtcatgctgcagatcaaccccaagctggaaagtcagcgtgtaaacaagaaagtgaacaacgatgcctccttaagaatgcacaatttgtccatcctcgttcggcaaatcaagttttactaccaggagactctccaacaactgattatgatgagcctacccaatgtattgatcatcgggaaaaatcccttctccgagcaggggacagaagaagtgaaaaagttgctcctgctcctgctgggctgtgcggtccagtgccaaaaaaaagaagagttcatagaacggattcagggcctggactttgatacgaaggctgcggtggccgcccacatccaggaggtgactcacaaccaggaaaacgttttcgacctacagtggatggaggtgacagatatgtcgcaagaggacatcgagcccctcctgaagaacatggctctgcatctgaagcgactgattgacgaaagggatgaacacagtgaaaccattatagaactgtccgaggagagagacgggctgcacttcctgccccatgcttcatcatctgcccagagtccgtgcggtagtccaggaatgaaacggaccgagtctcgccagcacttgagtgtcgaactggccgacgctaaggcaaagatccgcaggctccggcaggagctggaggaaaagacagaacagcttctcgactgtaaacaggagctcgagcaaatggaaatcgaactgaagaggctgcagcaggagaacatgaacttactctccgacgccaggtctgccagaatgtatagggacgaactcgatgcactgagggagaaggcagttagggttgataaactcgagagtgaagtttcccggtacaaggaacggctgcacgatatcgaattctataaggcacgagttgaggaacttaaggaagataaccaggttctgctcgaaacgaaaacgatgctcgaggaccaattggaagggactcgcgctaggagtgataagctgcacgagctcgaaaaagagaaccttcagctgaaggcaaaattgcacgacatggagatggagcgagatatggaccggaagaaaattgaagagctgatggaagagaacatgaccctggaaatggcccagaagcaaagtatggacgaatctctgcatttggggtgggagctggaacagataagccgaacctccgagctgagcgaagcccctcagaaatcacttgggcatgaggtaaatgaattgacatcctccagattgctgaagttggagatggagaaccagagtctgactaaaactgtcgaagaacttcgcaccaccgtcgattccgtcgaaggcaatgctagcaaaatattaaagatggaaaaagagaaccagcgtttgtcgaagaaggtagaaatcctcgaaaacgaaatcgtacaggagaagcagtcccttcaaaactgccagaacctctccaaggacttaatgaaggaaaaggcacagcttgaaaagaccatagagacactgcgggagaactcggaaagacagattaagattctggagcaagaaaacgagcacctgaaccagaccgttagctcgctgagacagagatctcaaataagcgccgaggctcgcgtgaaagacattgaaaaagagaacaaaattctacatgagtctatcaaagagacaagctctaaactgagtaagattgaatttgaaaagagacagattaaaaaagagctggagcactacaaggaaaagggggaacgtgcggaggagctcgagaacgagttacaccacttggaaaaggaaaacgaacttctgcaaaagaagattacaaatctgaaaattacttgcgagaaaattgaggcgctggagcaggaaaatagtgaactcgagcgggagaaccgcaaacttaagaagacgctggattctttcaagaacctcaccttccagctggaatccctcgaaaaggaaaacagccagttggacgaagagaatctggaactccggagaaacgttgagagtctcaagtgcgcctcaatgaagatggcccagttgcagctcgaaaataaagagttggagagtgagaaagagcagctgaagaaaggtctggaactcctgaaggcgagctttaaaaaaacggagcggttggaggttagttaccaaggactagatattgagaatcaacgcttacagaagaccttagaaaacagcaacaagaaaatccagcaattagaatcagagctccaggaccttgagatggagaaccagacccttcaaaagaacctggaagaactcaagatcagctcgaagcgcctcgaacagctcgagaaagagaataagtcgctcgaacaggagacctcccaactagaaaaggataagaaacaattagaaaaggaaaacaaacgtttgcggcagcaggcagagatcaaggacacaaccctggaggagaataacgtgaagattggtaaccttgagaaggagaataaaaccctgagtaaagagattggtatttataaggaaagctgcgtgagacttaaagaactggagaaagaaaataaagaattagtaaaaagagcaacaattgacattaaaaccctagttacattacgcgaagacttggtgtctgagaagctcaagacccaacagatgaataatgacctcgagaagctgacgcacgaactagagaagattgggttgaacaaggaacgccttttgcatgatgagcaatctaccgacgaccggtataagctgctagaaagcaaactagaaagtactttgaagaagagccttgagattaaggaagaaaaaatagcggccctggaggctagactcgaggaaagcactaactataatcagcaactgcgccaggagctgaaaactgttaaaaagaactacgaggctctgaagcaacggcaggatgaggagcgaatggtacaatcctctcctccgatctctggggaagacaataaatgggagcgggagtcacaagagactactcgcgagctacttaaagtgaaggataggctgatcgaggttgagcgtaacaatgccaccctgcaagcagaaaaacaggccctgaaaacacaactcaagcagcttgagacgcaaaataacaacctccaagcacagatccttgcactgcagaggcagacagtgtcccttcaggaacagaacacaaccctccagacacagaacgcaaaactgcaggtggagaattctaccctcaattctcagagtacttctctgatgaaccagaacgctcagctactgatccaacaaagctctcttgagaatgaaaacgagagcgtgattaaagagcgcgaggacctgaagtcattgtacgactccctcatcaaggaccacgaaaagctagagttactgcacgagagacaggcttctgaatatgagtcattgatcagtaagcacggaactctcaaaagcgctcacaagaatctggaggtcgaacatcgagacctggaggaccggtataatcaactcttgaaacagaaaggccagctcgaggacttggaaaaaatgctcaaagtggagcaggagaagatgcttctggaaaataagaaccacgagacagtcgcagcagaatataagaagctctgtggcgagaacgaccggctcaaccacacctactctcagttgttgaaagaaactgaagtgcttcagacggatcataaaaacctcaaaagcctcctgaataactccaagctggaacagactcgactggaggccgagttttctaaactgaaggagcaatatcagcagctcgacatcacaagcaccaagctgaataatcagtgtgagctactgagtcagcttaaggggaatctggaggaggagaatcggcacctgctggaccaaatacagacactgatgcttcaaaatcggaccttactggaacagaacatggaatctaaagatttgtttcatgtggagcagcggcagtacatcgacaagttaaacgaactgagaagacagaaggagaaactcgaagagaagatcatggatcagtacaaattctatgaccccagccctccacgccggagagggaattggattacgctgaagatgcgcaagctgattaagtctaaaaaggatatcaaccgagaaaggcagaagagcctgaccctcactccaacacggtcagactccagcgaaggtttcttacagctgcctcatcaggactctcaagacagtagctctgtcggaagcaattcgctggaggatggtcagaccctaggcactaaaaaatccagcatggtggcactgaaacgcctgccatttctaaggaataggcccaaagataaagataaaatgaaggcctgttaccgaaggagcatgtcgatgaatgacctcgtgcagtccatggtgctggccggccaatggactggatctaccgagaatctggaggtcccagacgatatatctaccggaaagcgccggaaggagcttggagccatggccttcagtactactgccatcaacttttccacggtcaattccagcgccggcttcagatcaaaacagctggttaataataaagacacgacttctttcgaggacatctccccccaaggagtcagcgatgatagttccaccgggtcccgggtccatgctagcagacctgcatcgctcgattccggccggactagcacgagcaattctaataacaacgcctctctgcatgaggtcaaagcaggagccgttaataaccagtccagaccccaatctcactcttctggcgagttttctctgcttcatgatcacgaagcatggtcttcttcaggctcatcgccaatccagtatctgaaaagacagacaaggagttctcccgtcctacaacataagatctcggagacccttgagtctagacaccacaaaatcaaaactggatcccctggctccgaggtggtcaccttacagcagttcctggaggagtcaaacaagctgacatccgttcagatcaagagcagttcccaggagaatctcctggatgaggttatgaagtctctctccgtgtcttccgatttcctgggcaaggataagcctgtgtcttgcggcctcgcacgcagtgtcagtggcaaaacacccggtgacttttatgatagaagaaccaccaaaccagagtttctgaggccggggccgagaaagactgaagatacctacttcatatctagtgctggtaagccaactcccggtacacaggggaagatcaaactggtgaaagaatccagcctgagccgccagtctaaagactcaaatccctacgccaccttgccccgagcttcaagcgtcataagtaccgccgaagggaccacccgtagaacttctatccacgattttctgactaaagacagccgccttccgatatccgtggattctcctccagcagctgccgattcgaacacgacagcggcatcaaatgtggataaggtacaggagagcagaaatagtaagagcagatctagagaacagcaatcatcatag

SEQ ID NO: 112628 - DNA, 2667 bp, Artificial Sequence
  Description of Artificial Sequence: Synthetic coding sequence
ctcttggaatcaaagttagaatcaactttaaaaaagagtttggagataaaggaggagaagatagccgctctggaggcgaggctcgaggagtcgactaattacaatcagcagctgcgccaggaacttaagacagttaaaaaaaattatgaagcgctgaagcagcggcaggacgaagaacgcatggtgcagtcgtctccgcccattagcggggaagataacaaatgggaaagggagtcgcaagaaactacacgagagctgctgaaggtaaaagatcgactgattgaggtcgagaggaacaacgccaccctgcaggctgagaagcaggccctcaaaacccagttaaagcaacttgagactcaaaataataatctccaagctcaaatcctcgccctccagcggcagaccgtctccctccaggaacaaaacaccacccttcaaacccaaaatgcaaagctgcaagtagaaaattctacactgaactcacaaagcacatctcttatgaatcaaaacgcccagttgctgattcagcaaagcagtctcgagaacgagaacgaatctgtgattaaggagagggaagacctgaagtccttgtatgactcactgattaaggatcatgagaaactggagctactgcatgagcgccaggctagcgagtatgagagcctgatatccaaacacggcaccctgaagtctgcccacaagaacttagaggttgagcacagagacctagaagaccgctataaccagttgctgaaacagaaagggcaactggaagacctggaaaaaatgctgaaagtagaacaagaaaagatgctgttagagaataagaaccatgaaactgtggcagctgagtacaagaaactctgcggcgaaaacgatcgcctgaatcatacatactcccagctgctcaaagagacagaggtgctgcagacggaccacaaaaatttgaaaagccttctgaataattccaaactagaacagaccaggctcgaagccgaattttccaagcttaaagagcagtatcagcagctcgacatcacaagcacgaaacttaataatcagtgcgaactgctgtcccaattaaaggggaatttggaggaggaaaaccgccacctcctagaccagattcagactctgatgctccagaaccgcactctgctagaacaaaatatggagtccaaggacctcttccacgtcgagcagcgccaatacatcgacaaactaaatgaactgcgacggcagaaggaaaagctcgaggaaaaaattatggaccagtataaattctatgatccctccccacctaggaggcggggtaactggatcaccctgaagatgcggaaactcattaagtccaagaaggacattaaccgggaaaggcaaaaatccctgactcttaccccaaccaggagtgatagctcagaaggcttcctacagcttccccatcaggattctcaggattcaagcagcgtcgggtccaactctctcgaagacgggcagacactcgggaccaaaaagtcttcaacaatgaacgatcttgtgcaatccatggtgctagctgggcaatggacaggaagtaccgagaatctagaggtgcctgacgatatttccaccggcaaacggagaaaggagctgggagcaatggctttctcaacaacagcaattaacttctcaacggttaactccagcgctggatttcggtctaaacagctggttaataacaaagacacgacttcgttcgaggacatcagtccccagggggtatcagacgatagcagcactggaagcagagtacatgccagtcggcctgcctccctggactccggcaggaccagcacttcaaacagcaataataacgcatccctgcacgaggttaaagcgggcgccgtgaataatcagtcgcggccacagtcacatagctcaggggaattctcacttctacatgaccacgaagcatggagctcgagcggaagctctcctatccaatacctgaaaaggcagacgcgatcatctcccgtgctgcagcacaaaatctctgagacactagaatcgaggcaccataagatcaagaccggaagccctggcagcgaagtggtgactctgcagcaattcctagaagaatccaataaactgacctctgttcaaattaagagttcatcccaagaaaatctgttggacgaagtgatgaagtcgctgagcgttagcagtgatttccttgggaaggataaacctgtctcttgcggcctcgctaggtcagtttccggcaaaactcctggagatttttacgaccgccgcacaaccaagcctgaattcttgaggcctggaccgcggaaaaccgaagatacttatttcatttcctcagccggaaaacctaccccaggcacgcagggcaagatcaagctagtcaaggagagcagtttgtctcgccaatctaaggatagcaatccgtacgcgacactcccgcgtgcttctagcgtgatctcaaccgcggaaggaactactagacggactagcattcacgatttccttaccaaagactctagactgcccatctccgtggactcccctccagctgcggctgactctaataccacagcagcaagcaatgtcgataaagtgcaagagagcagaaacagcaaatcacgctctcgtgagcagcagtcttcctag

SEQ ID NO: 112629 - DNA, 5391 bp, Artificial Sequence
  Description of Artificial Sequence: Synthetic coding sequence
atggaaaacgaaatcttcacccctctcctggaacagttcatgacatctcctcttgtaacctgggtaaagacattcggacctctggcagcagggaatggcacaaatcttgacgaatacgtggctcttgtggatggcgttttcctcaatcaagtgatgctgcaaatcaaccctaagctcgaatctcagagggtgaataaaaaggtgaacaacgacgcatccctcagaatgcacaacttgtccatcctcgtcaggcaaataaagttctattaccaggaaaccttacagcaattgatcatgatgtctctgcccaacgtcctgattattggcaagaacccattttccgaacaggggacagaggaggtgaagaagctgctacttctattgctggggtgcgccgtacagtgccagaagaaagaagagtttatcgagcggatccaaggattggattttgatacaaaagcagctgtcgccgcacatattcaggaagtgacccataaccaggaaaacgtgtttgacctccaatggatggaggtgaccgacatgagtcaggaggacatagaacctctcctgaaaaatatggcgctgcacctaaagagactgatcgacgagagggatgagcacagtgaaacaattatcgagctgagcgaagagagagacggcctacactttctaccgcacgccagctcgtcagctcagagtccctgtggctcccccggaatgaagcggactgaatccagacaacatctctctgttgaactcgcggacgcgaaagccaagatacgtcgtttaagacaagagctcgaggagaagaccgaacagttgttggactgtaagcaggaactggagcaaatggagatagagctcaaaaggcttcaacaagagaacatgaatctgttgagtgatgcccggtccgcccggatgtaccgcgacgaactggacgccctgcgcgagaaggcagttcgggtagataagctggaaagtgaggtctctcggtataaagaaagactccatgatatcgagttctataaggccagggtggaggaacttaaagaggacaaccaggtcctgctggagaccaagactatgttggaggatcagctggaaggaacccgtgcacggagcgacaagctccacgagctcgaaaaggaaaatctgcagcttaaggctaagctgcacgatatggagatggaaagggacatggatcggaaaaaaatcgaggaactgatggaggaaaatatgaccctcgaaatggcccagaaacaatccatggatgagagtctccatctcggctgggagttagaacagatttcccgtacatctgagctatctgaggctccccagaaatccctcgggcatgaagtcaacgaactgacaagctcccgcctgctgaagctcgagatggagaatcaaagcctcaccaagacagtcgaggagctgcgcaccaccgtggactctgtggaggggaacgctagcaagatactgaagatggagaaggagaaccaacgactctctaaaaaggttgagatcctagagaatgaaattgtccaggagaaacagagtcttcagaactgtcaaaatctctcgaaagacttgatgaaggagaaggcccaactagaaaaaacaattgagacccttcgggagaatagcgagcggcagattaagatcctggagcaagaaaatgagcacctgaatcagacggtttcttctctgcgccagaggtcacagatttccgccgaggcacgcgtcaaagacatagagaaagagaataaaatactgcacgagtccattaaagagacatcatccaaactctccaagatcgaattcgagaagagacagattaaaaaagagctcgagcattacaaagagaaaggagagcgggccgaggagttggagaacgaacttcaccatctcgagaaggaaaatgaacttctccagaagaaaatcacaaatctgaagatcacatgtgagaagattgaagctttagaacaggagaactccgaactggaaagagagaatagaaagctaaagaagacactcgatagctttaaaaacttaacattccagctcgagtctctggaaaaagaaaatagtcagcttgacgaggaaaacttggaactgagacgtaacgtagaatcgctcaaatgtgcatccatgaaaatggctcagttgcagttggaaaacaaggaacttgagtcagaaaaagagcaactgaagaagggactcgagctgctgaaggcatccttcaagaagactgaacggctggaagtgagctatcaggggcttgatattgaaaaccagcgattgcaaaagacgctggagaactctaataagaaaatccaacagctggaatcagagctgcaagatctggagatggagaaccagactctccagaaaaatctggaggagcttaagattagttctaagaggttggaacaattggaaaaggagaacaaaagcctcgagcaggagacatcacagttggagaaagataagaaacaactggagaaggaaaacaaaaggttgagacagcaagcagagatcaaagataccacactggaggagaacaacgtaaagattggaaacctggaaaaggagaacaagacattgtctaaggagattggtatctacaaggagagctgcgtacgccttaaagagcttgagaaggagaataaagaactggtgaaaagagccaccattgacataaagacccttgtcaccttaagagaagaccttgtgtcagaaaaattaaaaacgcagcagatgaacaatgatctcgagaagctcactcacgagctggagaaaattggacttaataaggagcggctgctgcacgacgaacagtcaacggacgacaggtacaaactgctggagtccaaactggaatctactctgaaaaaatcgctcgagattaaagaggagaagatcgctgctctggaagcaaggcttgaggagtccaccaactataatcagcagctcaggcaggagctcaagaccgtgaagaagaattacgaagctctgaagcagagacaggatgaagagcggatggtccagagttcaccccctatctctggagaggacaataagtgggagagggagagccaggagactaccagagagcttctgaaggtaaaagacaggctgattgaggtggagcgtaacaacgccaccttgcaagcagaaaagcaagcacttaagactcagctgaaacagctagagactcaaaacaataacctacaggcccaaatcctagcactgcaacggcagacagtgtccttacaggagcaaaacactacgctgcaaactcagaatgcaaaattgcaggtggagaactccaccttgaactcccagtcaactagcctgatgaaccaaaacgctcagctgctcatccaacagtcatcgctcgagaatgagaacgagtccgtcatcaaggagagagaggacctgaaaagtctctacgactcccttatcaaagaccacgagaagctggaactgcttcacgaacgacaggccagcgagtatgagtcacttatttcaaaacatggcacgctcaaatcagctcacaaaaacctcgaggttgagcaccgcgacctggaagaccgctataaccagctgctaaaacaaaaaggccagctggaggatctcgagaagatgctaaaggtggagcaggagaaaatgctgctcgagaataagaaccacgagaccgttgctgccgagtataaaaaactctgcggggagaatgataggcttaatcacacgtactcccagctattgaaggaaaccgaggtgctccagacagaccacaagaaccttaagtctctattaaacaatagcaagttggagcagaccaggctcgaagctgagttctcaaaactgaaggagcaatatcaacaactcgatattacatccactaagttgaataaccagtgcgagcttctgagtcagctgaagggaaacctggaggaggagaatcgccatctccttgatcagatacagactctgatgctccagaataggacactgttggagcagaacatggaatccaaggacctgtttcacgtggaacagaggcagtatatcgataaactgaacgagttgagacgacaaaaggagaagctggaggaaaagataatggaccagtataagttctatgatccaagcccaccccggcggcgcggcaattggataacccttaagatgcgaaaattaataaagagtaagaaggatattaatcgggagaggcagaaatcgctgaccctgacccccactagatccgactcgtccgaggggtttttgcaactgccccaccaggacagccaagactccagttccgttgggagcaatagtttggaggacgggcagactcttggtaccaaaaaatcgtctatggttgcgctgaaacgtctaccttttctaagaaatcgacccaaagacaaagataagatgaaggcatgttataggcgcagtatgtccatgaacgacctggtccaatccatggtcttggctggacagtggacaggtagcacagaaaacctagaagtgcccgacgacatctccacggggaaaaggcgaaaggagctcggtgctatggcattctcaacgacggccatcaattttagtaccgtcaattcttccgcaggatttcggtcaaaacagctggtgaacaataaagatactacatccttcgaggacatctcaccccaaggagtgtccgacgactcatccaccggtagcagggtccatgcgtcacgccccgccagtctggactctggcaggacctcaacctcaaactctaataataacgcctctctgcacgaagtcaaagctggggctgtaaataaccaatccagaccacagtcccattccagcggtgaattcagtctgctccacgatcacgaggcctggtcaagtagcgggtcttcccccatacaatatctgaagaggcaaactaggtccagtcccgtgctgcagcataagataagcgaaacactcgaatcacgccaccataaaatcaaaaccgggtcacctgggagtgaggtcgttactctgcagcagttcctcgaagaaagcaataagctcacctccgtgcaaatcaagagtagctcccaggagaacctgttagacgaggtgatgaaatctctctccgtcagttcggattttctgggaaaagacaaacccgtcagctgtggtctggcgtccgtcatatcaacagctgaggggactaccaggagaacgagcatccatgactttttgactaaagatagcaggttgcccataagtgtggacagtccacctgctgccgccgattccaacacgaccgccgcgagcaatgttgataaagtgcaggagagcagaaacagcaaatcaagatccagagagcagcagagctcctag

SEQ ID NO: 112630 - DNA, 1119 bp, Artificial Sequence
  Description of Artificial Sequence: Synthetic coding sequence
atggatcaatacaaattctacgaccctagcccgccccggcgccggggcaactggatcaccctcaagatgcgaaaactaattaaaagcaagaaagacatcaatcgggagcggcagaagtcattaactttgacacccactcgctcggactcctcagagggctttctacagctgcctcaccaggatagccaagatagctcctccgtggggagtaactcactggaagacggacagacactgggtaccaaaaaatcttctaatacgacgtcttttgaggacatctctccgcagggcgtaagcgatgattcatccaccgggtcacgggtccacgccggcgccgttaataatcagtccagaccgcagtcacattcaagcggcgagttttcactgcttcacgatcacgaggcatggtcttcatctgggtcgtccccaatccagtacctgaagcgccaaacccgaagctccccagttctgcaacataagattagcgagacattggagtctcggcaccacaaaattaagactgggtcccctggctcagaagttgtgacattgcaacagtttttagaggagagcaataagctgacctccgtccaaatcaagagcagctctcaagagaacttgcttgacgaagtgatgaagagtttaagtgtgagctccgattttctgggcaaagacaagccagtcagctgcgggctagctcgctccgtgagcgggaagacacccggcgacttctatgaccggcgaactacgaagcccgagtttctgaggccaggccctaggaagacagaagacacctatttcatctcatccgcaggaaaaccgacgcccggaacgcaggggaagatcaagctcgttaaggagtcgagtctgtcaaggcaatcgaaggattccaacccatacgcaaccttaccgcgcgcttcatccgtgatcagtacagccgagggaactacaaggcggacctctatccatgatttcttgacaaaggactcacgactccctatctctgtggatagccctccagctgctgcagatagtaataccaccgccgctagtaacgttgacaaagtgcaggagtccaggaactctaagagcagatcacgggagcaacagtcctcttag

SEQ ID NO: 112631 - DNA, 5616 bp, Artificial Sequence
  Description of Artificial Sequence: Synthetic coding sequence
atggagaatgagatcttcacaccactgctggagcaatttatgacctcgccactggtgacttgggtgaagactttcgggcccctggcggctggtaacggcacaaacctggacgagtacgtggctttggtcgacggggtgttcctcaaccaagttatgcttcagatcaaccctaaattagagagccagagggtcaacaagaaagtaaacaacgacgcatccttgaggatgcacaatttgagcatcctggtgagacagataaaattttactatcaggagaccctgcagcagctgattatgatgtcattgccaaatgtacttattattggaaagaatcctttcagcgagcagggcactgaagaggtgaaaaaactcctcctcttgctcctaggttgcgctgttcagtgtcagaagaaggaggaatttatagagcgaattcaaggactcgacttcgacaccaaagctgccgtggcggcacatattcaggaagtgactcacaaccaggagaacgttttcgacctccagtggatggaggtgactgacatgtctcaagaagatattgagcccctgttgaaaaacatggcgctccatctgaaacgactgatcgacgagcgagatgagcactccgaaactattatcgaactcagcgaagagcgggatgggttacacttcctcccgcacgcctcctcctcagcccagtccccatgcggatctcctggaatgaagagaacagagtcacggcaacatctgtctgttgaattggccgatgccaaggccaagataagacggctcaggcaggagctggaagagaaaactgagcagctgctggactgcaagcaagaactcgagcagatggaaattgagcttaagcggttacagcaagaaaatatgaatttgctgtcggatgcgcgcagcgctcgcatgtatagagatgaactagatgcactgagggaaaaagccgtgcgtgttgataagctggagtctgaggtctcaagatataaggaaaggctgcatgatattgaattctataaggcgcgggtggaggagctgaaagaggataatcaggtgctgctggagactaagaccatgttggaagatcagctggaagggactagggctcggagcgacaagctgcacgaactcgagaaagagaatctccaattgaaagcaaaacttcatgatatggaaatggagcgcgatatggaccgcaagaaaatcgaggagctcatggaggagaatatgaccctagagatggcccaaaaacagtccatggacgagagcctgcacttgggctgggaattggagcagatttcaagaacctccgaattgagcgaggccccacagaagtccctgggacatgaagtgaatgaattgacctcttcacgattactgaagctcgaaatggaaaaccagagtctcaccaagacggtggaggagctcagaaccactgttgattccgtagagggcaacgctagcaaaatcctgaagatggagaaggaaaatcaaagactctccaagaaagtggaaatactggagaatgaaatcgtccaggaaaagcagagcttgcagaactgccagaatttgtcgaaggacctcatgaaggaaaaggcccagctggagaagactatcgagaccctgcgtgagaatagcgagaggcagatcaagatactcgaacaggaaaacgagcacctgaaccaaacagtgagcagtcttcggcagcgttcccagatctcagccgaggcacgggtcaaggacatcgaaaaagaaaacaagattttgcacgaatccattaaggaaacatcaagtaaactgagcaagattgaattcgagaaaaggcagattaagaaagaattagaacattacaaggaaaagggtgagcgggctgaggaattggagaatgagctccaccatttggagaaggaaaacgagctcctgcagaaaaaaatcactaacctgaagataacctgtgagaaaatcgaggctctcgaacaggaaaactcagagctggaaagggagaatcgaaagctgaagaaaaccttggactcatttaaaaacctaacctttcaactcgagtctttggaaaaagagaatagtcagctcgatgaggagaacctcgaactcagacggaacgtagagtccctgaagtgcgcttcgatgaaaatggcccagctgcagctagaaaataaagagctggagtctgagaaagagcagcttaagaagggactcgagttgctcaaggcctcgttcaagaaaactgagagactagaagtgagttatcagggccttgatatagagaatcagcggctgcagaaaacgctggagaattccaacaaaaagatccagcagttagagtcagaattgcaggacttggaaatggagaatcagaccttacaaaagaatctggaggaactgaagatctctagtaagagactggagcagctcgagaaggaaaataaatcattggagcaagaaacatcgcagctggagaaggacaaaaagcagctggaaaaggagaacaagagactgagacagcaggcggagataaaggacactactttggaggagaacaacgtgaagattggaaacctggaaaaagaaaacaagactctctccaaagaaatcggtatttataaggaatcttgcgttcgcctgaaagaattagaaaaggaaaataaggaactggtcaagagggccaccattgacatcaagaccttagtaacattgagggaggacctggtgtcagagaagctgaaaacacaacagatgaataacgacctggagaagttgactcacgagctggagaagatcggcttaaacaaagagcgtctgttgcatgacgagcagtcaacagatgactcccggtataaactgctggaatcgaaacttgaatcaaccttaaagaagtcacttgaaataaaggaggagaagattgctgccctggaggccaggctggaagagagcacaaattataatcagcaactccgccaggaattaaagaccgtaaaaaagaattacgaagccctgaaacagagacaggacgaggagagaatggtgcagtcctcacctcccattagcggagaagataacaagtgggagagggagagccaggaaacaacccgtgaattactgaaggttaaagatcggctgatcgaagtcgaacgcaataacgcaactctccaagctgaaaagcaagcattaaaaacccagctgaaacaactcgagacacagaacaacaacctgcaggcacaaattttggcgctgcaacgccagacggtgtccctgcaagagcaaaacacaaccttgcagacccagaacgcaaaattacaagtggagaactccaccttaaacagccagtctaccagcctgatgaatcagaatgctcagctccttattcagcagagttcactcgagaatgagaacgagagcgtgatcaaggagagggaggatctgaagtcgctgtatgattccctcattaaggaccacgaaaagcttgagttgctgcacgaaagacaagcatctgagtatgagagtctcatctcgaagcatggtaccctgaaatcagcccataaaaatctggaagtggagcatcgggatttggaggacagatacaaccagctccttaagcagaaggggcagttggaagatctggaaaagatgctcaaggttgagcaagagaagatgctactagaaaataagaaccatgagaccgtggccgcagaatataaaaaactttgtggcgaaaacgaccgcctcaatcatacctattctcagctactgaaagagacggaagtcctccagacagatcataagaacctcaaatcgctgttaaataactccaagctggagcaaacccgcctggaggcagagttcagtaaattaaaagagcagtatcagcagctcgacataacatccaccaagctgaataaccagtgtgaactgctttcacagctaaagggaaacctcgaggaggaaaaccgccatcttctcgatcagatccagaccctgatgctccaaaatagaactctgctggaacagaatatggaatcaaaagacctgtttcatgtcgagcagaggcagtatatcgacaagcttaacgagttacgcaggcaaaaggaaaagctagaggaaaaaataatggaccagtacaagttttatgatccttctcctccaaggcgaagaggcaactggataaccttgaaaatgcggaaattaattaaaagtaagaaagatattaatagggaacgtcagaaaagccttacactaacccctacacggtctgattccagcgagggcttccttcagttgccccaccaggactcacaggactcttcatctgtcggctccaacagcttagaggacggtcagacgctggggacaaagaaatccagtatggtcgctcttaaacggttgcctttcctccggaaccgccccaaagacaaagataagatgaaagcctgttaccgaaggagcatgtctatgaatgatttggtacaaagtatggtgctggcaggccaatggacgggtagtactgaaaatctggaagtgccagatgatatctcaacaggaaagaggcgtaaagagttgggggctatggcttttagtaccaccgctatcaacttctctacagtgaactcttcggccgggtttaggagcaaacaacttgtgaataacaaagacaccacctcttttgaggacatcagcccccagggcgtaagcgatgactcctccactggctcgagggtgcatgcctcgcgcccagcttctctggatagcggacggactagtacatcaaacagtaataataacgcatcacttcatgaagtgaaagctggggccgtgaacaaccagtcccggccccagtctcattcttccggtgagtttagccttctccatgatcatgaggcttggagcagtagcgggtcaagccccattcagtatttgaagcgccaaaccaggagcagtccggtgcttcagcacaaaatatcagagacccttgagagtcggcatcataagattaagacaggctcccctggctctgaagtggtgacgttgcagcagttcttggaggaaagcaataaattaacttccgtccagataaagtccagttcccaggagaacctgctggacgaggttatgaagtcactctccgtgtcatccgatttcctgggaaaagacaaacccgtgtcatgtggcttggcccgaagcgtcagcggcaagactccaggcgacttttatgacaggcggaccactaaacctgaattcctacggccagggccacgaaagactgaggatacctacttcatctcatctgccggcaaaccaacgcctgggactcaaggcaaaatcaagttggtcaaagagtcctcactgagccgccagtcaaaggactctaacccttacgcaaccctccctcgggccagctctgtcatcagtactgcagagggcacaacaaggcgtacttccatacatgactttctgaccaaagacagcaggctacctatctcagtggatagcccaccagctgccgctgactcaaacacaactgccgcctccaacgtagataaagtacaggagtctagaaactccaagtcccggagtcgcgagcaacaatcttcttag

SEQ ID NO: 112632 - DNA, 420 bp, Artificial Sequence
  Description of Artificial Sequence: Synthetic coding sequence
atgccatgcgctgcacgaagccgatctagctggcggagatcctggacaaatacagcttgctggtctctgtgcccttgtccaggcccgcgttccccctcccctgcacctatgcgacgcgcccagtccagcttatgtttgcgcgacgagaccctcgcgggcggccagagacggaaactatcctctagattccctgtggggcggtcctcggagtctttttcgcccggcgacacgcctcgtcagcgattccggcagaggcacccaggtccactgggtgccccagtgtcccatagtaaagggcccggtgttggatgggagaattctgccgagaccctgcaagagcacgagacggatgcgaatagggagggacctgaggtgcaagaaccagagaagcggccgctgacccctagcctgtctcagtag

SEQ ID NO: 112633 - DNA, 4431 bp, Artificial Sequence
  Description of Artificial Sequence: Synthetic coding sequence
atggaagggggaaaggggccccggctgagagactttctttcaggcagcctggcaacttgggctctgggtctggcaggcctcgttggggaggccgaggactctgagggagaggaggaagaagaggaggaagaacccccgctgtggctggagaagaggttcttgcgcctgagcgatggcgctctgttactgagagtgcttggcatcatcgccccatcatcccgaggcggccccaggatgctgagaggtctcgatggccctgctgcgtggagagtctggaacctgaatcatctttgggggagactgcgcgacttctaccaggaagaactgcagctgctcattctgtcaccccctcccgacctccagactctgggcttcgaccctctctccgaggaggccgtagaacagctggaaggggtgttacgccttctcctcggcgcgagcgtgcagtgtgagcaccgtgagctcttcatccgtcatatccagggactgagcttggaagtacagagcgaactggccgccgccatacaggaggtgacacagcccggagccggcgtagttctggctctgagtggcccagaccccggggagctggctcctgctgaactggaaatgttgagtcgctccctgatggggaccctctcgaaactagcccgggaacgtgatcttggtgctcagcgcttggcagaacttctgctggaacgggagcctttgtgtctcagaccagaagcaccttcgcgggcacccgcagagggaccatcccatcatcttgctcttcagctggccaacgccaaggctcagcttcgaaggctgcggcaggagcttgaggagaaggccgaattgttgctggactcacaggctgaggtacaagggctggaagcggaaataagacgtctgcgtcaggaggctcaggctctctcgggccaagctaaacgcgccgaactttatagagaggaagcggaggcactgcgggagagggctggccggctgccgcggctacaggaggagctcaggcgctgccgtgagcggctgcaggctgctgaggcctacaaaagccaactggaggaagagcgcgtcctcagtggggttttggaggcatccaaggctttgttggaagagcagctggaggcagcacgggaacggtgcgccagactccacgagacacagagggagaatcttctgttgcggacacggctgggcgaagcccatgctgagctggatagcctgcggcatcaggtggaccaactcgccgaggaaaacgtcgaattagaacttgagttacagaggtcactcgaaccccctcctggaagtcccggggaggccccgctagccggggccgcccccagcctgcaggatgaggttcgtgaagccgaggctggaaggctgaggaccctcgagagagagaatagagagctgagggggctcctgcaggtcctgcagggtcagcctggaggccagcatccgttgcttgaggcccctagggaagatcccgtcctgcccgtgttggaggaagcccctcagacccctgtagcatttgaccatagtcctcagggccttgtgcagaaggctcgggacggcgggccccaagcactggatctggctccccccgccttggacagcgttctggaggcctcagctgaatgtccccaggcgcccgactccgatccacaggaagcagagtctccactgcaggccgcagcgatggaccctcaggcatcagactggtcgccccaggagagcggcagccctgttgaaacccaggagagcccggaaaaggccggacggaggtctagtcttcaatctccggcctctgttgctcctccccagggccccggtaccaagatccaagctccccaacttctgggtggtgagaccgagggcagagaggccccccagggcgagctcgtgcccgaggcatggggactgaggcaagaaggccccgaacacaagccaggcccatccgagccatcatcagtccagctggaagagcaggaaggtccgaaccagggacttgacttggctaccgggcaggccgaggcaagggagcacgaccaacggcttgaaggaacagtgcgggatcccgcctggcagaagccccaacagaaaagcgagggtgcactggaagtccaggtgtgggaaggccctataccaggagagtcactcgcatcaggagtggccgagcaggaagcccttagagaagaggtggcgcaactccgtaggaaggcagaggctttgggcgacgagttggaagcccaggcacgcaaactggaggcgcagaacacagaggctgctcgcctcagtaaagagctggcccaggccagacgggcagaggccgaggcacaccgtgaagcggaggctcaggcttgggaacaggccagattaagagaagctgtggaggcggcggggcaagaactggaatccgcttcgcaggaacgagaagccctggtggaagccttggctgcagcaggccgggagagaagacaatgggaacgggaaggatcacgcctccgcgctcagtctgaagctgcggaggaaaggatgcaggtgttggaatcagagggacgacagcatttagaggaggccgaacgggaacggcgagaaaaagaagccttgcaggccgagttagaaaaagcagtggtgaggggaaaggagctcggggataggttggaacatctgcaaagggagctggaacaggccgctctggaaagacaggaatttcttagagaaaaagagtcccagcaccagcgctatcaaggactcgaacagcggctggaagccgaacttcaggctgccgcgacatcaaaggaagaggcactgatggaactgaagactcgcgcactgcagctggaggaggagttattccagctgcggcagggcccagccggacttggaccaaagaagcgcgccgagccacagctcgtggaaacacaaaacgttcgtctaatcgaagtggagcgctccaacgccatgttggtcgcagagaaagccgcactgcaaggccagttgcagcacctggaaggacagctcggttccctccaggggcgcgctcaggagctcctgctccaaagccagagagctcaagagcattcatcccgtctgcaggctgaaaagtcagtgctggagatccaagggcaggagctccatcgcaagcttgaagtactcgaggaggaagttcgcgccgctagacagagccaggaggaaactcgtggtcagcagcaagcgttgcttagggaccataaagctctcgcgcagctccagaggcgacaggaggctgaactagaagggctcctggtgaggcacagagatctgaaagccaatatgcgagccctggagttggcgcatcgcgagttacagggacgccacgagcagctgcaagcacagagggcctcggtagaagcccaagaagtggcactcctcgctgagcgcgaacggctcatgcaagatggacatcgacagagaggtttagaggaagaactccgcaggctccagtcagagcatgatagagcgcagatgctgctcgcggagctgtcacgtgaaagaggtgagctgcagggcgagaggggagaacttcggggaagactggcacggcttgaactcgaacgggcacagctcgaaatgcagagccagcagctcagggaaagcaaccagcagctcgatctatcagcatgccggctgaccactcagtgcgagctcctgacccagctgcgatcagcgcaggaagaggaaaaccgccagctgctcgcggaagtgcaggcactaagccgcgaaaatcgagagctcctcgagcgtagcctcgagtctagagatcatctgcaccgcgaacaacgggaatatttagaccagctcaacgctctgcgccgcgaaaaacagaagctggtggaaaagattatggaccagtaccgcgtgctggaacccgtgccactgccgcgcacaaagaaggggagctggctggcggacaaagtgaaaagacttatgcggcctaggcgcgaaggcggccctcccggtggtcttcgccttggcgccgatggagctggtagcaccgaatccctgggcggtcctcctgaaaccgaactgcctgaaggcagggaagcggacgggactggtagcccttcacctgcgcccatgcgaagagcccagtcgtcactgtgcctcagggatgagactttggcgggcggacagaggaggaaattgtcatcccggtttcctgtcggacggtcctctgaaagcttcagcccgggtgacacacctcggcagcgtttccggcagcgccatccagggcccctgggcgctccagtgtctcatagtaagggccctggggtgggatgggagaacagtgccgaaactcttcaggagcatgaaacagacgcaaatcgggagggcccggaagtgcaagagccagagaagaggccgttaacaccttccctgtcccaatag

SEQ ID NO: 112634 - DNA, 2139 bp, Artificial Sequence
  Description of Artificial Sequence: Synthetic coding sequence
atggccggggtcgcagcgcatcgcgcacaccccccgtttacagctcatatgaaaaatcgcggcctgcgtgaggaacttgaaaaggcagtggtgcgaggaaaagagctgggcgatcgccttgaacatctgcagcgggaattagaacaggctgctttagagaggcaggagttcctgcgcgaaaaagagagtcaacatcagaggtaccaaggcctggaacagcgcctagaagcggagttacaggctgccgccaccagcaaagaggaggctctgatggagctcaagacacgggccttacagttagaggaagaactattccaactgcgtcagggccccgccggccttggtcctaagaagcgggccgaacctcaactggtggagacccaaaacgtcagattgatagaggtggagcgctccaatgctatgctggtagccgagaaagcagcactccagggacagctgcaacacttggaggggcagctgggctctttgcaggggagggcccaggagttgctgcttcagtctcagcgagcacaggagcactccagtagactacaagcagagaagtccgtgttggaaatccaggggcaggagctgcacaggaaactcgaagtgctggaggaggaggtcagggctgccagacaaagtcaagaggagacccgagggcagcaacaggctttactgagggatcacaaggcacttgcacagctccagcggcggcaagaggccgaacttgagggtcttctggtgaggcaccgtgatctgaaggcaaacatgcgagctctggaattggcccatagggagctacaagggagacacgaacagctccaggcacagcgagcaagtgttgaggctcaggaggtcgccctgctggcagagagggaaagactgatgcaggacgggcaccgtcagcgcggcctggaggaggagctgcgtcgcttgcagtcagaacacgatagagcccagatgctgctggcggaactgtctagggaaagaggagaactgcagggtgaaagaggcgagctgcgtggtcggcttgcgcggctcgaactggagcgagctcaactcgaaatgcagtcccagcaactgagggagagcaatcagcaattagatctatctgcctgcaggctgacgacacaatgcgaacttctcacacaactccgctccgcacaggaggaagagaatcgacaactcttagccgaggtgcaggcactgtcgagagaaaacagggagcttctggaaaggtccctcgagagcagagatcacttgcatagggagcaaagggagtacctggaccagcttaatgctctgcgaagagagaaacaaaaactggtggaaaagatcatggaccaatatagggtgctcgagccagtccctctgccacgaactaaaaaaggtagctggctggccgacaagggaccactgccgaggcatccatgcgctgggcccagagctccatccgcctgcggtatgagaccctggcaggctgggtcggggggcaacagcgcccagggatcccggtggggggaagccctgagccatagcgctcttggaacacctttggggaacgacagtgactctgctattcaggcaccctggggcaggccatcaccaaccgccaaagacttagtgtgggacggccgcacacccctccgcccatgtagaaatacaaagcaaatgcccaccgaacgggccctccgttaccggaaccggcgcaatgtacctagtcctcaccctagcgccagcgatactgtagggactgcaggtctgggcgtgcagccaagtcgccactggagtgtctcgggcggcccgcgccaacccaagtcatctggtagtcagggtccgcaaggagagagcctggacaaagaggcatgggcactgcgcagctcaacggtgagtgccggggcccggcggtggagttgggatgaatgcgtagaccgaggagatggatggcccccacgggctgcacctgggtggtcctccgggtccagccggtggctccctctgaggcagcgatcgctaggagatccgccagctgaaggcggctggcaggaacttgctagggagcctcccgccctgagcaggtgggaagctgagtcgcagtgctggggaaccgttgcctgggccgatctggagccatag

SEQ ID NO: 112635 - DNA, 4077 bp, Artificial Sequence
  Description of Artificial Sequence: Synthetic coding sequence
atggaaggcggcaaggggccaagacttcgcgattttctgtccggcagcctagcaacctgggccctgggcctcgcaggcctcgtgggggaggccgaagattccgagggcgaggaggaggaagaagaagaagaaccacccttgtggctcgaaaagcggtttctgcgcttatctgatggggctctgttgctgagggtacttggaattattgccccctctagtagagggggcccacgcatgcttcgcggactcgacgggccagccgcatggcgcgtctggaacctcaatcatctttggggcagactacgggatttctaccaggaagaactgcaactgcttattctgtcccctccccccgacttacagaccctcggctttgacccattgagtgaggaggccgtcgaacaactcgaaggagtgctgagattgttgctcggcgcttccgtgcagtgcgagcatagggagctgttcatcaggcatattcagggtctcagcctagaagtccagtctgaactcgccgccgcaatccaggaggtgacgcaaccgggtgcgggggttgtgctggcactgtctggaccagatcccggggagctcgccccggcagaactggagatgttgagcaggtcactgatgggaacactgtctaaattagcccgcgagcgcgatcttggagcccagagattagccgagcttctcctggaaagagaacctctctgtctaagacccgaagccccctcacgggcccctgccgagggtccaagtcatcatctggcactccagctggcaaatgcaaaggcccagctgcgccgactgcgccaagaactggaggagaaggctgagttgctgcttgatagccaggcagaagtgcaagggctggaggccgaaattagacgtctaagacaggaagctcaggctctctccgggcaagctaaacgtgcggaactgtacagggaagaggccgaggccctaagggagagggcaggacggttgccccgtctccaagaggagctgcgccgctgtcgggaacggttgcaggctgctgaagcgtataaaagtcagctggaagaggagagagtgctcagcggtgtattggaagctagtaaagcactcctagaggaacagttggaggcagcacgggaacgctgcgcccgtctgcacgaaacccagcgtgagaacctgctcctccgtaccagacttggcgaggcccatgccgaactggactcactccggcatcaagttgaccagctggctgaggaaaatgtggagctggaactcgagctacagcgaagtctagagccaccacctggcagccctggcgaagctcctctcgctggagcggcacccagccttcaagatgaggtacgggaggctgaagcagggcggctgaggacccttgagcgcgagaatagagagctgcgtggcctgctgcaggtccttcagggtcagcctggcgggcagcaccccctcctcgaggcacctagggaggacccagtactgcccgtgttagaagaagcccctcagacgcccgtggcatttgatcatagcccccaaggtctggtgcaaaaagcacgcgacggcggaccgcaggcattggacctcgctccccctgcactggacagtgtgttggaagcttccgcagagtgtccacaggctcctgatagtgatccccaggaggcagaatcccctctgcaggcagcggcaatggatccacaagcctctgactggagccctcaagaatcaggttctcctgtggagactcaagaaagtcccgaaaaggctggtagacggagtagccttcagagccccgcctcggtggcccctccacagggtccaggtacgaagatccaggccccccaacttctggggggagagaccgaaggaagggaggcacctcagggcgagcttgttcctgaggcttggggacttcgacaggagggccctgaacataagcctggtccctcagagcctagtagcgttcagctcgaagaacaagaggggccgaatcagggccttgacctggccaccgggcaggccgaagcaagggaacatgatcagaggctggagggcaccgtgcgggaccctgcctggcagaaacctcaacagaaaagcgaaggagccctcgaagtgcaggtttgggaggggcctattcctggtgagtctctcgcatcgggggtggcagagcaagaggccttacgcgaggaggtcgcgcagctcagaaggaaagccgaagcgctaggcgatgaactggaagcccaggcgagaaaactggaagcccagaacacggaggccgctcggcttagtaaggagctggctcaagcccgacgggctgaggccgaggcacatcgggaggcagaggcgcaggcatgggagcaagctcgcctcagagaggctgtggaggccgcaggacaggagcttgagagcgctagccaggaacgagaagcactcgtcgaagcactcgccgccgctggccgcgaaagacggcagtgggagagagagggtagcagactacgtgcacagtctgaggcagctgaggagcgcatgcaggtgttggagtccgaagggcgccagcacctcgaggaggccgaaagggaaagacgtgagaaagaggccttgcaggccgagctggagaaagcagtcgttagagggaaggaactgggcgacagattagagcatctgcaaagggagctcgagcaggccgccttagaaagacaggaatttcttcgcgaaaaggaatcacaacatcaacgctatcaggggctagagcagcggttggaggccgaactgcaggccgctgcaacttctaaagaggaggcgttaatggaactcaaaacgcgagcacttcagcttgaagaagaactgtttcagctaaggcaaggccctgcaggccttggacccaagaagagggccgagccccagctagtagaaacacagaacgtgagactgatagaggtcgagcgcagcaacgctatgttagtagcagagaaggccgcgttgcagggccagctgcagcaccttgaaggccagctgggctccctgcagggaagagcccaggaactgctgttagccgagcgagaaaggctgatgcaggatgggcatcgccagcggggtctagaggaggagctccggcggctccagtccgaacacgacagagcccagatgctgctagccgaactttctcgggagaggggtgagctgcagggagaaaggggggagttacggggccgactggcccggttagagctggagcgcgcacagctcgagatgcaaagccagcagctacgcgaatccaaccagcagttggacttgtctgcctgcagacttactactcaatgcgaactcctgacacagcttagatccgcacaagaagaagaaaatagacagctcctggctgaagtccaagccctgtctcgcgagaatagggaactgcttgagcggagcctcgagtctagagaccacctccacagggagcaaagagaatatctagatcagttaaatgctctgcggcgtgagaagcagaaacttgtagaaaaaatcatggatcaatatcgggttttggagccagttccgctgccccgcactaagaaggggtcttggctggcagataaggtaaagcgtctgatgcggccccggcgtgaaggcggcccccctggcggcctgcgactgggcgccgacggcgcgggatccacagagtctctgggcgggcctccagagaccgagctccccgaggggcgggaagcagatgggactggctcaccgtccccggcccctatgagaagggcccagtcttccctatgtctgcgagacgagactctggcaggcggtcagaggcggaagctctcctcaagatttcctgtcggcagaagctccgaatcgttttctccaggggacaccccgagacagcgttttcgccagcgtcaccctggacctttaggcgcacctgtatcacactccaagggtcctggcgttggttgggagaactcagcagagactctgcaagagcatgagaccgatgccaatcgtgaagggcctgaagttcaggagccggagaaaaggcctttgactcctagcctgagtcagtag

SEQ ID NO: 112636 - DNA, 684 bp, Artificial Sequence
  Description of Artificial Sequence: Synthetic coding sequence
atgggcggtacaacctcgaccagacgagtgacctttgaggctgacgagaatgaaaacatcaccgtggtgaaggggatccggctcagtgagaacgtcattgacaggatgaaggaatcgtccccgagtggctctaaatcccaaagatacagcggggcgtacggggcatccgtaagcgacgaggaattgaaacgaagggtagctgaggaactagctctggaacaggcaaagaaggaatccgaggatcagaaaagactgaagcaggccaaagagctcgaccgggaacgcgcagctgccaacgagcagcttacccgtgccatcctcagagagcggatctgttcagaagaagagcgagccaaggcgaaacatcttgctagacagcttgaagaaaaagacagggtcttgaaaaagcaagacgccttttacaaggaacagctagcccgcttagaggaaagaagcagtgaattctacagggtgacgacagaacagtaccagaaggcagccgaggaggtagaggccaaattcaagaggtacgagtcacacccagtgtgcgctgacttgcaggccaagatcttacagtgttatcgcgagaatactcaccagacactcaaatgctcggccctggctacccagtatatgcactgcgtcaatcatgccaaacaaagcatgctggagaaaggcggatag

SEQ ID NO: 112637 - DNA, 417 bp, Artificial Sequence
  Description of Artificial Sequence: Synthetic coding sequence
atgggcgggacgactagcacaaggagggtgacctttgaggccgatgagaacgaaaacattacagtggtcaagggtataagactgagtgagaatgtcatcgaccgcatgaaggaatctagtccctctggctccaaatcacagaggtactctggtgcttatggcgcctccgtttctgacgaagagctgaagcgacgcgtggctgaagaactggccttagaacaggccaagaaggagtccgaagatcagaaaaggttgaagcaagccaaggaacttgatagggaaagagctgctgcgaacgagcagcttaccagagcgatcctgagagagaggatttgctccgaagaagagcgcgccaaagcgaagcatctgatcaaggtggaacttctgtgggtgaaacctggcgtcctcacagcatag

SEQ ID NO: 112638 - DNA, 333 bp, Artificial Sequence
  Description of Artificial Sequence: Synthetic coding sequence
atgaaatgtgaggagactcatgcacccaatagtaattgggtctatgtgatgttgccctccaagaagacggtccgaatgccttctgttacacagcgtttaagagatccagacatcaacccttgcctgagcgaatccgatgcttccacgcgctgtctggatgagaacaactatgatagagagcgatgttctacttactttctgcggtataagaattgtagaaggttttggaattccatcgttatgcagaggaggaaaaatggagtaaagccattcatgcccacagctgccgagcgtgacgagatcctgcgggcagtcgggaatatgccatactag

SEQ ID NO: 112639 - DNA, 258 bp, Artificial Sequence
  Description of Artificial Sequence: Synthetic coding sequence
atgccgagcgtcacccagaggctgagggacccagacattaatccctgcctgtcagagagcgacgcttcaacgaggtgtctggacgagaataactacgaccgggaacggtgctccacttacttcctcagatataaaaactgccgacggttttggaacagcatagtaatgcagcggcgcaagaacggcgtcaagcctttcatgcctacggcagcagagagagatgaaattttgagggcagtcggcaacatgccatattag

SEQ ID NO: 112640 - DNA, 285 bp, Artificial Sequence
  Description of Artificial Sequence: Synthetic coding sequence
atgctgcccagtaagaagacggtgcggatgcctagcgtaacacagaggctgcgggaccccgatattaatccctgtctgagcgaatctgacgcctcaacccggtgtctcgatgaaaataattacgacagggagcggtgttctacctatttcctcaggtataaaaattgtcggaggttctggaactcgatcgttatgcagagaagaaagaacggcgtgaagccattcatgcctactgccgctgaacgcgatgagatactccgtgccgttggaaacatgccctattag

SEQ ID NO: 112641 - DNA, 135 bp, Artificial Sequence
  Description of Artificial Sequence: Synthetic coding sequence
atgccatctgtcacacagagattacgggaccccgatattaacccctgtctgagtgaaagcgacgcaagtaccaggtgtctggatgagaataactatgaccgggaacggtgttctacctatttcctgcggtactag

SEQ ID NO: 112642 - DNA, 294 bp, Artificial Sequence
  Description of Artificial Sequence: Synthetic coding sequence
atgcatcagacgcggactggcaaaaagaccgtccgcatgccatctgtaacacagagactccgcgacccggacatcaacccttgtctcagtgaaagtgacgccagcactcgatgcctagacgaaaataactacgaccgagagcgatgtagtacctattttctgagatataagaactgccgcagattctggaattctattgtgatgcagagaagaaaaaacggagtgaagccgttcatgcccacagccgctgaacgagacgaaatcctgagagctgttgggaacatgccttactag

SEQ ID NO: 112643 - DNA, 207 bp, Artificial Sequence
  Description of Artificial Sequence: Synthetic coding sequence
atgcatcagactcgcactggaaagaagactgtgagaatgccaagcgtgacccagcggctcagggatccagatattaatccatgcttgtcaatcctgttctatcttttaaatgacgccagtcttatcagcgtgaggaatttaatgctgccaccagacgtgtggatgaagataaccatgacaggaaaaggagtgcctctgacctcttag

SEQ ID NO: 112644 - DNA, 264 bp, Artificial Sequence
  Description of Artificial Sequence: Synthetic coding sequence
atgtccacatccgtgccacagggccatacctggacacagcgcgtgaaaaaagacgatgaagaagaggatcccctagaccagctcattagccggtctggatgcgctgcctcccactttgcagttcaggagtgcatggcccaacaccaggattggcggcaatgtcagccccaggtgcaagcgtttaaggactgtatgagtgagcagcaagcacgccggcaggaggagttacagagacgccaagaacaggccggggctcaccactag

SEQ ID NO: 112645 - DNA, 264 bp, Artificial Sequence
  Description of Artificial Sequence: Synthetic coding sequence
atgtccacgagcgtaccccagggtcacacttggacccagagagtaaagaaggatgatgaggaagaagatccacttgatcagttaatatcgaggagcggctgtgcagccagccactttgcagttcaggagtgcatggcccagcatcaggactggaggcagtgccaacctcaggtgcaggccttcaaagattgcatgagtgagcaacaggccagaagacaggaggagctgcagaggaggcaggaacaagccggagctcatcactag

SEQ ID NO: 112646 - DNA, 291 bp, Artificial Sequence
  Description of Artificial Sequence: Synthetic coding sequence
atgttttatcgcctgccaataccacggatgagtacatcagtccctcaggggcacacctggacacagcgagtgaaaaaagacgacgaggaagaagatccactggaccaactcatatctaggtcaggatgcgcagcctcacattttgccgtccaggaatgtatggcgcaacaccaggactggaggcagtgtcagccgcaggtgcaggctttcaaagactgcatgtccgagcagcaagctaggcgccaggaggaactccagcgtcgacaggagcaagcaggggctcatcactag

SEQ ID NO: 112647 - DNA, 264 bp, Artificial Sequence
  Description of Artificial Sequence: Synthetic coding sequence
atgagcacctcagtcccacagggacacacttggacgcaaagagttaagaaggacgacgaggaggaggatcccttggaccaattaatctcaagaagtggctgcgccgcatcgcactttgcggtccaggaatgcatggcccagcaccaggactggcgtcagtgtcaaccccaggtgcaggcattcaaagattgcatgtcagagcagcaggctcgccgacaggaggagctgcagaggcgtcaggaacaggccggagcccaccactag

SEQ ID NO: 112648 - DNA, 1731 bp, Artificial Sequence
  Description of Artificial Sequence: Synthetic coding sequence
atggccgcctctgaaactgtccggctgagactgcaatttgattaccccccccctgccacacctcactgcacagcattctggctcctggtcgacctgaacaggtgcagagtcgtgacggacctgatctccttgatcagacagagattcggctttagctctggcgctttcttgggactgtacctcgagggcggtctgctccctccagcagaaagcgcccggttggtgcgtgacaatgattgcttgagagttaaattagaggagcggggcgtcgccgaaaattccgtggtcatctctaatggcgatattaatttaagtttgcgcaaagccaagaagagggcctttcaattagaggagggtgaagagaccgaacccgactgcaaatacagcaaaaagcattggaaatcgcgcgagaacaataataataacgagaaggtgctggaccttgagcccaaggctgtcacagaccagactgtgtccaaaaaaaataagcggaagaacaaggcaacctgcgggactgttggagacgacaacgaggaagctaaaagaaagtctcccaagaaaaaggagaaatgcgaatacaaaaaaaaggcgaagaatccaaaatcacctaaagtacaggcagtgaaagactgggcaaatcaaagatgctcctcccctaagggaagcgcaaggaattcactggtgaaagctaaaagaaaggggtcggtctcagtatgctctaaagagtctcctagcagttccagtgagagcgaaagctgtgacgagtccatctctgatggaccttcaaaagtgaccttagaggctaggaactcgagtgagaaattacctacagagttgagcaaggaggagccgtctactaagaatacaaccgccgataagctggctatcaagctcggcttctcactaacaccatccaaggggaagacctctggaaccacttcatcatcgagtgatagtagcgccgagtctgacgatcaatgtctgatgagcagctcaactcccgaatgcgccgctggattcctgaaaacagtcgggctcttcgcgggccgcggccgcccgggccctggcctcagcagccagaccgccggagcagcgggctggagacggagtggctcaaacggcggcggccaagcccctggggctagtccatccgtatctctgccggcctctttgggtcgagggtggggtagggaggagaatctgttttcctggaaaggagccaagggaaggggcatgcgggggagagggagaggtagagggcacccagtgtcctgcgttgtgaacaggagtactgacaaccaaagacagcaacagttaaacgatgttgtgaagaacagttcaacgatcattcaaaaccccgtggagacgccaaagaaggactactcccttctccccctgctagctgccgcgccacaggtcggggagaagatagcctttaagttgctggaactgacttcaagctactcccctgacgtttctgattacaaggaaggcagaattttgagccataacccagaaacccagcaagttgatatcgagatcttgtcatctttgccggccctcagagagccaggtaagtttgatctggtctaccacaacgaaaacggtgccgaagtcgttgaatatgcggtcacgcaggagagcaaaatcactgtattctggaaagagctgatcgaccctcgattgatcatcgaatcaccaagcaacacgtcttccaccgagcctgcctag

SEQ ID NO: 112649 - DNA, 519 bp, Artificial Sequence
  Description of Artificial Sequence: Synthetic coding sequence
atggcttccgacgagggcaaactctttgtaggtgggcttagtttcgacaccaatgagcagagcctggaacaggtgttctccaagtacggccagatcagcgaagtggttgtggtgaaagacagagagacacagaggagccgcggttttggctttgtgaccttcgagaatatagacgacgcaaaggacgccatgatggcgatgaacgggaaaagcgtggacggcagacagatcagggttgatcaggctggcaaatcatctgacaatcgaagcagagggtatagggggggaagtgccggtggaagaggcttcttcagaggcggccggggccgaggacgtggattttctagaggcggaggagataggggatacggaggcaatcggtttgaatcaaggtcgggagggtacggcggatctcgcgactattacagcagccggtctcagtccggtgggtactcggacaggtcctccgggggtagctaccgcgactcctacgattcctatgccacccacaacgagtag

SEQ ID NO: 112650 - DNA, 792 bp, Artificial Sequence
  Description of Artificial Sequence: Synthetic coding sequence
atggcaagtgatgaggggaagttgtttgtcggaggtctatcgttcgataccaacgagcagtccctcgaacaggtcttttctaagtatgggcagatttccgaggtggtcgtggtcaaggatagggaaactcagaggagccgtgggtttggattcgttacattcgaaaatatagatgacgctaaagatgcaatgatggcaatgaatggcaaatccgttgatggccgacagatccgagtggatcaagccggtggtggcgaccgcgggtacggaggcaataggttcgagagccgctcaggtgggtacggtggttcgagagactactacagttctcggtcacagagcgggggttattcagatagatcatcagggggatcgtatcgcgactcatatgactcgtacgggaagtctcatagtgagggagctactctgctgtggcctgcggtaggcgcccggtttactctcgtgccttcaccttctacactgggctggaccctccgtccctgccattgcgcttgtccagaagaggcccacctttccagtcagagccacttctaccgtcgaacacagaaacctaacgagacagaccagaaagggaagggggagcggggccccgccggacagagcgcccggtgtatgtgcgggcgtcggcccgcaagcttgggctgtggaggctggctgctacctggtagacgcccaaggcctgggctggcgtcaggggtgaaactgcccttggtagcctcagtgccactgcattgcgcgtgctttttaagtagtgccacccacaacgagtag

SEQ ID NO: 112651 - DNA, 735 bp, Artificial Sequence
  Description of Artificial Sequence: Synthetic coding sequence
atgtcctccagatggtcaagatcaagtcagtctaccgataggtcactaaagtctgtagacgggaggcagatccgcgtggatcaggccggtaaatccagcgacaaccggtcccgtggctaccgcggcggctccgccggggggagaggattctttcggggcgggaggggtcgtggtcgcggtttctctagaggagggggggaccgtgggtacggtggtaaccggttcgagtccagaagcgggggttatggaggcagtcgagattactattcttcccggtcacagtccggagggtactctgataggtctagcggcggcagttatagggactcctacgactcctatggcaagtctcatagtgaaggagccactctgctctggccggcagtgggcgctcggtttactctggtgccttctcccagcacactcggatggaccttgagaccgtgtcactgtgcatgccccgaagaggcgcacctcagctcccagtctcacttctatcgaaggactcagaaacccaatgagaccgaccagaaaggcaagggcgaacgaggccctgccggacagtccgcgaggtgtatgtgcggtcgtagacccgcgagcctcggttgtggcggatggctgttgcctggacgccgtccccggcctggtctggcatcaggtgtgaaattgcctctcgtggcctccgtgccactgcactgcgcctgctttctcagtagtgccacgcacaacgaatag

SEQ ID NO: 112652 - DNA, 519 bp, Artificial Sequence
  Description of Artificial Sequence: Synthetic coding sequence
atggcctccgatgaaggaaagttgtttgtgggggggctgtctttcgacactaatgagcaatcgctggagcaggtgttttccaaatatgggcaaattagcgaggtggtggtggttaaggaccgcgagactcagagaagtagaggcttcggcttcgttacatttgagaacatcgatgatgccaaggatgctatgatggctatgaatggcaagagtgtagatggacgtcaaatacgagtggatcaggcagggaagtccagtgataatcggtcccgtgggtaccggggcggaagcgccggtggacgggggttcttccggggcgggcgagggagaggccgcgggttcagcagaggtggaggcgaccgcggctatggaggcaacagattcgagtctagatcaggaggttacggaggatcccgagactattactcttcccggagtcaatctggcggttactctgacaggtccagcgggggttcatacagggactcatatgattcctacgccacgcacaacgagtag

SEQ ID NO: 112653 - DNA, 2304 bp, Artificial Sequence
  Description of Artificial Sequence: Synthetic coding sequence
atgtcattcgaccctaatttgctgcacaacaacggccacaacgggtatccaaacggcacatctgccgctctgcgcgaaacgggggtaatagaaaagctgctgaccagttacggcttcatccaatgctccgagagacaggcacgcctctttttccactgttctcagtacaatggcaacctgcaggaccttaaagttggtgacgacgtcgaattcgaggtttcaagcgaccgacgcaccggcaaacctatcgctgtcaagctagttaaaatcaaacaagagatcctgccagaagagagaatgaacggccaggaggtcttctatttaacgtacactccagaagacgttgaaggaaatgtgcaacttgaaactggagacaagatcaactttgtgattgacaataataagcacaccggtgcagtgtctgcaaggaacattatgctgctgaaaaaaaaacaggccaggtgccagggagtggtgtgtgctatgaaagaggcattcgggtttatcgaacgcggtgacgtggttaaggagatcttttttcactatagtgagttcaagggggacctggaaactctgcagccaggagatgacgtcgagtttacgataaaggaccgcaacgggaaagaggtggccaccgatgtgcgcctgcttccccaggggaccgtgatatttgaagacatttcaattgagcatttcgagggaacagtgacaaaggtaattcctaaggtgccatccaagaaccagaacgatccactgcccggacggataaaagtggacttcgtcattccaaaagaactgcccttcggggataaagatacgaaatcaaaggtgacactcctggagggagaccatgtcagatttaatattagcacggaccggcgtgacaaactggaaagagccacgaatatagaagtcctgtctaatacatttcaattcacgaacgaagctcgggagatgggagtgatcgccgccatgcgagacggcttcgggtttattaagtgcgttgatcgcgacgttcgcatgtttttccatttcagcgagatattggacgggaaccaacttcacatagcggacgaagtggaatttacggttgtgcccgacatgctttcagcccagagaaaccatgcaattcgcatcaaaaaactcccgaaaggtacagtctctttccactcacactccgatcatcggttcctggggacagttgagaaagaagctacattctctaaccccaagacaacatctccaaacaagggaaaagaaaaggaggcagaagatggaattatagcctatgatgattgcggtgtaaaactcacgattgccttccaggctaaggatgtggagggatctacaagccctcagatcggcgataaggtggagttctccatttccgacaagcagcggcccggccaacaggtcgcaacgtgtgtgcggttgctgggaagaaatagtaactccaaacggctgctgggctacgtggctacactgaaagataacttcggatttatagagactgctaatcacgacaaggagattttttttcattattctgagttcagcggcgacgtcgactccctggaacttggggacatggtggagtattctttatccaaggggaagggaaacaaagtgtcggccgagaaggtgaataagacacatagtgttaatggtatcacagaggaagctgaccccaccatctatagcgggaaggttatccgcccactgcgatcagtcgatcccactcaaactgaataccagggtatgatagagatcgtcgaagaaggagatatgaagggagaagtctaccccttcggaatcgttggtatggccaataagggcgactgtcttcagaaaggggagtctgtgaagttccaactttgtgtcttagggcagaacgcccaaacaatggcctataatatcacacccctgcgccgcgcaaccgttgagtgcgtgaaagaccagttcggcttcatcaattacgaagtgggtgactccaagaagttattctttcatgtgaaagaggtgcaggacggcatcgagttgcaggccggtgacgaggtagagttctctgtaattttgaatcagcggactggaaagtgctcggcatgcaatgtttggcgagtgtgtgagggacctaaggccgtagctgccccccggcccgatcggcttgtgaatcggctgaagaatatcaccctggacgacgcctccgcccccagactgatggtactcagacagcctaggggcccagataattccatggggtttggggcagaacgcaagattaggcaggccggcgtgatcgactag

SEQ ID NO: 112654 - DNA, 2304 bp, Artificial Sequence
  Description of Artificial Sequence: Synthetic coding sequence
atgagctttgatccgaacctcctgcacaataatggacataatggataccctaacggaacttccgctgctctgcgggaaactggcgtaatcgagaagctactgacttcttatggattcatccagtgttctgaaagacaagccagactgttcttccactgttcacagtataacgggaaccttcaagatctgaaagttggtgacgacgtcgaattcgaggtgtcttccgacagacgcacaggaaaacccatagctgtgaaactcgtgaaaataaagcaggagatactacccgaggagcgcatgaatggacaggaggtgttttatttgacgtacactccggaagacgtggagggcaatgtccagcttgagaccggagacaaaattaattttgtgattgataataataaacacacaggcgcagtgtcggcgagaaacatcatgctgcttaaaaagaaacaggcccgttgccaaggcgtggtctgtgccatgaaggaggcttttggtttcattgaacggggcgacgtggtcaaggaaatcttttttcactactccgagtttaagggggatttagaaacactgcagcccggtgacgatgttgaatttactattaaagaccggaacggaaaggaagtggcaacagacgtcagacttttaccccagggaacagtcatctttgaagacattagcatcgaacactttgaaggtaccgtcactaaagtcataccaaaggttccaagtaagaatcagaacgatcctctgcctggccggatcaaggtggactttgtcattccaaaagaactgccttttggtgacaaagataccaagtccaaggtcacgttgctggagggggatcacgttcgatttaatatatctaccgatcgacgagataagctggaacgggcgacaaatatagaagttctgtcaaacaccttccagttcactaacgaagcacgcgagatgggcgttattgctgctatgagggacggtttcgggtttatcaaatgcgttgatcgcgacgtacgtatgttcttccattttagtgagatcttggatggaaaccaactgcatatcgctgatgaggtcgaattcaccgtcgttcctgacatgctgtctgctcagcgtaaccatgctatacgaatcaagaaactgcccaagggcaccgtctcatttcattcccatagtgatcacagattcctgggcaccgtggagaaagaggccactttctctaatcctaaaaccaccagcccaaacaagggcaaagagaaggaagccgaagatggcattatcgcatacgatgattgcggtgtcaagttaaccattgcttttcaagccaaagatgtcgagggaagcactagtccccagatcggggacaaggttgaattcagcatctcagataaacagcggcccggacaacaagttgccacctgcgtacgactactgggacgcaatagcaattccaagaggctcttaggctacgtcgcaaccctgaaggacaatttcgggtttatcgagaccgctaatcacgataaggagatcttttttcattactcggagttctctggcgatgtggattcactggagctgggcgatatggtagagtactctctgtcgaagggtaaggggaataaggtgtctgcagagaaagtgaacaagacacattcagtcaacgggatcacagaggaggcggaccctaccatctactccggaaaggtaataaggccccttagatcagtggacccgacacagaccgagtaccaagggatgatcgagatagtggaggaaggagatatgaagggggaagtgtatccgttcgggatcgtggggatggccaataaaggtgattgtctgcagaaaggcgagagcgttaaattccagctgtgtgtgcttgggcaaaacgcccaaacaatggcttataacatcacccctctgcggcgcgcgaccgtggaatgcgttaaagaccagttcggctttataaactacgaagtgggggactctaaaaaactgtttttccatgtgaaggaagtccaggacggaatagaattacaggctggagatgaggtggaattcagcgtgattctcaatcaaaggactggaaaatgtagcgcctgcaatgtgtggcgagtttgcgagggccccaaggccgtggccgctcctcgaccggacagacttgtgaaccgcctgaaaaacattaccctagacgacgcatctgcccctcgcctcatggtgctgcggcagccacgcggcccagacaattctatggggttcggagctgagcgtaaaatccggcaggccggggttattgactag

SEQ ID NO: 112655 - DNA, 2397 bp, Artificial Sequence
  Description of Artificial Sequence: Synthetic coding sequence
atgtccttcgatcctaacctactccataataacggacacaatgggtacccaaacggtacatctgccgccctgcgcgaaacaggcgttatcgaaaagttgctcacgtcgtatggatttattcaatgttccgaaagacaggccaggctgttctttcattgcagtcagtacaacggtaatctccaggacctcaaagtcggagatgacgtggaattcgaggtatctagtgacagacgtaccggaaaacccatagctgtgaagctggtgaaaattaaacaggagatactgcctgaggagaggatgaatggtcaagtagtctgcgcagttccccataatctagagagcaagtcccctgccgcccctggccagtcaccgactggatctgtatgctatgagcgcaatggcgaggtcttctacctgacctatacccctgaggacgtcgaaggcaacgtccagctggaaaccggcgacaagataaatttcgttatagataacaacaagcatacgggggctgtgagcgctcggaacatcatgttactcaagaagaaacaggcccggtgtcagggagttgtatgcgctatgaaggaggctttcggttttattgagaggggcgatgtggtgaaagaaatcttcttccattattccgagttcaagggcgatctggagactttacagccaggggatgacgttgaatttactattaaagatcggaatggaaaggaggttgccaccgacgttagattactacctcaggggacagtgatctttgaggacatttccattgagcacttcgaaggtaccgttacgaaggttatccctaaagtcccctctaagaatcagaatgaccccctccctgggcggattaaagtggactttgtgattcctaaagagctgccctttggagataaggatacaaagtcgaaggtgaccctgctggagggtgatcacgtacgctttaacatttctactgaccgtagagataaactggagagggccaccaacatcgaggtcctgtcaaataccttccagttcactaatgaggcaagagaaatgggtgtgatcgccgccatgagggacggctttggttttattaagtgtgtcgacagagacgtgagaatgttcttccatttctcggaaatccttgacgggaaccagttgcacatcgctgatgaagtcgaattcactgttgtgcccgatatgctcagcgcacagcgtaatcacgccatccgaatcaagaagctacccaagggcacagttagttttcattctcactcagaccaccgcttcctgggcactgttgaaaaagaagccactttctccaacccgaagaccacatcaccaaataaaggaaaagagaaagaagctgaagatggaataatagcgtacgatgattgcggagtcaagcttacaatcgcttttcaggccaaagacgtcgagggctccacctccccacagattggggacaaagtcgagtttagtataagcgataaacaaaggccaggacagcaagtggccacttgcgtgcgactgctgggccgcaactctaatagtaaaaggctcctaggctacgtagccacattgaaggacaacttcggattcattgaaacagctaatcacgataaggaaattttctttcactatagtgagtttagcggagatgtagacagtttagagcttggcgacatggtggagtatagcctgtccaaaggaaaaggcaataaggtttctgcagagaaagtgaacaaaacccatagcgtcaatgggattaccgaggaggccgatccaacgatttacagtgggaaagtgatccgaccgttgagaagcgtcgatcctacccagaccgagtaccagggtatgatcgagatagtggaagagggggatatgaagggcgaagtctacccctttggcattgttgggatggctaataaaggcgactgcctgcagaaaggcgaatcagtgaagtttcagctctgtgttctgggacaaaacgctcagactatggcttataacattaccccattacgtagagccaccgtcgagtgtgtgaaggatcaatttgggttcatcaactatgaagtgggtgatagcaagaagctgttcttccacgtgaaagaagtccaagatgggatagagctgcaggcaggcgatgaggtggagttctctgtgattctaaatcaacgcactggaaaatgttcagcatgtaatgtgtggcgtgtatgcgagggacctaaagcagttgccgctcctcggcccgacaggctggtaaataggctgaagaacattacactcgatgatgccagtgcccctcgactgatggtgctgaggcagccccggggaccagacaattccatgggatttggcgcagaaaggaagatcagacaggctggagtgatcgactag

SEQ ID NO: 112656 - DNA, 2442 bp, Artificial Sequence
  Description of Artificial Sequence: Synthetic coding sequence
atggaaaacgtctttacagtctcaagcgaccctcaccctagccccgctgctccacctagccttagtttgccccttagtagctcctccaccagttcaggaaccaaaaagcagaaaagaacacccacctatcagagatccatgtcgttcgaccccaatctgctccacaataatggtcacaatggctaccccaacgggactagtgcagcactgagagagactggagttatcgagaaacttctcactagctatggcttcatccaatgtagcgaacgccaggccagattattttttcattgctcccagtacaacgggaacctccaggatctcaaggtcggcgatgacgtggagtttgaagtgtcctctgatagacgtaccggcaagccaatcgctgtgaagttagttaagataaagcaggagatccttccggaggagagaatgaatggacaggaagtgttctatcttacctacacccccgaggacgttgaggggaatgtgcagctcgaaacaggtgacaagatcaatttcgtgattgataataacaaacataccggggccgtgtccgctagaaatattatgctgctgaagaagaaacaggcccgatgtcaaggcgtcgtgtgcgccatgaaagaagcattcgggttcatcgaacgcggcgatgtcgtgaaagagatcttttttcactatagcgaattcaagggggacctggagacacttcagcctggagatgatgtcgagtttacgataaaggataggaatgggaaagaagtggctactgatgtgaggctgctgccccaaggaaccgttatttttgaggacatatctattgagcattttgagggcactgtcactaaggtgattcccaaagtgccttctaagaaccagaatgatccactgcctggccgaatcaaagtggattttgtaattcccaaagaactgcccttcggagacaaagatacaaagtcaaaagtaacacttctagaaggagatcacgtgcgatttaacatctctaccgatcgaagggacaagcttgagagggcgaccaacattgaggtgctctctaacactttccaattcactaacgaggcccgggagatgggagtaattgcggctatgcgcgatggatttggcttcatcaagtgcgtggaccgggacgtacggatgtttttccacttcagcgaaatcctggatggaaaccaactgcacatcgcagatgaggtggaattcactgtggtgcctgatatgctgagcgcccagaggaaccatgcaatccgcattaagaagctgccaaagggcacggtgagttttcattcccactccgaccaccgctttctgggcaccgttgaaaaggaggcaacgttctcaaacccaaagaccaccagtccgaataaggggaaggagaaggaggccgaggatggcattatcgcctatgatgactgcggagtcaaactgacaatcgctttccaggctaaggacgtggaagggagtacctcccctcagatcggcgacaaagtggagttctcgatctctgataaacagcgacccggacagcaggtggccacctgtgtgcggctgctggggcgcaatagcaatagcaagcgcctgttagggtacgtcgcaacactgaaagataactttggtttcatcgaaactgccaatcatgataaggagatcttcttccactactccgagttcagcggcgacgtagacagcctggagctcggggatatggtggagtactccctgagcaaggggaaaggaaataaagtatctgccgagaaggttaacaagacccactcggtgaacggaatcactgaggaggccgaccccactatatattcagggaaagtgattagacccctgcgcagcgttgaccccacccagaccgaataccaggggatgatcgaaattgtcgaggagggcgatatgaaaggcgaggtgtaccctttcggcatcgtcggtatggccaacaagggcgactgtctacaaaaaggggagtctgtgaaattccaattatgcgtgttgggccaaaatgcccaaactatggcatataatataacccctctccggagggccacagtggagtgcgtgaaggaccagtttggtttcataaactacgaggttggcgattcgaagaagctctttttccacgtgaaagaggtgcaggatgggatagaacttcaggctggggacgaagtcgagtttagcgtgatcctgaaccagcggactggaaagtgtagcgcctgtaacgtctggagagtgtgtgagggccccaaggcagtcgccgcccctcgccccgatagactggtgaatcgcctcaagaacatcacgctggacgatgctagcgctcctcggctgatggtgctaagacagcctcgtgggcccgataattcaatggggtttggggcagagagaaaaatcagacaggcaggcgtgattgactag

SEQ ID NO: 112657 - DNA, 2535 bp, Artificial Sequence
  Description of Artificial Sequence: Synthetic coding sequence
atggaaaatgtgttcacagtgagctcagatccccacccttctccagccgctcccccatccctgagtctgcccctgtcctcttcgtccacatcctccgggacaaaaaagcaaaagaggacgcccacttatcaacgcagtatgtctttcgaccccaacttgctccacaacaacggccacaatggctaccccaacggcacgagcgcagctctacgtgagactggcgttattgaaaaacttttgacgtcatacggcttcattcaatgtagtgagcggcaagcgcgactgttttttcattgttctcagtataacggcaatctccaggacctcaaagttggcgacgatgttgagttcgaagtctcctcagaccggaggacgggtaaaccgatagcggtgaagttagtgaaaatcaagcaggagatcctgcctgaggagaggatgaatggacaagtggtttgcgccgtacctcataatctggagtctaagtctcccgcagcccctgggcagagtcccactggcagcgtgtgttacgaaagaaatggggaggtgttctacttaacatacacccctgaggatgtcgagggcaacgtgcagttggagacgggggacaaaataaacttcgtaattgataacaacaagcatacaggcgccgtgagcgctagaaatatcatgctactcaaaaaaaagcaggctcgttgccagggtgtggtgtgcgcaatgaaagaggcgttcggctttatcgagcggggagatgtggtcaaagagatcttctttcactactctgaatttaagggcgatctggagaccttacagcctggtgatgatgtagagttcacaatcaaagacagaaatgggaaggaggtggccaccgacgtccgccttctcccccaaggcacagtgatctttgaagatatctcaatcgagcatttcgagggaactgtgaccaaggtcattccaaaagtacccagcaagaaccaaaacgatccactgcccggaaggataaaagtggattttgtgatccctaaggagctgccgtttggtgataaggatacaaagtcaaaggtaaccctccttgagggcgaccatgtgaggttcaacatcagcacggacaggagagataaacttgagcgagcaacgaatatcgaggtgctctcaaacacttttcagtttaccaatgaggctcgcgagatgggggttattgccgccatgagagatggatttggtttcattaaatgtgtggatcgggacgtccgcatgttctttcatttctccgaaatcctggacgggaatcagttacatattgccgatgaggtggaatttacagtggtccctgacatgttatctgcacaaaggaatcacgcaattaggatcaaaaagctccctaaaggaactgtgagcttccactcccacagcgaccacagatttctcggcaccgtggagaaggaggctaccttttccaatcctaagaccaccagcccgaacaaagggaaagagaaagaggccgaggatgggataatagcctatgatgactgtggcgtcaagttaacaatagccttccaggccaaagacgttgagggatctacatctccgcagatcggggacaaggtggaattctccatatcagacaagcaacgccctggccagcaggtggccacatgtgtgaggctgctcggaaggaattcaaattcaaaacgactcctgggctacgtggctacactcaaggataattttggattcatcgagaccgctaatcacgataaggagatttttttccattattccgagtttagcggtgacgttgatagtctcgagcttggcgacatggtagagtatagcctgagcaaaggcaagggcaacaaagtatccgccgagaaggttaacaagacccatagcgtgaacggcatcacggaggaggcggaccccactatttactccgggaaagtgatcagacccctgagatccgtcgatcccactcagacagaataccaagggatgatagaaatcgtggaagaaggggatatgaaaggcgaggtgtacccttttggcattgtcgggatggccaacaagggagattgcctgcagaaaggagaaagtgtcaaattccagctgtgtgttctgggacagaacgctcagaccatggcctacaatatcaccccgctgaggagggctaccgtggagtgtgtcaaagatcagtttggttttatcaattatgaggtgggcgattctaaaaagttgttctttcatgtaaaagaggtccaggacggcattgaacttcaagccggggatgaggtcgagttcagtgtgatcctgaaccagcgaacagggaagtgttctgcctgtaatgtgtggcgggtgtgtgaaggtccaaaggctgtcgccgccccacgccccgataggcttgtgaacaggttgaaaaacataaccctggatgacgcgagcgcccccaggctcatggtgctccgccagccaagagggcctgacaacagtatggggttcggtgccgagaggaagatccggcaagccggcgtgatagactag

SEQ ID NO: 112658 - DNA, 141 bp, Artificial Sequence
  Description of Artificial Sequence: Synthetic coding sequence
atgtctttcgatcccaatctgctccacaacaacgggcacaacggctaccctaatggaaccagtgcagcactcagagagactggtgtcattgagaagctgctgacgtcatacgggtttattcagtgttcagaacgtcagtag

SEQ ID NO: 112659 - DNA, 24 bp, Artificial Sequence
  Description of Artificial Sequence: Synthetic coding sequence
atgagctttgatcctaacttgtag

SEQ ID NO: 112660 - DNA, 2007 bp, Artificial Sequence
  Description of Artificial Sequence: Synthetic coding sequence
atgaacggacaggaggtgttttatctgacttatacccccgaagatgtcgagggcaacgtacagctggaaaccggggacaagatcaactttgtgatcgataataataaacacactggagcggtttccgctagaaatattatgcttttaaaaaagaagcaggcccgctgccagggggtcgtgtgtgcaatgaaggaggcgttcggtttcattgagcgcggagatgtcgtcaaggagatcttctttcattactcagagttcaagggtgatctggaaacgctccagccgggcgatgacgtggagtttactattaaggacagaaatggcaaagaagtcgctactgatgtgagactcctcccacagggaaccgtgatcttcgaagatatttccattgagcattttgagggcacagtgactaaggtaattcccaaagttccctcgaagaaccagaacgaccccttgcctggccgaataaaagtggactttgtgatccctaaggaactgcctttcggagacaaagataccaaaagcaaggtgactctgttggaaggggaccatgtgcggtttaacataagcacagaccggcgagacaagctggaacgagctacgaatattgaggttcttagcaatactttccaatttactaacgaggcccgcgagatgggggtaattgctgcaatgagggatgggttcggattcataaagtgtgtggacagagatgtgagaatgttttttcatttctctgagattctagatggaaatcaattacatattgccgacgaagtggaatttaccgtagtgcccgacatgctttcagcacaaaggaatcacgccataagaatcaagaaactccctaaaggcacagtgagcttccatagccatagcgaccacaggttcctgggaaccgtagagaaggaagctacattctcaaaccccaaaaccacaagtcccaacaagggcaaagagaaggaagctgaggatggtataattgcttatgacgactgcggtgtaaaattaacaattgcctttcaagccaaggacgttgaaggtagtaccagtccccagattggagataaggtggagttttccatttccgataaacagcgccctggccaacaggtggcaacctgcgtgcggctgctgggaaggaacagtaattctaagaggctattagggtacgttgccacactcaaggacaattttggcttcattgagactgcgaaccacgataaagagattttcttccactacagtgaattctctggcgacgtcgactccttggaacttggggacatggtggagtactctctcagcaagggtaagggaaataaggtttccgcagaaaaggtaaacaagacccacagcgtaaacggtatcacggaggaagctgacccaactatttacagtgggaaagtaatcagacctctaagaagcgtggatccgacccagaccgagtaccaaggtatgatcgagattgtggaggaaggggacatgaaaggagaagtgtacccattcggaatcgttggcatggccaataagggtgattgcctgcagaagggcgaaagtgtgaagtttcagctgtgcgtcctggggcaaaatgcacagactatggcctacaacattacccctcttaggagggctacggttgaatgcgtgaaagatcagttcggattcataaattacgaggttggcgactcaaaaaagctgttcttccatgtgaaagaagtgcaggatggcatagaactgcaggcaggtgatgaggtggagttcagtgtcattctaaatcagcgcacaggaaagtgctctgcctgcaacgtgtggcgcgtttgcgagggacccaaagccgtggccgcccccaggcccgatcgactggtcaaccggttaaagaacattactctggacgacgccagtgctcccagactgatggtactcagacagcctaggggcccagacaatagcatgggcttcggggccgagagaaaaattcggcaagccggtgttattgattag

SEQ ID NO: 112661 - DNA, 288 bp, Artificial Sequence
  Description of Artificial Sequence: Synthetic coding sequence
atgtctttcgatcccaatcttctgcataacaacgggcacaatggctacccgaacggcacatccgcagctctacgtgagaccggagtcatcgagaaattgctcacgtcttatggctttatacagtgttctgaacgtcaggctcgcctcttttttcattgcagccagtataacggtaacttgcaggacctgaaggtgggggatgacgtcgagttcgaggtatccagcgacagaaggaccggaaagccaatcgcagtcaaactggttaagattaaacaagaaatactgtag

SEQ ID NO: 112662 - DNA, 2397 bp, Artificial Sequence
  Description of Artificial Sequence: Synthetic coding sequence
atgtcctttgatcccaatctgcttcacaacaatggacataatggttacccgaatggcactagcgctgcactgagggagaccggcgtgatcgaaaaactcttaacctcttacggatttatacagtgcagcgaacgacaggcccggttattctttcactgttcccagtacaatggaaacttgcaggacctcaaagttggtgatgatgtggagtttgaggtcagctctgacaggaggacgggcaagcccattgcagtcaaattggttaaaatcaagcaggaaatcctgccagaggagcgcatgaacggccaggtggtttgtgctgtcccccacaatttggagagcaaaagccctgccgcaccagggcagagccctacaggaagtgtctgctatgaaagaaacggcgaagtattctatctgacatacaccccggaagacgtggaggggaatgtgcaactggagaccggcgacaaaatcaattttgtgatcgataataataagcacaccggggctgtgtctgccagaaacatcatgctgctgaagaaaaagcaagcacggtgccagggcgtggtgtgtgcgatgaaagaagctttcggtttcatcgagcgcggagatgtggttaaggagatctttttccactacagcgaattcaaaggggacctggaaactctgcagccgggcgacgacgtcgaatttacaatcaaggatcggaacggaaaagaagttgccaccgatgtccggctgttgcctcagggtacggtcattttcgaagatatatccatcgagcatttcgagggaacggttacaaaagttataccaaaggtgccatccaagaaccagaacgacccactacctggccgcatcaaggtcgattttgtgatcccaaaggaactgccattcggtgacaaagataccaaatctaaagtgactctgttagaaggggaccatgtgcggttcaatatcagcaccgacaggcgtgacaaacttgaacgcgcaactaacattgaagtcctcagcaatactttccagtttaccaacgaggcccgggagatgggcgtcatcgccgcaatgagagatggcttcgggtttatcaaatgcgttgacagggatgtcagaatgttcttccacttctcagagatcctggacgggaaccagctccacattgctgacgaagtggaattcacggttgtccccgacatgctgagtgctcagagaaatcacgcaatccgcatcaaaaaactgccaaaaggaaccgtttcatttcactcccatagcgaccatagatttttgggcaccgtagagaaagaagcaaccttctccaacccaaagacaacatctcctaacaagggtaaagaaaaggaggcggaggacggaattattgcctacgacgattgcggtgtaaaattgactatcgcatttcaggctaaagacgtggaaggctctacctcgccccaaatcggtgataaggtggagttctctatttctgacaaacaacgtcccgggcaacaagtggccacctgtgtgcgcttgctcggcaggaacagtaactccaagcgattgttaggttatgtggccacgttgaaagataactttggcttcattgaaacggcgaatcacgacaaagaaatcttttttcattactccgaattctctggagatgtagactctctggagctgggcgacatggttgaatacagcctgtctaaaggcaagggaaataaagtttccgcagagaaagttaacaaaacgcattcagtgaatggaataaccgaagaggctgacccaaccatctactcaggcaaagtcatccggcctctgcgatccgtggatcctactcagacagaatatcagggcatgatcgaaattgtggaagaaggcgatatgaaaggagaagtctacccttttggaattgtgggaatggccaacaagggggactgcctgcagaagggagagtcggtgaagtttcaactgtgcgtcctcggccaaaacgcgcaaaccatggcctacaacatcacccctctaaggcgggcaaccgttgaatgcgttaaggaccagttcgggtttattaactatgaggtgggtgatagcaagaaacttttcttccatgtcaaagaggtgcaggacggcatagagctgcaggcaggcgatgaggtagagttttcagtgattctgaaccaaaggaccgggaagtgcagcgcgtgcaacgtgtggcgcgtgtgcgaaggtccaaaagccgttgccgcgccgagacccgatagactggttaaccggctcaaaaatatcacgctggacgacgcttctgccccacgcctgatggtcctgcggcagcccagaggccctgacaattctatggggtttggtgcagagcgcaaaattcgtcaagctggcgtgatcgactag

SEQ ID NO: 112663 - DNA, 1329 bp, Artificial Sequence
  Description of Artificial Sequence: Synthetic coding sequence
atggaggcttcacggtgtaggctgtccccttcaggtgatagcgtgtttcatgaagagatgatgaaaatgcgccaagccaagttggactaccagcggcttcttctcgagaagagacaacggaagaaacgtctggaaccctttatggtgcagcccaacccagaagctaggctccgccgagccaaaccacgtgccagcgacgagcagaccccccttgtcaactgccatactccacatagcaacgtgattctccacggaattgacggaccagccgcagtgcttaagcctgatgaggtgcatgccccgagcgtgagtagcagtgtggtggaagaagatgcagaaaacacagttgacaccgcctcaaagccaggccttcaggagaggcttcaaaagcacgatattagcgagtcagtcaactttgatgaagagaccgacgggatttcacagagtgcttgcctggagcggcccaacagcgcgagcagccagaacagcaccgacacagggacatcaggcagcgcgacagctgcacaacctgccgacaatctcctcggggacattgacgacctcgaagatttcgtctactcacctgcccctcagggggtgactgtgcgctgcaggatcatacgcgataagagaggaatggacagaggactattccccacatactatatgtaccttgagaaagaggaaaaccagaagatttttctgctcgcggcaagaaaaagaaaaaaatcaaagaccgccaattacttgatctccatagatcccgtggacctgagccgcgagggcgagtcatatgtcgggaagctcaggagcaatcttatgggaacaaaatttactgtatacgacaggggaatctgccccatgaaaggacggggcttggtgggtgctgcccatacccgacaggagctcgccgccatttcctacgaaacaaacgtattaggtttcaaggggcctaggaaaatgtccgtgatcattcccggaatgacgctcaaccataagcaaatcccttaccagccacagaataaccatgacagcctgttgagtcgctggcagaatagaacaatggagaacctggttgagcttcacaacaaggcccccgtctggaattcggacactcagagctatgtgctgaactttaggggacgggtaacgcaggccagcgtgaaaaatttccaaatcgtacataaaaatgaccctgactacatcgttatgcagttcggccgggtggcagacgacgtgtttaccctagactacaactaccccctttgcgccgttcaagcgttcggcataggactcagcagttttgatagcaaactcgcctgcgagtag

SEQ ID NO: 112664 - DNA, 912 bp, Artificial Sequence
  Description of Artificial Sequence: Synthetic coding sequence
atgtctgaagcaggcgaggcaaccactacaactaccactactctgcctcaagctcccacagaggctgccgccgcagctccccaggacccagcccccaaatcccctgttggctcaggtgcacctcaggcagccgcacccgcccccgccgctcacgtagcaggcaatcccgggggggacgccgccccagctgcgacgggcacggctgctgcagcaagtctggctacggccgccggcagcgaagacgcagagaagaaggtgttggctacaaaggtcctcggcacagtgaagtggtttaacgtcagaaatggatacggctttatcaacagaaacgatacaaaagaggacgtattcgtacaccagaccgccatcaagaagaataatccccgaaagtatttgaggagtgtgggggacggcgagactgtcgaatttgacgtggtggaaggagagaaaggagcagaggcagctaatgtcaccggccccgatggagttccagtggaaggctccagatacgccgccgatcggcggcggtaccggcgcggatattatggccgccggcggggcccaccaagaaacgcgggcgagattggcgagatgaaggacggcgtgcccgagggggcgcagctgcaaggccccgtacacaggaaccccacctatagaccaaggtataggagcagggggcctccacggcctcgacctgcacccgcggtgggagaggctgaggacaaggagaatcagcaggctacctccgggcctaaccaaccctctgtgagacgcggttacagacgtccttataattacaggcggcgcccccgcccgcccaacgccccatcccaggacggtaaagaagccaaggctggagaggcgcctaccgaaaacccggctccccccacacagcaatcctctgctgagtag

SEQ ID NO: 112665 - DNA, 339 bp, Artificial Sequence
  Description of Artificial Sequence: Synthetic coding sequence
atggagaagatcttgattctcctgctagtggctctgtccgtcgcgtatgcggcaccaggccctcgaggtattattataaacctggagaatggcgaactctgcatgaacagcgcccagtgcaagagtaactgctgccaacactcctctgcactaggcctggctcgctgtaccagcatggcttcagagaattctgagtgctctgttaagacgctctatggaatctactacaaatgcccctgcgaaagggggttaacctgcgaaggggataagaccatcgtcggatcgataacaaataccaacttcggcatctgccatgacgccggccgtagtaaacagtag

SEQ ID NO: 112666 - DNA, 216 bp, Artificial Sequence
  Description of Artificial Sequence: Synthetic coding sequence
atggaaaagatcctgatcctgttactcgttgctttgtcagtggcttacgcggcccctggccctcgtggcataattattaatttgacactatacggaatctattacaagtgcccctgcgagcgtggtttaacatgtgagggcgacaaaaccattgtggggagcataactaataccaatttcggtatatgccacgatgcagggcgctcaaaacagtag

SEQ ID NO: 112667 - DNA, 408 bp, Artificial Sequence
  Description of Artificial Sequence: Synthetic coding sequence
atgcaactgacttgggcttcaatcagcttggtcacacgctgctggcctcagacaccgaccttccaagacctgctcgcgtgtcttggtgcgcgcgctcttcccgggccccccggtgccccagggagggatgggtctaaaggggagcggggcgcccccggccctcgcggatccccggggcccccggggtccttcgactttttgctactgatgttagcggatatcagaaacgatatcacagagctccaggagaaggtgtttgggcaccgcacccattcctcagccgaggaattcccactccctcaggaatttcccagttaccctgaggctatggatctgggttctggcgacgatcacccccgacggaccgaaacacgcgacttgcgcgccccacgtgatttctacccctag

SEQ ID NO: 112668 - DNA, 1221 bp, Artificial Sequence
  Description of Artificial Sequence: Synthetic coding sequence
atggtcccacctcccccttcacgcggaggagccgcccgggggcagctgggacggtccctggggccccttctcttactgctcgcactgggccacacatggacctaccgcgaagaaccagaagacggagatagagaaatatgcagtgagtcaaaaatcgccacaacaaagtacccttgcctcaagagttcaggagaattgaccacctgctatcggaaaaagtgttgtaaaggctataaattcgtactgggacagtgcatacccgaagactacgacgtctgtgcagaagccccatgtgagcagcaatgcactgataatttcggccgtgttctttgcacatgttatccaggatatcgttatgaccgagaacgccatcggaagagagagaaaccttactgcctcgatattgacgaatgcgccagttctaatgggactctttgtgctcatatatgtatcaacacacttgggtcttatcggtgtgagtgtcgagaggggtacattcgagaggatgacgggaaaacgtgcacgcggggagataagtatcccaatgataccgggcatgagaagtccgaaaatatggttaaagctgggacctgctgcgctacttgtaaggaattttatcagatgaagcaaacagtcctccagctgaagcagaagattgcactcttgccaaacaacgcagcggacctcggaaagtatatcaccggggataaggtcctggcgtcaaacacatatttgcccggcccaccaggactccccggcggacagggtccccccggcagtcccggacccaaaggctctccaggttttccaggcatgccaggccctccagggcaaccagggcccaggggaagcatgggtcccatgggcccgtcccccgatctgagccacattaagcaaggtcgcagggggcccgttggcccccctggagcccctgggcgtgacgggtctaagggcgaacgcggggccccaggtccacgcgggtcccctggaccgcccggatcatttgactttttgcttctcatgctcgctgacatccggaatgacattacagaattgcaggaaaaggtgttcggacaccggactcacagctccgcggaagagtttcctttaccacaggaattcccaagctacccagaagccatggacttgggttcaggcgatgaccacccacggcgaactgagactcgggatttaagagctccacgggatttttacccctag

SEQ ID NO: 112669 - DNA, 699 bp, Artificial Sequence
  Description of Artificial Sequence: Synthetic coding sequence
atgtggccaccaggacgcagtatcacagtgaagctcagagagaagaccgtgtcacgcaagctggaaatgaacgggccctccgcgttccaggggctaatatgtggcaagtataacgggatgtgtctgcagggccccgctggtgtgcctggccgtgatgggagtcctggcgctaacggtatccccgggactcccggaatccctggccgagatggcttcaagggcgaaaaaggagagtgtttacgagaatccttcgaggaatcctggacgccgaattacaagcagtgctcatggagctctttgaattatggaatcgatctggggaaaattgctgagtgcactttcaccaagatgaggtccaatagcgctctgcgcgtgctgtttagcggcagcctcaggctgaagtgccggaacgcttgctgccagagatggtatttcacctttaatggcgccgaatgctcaggtcctctgccaatcgaggcaattatctacttagaccaggggtcccctgagatgaattctaccattaatatccaccgaacctcttctgttgaggggctgtgcgaaggaataggagcgggcctcgtggatgtggccatctgggtcggcacatgttccgactatccaaaaggtgatgccagcaccggctggaattcagtttcgcgcatcattatcgaggaattacccaactatctcttctag

SEQ ID NO: 112670 - DNA, 732 bp, Artificial Sequence
  Description of Artificial Sequence: Synthetic coding sequence
atgagaccccagggtccagccgcttctcctcagaggctccggggccttcttcttctgctattactacaactgccagccccctcttcagcatctgagatccctaagggaaaacaaaaggcccaactaaggcagcgagaagtggtggacctgtacaatggcatgtgtctacaggggcccgccggtgttcccggtcgggatgggtcacccggtgctaatggtataccgggaactcctggaattcctggtagggatggtttcaaaggggagaagggggagtgtttgagggagtcctttgaagagtcctggacccctaactacaagcagtgctcctggtccagcctgaactatggtattgatctaggcaaaatcgccgaatgtacttttaccaagatgcgcagcaactctgcactacgggtcctgttctctgggtctttgcggctcaagtgcagaaatgcatgctgtcagcggtggtacttcacgtttaatggcgcagaatgttccggacctctcccgattgaggcaattatttatctggaccaagggtccccggaaatgaactccactataaatattcaccgcacgagttccgtcgagggactgtgcgagggtatcggagccggcctggtcgatgttgcaatttgggtggggacttgttccgattacccaaagggtgatgcatccactggctggaattccgtgagccgtataataattgaagagcttcccaagtag

SEQ ID NO: 112671 - DNA, 690 bp, Artificial Sequence
  Description of Artificial Sequence: Synthetic coding sequence
atgtggccaccaggccgatccataacggtcaaattgagagaaaaaacagtgagccgaaaactggagatgaatggcccatctgcattccagggacttatatgtgggaaatacaacggtatgtgcctgcagggtcccgcaggagtccccggccgggatgggtcacccggtgccaacggaatcccagggactccaggcatcccagggagagatgggttcaagggcgagaagggggaatgcctgagagagtcctttgaagaatcttggacccccaattataagcagtgttcttggagcagcctcaattatggaatcgacctgggcaaaattgccgagtgtaccttcactaaaatgcgaagcaatagtgctctgagagtgttgttttccggctccttgcgcctgaaatgtcgcaatgcttgctgccagcgatggtatttcacttttaatggcgcagagtgctccggccccctccctatcgaagcgattatatacttggaccagggaagtccagaaatgaattctaccatcaacatccatcgtacttcaagcgtggagggactgtgtgagggaatcggagccggcctggtagacgttgccatatgggttggcacctgtagtgattatccaaaaggcgacgctagtaccggctggaactcagtgagtaggattatcatcgaggagttgccaaagtag

SEQ ID NO: 112672 - DNA, 5037 bp, Artificial Sequence
  Description of Artificial Sequence: Synthetic coding sequence
atgcacccgggactttggctactgctggtgactctgtgtctaacagaagagctggccgctgctggggagaagtcctatggtaagccttgtggcggccaggattgctctggaagctgccagtgtttccctgagaaaggagcacgaggaagacccggccccataggtatacagggccccacgggtccgcaaggctttaccggcagcaccgggctgagcgggctgaaaggcgagcggggatttccaggtctattgggcccttacgggccaaagggtgataagggacccatgggagttcccgggttcctcgggataaacggaattcccggtcatcctggacagcctgggcccagaggtccacctggcttagacggttgcaacggtacccagggcgccgttggatttcctgggccagatggatatccggggctgctaggcccccccggactgcccggacagaagggatccaagggagatcccgttctggcacctggtagctttaaagggatgaaaggcgacccggggctgccaggtctcgacggtattaccggacctcagggagcacctggcttcccaggcgcagtcggtcccgccggccctccagggcttcaaggtccacctggacccccaggcccactcggcccagacgggaacatgggacttggcttccagggtgaaaagggagtgaaaggggatgtgggcctgccaggtccggccgggccaccacccagcacgggtgaattagaatttatgggattccccaagggcaaaaaggggtctaaaggggaaccgggaccaaaaggttttcctgggatttctggacctcctggcttccccggcctgggcaccaccggcgaaaagggggagaaaggagagaagggaatacctgggctcccaggccccagggggccgatgggatcagagggcgtgcaaggcccaccgggtcagcaaggcaagaagggaacccttgggttccccggactcaatggattccagggaattgaagggcaaaagggtgacattggcctgccggggccagacgtattcattgatatcgacggcgccgtaatctctggcaacccaggcgaccctggcgtccctggcctccctggattgaagggggacgaagggatacagggactgcgcggtccatccggagtgcctggtctgccggccttgtctggcgtgccaggcgccctcgggccccagggattccccggcctcaagggggatcagggaaatcctgggaggaccaccatcggcgccgctgggctacctggccgcgacggactgcccgggccaccaggaccacccgggccacccagccccgagttcgaaactgagacacttcataacaaggagtctggcttccctggacttcgcggggaacagggacccaaaggtaaccttggtctgaagggtatcaaaggcgacagcggattctgcgcttgcgatggtggtgtgcccaatactggacctccaggcgagccaggtccccccggcccgtggggactgatcggcctgccaggcctaaaaggcgccaggggagatagaggttccgggggggcacaggggcccgcgggtgcaccagggctggtgggcccactcggcccgtctggcccaaagggaaaaaaaggagagccaatactgagcaccattcagggcatgccaggcgacaggggagactcaggaagccagggattccggggagtgattggggagccagggaaagacggtgtgcccgggctgcctggattgccaggactccccggcgatggtgggcagggattcccaggggaaaaaggtctgcccgggctgcccggcgaaaaaggccatccaggacctcccggcttaccgggcaacggtttgcccggcctgccaggacctcgaggacttcctggcgacaaggggaaagatggccttccaggccaacaggggctgccgggaagcaaaggcataacactgccatgcatcattccggggtcatatgggccctcggggtttcctggaactccaggcttccccggacccaaaggatccaggggtttgccaggcaccccaggccagcctggcagcagtgggtccaagggcgagcccggatcacccgggctggtccatctccccgagctgcccggttttcctggaccgaggggtgagaaaggcctgcctgggttcccaggcctccccgggaaagacgggctgcctgggatgatcggcagccctgggctgcccgggagtaagggtgccactggagacatcttcggagccgagaatggcgcacctggtgagcagggacttcaggggcttaccggccacaagggcttcctcggagactcggggctgccgggcctgaaaggggtgcacgggaaaccaggtctgttgggccccaaaggagagagaggctccccgggcacccctggacaggtcggtcaaccagggactcctggctcctcaggaccatatgggattaagggcaaaagtggcctccctggagcccctggtttccctggaatctcaggccacccaggaaaaaagggaactcgcggcaagaagggccctcccgggtccattgtcaagaaagggctgccgggactgaagggcctccccggaaatcccggtttagtgggactgaagggaagccctgggagcccaggagtggcaggactgccagcactgagtggcccaaagggcgaaaagggatctgtgggctttgtcggcttccctggaattcctggccttccaggcatcccaggcaccagggggctgaagggaattccgggaagcacaggaaagatgggcccttcaggaagagcggggacccctggggaaaaaggagaccgcggtaacccaggtccagtcggtatccccagtccacggagaccgatgagtaacctgtggttgaagggcgacaaaggatcgcaggggtctgctggaagcaacggtttcccaggtcccaggggagataaaggcgaagccggccgacccggccccccaggactgccgggagcaccaggcctgcccggtataattaagggagtgtctgggaaaccaggcccaccagggttcatgggcattcggggcctccctggtctcaagggatcgtcgggaattactggattccccggcatgccaggcgagagcggaagccagggcatcagaggttcccccgggttgccgggcgcatcaggtctgcccggcttaaagggagataatggacaaaccgtagagatcagtggcagcccaggacccaagggccagcccggagaatcggggttcaagggtactaagggacgggacggactgattgggaatattggattccccggtaacaagggagaggatgggaaagtcggtgtgagtggagacgtgggcctgcccggggcccccggcttccctggagtggctggtatgaggggagaaccagggctcccgggatcctcgggccaccagggggccataggtcctctcgggagcccaggactcatcgggcccaagggcttcccaggcttccctggactccatggcttgaacggcctgccggggacaaaaggaacacacggcacacctggtcctagtataacaggtgttcctggacccgctgggctgcccggacccaaaggagaaaaaggatatccaggcatcggcatcggtgcaccgggtaaacctggccttcgcggccaaaagggagatcggggcttccctgggctccaaggccccgctggtctaccaggcgccccagggatcagtttgccttcactcatcgcagggcagcccggcgacccaggccggcccgggctggatggtgagagaggtcgtcctggcccagccgggccccccgggccgcccggtccttccagcaatcagggcgatacaggcgatcccggcttcccaggaattccaggattctcagggctgcccggcgagctagggctcaaaggtatgcggggggagcccggatttatgggaacgccaggtaaagtaggcccaccaggtgacccagggttccccgggatgaaggggaaggccgggccccggggaagttctggcttgcagggcgaccccggtcagacgcccacagctgaagccgtacaggtgccaccaggcccattgggcctgcccggcattgatggaatccccggactgaccggcgatcctggagcgcaggggcctgtggggctccaggggtctaaggggttgcctgggatacccggaaaagacgggccctctggccttcccggccccccaggcgctctgggtgacccaggcctgcccggacttcagggcccgccaggttttgagggagcccccgggcagcagggaccttttgggatgccaggcatgcccgggcaaagtatgagggtcggttacaccctcgtgaaacactcacaaagcgaacaggtccctccatgccccatcgggatgtctcagctgtgggtgggttactccctgctcttcgtcgaaggacaggaaaaagctcacaatcaggatcttgggttcgccggatcctgcttaccacgcttttctacaatgcccttcatttattgtaacattaacgaggtgtgccactacgctagacgcaatgataagtcctactggctgtccaccaccgctccaatacccatgatgccagtttcccagacacaaattccacagtatatttccaggtgttctgtttgtgaggctccttctcaggccattgccgtgcacagccaggatatcacgattcctcaatgccccctgggttggagatcattgtggattggttattcctttttaatgcatactgctgccggtgccgaaggagggggccaatccctcgtgtcccccggaagctgtttggaggactttcgcgctaccccattcattgagtgtagtggtgctcgcggaacttgccattattttgccaacaaatactctttttggctcaccactgttgaggaaagacagcaatttggggagctccccgtctcagagactcttaaggcaggacaactccacacacgggtgagtcggtgccaggtgtgcatgaaatcattgtag

SEQ ID NO: 112673 - DNA, 3087 bp, Artificial Sequence
  Description of Artificial Sequence: Synthetic coding sequence
atgagagcggcgagagccctcctcccactgttactccaagcttgctggactgctgcccaggacgaacccgaaacaccaagggccgttgcattccaggattgccccgtggatctcttttttgtattggacacctccgaatccgttgcccttcgtttgaagccatatggtgcactggttgataaggtgaaatcctttacgaaacgctttatcgataacctgcgcgatcggtactacagatgcgatcgaaacttggtgtggaatgcaggggccctgcattactccgatgaggttgagatcatacaggggcttacacggatgcctggggggcgcgatgcattgaaaagttcggtggacgcagtgaagtactttggcaaaggcacatataccgactgcgctatcaagaaagggctggagcagttattggtgggggggagtcacctgaaagagaacaagtacctgatcgtggtgacagacggccatcccctggagggatacaaggaaccttgtggcggactcgaagatgccgtgaacgaagcgaaacacctgggggtgaaggtgttctctgttgccataacacccgaccaccttgaacctaggctctcaatcatcgcaacagaccacacctatcgaaggaacttcacggcggccgattggggacagtctcgggatgcggaggaggcaatcagccagaccattgataccatcgttgacatgattaagaacaacgttgagcaggtctgttgttccttcgaatgccagcccgcaaggggaccccctggattacgtggagacccaggcttcgagggagagcgtggcaaacccggcctccccggcgaaaagggagaggctggggaccccgggcggccaggagatctggggccggtgggctatcagggaatgaagggtgaaaaggggagccgaggagagaaaggaagtaggggcccaaaggggtacaagggcgagaaaggcaaaagagggattgatggcgtcgacggcgtcaagggtgaaatggggtaccccggcctgcccggatgcaagggctccccaggatttgatggcattcagggccccccgggcccaaaaggggaccctggggcattcggattgaagggtgagaagggcgagccaggagccgacggcgaggctgggagacctgggagcagtgggcctagtggagatgaaggtcagcccggcgagccgggccctccaggggagaagggcgaagcaggcgatgagggcaatccaggtccggacggagcccctggcgagaggggtggccctggggaaaggggccctagaggaaccccgggaacccgggggccccgcggggaccccggggaggccggccctcaaggagatcagggacgcgagggccctgtgggagttcctggtgatccgggagaggcaggtcctattggccccaaggggtacaggggcgatgagggccctcctggaagcgagggagcccggggagcacctggacccgctggcccacccggggaccctggactgatgggagagaggggcgaagacgggccagcaggtaacggaacagaaggattcccaggattccccggataccctggcaatcgcggggcccctggaatcaatggaacgaagggctatccaggcctgaagggagatgagggcgaggctggggaccccggcgatgataacaatgacatcgcgcctcgcggagttaaaggcgcaaaaggttatcggggccctgaaggccctcagggcccccctgggcaccaaggacctcccggccccgatgaatgcgagatcctggatattattatgaaaatgtgctcatgttgcgaatgtaagtgcgggcccatcgacttattatttgttctggactctagtgagtcaatcggtctgcagaactttgaaatagctaaagatttcgtcgttaaggtgatcgaccgcttgagcagggacgaactggtcaagtttgaaccaggtcaatcctacgccggggtcgtccagtactcccattcacagatgcaagaacatgtgagcttgagaagtccatccatccgtaacgtgcaggagctgaaggaagccattaagagtctgcagtggatggctggcgggacctttaccggggaagcccttcagtacacccgggatcagctcctgccaccaagccctaacaacaggatagctttggtcattaccgacggccgatccgatacccagagagacacaaccccactcaatgtgctttgttctccggggattcaggtggtgtccgtgggaattaaggacgtctttgacttcatcccggggagcgatcagctgaatgtcatatcgtgtcagggcctcgctccatcacaggggagacctggcctgtccctggtaaaggaaaattatgcagaactgctggaagacgcattcctcaagaacgtcactgctcaaatatgcatagataagaaatgtcccgactatacgtgccccataacttttagctctccagcggatatcacaatcctactggacggctctgccagcgtgggctcgcacaacttcgataccactaagcgattcgctaaacggctcgccgagcgatttttaaccgcgggacgcaccgatcctgcacatgatgttagagtcgcagtggtgcaatattccggtactggccaacagagaccagagcgagcctccctgcagtttcttcagaattataccgcgctcgccagtgccgtggacgctatggacttcatcaacgatgccactgacgttaacgatgctctggggtatgtgacaaggttctaccgcgaggcctctagcggcgcagcgaagaagcgtctgctgctgttctctgatggcaactcgcagggggccacgcctgccgcaatagaaaaggcggtccaagaggctcagagagctgggatcgagatatttgtggttgtggtgggtcggcaggttaatgaaccccacatcagggtactcgtgacggggaagaccgccgagtatgatgtggcgtatggagaaagccacctctttcgggtcccttcataccaagctctgctgcgaggggtgtttcaccagactgtgtccagaaaggtggccctgggttag

SEQ ID NO: 112674 - DNA, 1770 bp, Artificial Sequence
  Description of Artificial Sequence: Synthetic coding sequence
atgagagctgccagggcactgctccctcttctcctgcaggcttgttggacagcggcacaagatgaaccggaaaccccgcgggctgtcgccttccaggattgccctgtggacctgtttttcgtcctggatacgtctgaatccgtggccctgagattgaagccttacggcgctctagtagacaaggtcaaatccttcaccaaacgtttcatagataatttgagagatcgatactaccgatgcgatcggaacctggtctggaacgctggcgctctgcactactccgatgaggtcgaaattatccagggtctgacacgaatgcctggcgggagagacgccctgaaaagttcagtcgacgccgtaaagtatttcggaaaaggtacttataccgactgtgctataaagaagggtcttgaacagcttctggtgggaggctctcacctgaaagaaaacaaatatttaatcgtggtgacagatggtcaccctttggagggatacaaggaaccatgtggcgggttagaagatgccgtcaatgaagccaaacatctgggggttaaggtgttctcggtcgccattactccagaccatctcgaacctcggctttcaatcattgctacagatcacacatacaggcggaactttaccgctgctgattggggccagtctagagacgccgaggaggccatctcccagaccattgataccatcgttgacatgatcaagaataatgtggaacaggtatgttgttcatttgaatgccagcccgcccgcggaccaccaggccttagaggggatcccgggtttgaaggggagagaggcaagcctggcctcccaggggagaagggggaggccggcgaccctggacgacctggcgacctggggccagtgggctatcagggtatgaaaggcgaaaaaggcagtcggggagagaagggcagtcgcggccctaaggggtataagggcgaaaaagggaagcgcggaattgacggtgtggatggggtcaagggtgaaatgggataccccggcctccctggctgtaagggcagccccggctttgatggcatccagggaccacccgggcctaagggagatcctggggcttttggcctgaagggcgaaaagggagaaccgggggcggatggggaagcaggtagaccagggagttctggcccttccggggatgaaggccaacccggagaacccgggcctcctggggagaaaggcgaggcgggggatgaaggtaatccaggtccggacggagctcccggtgaaagaggggggcctggcgagaggggtccgcgaggaactcctggcacccgtgggcctcgcggggatcccggcgaggcaggacctcaaggcgaccaaggacgggagggaccggtcggggtgccgggtgatcccggggaagccggacccattggcccgaaggggtacagaggagacgagggaccacctggctcagaaggagctcggggcgccccagggcccgcgggacccccgggagatcccggactaatgggcgaacggggcgaggacggtccggcaggcaatggtaccgagggctttcctggctttccaggatatcccgggaatcgtggcgcaccagggatcaacggtaccaagggctacccagggctgaagggcgacgagggagaggccggcgatcccggcgacgacaataatgatatcgccccgaggctgctgcgtgtgcttctggtgaccgggttggacctcggtcccacagccctggaggccgctgccgaccagcactag

SEQ ID NO: 112675 - DNA, 324 bp, Artificial Sequence
  Description of Artificial Sequence: Synthetic coding sequence
atgcgcgcggcccgagcattactgcctctcctgttacaggcgtgctggactgctgcacaggacgagccagaaacacctagggccgtggcatttcaggactgccctgtagacctgttctttgtgctagatacttctgaatcagtggctctgcgtctgaagccatatggggcattggtcgacaaagttaagagttttaccaaacgctttattgacaatttgcgagaccgatactatagatgtgatagaaacttagtgtggaacgccggcgctctccattactctgacgaggtagaaatcatccagggcctgaccaggatgccatag

SEQ ID NO: 112676 - DNA, 3060 bp, Artificial Sequence
  Description of Artificial Sequence: Synthetic coding sequence
atgttgcagggcacatgtagtgtactgcttttgtggggtattctgggagcaatccaggcccagcagcaggaggttatctcgccggataccacagaaagaaataataattgtccggagaaaactgattgcccaatacacgtctattttgtactggacacctctgagagtgtgacaatgcaaagccccacagacatcctactcttccacatgaaacagttcgtccctcagtttataagtcagctacagaacgaattttatttggatcaagtagccttgtcgtggcgatacggcggactacacttctctgaccaagttgaagtgtttagtccaccaggctctgatcgtgcgtccttcatcaaaaatctgcaggggatttctagcttccggcgcggtacatttacggactgcgctctggcaaatatgactgagcagatacgccaggataggagcaaggggacagtgcattttgccgtggttataactgacgggcacgtcaccggatctccctgtggcgggatcaagctgcaggccgaaagagcacgtgaagaggggatccgcttattcgcagtggcacccaatcaaaacctgaaagagcagggtctgagagacatcgccagcaccccacacgagctgtatcgaaatgactatgcgacaatgcttccagactcgactgagattgatcaggatacaatcaacaggatcatcaaagtcatgaagcacgaggcttatggcgagtgttacaaagtttcctgcctggaaatacctggtccctctggccctaagggatatcgaggacaaaagggggccaaggggaatatgggtgagccgggtgagccagggcagaaaggaagacaaggcgatccgggcattgaaggcccaattgggtttcccggcccaaagggtgtaccgggtttcaagggcgagaagggcgaattcggtgcggatgggcggaagggtgctcctggactggccgggaaaaacggcacagacggccagaaaggaaaactcggaagaatcggtccacccggatgtaagggagatcccggtaacagggggcccgatggttaccctggcgaggcagggtctccaggggaacgcggggaccagggcgggaagggcgatcctgggaggcccggccgtcgtgggccaccgggggagattggagcaaaaggtagcaaagggtaccagggaaattccggagccccgggaagtccaggcgttaaaggcgctaagggtggccccggaccccgtggccctaagggagagccaggcaggagaggtgatccgggcaccaagggaagccccgggtcggatggccctaagggggagaaaggcgatcccggccccgaagggcctaggggtttagcaggagaagtcggcaacaagggtgccaaaggagacagaggcctcccaggtccccgtggacctcagggggccctgggagaacctggcaaacaaggctcaaggggtgatccaggggatgcgggaccaaggggagatagcgggcagcctgggccaaagggggacccaggcaggcctggtttctcctaccctggacctagaggggcccccggggaaaagggagagcctgggccacgtggccccgaaggtggccggggtgattttggtctgaaaggggaacccgggagaaaaggggagaagggagagccagccgatccaggaccccccggggagcccggcccaaggggccctcgcggcgtccccggccctgaaggcgaacctgggcctcccggtgaccctggacttacagaatgtgacgttatgacgtatgttagggaaacttgtggctgttgcgattgtgagaaaaggtgtggggccttggacgtggtttttgtgatcgactcctcagagagcatcggttacacaaatttcactctggagaagaacttcgtcattaatgttgtaaatagactcggggcaattgccaaggatccaaagtcagagactggtaccagagtcggagtggtgcagtatagtcacgaaggtactttcgaggctatccagctggatgacgaaaggattgactctctctcctccttcaaagaggccgttaagaatttggagtggattgcggggggcacttggacccctagtgctcttaagttcgcttacgaccgcttgatcaaggaatcccgtaggcagaagacccgcgtgttcgccgtggtgatcacggacggacggcatgacccgagagacgatgatctcaacctcagggcgctgtgcgaccgagacgtcactgtaacagccatcggaatcggcgatatgttccacgagaaacacgagagcgagaatctgtacagcattgcgtgtgacaaacctcagcaggtgaggaacatgacactgttctcagacctggtggcagagaagttcatcgacgatatggaggatgtgttgtgccccgacccccagatcgtgtgtccagatctgccttgccagacggagctttccgtggcacaatgcacccaacgcccagtcgatatagttttcctgctcgatggaagtgagaggttaggggagcaaaattttcacaaggcccgcaggttcgtagaacaagtggccagaagactgacgctggcacgcagagacgacgatcccctcaatgccagggtcgcccttctgcaatttgggggacccggtgagcagcaggtggccttcccactcagccacaatcttacggcaattcacgaagcactggagaccacccaatacctgaacagctttagtcatgttggcgcaggtgtcgtacacgcgattaatgcaatcgttcgttcacccaggggcggggcgcggcggcacgcagaactgagcttcgtgttcctgactgatggcgtcacaggtaatgattctctgcatgagtcagcccattctatgcgtaagcaaaacgttgttcccaccgttctggctctgggctcggatgtggatatggacgtcctgactaccctgtctcttggtgaccgggccgctgtgttccacgaaaaggactacgacagtctcgcccagcctggcttttttgacaggttcatacgctggatctgttag

SEQ ID NO: 112677 - DNA, 2487 bp, Artificial Sequence
  Description of Artificial Sequence: Synthetic coding sequence
atgctgcaagggacctgttcagtgctgctactctggggcatactgggggccattcaggcccaacaacaagaagtaatctccccggatacaaccgagcggaacaacaactgcccagaaaaaaccgactgcccgattcacgtctactttgtgcttgacacaagtgagtccgtcaccatgcaatctccgactgatattctcctttttcatatgaagcaattcgtcccacagtttatctcacaactccagaacgaattctatctagaccaggtcgctcttagttggcgatacggcggcctgcactttagtgaccaggttgaggtgttttcccctcctggttctgatagagccagcttcattaaaaaccttcagggaatcagttcttttcggcggggtacttttacagattgtgccctggccaatatgaccgagcagatacggcaagatcgctcgaaagggacagttcactttgcagtggtcataacagatgggcatgttaccggctcgccttgcggaggaatcaagcttcaggccgagcgggccagggaagagggcataagactattcgccgtcgccccaaatcagaacctgaaagagcaagggctcagggatatcgcatcaactcctcatgaactgtaccgcaatgattacgcaacaatgctgcccgattcaacggagatcgaccaggataccattaacagaataatcaaggttatgaagcacgaagcctatggggagtgctataaggtctcgtgcctcgagataccaggcccaagtggccctaagggctataggggccaaaaaggcgcgaagggcaacatgggggaacctggtgagcccggccaaaaaggaaggcagggggatcctggaattgaggggccaatagggttccctggccctaagggagtgcccgggttcaagggagagaagggagagttcggcgctgatggtcgtaaaggtgcgcctggcctagccggtaagaatggaaccgacggccagaaggggaagctgggcaggattggcccccccggctgcaaaggagaccctggaaaccgggggccagatgggtaccctggcgaggccggttcccctggggaaagaggtgaccaggggggcaaaggggaccctggccggccaggccggcggggtccacccggcgaaatcggcgcgaaggggtccaaagggtatcagggcaactctggggcacctggatctccaggtgttaagggagcgaagggaggtccaggtccgcgcggccctaagggggagcccggcaggaggggcgatcccggaactaagggttcaccagggtccgacggaccaaagggagagaaaggcgaccccggaccggagggcccccggggcttagccggggaagttggcaacaaaggtgccaagggcgatagagggctgccgggaccgcgcggccctcaaggcgctcttggggaacccggtaagcaggggagtcggggggaccctggggatgcggggccccggggcgactcaggacagcctggccctaaaggcgatcccggtcgtcctggtttttcatatccaggtccgcgtggagcccctggcgaaaagggcgaaccgggccccagaggccccgaggggggccggggggattttggcttaaagggtgagccgggaaggaagggggagaaaggggagccagcagatcccggcccgcccggtgagcctggaccaaggggtcctaggggtgtgcccgggcctgaaggagaacccggtcctcccggcgatcccggattaactgagtgcgacgtgatgacctatgtcagggagacttgtggatgctgcgactgtgaaaagagatgtggagcactagacgtagtgtttgtgatagattcttcagaaagcattggttatactaacttcacgctcgaaaagaattttgtcattaacgtcgtcaatcgccttggagcaatcgctaaggaccccaaatccgaaacagggacacgggtaggcgtggtgcagtattcgcacgagggcacattcgaagccattcagttagatgatgagcgaatcgacagcctgagtagtttcaaggaagccgtgaagaacctggaatggatcgccggcggcacgtggacaccgtctgcactgaaattcgcctacgaccggctcatcaaggaatcaaggaggcagaagaccagagtgttcgctgtggtgattaccgacggcagacacgaccccagagatgacgacttaaacttgagagccctgtgcgatcgcgatgtgaccgttaccgccataggcattggagatatgttccatgagaagcatgagtcggagaacctctattctattgcctgtgataagccacagcaagtccgtaacatgacattattctcagatcttgtggcagagaagtttatcgatgatatggaagacgttttgtgcccagaccctcagatcgtctgtccagacctgccttgtcaaacagggttggacggcgcagtactgtgttag

SEQ ID NO: 112678 - DNA, 2757 bp, Artificial Sequence
  Description of Artificial Sequence: Synthetic coding sequence
atgctccaaggcacctgtagtgtgctgctgttgtggggtattcttggagccatccaggcgcagcagcaggaagttatatcccctgataccacagagcgcaataataactgtcctgaaaaaaccgactgtcccatacacgtctattttgttcttgacacaagcgaatctgtgactatgcagtcccccactgacatcctcctgttccacatgaagcaattcgttccccagtttatctcacagctgcaaaacgaattttatctcgatcaggtggcccttagttggagatacggaggcttgcatttcagcgatcaggtggaagtgttctcccctccaggaagcgacagggctagctttataaaaaatttgcagggaatctcctccttcagacgaggcacattcaccgactgcgccttagccaacatgaccgaacagatcagacaagaccgcagcaagggtaccgtgcacttcgccgtggtgataaccgatggacacgtcactggctctccttgcgggggcatcaaactgcaagctgaacgagcccgggaagaagggattagactgttcgcggttgcacctaaccagaatctcaaagaacaaggattgcgagatatcgcctccacacctcacgaactgtaccgcaacgattatgcgacaatgttgccagactccacagaaattgatcaggatactatcaaccggataatcaaagttatgaagcatgaagcatacggggagtgttacaaagtctcctgcctagaaatccccggtccatcaggtccaaagggctacaggggccaaaaaggagccaagggtaacatgggagaacccggcgagccaggccagaaaggtcggcagggagaccccggaatcgaagggcccatcggcttccccgggccgaagggagttccaggttttaaaggagaaaagggggagttcggagctgacggtcgaaagggcgcccctggactggccggaaaaaacgggaccgatgggcagaaggggaaactgggccggatcggcccaccaggctgcaagggggatcccggtaacagaggccctgacggctatcccggcgaagccggatcacctggcgaacgaggagaccagggggggaaaggggacccaggtcggcccggaagacgcggtccaccaggcgagattggggccaaagggtccaagggttatcagggaaactccggcgctccaggctcccccggggtaaaaggggccaaagggggtcccggtccacgcggtcctaaaggagagccaggccggaggggcgaccccgggactaagggttcccccgggtccgatggacccaagggagaaaaaggtgacccagggcccgaaggccccagagggcttgccggggaggtgggtaataagggcgccaagggcgataggggtctgcctggaccccggggaccccagggggccttgggcgagccaggcaagcaagggtccagaggcgaccccggtgacgcaggccccagaggagactctggacagcctgggcccaagggcgaccccggtcggccaggattcagctaccccggtcctcgcggggccccaggagaaaaaggcgaaccagggcctcgagggcccgaaggagggcgaggtgattttggcctgaaaggagaaccagggcgcaaaggagaaaagggggagcctgctgatcccggaccccccggggagcccggaccaagaggacccaggggcgttcctgggcccgagggagagcccggacccccgggcgaccccggcttgactgaatgtgacgtgatgacctatgttcgcgagacgtgtgggtgctgcgactgcgaaaaaaggtgtggcgcacttgacgtggtgtttgtgatcgatagctctgaaagcattggttataccaattttacgttagaaaagaactttgtgataaatgtcgtgaatcgtctgggcgccatcgctaaggatccaaagagcgagaccggtacccgggtcggggttgtgcagtactcacatgagggaacctttgaagctattcagctcgacgacgagcggatcgactcactgagtagcttcaaggaggctgtaaaaaacctggaatggatcgccggaggaacctggacaccatccgctctaaagtttgcgtatgaccgacttataaaagagagcagacgacagaaaacccgtgtgttcgcagtggtcataacagatgggaggcacgaccctcgggatgatgatcttaatctccgagccttatgtgatagggacgttacggtcacggctattggcatcggagatatgttccatgaaaagcacgagagtgaaaacctatacagcatagcatgtgacaaaccccaacaggtgcgcaacatgacgctcttttctgacctggtggcagaaaagttcatagacgatatggaggatgttctgtgccccgatccgcaaattgtatgtcctgacctgccatgccagacggacgccccttggcccggaggtgagcctccagttactttccttagaacagaagagggacctgatgctacatttcccagaacaattcctttaattcagcagcttttgaacgcaaccgaactgacacaagatcccgcagcttactcacagctggtggcagtcttggtttatacagccgagcgcgcgaaattcgcaaccggagtggagaggcaggattggatggaactattcatagacacttttaaattagtgcatcgggatatagttggtgatcccgagacagctctcgctctgtgctag

SEQ ID NO: 112679 - DNA, 2757 bp, Artificial Sequence
  Description of Artificial Sequence: Synthetic coding sequence
atgctgcagggtacctgtagcgtgctcctgctttggggcattctcggggccattcaggcacagcagcaggaggtgatctctcctgataccaccgaaaggaataacaactgccctgaaaagacggactgtcctatacacgtgtattttgtactcgacaccagtgaaagtgtcactatgcaaagtccgactgatatcctccttttccacatgaagcagtttgtgccacaattcattagccaattgcaaaacgagttctatctggaccaggttgctctctcatggcggtacgggggcttacatttttcagaccaggtcgaggtgtttagccctccagggagcgatagggcttccttcattaagaatctgcagggaatctcatcattccggagaggaaccttcacggattgcgcgctcgccaacatgaccgagcagattcgacaggacaggtcaaaggggacggtgcacttcgccgtagtgataacagacggccacgtgaccggctctccctgcggcggcataaagctgcaggctgaacgggcccgagaagaaggaattcgccttttcgccgtggccccaaatcagaacctgaaggagcagggcttaagagacatcgcatcaacaccccatgagctctaccggaatgactacgcaacaatgttgccagacagcaccgaaatcgaccaggataccattaacaggataatcaaggttatgaagcacgaggcctacggggaatgttacaaggtctcctgtttggaaatcccgggcccaagtggccctaagggctaccgggggcaaaaaggtgcaaagggcaacatgggcgaacccggcgagcccggtcagaagggtcgtcagggcgatcctgggatcgagggcccaattggcttcccgggaccaaaaggggtgcccggctttaagggcgagaagggggagtttggagctgatgggcgaaagggcgcccccggattggcaggcaaaaacggtaccgacggtcagaaggggaagctaggcaggattggcccacctggctgcaagggggatccgggaaaccgaggacccgatggctatccgggtgaggccggctctcccggggaaaggggcgaccagggcgggaagggcgatcccggtcggcccggtcggcgtggaccacctggagagattggcgccaagggcagcaaaggttaccaagggaacagtggtgccccagggtcccctggcgtgaaaggagctaagggcggccccggacccagagggcctaagggggaaccaggcagacgaggcgaccctggaaccaaaggatctccggggagcgatgggcccaaaggtgagaagggggatcctggccccgaagggccaaggggactggctggtgaagtgggaaacaaaggcgccaagggcgaccggggcttgccgggaccccgcggaccacaaggagcactaggggagcccgggaagcagggctctagaggggacccaggggatgcagggccacgcggggacagcgggcagccaggacccaaaggagatccagggaggcctggattctcttaccctggacctcggggggctcctggcgagaagggcgaacccggaccacggggtccagagggcggaagaggtgattttggtttaaagggtgagcctgggaggaagggagaaaagggcgaaccagcagaccccgggcccccaggggagccggggccaagaggcccgcgcggtgtcccaggacccgagggcgaacccgggcctcctggcgaccctgggctgactgagtgtgatgtcatgacatacgtgcgagaaacctgcgggtgctgcgactgtgagaagcgatgtggtgcacttgacgtggtgtttgtcattgactcttccgagtccattgggtacacaaacttcacattggagaaaaattttgtcatcaatgtcgtgaatcggcttggcgccatagcaaaagaccccaagtccgaaaccggcactagggtcggtgtcgtgcagtatagtcacgaaggaacctttgaggcaatccaactcgatgatgagcgcattgattccttatctagctttaaagaggccgtgaagaatctggaatggattgctggcggtacatggacccccagcgctctgaagttcgcgtatgaccgcttgatcaaggagagcaggagacaaaaaactcgcgtattcgccgtcgtcatcacggatggtcgacacgacccacgcgacgacgatcttaacctgagagctctttgtgaccgagacgtgacggtgactgctataggcattggagacatgtttcacgagaaacacgagtctgaaaacctgtacagcattgcctgcgacaaaccccagcaggtcagaaacatgacccttttctcggatctcgtagctgagaagttcatcgatgatatggaggacgtcttatgtcccgacccgcagatcgtttgcccagatcttccctgtcaaacagatgccccatggcctggaggagagccaccagtcacatttctgcgaaccgaggaggggccagacgctacattccccagaaccatccctctgatacagcagctgctgaatgctaccgaactgacacaggaccccgctgcctactctcagctagttgccgttctcgtgtatacagcagagcgggccaagtttgctacaggtgtagagcgccaggactggatggaactgttcatcgacacttttaaactggtacatagagatatcgttggggacccggagacagctctggcactgtgctag

SEQ ID NO: 112680 - DNA, 2487 bp, Artificial Sequence
  Description of Artificial Sequence: Synthetic coding sequence
atgttgcaaggaacctgctccgtgctccttctatgggggatcctgggagctattcaggcccagcagcaggaggtcatctcgcccgatacgaccgagaggaacaataactgccccgagaagacagattgtccaatccatgtctacttcgttcttgacacctctgaaagcgtaaccatgcagtctcccactgatattctccttttccatatgaagcaattcgtccctcagttcataagccagttgcaaaatgagttttaccttgaccaggtcgcactatcctggcggtatggtggacttcacttttccgatcaggtggaggtgttcagtcctccaggcagtgaccgtgctagctttataaaaaatctgcagggaatcagcagttttagacgaggcacctttactgactgtgccctcgccaacatgactgaacagattcggcaggacaggtctaagggaaccgtgcacttcgccgtggttattaccgacggccacgttaccggatcaccttgcggcggaattaagctccaggcagaacgcgctagggaggagggtatcaggctgttcgccgtggctccaaaccaaaacctgaaagaacaggggctgcgagatatcgcaagtacaccccacgagctgtatcggaatgactatgctactatgttgcccgacagtaccgaaatcgaccaggatactattaatagaataattaaggtgatgaagcacgaagcctacggtgaatgttataaggtttcttgcctcgaaatcccaggtccgtcaggcccaaaagggtaccgtggccagaagggagcaaaagggaatatgggtgagcccggggagccaggccagaagggtcgccaaggtgaccccggcatcgaaggcccaatcggatttccgggcccaaagggggtgccaggattcaagggcgagaagggggagttcggagcagatggccgaaaaggagctcccgggctggccggcaagaacggtaccgacgggcagaagggtaaactgggccgaattggcccgccaggctgcaagggcgacccgggaaaccgaggtcccgacggttatcccggggaggccgggtccccaggtgagagaggcgaccagggagggaagggagacccagggcgtccaggtcggcgcggacctcctggggaaatcggcgccaagggttcgaaaggataccagggcaatagcggggcccctgggtctcctggagttaagggtgctaaaggcgggcccggaccccggggcccaaagggtgagcccggcaggcgtggtgaccctgggacaaaagggtccccgggctctgatggccctaagggtgagaaaggtgatccaggcccagagggtccaagagggctggctggggaggtggggaacaagggggctaagggtgaccggggcctcccagggccacgcggtccacagggggcattaggcgagcccggcaaacaagggtcccggggcgaccccggggacgccgggcccagaggggatagcgggcagcctggacctaagggcgaccccggtcgacccggcttttcgtatcccgggcctcgcggcgctcccggagagaagggggaaccagggccaaggggccccgaggggggccggggggactttggcttgaaaggcgaacctggcagaaagggtgagaagggcgagccagcagaccccggtcccccaggagaaccgggcccaagaggtccacgcggagtcccaggacccgagggggagcctggcccccccggcgatccagggcttaccgagtgtgacgtcatgacatatgtgagagaaacttgtggttgctgtgactgtgagaaaaggtgtggggcactggatgtggtgttcgtgatagattcatctgagtccatcgggtatacaaacttcacattggagaagaacttcgtaatcaacgtggtcaaccgcctgggagcgattgcaaaggaccccaaaagtgaaacagggacccgggttggcgtggtgcagtactcccatgaggggacttttgaggccattcaacttgacgatgaaaggattgactccctatcgtcttttaaggaggctgtgaagaatctcgagtggatcgccggtggtacctggaccccatccgcactgaagtttgcttacgaccgcttaatcaaagagagtagaagacagaaaacaagagtgtttgcagtcgttattaccgacggcaggcacgacccaagggacgatgacctgaaccttagagctttgtgtgatagggacgtgactgttacagccatcgggatcggagatatgttccatgaaaagcatgagtccgaaaacctctatagcattgcctgcgataaaccacagcaggttcgcaacatgaccctcttcagcgatttagtcgcagagaaatttatagatgatatggaggatgtcctttgtcccgaccctcaaatcgtctgtcctgacttaccttgccagaccggccttgacggtgcagtattgtgctag

SEQ ID NO: 112681 - DNA, 543 bp, Artificial Sequence
  Description of Artificial Sequence: Synthetic coding sequence
atgcttcaggggacatgttccgtgctgctgctctgggggatcttgggagctatccaggcccaacagcaggaggtgatcagccctgataccacagagcgtaataacaattgcccagaaaagacagactgcccgattcatgtgtatttcgtactggacactagtgagtctgtaacaatgcagagtcctactgatatcttactcttccacatgaaacaattcgtgccacagttcatctcccagcttcaaaatgagttctacctggatcaggttgctctgagctggcgctatggtgggctgcacttttcagaccaggtggaagtttttagcccaccagggtccgatagggccagtttcataaagaatctccagggaatatctagcttccgtcgtggcacctttacagactgcgctctcgccaacatgactgaacagatccgacaagatcgctcaaaagggacagttcattttgctgttgtgattacagatgggcacgtgacaggaagcccatgcggaggcatcaaattacaggctgaacgggcatag

SEQ ID NO: 112682 - DNA, 2235 bp, Artificial Sequence
  Description of Artificial Sequence: Synthetic coding sequence
atggccgtgttacctgggccactgcagttactgggggtcttattgacaatcagtctgagttccattcggctcatccaggccggagcctactacgggatcaagcccttgcctccccagatccccccacaaatgccgccacagattccacagtatcagccactggggcagcaggtcccgcacatgcccctcgctaaggacggcttggccatgggtaaggaaatgccacacttgcaatacgggaaggaatatccccacctgcctcagtacatgaaggagatccagccagcccctcggatgggtaaagaggccgtccccaaaaaagggaaggagatccccctagcttctctcagaggggaacaaggcccacgtggcgaacccgggccacggggccccccggggccacctggccttcctgggcacggcattccgggtatcaagggcaagccaggcccgcaggggtaccctggggttggcaaaccagggatgcccgggatgcccgggaaaccaggggcaatgggcatgcccggtgctaaaggagagattgggcagaagggggaaattggcccgatgggtatcccaggaccacaaggcccgcccgggccccatggtctaccaggcatcggaaagccaggcggacccgggcttccgggtcaacccggtccaaagggggatcgcgggccaaaagggttgccaggaccacaaggcctgagaggccctaagggggacaaaggatttggaatgcctggtgcgccaggagtgaagggcccgccaggcatgcatggccccccaggaccagtgggcctcccaggcgtaggcaaacctggggtgacaggttttccaggcccccagggccccctcggcaaaccaggggctcccggcgaacccggaccacagggcccgattggcgtgccaggtgtgcaggggcccccaggcattcccggcattggcaagcctggccaggacggaatccccggccaacctggatttcctggaggtaaaggagaacagggccttccgggtttgccgggaccaccaggtctccctgggatcgggaaaccaggctttcctggccccaagggcgataggggtatgggaggagtgccgggagctctcggaccaaggggcgagaaaggacctataggggctcctggtatcggcgggcctccaggagaacctggacttcctgggattcctggtcctatgggtcctccaggagccatcggatttcccggcccaaagggcgagggtgggatcgtgggaccccagggcccccccgggcccaagggagagccaggactgcaagggtttccaggtaagcctgggtttttgggcgaagtgggtcccccaggtatgagggggctccctggaccgattggccctaaaggagaagccggacaaaagggagtgcccgggctgcctggggttcccggccttctgggccccaaaggcgagccgggcataccaggggaccagggtttgcaggggcccccaggcatacctggaatcggtggcccttcaggccccatcggcccaccaggtatccctgggccaaagggagagcccgggctccctggaccacctgggtttcctggcattggcaaacctggagtagctgggttacacgggccaccaggcaagcccggcgctcttgggcctcaggggcaacccggactcccaggacccccaggaccaccgggaccccccggtccccctgctgtgatgcccccaactccccccccacagggcgaatatctcccagacatggggctgggaattgatggagttaaaccacctcatgcctacggggccaagaaggggaagaatgggggacctgcctacgagatgcctgcatttactgcagaactgactgcccccttccctccagtgggtgcacctgttaagttcaataaactgctttacaatgggcggcagaactataacccccagacagggatatttacatgcgaagtccctggcgtctattattttgcatatcacgttcactgcaagggaggtaacgtatgggtcgccctgttcaaaaacaatgagcccgtaatgtacacttatgatgagtataagaagggctttctcgaccaggcctcaggaagcgcagtgctgcttctcaggcctggggatcgggtttttttgcagatgcccagcgagcaggccgctgggctgtatgccggccagtacgtccactcaagcttcagcgggtatctcctgtacccaatgtag

SEQ ID NO: 112683 - DNA, 2235 bp, Artificial Sequence
  Description of Artificial Sequence: Synthetic coding sequence
atggctgtgctgcccggccctctgcagctgctgggggttttgctaacaatttccctgtcaagtatccgcctcattcaggccggcgcttactacggaattaaacctctccccccccagattccccctcagatgccccctcagatcccacagtatcagccactggggcagcaggtcccccatatgccccttgctaaggacgggctggctatgggcaaagagatgcctcatctacagtacggaaaagaatatcctcacttgccccagtacatgaaggagattcagcccgcaccaaggatgggtaaagaggctgtgcctaaaaaaggtaaggagatccctctcgccagtctaaggggtgagcagggtccacgaggggaacccggtccaaggggacccccaggaccgccagggttgccaggtcacggaatacccggcattaagggaaagcctggaccccagggatacccaggagtcgggaagccagggatgcccggcatgccaggaaagccgggcgccatgggtatgccaggtgcaaagggggaaatcgggcagaaaggcgaaatcggacctatgggaattcccgggccacagggacccccaggcccccacggcttgccaggcattggcaaaccaggcgggcctggcctccctgggcagcccggccccaaaggtgaccggggccccaaaggcctccccggtccacagggtctgagaggaccaaagggagacaagggatttggtatgccaggagcaccaggtgtcaagggcccccctggcatgcatggtccccctggcccagtaggactgcctggcgtagggaaaccaggcgttactggctttcccggccctcagggaccactcgggaagcctggagcccctggtgaacccggcccacaggggcctataggcgtacccggagtgcagggtcccccgggtattcccggcattggcaagcccggtcaggacggcatccccgggcagcctggcttcccaggtgggaagggagagcagggcctgcctgggctccccggacctccgggccttcctggcattggaaaacccggtttcccgggacctaaaggggatagaggaatgggtggtgtgccaggggctctgggtccgaggggtgaaaagggacccatcggagcaccaggcatcggtggacctccaggcgagccaggcttacccggcatcccaggccccatgggccctcctggggctattgggttcccaggacctaagggcgagggaggcattgtcggcccacagggtcccccaggacctaagggagagcctggcctgcagggttttccagggaagccaggattcctgggagaggttggccctcctggcatgcggggcctgcctggccccatcggccctaaaggtgaggccgggcaaaagggggtcccaggactgcccggggtgcctggattgctcggccccaagggcgaacccgggattccaggcgatcagggtcttcagggaccccccggtataccaggtatcggagggccatctggccctatcgggcctcctggcattccggggcccaagggagaaccaggattacccggccctcctggcttcccggggattggcaaaccaggtgtcgccgggctgcacggccctcccggcaagccaggggccctgggcccgcagggacagcctgggctgccagggcccccagggcctccgggcccccccggacctccagcggtgatgccacctactcccccaccccagggagagtacctgcctgacatgggcctgggtattgacggcgtgaagccaccgcacgcctacggggcgaagaagggaaagaacggaggcccagcttatgaaatgcccgcttttaccgctgagttaactgcacccttccccccagtgggtgcccccgtcaagttcaacaagctattgtacaatggccgacagaattataacccacagacggggatcttcacctgcgaggtcccaggagtttattacttcgcctatcacgtccattgcaagggggggaacgtatgggttgctttgttcaaaaataacgaaccagtgatgtatacctatgacgagtataagaaggggttcctggatcaggcttccgggagcgctgtcctcctgctgagacccggcgacagggtgttcttacagatgccttcagagcaggccgctgggctgtatgcaggacaatatgttcactcatctttcagtgggtatctgctttatcctatgtag

SEQ ID NO: 112684 - DNA, 345 bp, Artificial Sequence
  Description of Artificial Sequence: Synthetic coding sequence
atggcggtgttgcccgggcccttgcagctgctgggcgtgttgttgacaataagcctgagcagcattcgcctgatccaggccggagcttactatggcatcaagcccttgccccctcaaattccgcctcaaatgccacctcaaatccctcagtaccaaccactcggtcagcaggttccacatatgcctcttgctaaagacggactggccatggggaaggagatgccacatctgcagtacggcaaggaataccctcacctcccacagtacatgaaagaaattcaacctgctcccagaatggggaaagaggctgttccaaaaaagggcaaagagatccccttagcttag

SEQ ID NO: 112685 - DNA, 2061 bp, Artificial Sequence
  Description of Artificial Sequence: Synthetic coding sequence
atggttgccgagcgcactcacaaagcagctgctaccggtgctcgagggccgggagagttgggagctccaggaactgtcgccttagtcgccgctcgagcagagagaggagcgcgcttaccctctcctgggtcttgcggcctgttgacattggctctttgtagcctcgctttatcgctcctcgcacactttagaaccgccgagctccaggcccgggtgctccggctagaggctgaaagaggcgaacagcagatggaaactgccattctgggtagagtgaatcagctgctggacgaaaagtggaagctgcactcgcgccgacggcgcgaggctccgaagacctcacctggatgtaactgtccgcccggtcctccgggacccactgggcgcccaggcctgcccggtgataagggagctattgggatgcctggtcgcgttggctcccctggcgacgctggcctcagcattataggacccagaggaccaccagggcagcccggcacaaggggttttccagggtttcccggccctatcgggctggatgggaagcctggccatcctggaccaaagggtgacatgggccttaccggcccacccggtcagccagggccacaaggacaaaagggggaaaaagggcagtgtggtgagtatcctcataggcttcttccccttcttaatagtgtacggttggctcctcctcccgtgatcaaacgccggaccttccagggggagcaatcgcaggcttctatccaggggccaccaggtcctcctgggccaccaggtccgtcggggcccctaggtcaccccggactccctggaccaatgggtccacctggactcccaggcccccccgggccgaagggggatccgggcatacagggctatcacggccgcaagggcgagaggggcatgcctgggatgcccggaaagcacggtgcaaaaggtgctccaggaattgcggtggccggtatgaagggggagccaggaatccctggcaccaagggtgaaaaaggggccgagggtagtcccggacttcctggactccttgggcagaagggcgagaagggggatgccggaaatagtatagggggcggtcgtggcgaaccagggcccccgggcctgcccgggccacccggaccaaagggcgaggccggtgtagatggtcaggttggacctcccggccagcccggcgacaagggcgagcgcggcgcagcaggcgagcaggggccagacggaccaaagggttcaaaaggggagccagggaagggagagatggtggactacaatggcaacataaatgaggcccttcaagaaatccgaacacttgctctgatgggaccacccggactgccagggcagatcggccccccgggagcccctggtatcccaggtcagaaaggtgaaatcggacttcccggcccccccggccacgatggagagaagggcccgcgggggaagcccggtgatatgggccccccaggcccccaaggccctcccggcaaagacggcccccctggggtgaagggagaaaacggccatcccggctcaccgggcgagaagggtgagaagggcgaaactggacaggcaggatcgcctggggaaaaaggcgaagcaggagagaagggcaatccaggagccgaagttccagggctgccgggcccggaaggacctccgggaccccccggcttgcagggagtgcccgggccaaagggtgaggccgggttggatggcgctaaaggggaaaaggggtttcagggggagaaaggagatcgtggaccccttgggctaccagggactcctgggcctatcggagtccccggacctgctggcccgaagggagagaggggttctaagggggatccaggcatgaccgggcctacaggcgccgccggcctgcctgggttgcatgggcctccaggggacaaggggaacaggggcgagagaggcaagaagggatcgagaggccccaagggggacaaaggcgaccagggcgcacccggtctcgacgccccctgccctttaggagaggatggactgcctgttcagggctgctggaacaaatag

SEQ ID NO: 112686 - DNA, 1338 bp, Artificial Sequence
  Description of Artificial Sequence: Synthetic coding sequence
atgacaggatctagtttttctctggcccaccttctgatcatctctggactgctttgctatagcgccggctgtttagctctccctagcttagaccagaagaaaagaggtggccacaaagcctgttgtctcctgaccccgcctcccccacccttgtttccccctcccttttttcgagggggtcggtcgcctctgctttcccccgacatgaaaaaccttatgctggaattggagacgtctcagtcgccatgcatgcagggctctctcggttcacccggcccccccggtcctcagggacctcctggcctcccaggcaaaacaggaccaaagggcgaaaagggagaattgggaaggcccgggcggaaaggcaggcccggtcctcctggcgtccctgggatgcctggccctatagggtggcctggtcccgagggacccaggggggagaaaggcgacctgggaatgatgggactgccaggttctcgtggcccaatgggatctaaaggatatcctggttcccggggcgaaaagggcagcaggggggaaaagggggacctaggtcctaagggggagaagggattccccggcttcccaggaatgctgggacaaaagggggagatggggcccaaaggtgaacccgggatcgcagggcatagaggacctacgggacgaccgggcaagagaggaaaacagggccaaaagggggattctggcgttatggggcccccagggaaaccgggtccgagcggccaacctgggaggccagggccccccggacccccacctgcggggcagcttattatgggccctaagggtgagcggggcttccccggtcctcctggtagatgcctttgcggacccacaatgaacgttaataacccttcctatggcgagagcgtgtacggcccaagctcaccacgtgttcccgtgatcttcgttgtgaacaaccaagaggagttagagaggctcaatacacaaaacgcaatcgccttcagacgtgaccaacgatctctatattttaaggattccctgggatggctgcccattcagctcacccccttctatcccgtggattataccgctgatcagcacggaacgtgcggcgatggtctactgcagccgggggaggagtgcgacgatgggaacagtgacgtcggcgacgattgcatcagatgccacagggcttactgcggtgacggacatcgtcacgaaggggttgaggactgtgacggcagcgactttggctatttgacttgtgagacatatctgccagggagttatggcgacctccagtgcactcagtactgttatatagattctactccctgtagatactttacctag

SEQ ID NO: 112687 - DNA, 876 bp, Artificial Sequence
  Description of Artificial Sequence: Synthetic coding sequence
atggttgtgctgaatcctatgacacttggcatttatctgcagctgtttttcttatcgattgtcagtcaacccaccttcattaattccgtacttcccatctcggcagccctaccatccctggaccagaagaagcgcggaggccataaagcctgttgcctcctaacgcccccaccaccgccactttttcctcctccatttttccgcggcggacgatcacctctgctctctccagacatgaaaaacctgatgttggaattggagacgagccagagcccttgtatgcagggctcattgggatcaccggggccccctgggccacaaggcccaccgggcctccctggtaaaacaggacctaaaggagagaagggggagctgggtcggccaggacggaagggcagaccgggacccccaggagtgccagggatgcccgggccaatcggctggccggggccggaagggcccagaggcgagaagggcgacctcggcatgatgggtttgcctggtagccgaggccccatgggtagcaaaggctaccctggaagccgaggcgagaaggggtctagaggcgaaaagggagacttaggaccgaaaggggagaaaggcttcccggggtttcccgggatgctgggacagaaaggggagatgggaccaaaaggggagcccggtatcgctggccataggggacccaccggaagacccggaaaacggggaaaacagtccagtagaaccccttgcacactcccccggaggcccccagtgccatgcggacaggggtctcgtagtccggtcaccgtggtggccggcaaagaaagccaggcatgccttctgccgaggttcgaggaagattatataagctcaggaaccgagcgcggatag

SEQ ID NO: 112688 - DNA, 1266 bp, Artificial Sequence
  Description of Artificial Sequence: Synthetic coding sequence
atggttgtccttaaccccatgaccctgggaatatatcttcaactgtttttcttgagtattgtgtctcaacctacgttcatcaacagcgtgctgcctatctcagcagctcttccatctctggatcagaagaagcgtggaggccacaaagcgtgctgtctccttacacctccgccaccccctctattccccccgcccttttttaggggaggcagatccccgggacctcccggattaccagggaaaacaggacccaagggagaaaaaggagaactgggaaggccaggcaggaaaggccgccctggtccacctggtgtccctggcatgccaggacccattggctggcccgggccggagggacctaggggagaaaaaggcgacctcgggatgatggggctaccaggaagccgggggccaatggggagtaaggggtatccggggagccgtggggaaaaggggtctagaggagaaaagggagatctgggacctaagggagagaagggtttccccgggtttccagggatgctcggtcaaaagggcgagatggggcccaaaggcgagccgggtattgccggacacagagggccgaccggccgacccggcaagagggggaagcaaggacaaaagggcgattccggtgttatgggacctcctggaaaacccggaccttccgggcaacccgggcgccccggtccacccggcccgcccccagccggccagttgatcatgggtcccaaaggagagcgcggtttccctggtcccccaggacgatgtctgtgtggaccaacaatgaatgtaaacaaccccagctatggtgaatcggtctatggtcctagcagtcccagagtgccagtaatctttgttgtgaataatcaggaggagctggagaggctgaacacacaaaacgctatcgcattccggcgggaccaacgctctctatattttaaggacagtctcgggtggctgcccatccagctcacaccattttacccagtggattacacagccgaccagcacggaacatgtggtgacggtctcctccagcctggggaggaatgtgacgacggtaacagtgacgtgggagatgactgcattcggtgtcaccgcgcttattgtggtgacgggcacagacatgagggcgtggaagattgtgatggtagcgactttggctacctgacatgtgagacatacctgcctgggtcgtacggggacctgcagtgcacccagtattgttatattgattcgacgccctgtcgctactttacctag

SEQ ID NO: 112689 - DNA, 1341 bp, Artificial Sequence
  Description of Artificial Sequence: Synthetic coding sequence
atggtggtactgaatcccatgacccttggaatttatttacagctctttttcctgagtatcgtgtcacagccaacctttattaattccgtgcttccaatctctgctgccttgccctcccttgaccagaaaaagcggggcggccacaaagcctgttgtttactcaccccacctccacctccactctttcccccacccttctttcgaggcggacgaagtccacttctctccccagatatgaaaaacttaatgttagagcttgagacaagtcagagcccctgcatgcagggcagcctgggatccccaggcccgccaggaccgcaaggcccccccggactgccaggcaagactggacccaaaggagaaaaaggccgccccggccctcccggtgtcccaggcatgcctgggcccattggctggcccgggccagaggggccacgtggagagaaaggagatcttggcatgatgggactgcctgggtcacgcggccccatgggaagcaaaggttaccccggcagtagaggcgagaagggaagtcggggtgaaaagggcgatttgggacccaaaggtgagaagggtttccccgggtttccagggatgctggggcagaaaggcgagatgggccccaaaggcgaaccgggaatcgccgggcacaggggacctacgggaaggcccggcaaaagaggtaaacaggggcagaaaggcgatagtggcgtgatggggccccctggaaaaccaggaccctcaggccagcccggaagacccggtcccccaggcccccccccagccggtcaactgatcatggggcctaaaggtgagcgcggctttcccggacctcctgggcgatgcctgtgcggcccgacaatgaacgtgaacaatccatcttatggcgaatcagtttatggtccttcttcgccgagagtgccagttatctttgtggtcaataaccaagaggagctcgagagactgaacacgcaaaacgctatagcattccgacgcgatcagagatctctgtactttaaggattccctgggatggttacctatccagctgacgccgttttatcccgtcgattataccgcagaccagcacggcacatgtggtgacggtctgcttcaaccgggcgaggaatgcgacgatggtaactcagatgtgggagatgattgcatacggtgccaccgggcttattgcggagatggtcaccgccacgaaggtgtcgaggactgtgatggatctgattttggctacttgacctgcgaaacctacctcccaggctcctacggagatctgcagtgcactcagtattgctatattgattcgacaccatgtcggtattttacctag

SEQ ID NO: 112690 - DNA, 1368 bp, Artificial Sequence
  Description of Artificial Sequence: Synthetic coding sequence
atggtagtgctgaaccccatgacactggggatttacttacaacttttcttcctgagtatcgtgagccaacccacatttataaacagcgttctccccatttctgcagcgcttcccagtctggaccagaaaaaaagaggcggccataaggcatgctgcctcttgacccctccaccaccacctctctttccacccccctttttcaggggtgggcggtcccctctcctcagtcctgacatgaagaatctcatgctggaactcgagacgagccagtcaccttgtatgcaaggctcgcttgggtccccagggccgcccgggccccagggcccccccggactgcctgggaaaacgggaccaaagggggaaaaaggggagctgggccgaccaggaaggaaggggcggcccgggccgcccggtgtccctggtatgcctggcccaatcgggtggcctggtccggagggtccacggggtgaaaagggagatctcgggatgatgggtttgcctggttcccgaggtcctatgggctccaaaggttacccgggcagtcggggtgagaagggatccagaggagaaaagggcgatcttgggcccaagggagaaaaggggtttcccggatttcctggaatgctgggacagaagggagaaatgggccctaagggagagcctggaatcgccggccatagaggccctaccggcagaccagggaagcgcgggaagcagggacagaagggggattctggtgtgatgggtccaccgggcaaacccgggcccagtggccaacctggtaggccagggccacccggacccccccccgccggccaactaattatgggtccgaagggggagaggggctttccaggaccacctggtcgttgtctgtgcggtcccactatgaacgtgaataaccctagctacggggagagcgtgtatggaccatcttcacctcgagtgcctgtgattttcgtggtcaacaatcaggaggaactcgagcgtctcaatacccagaatgccatagcatttcgaagagatcagcgctctctctacttcaaagattccctgggctggttgccaatccagttgacacctttttatcctgttgactacacagccgatcagcacggaacctgcggcgacggcctattacagccaggggaggagtgtgatgacggtaactcagacgttggcgacgattgcattcggtgtcatcgtgcttattgtggggatggccacagacacgaaggagttgaggactgcgacggctcagatttcggctacctgacatgtgagacttatcttcccggatcatacggagacctgcagtgtactcagtattgctacattgattctactccatgtaggtactttacctag

SEQ ID NO: 112691 - DNA, 1338 bp, Artificial Sequence
  Description of Artificial Sequence: Synthetic coding sequence
atgacaggatcaagtttctcactcgcccatctgctgatcatcagcggcctgctatgctattccgccgggtgtctggctctcccgagtctggaccaaaagaagaggggaggccacaaagcgtgctgcctgcttactcccccacctcctcccctgttccccccgccattcttcagaggcgggagatccccactcctcagccccgacatgaagaacctgatgctcgagctcgagacctcccaatctccctgcatgcaggggagccttggtagcccgggcccacctggccctcaaggccctccaggcctgcctgggaaaactggccccaagggagagaagggtgagctgggtcggccggggaggaagggccgccctggcccccccggggtgccaggtatgccaggtcctattggctggcccgggcctgagggccctcggggagagaagggagacttgggaatgatgggtctgcctggtagccgagggccaatgggatcaaaaggctacccagggtcgcgcggtgaaaagggaagcagaggtgaaaagggggatctcggccccaagggggaaaagggatttccaggtttccctgggatgctcgggcagaaaggggagatgggtcctaagggggagcccggcatcgccgggcacaggggcccaacagggcgccctggaaaacggggaaaacaggggcagaaaggggactctggtgtaatgggtccccccggcaaacctggtccctctggtcagcctggccgccctgggccacccggcccgccccccgcgggccagttgatcatgggccctaaaggtgagcgggggttccccgggccgcctggaaggtgcctctgcggcccgaccatgaacgttaacaatcctagctacggcgagtccgtgtacgggccgtcttcacccagggtaccggttatctttgtcgtaaataaccaggaggagctggagcgcctgaacacccaaaatgcaattgcattcagacgggatcaacgcagcctgtatttcaaagactcccttggatggctgcccattcagctgacacccttctacccagttgactataccgctgatcagcatgggacatgtggagacggattactccagccaggcgaggagtgcgatgatggaaactccgatgttggggatgactgcatcaggtgtcaccgggcttactgcggtgacggacaccgtcacgagggggttgaagactgcgatggctcagactttggatatctcacctgcgagacttacctcccaggatcctacggcgacctccagtgcactcagtactgctatatagattctaccccttgccggtactttacctag

SEQ ID NO: 112692 - DNA, 585 bp, Artificial Sequence
  Description of Artificial Sequence: Synthetic coding sequence
atcagtggcttactgtgctactccgccgggtgtctcgccctgccctcccttgaccagaagaaaaggggcgggcataaagcttgttgcctcctgacacctccccccccccccttattccccccaccattttttcgcgggggcaggtctccaggccctccaggcttacccggtaagacaggacccaagggagaaaaaggcgaacttggccggcctggcaggaaaggaaggccgggcccccccggtgtgcctggaatgcctgggcctatcggctggcccggtcctgaaggtccccggggtgaaaagggagacctggggatgatggggctccctggctcaagggggccaatgggaagcaagggctatccgggcagtaggggcgaaaagggtagcagaggtgaaaagggcgatcttggacctaagggagaaaagggctttccaggcttcccggggatgcttgggcagaaaggggaaatgggccctaaaggagagcctggaatagccggtcatcgaggccccacgggcaggcctggtaagaggggcaaacaaggccagaaaggtgattcaggggtgatggggcctccttag

SEQ ID NO: 112693 - DNA, 1338 bp, Artificial Sequence
  Description of Artificial Sequence: Synthetic coding sequence
atgactggatcgtcgttcagcttagcccacctcctcatcatcagcggcctactgtgttacagcgccggttgtctggcgctacccagcctcgatcaaaagaagcgaggaggccacaaagcttgctgcctcctgactcccccacctcctcctctctttccacctccttttttccgtgggggccgcagcccacttttgtctcctgacatgaaaaacttgatgctggaattggagacctcgcagtcaccctgcatgcaggggtccctgggcagccctggcccgcccggaccccaggggccacctggactcccggggaagactggcccgaagggggaaaaaggcgagctcggacggcctggcagaaaagggcggccaggacccccaggtgtaccaggcatgcccgggccaattggatggcccggcccggaagggccacggggggaaaagggggatcttggcatgatgggtctcccgggatctcgaggccccatgggatctaaaggatacccaggaagcaggggcgagaagggttcccggggggaaaagggggatctgggccctaagggggagaaatgtaaccctttgctattgttgtttccaagctttcagggcgagatgggaccaaaaggggagcctggtatcgctggccacagagggcctactggcaggccaggcaaaagaggcaaacagggtcagaaaggggactcgggggtcatgggcccacccggtaaaccaggcccctctggccagcccggccggcccggccctcccggcccaccacccgcaggacaactgatcatggggcccaaaggcgagagaggtttcccaggcccccccggaagatgtttgtgcgggcccacaatgaatgtcaacaaccccagctacggtgagagtgtatacggcccctcctcaccaagagtgcccgttattttcgtagtcaacaaccaggaggagctggagaggctgaacactcagaatgcgatcgctttcagacgggatcaacgctccctgtatttcaaggacagcttgggctggctgccaattcagttgactcccttttacccggtcgactatactgccgatcagcacgggacatgtggcgacggactactccaaccaggggaagaatgtgatgacggaaacagtgacgtgggggatgactgtattcgatgccatcgtgcctattgcggagatggccaccgacacgagggcgttgaagactgcgacggtagtgatttcggctatctgacctgcgagacttatttgccaggcagctatggagaccttcagtgcacacagtactgctacatagacagtacgccatgcagatatttcacctag

SEQ ID NO: 112694 - DNA, 2061 bp, Artificial Sequence
  Description of Artificial Sequence: Synthetic coding sequence
atggcagatcggagaagagcatggaatacagaggatgacctgcctgtctacctggcccggcctgggtcagccgcacagactcctagacagaaatatgggggtatgttcgccgccgtcgaaggagcctatgagaacaagacaatagattttgacgcttacagcgtcggaaggcgtggttccgcccggacgccaaggtctgccggccgaccagatgccgttggcctgccaggacctggaggaagtgaagacaccgcatctgatgtgtccgagccctccgggtctgccgtatcaagcccgggcgaaagggatgaacgcccccctactctcaggattagaaggcccgctccacgggatttgcccctcggtcgcgacaacggccaatcagaccgcttgcttattaaaggagggcggatcatcaacgacgatcagagcctgtatgccgatgtatacttagaagacggcctcatcaagcagataggcgaaaacctgatcgtacccggtggcgtgaagaccattgaggcaaatgggaggatggtaatccccggaggcatcgatgttaatacataccttcagaagccctctcagggtatgactgctgcggacgacttctttcaggggacaagagccgcacttgtagggggaacaacaatgattatagatcacgttgtcccggagcccggcagttctttgttgacgtcattcgaaaaatggcatgaagcagccgataccaagtcctgctgcgactatagcctccacgtcgatataactagttggtatgatggtgtcagggaggagcttgaagtactagttcaggataaaggtgtgaactcattccaggtatacatggcatacaaggatgtataccagatgagcgatagccagctgtacgaggcttttacgtttctgaagggactgggagctgtaattctcgtccacgcagagaatggtgacctgattgctcaggagcagaagagaatcctcgaaatgggaattaccggaccagaggggcacgctctttccaggcctgaagaactcgaggccgaggctgtgtttcgtgcaatcacgatcgccggcaggattaattgccccgtgtacattacaaaggtgatgagtaaaagcgccgccgacatcatcgccctggcgcgtaaaaaaggcccactcgtgttcggcgagcccatcgccgcatctctcggcaccgatggcactcattactggtccaaaaactgggcaaaagctgctgcttttgttacatccccccctctgtctcctgatccaaccacaccggactacctgacaagtctgctcgcatgtggcgacctccaggtcacgggcagcggccactgcccctactctactgcccaaaaggccgtgggtaaggacaattttactctaatcccggaaggagtcaatggcatagaggagagaatgacagtggtgtgggataaggccgtcgccaccggcaaaatggatgaaaaccagtttgtcgccgttacatcaacaaatgccgcaaagattttcaatctctacccccgcaagggccggatagcggtaggcagcgatgccgatgttgttatctgggacccagacaaattaaagaccattactgcaaaatcacataaatccgcagtggagtacaatatctttgagggtatggagtgccacggcagccccttagtggtgatttcacaaggaaaaatagtattcgaggatggcaacatcaacgtgaataaaggtatgggccgcttcatacctcgtaaggcctttccagagcacttataccagcgcgtcaaaattagaaataaggtattcgggctgcaaggagtcagccgtgggatgtacgacggaccagtgtatgaggtacctgctactccaaagtatgccaccccggccccatctgctaaatcgagcccctcaaaacatcagccacccccaataagaaacctccaccagagtaacttttcactttccggagcccagatcgatgataacaaccctaggcgcactggccataggattgtcgcaccccctggaggacgttcaaatattacaagcctgggatag

SEQ ID NO: 112695 - DNA, 1719 bp, Artificial Sequence
  Description of Artificial Sequence: Synthetic coding sequence
atgagttatcagggcaagaagtctatccctcacataacctccgacagactgctaattaaggggggtagaattataaacgacgatcagagcctttacgccgacgtgtacctcgaagacgggctgataaaacagattggcgaaaatcttatcgtgcctgggggagtgaaaaccattgaggctaacggacgtatggtcatcccgggcggcattgatgtgaacacctatctgcagaaaccctcacaaggtatgaccgctgctgacgacttctttcagggcacccgggctgctttagtcgggggcacgaccatgatcatcgatcacgttgtgcccgaacctggaagctcgctgctgacttcctttgagaaatggcacgaagccgctgataccaagtcatgttgcgattattctctgcacgtagacatcacatcttggtacgatggtgttagagaggaactcgaagtcctggtgcaggataagggggtgaattccttccaggtgtatatggcttacaaggacgtgtaccaaatgtctgatagtcaactgtacgaagccttcactttcctcaaagggctgggtgcagtgatccttgtgcacgctgaaaatggggatctgattgcccaggaacagaaacgcatactggaaatgggtatcacgggacctgaaggacacgccctgtcaagaccagaggagcttgaagccgaggctgttttcagggccatcaccatcgctggccgaattaattgtcccgtatacatcacaaaggtgatgtccaagagtgccgccgacattattgcccttgcccgtaaaaagggtcctttggtgtttggggaacctattgcagcgagtctagggaccgacggcactcattactggagcaaaaactgggccaaggcagccgccttcgtgactagccctccactgtctcctgaccccaccaccccagactatctcacatccttactcgcctgtggcgacctgcaggtcaccggatcaggccactgtccttattcaactgcccaaaaggcagtgggcaaggacaacttcacgctgatacctgaaggcgtaaatggtattgaagaacgtatgaccgttgtctgggacaaagccgtggctaccgggaagatggacgagaatcaatttgtcgcggtaacttcgaccaacgccgcgaaaatcttcaatctctacccacgtaagggtcgcatagcagtggggtcggacgccgatgtggtcatttgggaccccgacaagcttaagactataacggcgaaaagccacaagtctgcagtggaatataacatcttcgagggaatggaatgtcacgggagtcctttagtggtgattagccagggaaagattgtgttcgaggacggcaacatcaatgtcaataagggcatggggcggtttatcccacgcaaagctttcccggagcacctgtatcaacgagtgaagatccgtaacaaggtgttcggcttgcaaggggtgtctagaggaatgtacgacggcccagtgtatgaggtgccagcaacacccaaatacgccacccctgctccaagcgctaagtcaagtcccagcaagcaccagcccccacccatcagaaaccttcatcaaagtaattttagtctaagtggcgcacagattgatgataacaaccccaggcggactgggcatcggatcgtcgccccgcccggtggaagatcaaatatcactagtctgggctag

SEQ ID NO: 112696 - DNA, 1713 bp, Artificial Sequence
  Description of Artificial Sequence: Synthetic coding sequence
atgcagaagatgaataatgaagttgtagacaaatcggatagacttctgatcaaagggggacgaattatcaatgacgatcagagcttgtatgcagatgtttaccttgaggatggtctcatcaagcagattggagaaaacctcattgtccccgggggcgttaagaccatcgaagctaacggcagaatggtgattcccggggggattgatgtgaatacatacctgcaaaaaccttcacaaggaatgacggccgctgatgacttctttcaggggactcgggcagccctggtcggaggcacaaccatgatcatagaccatgttgtgcctgagcccggcagtagcctgctaaccagctttgaaaaatggcacgaggccgcagatactaagtcatgttgtgattacagcctacatgtggatattacttcttggtatgatggcgttcgtgaagaattagaggtcctggtgcaggacaaaggagtgaacagttttcaggtatacatggcatacaaggatgtttaccagatgtcggactcccagctctatgaagctttcacattcctgaagggtcttggggccgtgattctcgtccacgccgaaaatggagacttaatcgcccaggagcaaaagagaatcctcgaaatgggaatcacaggccctgaggggcacgcactctcccgccctgaagagttggaggctgaagcagtttttcgagctattacgattgccggccggattaattgtcctgtttatatcaccaaagtgatgagcaagtccgccgccgacatcatcgccttggctagaaaaaagggaccgctggtgttcggggagccaattgccgcaagcctgggtactgacggtacacactactggagtaaaaactgggccaaggcagctgctttcgtgactagcccccccctctctcctgatcctactactcccgactacctgaccagcttgctggcgtgcggcgacttacaagtaacaggttctgggcattgcccctattccacggcccaaaaagccgtgggtaaggacaacttcactcttattccagaaggggttaacgggattgaggagcggatgacagtggtatgggataaagcagtggctacggggaagatggacgagaatcaatttgtggccgttacaagcactaatgcagcgaagatattcaatctgtaccctagaaaagggcggatcgccgtcgggagtgatgccgatgtagtgatatgggatccagataagctaaagacaattaccgctaagtcacacaagagtgccgtcgagtacaacatcttcgagggtatggaatgccacggctctccccttgtagtgataagtcagggtaagatcgtgtttgaagacggaaacatcaatgtgaacaaaggaatggggcgatttattcctcggaaagcattccccgagcacctgtaccagcgggttaagatccgaaacaaagtgtttggcttgcaaggggtctccaggggcatgtacgacggaccagtctatgaggtccccgccaccccaaagtacgcaaccccagccccctccgccaaatcatccccatccaagcaccaacctcctcctattagaaatctgcaccaatccaacttctctctatccggggctcaaattgatgataacaacccacggagaactgggcaccgcatcgtagctcccccagggggtcgttcaaatatcaccagtctgggctag

SEQ ID NO: 112697 - DNA, 1719 bp, Artificial Sequence
  Description of Artificial Sequence: Synthetic coding sequence
atgtcataccagggcaagaaaagtataccccacatcacgagtgaccgcctgcttatcaaaggcgggagaataattaatgatgatcaaagcctgtatgccgacgtttacctcgaagatggcctaatcaagcagatcggagagaacctgatcgtgccagggggcgtaaaaacaatagaggcaaacggtagaatggtgattcctggaggcatcgacgtgaatacgtatctgcagaagccctcgcagggtatgacagccgcagacgactttttccagggcactcgagccgccctagtgggcgggacaacaatgatcattgatcacgtggtaccggagcccggcagctctctactcacgtccttcgagaaatggcacgaagcagctgacactaaaagctgttgtgactactccttgcatgtcgacataacgagttggtacgacggtgtcagggaggaactcgaagtcctggtacaggacaagggcgtaaacagtttccaggtgtatatggcttacaaagacgtgtatcagatgtctgactcccagctctatgaggccttcacatttctgaaaggactgggcgccgtgatcctggtgcacgctgagaatggagacctgatcgcccaagagcagaagcgcatcttagaaatgggtataacaggccctgagggccatgcgctgtctagacctgaagagttggaagccgaggccgtgtttcgagcaattaccatcgcgggaagaattaactgtcctgtttacatcaccaaagtgatgtcaaagtccgcagctgacatcattgccttggcacgcaagaaggggccccttgtttttggcgaaccaatagctgccagtttgggcacagatggaacgcattactggtcaaagaattgggcaaaagccgctgcgttcgtcacttcccctcccctctcgcccgatcctacaacccccgactatcttacttcgctgctggcctgtggagatctgcaggtcactggaagtgggcactgtccatattctactgcacaaaaggccgtgggcaaggataatttcacattgattcccgaaggtgtcaatggtatagaagagaggatgacggtggtgtgggacaaggcagttgccactggcaaaatggacgaaaatcaatttgtggcggtgactagcaccaatgccgctaaaatcttcaacctctatcctaggaaaggcagaattgcggtgggctcagatgcagacgtagttatttgggatcctgataaattaaagacaatcactgcaaagtctcataagtccgctgtagagtacaacattttcgaaggcatggagtgtcatggtagtcctttggtggtgatctcccaaggcaagattgtgtttgaagacgggaacataaatgttaataaaggtatgggaagattcataccccgaaaagcattcccagaacatctttaccagagagtcaagattaggaataaagttttcggcctgcaaggggttagccgggggatgtatgacggacctgtgtatgaagtaccggcaactcccaagtatgcgacacccgcgccgtctgccaaaagcagcccctccaaacaccagccgccacctatccgcaacctgcaccagagcaatttcagccttagcggtgctcagattgatgacaacaaccctcgccggacaggacatcgtattgtggccccccccggtggacgctctaatatcacttctttaggctag

SEQ ID NO: 112698 - DNA, 834 bp, Artificial Sequence
  Description of Artificial Sequence: Synthetic coding sequence
atgaacggattcgcgtcgctccttcgtcggaatcagttcattctgttggtacttttcctcctccaaatccagagtctgggcctggacatcgacagccgtcccactgccgaggtgtgtgccactcatacaataagccctggccccaagggcgacgatggggaaaagggcgatcctggggaagaaggtaaacacggcaaggtggggcgtatgggcccaaaggggattaagggggagctaggagatatgggtgatcaagggaatatcgggaagacaggaccaatcgggaagaagggggataaaggcgagaagggtcttttaggtattccaggcgagaaggggaaagctggcacggtgtgtgattgcgggaggtatcgcaagtttgtcggacagctcgacatcagcatcgctagactgaagacttctatgaagtttgttaagaatgtgatcgccggtatacgggagacagaagagaagttttactatattgttcaagaggagaaaaattacagagagtccctgacccattgtaggatccgtggtgggatgctcgccatgcccaaagatgaagctgccaacactctgatcgccgattatgtcgctaagtcaggtttttttagggtatttataggagtaaacgacctcgagagagagggtcagtatatgttcaccgacaatactcccctacagaactactctaattggaatgagggagaaccctcagacccatacgggcacgaagactgtgttgaaatgctgagcagtggacgatggaatgacacagagtgccatttgaccatgtatttcgtatgtgagttcattaagaaaaaaaagtag

SEQ ID NO: 112699 - DNA, 807 bp, Artificial Sequence
  Description of Artificial Sequence: Synthetic coding sequence
atgactcctgccctttgcagatcatcttctctggcttcgaagggtatgagggaacgccgagaaaccaaagccccaccagatggtcttgaggaaagcgccccccgcgagaaaaaacagagccagcccgttgtaaccgcatccgacatatctaaacggaaatgtacctcgtcctttgtcgaaatgggctcccagggtgatatgggtgataaaggccagaaagggtcggtgggccgacacggtaagattggacccataggctctaaaggagaaaaaggcgactctggcgacatcggccctccaggtccaaacggcgaacccggcctaccctgcgaatgcagtcagctgcgcaaagccataggcgagatggacaatcaggtgtcccagctgacatcagagctgaaattcataaagaacgctgtggcgggagtcagggagaccgagtccaaaatctatctcctggtcaaagaagaaaagagatacgccgacgcccagctctcctgccagggcagaggcggaacattaagcatgcctaaggatgaggctgctaatgggcttatggccgcttatctggcacaggccggtttggcccgtgtgtttataggaattaatgacttggagaaagaaggagcattcgtctacagcgatcacagccctatgcggacctttaacaagtggagatcgggcgagccaaataatgcctacgacgaggaagattgtgtggagatggtagcctctggtggctggaacgacgttgcttgtcacactaccatgtactttatgtgcgagtttgataaggagaacatgtag

SEQ ID NO: 112700 - DNA, 816 bp, Artificial Sequence
  Description of Artificial Sequence: Synthetic coding sequence
atgagggggaacctggcgctagtgggggtgctcatatcccttgccttcctttcattgctcccaagtggccatccccagcccgccggtgacgatgcctgctcggtgcaaatcctcgtgcctggcctgaagggcgatgcgggcgaaaagggggataaaggtgcccccggaaggccaggtcgagtgggtccaaccggtgagaagggtgacatgggagataaaggacaaaagggatctgtgggcaggcatggcaaaatcggcccaatcggttccaaaggggaaaagggcgactccggggatattggacctcctggccctaacggcgaaccaggcctgccttgtgagtgttcccaactgagaaaggctatcggagaaatggataaccaggtttcacagctcacctccgaactaaaattcatcaagaatgcagtggcgggtgtgcgggagacggagtctaagatctacctgctcgtcaaggaggaaaagaggtacgctgatgcccagctgagttgtcaagggagaggagggacattgtcaatgcccaaagacgaagctgccaacggtctgatggcagcctacctggcccaggccgggttagctcgagtgtttattgggatcaatgatctagaaaaggagggcgcttttgtttattccgatcacagccctatgcggacattcaacaaatggcggagcggcgaacccaataatgcctatgatgaggaagattgtgtggaaatggtagccagcggtggttggaacgatgttgcctgtcacaccaccatgtactttatgtgtgagtttgacaaggagaatatgtag

SEQ ID NO: 112701 - DNA, 744 bp, Artificial Sequence
  Description of Artificial Sequence: Synthetic coding sequence
atgcgcggaaatctggctctcgtcggagtgctgattagcctggctttcctgagcctattgccatctggacatccacagcctgccggggacgatgcttgctctgtgcagatcttggtacctggtttgaaaggcgacgccggagagaagggcgacaaaggcgcccctggccggcccggccgtgtgggacccaccggagaaaagggcgagaagggcgattcgggggatatcggtcctcctgggccgaacggtgaacccggtcttccctgtgagtgttcccagctgaggaaggctatcggtgagatggacaatcaggtatcacagctcacatccgagctaaagtttatcaagaatgcagtagcaggcgttcgtgagactgagtcaaagatttatctgctggtgaaggaggaaaaaagatacgcagatgcccagctatcctgccagggcagaggcggcactctatctatgccaaaagacgaggcggccaacggtttaatggctgcctatctggcccaggccgggctcgctcgcgtgttcatcggcattaatgatctggaaaaagaaggagctttcgtttattccgaccatagtcccatgcggactttcaataagtggcggtccggagaaccaaataacgcatacgacgaagaggactgcgtggagatggtagcctcgggcggctggaatgacgtggcatgtcataccacgatgtactttatgtgcgaatttgataaggaaaatatgtag

SEQ ID NO: 112702 - DNA, 858 bp, Artificial Sequence
  Description of Artificial Sequence: Synthetic coding sequence
atgaaaaagcagcgcggggttggcgttctgcctgcacttcgcatgcggggcaatctggctctggtaggcgtccttatatccttagcattcttgtctctcctaccgagtggccacccccaacccgcaggagacgatgcctgctcagtacaaatcctcgtgccgggactcaaaggggacgctggggaaaaaggcgacaagggagcaccaggccgtcccgggagggtagggccgactggagaaaaaggggacatgggtgacaagggccaaaaaggcagcgtcggcagacatggcaagatcggtccaatcggttctaaaggcgaaaagggggattccggggacatcggaccccccggccccaatggagagccaggactgccttgcgaatgcagccagctccgtaaggctatcggcgaaatggataatcaagtatcccagttgacctcggaactaaaatttattaagaatgcggtcgccggtgtgcgagaaacggaatccaaaatctacctgttggtgaaggaggaaaaacgatatgccgatgcccagctatcctgtcagggcagaggcggaacactctcgatgcctaaagacgaggcagccaacgggctcatggcggcttatctcgcacaagccggtttggctcgcgtttttatcggcatcaatgacctggagaaggaaggcgcctttgtttactccgatcacagccctatgcggacgtttaacaaatggaggtccggggaacctaacaacgcttacgacgaggaggactgtgtcgagatggttgcctcagggggatggaatgacgtcgcttgccataccacaatgtatttcatgtgcgaatttgataaggaaaatatgtag

SEQ ID NO: 112703 - DNA, 666 bp, Artificial Sequence
  Description of Artificial Sequence: Synthetic coding sequence
atgtggtgggtgcctccatcaccatacggctgcctcccttgcgccctccctggcgacatgggggacaagggacagaaagggtccgtggggcggcacggaaaaatcggacctatcggtagtaagggagagaaaggcgatagtggcgacattggtccaccaggtccaaacggagagccgggactgccgtgcgaatgctctcaactccgaaaagctattggtgaaatggacaaccaggtgtcccaactgacctctgagttaaaattcatcaaaaatgcagtggctggtgtgcgcgagactgaaagcaaaatctatctcctggtgaaggaggagaagcggtatgctgatgcgcagttaagctgccagggccggggcggcacactctctatgcccaaagatgaagctgcaaacggccttatggccgcgtacttggcgcaagccggcctggccagagtgtttatcggaatcaacgacctcgagaaagagggggcgttcgtctactcagatcactctccaatgaggactttcaacaagtggcggtcaggcgaacctaacaacgcttacgacgaggaagattgtgtcgaaatggttgcaagcggcggttggaacgatgtcgcatgtcacaccactatgtactttatgtgcgaattcgacaaggaaaatatgtag

SEQ ID NO: 112704 - DNA, 666 bp, Artificial Sequence
  Description of Artificial Sequence: Synthetic coding sequence
atgtggtgggtgccgccatctccgtacggatgtttgccctgcgccctgcccggcgatgcaggagagaagggcgacaagggggcccccggaagacccggcagagtggggcccaccggcgaaaaaggcgaaaagggtgatagtggcgacatcggaccacctggccccaacggagagcccgggctgccttgtgaatgctcccagttgcggaaggccatcggtgagatggataaccaggtcagtcagctgacctccgagttgaagtttataaaaaatgccgttgcaggggtgcgcgaaacagagtcaaagatctatctcctggtaaaagaggagaaaagatatgcagatgcccagctctcctgccaaggaaggggcgggactctcagtatgcccaaggatgaagctgccaatgggctaatggcagcttatctggcccaagccggactcgccagagtctttatcggtatcaacgaccttgaaaaggaaggagcctttgtgtactccgatcactcccccatgcgcacttttaacaaatggagatctggggagcctaacaacgcctacgatgaggaggattgcgtggaaatggtagcatcgggaggttggaatgatgtggcatgtcataccaccatgtattttatgtgtgagttcgataaggaaaacatgtag

SEQ ID NO: 112705 - DNA, 594 bp, Artificial Sequence
  Description of Artificial Sequence: Synthetic coding sequence
atgtggtgggtcccacccagcccatacggctgtcttccatgcgctcttcccggagaaaagggagattcaggagatatcggacctccgggccctaacggcgagcccggtctgccttgcgagtgctcacagttacggaaagctattggcgaaatggacaatcaagtttcacagctcactagtgaactgaaatttatcaaaaacgcagtcgcgggggtccgggagacagaaagcaagatttacctgttggtgaaggaggaaaaacgttacgctgatgcacaactgtcttgccagggacgcggcggcacattgagtatgcccaaggatgaagctgccaacggactcatggcagcctacttggcgcaggcaggactagcaagagttttcattgggatcaatgacctcgaaaaagaaggggctttcgtttattcagatcacagcccaatgcgaactttcaacaaatggcgctcaggggagcccaataacgcctacgatgaagaggattgtgtggagatggttgcaagtggtgggtggaatgacgtcgcttgccacactacaatgtacttcatgtgcgagtttgataaggagaatatgtag

SEQ ID NO: 112706 - DNA, 2229 bp, Artificial Sequence
  Description of Artificial Sequence: Synthetic coding sequence
atgaaggacgactttgcagaagaagaggaggttcagagctttggatataagagatttggtattcaggaaggcactcaatgtacaaagtgtaagaacaattgggctcttaagttttccattattctcttatatattttgtgcgcattgctcacaattaccgtcgctatcctgggttataaagtggtggagaagatggacaatgtgaccggcgggatggagacttcaagacagacatacgatgataaattgacggcagtcgagtccgatttaaaaaagctcggtgaccagaccggcaaaaaggctatcagtacaaatagcgagctgtctacatttcgcagcgatatcctcgatttgcggcagcagctgcgtgaaattaccgagaagaccagcaaaaataaagacactctagaaaaactccaggcctcgggtgacgccctggtggatcggcaaagccagctgaaggagacattagaaaataactcattcctgatcaccaccgtgaataagacccttcaggcgtacaatggttatgtgactaacctccagcaagatacttccgtattacagggcaacttgcaaaaccagatgtattcacataatgtcgtgatcatgaacctgaataacctgaaccttactcaggttcaacaacggaatttaatcacgaaccttcagcgatccgtggacgacacgtcccaggcaattcagagaatcaaaaacgattttcagaatttgcagcaagtgtttctgcaggcgaagaaggacacggactggctaaaagagaaggttcagtcattgcagactcttgccgctaacaacagcgccctggcaaaagcaaataacgacactctcgaagacatgaactcacagctgaactcattcaccgggcaaatggagaatataacgacaattagccaggccaacgaacagaacctcaaggacctccaggacctccacaaggacgccgagaaccgcaccgccatcaaattcaatcagctcgaggaacgttttcagctattcgagaccgatatcgtgaatatcatttctaacatcagctacaccgcccaccatctgagaaccctaacctctaatctgaatgaagtgcgcactacatgtacagacacactgaccaagcatacagatgatctcacatccctgaataatacactcgccaacatccgtcttgattctgtttcactaaggatgcagcaggaccttatgcgcagccggctggacaccgaggtggctaacctctccgtgatcatggaggagatgaagttggtggacagcaaacatgggcagttgattaagaatttcacaattttacaaggccctcctggaccaagaggcccaaggggggacaggggatcccagggccctccaggcccgacaggcaataagggacagaaaggggaaaagggcgagcctggtccgccaggtcccgccggggagaggggaccgattgggccagctggccctcccggggagagaggggggaagggatccaaggggtcgcagggtcccaagggatctcgcggctcaccgggtaagcccggcccgcagggcagttcaggtgaccccggccctccaggaccaccaggaaaggaagggctgcctggccctcagggacctcctgggtttcagggtctccagggcactgtcggggagcctggtgtccccggacctcgcggtctgcccggcctccccggcgtgcctgggatgccaggcccgaagggccccccaggacccccaggaccttctggagccgtggttcccctggccctgcaaaatgaacccactccggcccccgaagataatgggtgtcccccacattggaaaaatttcacagacaaatgttactacttctccgtggagaaggagattttcgaagacgctaagctgttttgtgaggataaatcctctcacctggtgttcatcaatacccgcgaagagcagcagtggatcaagaaacagatggtaggaagagagagtcactggatcgggctgactgactcagagagggaaaacgaatggaagtggcttgacggcacatctccagactataagaattggaaggccggacaaccagataactggggccatgggcacggacctggtgaggactgtgcggggctgatctatgcgggacagtggaatgatttccagtgtgaggacgttaacaattttatttgcgagaaggacagagaaaccgttctctccagcgctctttag

SEQ ID NO: 112707 - DNA, 2919 bp, Artificial Sequence
  Description of Artificial Sequence: Synthetic coding sequence
atgggccctggagtgcttctgttgcttctagtcgctactgcgtggcatgggcagggaattcccgtgatcgaacccagcgtgccagagcttgttgtaaagccgggcgcaaccgtcaccctaaggtgtgtgggaaacgggtcagtggagtgggacggacccccatcccctcactggaccctgtattctgatgggtccagcagtattctttcgaccaacaatgctaccttccagaacactggcacatatcggtgcacagagccgggtgacccactagggggatcagctgctattcacctgtatgtcaaggatcccgcccgaccctggaacgtcctggctcaggaagtggttgtcttcgaagatcaggacgccctgttgccatgtttgctgaccgaccctgtgttggaggctggagtgtctctcgtgcgcgttagaggacgcccactcatgcgccatacaaattacagcttctccccttggcacgggtttaccatccaccgggccaagttcatccagagtcaggattatcagtgttctgcactgatgggggggaggaaggtgatgagtattagcatcagactgaaggtgcagaaggtgatcccaggcccacctgcactcaccctcgtgcctgcggaattagtgagaattcgaggagaggcggcccaaatcgtctgcagtgctagctccgtggacgtgaacttcgatgtgtttctgcaacacaataacaccaaacttgcgatcccgcagcagtctgacttccacaacaaccggtatcaaaaggtgctgaccctgaacttagaccaagtagactttcagcatgccgggaactatagctgtgtggcctctaatgttcaggggaaacacagtacttccatgttctttcgtgttgtggaaagtgcttacctcaacctgtcttccgagcagaacttgatccaggaggtcacagttggtgaaggattgaacctcaaggtgatggttgaggcttatcccggcttacaggggttcaactggacctacttaggacccttcagtgaccaccagccagagccaaagctggcaaatgcgacgactaaggatacctacagacacacatttacactctccctgcccagactcaaaccttctgaggcaggtcgatacagctttctcgcaaggaatccaggcggctggcgggccttgacattcgagttgacacttcgttacccaccagaggtgtctgtgatctggacatttatcaacgggagcggcaccctcttgtgcgctgccagcggatatccccagcccaacgtcacgtggctacagtgctccggacacacagatcgctgtgatgaggcacaggtgctgcaggtgtgggatgacccgtatcccgaagtgttatcacaagaaccttttcacaaggtaacagtgcagagcctgttgaccgttgagacactggaacacaaccagacctatgagtgtagggcccataatagtgttgggtcagggagctgggcgtttatccccatctcagctggcgctcacacccatccgcctgatgagtttctgtttacacccgtggtggtggcctgtatgagcataatggctctcttactgctgctgcttctgctgctcctctacaaatataagcagaagcccaaataccaagtccgctggaagatcattgagtcctatgagggaaactcctacacctttattgatcccacacagctaccctacaacgaaaagtgggagttcccacgcaacaacctccagttcggtaaaaccttaggcgccggcgccttcggaaaggtcgtagaagctactgccttcggtttgggcaaagaagacgcagttctgaaggttgcggtcaagatgctcaagtcaactgcacatgccgatgagaaggaggcactaatgagtgagctgaagattatgagccacctaggacagcacgagaatatcgtgaatctgctgggcgcttgtacgcatggggggcctgtgctcgtaattacagagtattgttgctatggggacttgttaaattttctccggcgaaaagccgaggctatgttaggccctagtctttctcctgggcaagaccccgaagggggggttgattacaagaacatccacctggagaaaaaatacgtccgaagagactctgggttctccagtcagggagttgatacatacgtcgaaatgagacctgttagcacttcctctaacgacagctttagcgaacaggacttggataaggaggatggccgacccctggagcttagggacctgctgcatttttctagccaagtagcacaggggatggccttcttggcctcaaagaactgcatacatcgagacgtggcagctcgtaacgtcctattaactaatgggcatgtcgccaaaatcggcgacttcggcttggcccgggatatcatgaatgactctaactatatagtgaaaggtaatgctcggctgccagtcaaatggatggcaccagaaagtatttttgattgtgtgtatacagtgcagtctgatgtgtggtcgtacgggatcttgctttgggaaatcttctcactggggctcaacccttatcccggcattctggtcaattctaagttctataaactggtgaaggacggctaccagatggctcaacctgcttttgcccctaagaacatttactctatcatgcaggcatgttgggctctggagcccacccacagaccgaccttccagcagatttgttcttttctgcaagaacaggcccaggaggatcggcgcgaacgagattacaccaacctgcccagcagtagccgctccggtggatccggttcttcctccagcgaacttgaagaggagagcagcagcgaacatctcacatgttgcgaacaaggcgatatcgcccagccactcctccaaccaaacaattaccagttttgttag

SEQ ID NO: 112708 - DNA, 1506 bp, Artificial Sequence
  Description of Artificial Sequence: Synthetic coding sequence
atgagacacaccaactactcttttagtccctggcacgggtttactattcatagggccaaattcattcaaagtcaggattatcaatgctctgccttaatggggggaaggaaagtgatgagcatctctattcgcttgaaagtccagaaagtcatcccagggcccccagccttgaccttggtgccggctgagcttgtcaggattcggggtgaggctgcccagatcgtttgctccgctagttcagtggatgtgaactttgatgtgttcctgcagcataataatacaaagctcgccattcctcagcagtcagatttccataataatcggtaccagaaggttctcactctgaacttggaccaggttgacttccaacacgccgggaactactcctgtgtcgcctcaaatgtccagggtaagcacagcacaagcatgtttttccgggtggtcgaatctgcatacttaaacctgtcttctgagcagaatctgatccaagaggtgaccgtaggtgaagggcttaatctgaaggtcatggtggaagcctaccccgggctgcaagggtttaactggacataccttggccccttctctgaccaccagccagaacccaaactggccaacgctacgacaaaagatacatatcggcatacctttactctgtcactgcccagattgaagccaagcgaggctggcaggtacagctttcttgccagaaaccccggtggatggagggcccttacgtttgaacttactttaaggtatccacccgaggtgtccgttatctggactttcatcaatggctcaggcaccctcctgtgtgccgcaagcggctacccacagccaaatgtaacttggctgcagtgctctggacacaccgacaggtgtgatgaggcccaagtgctccaagtctgggatgacccctaccctgaggtactgagccaggagcctttccataaggtgacagtgcaaagccttcttactgtggagactctcgaacataaccagacttacgagtgtcgagcccataattctgttggttctggcagctgggccttcatcccgatctcagcaggggctcacacccatccaccggatgagttcctctttacccccgtcgtggtcgcttgtatgtcaatcatggctctgctcctcctgttgctgcttctgctcttgtacaaatacaagcagaagccaaaataccaggtgcggtggaagataattgaaagctatgagggtaactcctacactttcattgaccccacccaactgccatataacgagaagtgggaattcccacgaaataatctgcaattcggaaagacactcggtgccggagctttcggaaaggtagtcgaggccacagcatttggcctcggtaaagaggatgctgtgctgaaggtggcggttaagatgttgaagtccacagctcacgcggacgaaaaggaagcctccggattgtaccagagcgctgaacagcagcagaagcgctggcagcgacaacagcagcagtag

SEQ ID NO: 112709 - DNA, 2016 bp, Artificial Sequence
  Description of Artificial Sequence: Synthetic coding sequence
atggggcccggggtgttactgctgctcttggtcgcaaccgcctggcacgggcagggcatcccggttatcgaaccttctgtgcctgaactggtggtaaaacccggtgctaccgtcacactacggtgcgtgggcaatggcagcgttgagtgggatggaccgccctcaccacactggaccctgtactccgacggtagctccagcatacttagtaccaacaatgcaaccttccaaaatactggcacctatcgctgtaccgagcctggagatccattgggcggtagcgctgccattcacctatacgtgaaggatccagcccggccctggaacgtgcttgcccaagaggttgtggttttcgaggatcaggacgcgttgctgccctgtctcctaaccgatcccgtgctggaggccggcgtcagtctcgttcgcgttagaggcaggcctttaatgcgacacacaaactactccttttctccttggcatggctttaccatccatagagctaaattcatacagtcccaggattaccagtgctcagcactgatgggcggtaggaaggtgatgtcaatcagcatcaggctcaaagtgcagaaagtgatcccagggccacctgctttgactctggtgcctgcagagctagttcggatcaggggtgaagctgcacagatcgtgtgctcagcttctagtgtagatgtcaactttgatgtctttctgcagcacaataataccaaattggccatcccacagcagagcgacttccataacaatcgataccagaaagtcctgaccctcaatctcgatcaggtggactttcagcacgcaggaaattactcatgtgttgccagcaacgtgcagggcaaacattcaacgtccatgttctttcgcgtcgtggaatccgcctacctcaacctatctagtgaacagaacctcattcaggaagtcacagtgggagaggggttgaacctaaaggtcatggttgaggcttatcctggactccaagggtttaattggacctacctgggccccttctctgaccatcagcctgagccaaaactcgcaaacgcaaccacaaaagacacttatagacatacttttactctttctctaccccggctgaagccatcagaggccggtcgttattcttttttggctcggaaccccggcgggtggcgcgcactgacttttgagctgactctccgctatccaccagaggtcagcgtgatctggactttcatcaacggttccggaactctgctttgcgccgcgagtgggtacccacaacccaacgtgacgtggctccagtgcagcgggcacacagaccgctgcgacgaggcacaggtgctgcaagtctgggatgatccctaccccgaagtcctaagccaggagccttttcacaaagttacagtgcagagcctgttgacagtggagaccctggagcacaatcagacctatgagtgtcgcgcacacaacagcgtggggtccggaagctgggcatttatcccaatctcggcaggagcccatacccaccctcctgacgagttcctgtttacacctgtggtggtggcctgcatgtctattatggccctcctgctgctgctgctgctcttgctcctctataagtataagcagaagccgaaataccaagttcgctggaaaattatagagtcatatgagggaaactcatatacctttattgatccaactcagttgccgtacaacgaaaaatgggaatttccacgcaataacctccaattcggtaaaaccctaggggcaggtgcctttggtaaagtggtagaggcaaccgccttcggtctggggaaggaagacgctgtgctgaaggtggctgtaaaaatgctgaaaagtaccgcccacgcagacgagaaggaggctcttatgtctgagctaaaaatcatgagccacctcggacaacacgagaacatcgtcaacctcttgggagcctgtactcacggtggaacggtggccagccctgccagggtctggacgcccatgtggagatag

SEQ ID NO: 112710 - DNA, 921 bp, Artificial Sequence
  Description of Artificial Sequence: Synthetic coding sequence
atgggccctggtgtgctactcctgctcctggtcgcgactgcttggcacggacagggaattcccgtaatcgaacccagcgttccagaactggtggtcaagccgggagccacagtcacccttcgttgcgtcggtaatggatctgtggagtgggatgggccgccttctcctcactggaccttatactccgatggctcaagtagtattctatccaccaacaacgccaccttccagaacaccggcacctaccgctgcactgagcccggggacccgctggggggatcagccgctatccacctctacgtgaaagatccggctagaccttggaatgtcctcgcccaagaggtggtcgtttttgaagaccaggacgcactgctgccatgtttgctgacagatccagtactggaagctggtgtgagcctcgtgagggtgcgcgggcgaccattgatgcgccataccaattactctttttccccctggcacgggtttaccatccatagagccaagttcattcaatctcaggactaccagtgttccgcattgatgggtggtaggaaggtaatgtccatcagtattcggcttaaggtgcagaaggtgatcccgggacctcctgccctgactctcgtaccggcggaattggttagaattcggggagaagcggcccaaatcgtttgttcggccagtagtgtggacgttaatttcgacgtcttcctgcagcacaacaacactaagctagctattcctcagcagtccgacttccataacaaccggtaccagaaggtgctgactctcaacttggaccaggtggatttccagcacgcaggtaattacagctgtgttgcatctaatgttcaaggaaaacactcaactagtatgttcttcagagtcgtcggaaccccttccccgtcattgtgtccggcgtag

SEQ ID NO: 112711 - DNA, 1134 bp, Artificial Sequence
  Description of Artificial Sequence: Synthetic coding sequence
atgcttttactcgtgaccagcttgctcctgtgtgaactgccacatcctgctttcctcctgattccagaaaagtccgacctgaggaccgtagcacccgctagcagtcttaatgtgcggttcgactctaggactatgaatctctcatgggactgtcaggagaatacaacctttagcaagtgcttcctaaccgataaaaagaacagagtggtggaaccgcgactctcgaacaatgaatgtagctgcacattcagagaaatttgtctccacgagggtgtgacctttgaagtgcatgtaaacacatcgcagcgaggtttccagcagaagctgctctaccccaacagtggccgtgaaggaaccgctgcccaaaattttagttgcttcatctacaatgcagacctaatgaattgtacttgggcccgcgggccaaccgcacctcgtgatgtgcagtacttcctctacattcgcaactcaaagagaaggcgcgagatacgttgtccctactatatccaagacagtggcacccatgtaggatgccacctcgacaacctctcaggactcacttccaggaactacttcttggtgaacggtaccagccgcgagatcggtattcagtttttcgacagtcttttggatactaaaaagatcgagcgctttaaccctccctctaacgtaactgtcagatgtaataccacccattgcctcgtacgctggaaacagcccaggacataccaaaagctgtcatacttagatttccaatatcagctggacgtgcatcggaaaaatacccagcccggaaccgagaatcttctaataaatgtctcaggcgacctggagaatcggtacaactttccttcctccgagccaagggcgaagcattcagtaaagatacgagcagcggacgtaagaatcctgaactggtcctcctggagtgaagctatcgagttcgaccaccttggtggcatacatccacgcggcagggaaaggcttccgagacgtggcttggaccgggaaggcaactacctaaggccacgtgggtgccgcaacggaatggatatctctgcttccgccacccggggtaactgttttttggacgacgcggtgaatttgtacatcatcttttacgtgttcatctag

SEQ ID NO: 112712 - DNA, 702 bp, Artificial Sequence
  Description of Artificial Sequence: Synthetic coding sequence
atgctccttctggtaactagtctcttgctgtgcgagctgccgcaccccgccttcttgctgatcccagaaaaatccgaccttcggactgtagccccagctagttctctgaacgtgagattcgattccagaacaatgaacctgtcctgggactgccaggagaacactaccttcagtaaatgttttctgacagataagaagaaccgggtggtcgagcctagactgtcgaacaatgagtgttcttgcacgttcagagagatttgtctacacgagggggtgactttcgaagtccacgtcaatacaagccagcgtggctttcagcagaaactcctgtacccaaactcgggaagagaagggacggctgcccaaaatttttcatgtttcatttataacgccgatttaatgaactgcacctgggcccggggccccacagcccctagggatgtccagtacttcctgtatattaggaactcaaaaagacggcgggaaatcaggtgcccttactacatacaagactccggcactcacgtcgggtgtcacctggacaacctctccggactgacatcccgcaactatttcctggtgaacggtacctcccgcgagattggcatccaatttttcgatagcctgctcgatacaaaaaaaattggctccttgggctactcgggatgttcccgccagtttcatcgctccaaaacgaactag

SEQ ID NO: 112713 - DNA, 1002 bp, Artificial Sequence
  Description of Artificial Sequence: Synthetic coding sequence
atgctgctgctggtaacttcgctgcttctgtgcgagttaccccatcctgcctttctcctgattcctgagaagagcgacctcagaactgtcgcccctgcctctagtttgaacgttcggttcgactcgcgtaccatgaacctgtcttgggattgtcaggaaaataccacattctcaaagtgtttcttgacagataagaagaaccgtgtggtggagccacggctgtctaataacgaatgttcttgcaccttcagagagatctgcttgcacgagggagtgactttcgaggtgcacgtgaataccagtcaaaggggtttccaacagaagctgttgtatccaaactccgggagagaaggtacagctgctcagaatttttcctgtttcatctataacgctgatctcatgaattgtacctgggccagggggcctacagccccacgtgatgtgcagtactttctttacatccggaacagtaagagaagacgggagatcaggtgcccgtattacattcaggattctggtacgcacgtcggttgtcacttggataatttaagcgggcttactagcaggaattacttcctggtgaatggtaccagccgggaaatcggcatccagttcttcgatagtctgctggacacaaagaaaatagagagattcaatccgccttccaacgtcactgtgaggtgcaacactacacactgtctggtgagatggaaacaacccagaacctaccagaagctgagttatctcgattttcagtaccaactcgacgttcatcgaaagaatacacagcctggcacagaaaatcttcttatcaatgtgtcaggcgacctggagaacagatataactttccatccagcgagccaagggctaaacatagcgtgaagattagggctgccgacgtgcgcattctgaactggtcatcctggagcgaggctatcgagtttgggtcactgggatactccgggtgctctcgccagttccatagaagcaagacaaattag

SEQ ID NO: 112714 - DNA, 1002 bp, Artificial Sequence
  Description of Artificial Sequence: Synthetic coding sequence
atgctactcttggtgacatcgcttctgctttgtgagctgcctcatcccgcatttctgttgattccagaaaaatctgatctgcgcaccgtagcccccgcatcatctctcaatgtgcgattcgactccaggacaatgaatctgagttgggactgccaagagaataccacattttctaagtgttttttaactgacaagaaaaaccgcgttgttgagccacgcctctcgaataacgagtgctcctgtactttcagagaaatctgcctgcatgaaggcgtaactttcgaggtccatgtgaacacctctcagcggggcttccagcaaaaactcctgtatccgaactctgggagagaaggaaccgcagcccagaacttctcgtgtttcatttataatgcggacctcatgaactgcacatgggccagaggtcctaccgctcctagagacgtccagtattttctgtatatcaggaacagcaagaggaggcgcgaaatcaggtgtccctattacatacaggattcagggactcatgtgggctgtcacctcgataacttgagtgggctcacatcacgaaactatttccttgtgaacggcaccagtagggaaatcggcattcagttctttgactctctcttggacaccaaaaagatagagagattcaatccgccgtcaaacgtgactgttaggtgtaacaccactcactgtctggtcaggtggaaacagcctcgcacctaccagaagctctcttatctggacttccagtaccagctcgatgtacatcgcaagaacactcagcccgggaccgaaaacttgctgatcaacgtgagtggtgacctcgagaacagatacaatttccccagcagcgagcctagggccaagcactctgtgaagatccgcgcagccgacgtgagaattcttaactggagttcatggtctgaggctatcgagtttgggagcctcgggtacagcggctgttccagacagttccacagatcaaagaccaactag

SEQ ID NO: 112715 - DNA, 861 bp, Artificial Sequence
  Description of Artificial Sequence: Synthetic coding sequence
atgctgctgctggtcacatctctactgctctgcgaactcccacatccagcttttcttctgatcccagagaaatcagacctgcggaccgtcgcaccagccagctccctgaatgtcaggttcgattctcgaacgatgaacttatcgtgggactgccaggaaaatacaacattctctaagtgttttttaactgacaagaaaaatcgcgtggtcgagcccagattaagcaacaacgaatgttcatgtacttttcgtgagatttgcctccacgaaggggtcacttttgaggttcatgttaacactagccagagagggtttcagcagaagctgctgtaccccaattcaggtcgggagggtaccgcagcccagaatttctcttgcttcatttacaatgctgatctgatgaactgtacgtgggctcgaggccctaccgcccctagggacgtgcagtacttcttatacatccgcaattctaagagaagacgggagattagatgcccttactacattcaagactcaggtacgcacgttggctgccatctcgataatctgagcggcctcacttcccggaactatttccttgtcaacgggacatcgcgcgagatcgggatccaattctttgatagtctcctggacaccaagaagatcgaacgatttaatcctccatccaatgtaaccgtgcgatgtaacaccacgcattgcctggttcgatggaagcagcctcggacttatcagaaactgtcttaccttgatttccaataccagctggacgtacatcggaaaaacactcaaccgggcactgaaaacctcctggtagttctgaccaccggcacctccgccttatgcacctttatgtgcagctag

SEQ ID NO: 112716 - DNA, 1233 bp, Artificial Sequence
  Description of Artificial Sequence: Synthetic coding sequence
atgctgctgcttgtgacttcactgctgctctgcgagctgcctcaccccgcctttctcttgatcccagaaaagagtgatctcagaacagtggcgccagcttctagcctgaatgtccggttcgatagcaggaccatgaacctgagttgggactgccaggagaacaccaccttcagtaagtgcttcctgacggacaagaaaaatagagttgttgagcctagacttagcaacaacgaatgctcttgtaccttccgcgaaatctgcttacatgagggggttaccttcgaggtccacgtgaacacgtcacaacgaggcttccaacagaaattattatacccgaattcaggtcgagagggcacagctgcccagaatttttcatgttttatttacaatgctgaccttatgaattgcacgtgggccaggggaccaactgccccgcgggacgtacagtactttctgtatatcagaaactcaaagcgccggcgcgagatacgctgtccttactacatccaggatagcggcacccacgtcgggtgccatttggacaacctgagcggtctgaccagccggaactatttcctggttaacggaacatcacgagagataggcatacaattcttcgacagcttgctggacacaaagaaaattgaaagatttaaccccccaagcaacgttaccgtacgctgtaataccacccattgtcttgttcggtggaaacagccccggacttaccagaagctgagttacttggacttccagtaccaactggacgtgcacagaaaaaatacacaacctggcaccgaaaatctgctgataaatgtgagcggcgatctggaaaaccgctataactttcctagctccgagcctcgagctaaacatagcgtaaagataagagctgcggacgtccgtattctgaactggtcttcctggtctgaggctatcgagttcggatccgacgatggtaacttaggttcagtttatatttatgtgcttcttatcgtgggaacacttgtatgcgggatagtgttgggattcttattcaagcgtttcctgcggatccagcgacttttccctcccgtccctcagataaaagacaaactgaacgacaatcacgaggtggaggatgaaatgggaccacagcggcaccatagatgtggctggaatctatatccaacccccggtcccagtccaggctcagggtcttccccccgtctcgggtctgaatcatccctctag

SEQ ID NO: 112717 - DNA, 1203 bp, Artificial Sequence
  Description of Artificial Sequence: Synthetic coding sequence
atgctgttgctcgttactagcctgctgctgtgtgagcttccccacccggcattcctgctgatcccagagaagtctgacctgcggactgtcgcgccggctagttcgctgaacgtcagattcgattcccgtaccatgaatttgtcctgggactgtcaggagaacacgacttttagcaagtgtttcctgacggataaaaagaaccgagtcgtcgagcccaggttgtccaataacgaatgtagctgtacatttagagagatatgtctgcacgagggagtcactttcgaggtgcacgtgaatacttcccagcgagggttccagcagaagctcctctacccgaacagcggccgcgaagggaccgcggcgcagaatttcagttgtttcatttacaatgccgatctgatgaactgtacgtgggcccgcggacccacagcccctcgggacgtgcagtacttcctttatatccgcaattcaaagcgccggagggaaatacggtgcccttattatatacaggacagtggcactcacgtgggatgtcaccttgataacctgagtgggctcacgtcccgcaattacttcctggttaacggtacctcacgcgagatcggcattcagttctttgacagcctccttgatactaagaagatcgagaggtttaaccctccgagcaacgtaaccgtgaggtgcaatacaacgcactgcttggttagatggaagcagccacggacttatcagaagctgagctatcttgatttccagtatcagcttgacgttcaccgtaagaatactcagcccggcacggaaaacctactaatcaacgtgtcgggggacttggaaaaccgttataacttcccatcttcagagccacgggccaaacacagtgttaagattagagctgcggacgtgagaatcctgaattggtccagctggtcagaagccatcgagttcgggtctgacgacggaaacctgggcagcgtgtacatatacgtcttgctgatcgtcggaacgctcgtatgcggtatcgttctggggtttctgttcaaacggtttttacgcatccagcgcctttttcctccagttccacagataaaagacaaactgaatgacaaccacgaggtggaggacgaaatcatatgggaagagttcacacctgaggagggaaagggatatcgggaggaagtactgaccgtcaaggagatcacctag

SEQ ID NO: 112718 - DNA, 1203 bp, Artificial Sequence
  Description of Artificial Sequence: Synthetic coding sequence
atgttgctgttagttacctcacttttgctgtgtgagttgccacatcctgcatttcttttaatccctgaaaagtcagatcttcggaccgtcgcccctgcctcctccctgaatgtgcggttcgacagccgcacgatgaacctaagttgggattgccaggagaacaccaccttctccaagtgctttctcacggataagaaaaacagagtggtcgagcccaggctgtcaaacaacgaatgttcatgcacattccgcgagatttgtctgcatgaaggtgtgactttcgaggtacacgtgaatacatctcagaggggattccaacagaaactgctgtacccgaactcgggaagagaagggacggccgctcaaaatttttcctgttttatctacaatgctgacttgatgaactgcacctgggcgagggggcccacggctcctagagatgtgcagtacttcctttatatccgcaattctaaaaggcgccgagagattaggtgtccctactacatacaggattcaggcactcacgtcggctgccacctggacaatctttctggattgacatcccggaactattttctggtgaacggcacgtcccgagaaattggtatacagttcttcgatagcctgctggacaccaaaaagatcgaacggttcaacccaccaagcaacgtaacagtgcgttgcaatactactcattgccttgtacgatggaaacaaccaagaacttatcagaagctctcttacttggactttcagtaccagctggatgttcaccgcaaaaacactcagccaggaaccgaaaatctgctcatcaatgtcagtggggaccttgagaacagatacaacttcccgagctcagagcctcgggccaagcatagtgtaaagatccgagcagccgatgtgagaatattgaattggtcctcctggagtgaggccattgagtttggtagtgacgacgggaatctgggaagcgtctatatctacgtcctcctcatcgtgggcacactggtctgtggtatcgtcctggggtttttgttcaagcgattcctaaggattcagaggctctttcctcctgtgccgcagattaaggacaagttaaacgacaaccacgaggtcgaagacgagatcatctgggaagagtttacgcctgaggagggcaaggggtaccgtgaagaggttttgaccgtgaaggaaatcacgtag

SEQ ID NO: 112719 - DNA, 717 bp, Artificial Sequence
  Description of Artificial Sequence: Synthetic coding sequence
atgttgctcttagtgacaagcctactgctatgcgagctccctcatcccgctttcctcctaatcccagagaagagtgacctgcggacagttgctccagcctctagtttgaatgtgcgttttgattcaagaacaatgaatctgtcatgggactgccaggagaacactactttcagtaagtgctttttaacagataagaagaatcgagttgtggagcctcggctgagtaacaatgagtgcagttgcacgtttcgagaaatttgcctccatgagggcgtcacattcgaagtgcatgtgaatacctcccagagggggttccagcagaaattgctgtatcccaatagcggaagagaggggacagctgctcagaatttttcttgtttcatctacaatgccgaccttatgaattgtacctgggcaagaggcccaactgcccctagggacgtccagtacttcctctacattcggaattccaaacgtagacgggaaatccgctgcccctattatatccaggactctggaacccacgtgggttgtcacttagacaacctgtccgggctgaccagtcgtaactatttcctggtgaacggaaccagtagagagatcggcattcagttctttgactccctgctagacacaaagaagattgagcgatttaatccgccttccaacgtgactgtccgctgcaacactacccattgtttggtgaggtggaaatag

SEQ ID NO: 112720 - DNA, 1305 bp, Artificial Sequence
  Description of Artificial Sequence: Synthetic coding sequence
atgcttttgttggttaccagtctcttactctgcgagcttccgcaccccgcgttcctgctgatccctgaaaaaagtgatctaaggacagtagctcccgcatcctccctgaacgtgcgctttgacagccgaaccatgaatctgtcatgggattgccaagaaaacacaacctttagcaagtgcttcctgaccgataagaagaatcgagtcgtggagccaagattgtccaataacgaatgctcctgtacgtttagggaaatttgtttgcacgaaggtgtcacgttcgaggttcacgtaaacaccagccagcgtggcttccaacagaaactgctgtacccaaactcaggacgtgaaggcactgctgctcagaatttctcctgtttcatctataatgccgacctgatgaattgtacatgggccaggggtcccactgctcctagggatgtgcagtacttcctctatattcgaaacagcaagcggcgacgtgaaatacggtgtccctattacatccaggatagtggtacacacgttgggtgtcacttggacaatctgagcggcctaacgagccgcaactacttcctggtcaatggtaccagtagagagatcgggatccagtttttcgacagtctgttggatacaaagaaaattgagcggtttaaccccccgtctaatgtgacagtgaggtgcaatactactcactgcttggtgcggtggaagcagcctagaacctaccagaagctgagttatctggactttcagtaccaactggatgtgcatcgaaaaaatacccagccaggcactgagaatctcttgatcaatgtctcgggcgaccttgagaataggtataatttcccttccagcgaacctcgggctaaacactcagtgaaaatacgcgcagctgacgtgagaatcctgaactggtcctcctggagtgaggctattgaatttgggagccactctgtgacccaggctggcgtgcagtggcacaacctcggctccctccaacctccatcaccccgacttaagcggttttcatgtttgagactccccgggtccgacgacggcaacctcggctcagtatatatctacgttctactcattgtcggcaccctcgtgtgcgggatcgtgctgggcttccttttcaaaaggtttttgagaattcagagattatttcctccagttcctcaaattaaagataagctgaatgataatcacgaagtggaagacgagatcatctgggaggaattcaccccagaggagggaaagggatatcgagaggaagtgttaacagttaaggagatcacctag

SEQ ID NO: 112721 - DNA, 567 bp, Artificial Sequence
  Description of Artificial Sequence: Synthetic coding sequence
atgttgctgctcgtcacgtctctgctcctttgcgaacttcctcatccagccttcttacttatcccagagaagagcgacctgagaacggtcgcccctgccagttccttgaatgtcagatttgatagcaggactatgaacctctcctgggactgccaagagaacaccactttctcaaagtgttttcttacagacaagaaaaaccgagtggtggaaccacgactatcaaataacgaatgttcctgtacattccgagagatctgcctgcacgaaggtgtaacctttgaagttcacgtgaatacatcacaaagggggtttcagcagaagctgctgtacccaaactcgggaagagaggggaccgccgcccagaatttctcctgcttcatatacaatgccgacctgatgaattgtacttgggctcgaggtccaacggcaccaagagatgtccaatacttcctatacatccgcaatagcaaacgaagacgggaaataaggtgtccgtattacatccaggattccgggactcacgttggttgtcaccttgataatttgtctgggctgacctcttag

SEQ ID NO: 112722 - DNA, 1203 bp, Artificial Sequence
  Description of Artificial Sequence: Synthetic coding sequence
atgttgctgctggtgacaagcctgctgctctgtgaactgcctcacccggccttcctgctgatcccagaaaagtctgacctccgaaccgtggcacccgctagcagcttgaacgtcagatttgactcccggaccatgaatctctcctgggactgccaggagaacactaccttttctaagtgtttcctgacagacaagaaaaaccgcgtggtcgagccccgcttgagcaataatgagtgttcctgtacttttcgtgaaatttgcctgcacgagggcgttactttcgaggtccacgtcaatacctcacaacgggggttccagcagaagctgctgtatccgaactccggcagggaaggtacggctgctcagaactttagttgctttatctataatgccgacctgatgaactgcacttgggcgcgtgggccgacagcaccccgggatgttcagtatttcctgtacataagaaattcgaaaagaagaagggaaattagatgcccgtactatatacaggacagtggaacccacgtgggctgccaccttgataatcttagcgggttaacatcccggaattatttcctggtgaacggcacctcaagggaaatcggcatccagttctttgacagcttactcgacacaaaaaagattgaaagattcaatcctccttccaacgtgactgtgaggtgcaataccacacactgtttagtacggtggaaacagccaagaacgtaccaaaagctttcatacttagacttccagtatcaattggacgttcatagaaagaatacacagcctggcaccgaaaatctcctcatcaacgtttccggcgaccttgagaataggtacaatttcccatcttccgagcctcgggctaagcacagtgtgaagattcgtgctgccgacgtcagaattttgaactggagcagctggtccgaggccatcgaattcgggagcgacgacggcaacctgggttcggtttacatttatgtgttactgatcgtgggaaccttagtgtgcggcattgtgctaggcttcctgttcaagcggttcctcagaatccagaggctcttcccccccgtcccccagataaaggataagcttaacgacaatcatgaagttgaggacgagattatctgggaggaattcaccccagaagaggggaaagggtatagggaagaggtgttgacagtgaaagagatcacctag

SEQ ID NO: 112723 - DNA, 804 bp, Artificial Sequence
  Description of Artificial Sequence: Synthetic coding sequence
atgaactgcacgtgggcgcgggggcccacggcccctagggatgttcaatattttctgtacattcgtaacagtaaacgaaggagagagatccgttgtccctactatattcaagacagcggcacacatgtaggatgtcatctggataacctgtcgggactcacttcacgaaattactttttggtcaacggaacttctcgcgagatagggattcagttcttcgattcattgctagacaccaaaaagattgaacgctttaatcccccgtcaaacgtgaccgtaagatgtaatacaactcattgcttggtccggtggaaacagccacgaacctatcagaagcttagttacctagacttccagtaccagctggatgttcatagaaagaacacgcaacccggaacagagaacctcctgataaatgtgtccggggacttggaaaatcgatacaacttcccctcttcagagccacgggctaagcactctgttaaaatacgcgccgccgacgtgcggatcctgaattggagttcttggagcgaagccatcgagttcggttctgatgacggaaatctcggtagtgtgtacatttacgttctgttgattgtgggaacactcgtgtgtggtattgtactgggcttcctgtttaagagattcctgagaatacagaggttgtttccacccgttccccagattaaggacaaattaaatgacaatcacgaagtggaggacgaaatcatctgggaggaatttacgcccgaagagggcaaaggctatagagaggaagtcctgaccgtcaaagagattacttag

SEQ ID NO: 112724 - DNA, 2712 bp, Artificial Sequence
  Description of Artificial Sequence: Synthetic coding sequence
atggtgctcgcacagggtctgctgtctatggctctcctcgcactttgctgggagagatcgttggcaggggctgaagaaaccatcccattgcagacactgaggtgttacaacgattataccagccatatcacttgtaggtgggcggatacacaggatgcccagcgcctggtgaacgtcacgctgatacgtagggtgaacgaggacctgcttgagccagtctcatgtgacttgtccgatgatatgccttggtccgcctgcccccacccacgctgcgtcccccggcggtgcgtgataccctgccagagcttcgtggtgacagatgtcgactatttctcattccagccagaccgcccccttggcacaaggttgacagtcacactcacacagcatgtccaaccaccggagcctcgagacctgcagattagtacagaccaggaccatttcctcttgacctggtccgtcgctctcggtagtccacaatcccattggttgtcaccgggggatcttgagttcgaagtagtctacaagcggctgcaggactcttgggaagatgctgccatcctgctgtctaacacatcgcaggccactctgggtcccgaacatttgatgccttcttccacatatgtggccagagtgcggacgcggctggcaccaggatcacggttatctggccgccccagcaagtggagccccgaagtttgctgggacagccagccgggagatgaagcccagccccagaatctggagtgttttttcgatggcgcagccgtactttcttgttcttgggaagtccgcaaggaggtggcctcctctgtatctttcggtctcttctacaaaccatccccagatgcgggatctgcagtgctgttacgcgaagaggagtgtagcccggtcctcagagagggcctggggtctctgcacactcggcaccactgtcagattcccgtgcccgacccagccactcatggccaatacatagtttcagttcagccacgaagggccgagaaacatattaagtcatccgtcaatattcaaatggctcctccctccttgaacgttaccaaggatggggatagttactccttgaggtgggaaactatgaaaatgcgctatgagcatattgatcacacatttgaaattcaataccggaaggacaccgctacttggaaggacagcaagacagaaacccttcaaaacgcccacagcatggcacttccagccctggaaccaagtactcgctattgggctagggtgcgggttaggacatccagaaccggatacaacggaatctggtccgagtggtctgaggcacgtagttgggatacagaatcggtcctcccaatgtgggtgcttgcactcattgtcatttttctgacgatcgctgttcttcttgcactgagattttgtggaatttatggttatcgtctaagacggaagtgggaggaaaaaataccaaaccccagtaaaagtcacctttttcagaatggaagtgctgaattatggcccccaggaagcatgtcagcattcactagtggatctccaccccatcaaggaccatggggtagccgttttcctgagctcgagggagtttttcctgtggggttcggggatagcgaagtcagtccactcacaattgaagacccaaaacacgtgtgtgaccctcccagcggcccagatacaacaccagccgcctcagaccttccaacggaacagccaccgtccccccaacctggcccgcctgcggcctctcatacaccggagaaacaggctagttctttcgactttaacggaccatacctcggtcccccgcacagtcgaagcttaccagatatactgggccagccagaacctccgcaggaaggtggtagccagaaatctccgcctcctgggtcccttgagtacctatgtcttccggccggtggccaggtgcaattggttcccctggcacaggctatgggccctgggcaggccgtggaggtggaacgtcgtccgtctcagggcgctgcgggatctcccagtctggagtccggcggaggcccagccccaccagccctgggccccagagtgggaggccaggaccagaaagactctcccgtcgccattcctatgtcctctggtgatacagaagaccctggggtggcatccggctacgtgtccagcgcagatctggtcttcacccctaatagtggggcgtcctcagtttctttggtgcccagcctcggcttgccatccgaccagacgccaagcctgtgtccagggttagcttcagggcctccaggcgcgcccggacccgtgaaatccggttttgaagggtacgtcgaactgcccccaatcgaagggaggagcccaaggtcccctagaaataacccagtccctccggaggcaaaaagccctgttctcaaccctggggagcgaccggccgatgtgtcgccaacaagtcctcaacccgaggggctgttggttctgcaacaagttggagactactgcttcttgcctggtctgggacctgggccactgtcccttcgctccaagccttcgagccccgggcctggtcccgagattaagaatttggaccaggcctttcaggtgaaaaagccaccaggccaggctgtgccgcaggttcccgtgatccagctcttcaaagcacttaagcaacaagactatctcagtcttcctccttgggaggtcaacaagcccggggaggtctgctag

SEQ ID NO: 112725 - DNA, 2694 bp, Artificial Sequence
  Description of Artificial Sequence: Synthetic coding sequence
atggtcctggctcagggactcctttccatggccctgctggccctgtgttgggagcgatccctggcgggcgcagaggagactatccctctgcaaacactccggtgctataacgactatacaagtcacatcacgtgcaggtgggctgatacacaggatgcccagagactcgtgaacgtgaccttgatcagacgcgttaacgaggatttgttggaacccgtaagctgcgacttgtccgatgatatgccctggtctgcctgccctcacccacggtgcgtacccagaaggtgtgtgatcccctgtcaatcatttgtggtcacagatgtcgactacttttctttccagcccgatagacccttaggcactcgtcttaccgtcaccctgacacagcacgttcaacctcctgagccgcgagatcttcagatcagtacggatcaagaccactttctgttgacatggtcagtggcattgggctcccctcagagccactggctctctcctggggaccttgaattcgaagtggtgtacaagcgcctccaggattcctgggaagacgctgctattctgctgtcaaatacatctcaagcaacactcggccccgagcatctcatgccctctagcacttacgtggcccgcgtcaggacgcggctggcccccggatcccggttaagcggtcgcccatctaagtggagtccagaggtgtgctgggattctcaacccggggatgaagctcagcctcagaacttggaatgcttcttcgatggggctgccgtccttagctgcagttgggaggtgcggaaggaagtcgcttcatccgtatcttttggcttgttctacaagccctccccggacgccggggaggaagagtgcagccctgtgctgcgggaagggctcggctccctgcacactcgccaccactgccagataccagttcctgaccctgccacgcatggtcagtatattgtgagtgtccagccccggagggcagaaaagcacattaagtcgtctgtgaatattcaaatggcccctccgtcgctgaacgtgacgaaagatggggactcttattccctgcggtgggagacaatgaagatgcgatacgagcatatcgaccacacctttgagatacagtatcggaaggacacagccacatggaaggactcgaagactgagactttacagaatgcgcatagtatggccttgcccgctctggaaccaagcaccaggtattgggcacgcgtccgggtgcggacctcgcgcaccggctataatggcatttggtccgagtggtccgaggccagatcttgggacacggagtccgtcctccctatgtgggtactggcactgattgtgattttcctcacaattgctgttctgcttgcactgcgcttctgtggcatttatgggtatcgactgcgcaggaaatgggaggagaaaattccaaaccccagcaagtcacacttgtttcagaatggctccgccgaactttggccaccggggagcatgagcgcattcacaagcgggtcccctccccaccaaggcccttggggcagcagatttcccgagcttgagggggtatttccagtgggcttcggcgatagcgaagtctcaccgctgaccattgaagatccaaagcacgtctgcgatcccccctcagggcccgataccacgcccgctgcatctgaccttccaacagaacagccccccagcccacagccgggccccccagctgccagccacacaccagagaagcaggcctccagcttcgactttaatggaccatacctcggaccccctcattctagaagtctgcccgatatcctcggccagcccgaacctccgcaagagggcggaagccagaagtctcctccacccggctcactggagtacttgtgcctgccggccggcggccaggtccaactcgtgcctttggcccaggccatggggcccggacaggccgttgaggtagaacgccggccttcccagggagccgcgggcagtccgtcactggaatctggcggcgggccggctccccccgccctcggcccaagagtgggaggacaggaccagaaagacagtccagtggcaattccaatgtccagtggcgatacagaagatcccggcgtcgcctcagggtatgtgtcctctgccgacctcgttttcacccccaattcaggagctagtagcgtgagtttggttccatctctcggactgccatccgatcagactcccagcctttgcccgggccttgcatcagggcccccaggtgctcccggcccggtgaagtccggttttgaaggatatgtcgagctacccccaattgaaggccgctctcctagaagcccaagaaacaaccccgttccccctgaagccaaaagccccgtgctaaatccgggggagcgccccgcggacgtgtctcccacttcccctcaacctgaagggctgctggtgctgcagcaagtaggtgactattgctttttgccagggctaggcccgggtccattatctctcagaagtaaaccatccagtcccggacccggacccgagataaaaaatctggatcaggcctttcaggtgaagaagcccccaggccaggccgtgccccaggtaccagtaattcagctttttaaggccctgaagcagcaggactacctgtccctgccgccttgggaagttaacaagccgggcgaagtgtgttag

SEQ ID NO: 112726 - DNA, 690 bp, Artificial Sequence
  Description of Artificial Sequence: Synthetic coding sequence
atgccctggagcgcatgtccacatcctcggtgcgttccgcgaaggtgcgtaatcccgtgtcagtcttttgtagttacagacgttgattacttctcttttcagccagaccgccccctgggcacccgacttaccgttacattgacacagcacgtccagcccccagaacctcgcgatcttcagatctctacagatcaggatcacttccttctgacctggtctgtagcactggggtctccacagtcccactggctgtccccaggagacttggaattcgaagtggtgtataaaagattacaggacagctgggaagacgctgccattttgctcagcaacacctctcaggctaccttgggacctgagcacctcatgccctcaagcacatacgtcgctcgcgttcgcacccgcctcgcgcctggctcccgattgagtgggcgaccatcaaagtggagccccgaagtgtgttgggattcccagccgggcgacgaagctcagccccagaatctcgaatgttttttcgacggagccgctgttctctcttgcagttgggaggtgagaaaggaggttgcaagctctgtctcattcggtttgttttacaagccatcacctgatgcaggggaagaggagtgctcccccgtgctgagggagggcctgggttctttgcataccaggcaccactgtcagattccttag

SEQ ID NO: 112727 - DNA, 2535 bp, Artificial Sequence
  Description of Artificial Sequence: Synthetic coding sequence
atggggaagctcagaccgtggcgtgacctgctggagcctgtctcttgcgatctgagtgacgatatgccgtggagcgcctgcccccatccccggtgcgtccccagaaggtgcgtgattccctgtcaaagctttgtcgtgaccgatgttgattacttcagctttcagcctgaccgtcccctgggcacaaggttgacagtaactctaacacagcatgttcaaccaccagaacctagagacctccaaatttctaccgatcaagaccattttctgctgacctggagcgtggccttgggctctccacagtcccattggctttctccaggagatctggagtttgaggttgtctataagcggctccaggactcttgggaggacgcagccatcctactgagcaatacctcccaagctacgctggggcctgaacacctcatgccctcatctacatatgtcgctagagtgcgaacaagactagcaccaggctcccggctgtcaggcagaccttctaagtggagtccagaggtgtgctgggactctcagcccggcgacgaggctcaaccacagaacctggaatgcttcttcgatggcgccgcggtgctgtcctgttcatgggaggtcaggaaagaagtggcttcttctgtgtcctttggcctcttttacaagccctctcccgatgctggttcagccgtgcttctgagagaggaagaatgctcgcccgtactccgggagggactgggctcattacacacgaggcatcattgtcagattccagtgccggatcccgccactcacggtcagtacatagtatctgtccagccccggcgggctgaaaagcacatcaagagtagtgtgaatattcagatggctcccccctctctcaacgttactaaggacggcgacagttacagtctgaggtgggaaactatgaagatgcgttacgaacacattgatcatacgttcgagatccagtatcgcaaggacacagctacatggaaggattcaaagacggagactttgcagaacgcccatagtatggcactccctgcgctggagccctctacaagatactgggccagggtgcgggtacggacctcccggaccggctacaacggcatctggtcagagtggtctgaggcccgttcttgggacacagagagcgtactccctatgtgggtactggccctcatcgtgatatttttgacaattgccgttctcctggcgcttagattttgcggcatttatggttatcgactgcggaggaaatgggaggagaagatacccaacccttccaaaagtcatctgttccagaacggaagtgccgaactctggccccctggctctatgtccgcattcaccagcggctctccgccccaccagggtccatggggatcacgatttcccgagctggagggcgttttccctgtgggtttcggtgattcagaggtgagtcctctgacgattgaagaccccaagcatgtctgtgatccccctagtggacccgacacgacacctgcagcatcggatctgcctactgagcagccaccaagtccacagccaggccctcctgccgcgtcacacacaccggagaaacaggcctcatctttcgactttaatggcccatacctgggtcctcctcatagtagaagtctgccggatatcctcggccagcccgaaccacctcaagaaggcgggtcccaaaagagtcccccccccgggtccctggaatacctgtgtctgcccgccggtgggcaagtgcaattagttcccctggcacaggccatgggtccaggacaggcagtggaagtcgaacggcgcccaagccagggggcagctggcagccccagtctagagtcaggcggtgggccggccccgcctgctttggggccaagggtgggaggccaggaccaaaaggatagtccggtcgccatacccatgagtagcggtgatacagaggaccccggcgttgcgtctggctatgtatccagtgctgatctggtgttcacaccaaacagcggggctagtagtgtcagcctcgtgcccagtcttggcctgccatccgatcagaccccatccctgtgtcccggcctagctagcggcccccccggcgcccctggaccagtcaagagcggatttgagggctacgtggagctccctcccatcgagggaaggtccccacggtccccccgaaacaaccccgtgcctccagaggcaaagtcccccgtcctgaatcccggagagcgccctgcagacgtttcaccaacatctccacagcccgaggggctccttgtgctgcagcaagtcggggattattgctttttgcccggcctggggccgggacccctcagcctgcgttctaagccatcctcgcccggcccagggcccgaaattaaaaatcttgaccaggcatttcaggtgaagaaaccaccaggccaggctgtccctcaggttcccgtgattcagctttttaaagcactgaagcagcaggattatttatccctgcctccttgggaggtgaacaaaccaggagaagtctgttag

SEQ ID NO: 112728 - DNA, 2670 bp, Artificial Sequence
  Description of Artificial Sequence: Synthetic coding sequence
atggtgctcgcacaaggtctcctgagcatggccctgctggctctgtgctgggagcgtagcctggctggggctgaagagacaattcccttacaaacgcttagatgctacaacgactacaccagccatataacatgcagatgggcagatactcaggatgcccaacgtttagtaaatgttacactgatacggcgggtgaacgaggacttactggaacctgtgtcttgcgacctctcagacgatatgccctggtctgcctgccctcacccaagatgtgtccctcgccgctgcgtgatcccctgccaatccttcgttgtcactgacgtcgactacttcagcttccagcctgacaggccattggggacgcggctcacagtgacgctgactcagcacgtccagcccccggaacccagagacttgcaaatctcaaccgaccaagaccactttctgctcacctggtccgtggccctgggatcacctcagtcgcattggctgagtcccggagatctggagttcgaggttgtgtacaaaaggctgcaagatagctgggaggatgccgccatcttattgagcaacactagtcaggcaactttggggccggagcatctcatgccgtctagcacctacgtggcaagggtgaggactcgtctcgctccagggtctcggctatctggtaggcccagcaagtggtccccagaggtttgctgggattcccagcccggcgacgaagcacaacctcagaacctggagtgtttcttcgacggcgccgcggtgctctcgtgcagctgggaagtgcggaaggaggttgcctcatcggtctcatttggcttgttctacaaaccctcaccagacgctggcgaagaggagtgctccccagtcctccgtgagggcctgggttccctgcacactaggcatcattgtcaaatccccgtacctgatccagctacccacggtcagtacatcgtgagcgttcagccgcggcgtgcggagaagcacataaagtctagcgtgaacattcaaatggctccccccagtctgaacgttactaaggatggggactcttatagcctgcggtgggagacaatgaaaatgcgttacgagcacatcgaccatacgttcgagatccaataccgcaaagacacagctacctggaaggactctaaaactgagacccttcagaacgctcacagtatggcgctcccagccttggagccgtccactaggtattgggcaagggtgcgcgttaggacctctagaaccgggtataacgggatctggtcagagtggtccgaggccaggtcctgggacaccgagagcgttctgcccatgtgggtccttgctctgatcgtaattttcctgaccatagccgtgctgctcgcccttcgattctgcgggatctacggctacaggctgcggaggaagtgggaggaaaagatcccgaatcctagcaaatcgcacttgttccaaaacgggagcgccgagttatggccacccggcagcatgagtgccttcacttccggtagtccccctcaccaggggccatggggttctcgtttccctgagctggaaggggttttcccagtcggtttcggtgactctgaggtctctccgctgaccatagaggacccaaagcacgtgtgtgatccgccgtccggacctgatactaccccagcagcttctgacctgcccacagagcaaccaccaagccctcaaccaggcccgccagcagcatcacatactcccgagaagcaggcaagtagcttcgatttcaacgggccctacttaggcccccctcattccagatccctgcctgacattctcggccaaccggagcctccacaagagggtggtagtcagaagtctcccccgccaggaagccttgaatacttatgcctgcccgccggcggccaggttcaactagtgcctcttgcccaggccatgggcccaggccaggcggtggaggttgagcggcgaccctcccagggcgccgctggctctccctccctcgagtcaggaggggggcccgctccgcccgctttggggcccagagtagggggccaagaccagaaggatagcccagtggcgatacccatgagctcaggggacacagaagatcctggggttgcgtcaggttatgtaagcagcgcagatctggtgttcacccctaatagtggggctagctccgtgtcattggtgccatctctaggtttgcctagcgaccagaccccctcgttgtgcccaggtcttgcgtccgggcccccaggtgcccctggtcccgtcaaaagcggattcgagggctacgttgagctgcctcctatcgaaggccggtcgcctcgtagccctcgtaataacccagtcccaccagaagccaagtcacccgttcttaacccgggggagcggccagcagatgtgtcgcccacaagcccccaaccagaagggctcttggtgctccagcaggtgggggattactgcttccttccagggctgggacccggccctctcagcctgagatcaaagccatctagtcctggccccggccctgaaataaaaaacctcgaccaggcattccaggtcaagaaaccacctggtcaggctgtgccacaggtgcccgttattcagctgtttaaagccttggtagtttcggtgatgtctgtcggcccaccagtgccttag

SEQ ID NO: 112729 - DNA, 2352 bp, Artificial Sequence
  Description of Artificial Sequence: Synthetic coding sequence
atggccaggctggggaactgcagcctcacatgggctgccctgatcatcctactgctgcccggttcactcgaagagtgtggccacatctccgtaagcgcacctatcgttcacctgggggacccaattactgcttcatgtatcataaaacagaattgctcccatctggatccagagccccaaatattgtggaggctcggggcagagttacagccaggagggaggcagcagaggctgagtgacgggactcaagaatcaatcataaccctgccccaccttaatcacactcaggctttcctttcctgttgcctcaattggggaaattcacttcagatcctagatcaggtcgagctgagagccggatatccgcccgccattccacacaacctttcttgtttaatgaacctgaccacatcctctctgatctgtcagtgggagcccggtccggaaacacacctcccaacatcctttacactcaaatcgttcaagagtcgtggcaactgccagacccagggagacagtattttggattgtgtcccaaaagatggacagagccattgttgtattccccggaagcatttattgctttatcagaacatgggtatctgggtccaagccgagaatgcccttggcacttccatgtccccacagctctgtctggaccccatggacgtagtgaagctggagccacccatgctaagaactatggatcctagccctgaagcagcaccccctcaggcaggctgtttgcagctgtgctgggaaccctggcagcccggtttacatatcaaccagaaatgtgagttgcgacacaagcctcaaagaggggaggcaagttgggcgctggttggccccctgcccctcgaggccctgcaatacgagctgtgcggactgcttcccgcaacagcctacactctccaaattaggtgcattaggtggcccctgcctggacactggtccgattggagtccatcgttggaactcagaactacagagcgggcccccaccgtgcgattagacacctggtggagacaaagacagttggaccctcggaccgtacaattgttctggaaacctgtccccctggaagaggattccggtcgcattcagggatatgtggtctcatggagaccgtcagggcaggctggcgctatacttcccttgtgcaatacaaccgagctttcttgcacattccacctcccaagtgaagcacaggaggtggcactggttgcgtataactccgcagggacttcgcggcctaccccagtggtgttttccgaaagccggggcccagccttgacacgcctacatgctatggctagggacccacacagtctgtgggtggggtgggaaccccctaacccttggcctcagggctatgtcatcgagtggggcctcggcccgccaagcgcgagcaatagcaacaaaacatggcgcatggagcagaacggacgcgcaactggcttcttgctcaaggagaatatccggccattccagctgtacgagatcattgtgaccccactttatcaggataccatgggccccagccagcatgtttacgcctatagtcaggagatggccccatctcacgcaccggagctgcacctgaaacacatcggcaaaacatgggcccagctggagtgggtcccagagcccccagaactgggaaagagtcccctaactcattacactatcttctggaccaatgcacagaatcagtcattcagcgcaatccttaatgcaagctcccgaggtttcgtgttgcacgggttggagcccgcctcactctaccatatccacttgatggcggccagccaggcgggcgcaacgaatagcacggtactcacattaatgacactcacccctgagggctctgagctgcacattattttgggcctgttcgggctcctcctattactcacctgtctttgtgggactgcatggctctgctgttctcccaaccgtaagaatcctctttggccaagcgttccggacccagcgcatagttcactcggatcttgggtgcccactattatggaagaggacgccttccaactgcccgggctggggacgccaccaatcaccaagctgacagtactagaggaggacgagaagaaacctgtcccttgggagagccacaattccagcgagacctgcgggctgcccactttagttcagacctacgtgctgcaaggagatccccgcgccgtcagcacgcagccccaaagccagtcaggtacaagcgaccaggccggccccccgagacggagcgcctattttaaagaccagattatgctgcaccctgcacctcctaacggactgctgtgcctgtttccaattacctccgtactgtag

SEQ ID NO: 112730 - DNA, 2310 bp, Artificial Sequence
  Description of Artificial Sequence: Synthetic coding sequence
atggctcgcctgggtaactgttccctgacatgggcagcactgataatactcctgctccccggttccttggaagagtgcggtcatatctccgtatctgccccaattgtgcaccttggagatcctattactgcctcttgtattatcaaacagaactgttcacacctggaccccgaacctcagatactatggcgcttaggggctgagcttcaacctgggggacgacaacagagactgagtgacggcacacaggagtcaatcattacccttcctcacctgaatcacacccaggcttttctttcctgttgcttgaactgggggaattcattgcaaatactggaccaagtggagttaagggctggatatccccctgccatccctcacaacctctcctgcctgatgaacctgaccaccagctctctgatctgccagtgggaacctggccctgaaactcatttaccaacttcttttactctcaagagcttcaaaagccgaggtaactgccaaacccagggggacagtatcttagactgcgtgccaaaggatggtcaatcccactgctgtattccccgtaagcatctgctgctgtaccagaacatgggcatctgggtccaggcggagaacgcgttaggaacctccatgagtccacagctgtgcctggatcccatggatgttgtcaaactcgagccccccatgttacggactatggacccatcacccgaagccgctcccccccaggccggttgtctgcagttgtgttgggagccatggcaaccagggctgcacattaatcaaaaatgtgagctgagacacaagccccagcggggcgaagcttcgtgggccctcgtgggcccacttccactcgaggccttacagtacgaactgtgtggtctgttgccggccaccgcatacaccctacagatccggtgtatccggtggccacttcccggtcactggtctgactggtcccccagcctcgagttaagaactaccgagcgggccccaacggtgcggcttgatacttggtggcggcagaggcaactcgaccctagaaccgtccagctcttttggaaacccgtgcctctggaggaggattcagggcgaatacagggatacgtcgtctcctggagaccttcgggccaagctggtgcaattttgcccctgtgcaatacaactgagctgagctgcacattccaccttcctagcgaggctcaagaggtcgccctagttgcatacaactctgctgggacctcgcgaccgacccctgtggtgtttagcgagagcaggggccctgctctgacccgccttcacgctatggcgcgcgatccacatagcctgtgggtcgggtgggaaccacctaacccatggccccaagggtacgtgattgagtggggtctggggcccccgtccgcctccaatagcaacaagacctggcgcatggagcagaacggccgcgcaaccggattcctcttgaaagagaacattagaccgttccaactgtacgaaatcatagtgaccccgttataccaggatacgatggggccgtcccagcacgtgtacgcttattcgcaagagatggcacccagtcacgccccagaactgcacctgaagcacatcggcaagacttgggctcagttggaatgggtgcctgaaccacccgagctcgggaagtcaccactcacacattacaccatcttttggaccaacgcccagaatcagagctttagcgcaatcctcaatgcatcttcacggggtttcgttcttcatggactggagcctgcgtcactataccacattcatctgatggcagccagtcaagccggcgccactaactccactgtgctcacccttatgactctcacgcccgccgggaggataccatctggccaagtgtcccaaacacaattgaccgccgcttgggcccccggctgcccccagagctggcgtcgtatgcctagctcctgcccggctctcgctcgtcacccgagcccgtccagccaatgttggaggagaatgaaacggtcaagatgccccggctctcccattacagcccagcgacctgtcgcctcacctctttggagtcgccccatgtgtagtaggggcactcaagagcaattcccacctagtcctaatccatctctggccccagccatccggtcattcatggggtcatgctgggcagcaccccaagcccaaggccaggggactatctctgctgtaacaccgctgagtcctagttggagggcgtcgccacccgctcctagtcctatgcgcacatctggctctaggcccgctccgtggggcccttggtag

SEQ ID NO: 112731 - DNA, 2511 bp, Artificial Sequence
  Description of Artificial Sequence: Synthetic coding sequence
atggctcgccttggcaactgttctcttacatgggctgcactaattatcttacttctccccgggagtctggaagaatgcgggcacattagtgtctccgcccctatcgtgcatcttggagaccctataactgctagctgtatcattaaacaaaattgcagtcatctggatcctgagccccagatcttgtggagactgggcgctgagcttcagccaggaggaaggcaacaaagactttccgacgggacgcaggaatctataatcaccttaccacacctaaatcacacccaggctttcctgtcctgttgcctgaattggggtaatagcttgcaaattctcgatcaggtggaattgcgggcggggtatcctccggccatcccacacaacctgagttgcctcatgaaccttactacttcgagtctgatctgtcagtgggagcccggacctgagacacacctcccaacgtcttttacactcaaaagcttcaaatcaagaggaaattgtcaaactcagggcgactcaatcctggattgcgtgcctaaggacggtcagagccactgttgtatccctagaaagcacctcctactgtaccagaacatgggcatctgggtccaggcagagaatgctttagggacctccatgagccctcagttgtgtctggatcctatggacgtcgtaaaactggagccccccatgttgcgcacgatggatcccagccccgaagccgctccccctcaggccggctgcctgcagctttgttgggagccttggcaacccggactgcatatcaaccagaaatgcgagctgagacacaagccacagcggggcgaggcttcctgggctctcgttggcccgttacccttggaagcccttcagtacgaactgtgtggcctcctccccgcaacagcctatacccttcaaattcgttgtattcgctggccattgcccgggcattggagtgactggagcccgtcactggagcttaggaccaccgagcgggcccccacagttcgcctggatacgtggtggcgtcagcgacagctagatcccaggacagtccagttattctggaagccagtcccattggaagaagacagcggcaggatccagggatacgtcgtgtcctggagaccaagcggacaggcgggcgccattcttccgctctgcaacaccaccgaacttagttgtacatttcatttaccgtccgaagcccaagaggtggcccttgtagcatataatagcgcagggacatcccgcccgactcctgtggtcttttcggagagcaggggacccgcactgaccaggctccatgctatggctcgggatcctcactcactctgggtgggatgggagcctcctaatccatggcctcaaggctacgtgatcgaatggggactggggccccccagcgcctccaattccaacaaaacttggcgaatggaacagaacggaagagcaactgggtttctgctgaaggagaatattcggccatttcagctgtacgaaatcatcgtgaccccactgtaccaggatacgatgggaccaagtcagcatgtctatgcttacagtcaagagatggcaccttctcatgctcccgaattacacctgaagcacattggtaaaacctgggcccagttggaatgggtgcccgaacctcctgaactcgggaagagcccactgacccattacaccatcttctggacgaacgcacagaaccagagtttttcagcgatacttaatgcctccagtagaggttttgttttgcacggattggagcccgcatctttgtatcacatacacctcatggccgccagccaggccggggccacgaattcgacagtgctgaccctgatgacgctgactcctgagggttcagaactgcatatcattctcggcctatttggtctgctcctactccttacgtgcctatgcggtaccgcatggctctgctgttcacccaatagaaaaaatcccctgtggcccagcgttccagatcctgcgcactcttctctgggctcttgggttcccaccattatggaggaagacgcctttcaattgcccggattgggcaccccgcctatcaccaagctgaccgtcttagaggaggacgagaaaaagccagtgccatgggagtcacacaacagcagcgagacctgcggcttgcctaccctggtccagacctacgtgcttcagggtgatccgagggctgtgtctactcaaccccagtcccaaagcggcactagtgatcaggtcctgtacggtcaactgctgggctcccctacgtccccagggcctgggcactacctgagatgcgactcaacccaacccctgctagcaggcttgacaccaagcccgaagagctacgaaaacctgtggtttcaagcctcacccctcgggacgctggttaccccagccccatcccaggaggacgattgcgtgttcggcccactcctgaactttcccctgctgcagggtatccgagtccacggcatggaagcactggggtccttctag

SEQ ID NO: 112732 - DNA, 2592 bp, Artificial Sequence
  Description of Artificial Sequence: Synthetic coding sequence
atggcacggctgggaaattgtagcctgacctgggctgccctgatcatcctgctcctacctgggtctttagaggaatgcggtcatatttcagtctcagcccctatcgtgcacctgggtgaccccataacagcatcctgcattatcaagcagaactgctcacacctggaccccgagccccagatcctgtggcgtctcggggctgagctccagccaggaggccggcagcagaggctgagtgatggtacacaggaatccatcataaccctgccccatttaaatcacacccaggcctttctttcctgctgtttgaattggggtaacagtttgcagattcttgaccaagtcgagcttcgagccgggtaccccccagcaatcccccacaacctatcctgcctgatgaacctcaccacatctagcctgatctgccagtgggaaccgggccccgaaacacatttgcccacttcgtttaccctgaagtcctttaaaagcaggggcaattgtcagacacagggggatagcattctcgattgcgtgccaaaggacggtcaatcgcactgctgtatccccagaaaacatctccttctgtaccagaatatgggcatatgggtacaggccgaaaatgcccttggcacaagcatgtctcctcaactgtgtctggatcctatggatgttgtcaaactcgagccccctatgctgaggactatggaccctagccccgaggccgcaccaccacaggccggctgcctccagctgtgctgggaaccttggcagcctggcctgcacattaatcagaagtgcgaactgaggcataagccgcagcgcggcgaggcttcctgggctcttgtgggtcctctaccactggaggctctgcagtacgaactctgcggcctgttgccggccacggcatacaccttacagattcgctgcattcgctggcccctgcctgggcattggagtgattggtccccaagcctggagcttagaaccactgagcgtgccccgaccgtgcggctggacacttggtggaggcaaaggcagctggatccaagaaccgtgcaactgttttggaagcctgtgccattggaggaggactcaggtcgcatccagggatatgtcgtcagttggcgcccttccggccaggcgggagcaatacttcctctttgcaatacaaccgagctgtcatgcacgttccacctcccaagtgaagcccaagaagtagctctggtggcgtataactctgccggcacatctaggcccacccccgtggtatttagtgaatctagggggccggccctcacccggctgcacgcaatggccagagatccacacagcctgtgggtagggtgggagcctcccaacccgtggcctcaagggtacgtgatcgagtgggggctggggccaccttccgcttccaactcaaacaaaacctggagaatggaacagaacggtcgcgctaccggttttctgttgaaagagaatatccgacccttccagttgtacgagatcattgtgactcccctgtaccaggacactatgggacccagtcaacatgtctacgcatacagccaggaaatggcacccagccacgctccagagcttcacctcaaacatataggcaagacctgggcccagctggaatgggtccccgaaccaccggaactgggtaaatcacctctgactcattatacaatcttttggaccaacgcacagaaccaatccttctccgccattctgaacgcctccagcagagggtttgttctgcacgggctggaacccgctagcttgtatcacatacatttgatggcagcttcccaggccggggcaacaaactcgacagtgctcacactgatgaccttgacccccgagggtagcgaactgcatattattctcggattgtttgggctgttactgctcctgacttgtctgtgcggcacagcgtggttatgttgctcacctaaccggaagaacccactctggccgagtgttcctgatccggctcactcctccctggggagctgggtgccaaccattatggaggagctgcccgggccgcggcagggacagtggctgggacaaacgagtgaaatgtcccgagcactgaccccacacccgtgcgtccaagatgcctttcagctacccgggctaggaacccctcccatcaccaagcttacggtgctggaagaagacgaaaagaagccggttccttgggaaagccataattcaagcgaaacctgtggcctcccaactttggtgcaaacatacgtgctgcagggtgacccaagggctgtgtctacacaaccgcaaagccagagtggcacatccgatcaagtcctgtatggccagctcctcggatcgcctacctctccagggcccggccactacctgcgttgcgacagcacacagccattactagctggcctaaccccatccccaaaatcctatgagaatttgtggtttcaggcttctcccttagggaccttggtcacacctgcaccgtcccaggaagatgattgtgtattcggacctttgctcaacttcccgctgctgcaaggcatccgggttcacgggatggaagccctggggagcttttag

SEQ ID NO: 112733 - DNA, 2352 bp, Artificial Sequence
  Description of Artificial Sequence: Synthetic coding sequence
atggctaggttggggaactgttccctcacatgggccgcgctgatcattcttctactgcctggttctttagaagagtgcggccatatttccgtgtctgcccccatcgtgcacctgggtgaccctattaccgctagctgcattattaagcaaaactgcagccacttagatccagagccacagatcctgtggcgacttggcgcagagctccagcctggcggaaggcagcaacggctttcagacggcacccaggaaagcattattacattgccccacctcaatcacacccaggcttttctgtcatgttgtctgaattggggtaatagcctccagattctggatcaggtggaactgagagctggatacccacctgctatcccccacaatctgtcctgtcttatgaacttaacaacgtcgtcactaatctgccagtgggagccaggaccagaaacacatttacccacttcattcacgctgaagtctttcaaaagcaggggcaactgccagacccaaggagatagtattctggattgcgtacctaaagacggtcaatcccattgctgcatacctcgcaaacatctgttgctgtatcaaaatatgggaatctgggtccaggccgaaaatgctctgggcacttcaatgagtccacagctatgcctggatcccatggacgttgttaaacttgagcctcccatgctgcgcaccatggacccctcacccgaagctgccccccctcaggctggctgtcttcaactctgttgggaaccctggcaaccaggtctgcacatcaaccagaagtgcgagcttaggcataagccacaacgcggtgaggcttcgtgggcgctggtgggacctctcccactggaagcattacagtatgagttgtgtggtctgctgccagccacggcttacacactgcagatcagatgcatccgctggcccctgcccgggcactggtcagattggtctccttcattggaacttaggaccaccgagcgggcccctacggtcaggctggacacttggtggcggcaacgccaactcgacccgcgcacggtccaacttttttggaaaccagtgcccttagaggaggactcagggcggattcagggctatgtcgtgtcatggcgaccaagcggacaggcaggtgctatcctgccgctgtgtaacacaactgaactctcatgcacattccatctgccctctgaggcccaggaggtggcactggtcgcttacaatagtgccggcactagtagacctacccccgtagtgttctctgagtctagaggccccgctctgacccggctccatgctatggcaagagacccgcactcattgtgggtcggctgggagccaccaaacccttggccccagggctacgtcattgagtggggactggggccaccaagtgcgagcaactcaaataaaacctggcgcatggagcagaatggcagagccaccggtttcttgttaaaagagaatattcggccattccaattgtacgaaattatcgtgacccccctctaccaagacaccatgggtccctcccaacacgtgtacgcatactcacaggaaatggcgccctcccatgcccctgaactgcacctcaaacacataggaaagacctgggcacagcttgaatgggtacccgaacctcccgagctcggcaaatcacccctgactcactatactatcttttggacgaacgcgcaaaatcagagtttttcagctatcctaaacgcttccagccgcgggtttgtgctccatggcctggagcctgctagtttgtatcacatccacctgatggcagcatcacaggccggagcgaccaattcaaccgttcttacattaatgaccctgactcctgaagggtccgaactgcatatcatactgggactgttcggattgttattactgctaacttgcctctgtggcacagcctggttgtgttgttcgcctaatcgcaaaaacccattgtggccgagtgttcccgatcctgctcatagttctcttgggtcttgggtccccacaataatggaggaagatgcctttcaactccctggactcggcacacctccaataacaaagctgactgtgctggaagaggatgagaagaagccggtaccttgggagtctcacaatagttcagaaacctgtgggttgcctactctggtgcaaacatatgtcctgcagggagatccccgtgcggtctctacacagccgcagtctcagtctggaacttccgaccaggcagggcccccaagaagatccgcgtacttcaaggatcagattatgctgcacccggccccacctaacgggctgttatgtctttttcccatcacctctgttctgtag

SEQ ID NO: 112734 - DNA, 2511 bp, Artificial Sequence
  Description of Artificial Sequence: Synthetic coding sequence
atggcaagactgggcaattgttctctgacctgggccgccctgataatcttgctgctgcctggaagcttggaagaatgcggccacatcagcgtgagtgctcctatcgtgcatcttggcgatcctattacggcatcatgcataataaaacagaactgtagtcacctagaccctgagccccagatcttgtggcggcttggggcagaactacaaccgggaggacgccagcagaggcttagtgacggcactcaggaaagcattattacacttcctcatcttaatcatacccaagcgtttctgtcatgttgtctgaattggggtaattctttacagatcctcgaccaggtggagttgcgcgccggttatcccccagccataccacacaatctgagctgcttgatgaacctgaccacctcaagcctgatttgccagtgggagcccgggccagaaacccacctcccaacatcgtttacgctgaaaagcttcaagtcccgcggaaactgtcagacccagggggactccatcctggattgtgtgcctaaagatggccagtcccactgctgcatcccccgaaagcacctcctcctctaccagaacatgggcatctgggtgcaggccgaaaatgcgctgggaacgagtatgtcccctcagttgtgcctggacccaatggatgtggtcaaactggagccacctatgctgcgaacaatggacccaagtcccgaggccgcgcccccccaggctgggtgcttacaactttgctgggagccttggcagccaggcctgcacatcaaccagaagtgtgaactgcgtcataaaccacagagaggcgaagcctcatgggcccttgtagggcccctgcccctggaggcactgcaatatgagctgtgtggcctccttccagctacagcctatacactgcaaatcaggtgcatccgttggcccctacccggacactggtccgattggagcccttccctggaactgaggaccaccgagcgcgcccccaccgtgcggctggatacctggtggcgacagcgccagcttgacccccgaaccgtccagctattctggaagcctgtgccattggaagaggattccggcagaattcaggggtacgttgtgagctggaggccgtcaggccaggcgggcgcaatcctgcctctgtgtaacacaaccgaactctcctgcacttttcacctgccctcagaagcacaagaggtggccctggtcgcatacaactccgcggggacctctagaccaactcccgtggtctttagcgagtcgcggggcccagccctgaccaggctgcatgcaatggctagagaccctcactccctctgggtcggctgggagccccctaacccatggccgcaaggctatgtgatcgaatggggcctgggcccccccagcgcttctaatagcaacaagacatggcgtatggagcagaacggacgcgccaccggttttctcttgaaggaaaacattagacccttccagttgtatgaaatcattgtgacacccctatatcaagacacgatgggcccaagtcagcacgtgtacgcatactcccaggaaatggcaccctcccatgcaccagagctacacttgaagcacatcgggaagacctgggcacagcttgagtgggtcccagaaccacctgagctggggaaaagcccactgacccactatacgatattttggacgaatgctcagaaccagtccttcagcgcgatcttgaacgccagcagccgcggattcgttcttcatggcttggagcccgcttctctgtaccacattcacctgatggccgctagtcaggccggggccaccaattccaccgtgctgacacttatgactctgacacctgaaggtagcgaattgcacataattctcggcttgttcggtctcctgctgctgttgacatgtctctgcggaaccgcctggctatgctgtagtccaaatcggaaaaaccccctttggccatctgtgccggatccagcccactcctctctgggctcctgggtgcctacaataatggaggaggacgctttccagctgccaggactcgggaccccccccataaccaagctgaccgtgctggaagaggacgagaaaaagccagtgccctgggagtctcataactcgtccgaaacctgcgggctccctactttggtccagacctacgtgcttcagggtgacccaagagccgttagcacacagccccagagtcagagtggaactagtgaccaagtcttgtacggccagctgctgggcagcccaaccagtcccggtcccgggcactatctcagatgcgactctacacagccactacttgccggattgactcctagtccaaagagctatgagaatttgtggttccaggcctcaccgctgggaactctagttacaccagcacccagccaggaagacgattgtgtgtttggacccctcctaaactttccccttcttcagggaattcgcgtgcacggaatggaggcccttgggtccttttag

SEQ ID NO: 112735 - DNA, 2511 bp, Artificial Sequence
  Description of Artificial Sequence: Synthetic coding sequence
atggcaaggctgggcaactgtagtctgacctgggccgccctgatcattctactcctccctggctctctggaggagtgcggtcacattagcgtgtccgccccaattgtgcacctgggggatcccataacggcctcttgcataatcaaacaaaactgttctcatctcgatcctgagccccagattctctggcggctaggagctgaactgcagccaggcggccgacagcagaggctttctgacggcacacaggagagtataatcacgttgccccacttgaaccacacccaggcctttctgtcatgctgtctgaactggggtaacagcctgcagatcttggaccaagttgaactgcgcgccggataccccccagctatccctcacaatctgagctgcttgatgaatttaacaacatctagccttatctgccagtgggagcctggccctgaaacccatctgcccacatcattcacgctgaagtcttttaaaagccgcggtaactgtcagacacaaggcgattctatactggactgcgttcccaaagatgggcagagccattgttgtataccccggaagcacctgctactttatcagaatatgggaatctgggtgcaggccgagaatgcactcggcactagcatgtccccacagttgtgcctggaccccatggatgtagtcaaacttgagcccccgatgctacgcacaatggacccaagcccggaagctgctcccccacaggccggctgtttgcagctttgttgggagccatggcagccagggctccatattaatcagaaatgtgagctgcgccataagcctcagagaggagaggcatcctgggcgctcgttgggcccttaccactcgaggccctccagtatgaactctgcggcttactgccggcaactgcctacacactgcaaattaggtgtattcgatggcccctacctggccattggagcgattggtccccttccttagagctacgcaccaccgagcgggcccctactgtgagactcgacacatggtggaggcagcgccaactcgatccccgtacagtgcagctcttctggaagccagtgcccttggaggaggattcagggcgcattcagggctatgttgtaagctggaggcccagcggtcaggcgggtgccatcctgcccctgtgtaatacaacagaacttagttgtactttccacctcccgtctgaggcccaggaggtggcactggtggcatataacagcgcaggaacatcccggcccacaccggtggtcttctcagagagccggggacctgccctaacccggctgcacgcgatggcaagggacccccatagtttgtgggtgggctgggagccaccaaacccatggccgcaggggtacgttattgagtggggcttgggacctccttccgcctctaatagtaataagacatggcgcatggaacagaacggccgtgcaactggcttcctcctgaaagagaacattagaccctttcagctctacgagatcatagtaactcccctgtatcaggatacgatgggaccaagtcaacatgtgtacgcctattcacaggagatggccccatctcacgccccggagttacacctgaagcacattggcaagacttgggcccagctggagtgggtaccagagccccctgaactcggaaagtcccccctgacccattacacaatattctggaccaacgcccaaaaccagtcattctctgccatccttaatgcaagctcgagaggctttgtattgcacggcctcgaacccgctagcctgtaccatattcacctcatggctgccagtcaggcaggggcaacaaattccaccgtgctgaccctaatgacactgactccagaggggtccgagctccatatcatcctcgggttgtttgggttgctgctgttgttgacctgcctgtgtggcacagcctggttatgttgcagccccaatcgtaagaacccactgtggccttcggtgcccgaccccgcacacagtagcctgggctcctgggtgcctacaatcatggaggaggacgcctttcagcttcctggcttgggcaccccccctatcactaagctaacagtcttagaagaggatgagaaaaaaccagttccttgggagagccacaattcaagcgagacctgcgggttacccacactggtacagacttacgtgctgcaaggcgaccctcgggcggtttcgacccaaccgcagtcacagagcggcacaagcgaccaggtcttgtatgggcagctcctggggagccccacatctccagggccaggccactacctccgttgtgactctacccaacccttgttagctggactgacgccgagccctaagtcatacgagaacctctggttccaagcatccccactgggaacacttgtgacacctgcgcccagtcaagaagacgattgtgtctttggcccattgctcaattttcctctgctgcagggaatacgtgttcacggtatggaggccctaggctctttttag

SEQ ID NO: 112736 - DNA, 2592 bp, Artificial Sequence
  Description of Artificial Sequence: Synthetic coding sequence
atggccaggctaggcaactgctctctgacgtgggctgccctgataatcctcctgctccccggatccctggaggaatgcggccacatctctgtgagcgctcctattgttcacctgggagaccccatcactgcaagctgcataataaaacagaattgctcccacctggaccctgagcctcagatcctctggaggctgggcgcagaattgcagcccggcggcagacagcagagactgagcgatgggacacaagagagcataattaccttgccgcatctcaaccatactcaggcttttctttcctgttgtctaaattggggcaattccctccagatcctggaccaagtcgagttacgggccggctatcctcctgctattccgcataacttgagctgcctgatgaaccttaccacctcctccctgatatgccagtgggagccaggaccagagacgcacttgcccacatcttttacattgaaatcattcaagtcccgcggcaattgtcagacacagggcgacagcatcctggactgcgtgccgaaggacgggcagagtcattgctgcattcctcgaaagcacctgcttttataccagaatatgggaatctgggtacaggccgagaatgctctcggcacatccatgtcaccgcagctgtgtctcgacccaatggacgttgtaaaactggagccgcctatgctgaggactatggatccctcccccgaggcagctcctccccaagctgggtgtttacagctttgctgggagccctggcaacctgggctccacatcaatcaaaagtgcgaattgaggcataaaccccagcggggtgaagcttcctgggcactggtcggccctctgcctctggaagcacttcagtacgagctgtgtgggctgctgccggccacagcttatacactacagatccggtgtattcggtggcctctgcctggacattggtccgattggagtccatctctggaactgaggactacagaacgtgccccaactgtgcggttagacacttggtggagacagcggcagttggacccgaggactgtccagttattttggaaacccgtgcctcttgaggaagactccggtagaatccaggggtatgttgtcagttggaggcctagtggacaggccggggccatcctcccactctgtaacactaccgagctctcttgcactttccacctgccgtctgaagcacaggaggtcgctctcgttgcatacaattctgcaggaacttccaggcccactcccgtggtcttttctgagtccaggggcccagcccttacaaggctgcacgcgatggcccgagatccacactctctctgggtcggctgggagccccctaatccctggccccagggttacgtcatcgagtggggtctgggcccgccctccgcctctaactccaataaaacttggcgaatggaacagaatggaagagccaccggttttcttctcaaggagaatatccgaccatttcaactgtatgaaatcatcgtcacaccgctctatcaagacacgatgggaccatcccagcatgtgtacgcttactctcaggaaatggcccctagccacgccccagaactccacctcaagcacatcgggaaaacctgggcgcagttagagtgggtccccgagcccccagagctcggcaagagtccactgacacattacacaattttttggactaacgctcagaaccaaagcttctctgcgatattaaacgccagcagcaggggatttgtgcttcacgggctggaacccgcatcattataccatatccacctgatggctgcctctcaagccggcgccaccaattctaccgttctcactctaatgactctgacacctgagggtagtgaactccatataatccttggcctgtttgggcttttgctcctgctcacttgtctgtgcggcactgcctggctatgttgctcacctaaccgcaaaaacccgctgtggccctctgtgccagacccagcacacagctccttaggttcttgggtgcctactattatggaagaactgcctggccccagacagggccagtggctgggccagacctccgagatgagccgggccctcacaccccacccatgcgtccaggacgcttttcaactcccgggcctggggactcctcctatcacaaaattgacagtgctggaggaggacgaaaagaaacctgtgccttgggaaagccacaattcatctgagacttgcgggcttcctaccctagtccagacttatgttttgcagggggatccacgggctgtgagcacgcagccgcagtcccagtcggggacatctgaccaggtcctctatggacagctgcttgggagccctacatcgccggggccaggtcactatctgagatgtgatagtactcagccacttctggccggtttgaccccttctcctaaatcctacgagaacttgtggttccaggcctccccactcggcactctcgtgacacctgcccccagccaggaggacgattgtgtgttcggccctttgttgaatttcccacttctacaggggattcgagttcacgggatggaggctctcggctccttctag

SEQ ID NO: 112737 - DNA, 1167 bp, Artificial Sequence
  Description of Artificial Sequence: Synthetic coding sequence
taaacctcacgtccaactccagttgtattttccgaatcacgcggcccagcactaacaagattacacgccatggcccgggacccacatagcttgtgggtgggatgggaaccacccaatccttggcctcagggttatgtaattgaatggggcttgggacccccttcagcctccaactcaaataaaacatggcgtatggaacagaatggtcgggccacggggttcctgttaaaggccccatctcacgctccagagctgcatctgaagcacatcggaaaaacttgggctcagctcgaatgggtccccgaaccaccagagctgggcaagtcccccttgacgcactacacgatcttctggacaaatgcgcagaaccagagcttctcagccatactgaacgccagcagtagggggttcgtattacatgggttagagcccgcctctctgtatcacattcacctaatggctgcaagtcaagccggtgcgaccaatagtacagttctgaccttgatgaccttgacacctgaagggtctgaactccacattatcctcgggctgtttggcttgttattattactgacatgcctttgtggtacagcctggctgtgctgttcacctaatcgcaaaaatcccctgtggccatctgtgccagatccagcccatagctccctgggttcctgggtccccacaatcatggaggaggatgcatttcagctcccgggattagggaccccccccatcacaaaattaaccgttctggaggaagacgaaaaaaaacctgtcccttgggagtctcacaactctagtgagacgtgcggattgcctacattggttcagacgtacgtcctgcaaggagacccacgggcagtgagtacgcagccacagtcacaatccggaacaagcgatcaggttttgtatgggcagctactcgggtcacccacaagtcccgggccaggtcattatcttcggtgcgacagtactcagccattactcgccgggttaacaccatcaccaaagtcttacgagaatctctggtttcaggcctcacctctgggtacgctggtcacccccgctccgtcccaggaggacgactgtgtgttcgggcccttgctgaactttccccttttgcagggcatacgcgtgcacgggatggaggcattagggtctttttag

SEQ ID NO: 112738 - DNA, 66 bp, Artificial Sequence
  Description of Artificial Sequence: Synthetic coding sequence
atggcgcgtctgggtaactgcagcttgacatgggcggccctgataatcctgctgctcccagggtag

SEQ ID NO: 112739 - DNA, 675 bp, Artificial Sequence
  Description of Artificial Sequence: Synthetic coding sequence
atgtccgccgtgggagccgctaccccttaccttcaccatcctggggactctcacagcggcagagtttcctttcttggagcccagcttccccctgaggtggcggccatggcccgccttttaggcgatttagatcggtctactttcagaaaactgcttaagttcgttgtgtcatctctgcagggcgaggactgcagggaagccgtgcaacgtctaggagtttccgccaaccttccagaagaacagctcggtgccctccttgcaggcatgcacacactactccagcaagcactgcgcctgccaccaacttcattgaaacccgatacatttcgggatcagctgcaggagctgtgcatcccacaggatctggtaggtgatctggccagcgtagtgtttgggtctcagaggccccttctggactctgtggcccaacagcaaggagcgtggcttcctcacgtggccgacttccggtggagggtggatgtggccatctccaccagcgccctcgcgaggtccctgcagccttctgtcctgatgcagctgaaacttagcgatggatccgcctatcggtttgaagtcccgactgctaagttccaagaactgcgatatagcgtggcactggtactgaaagagatggcggacctcgaaaagagatgtgaacggcgcttgcaggactag

SEQ ID NO: 112740 - DNA, 675 bp, Artificial Sequence
  Description of Artificial Sequence: Synthetic coding sequence
atgtccgcagtaggggcagctacgccttatctccaccaccccggggactcgcactccggaagagttagcttcctgggcgctcaactcccaccagaagttgccgcaatggcccggttgctgggcgatctagacagatccacattcagaaaactgctgaagtttgttgtgtcaagccttcaaggagaggactgccgcgaggcggttcaacgcctcggggtgtctgcaaaccttcctgaggaacaacttggtgccttgttagcaggcatgcatactcttctacagcaagcactgcgcctgccacccacctccctgaaacctgacacatttagggatcaactccaggagctttgcatcccgcaggatctggtgggagacttagcctccgttgtgttcggttctcagcgtccactgctggactccgtggcccagcagcagggcgcatggctgcctcacgtcgctgactttcgttggagggtggacgtggctatcagcacgagtgccctggctcgtagcctgcagccctcagtgcttatgcagcttaagctctctgacgggtccgcctacaggttcgaggtgcctactgcaaagtttcaggaacttcggtacagcgtggcacttgtcctgaaggagatggctgatctcgagaaacgctgcgagcgccgtttacaggactag

SEQ ID NO: 112741 - DNA, 675 bp, Artificial Sequence
  Description of Artificial Sequence: Synthetic coding sequence
atgagcgccgtcggggcagctacaccgtaccttcaccatcctggcgacagccactcagggcgtgtcagcttcctgggcgctcaactgccacccgaggtagctgccatggcccgactgctgggcgacttggataggtctacttttaggaaactgttgaagttcgtagtcagttccctgcagggcgaggactgtcgcgaggcggtccaaaggctcggggtgtcagcaaaccttcccgaagagcagctgggggccctgctggcgggcatgcatacgttgctccagcaggctctccgcctgccacccaccagcctaaaacccgatactttcagagatcagctgcaggagctctgcattccgcaggatctcgtcggagacttggccagcgtggtgttcgggtcccagaggcctttactagacagtgtggcgcagcagcagggcgcgtggctcccgcacgtggcagacttcaggtggcgagtagatgtcgccatctccactagcgcgctggctcggtccctgcagccatccgtgctcatgcagctgaagctttcagatggctccgcatatcggtttgaggttccaacggcaaaatttcaggagttgcgttatagcgttgctttggtgctgaaggagatggccgaccttgagaagaggtgtgagaggcgcctccaagactag

SEQ ID NO: 112742 - DNA, 297 bp, Artificial Sequence
  Description of Artificial Sequence: Synthetic coding sequence
atggaggcttcgtcagagcctcccctggacgcgaagtcagacgtcaccaaccaattggtggacttccaatggaagctgggtatggcagtctcttccgacacctgcagatctcttaagtatccttacgtcgcagtgatgctgaaagttgcagatcacagtggccaggtgaaaactaaatgctttgaaatgactatacctcagttccagcctcaactgctcgctaccagctccctcctttctgcctccaacttctaccgccaattcaaggagatcgccgccgttatagagaccgtgtag

SEQ ID NO: 112743 - DNA, 258 bp, Artificial Sequence
  Description of Artificial Sequence: Synthetic coding sequence
atggaggcttcttccgagccccccttggatgcaaagagcgacgtgaccaaccaactcgttgacttccaatggaagctgggtatggctgtgtctagcgatacatgtcgctccctgaagtacccctacgtcgccgtcatgctcaaagtggctgatcatagcggacaggtgaagaccaaatgctttgagatgaccatcccacagttccaaaacttctacagacagttcaaggagatcgcagccgtgatcgagactgtgtag

SEQ ID NO: 112744 - DNA, 258 bp, Artificial Sequence
  Description of Artificial Sequence: Synthetic coding sequence
atggaggcatccagcgagccaccacttgatgctaagagcgacgtgaccaatcagcttgtggactttcagtggaagctcggaatggcagtaagttctgatacttgcaggagtttgaaatatccatacgtggcggtcatgctcaaggtcgcagaccacagtggacaggtgaaaactaaatgttttgaaatgacgatccctcagtttcagaatttctatcgccaatttaaggagatcgctgccgtgatcgagacagtatag

SEQ ID NO: 112745 - DNA, 7470 bp, Artificial Sequence
  Description of Artificial Sequence: Synthetic coding sequence
atgggggccagctctcctcgctccccggagcctgttggtccacctgcccccgggttacccttctgttgtggaggctccttactggccgttgtggtactgctggccctgcccgtggcttggggccagtgcaacgcccccgaatggcttccctttgcacggcctacgaacctgacagatgagttcgagtttcccatcggaacctacctgaattatgaatgtagaccaggttacagcgggcgaccattcagcatcatctgcctaaagaactccgtgtggacgggagccaaggacagatgtcgtagaaaatcttgtcggaatcccccggatcccgttaacggcatggttcacgtgatcaagggcatccagttcggctcgcagatcaaatatagctgcactaaggggtatcgactgatcggatcgtcttccgccacctgcattatcagtggagataccgtcatctgggacaatgagactccgatctgtgacaggatcccctgcgggttgccgcctactatcactaatggagattttatttctaccaacagggaaaattttcactatggctctgtcgtaacttatagatgcaaccccgggagtggtgggaggaaggtattcgaactggtgggggagcccagcatctactgcacatcaaatgatgatcaggtggggatctggtccggaccagcaccccagtgcatcattcccaacaaatgcaccccgccaaacgttgaaaatggcatactcgtcagcgacaaccgctcactgttctcattgaatgaagtggtggagtttcgatgccagccaggattcgtaatgaaggggcctcgcagggtgaaatgccaggccctgaacaaatgggaacccgaactgcccagttgcagtcgcgtgtgccagcctccacctgatgtgctacacgccgagaggacccagcgcgataaagacaacttcagccctggacaggaagtgttttattcttgcgaaccgggctatgacctcaggggagccgcctctatgagatgtactccccagggggactggagccccgccgccccaacttgtgaggtcaagtcctgtgatgactttatgggtcagttactaaatggcagggtactgtttccagtgaacctccagctgggcgccaaggtagacttcgtgtgtgatgaggggttccaactcaagggctcttcagccagctactgcgtgttggctggcatggagtcactgtggaactcgagcgttcccgtctgtgagcagattttttgcccctcaccgccagtgatcccaaatggcagacacacaggcaaacccttagaagtttttcccttcggcaaaactgtaaattatacatgcgacccacaccctgatcggggaacctcatttgacctgattggcgagagcacaatccgttgtacttcagacccacagggcaatggagtttggtcaagccccgcccccagatgcggcatcctggggcactgccaagcaccagaccatttccttttcgctaagctgaaaactcagacgaatgctagcgacttcccgattggcaccagcctcaagtatgaatgccgaccagaatactacggccgaccattcagcataacatgtctggataaccttgtctggtcctccccgaaagacgtgtgcaaacggaaatcatgcaagaccccccccgatccagtcaacggcatggtgcacgtcatcaccgacattcaggtgggctcgaggatcaactactcctgcacgacaggtcaccgcttgataggccactcttctgcagagtgtattctgtctgggaatgccgctcactggtccacaaagccccctatttgtcagcgcataccttgcggcctgccacctaccatcgccaatggtgacttcatctcaactaaccgtgagaactttcattacggatccgtcgtgacttatcgatgcaatcctggaagcggggggaggaaggtgtttgaactggtcggggagccctcaatctactgcacctccaatgatgaccaggtgggcatctggagtggcccagcccctcaatgcatcatcccgaataagtgcacccctccaaatgttgagaacggtatcctggtttccgataacaggtccttattctctctgaacgaagtggtggagtttaggtgtcagccgggcttcgtgatgaaaggaccgagacgagtaaaatgccaggctctcaacaaatgggagccagaacttcctagctgttcacgggtgtgccagcctccgcccgatgttctgcatgccgagagaacccagagagacaaggataacttctcccccggtcaagaagtcttctattcttgtgagccagggtacgatctgcgaggagccgcaagcatgcgctgcaccccccagggcgactggagccccgcagcccccacgtgcgaagtgaaaagctgcgatgacttcatgggccagcttctgaatggcagggttttatttcccgtaaatttacagctgggcgctaaagttgacttcgtgtgtgacgaaggatttcaacttaagggatctagcgcttcctattgcgtcctggccggtatggaatctctttggaattcttctgtcccagtgtgcgaacaaattttctgcccaagtccccccgttattcccaacgggaggcatactggaaagccgctagaggtgttcccattcggaaaaaccgtcaactatacgtgcgatcctcaccctgatagagggacctcctttgacttaatcggcgaatctactataagatgtactagcgaccctcaaggtaatggcgtgtggtcgtctccggcaccgcgctgtggcatcttaggccattgtcaggctccagaccactttctctttgccaaactgaagacccagactaatgcgtcagattttccaatagggacatcccttaagtatgaatgtcggcccgaatactatgggcgacccttttccataacctgcctcgataatctcgtgtggtctagtcccaaagacgtgtgcaagagaaagtcctgtaaaacacccccagatcccgttaatggaatggtgcacgtaatcaccgacatccaggtgggctcgagaatcaactatagttgcacaacgggtcatcggctgattggccattcctctgctgagtgtatattgtctggaaacgcggcgcactggtctactaagccacctatctgtcaaagaatcccttgtggcctccctccaacaatcgcgaacggggattttatttctaccaatagagagaattttcattacggatctgtggtgacatataggtgtaatcctggatctggaggacgaaaagtgtttgagctagtgggagagcctagcatctactgcaccagcaatgatgaccaggtcggaatttggtctggaccagcaccccagtgcatcatcccgaataaatgcacgccccccaatgtcgagaatggaatcctcgtgagcgataacaggtcacttttctcacttaacgaagtcgtggagtttcgctgtcagccaggtttcgtcatgaaaggccctagacgtgttaaatgtcaggctctgaataagtgggaaccagagctgccttcatgttccagggtgtgtcagccaccccccgacgtcctccatgccgagcggactcagagagacaaggacaactttagcccaggtcaggaagtgttctatagttgcgaaccaggctatgatcttcgcggcgcagcatccatgcggtgcactcctcagggggattggtccccagctgcccctacctgcgaggtgaagagctgcgacgatttcatgggtcaactcttgaatggccgggtcctatttccagtcaacctacagctcggcgctaaggtcgattttgtctgtgacgaggggtttcagttgaagggcagtagcgcgagttattgcgttcttgctggaatggaaagtctgtggaatagcagtgtgcccgtctgcgagcagatattctgtccctcgcctcctgtgatcccaaacggccggcatacagggaaaccattggaggtctttccattcggaaaagcagtgaattatacctgcgatcctcaccctgatagaggcacctcctttgatctcataggggagagcacaatcagatgcacatcggatccccaggggaacggggtgtggtctagtcctgcccccagatgcggtattctgggtcattgccaggcgccagaccatttcctgttcgccaagctaaaaactcagacgaacgcatctgactttccaattggaacctccctcaaatacgagtgcagacctgaatactacggccggccattcagtattacttgcctcgataacttggtttggtcatctccaaaggatgtgtgtaagcgcaagagctgtaaaacgccacctgaccccgtcaacggaatggtccacgtgataactgacatccaggtaggaagtcggataaactatagctgcacaaccggccatcgtctgattggacattcatcagccgagtgtattctgtctggaaacacagcacactggtccactaaacctccaatttgtcagcggataccctgtggcctgccccctactattgcaaatggcgactttatctccaccaacagagaaaattttcactatgggagcgtcgtgacatataggtgcaatttaggaagccgcggcaggaaggttttcgagctggttggcgaaccctctatttactgcacctcaaacgatgaccaagttggtatttggtccgggcctgcaccgcagtgtattatccccaacaaatgcacaccacctaatgtggagaacgggattcttgttagtgataatcggtctctcttctctctgaatgaggttgtggaattcaggtgtcagccagggttcgttatgaagggtcccagaagggttaagtgccaggcactcaataaatgggagcctgagctcccctcttgcagtcgggtctgccaaccacctcctgagattctccacggcgagcatactcccagccatcaagacaatttctcacctggacaagaagtgttctattcctgcgaacctggctacgatctccggggggcggcatcacttcactgcactccacagggagactggtcacctgaggctcctaggtgcgccgtgaagtcatgtgatgatttcctggggcagctcccacacgggcgtgtacttttcccgttaaatctgcaactgggggccaaggtgtctttcgtctgcgacgaaggatttagactgaagggaagctccgtctctcattgtgtcctcgtgggaatgaggagcctgtggaacaacagcgtccctgtgtgtgaacatatcttctgccctaatccccctgctatcctgaatggacgccacacagggacgccatccggtgacatcccctacggcaaagagatcagttatacctgcgaccctcatcctgataggggtatgacattcaatctgattggagaaagcactattagatgcaccagtgacccacacggaaacggcgtttggtcgtcccccgccccacgttgtgagctcagtgttagagcgggacattgcaaaacacccgagcagtttccattcgcttcgccaaccatccctattaatgacttcgagtttccagtaggaacttccctgaactatgagtgtcgtcccgggtacttcgggaaaatgtttagtattagttgtctcgagaatctggtctggagctccgtcgaggataattgtagacggaaatcttgtgggcctcctcctgagccatttaatgggatggtccacatcaacacagatacacagttcggatctaccgttaactacagttgcaatgaggggttcagattgatcggatctccgtcgaccacttgtctcgttagcggaaacaatgtcacatgggacaaaaaggcaccaatctgcgagatcataagttgtgaaccacctcctaccatcagtaacggcgacttctattcgaataatcgcacaagcttccacaacggcacagtggtgacctatcagtgtcacacaggcccagacggcgagcagctttttgagctggtgggcgaaaggagtatctactgtaccagcaaggatgatcaggtgggggtgtggagttcaccacctccacggtgcattagcactaacaagtgtaccgctccagaagtggaaaacgccatacgcgtgccaggcaacagatcgttctttaccttaaccgaaattattaggtttcgatgtcagccaggtttcgtcatggtcggaagtcatacggtgcagtgtcagaccaacggtaggtggggccccaaactgccccactgttccagggtctgccagccccccccagaaatcctgcacggcgaacatactttgtctcatcaagataacttttcccctgggcaggaggttttctacagctgcgagcctagttatgatctgcgaggcgcagcaagtctacactgcaccccgcaaggggactggtctcccgaagccccaagatgtactgtgaagtcctgtgatgacttcttgggacaactgccccacggacgtgttttactccctttgaacctgcaactcggagccaaagtctccttcgtgtgtgacgagggatttcggctgaagggccggtctgcttctcactgtgtgctggctgggatgaaggccctctggaatagttcggtgcctgtgtgtgagcagattttctgccccaatcccccggccattttaaatggacggcataccggaaccccctttggagacatcccctacggaaaagagatttcttatgcatgcgacacacaccccgaccggggcatgacttttaacctcataggggaatccagcatcagatgtacatcagatccccaggggaatggcgtgtggagcagcccagctcccagatgtgaactctcagtgcctgctgcatgtccacatcctcccaagattcagaacggacactacattggtgggcatgtgagtctttatcttcccgggatgactatctcatacatctgtgaccctggataccttctggtggggaaagggttcatcttttgcaccgaccaggggatatggtcccagttagatcattattgtaaggaggtcaattgtagcttcccgctgtttatgaatggtatctccaaagagctggagatgaaaaaagtgtaccactacggcgactacgttaccctcaagtgtgaggatggatacacccttgaagggtcgccatggtcacagtgccaggccgacgatagatgggaccctccactggcaaaatgtacctctagaactcacgatgcccttatagtgggcaccctaagtggaaccatcttttttatactgttgatcatcttcttaagctggatcatattgaagcataggaagggcaataacgcacatgaaaaccctaaggaagtggccatccatctgcattcccagggaggtagctcagttcatccccggactctgcagactaacgaagaaaacagtcgggtcctaccctag

SEQ ID NO: 112746 - DNA, 6120 bp, Artificial Sequence
  Description of Artificial Sequence: Synthetic coding sequence
atgggcgcgtctagcccacgttctcccgagcccgtcggaccccctgcccctgggttacccttttgttgcggaggttctttattagccgttgtcgtgctcctcgccctgccagtcgcctgggggcaatgtaatgctcccgaatggctgcccttcgctcgacctaccaacctgaccgatgagtttgagtttcctataggcacctacctaaactatgagtgtcgcccagggtattcaggacggccgttcagcataatttgccttaaaaattcggtgtggacgggcgccaaagatcgctgtagaaggaagtcatgtcgaaaccctcccgatccagtcaatggaatggtgcacgttatcaaaggcattcagttcggcagccagatcaagtacagctgtacaaagggataccgtctcattggctcttctagtgctacttgcataatctctggcgataccgtgatctgggataacgaaacacctatttgtgacaggatcccatgcggattgcccccaacaattgctaatggggacttcatcagcacaaatagagaaaactttcactacgggtctgtggtcacttacaggtgcaaccccggtagcggtggccgcaaggtgtttgaactggtgggggaaccatccatttactgcacctccaacgacgatcaagtgggcatttggtcgggccccgcaccacagtgcataatacctaataaatgcacgccgccaaacgtcgaaaacggcattctggtgtccgataatcggtcgctgtttagcctgaatgaggtggtggaatttcggtgtcagccagggttcgtcatgaaaggccctcgtcgcgtcaaatgccaggccctcaataagtgggagcctgagctcccaagctgtagcagggtctgccagccccctcctgatgtgctgcatgcagaaagaacacagagagacaaggataatttctctcccggtcaggaggtgttttactcttgtgagcccggttacgatctaaggggcgccgctagtatgaggtgtactcctcagggtgactggtcccccgccgctcccacttgtgaagtaaagagctgcgacgatttcatggggcaactgctaaacggccgagttctcttcccggtcaatctgcagttaggcgccaaggtggattttgtctgtgatgaggggtttcagctgaagggatcaagtgccagctattgcgtgcttgccggcatggaatccttgtggaattcctccgtgcctgtgtgtgagcagatattttgccccagcccgcctgtaatcccaaatggtcgacacacaggaaagcctctggaggtgttcccgtttgggaaaactgtgaactatacatgtgacccacaccccgatcggggtacttctttcgatctcattggcgagtcgacgatccgctgcacatccgacccccagggcaatggagtctggagcagtcctgctccccgttgcgggatccttggacattgccaggcccccgaccacttcctgtttgctaaactcaaaacccagactaatgcctctgattttccaatcggcacctctctcaaatacgagtgccggccagaatattatggtcgtcccttctctatcacatgcctggataacctagtgtggtctagccctaaagacgtttgcaagcggaaatcatgcaagacaccacctgatcctgtgaatggcatggtacatgtgatcacggacatccaggttggctccagaatcaactactcttgcacaacaggtcaccggctcatcgggcactcttccgccgagtgtatactgagtggtaacgcagctcactggtcaacaaaacctcctatctgccagcgtatcccttgcggactgcctcccaccatcgcaaatggcgactttatcagcacaaatagggagaatttccactatgggagcgtcgtcacctacagatgcaatcctggaagcggcggacgtaaagtcttcgagctcgttggagagccgtcaatctactgcactagcaatgacgatcaggttggcatatggagtggaccagcacctcaatgcataatcccaaacaagtgtacgccacctaacgtcgagaatggaattctggtgtccgataacaggtcgctcttttctctcaacgaggtggttgagttccgctgtcaaccagggttcgttatgaaaggaccccgccgggttaagtgccaggccctcaataaatgggagccagaattgcctagttgctcccgggtctgtcagccgcctccagatgtattacacgctgagcgcacccagagagataaagacaatttcagcccaggccaggaggtattttactcctgcgagcccggctatgacctgaggggcgctgctagtatgcgatgcacgccgcaaggtgattggagcccagctgccccgacgtgtgaggtgaaatcctgtgatgactttatgggtcagttgttaaacggcagagtgctgttcccagtcaacctccagctgggtgctaaagtggactttgtttgcgacgagggatttcaactcaagggatcatcagcttcgtactgtgttctcgccgggatggaatccttatggaattcttcagttcccgtctgcgaacagattttctgcccctccccccccgtcattccaaatgggcgacacacagggaagccactggaagtttttccattcggaaaggccgttaactatacttgtgaccctcacccagaccgaggaacatcttttgacctgattggtgaaagtactatccggtgcactagcgacccccagggcaacggggtttggtcgagccctgctccccgctgcgggatcctcggacattgccaggccccagatcactttctttttgcaaagctgaaaacacaaactaacgcatcagacttccctattgggacgtccctcaaatacgagtgtaggccagaatactatgggagaccttttagcataacatgtttggataacctggtatggtctagtccaaaagacgtatgtaaaaggaagagttgcaagactccacccgatcccgtgaacggcatggtccacgtgatcacagatatccaggttggaagtagaatcaattatagctgtacaaccggccataggttgatcgggcacagctccgcagagtgcatcctctccggcaacactgctcactggagcactaaaccacctatctgtcaaaggattccttgcggactcccaccgacgattgccaatggcgattttatatccacgaatagagagaattttcattacggctccgttgttacatatagatgtaacctcgggtcgagaggcaggaaggtctttgaacttgtcggagaacctagcatctactgcacatctaacgatgaccaggtggggatttggtcaggtcctgccccccagtgcattattcccaataagtgtacccctcctaatgtggaaaatggcatcctggtaagtgataaccgttcattgttctccttgaacgaagttgtagagtttagatgccagcccggattcgttatgaaggggccaagacgggtgaagtgtcaagctcttaacaagtgggaacccgagctcccctcctgctctcgcgtctgccaaccccctcccgagatcctgcatggagagcacactccctctcatcaagataacttctccccagggcaggaagtcttttactcttgtgaacctggatacgacctacggggagccgcttcgttacactgtactccacagggcgactggtctcccgaggcccctaggtgtgcggttaaatcctgtgatgactttctgggacagttacctcacggccgagtgctgtttcccctcaacctgcaactcggcgccaaggtttcatttgtttgcgacgaaggctttcggttgaaaggatcctccgtttcgcactgcgttcttgttgggatgagatcactgtggaacaactccgttccagtttgcgagcacatcttctgtcctaatccaccagcaattctaaatggacgccataccggcacgccctccggcgacattccatatggcaaggagatatcctacacatgcgacccccaccctgacaggggcatgacctttaatctcatcggtgaatctaccattagatgcactagcgacccccatggaaacggagtgtggtcttcccccgccccccgatgtgagctgagtgtgagggcggggcactgtaagacccctgaacaatttccttttgcctctccaacaatccccattaacgactttgaattccccgtggggacttcactgaactatgagtgccgtcctggctactttggaaagatgttttccatctcttgcctggagaacctggtctggtcaagcgtggaagataactgccgccgaaagtcctgtggcccccctccggagccattcaacgggatggtgcacatcaatacagacacccaattcggctccacagtcaactacagctgtaacgaggggttcagactgatcggtagcccaagtaccacttgtcttgttagtgggaacaacgtgacgtgggacaagaaggcgcccatatgtgagattatttcctgcgaaccaccaccgacgatttcaaacggtgacttttactcgaataacagaacgagcttccacaatggtactgtagtcacttaccagtgccatactgggccagatggtgaacagctcttcgagttggtgggagagcgttctatttattgcacaagcaaagatgaccaggtcggtgtgtggtctagtcccccgcctcgctgtatctccaccaataagtgtaccgctcccgaggtcgaaaatgcaatcagggtgccaggaaatagaagtttcttcacacttacggaaataataaggtttcgctgtcaaccagggtttgtcatggtcggttctcacacggttcagtgtcagacaaacggaaggtgggggcccaagttgccccactgttcacgcgtttgtcagcctccaccagagatcctgcacggggagcacacactctcccatcaagataatttttccccaggacaggaggtattctactcctgtgagccatcttacgatttgcgaggagcagcaagcctccattgtacgccccagggcgactggagccccgaagccccacggtgtaccgtgaagagttgcgatgattttctgggacagctaccccatggtagagtgcttctccctctcaatctccagcttggcgccaaagtgagtttcgtatgcgatgaaggattccgcctaaagggccggtctgcatctcactgtgtgttggcaggtatgaaggctctgtggaatagcagcgtccccgtttgcgagcagatattctgcccaaaccctcctgcaatcctcaacggcaggcacactgggacgccattcggcgatataccttatggaaaagagataagttacgcctgcgatacgcatcccgatcgagggatgactttcaatctaatcggcgaaagctcaataaggtgcacaagcgatcctcaaggtaacggggtgtggagctcacctgcccctcggtgtgaattatctgttcctgcagcgtgtccccaccctccgaaaatccaaaatgggcactatattggaggacacgttagtctctaccttcccgggatgactatttcctatatctgcgatccaggctacctgctggtgggaaaggggtttattttttgcacggatcagggaatctggtcccaactggaccactactgtaaagaagttaattgttcttttccactattcatgaatgggatcagcaaggaactggagatgaagaaggtgtaccactacggagattatgttaccctcaaatgcgaagatggatataccctggaggggtcaccctggtctcagtgtcaggcagacgacaggtgggacccaccgctggccaaatgtacgagtcggacgcatgatgccctcattgttggtaccctttctggaaccatatttttcatactgcttattatcttcctgtcttggataattctgaaacatagaaaggggaataacgcccacgagaatcctaaggaggtggccatccacctgcattcacaaggtgggtcatccgtccatcccaggactctccagactaacgaagagaacagtagggtgttgccttag

SEQ ID NO: 112747 - DNA, 6120 bp, Artificial Sequence
  Description of Artificial Sequence: Synthetic coding sequence
atgggagcctcatcacccaggtcgccagaacccgtaggtccccccgctccaggactaccattctgttgcgggggcagcctgctggccgtggtggtgctcctggcacttccagtggcatgggggcagtgcaacgctcccgagtggttgcctttcgcaaggcctacaaacctcacagatgagtttgagttcccaataggaacttaccttaattacgagtgtcgcccagggtacagtggccggccgtttagcattatctgcttgaaaaatagcgtttggacaggagccaaagatcgctgtagaagaaaaagctgtagaaatccgcctgacccagtgaacgggatggtccatgtgatcaaggggatacaattcggcagtcaaatcaagtattcttgcacaaaaggttatagactcattgggagttctagcgcaacatgcatcatctcgggtgacaccgtgatctgggacaacgagacacctatttgtgatcgaattccatgcgggctgccacctaccatcaccaatggagactttatatccacaaatcgagaaaacttccattatggtagtgtcgtgacatatagatgcaaccctggttcaggtggcagaaaggttttcgaacttgtgggggaaccttccatctactgtacaagcaacgatgatcaagtgggaatctggtcgggacctgctccacagtgcatcatccccaataagtgcactccccccaacgtggagaacggcatcctcgtgtcagataatcgcagcttgttctcactgaatgaggtcgtggaatttcgatgccagcccggttttgttatgaagggcccaaggagggtgaagtgccaagctttgaataagtgggaacccgaattgcccagctgttccagggtatgccaaccgccccctgacgtcctccacgccgaaagaacccagagggacaaggacaacttcagtccaggacaggaggtcttttacagttgtgaacccggatacgatctgcggggagcagcatcgatgaggtgtacccctcaaggcgactggagcccagcagcacccacatgtgaggtcaagagttgcgatgattttatggggcagcttctgaacggtcgtgtgctgtttccagtgaatctacaattgggtgctaaggtggacttcgtgtgcgatgaaggattccagctgaagggttcttcagcttcatattgcgtgctggccggcatggaatcactctggaactcctctgttcccgtgtgcgagcagattttttgtcctagcccacccgtcatcccgaacggtagacatactgggaagccactggaggtgttccccttcggcaagactgtcaattacacttgtgatccacacccagaccggggaacatccttcgatttaatcggtgagtcaacaattcgttgcacaagtgatcctcaaggtaacggagtatggtcttctcccgccccccgctgcggaattctgggccactgccaggcccctgatcactttctttttgccaagttgaagacccagacaaatgcctctgatttcccaattggaacatcactaaagtacgagtgccgacccgaatactacggccgccccttcagcattacctgtctggacaatctcgtttggtctagccccaaggatgtgtgtaaaaggaagagttgtaagactccccctgacccagtgaacgggatggtccacgtgatcacggacatccaggttggctcaaggattaactattcatgtacaacaggccatcgcctgattggacactcctccgctgaatgtattctgtctgggaacgctgcccattggagcaccaagccccccatttgccagcggattccctgcgggctccctcctacaattgctaacggcgatttcatttctaccaatagggagaacttccattacggatcagtggtgacatatcgatgcaacccaggctctgggggccgaaaagtgtttgaactcgtcggtgaaccatcgatctattgtacttccaatgacgaccaagttgggatctggagcggcccagctccacagtgcattatccctaacaagtgcacccctccaaatgttgaaaatggaatcctggtaagcgataatagatcactgttctcactcaacgaggtggtggagttccggtgccagccagggttcgtgatgaaagggccacgacgtgtcaaatgccaggctctgaacaagtgggaaccagaacttccttcttgcagtcgcgtgtgtcagcctcctcccgatgtacttcacgccgagaggacacaaagggataaagacaattttagccctggtcaagaagtgttctacagctgtgaaccagggtacgatctcagaggggccgcttccatgcgatgtacccctcaaggggattggagccctgccgctccgacttgcgaggttaagtcttgcgacgatttcatggggcagctacttaatgggcgagtactgttccctgtcaatctgcaactgggtgctaaggtggacttcgtgtgtgacgaaggtttccaactgaaggggagtagcgcttcttactgcgtgttggctgggatggagagcttgtggaatagcagcgtgccggtgtgtgaacagatattctgcccctccccgcctgtaattccaaatggcagacatactgggaaacctctcgaggtttttcctttcggtaagaccgtgaactacacctgtgatccccatccggacaggggaacttctttcgatctcatcggagagtcaactattcggtgcactagcgatccccagggaaatggggtgtggagcagccccgccccgcgctgtgggatactggggcattgtcaggcaccggatcatttcctcttcgccaagctgaagacacagaccaatgcatccgattttccaataggcacatcacttaagtatgagtgcagacccgaatattacggccggcccttttccattacttgtctcgataatctagtttggagcagccccaaagacgtgtgtaagagaaagagctgcaagacccctcctgatcccgtgaacgggatggtgcatgttattacggacatccaagtggggagccggataaactacagctgtacaacaggccaccgcttgatcgggcactcctccgccgaatgcatcctgagcggaaatacagcccactggagcactaagccaccaatctgccagcgaatcccctgtggactccccccaaccatcgccaatggggattttatatcaactaatagggaaaatttccattatgggagtgtggtgacttaccggtgcaacctgggaagccgcggaaggaaggtctttgagctggtcggcgagccctcaatatactgtacatctaacgatgaccaagtgggtatttggtccggccccgccccacagtgcataattcccaacaagtgtaccccccctaatgtggaaaatggtatcttggtttccgacaatagatctctgttctccctgaatgaagtggtggaattcagatgtcaacctggattcgttatgaagggacctcggcgcgtcaagtgccaggctcttaataagtgggaacccgaattaccctcttgctcaagagtgtgccagccaccacctgaaatactgcacggcgagcacacccctagccaccaggacaattttagccctggccaggaggtcttctacagttgtgaaccaggctatgatctgcgcggcgcggcatccttacactgtacaccacagggagattggtcccccgaagctcctcgatgcgcggtaaaatcttgcgacgatttcttgggccagctcccacacgggagagtgctcttcccactgaacttgcagcttggcgccaaggtttccttcgtgtgcgacgagggctttagactaaaggggtcatcggtgagccattgtgttctggtggggatgcgcagcttatggaataactccgtgccggtgtgtgaacacatcttctgtccaaatccacctgcgatcttgaatggtcggcatactggtacccctagtggcgatattccctacggcaaagagatttcctacacctgtgacccacatcctgaccgagggatgaccttcaatctgatcggggagagcactatacgctgcaccagcgacccgcacgggaatggtgtctggtcaagcccggcccccagatgtgaactgtcagtgagagcaggacattgcaagacacccgaacagtttccatttgccagtcccactattccaatcaatgattttgaattccctgtgggtacgtccctcaactacgaatgtcgccctggctactttggaaaaatgttcagcatctcctgcctcgagaacctggtgtggagcagcgtagaggataattgtagaaggaagtcatgcgggccgccgcccgaacctttcaatggcatggttcacatcaacacggatactcagtttgggtctaccgttaattactcttgtaacgaggggttccgcctgatcggctctccctctactacatgtctggtatccggaaacaatgtgacctgggataaaaaagcccccatatgtgagatcatctcatgcgagcctcctccaactatctcaaatggcgacttctattcgaacaaccgtacctcttttcataatgggacagtcgtcacataccagtgccatactggcccggacggtgagcaactgtttgagctcgtgggcgagcgttcaatctattgcacaagcaaggatgatcaggttggagtttggtcaagtccacccccccgttgcatcagtacaaataaatgtactgcccctgaagtggagaacgcaatccgggtccccggcaacaggtccttttttactcttactgagatcataagatttaggtgccagccggggtttgtcatggttggcagccatacggtgcagtgtcagactaatgggcgctgggggcctaaactccctcactgctcacgcgtttgtcagccccccccagaaatcttgcacggggaacacaccctctcacaccaggataatttttctccaggccaggaagtgttttactcatgcgaaccaagctatgatcttagaggggccgcctctttacattgcacccctcagggcgattggagtcctgaggcccccagatgtaccgttaagagctgcgatgacttcctcggccagctgccccacggccgtgttctgctaccgctgaatctgcagctgggggccaaggttagcttcgtgtgcgatgaggggttccgtctcaagggaaggtctgcctcccactgcgtgctcgctggcatgaaggcattatggaattcaagcgtgcctgtgtgcgagcagattttttgtcccaatcccccagcaattttaaacgggcgtcacaccggcactcctttcggagatatcccatatgggaaggagattagctacgcctgcgatacccacccggacagggggatgacatttaacctgataggagagagctccatccgctgcacaagcgacccacaaggtaatggtgtctggtcgagtccagctccgcgttgtgagctgtcggtgccagccgcgtgtccacaccccccaaaaatccaaaatggccattacattgggggccacgtaagcctctatctgcccggcatgacgatatcctacatctgtgaccccggctatttgctggtgggcaaggggttcatcttttgcaccgaccaggggatctggtcccaactggatcactattgcaaagaagtgaactgtagctttcccctgtttatgaatggaatctcaaaggagctggaaatgaagaaggtgtaccactacggagattacgttacacttaagtgtgaagatggatacaccctggaaggatcaccatggtcccaatgccaggccgacgaccggtgggaccctcccctggctaaatgtacttcacgcacccatgacgccttaatcgtcggtaccctgtccggcaccatcttctttatcttgttaattattttccttagttggattatcctgaagcaccgtaagggcaataacgcacatgagaaccccaaggaagtggcgatccacctacactctcaggggggctccagtgttcaccctcggacccttcaaacgaacgaagagaacagccgcgttttaccctag

SEQ ID NO: 112748 - DNA, 6120 bp, Artificial Sequence
  Description of Artificial Sequence: Synthetic coding sequence
atgggggccagtagtcctcggtctcccgagcccgtgggaccacctgcccccggcctccctttctgttgtgggggcagtctcctggcggtcgtagtgctgctagctctcccggtcgcatggggacagtgtaatgcacctgagtggctcccttttgcccgcccaacaaatctgacagatgagttcgagttcccgatcggcacttacctcaattatgaatgccgccccgggtatagtggtagacctttcagcatcatctgcttgaaaaattctgtctggaccggagcgaaagatcgttgcaggaggaagtcgtgtaggaatccgcctgatcctgtgaatggtatggtgcacgtgatcaagggaatccaatttgggagccaaatcaaatacagctgtacaaagggatacaggttgatagggagctcctccgccacgtgtatcatctcaggggataccgttatctgggataatgaaacaccgatctgcgatcggatcccatgtgggctgccgcctactatcacgaatggcgacttcatttcaactaacagggaaaatttccattatggatcagttgtgacctatcgctgtaatcccggtagtggcggccgtaaggtgttcgagctcgtcggcgaaccctctatatactgcaccagcaatgatgaccaggtcggcatctggtctggtccggccccacaatgtatcataccaaacaaatgcacgccaccaaacgttgaaaacgggatcctggtaagtgacaacagatctctattcagcctcaatgaggttgttgagttccgatgccaacctggcttcgttatgaagggccccagacgagtcaaatgtcaggccttgaacaagtgggagccagaacttccaagttgttcacgggtgtgccagcccccgccagatgtgctgcatgccgaacgtacgcagcgcgacaaggacaacttctcccctggacaggaggttttctatagctgtgaacccggctacgaccttcgtggtgctgcctctatgcgttgtactcctcagggagactggagtcctgcggccccaacctgtgaggttaaatcttgcgatgattttatgggacaactccttaatggcagggtcttgttcccagtaaacctccagcttggagccaaagttgattttgtttgcgacgagggtttccaactgaaagggtcaagcgcatcttattgcgtgttggcagggatggagagcctctggaactctagtgtgcccgtgtgcgaacagattttctgcccttcacccccagttattcctaacggcagacacaccggcaagccacttgaggtgttccccttcgggaaaaccgtcaattatacatgcgacccccaccccgacagaggaaccagtttcgatctaattggggagtcgactattagatgtacctccgacccccaaggcaacggcgtgtggagctcacctgcaccacgatgtggcattttaggccactgccaagctcccgaccattttcttttcgccaagctgaagactcaaacgaacgcatccgactttcctatcgggacaagtttaaagtatgaatgcagacctgaatattacggtcggccctttagcatcacatgcctggacaacttggtctggtcctcccctaaggatgtgtgtaaacgaaaatcatgcaaaacaccgcctgaccctgtgaatggaatggtccacgttattacggatattcaagttggtagcaggataaattactcctgcaccacggggcacagactgatcggccattcatctgctgaatgtattctcagcgggaatgccgcccactggtccacgaaaccccctatatgccagcgcatcccgtgtggcctaccacctacaattgctaatggcgactttatcagcaccaaccgggaaaattttcactatggaagtgtcgttacttacagatgtaatcctggctctggcggacgaaaggtcttcgagctagtgggggagccgagcatttactgcacgtctaatgacgatcaagtggggatctggtccggccccgcacctcaatgtatcattccaaataaatgcactccccccaacgtcgagaacggcattttggtgtctgataatcgcagtctgtttagccttaacgaggtagtggagttccggtgccagccaggatttgtgatgaagggacccagaagggtgaagtgtcaggctttgaacaaatgggagcctgagttaccctcctgttcacgcgtatgtcagccaccaccagacgtgctccatgcagagcgcacacagcgggacaaagataatttctcccccggtcaagaggtgttctattcgtgcgagcctggctacgacttacggggcgcagcatccatgagatgcaccccccagggcgactggtccccagccgcccccacctgtgaagttaagtcctgcgacgatttcatggggcaattattaaacggacgggtgctctttcctgtcaatttacagttaggagcaaaggtggattttgtgtgcgatgaaggttttcagctcaagggcagtagcgcctcgtactgcgttttggccggcatggaatcactgtggaatagcagcgtcccagtctgtgagcaaatcttctgtccctcgccaccagtgattccaaacggcagacatacagggaaaccactcgaagttttcccattcggaaaagcggtaaactacacctgcgatccgcaccctgatcgtggaactagcttcgacttgattggcgagagcacaattaggtgtacctccgacccccaagggaatggagtgtggtcgagccccgctccacggtgtgggattctaggacattgccaggcccctgaccattttctgttcgcgaagttgaaaactcaaaccaatgccagcgacttccccatcggtacaagcttgaagtacgagtgccggccagaatattacgggcgacccttcagtataacttgtctagataacctcgtctggtcttctccgaaggatgtatgtaagcggaagagctgcaagacgcctccagatccagttaacggaatggttcacgtgattacggacattcaggtcggatccagaattaactacagctgtaccactggccacaggctgatcgggcacagctccgccgaatgcatactgtccgggaatacggctcactggtccactaagcctcctatatgtcagaggatcccatgcggcttgcccccaactatagccaatggtgacttcatttctaccaatagggagaactttcattacggctctgtggtgacttacagatgcaatctcggaagccgcgggagaaaagtgttcgagctagttggcgaaccttcaatctattgtacttctaacgacgaccaggtagggatctggagcggcccagccccgcaatgtattattccaaataagtgcacgccaccaaatgttgaaaatggcattctcgtgtccgacaaccgatccctatttagtttaaacgaggttgtggagttcaggtgtcagcccggattcgtcatgaagggacccaggagggtgaagtgccaggctctaaataagtgggagccggagctgccttcttgtagccgggtgtgccaacccccccccgagattctgcacggcgagcacactccttcacaccaggacaatttctcgcccggccaggaagtattttacagctgcgagcccgggtatgatcttcgcggcgcagcgagtctccactgtacccctcagggcgattggtcgccagaagccccccggtgcgccgtgaagtcatgcgatgactttttgggacagcttccacacggcagagtccttttccccctcaatctgcagttaggagctaaggtaagtttcgtttgcgacgagggatttaggctcaagggttctagtgttagccactgcgtgctcgtaggcatgcgatccctttggaataattctgtgcccgtgtgcgagcatattttctgcccaaatccccccgctatactcaacggcagacataccggaactcccagcggagacatcccatacggtaaggaaatcagctatacttgcgatccacatcccgatcggggaatgacctttaacttgattggggaaagcacgatcagatgtacttctgatccgcacgggaacggggtgtggtccagtcctgccccacgctgtgaactgtcggtccgggcaggccattgtaagacccccgagcagtttccgtttgctagcccaaccattccgatcaacgattttgaatttccagtagggactagtcttaactacgaatgtcggcctggatactttggcaagatgttttcaatcagctgtctggaaaaccttgtctggagctctgtagaggacaattgccgtcgcaagtcttgtggccctccaccagagccgttcaatggcatggtgcatatcaataccgatacgcagttcggcagcaccgtgaactattcatgcaacgaaggcttcaggctgattgggtcacctagcaccacttgtttggtcagtggaaataatgtaacttgggacaagaaggcgccaatctgcgagatcatctcttgcgagcccccccctaccattagcaacggcgacttttatagcaacaatcgaacttcctttcacaacggcactgttgtaacctatcagtgccacaccgggccagatggtgagcagctctttgagctggtcggcgagaggtcgatttactgtacaagcaaggacgaccaggtgggcgtgtggtcctcccctccacctagatgcatcagcactaacaagtgtaccgcccctgaggttgaaaacgccatacgggttccagggaacagatcatttttcacactgaccgagatcattcgctttagatgccaaccaggattcgtaatggttggaagccacacagtgcaatgccagactaatggccggtggggtccaaaactgccacattgttcgcgcgtttgtcagccaccccctgagatccttcacggcgagcatacactttcccaccaagacaacttcagtccaggtcaggaggttttttacagctgcgagccctcctacgatctgaggggagcagcttcactgcattgtaccccacagggggactggtcccctgaggctccacgctgcacagttaagagctgcgacgatttcctggggcagttgcctcacgggagggttctcctgccactgaatttgcagctaggtgccaaagtgagcttcgtgtgcgacgaggggtttcgtttgaaggggcgcagtgctagccactgcgttctcgcagggatgaaggcactgtggaattcatctgtgccagtctgtgagcagatcttctgcccgaatcccccggccattctcaacggcagacacacaggcacgccatttggcgatatcccatatgggaaggaaatctcgtacgcgtgtgacactcaccctgatcggggaatgaccttcaacctgatcggagaaagcagcatcaggtgcacatctgatccccagggaaatggtgtgtggtcttcccccgcgcctcgatgcgagttgagtgtgcccgctgcctgtcctcatccccccaagatacagaatgggcactacatcggaggccatgttagcctatatctgcctggcatgactatctcctatatttgcgatcccgggtatcttctggtaggcaagggctttattttttgcactgaccaggggatctggtctcaactagatcattattgtaaggaggtgaactgctcatttcccctgtttatgaacggaatttcaaaagagttggagatgaagaaggtgtatcactacggcgattacgttaccttgaaatgcgaggacgggtacacactcgaggggagtccttggagccagtgccaggcggacgatagatgggatccgcccctggctaaatgtacgtcacgaacccatgatgccttaattgtgggtactttatcaggcactatcttcttcatcttgctgattatttttctgtcctggataattcttaagcacagaaaaggtaacaacgcccacgagaatcctaaggaggtggccattcacttacacagccagggcggcagctctgtgcatccccgcacactccaaacgaatgaagaaaacagtagagtgttaccttag

SEQ ID NO: 112749 - DNA, 6120 bp, Artificial Sequence
  Description of Artificial Sequence: Synthetic coding sequence
atgggtgcctcttctccacggtctccagagccagtggggccaccagcaccgggattgccattctgttgtggtggatcactgttggccgttgtggtgctcttggccctccccgtggcctggggtcagtgcaatgctccagaatggctgcccttcgctcgacccaccaatttgacggacgaatttgagttccctatcggaacctatctcaactacgagtgcagaccgggctacagtggtagacctttctccatcatctgcctgaagaactcggtgtggaccggtgcaaaggacaggtgtcgtagaaaatcctgtcgaaaccccccggaccccgtgaacggcatggtgcatgtgatcaagggaattcagtttggcagccagattaaatacagctgtaccaagggatatcgcttaatcggaagttcctccgctacttgcatcattagcggggatacagtgatttgggacaacgagaccccgatctgtgaccggatcccctgcggtcttccacccacaattactaatggagactttatctctacaaatcgtgagaattttcactacggatcggttgtgacatatcggtgtaaccctgggtcggggggacggaaagtttttgaactcgtcggggagccctcaatctactgcacatcgaatgatgatcaggtgggtatttggtcgggacctgcccctcaatgcatcatcccaaataagtgcacaccacccaacgttgaaaatggtatactggtttctgacaacagatctttgttctcgctgaacgaagttgtagagttccgttgtcaacccggctttgtcatgaagggcccccggagggtcaagtgtcaagccctgaataaatgggaacctgagctgccaagttgtagcagagtgtgccagcccccacccgatgtgctgcatgccgaacgcacccagcgcgataaggacaatttttcacctggccaggaggttttttattcctgtgagccgggatatgatctgagaggtgcggcttctatgaggtgcacaccgcagggagattggtcccccgccgctccaacgtgcgaggtgaaatcatgcgatgattttatgggacagctgctcaatgggcgtgtgctatttccagtcaacctccagctgggcgccaaggtagatttcgtgtgtgatgaagggttccagctgaagggctcctcagcatcatactgcgtactcgccggcatggaatcactctggaattcaagcgtgccggtctgcgaacagattttttgcccctcacctccagttatccccaacgggcggcataccggcaagcccttggaggttttcccttttgggaaaactgtgaattacacctgcgaccctcatccagaccggggtacgtccttcgatctcatcggggagtctacaattcgctgtacttctgatccccaggggaatggggtttggtcgagccctgcccctagatgtggaattctcggccattgtcaggcccctgaccactttttgttcgctaagttaaagacacaaaccaatgcgtcagatttcccaattggaacctctcttaagtatgagtgcaggcctgagtactacggaaggcccttttcaattacttgcctggataacttggtgtggtcttctcctaaggatgtgtgcaagcggaagagctgtaagaccccgcctgatcctgttaatgggatggtgcacgttataactgatattcaagtgggttcaagaatcaattactcttgtacaaccggacacaggctgattggacactcctctgcagaatgcatactttcaggcaatgccgctcactggtccaccaagcctccaatttgtcagcggatcccctgcggtctccccccaactatcgccaacggagacttcattagcactaatagagaaaacttccattacggaagtgtggttacttatcgatgcaaccccgggtccggaggtcggaaggtctttgagcttgtgggtgaacccagcatctactgcacatcaaacgatgatcaggttggcatctggtccggaccagcacctcagtgcatcataccaaacaagtgtacccctcctaacgtggagaacgggattttggtttctgataacagaagtctgttttccctgaacgaggtggtggagttccgctgccagccgggatttgttatgaagggtcctcgcagagttaagtgccaagcattgaataaatgggagcccgagttgccaagctgcagtagggtgtgccaacctccacctgacgtgctgcacgcagaacggacccagcgagataaggacaacttctctccagggcaggaggttttctactcctgcgagccgggctacgacctcaggggggccgcctccatgcgctgcaccccgcagggcgattggagcccagctgctcctacttgtgaggtgaagagctgcgacgatttcatgggtcagttgctcaacggcagggtcttatttcctgtcaacctgcagctgggagccaaggtagatttcgtctgcgatgaaggctttcagcttaagggaagctcagcgagttactgcgtgctggctggcatggaaagtctctggaattcatccgtgccagtttgtgagcaaatcttttgcccttctcctccagtcatccccaacggtagacatacaggcaagccgctcgaggtcttccccttcggtaaagctgttaattatacttgcgatcctcatcctgacaggggaacctcattcgatttgattggtgagagtactattaggtgtacttccgatcctcaggggaatggagtgtggagctcgcctgctcccagatgcgggatcctcggacactgtcaggcgccagaccatttcctgtttgccaaattgaaaacccaaacgaatgcttcagactttccaataggaactagcctcaaatatgagtgcaggcctgagtactatggcaggcctttctctatcacctgcctggataacctggtctggtcttctcccaaagacgtctgcaagagaaagtcttgcaagacacccccggaccccgtaaatggaatggttcacgtcatcaccgacatccaggtgggctctcggatcaattatagttgcacgactggccatagattgatcggtcactcctccgctgaatgcatcttgagcggcaacactgcccattggtcaaccaagccacccatttgtcagcgcatcccttgtggccttccccccaccattgccaatggcgattttatcagtaccaacagggaaaacttccattatggctctgtcgtgacctatcgctgtaacttggggtctcgaggcagaaaagtctttgaactggtgggagaaccctcaatttattgcacctctaatgacgatcaggtcggcatctggagcggccccgctcctcaatgcatcatccctaataagtgcaccccaccaaatgtcgagaatggcatattggtttctgataaccgctccctgttcagtctcaatgaggtggtcgaattcagatgccagcccggatttgtgatgaaaggcccaagacgcgttaaatgccaggccctgaataagtgggagccagagctcccttcctgctcgagggtgtgtcagcccccccctgaaatcctccatggggaacataccccttcacatcaggacaatttctctcctggacaggaagtattctactcgtgcgagccaggttatgatttgcgaggagccgcctctctccattgcacgccacaaggcgattggagtcctgaggcacctcggtgcgcagtcaaaagctgcgacgacttcctcggacagctgccccacgggagggtgctatttcctttgaacttacagctgggcgccaaggtatcattcgtgtgcgacgaggggttccgcctgaaaggctcatcagtgtcacattgtgtactggtgggaatgcgcagcctgtggaataactccgtgcccgtttgtgaacatattttttgtcctaacccacctgcaattctgaacggccggcacacagggacgccctccggggatataccctatggcaaggagatcagctacacatgtgacccgcatccagacaggggtatgacctttaatcttattggagaatccactatacgatgcacatcagatcctcacggtaacggcgtctggagttctcctgctcccagatgcgagttgtccgtgagagcaggccactgtaaaacccctgaacagttccccttcgcttcccccactatccccataaacgatttcgaatttccagtcggtacttctctcaactatgagtgcagacccgggtactttggcaagatgttcagtatctcctgcctcgagaacctggtatggagctcagttgaggataactgtaggagaaagtcctgtggtcctcctcccgagcccttcaacggcatggtgcacattaacacagacacccaattcggctctaccgtgaactattcttgcaatgaagggtttcgccttattgggtcacccagcacaacctgcctggtatccggtaacaatgtcacgtgggataagaaggcacccatctgtgagattatcagctgcgagcctccacctactatctccaatggtgatttctatagtaacaacaggacgtcctttcacaatggaacagtagttacgtatcagtgtcatacaggaccagatggtgagcagctgttcgagctggtgggcgagaggtccatctactgtacttccaaagacgaccaagtgggagtgtggagttcccccccacctagatgcatctctacaaacaaatgcactgccccagaggtggagaacgcaatacgcgtaccaggaaacaggtcttttttcaccctgacagagattattcgtttccgttgtcagccaggtttcgtgatggtgggtagtcacaccgtgcagtgccagaccaacgggcgttggggacccaaactgcctcattgtagcagggtgtgtcagcccccccctgagatcctgcacggggagcacaccttgtcgcaccaggacaacttctcgcccgggcaggaggtgttctattcctgtgagccaagttatgacttgcgaggtgcagcgtccctacattgcacgcctcaaggggactggagtccggaagcacctagatgcacagtgaagtcgtgcgacgatttcctggggcagctgccgcacgggcgggtcctgctgcctctgaatctacagctcggagcgaaagtgagctttgtgtgcgatgagggctttaggctcaagggacggagtgcttcacactgtgtgcttgctgggatgaaggctctctggaactctagcgtcccagtctgcgaacaaattttctgcccaaacccacccgctatactcaatggacgccatacagggacccctttcggggacatcccgtatgggaaagaaattagttacgcatgtgatactcatcccgatagaggtatgactttcaaccttatcggggagagtagcattaggtgcacttcggatccccaaggaaacggtgtttggtcctcgcctgctccccggtgcgagctgagcgtacctgccgcctgtccacacccacccaaaatccagaacgggcattacattgggggacatgtctcactctacctccccggcatgactatatcatatatttgcgatccgggctacctcctggtcggcaagggatttatattttgcaccgaccagggtatctggtcacagctcgaccactattgtaaagaggttaactgctcatttcccctgtttatgaacgggatctcaaaggaactggaaatgaagaaggtgtatcattacggcgattatgtaacactcaaatgtgaagatggttacaccctagagggcagcccctggtcacagtgccaggccgatgataggtgggatccgcctctagccaagtgcacatctagaactcatgatgctctgatcgtgggtacactgagcggaacaatattctttatcctgctgattatttttctgtcatggatcatactgaaacacagaaaggggaataatgcccatgagaacccaaaggaagtggcaatccacctacactcccagggaggcagttccgtccaccccagaacactgcagaccaatgaggaaaatagtcgtgtgttaccttag

SEQ ID NO: 112750 - DNA, 1755 bp, Artificial Sequence
  Description of Artificial Sequence: Synthetic coding sequence
ggccactgtcaggcaccagatcatttcctcttcgcaaagctcaagacgcagacaaatgccagtgactttcctatcggcacgagtctgaaatatgaatgtaggcctgaatattacgggcgtcccttctccatcacatgcctggacaatttggtgtggtcatcccccaaagacgtttgcaaacgtaaatcttgcaaaacgcctcccgatcctgttaacgggatggtgcacgtgataaccgatattcaggtagggtcaaggatcaactactcctgcacgactgggcatcgactgattggacattctagtgccgaatgtatacttagcgggaacgctgcacactggtcaaccaaaccgccaatttgtcagaggatcccctgtggacttccgcccaccatagccaatggagatttcattagcaccaatcgtgaaaactttcattacggcagtgtggtgacctaccggtgtaaccccgggagcggcggacggaaagtcttcgaacttgtgggggagcccagtatctactgtacctcaaacgatgaccaggtgggcatctggagcggtccagctcctcagtgcatcatcccaaacaaatgtaccccgccaaatgtggaaaatgggatcctggtttctgacaaccgctctttgtttagtctgaacgaggttgtcgagttccgctgtcaaccgggcttcgtaatgaagggcccacgcagagtgaagtgccaagctctgaataagtgggaacccgaactccccagctgcagtagagtatgccaacccccccccgacgtgctgcacgctgagagaacccagcgcgataaagataacttctcacctgggcaggaagtcttctatagctgcgaacccggctatgatttgcgaggtgcagcctccatgcggtgtactccacagggcgactggtcacccgccgctcccacctgtgaggtgaaaagctgtgacgactttatgggacagcttctcaacgggcgtgtgttgttccccgttaatctgcagctgggtgccaaggtcgactttgtttgtgacgaaggctttcagctgaaagggagttctgcatcttattgcgtacttgctggtatggagtccctctggaacagtagcgttcctgtgtgtgaacagatcttctgcccttctccgccagtgattccaaacgggcggcacaccgggaaaccactcgaggtgttccctttcgggaaaactgtgaactacacttgtgacccgcatcccgatagaggcacaagttttgacttgattggtgaaagcaccatccggtgtacaagtgatcctcaaggcaatggagtctggtccagccccgctccgcggtgcggaattctcggtcactgccaggctcccgaccacttcctcttcgccaagctcaagactcaaaccaacgcttctgatttccctataggtacctctctgaaatacgaatgtcgccccgagtattacgggcgtcccttctctattacctgtctggataatctggtgtggagcagccccaaggacgtctgcaagcgcaagagttgcaaaacacccccagaccccgtaaacggcatggtgcacgtcatcacggatatacaggttggctcacgtattaactactcttgcacaacgggacatagattaattgggcacagttcagccgaatgtattctgagcggcaacgccgcgcattggagtacaaaacctccaatctgccaaaggtcatgccacctaccctgtgaactgtttgggaggtag

SEQ ID NO: 112751 - DNA, 1335 bp, Artificial Sequence
  Description of Artificial Sequence: Synthetic coding sequence
atggccccgcctgtgaggcttgaaagaccttttccttctaggcgttttcctggactgctgttagcagccctcgtgctactgttgagctcattctccgaccagtgcaatgtccctgagtggctgccctttgcccgtcctaccaatctgaccgacgatttcgaattccctattgggacctatctgaactatgaatgtcgccctggatactccggtagaccctttagcatcatctgcctcaagaatagcgtgtggacttcagccaaagacaagtgtaagagaaagtcgtgcagaaatccacccgatccagttaatggcatggcccatgtcatcaaggatattcagttcagatcccagataaaatacagctgtccaaagggctacaggctgattggatcttcgtccgctacgtgtattatttctggaaataccgttatttgggataacaagactccagtctgcgatagaattatttgcgggctgccccccacaatcgctaatggggacttcaccagtattagtagggaatacttccattacgggagcgtggtgacctatcactgtaacctgggtagcagggggaagaaagtattcgagcttgttggcgaaccttcgatatattgtacaagtaaagacgaccaggtgggcatctggtccggacccgctccccagtgtattattcccaataaatgcacccctcccaacgtcgaaaacggaatattagtgtctgacaatcggtcattgttctcactcaacgaagtcgtggagttccgatgccagccgggatttggcatgaagggcccctctcatgtaaagtgccaagcgcttaataagtgggagcccgagctgccttcatgttcccgcgtctgccagcccccacccgatgtgctccatgccgagcggacccagcgggataaagataacttctccccaggacaggaggttttctattcatgcgaaccgggatacgatctgaggggatccacttatctgcactgtacaccacagggagactggtcgccagcggcccccaggtgtgaggtcaagagttgcgatgatttcttaggccaactgccgaatggccacgtgctttttccactgaatttacagttgggagcaaaggtcgatttcgtgtgcgatgagggtttccagctgaagggttcatctgcatcctactgcgttctggcgggaatggagtccctgtggaactcatccgtccccgtgtgcgaacggaagagctgcgaaacccctcctgtccctgtgaacggcatggtgcatgtcattactgacattcacgtgggcagccggatcaactattcatgtacaacgggtttctag

SEQ ID NO: 112752 - DNA, 1710 bp, Artificial Sequence
  Description of Artificial Sequence: Synthetic coding sequence
atggcccctcctgtgaggttggaacgcccctttccttcccgccgctttccagggctgctgctggctgcactggtgttgcttctgtcctctttctccgaccaatgtaacgtaccagagtggctgccctttgcccgaccaactaacctgacagacgactttgaatttccaataggcacatatctcaattatgaatgccggccggggtactcgggccgcccattcagtattatttgcctgaaaaacagcgtctggacttccgccaaggataagtgcaaacgaaagagctgccggaatccccccgatccagtgaacggaatggctcacgtgatcaaagatatacagttccggtcacagatcaaatattcatgtccaaaaggataccgactaataggttcttcaagcgctacatgtatcatcagtggcaatacagtcatttgggataataaaacaccagtgtgtgataggatcatctgtggactgcccccaacaatcgctaatggtgacttcacgtctatttctcgtgagtacttccactatggatcagttgtaacttaccactgtaatttgggttcaagaggcaagaaggtctttgaacttgtcggggagcccagcatctattgtaccagtaaggatgatcaggtgggtatatggtctggacctgcgccacagtgcattatccctaacaaatgtactccgccaaatgtcgaaaacggcatcctggtgagtgacaatcgatcactcttttctttgaatgaggtggtggagtttagatgtcagccaggattcggtatgaaggggccctcgcacgtcaagtgtcaggccctcaacaagtgggaacctgagctcccctcctgtagccgggtctgccagccaccccctgatgtcttgcatgctgaaaggacgcagcgcgataaagataatttttcaccaggacaagaagttttctactcttgcgaacctggatatgacctgcgcggatcaacttacctgcactgtaccccccagggtgattggtccccggctgctccccggtgtgaagtgaagtcatgcgatgactttcttggtcagctaccaaatgggcatgtgttgtttccactcaatttgcagttaggcgccaaggtggacttcgtttgtgatgaaggattccagttgaagggtagttctgcttcgtattgtgttttggcgggaatggaaagtttgtggaacagctcggttcctgtgtgtgagcggaagtcctgcgagaccccacccgtgcctgtgaatggaatggtccatgtgatcaccgatatccatgtgggatccaggattaattattcatgcaccacaggacatcggctgatagggcactcttctgccgagtgcatcctgtcgggaaatactgctcactggtcaatgaagcccccaatatgtcagcagatattttgcccgaatccgccagcaatactcaacggaaggcatacaggaaccccattaggtgacataccttatgggaaagaggtctcttacacatgcgaccctcaccctgaccggggaatgacatttaatctgattggagaatcaacaatccgccgtacttctgagccacatggcaacggagtttggagttcccctgcacccagatgtgagctcccagtgggggctggaagccacgatgccttaattgtcggaaaattctacgaggtgttcgctgaagaattctgtcacctctag

SEQ ID NO: 112753 - DNA, 3279 bp, Artificial Sequence
  Description of Artificial Sequence: Synthetic coding sequence
atgggcgcagcggggctcctcggagtgttccttgcattagttgcccctggagtcttgggcatttcatgtggctctcctcctccaatcttgaatgggcgtatctcctactacagcacccccatcgccgtgggtaccgttattcggtattcttgttcaggaacgttccggttgattggggagaagagccttctctgcattaccaaagataaagtcgatgggacctgggataaacccgccccaaagtgtgagtacttcaataagtacagtagctgtcctgaacccatagttcctggcggctacaaaatccgcgggagtacaccatacagacacggcgattcagtgacttttgcatgcaaaacgaatttttccatgaatggaaacaaatcagtgtggtgccaggccaacaacatgtggggtccgacacgtttaccgacctgtgtgagcgtgttccccctggaatgtcctgcgctgccaatgattcacaatggccatcacacaagcgaaaacgtcggctccatcgcccctggactaagcgtaacgtactcatgcgaatccggatacctcctagtgggggaaaaaataattaactgcttgagtagtggaaagtggagcgccgtgcctccaacgtgcgaggaggctagatgtaagtccttaggccgttttcctaacggtaaagtgaaggaacctcctattctgagggttggtgtcaccgcgaatttcttctgtgatgagggatatcgtttacaggggcctccctcaagtcggtgtgtcatcgccggccagggggtggcctggacaaagatgccggtgtgtgaggagattttttgtccatctcccccacccattctgaatggacgtcacatcggcaatagcctcgccaatgtgtcatacggcagcatcgttacatatacatgtgatcccgatcctgaggaaggggtgaacttcatcctcattggggaatccacgctgcgatgcacggtggattcacagaagacaggtacatggagcgggcccgctccaagatgtgaactgagtactagcgctgtgcagtgtccgcacccccagattctgcgaggaagaatggtcagcggacagaaggaccgatacacatataatgacacggtgatcttcgcgtgcatgttcgggttcacacttaaaggatcaaagcaaatccggtgcaatgcccagggcacatgggagccttctgctccagtatgcgagaaggagtgccaggcgccgcctaatattcttaatgggcagaaagaggaccgccatatggttaggttcgatcccggcacctctataaaatacagttgtaacccaggatatgtcctcgtgggcgaggagtctattcagtgcacgtctgagggagtgtggacacccccggtgcctcagtgcaaagtagccgcctgtgaggccacaggacgacagcttctgacaaagccacaacaccaattcgttcgcccagatgtgaacagctcatgtggtgagggatacaagctcagcggatccgtgtatcaggagtgtcagggtacaatcccctggtttatggagattcgtctgtgtaaggagataacatgccctcctcctcctgtgatatataatggcgcccatacaggctcctctctggaggatttcccgtacggcactaccgttacctatacgtgcaaccctggccccgagcggggggtggaatttagcctcattggcgagtcaaccattaggtgcacctccaacgatcaggaaagggggacttggtctggccccgctcccctgtgcaagctctccctcctggccgtgcagtgctcccatgttcatattgccaatgggtataagatcagcggcaaagaggccccctacttttacaatgacacggtgacctttaaatgctactccgggttcacgctaaagggtagttcccagatccggtgcaaagccgataatacatgggatcctgagatccctgtctgtgagaagggctgccagagccctcccggactccaccatggccgccatacaggagggaatactgttttttttgtcagcggcatgaccgtcgactacacatgcgacccaggctaccttttggttgggaataagtctattcattgcatgccgtctggcaactggtctccgtcggcccctcggtgcgaggagacgtgccagcatgtgagacagtccctccaggaactgcccgcaggtagccgagtcgagctagtgaatacttcatgtcaggatggataccagctcacaggccacgcctaccaaatgtgccaggacgcggagaatgggatctggttcaaaaaaattcccctgtgcaaggtgattcactgccatccaccccctgtgatagtgaacggaaagcacacagggatgatggctgaaaatttcctctacggcaatgaagtgtcatacgaatgtgaccagggcttctatctgctgggagaaaagaaactgcagtgcaggtccgattcaaaaggccatggttcctggtccgggccgagtccccagtgccttcggtccccacccgtgaccaggtgtccgaatcctgaagtaaagcacggctacaaactgaataagacacattccgcatactcacataatgatatcgtctatgtcgactgtaacccagggttcatcatgaatggatctcgggtaataaggtgccatactgacaatacatgggtgcctggcgtgcctacctgtatcaagaaggccttcattgggtgcccccctccaccaaagaccccgaatggcaaccacaccggaggaaatatcgcccgttttagccccggcatgagcatcctttactcctgcgatcagggctacttgctggtgggcgaggcccttctactctgcactcatgaggggacatggtcccagcccgctccccactgcaaggaggtgaactgctcatcccccgcagatatggacggtattcaaaaagggcttgagcctagaaagatgtaccagtacggcgcagtggtgacactagagtgtgaagatggatatatgctggagggctctccgcagtcgcagtgtcaaagtgaccaccagtggaacccgcctcttgctgtctgtcgatcgaggtccctagcccccgttttatgcgggattgcagccggactgatactgctgacattccttattgtaataacactctatgtgatatctaagcaccgcgcccgtaattattacaccgatacttcacagaaagaagcatttcacctggaggcccgggaggtgtacagcgtggatccttacaaccccgcctcttag

SEQ ID NO: 112754 - DNA, 3102 bp, Artificial Sequence
  Description of Artificial Sequence: Synthetic coding sequence
atgggcgctgcggggctcctgggcgtctttctggcccttgtggccccgggtgttctaggaattagttgtggcagtcctccacctatcctcaatggccgcattagttactattcaactcctattgcagtgggtacagtgatccgctatagctgtagtggaaccttcagactgatcggagagaagtccctgctttgtattacgaaggataaggtggatgggacatgggataagcccgctccaaaatgtgagtactttaacaagtattcctcttgtcctgaacctatcgtgccgggagggtataaaattcgcggttccaccccctatagacatggggattccgtgacctttgcttgcaagacaaacttcagcatgaatgggaacaagtcagtctggtgtcaggccaataacatgtggggaccaacccgcctccccacgtgcgtgagcgtctttcctctggagtgtcccgctcttccaatgattcacaatgggcaccatacttccgagaacgtaggcagtatcgcccctggcctctctgttacttatagctgcgagagcgggtatcttttggttggcgagaagattattaactgtctgtctagcgggaagtggtcagccgttccccctacttgcgaagaagcccgctgcaaatctctcggccggtttccaaatggcaaagtgaaggagccccctattctgcgcgtgggcgtgacagctaactttttctgcgacgagggatacagactgcaggggccaccatccagccgatgcgtgatagcaggacaaggcgtcgcctggacgaaaatgcctgtgtgtgaagagattttctgcccatcccctccgcctattcttaacggccgacacatcggaaacagcctggccaatgtttcctacggtagtatagtgacctacacgtgtgaccccgacccggaggaaggggtaaattttattttgatcggggagtccaccctgcggtgcacagtcgactcacagaaaacaggaacttggtcaggccccgcaccaaggtgcgaacttagcacgagcgcagtccaatgccctcatccccagatactgcgtggtagaatggtgtctggccagaaggacagatacacctacaacgatactgttatctttgcgtgcatgtttggatttacgcttaaggggtccaagcaaatcaggtgcaatgcccaggggacctgggagcctagtgcccccgtttgcgagaaagagtgtcaggcaccgccaaacatcttgaatggccagaaggaggacaggcatatggtcaggtttgatcccggcacttccattaagtactcttgcaatcccggttacgtgcttgtaggggaagagtcaatccaatgtacaagtgagggcgtctggactcccccagtgccccagtgcaaagtggctgcctgtgaagcaactgggcggcagctcttgaccaaaccccagcaccagttcgtaaggccagatgtgaactcctcctgtggcgaagggtacaaactctctggcagcgtgtaccaggaatgccagggcaccataccatggttcatggaaatcaggttgtgcaaggagattacatgtcccccgccacctgtgatctacaatggcgcccacacaggttctagcctggaggacttcccttacggcaccactgtcacctacacatgtaaccccggccccgaaaggggcgtggaattttctctgatcggggagtccacgattaggtgtacctcaaatgaccaagagcgtggcacatggtctggtcccgcacctctgtgcaaattgagtttgctggcagtacagtgttcgcacgtgcatatagcaaacggatacaaaatttccggcaaggaggcaccatacttctacaacgacactgtcacattcaaatgttactccggctttacattgaagggaagctcacagatccgttgtaaggcggacaacacttgggaccccgaaattcctgtgtgcgaaaaagagacatgccaacacgtgcggcagtccctgcaggaacttcccgcaggcagccgggtggagctggtcaataccagctgtcaggatggctaccagctgacaggccatgcttatcagatgtgtcaagatgctgaaaatggtatctggtttaaaaaaatcccactgtgcaaggtcatacactgtcaccctccgcccgtgatcgtgaacgggaaacacaccgggatgatggccgaaaactttctgtacgggaatgaagtgagctatgagtgtgatcagggcttttatctgttaggagagaaaaaactccagtgtcgcagcgacagcaagggccacggcagttggagtggcccaagtccacagtgtctgcggtcgcctcctgttacccgttgtccaaatcccgaggttaaacatggatataagctgaacaaaactcactccgcatacagtcacaatgatattgtgtatgtcgactgtaatcccgggtttatcatgaatggcagtagagttatcagatgtcacacagacaacacatgggttcccggtgtcccgacatgcattaaaaaagccttcatcggttgtcccccccccccaaagaccccaaatgggaatcatacaggaggaaatattgcacgattttccccaggcatgagcatcttgtactcatgcgaccagggttacctgctggtaggggaagcgttgctgctgtgcacccatgagggaacatggtcccaaccggcacctcactgcaaagaagtgaactgttcgagcccggcagatatggatgggatccagaaaggtctggagccacggaagatgtatcagtacggcgccgtagtcactctggagtgcgaggatgggtacatgctcgagggctctcctcagtcccagtgccaatctgaccaccagtggaaccctccgttggcagtatgcaggtcaaggtcactggcccccgtgctgtgcggaatcgctgctgggctgattctgctgacatttctgattgtgatcaccctctatgtcatctcaaagcacagagcaagaaactactataccgacacatcgcagaaagaggctttccatttggaagctagagaggtgtattcagtcgacccctataatcctgcttcatag

SEQ ID NO: 112755 - DNA, 2916 bp, Artificial Sequence
  Description of Artificial Sequence: Synthetic coding sequence
atgggcgcagctggccttctaggagtgtttctagctctggtcgctccaggagtactcggtatctcctgcggaagtccgcctccgattttgaatggtaggatctcttattactccactcccattgcggttggaactgtgattaggtattcgtgttccggcacttttcgcttgatcggagaaaaatccttactgtgtataaccaaggataaggtggatggcacctgggacaaaccagcacccaagtgcgagtattttaacaagtactccagctgtcccgagccgatcgtgcctggaggctataaaattcgggggtccacgccgtacaggcatggcgattctgtgacatttgcttgcaagacaaacttctctatgaatggaaacaagagcgtgtggtgtcaggccaacaatatgtgggggccaacccggttgcccacgtgtgtctctgtgttccccctggaatgtccagcgctccctatgatccacaatggacatcacacatctgaaaacgttggttctattgccccagggctgagtgtcacctacagctgtgaaagcgggtacctcctggtcggcgagaaaatcatcaattgtctgtccagcggaaaatggtctgccgtccctcccacctgcgaggaggccaggtgcaagtctctgggtcggtttcccaatggcaaggtgaaggaaccgcccattctcagggtgggggttacagctaactttttctgcgatgaaggctatcgtctccaggggccaccaagctcccgttgtgttattgctgggcagggggtggcctggaccaagatgccggtgtgcgaggaaatattctgcccgtcccctcctccaatattgaatggacgccatatcggcaactcactcgctaatgtctcctacggatcaatcgtcacttatacgtgtgatccggatcctgaggagggagtgaattttattctgattggcgagagtactctgcgctgcaccgtggatagccagaagacgggcacctggtctggaccggctcctcggtgcgagctgtccacctcagctgtgcagtgccctcacccccaaatcttaagagggcgaatggtttcgggtcagaaagataggtatacatacaacgacaccgttatctttgcctgtatgttcgggttcacactgaagggaagcaaacagattaggtgcaacgctcaggggacatgggagccatcagcacccgtctgtgagaaggaatgtcaggcacctccaaacatcctgaacgggcagaaggaagatcgtcatatggtgcgatttgaccctgggacttctatcaagtatagctgtaaccctgggtatgtcttggttggggaagaatcaatacagtgtaccagcgagggagtgtggactcccccagtccctcaatgtaaggtggcagcgtgtgaggctacaggaagacagcttttgactaagccccaacaccagtttgtgaggccagatgtgaatagcagctgtggtgaagggtacaagctctctgggtccgtctaccaggagtgccaggggaccatcccctggtttatggaaattcggctctgtaaagaaatcacatgtcctcctcctcctgtgatttataatggagctcataccgggagttcactggaggactttccttatggtaccactgtgacctatacttgtaaccctggcccagagcggggagtagagttcagccttatcggcgagtctactatccgctgtacctctaatgaccaggagcgcgggacttggtctggaccagctcctctgtgtaaactgagcctgctggctgtgcagtgcagtcacgtgcacatagctaacggttacaaaatttccggaaaagaggcgccatacttctataacgacactgttaccttcaagtgttattcagggttcacactgaagggatcctcccagatacgctgcaaggccgacaatacttgggacccagaaatccctgtttgcgagaaggaaacctgccagcacgtgagacagagcctgcaggaactgccggccggcagtcgggtggagttagtgaacactagctgtcaggacggatatcagctgaccggccacgcctaccagatgtgccaggacgccgagaacggaatctggtttaaaaaaataccactctgtaaagtaatacactgccatcctcccccagtgatcgtgaatggcaagcatacgggtatgatggctgagaatttcctatacgggaatgaggttagctatgagtgtgaccagggattctacctgttaggcgagaaaaagctacagtgtcgctccgactctaaggggcatggctcctggagcggaccttcaccgcagtgtttgagatctcctcctgtgacgagatgtccaaaccccgaagtcaaacacggctacaagcttaacaagacccatagcgcatacagccacaacgatattgtgtacgtagactgtaaccccggctttatcatgaatgggagcagggtcataaggtgtcatacagataacacctgggtgcctggcgtgcccacatgtattaaaaaggaggttaactgcagttccccagccgatatggatggcatacagaagggtcttgagcccaggaaaatgtaccagtatggtgcagtggtgacacttgagtgcgaggatggatacatgctggagggatctccccaatcacagtgccagtccgatcaccaatggaaccctcctttggccgtctgtaggtcgcggtcactggcccctgtcctgtgcggtatcgccgctggcctaatcctgctgactttcctgatagtgatcaccctctacgtgatctctaagcacagagctcgtaattactatacggatacatcacagaaggaggccttccacttggaggcacgggaagtgtacagtgtcgacccttataaccctgcgtcctag

SEQ ID NO: 112756 - DNA, 3021 bp, Artificial Sequence
  Description of Artificial Sequence: Synthetic coding sequence
atgggagccgctggactgctgggggtttttctggctctggtcgcccccggcgtccttgggataagttgcggatcgcccccacccattttaaatgggcggatcagctactactccacccccattgctgtcgggaccgtaatcaggtatagttgtagcggaacgtttcgattgatcggagagaagagtctcctctgtattacgaaagataaagtcgatggcacatgggacaagcccgcgccaaagtgtgagtattttaacaagtactcgagttgtcccgagcctattgttcccggcggttataagatcagaggttcaacaccctaccggcacggcgactccgtaacctttgcgtgtaaaactaatttttccatgaatgggaataagtccgtgtggtgtcaggccaataacatgtggggacctaccagactgcccacctgcgttagtgtcttccccctggaatgcccggctctcccaatgatccacaacggacaccatacctcagagaacgtgggatccattgctcccgggctgagtgttacttattcctgtgaaagcggatatctacttgtcggcgagaaaatcataaattgtctctcaagtggcaagtggtccgctgtaccccccacttgcgaagaagcccggtgtaaatctctcgggcggttcccaaatggaaaagttaaggaacctccaattctccgggtcggagtgaccgccaacttcttctgcgatgaaggctatagactgcaggggccaccaagtagccgctgcgttattgccggtcagggcgtggcctggaccaagatgcccgtgtgcgaggagattttttgtccctcacctccccctatcctcaatggacgccacatcggaaatagccttgccaatgttagctacggctccatcgtcacctatacttgcgatcccgatccagaagagggcgtcaatttcatactgattggcgaatcgaccctgcgctgcactgtggactcccagaaaacaggtacatggagcggccctgctccacggtgtgagctgtcaacctctgccgtacagtgtccccatccccaaatcctcagaggaagaatggttagtgggcagaaagatagatatacatacaacgacaccgtcatcttcgcctgtatgtttggatttacactgaaggggtctaagcaaattcggtgtaatgcacagggtacgtgggagcctagtgccccggtctgcgagaaggagtgtcaggctccccctaacatcttaaatggccagaaagaggaccgacatatggtaaggttcgaccccggcacttcgatcaaatattcctgtaatcccggatacgttcttgtgggcgaagagagcattcagtgcacgtcagaaggagtctggacgcctccagtccctcagtgcaaagtggccgcttgtgaggcaactggtagacagcttctgactaagccccaacatcaattcgtaagacccgatgtgaatagctcgtgcggagagggcaatcacctcccaacgaccccctgctatctccagtggggaacacatagagagtttttgaggagattctccatctggaaccacggacatctgcacatgccaggccctgagaggggagtcgagttctctcttatcggcgagtccactatcaggtgcacatcaaatgaccaggagcggggaacctggagtggacccgctcccctgtgcaaactcagtctgcttgcagtccagtgtagtcacgtgcatatcgccaatggctataagatcagcggaaaagaagctccatatttctacaatgacaccgtaactttcaagtgttatagtggctttaccctgaaagggagcagtcagatccggtgcaaggcagataatacttgggatccagaaattccagtctgtgaaaaggaaacctgccagcacgtgcgacagtcgctccaggaattacccgctggatcaagagtagagcttgttaatacttcctgccaggacggatatcagttgacagggcatgcctatcagatgtgtcaagacgctgagaacggtatctggtttaagaagatccctctgtgcaaagttattcattgtcacccaccccctgtgattgttaatgggaaacataccggcatgatggctgagaactttctctacggaaacgaggtatcctatgaatgtgatcaggggttctacctgctcggggagaagaagctgcagtgcaggtcagactccaagggacacggctcatggagcggcccatcaccacagtgtttgcggtcaccccccgttactcgatgtccaaatcccgaagtcaagcatggttacaagcttaacaaaacgcattcagcatatagccacaacgatattgtgtatgtggattgcaatcccgggtttattatgaacgggtctcgtgtcatccgttgccacacggataacacatgggtgccaggggttcctacgtgcatcaagaaagcgtttatcggctgccccccaccaccgaagacacctaatggaaaccacactggtggaaacatcgcacgctttagcccaggcatgtcgatactgtattcctgcgaccaaggttaccttctcgtgggagaggccctactgctgtgcacccacgagggcacttggtctcagcccgccccgcattgtaaggaggtaaactgttcctctcccgcagacatggatggaatccaaaagggactggagcccaggaaaatgtaccaatatggcgctgttgtcactctggagtgcgaggacggctacatgttagagggttccccacagtcacagtgtcagtcagaccatcagtggaacccccccctggccgtgtgtcgtagccgtagcctcgcccccgtgttgtgcgggatagccgctggcttgattctcctgaccttccttatagtgatcacgctgtacgtgatcagcaagcatcgagccaggaattactacacggacacatcacaaaaggaggcattccacctggaagctagagaggtttattccgttgatccctacaaccctgcttcctag

SEQ ID NO: 112757 - DNA, 2226 bp, Artificial Sequence
  Description of Artificial Sequence: Synthetic coding sequence
atggccgccgcggaggggcctgtaggagatggagaactgtggcaaacttggctgcccaaccacgtggtgtttttacggctgagggagggcctcaaaaaccaatctccgactgaggctgagaagccagcaagttcgagcctgccttctagtccaccaccacagctcttaacacgcaacgtggtcttcgggctcgggggagagctgttcttatgggatggcgaagactcttcgtttctggttgtgcgtctgaggggcccttctggtggcggcgaagagcctgccctgagccaatatcagcggctgctctgtattaacccccccctgttcgagatctatcaagtccttctctctccaactcaacatcacgtagccctcatcggcatcaaagggcttatggtgctcgaactgcctaaacggtggggcaaaaattccgaattcgaagggggaaaatcaactgtgaactgttcaaccaccccggtggccgaaagattcttcacatcgtccacttctctcaccctgaaacacgctgcatggtatccatctgaaatattagacccccatgtggtgctgctaacatccgataatgtgattcggatctacagcttgcgcgaaccacaaacccccacaaatgttatcatattgagtgaggctgaagaggagtctcttgtgctgaacaagggccgcgcctacacagccagtttgggcgaaacagctgtcgctttcgactttggcccgcttgcagccgtcccgaaaactctcttcgggcaaaacggcaaagatgaagtcgtggcatatccattatatattctctatgagaacggagagacattcctgacttatatttccctgctgcattcccccgggaacatcggcaaactgctcggacctctgcccatgcacccagcggccgaggacaattacggatacgatgcatgcgccgtactctgtctgccttgtgtaccaaacatactggttatcgcaacagaatcagggatgctttaccattgcgtagtgctggagggagaggaggaggatgatcatacttctgaaaagagttgggatagtaggatcgatctgattccgtcactgtacgtttttgagtgcgtggagcttgaactcgctttaaagctggctagtggagaagacgaccccttcgactccgacttctcctgcccggtcaaactgcacagagacccaaaatgtccgtcgagataccactgtactcacgaggccggtgtacacagtgttggcctgacatggattcacaagttgcacaagttcttaggatccgatgaggaggacaaagattcactgcaggagctgtccacagaacaaaaatgtttcgtcgaacacatcttgtgtacaaagcctttaccttgccgacagccggccccaatcagggggttttggattgttccagacattctcgggccaaccatgatttgcattacctccacctatgagtgtcttatttggcccctcctttctaccgtgcacccagcttcccccccactcctatgcactcgcgaggatgtggaggttgccgagagtcctctgagggtcctggcagaaacacctgactcttttgaaaagcacatccgatcgattctacagcggagcgttgcaaaccccgcgtttctaaaggcctcggaaaaggatatagccccacccccagaagagtgcctccaactgctttcccgcgccacacaggtgttccgtgaacaatacattctcaagcaggaccttgcaaaagaggaaatccaaaggagagtgaagttgctgtgtgaccaaaagaagaagcaattggaggatctatcttactgcagggaagaaaggaagtccctgagggagatggcagagcggcttgctgataaatatgaagaagctaaggagaagcaggaagatattatgaatcgaatgaagaaactcctgcactcttttcactccgaattgccagtgctgtccgatagcgaaagggatatgaaaaaggaactccagctcattccagaccaactccgtcacctggggaatgccattaagcaggtgacaatgaaaaaagactatcagcagcagaagatggagaaagtcctttctttgcctaaaccgactatcattctgtccgcataccagagaaaatgtatccagtccatcctgaaggaagaaggtgagcacatcagggagatggttaaacagattaacgacattcgcaaccatgtgaacttttag

SEQ ID NO: 112758 - DNA, 762 bp, Artificial Sequence
  Description of Artificial Sequence: Synthetic coding sequence
atgatgatgaaaatcccatggggatctataccagtcttgatgctgctgctgctgctagggttgatcgacatatcccaagcacagctgtcctgtacaggcccccctgctatccctggaattcctggaatcccaggcacacccgggccagatgggcagcccgggacgccaggcattaagggcgagaagggcctcccaggactggccggcgaccatggagaatttggtgagaagggcgatcctggtattccggggaatcccggcaaggtgggccccaagggtcctatgggcccaaaaggcggacccggcgcacctggtgcgccaggaccgaagggcgagtccggagattacaaggcgacccaaaagatcgccttctctgcgactaggaccatcaatgtgcctcttaggagagatcagactattcgtttcgaccacgtgatcaccaatatgaacaataattacgagcctcgctcaggtaaatttacttgcaaggtccccgggctttactattttacctatcacgcttcctccagaggtaacctctgcgtgaatctgatgaggggaagggaacgggcacaaaaggtggtgactttttgcgactatgcctataacacgttccaggtcacgaccggaggcatggtcctcaaattagagcaaggggaaaacgtgtttctgcaggccactgacaagaactcactcctcgggatggaaggcgctaactcgatcttctcaggtttcctcttgtttccggatatggaggcctag

SEQ ID NO: 112759 - DNA, 690 bp, Artificial Sequence
  Description of Artificial Sequence: Synthetic coding sequence
atgaagatcccatggggaagcatccccgtgctgatgctgctgctccttttgggactgatcgatatcagccaggcccagctgagctgtactggcccacccgcaattccaggcatccctggcattcccggaacccccggaccagatggccagcccggcacccctggaataaagggagagaaggggctcccaggactcgctggagaccacggcgaattcggagaaaagggggaccccggcatacctggaaatcccggaaaagtcgggcctaagggtcccatgggccccaagggtgggcctggggcccccggtgcacctggaccaaaaggcgagagtggagattataaagctacacagaagatagcatttagcgcaacccggactatcaacgtccccctgcggcgggatcagaccatcagatttgaccatgtgattacaaatatgaacaataactatgagccgcgaagcggaaaatttacgtgcaaagtgcctggattgtactacttcacctatcatgcctccagcagagggaatctctgtgtgaaccttatgcgcggacgagagagggcccaaaaagtcgtaactttttgtgattatgcctacaatacctttcaagtcactactggcggcatggtcttgaagcttgagcagggagagaatgtgttcttgcaggcgactgacaagaacagctag

SEQ ID NO: 112760 - DNA, 756 bp, Artificial Sequence
  Description of Artificial Sequence: Synthetic coding sequence
atgaaaattccttggggtagcataccagttctgatgttgctactcctcctagggctcatcgatattagccaggcccaactaagttgcacaggacccccggctatcccagggatccctggcattcctggcacccccggcccggatggacagcctggaacccccggaatcaaaggagaaaagggcctgcctgggctggctggtgaccacggcgagttcggtgaaaagggggaccccgggattcctggaaatcctgggaaggtcggacccaagggccccatggggcccaaaggcggccctggggcccccggagcacccggaccaaaaggagaatcaggggactacaaggccacacaaaaaatcgcattttcggcaactagaacaattaatgtgccactacggcgggaccaaaccattcggtttgaccacgtaatcacaaacatgaacaataactacgagccacgcagtggtaagtttacgtgtaaggtgcccggactctactacttcacgtatcacgcgtcttccagaggcaatttgtgtgtgaatctcatgaggggacgagaacgagctcagaaagtcgttaccttttgcgactatgcctataataccttccaggtcacaaccggcggaatggtacttaaactcgagcagggagagaatgttttcctgcaggccacggacaaaaactctctcctcggaatggagggggcgaacagcattttcagcgggttcctgctgtttccagacatggaggcctag

SEQ ID NO: 112761 - DNA, 462 bp, Artificial Sequence
  Description of Artificial Sequence: Synthetic coding sequence
atgaaaattccgtggggcagcatcccagtgctaatgctgctgcttcttctcgggctgattgatatcagccaggcccaactcagctgcacaggacccccagctataccaggcataccgggaatccctggcacaccagggccagacgggcagccaggcaccccaggtattaagggcgaaaaaggtttgccagggcttgcaggcgaccatggtgaatttggagaaaagggtgaccctggaattcccggcaatccaggaaaggtaggcccaaaggggcccatgggccctaaagggggtcctggggctcccggcgcacctggccccaaaggagagtcgggcgactataaagcaacacagaaaatcgccttttcagcaacgcggacaattaacgtccccctgcgacgggaccagacaattcgcttcgaccatgtcatcacaaatatgaacaataattatgaaccctag

SEQ ID NO: 112762 - DNA, 738 bp, Artificial Sequence
  Description of Artificial Sequence: Synthetic coding sequence
atggatgtgggacctagtagtcttccacacttggggctgaaactcctcctgcttctgctgcttttgccacttcgtggccaggcaaacaccggctgctacggaattccagggatgcccggactgcctggggcacccggaaaggacgggtacgacggcctgccaggcccgaaaggggagccaggcattcccgccatccccgggattcggggccccaagggacaaaaaggagagccggggctgcccggccaccctggcaagaacggcccaatgggaccccctgggatgcccggagtgcccgggcccatgggaatcccaggcgagcctggtgaggagggcaggtacaagcagaagtttcagtcagtgtttaccgtcacaaggcagacccaccaaccgccagcccctaattcactcatccgctttaacgctgttctgaccaacccgcagggcgactatgatacttcaacgggtaaattcacctgtaaggtcccaggcctttattacttcgtctaccacgcctctcacacggctaatctgtgtgttctgctgtaccggagcggggtgaaggtcgtgaccttttgtggccacactagtaagacaaatcaggttaactcaggaggcgtcctcctacgcctgcaggtgggagaggaagtttggctagccgtcaatgattattacgacatggtgggaatccagggatccgattccgtgttttctggctttctgcttttccccgattag

SEQ ID NO: 112763 - DNA, 738 bp, Artificial Sequence
  Description of Artificial Sequence: Synthetic coding sequence
atggacgttgggcccagttccctacctcatcttgggctcaagttgcttctgctgcttctgctcctgcccctgcgcggtcaggccaacactgggtgttatggcatcccagggatgcctggcctgcccggcgctccggggaaagatggctatgacggactgccgggcccgaagggcgaacctggaataccagccatacctggcattaggggaccgaaaggacaaaagggggagcccggcttaccgggacatccaggtaaaaatggacctatgggcccaccaggcatgcccggcgtgcctgggccaatggggatcccgggtgaacctggagaagagggccgctacaagcagaaatttcagagcgtgtttacggtcacaagacagacccaccagccgcccgctcctaatagtctaatccggttcaatgctgtgttgaccaatccacagggcgattacgacacatccactggcaagttcacctgtaaggtgccgggcctgtactatttcgtgtatcacgctagccacaccgccaatctgtgtgtacttctgtatcgaagcggggtgaaagtggtaacgttctgcgggcacacaagtaaaaccaaccaggtgaacagtggaggggtgctgcttagactgcaagtcggtgaggaagtgtggctggcagtcaacgactactatgatatggtgggaatacaaggaagcgacagtgtattttctggattcctcctgtttccggattag

SEQ ID NO: 112764 - DNA, 738 bp, Artificial Sequence
  Description of Artificial Sequence: Synthetic coding sequence
atggacgtgggacccagttccttaccacatttgggactcaaactgctcctcttgctcctgctgctcccccttaggggacaggcaaatacaggctgctacggaattcccgggatgccaggattgcctggtgcacctggcaaggacggttatgatggactgccgggacctaaaggggaacccggcatcccagctattcccggtataagaggtcccaagggacagaaaggagagccaggcctgccaggacatcccggtaagaacggccccatggggccccccggcatgcctggtgtaccaggccctatgggcatacccggggaaccaggtgaggagggccgctacaaacaaaagttccaaagcgtttttacagtcacgcgccagacgcaccagccccctgctccgaactccctgattcggttcaatgccgtgctaacaaatcctcagggcgactacgacactagcactggaaaatttacgtgtaaagttcctgggctgtactacttcgtgtatcatgccagccacacggccaatctgtgcgtgcttctgtaccgtagcggagtgaaggttgtcacgttttgtggccacacctcgaagacgaaccaggtgaactccggtggcgtcctgctgagactgcaagtgggtgaggaggtctggctagccgttaatgattactatgacatggtggggatccaggggtcagacagtgtgttctctgggttccttctcttccctgactag

SEQ ID NO: 112765 - DNA, 777 bp, Artificial Sequence
  Description of Artificial Sequence: Synthetic coding sequence
atgttactggttctggtggtgctaatccctgtcctggtgtcgagtggcggcccagagggacactacgaaatgctcggcacctgtcggatggtgtgtgatccgtatcccgctcgggggcctggagctggagccagaaccgacggaggtgacgccttatctgagcagtctggggctccgcccccctcgacgctggtccaagggccccaaggaaaacctggacgcactggaaagccgggcccccccgggccgcccggcgatcccggtcctccagggccagtcggtccacctggagagaaaggtgaacctgggaagcctggcccacctgggcttcccggtgcagggggctcaggtgccatatctactgccacctatactaccgtgcctcgggtagctttttacgccggccttaagaacccacatgaagggtacgaagtcctgaagttcgatgacgtagttacgaacctcgggaacaactacgacgccgcttccggaaagtttacatgtaacattcctggcacatatttcttcacctaccacgtactgatgcggggaggtgatggcacctcgatgtgggccgatctgtgcaagaatggacaggtgcgcgctagcgccatcgcccaggacgcggatcagaattacgattacgcctccaatagcgtcatattgcaccttgatgccggcgatgaagtatttattaaacttgatggcggcaaagcccacggcggaaattcaaacaaatactctacattctcaggtttcattatttatagcgattag

SEQ ID NO: 112766 - DNA, 864 bp, Artificial Sequence
  Description of Artificial Sequence: Synthetic coding sequence
atggcattgggtctgttaattgcggttcccttgcttctacaggctgcaccaagaggagccgctcactacgagatgatggggacgtgtcgcatgatatgtgacccatacaccgcagccccaggcggcgaaccacccggggccaaagcccagccccccggtccttccacagcagctttagaggtgatgcaggacctgagtgcaaatcccccaccccccttcattcaaggtccaaaaggggaccctggcaggcccggtaagcccgggccgagagggcccccaggagagcctggacccccgggcccgcgtgggcccccaggggaaaaaggtgattccggccgtccgggtttacctgggctgcagctgaccgccggcacagcctcaggagtaggcgtggtgggaggaggtgcaggcgtgggaggggactccgagggtgaagtcacatccgcactatctgccaccttttccggcccaaaaattgccttctacgttgggctgaaatcaccccatgaaggatacgaggtgctaaagttcgatgacgttgtaacaaacctgggaaatcattatgatcccactacagggaagttttcatgtcaggtaagaggtatctacttttttacctaccatattctgatgcgtggtggtgacggtactagcatgtgggcggatctctgtaagaatgggcaggttagagcttcggcaatcgctcaggacgctgaccagaattacgattatgctagcaactctgtcgtgctccacttagattccggtgatgaggtatacgtgaaactcgatggggggaaggcccatgggggtaacaacaacaaatacagtaccttttcagggttcttgctgtacccagactag

SEQ ID NO: 112767 - DNA, 2007 bp, Artificial Sequence
  Description of Artificial Sequence: Synthetic coding sequence
atgtccgtcaggtttcgtgtcggtagggaggaaaacgcccaatggtggctactgtacctgttagtgcccgctctcttttgcagggccggtgggtcaatccctataccacaaaagctcttcggtgaggtgacaagcccgctgttcccgaaaccgtatcccaacaactttgagacaactacagttattaccgtcccaaccggctatcgggttaaactagtgtttcagcagtttgacctggagcccagtgagggatgcttctatgattatgtgaaaattagtgccgataaaaagtcgctgggccggttctgtggacagttgggcagtcctctgggaaacccccctggcaaaaaggagttcatgtcccaaggtaataaaatgctgctgactttccacaccgacttttcaaatgaagagaacgggaccattatgttttacaaaggattcttggcctattaccaggccgtggatttagatgaatgcgcttctcggagtaaatcaggggaagaggacccccagcctcagtgtcagcacctgtgccacaattacgtaggaggctacttttgctcctgtaggccaggttacgaactgcaggaggatcgacacagttgtcaagctgaatgcagcagtgaattgtataccgaggcatcaggttacatctcgagcctcgaatacccgcgctcctatccaccggatctccggtgtaactactctataagggtggaacgcggcttgacactgcatctaaagtttttggagccgtttgacatcgacgaccatcagcaggttcactgtccatatgaccagcttcagatttatgctaacgggaagaacattggtgagttctgcggcaagcagcgtcctccggatctggatacatcgtcgaacgccgtggatctcctgttttttaccgatgaatcaggagattcacgcggttggaaactgaggtatacaactgaaataattaagtgtccacagcctaaaactttagacgaattcacaatcatccagaatctgcaaccccagtaccagttccgggattactttattgcaacatgcaaacagggataccagctcattgaagggatccaggtggtggccggagttgtggacgtgagtgcaggtcgggtgagttggagcacctcctctcagacatgctgtacaagagtgtacacatgcactgctcagggcatctggaagaacgagcagaaaggagagaagatcccgaggtgtctgcccgtgtgcgggaaaccagtcaatcctgtggagcaacgacagaggatcattggcggacagaaggcaaagatgggtaacttcccttggcaggtgtttactaatattcacggaaggggcggtggagccctgctgggcgatcgttggattctcactgcagcacatacactctaccccaaagagcacgaagcgcagagtaatgcttccctcgatgtgttcctgggccacaccaacgttgaggagttaatgaagctaggaaaccaccctatccgtcgggtttccgtgcacccagactacagacaggacgaatcctataatttcgagggggatattgcactgctggagcttgaaaatagcgtgactctcgggcccaatctgttgcccatttgcctaccagacaatgatactttctatgatctgggtctgatgggttacgtctctggttttggggtgatggaggaaaaaatcgcacatgacctgaggttcgttcgacttccagtggcaaatccccaagcctgcgaaaattggctgagaggcaagaaccgtatggatgtattttcccaaaacatgttctgtgccgggcatccgtccctgaagcaagatgcttgccagggcgatagcggaggcgtgttcgcagtgcgcgacccaaatactgatcgctgggtagctacaggaattgtcagttgggggattggttgcagcagaggctacggtttctacaccaaagttctgaactatgttgattggataaagaaggaaatggaggaagaggattag

SEQ ID NO: 112768 - DNA, 1131 bp, Artificial Sequence
  Description of Artificial Sequence: Synthetic coding sequence
atgtggctactgtacctcctcgttcctgcgctgttttgcagggcagggggttccatcccgataccccaaaagttgtttggtgaagtgacatctccgctgttcccaaagccctacccgaataacttcgagaccacaaccgtgattaccgtgcctacgggttatagggtcaaactcgttttccaacagttcgacctggagccatcggagggctgtttttatgattatgtcaaaatctccgctgacaaaaaatcgctgggcaggttttgtggccaactcggttcaccattgggaaatccgcccggtaagaaagagtttatgtcccagggcaataaaatgctcctcaccttccatacagacttctctaacgaagaaaatggaactataatgttttacaagggcttcctcgcatattatcaggccgtggacttggatgaatgcgcgtcacggtcaaagtccggcgaagaggatccacagccacagtgccagcacctctgccacaactacgttggcggctacttctgtagctgccgtccaggctacgagctgcaggaggatcgtcactcttgtcaggcggagtgctccagcgagctctacaccgaggccagcggttacatctcctctctggagtacccgcggagctaccctccggatctgcggtgtaattactccataagggtggagcggggtctcaccctccatctgaagtttttggaaccttttgatattgatgaccaccaacaagttcactgcccctacgatcagctgcaaatatatgccaatggcaagaacattggggaattctgcggcaagcagcgaccacctgatctggatacatcgagcaatgcagtcgatttactattctttacagacgagtccggcgactctcgtgggtggaagctgagatataccaccgagattatcaagtgcccacagccaaagactcttgacgaattcactattattcagaacttgcagccccagtaccagttccgtgattattttatcgctacatgtaagcagggatatcagctgatagaggggtgtacaccagctcaacatcgagcctttggacggatgaaccgacgggagcgacgtttcttgggagcctgtcaatgcgtagggtccccctag

SEQ ID NO: 112769 - DNA, 1962 bp, Artificial Sequence
  Description of Artificial Sequence: Synthetic coding sequence
tggttactgtatctgctcgtccccgctttattctgcagggcgggtgggtctatccctattccccagaagctcttcggtgaggtgacatccccattgtttccaaaaccttaccctaataactttgagaccaccacagtgattacggtgcccaccggctacagggttaaactggtgttccagcagtttgatctagagccatcagagggatgcttttatgactatgtgaagatcagcgctgacaaaaaatctctaggccgcttctgcggtcagctgggttcccccttgggaaatccaccaggaaaaaaagagtttatgtcccagggaaataagatgcttctgacctttcacaccgactttagcaacgaagagaatggaactatcatgttctataagggcttcctggcttattaccaggccgtcgatctcgacgagtgtgcttccaggtcaaagtctggcgaagaggacccccaaccacaatgccaacatctctgccataactatgttggcggatatttctgctcctgccgaccgggctatgagctgcaggaggataggcactcttgtcaagcggaatgttccagtgagctgtatactgaggcgagtggatatatcagcagccttgaatatccacgtagctacccccctgacctcagatgcaattattccattagggtggagcgaggccttactctgcatctaaaatttttggagcctttcgatatcgacgaccatcagcaggtacattgtccgtacgatcaattgcaaatctacgccaatggaaagaacatcggcgagttttgtgggaagcagagaccccccgatttggacaccagtagcaacgctgtggacctgttattttttactgatgaatccggtgattctcgcgggtggaaactgcgatataccacagagataattaagtgccctcaacctaaaacacttgacgagtttactatcattcagaacctgcagccacaataccagtttcgggattacttcatcgccacctgcaagcagggttaccaactcatagaggggatccaagtagttgcgggtgttgtggatgtgtctgccggccgagtgtcctggtcgaccagctctcagacctgctgtacccgtgtgtacacatgcacagcccagggaatctggaaaaacgaacagaagggcgaaaagattcctcgatgcctcccagtttgtgggaagcctgtgaatcccgtcgagcagcgtcagcgtatcattggggggcagaaggcgaaaatggggaactttccctggcaggtttttacaaacatacacggaaggggtggaggtgctctcctgggcgacagatggatcctcacagcagcccatacgttgtatccaaaggaacacgaagcccaatccaacgctagcctggacgtcttcctcggccacactaacgtagaggaactgatgaagctcggcaaccaccccatacgtagggtttccgttcaccctgactaccgacaagatgaaagctacaattttgagggcgacattgccctcctggaactggaaaatagtgtgaccctgggcccaaatttattgccaatatgcttacccgataatgacacgttttacgacctgggacttatggggtacgtttccggctttggagtgatggaagaaaaaatcgctcacgacctgagatttgtccgtttgccggtagcgaatccacaagcctgcgaaaactggcttcggggaaagaacagaatggacgtcttcagtcagaatatgttttgtgccggtcacccatcccttaagcaggacgcctgtcagggggattctggaggcgtgtttgctgttagggatcctaatactgacagatgggtggctaccggcattgtgtcttggggcataggatgttctcgtggatacggcttttatacgaaggttctgaattacgttgattggattaagaaagagatggaagaagaggactag

SEQ ID NO: 112770 - DNA, 1464 bp, Artificial Sequence
  Description of Artificial Sequence: Synthetic coding sequence
atgccgggtcctcgagtgtggggcaagtatctctggcgcagcccccactccaaggggtgcccgggtgctatgtggtggttactgttgtggggtgtgctccaagcctgcccaacccgtgggtcagtattgctggcccaagagctgccccagcagctaacctcgcccggctatcccgagccctacggaaagggacaagaatcttccacagatatcaaggctccggagggttttgccgtccggctggtgttccaggactttgatctggaacccagtcaggactgcgcgggagactccgtgacgatctccttcgtcgggtcagatcccagccaattttgtggccagcagggctcgcccttggggaggcctccaggccagcgcgaattcgttagtagtggacgctctctccgcctgacctttcgtacgcaaccatcatctgagaataagaccgctcacctacacaagggctttcttgctctgtaccagactgtagctgttaattatagtcagccaatttccgaggccagccgcggttcagaggctatcaatgctccaggagacaaccctgctaaagtccagaatcactgtcaggaaccatattaccaggctgccgccgctggcgccctgacctgcgctactcccggtacgtggaaagaccggcaggatggggaggaagtcctgcagtgtatgcctgtgtgcggccgccccgtgactcccatcgcacaaaaccagaccacactgggtagcagccgggccaagctcggcaactttccatggcaggctttcactagcatccacggacgcggagggggcgccctgctaggagacaggtggatcctgacagcagcccatacgatttatccaaaagactcagtcagcctgagaaagaatcagtcagtgaatgtgttcttgggccacacggccatcgatgagatgctgaaactcgggaaccaccccgtgcaccgggtggtggttcatccagactataggcagaacgaatcacacaattttagtggggatattgcgctgctggagctgcagcactccattcccttgggcccaaatgtactgccagtgtgtctaccagacaacgaaacactctacaggtccgggctgctaggatacgttagtggcttcggcatggagatgggctggcttaccaccgagctcaagtatagcagactccccgtggctcctagagaagcgtgtaatgcctggcttcagaaaaggcaaagacctgaagtgtttagcgacaacatgttctgcgtgggagacgagacacagcgccattcagtatgccagggtgactcaggatccgtctatgtcgtgtgggacaatcatgcacaccactgggtcgcaacgggaattgtatcatggggcatcggctgcggcgaggggtacgacttttacaccaaagtgctgtcgtacgttgactggattaagggggtaatgaatggtaagaattag

SEQ ID NO: 112771 - DNA, 1317 bp, Artificial Sequence
  Description of Artificial Sequence: Synthetic coding sequence
atgcctgggccccgggtatggggcaaatatctatggcggtccccacactcgaaggggtgccccggggctatgtggtggttattactgtggggagtgctacaggcgtgcccaaccagggggtcagtcctcctggcacaggagctccctcagcagctcacgtcccccggttatccagaaccctacgggaaaggtcaggagtcctctaccgatatcaaagcccccgaaggcttcgccgttagactcgtgttccaggatttcgatctggagccgtcccaggactgtgctggggattctgtcaccatttcttttgtaggttccgaccccagccagttttgtggtcagcaggggtccccacttgggaggccccctgggcagagagaattcgtcagttctggtaggtctctgcgtctaacgtttcgtacccagccttcatccgaaaataaaactgcccacctccacaaagggtttctcgcactttatcaaacagttgctgtcaactattcccagccaatttccgaggcttcccgtgggtcagaagctatcaatgcaccaggagacaatccggccaaggtccagaatcattgccaggagccctactaccaggccgcggctgctggagccctaacttgcgcgacacctggtacttggaaagataggcaggacggtgaggaggtactccagtgtatgcctgtctgtggacggcctgttactcccattgcccagaatcagaccactttaggctcaagcagggcaaagctgggcaatttcccatggcaggcctttacttcaatccacggcagggggggcggcgctctccttggggataggtggattctgaccgctgctcatacaatatatcctaaggattctgtgtctctgaggaagaaccaatcagtaaatgttttcctgggccatacagccatcgacgagatgctgaagctaggaaatcatcctgtgcatcgagtggtcgtgcaccccgattacagacagaatgagagccataactttagcggagacatagcgttgctagaacttcagcactcaatccctctgggccccaatgtcctcccagtttgcctccctgataacgagacactttatcggtccgggctattgggatatgtctctgggttcggcatggagatgggatggctgacgacggaattgaagtactccagactcccagtagcaccaagagaggcttgtaatgcttggctgcagaaaaggcaacgccccgaagttttttccgacaacatgttctgcgttggcgatgaagcgggggagagcctggaaccaggtcggaggcgtctacagtag

SEQ ID NO: 112772 - DNA, 2067 bp, Artificial Sequence
  Description of Artificial Sequence: Synthetic coding sequence
atgtggtgtattgtgctgttttctcttctggcatgggtttatgctgaacctactatgtacggcgagatcctgagtccgaattatccgcaggcctatccatccgaagtagaaaaatcctgggatatcgaagtgcccgaaggctatggcatccacctttattttactcatctggatatcgagctaagcgaaaactgcgcctacgactctgttcagataattagcggcgataccgaagagggccgattgtgtggccagcgtagtagtaataacccacactcccctattgtggaagaattccaggtgccttacaataagttgcaagtaatcttcaagagcgacttcagcaacgaggagcgctttactggcttcgcggcttactacgtggcaaccgatataaatgagtgtacggatttcgtcgatgtcccttgctcccacttttgcaacaacttcataggaggttacttttgttcgtgtccccccgagtacttcttgcatgacgatatgaaaaattgtggggtcaactgttctggcgacgtgttcactgcactgatcggcgaaattgcctcacctaactaccccaagccttaccctgagaactctcggtgtgaataccagatacgcctcgaaaaggggttccaagtggtggtgaccttgagacgcgaagacttcgacgtcgaagccgctgactcggcggggaactgcttggactcgctggtgttcgtggccggggacaggcagtttggcccatattgtggtcatggcttccccggccccctcaacatcgaaaccaagtctaatgctttggacattatttttcagaccgacctgaccggacagaaaaagggttggaagttgagatatcacggtgatccaatgccctgtccaaaagaggatacccccaactccgtgtgggagccagccaaggccaagtacgtgttccgcgacgtggtgcagattacatgcctggatggcttcgaggttgttgaggggcgggtgggcgcaacaagcttctactcaacgtgccagagcaatgggaagtggtcaaacagcaagcttaagtgccagcccgtggactgcggtattcccgagagtatcgaaaatggcaaagtagaggaccctgaatcgaccctcttcggatcagtcattaggtacacttgtgaggagccgtattactatatggaaaacgggggagggggcgagtatcactgtgctgggaacgggagttgggtgaacgaggttctcggacctgagttgccaaagtgcgtaccagtgtgtggcgtgcccagagagccattcgaggagaagcagaggataattggcggttctgacgccgacatcaagaattttccttggcaagtattctttgacaatccatgggcggggggtgctcttattaacgaatactgggtgttgaccgctgcccatgtagtcgaggggaaccgggagcctaccatgtatgtaggatcaacgagtgtgcagaccagtcggctggccaaaagcaagatgctgaccccggaacatgtcttcattcacccgggatggaagttattggaggtgccagaaggacgcacaaattttgacaatgatattgctctggtccgactgaaggaccctgtgaaaatggggccaaccgtgtcccctatctgcctgccgggcacttcaagtgattataacttaatggatggggatttaggcttgatttctggctggggcagaactgaaaagagggacagagctgtccgcctcaaggcggctcggctcccagtggcaccattgaggaagtgcaaagaggtcaaagtggagaagcctaccgccgatgcagaagcttacgtgttcacacccaacatgatttgcgccggcggagaaaaaggcatggacagctgtaagggcgatagtggcggagccttcgcagtccaggaccccaatgacaagaccaaattctacgccgccggtctggtctcctggggtccacagtgcgggacctacggactatataccagagtgaaaaactacgtggactggattatgaaaaccatgcaggagaactccaccccgagagaggactag

SEQ ID NO: 112773 - DNA, 2067 bp, Artificial Sequence
  Description of Artificial Sequence: Synthetic coding sequence
atgtggtgcatagttctgtttagtcttctggcatgggtgtatgcagaaccgaccatgtatggtgaaattttaagtcccaattaccctcaggcatacccatcagaggtggagaaatcatgggacatcgaggtccccgagggatacggcatccacttgtatttcacccacctggatatcgaactcagcgagaactgtgcttacgatagcgtgcagattattagtggggacacagaagagggccgactctgtggccagaggtcttcgaacaatccacactccccaatcgttgaggagtttcaggtcccatacaataaattgcaggtcatctttaagagtgatttcagcaatgaagaacgcttcactggatttgccgcttactatgtcgcgaccgacatcaatgagtgcaccgatttcgttgatgttccatgttcacacttttgtaataacttcatcgggggctacttttgctcttgcccaccagagtactttctgcacgacgatatgaagaattgtggcgttaactgctcaggggacgtatttaccgctcttatcggggagattgcatctcctaattaccccaagccgtatcctgagaattcccggtgcgagtatcagatccgtctcgaaaagggctttcaggtcgttgtgacattacgccgggaggacttcgacgtcgaggccgctgattccgcaggcaactgcctggattctctcgtgtttgttgccggggatcgacagttcggaccgtactgtgggcatggattccccggaccccttaatatcgaaacaaaatccaatgccttagatattattttccagacagatctgaccggtcagaaaaagggctggaaactgaggtatcacggcgacccgatgccttgcccaaaggaggacacaccaaattctgtgtgggaacccgcgaaggccaagtacgtttttagggatgtagtccaaatcacgtgccttgatgggtttgaggtggtggaagggcgcgtgggggcgacctcattttattccacatgtcaatctaatggcaagtggtctaactcaaagctgaagtgccaaccagtggactgcggcatccccgagtcaatcgagaatggcaaggttgaggatccagagtctacattgttcggaagcgtgatccgctacacatgcgaggagccttactattacatggagaacggtggcggcggtgagtaccattgcgcaggcaacggaagctgggtcaatgaggtgttagggcccgaactgccaaaatgtgtgcctgtctgcggcgtgcccagggagccattcgaagaaaagcaacgcatcatcggcggttcggacgccgatatcaagaatttcccttggcaggttttcttcgacaacccatgggccgggggtgccctgatcaacgagtattgggtgttgaccgcggcacacgtagttgaaggaaatagggagcccacaatgtacgtagggagcacttcagttcagacatctagactagccaaatccaagatgttaactcctgaacatgtttttatccacccagggtggaaattgttggaggtgcccgaaggccgtacaaacttcgataatgacatcgccttggtacgtctaaaggatccagtgaaaatgggtcccaccgtcagcccaatctgcctgccaggcacatcttccgactacaaccttatggacggcgatctgggactaatcagcggttgggggcggactgaaaagcgtgatcgggccgtccggctcaaggcggctcgccttcctgtggctccccttaggaagtgcaaggaagtgaaggtggagaagccaacggccgatgccgaagcttatgtattcactcctaatatgatttgcgcaggcggggagaaggggatggatagttgtaagggagacagtgggggtgctttcgcggtgcaggacccaaacgataagactaaattctatgccgcaggattagtatcttggggacctcagtgtggaacatacggactgtacacaagggtgaaaaactatgtggattggatcatgaagactatgcaggaaaatagtaccccccgtgaggactag

SEQ ID NO: 112774 - DNA, 2049 bp, Artificial Sequence
  Description of Artificial Sequence: Synthetic coding sequence
atgtacggcgagattctttcccctaactacccacaggcctatccctcagaagtggagaaaagctgggacattgaagtgccagaggggtatggcattcatttatactttacccatttggatatcgaactttctgagaattgtgcctacgatagcgtgcagataattagcggggatactgaagagggacgtctatgcgggcagaggtcttctaacaacccacattcacccatcgttgaggaattccaggtgccctacaataagctccaggtgatcttcaaatccgactttagcaatgaggagagattcaccggcttcgccgcatattatgtcgccaccgataaagatgaatgttctggtagagcccaactatggaatcacatgtctgatgtaccgtgttcccacttctgcaataactttatcgggggatatttctgttcttgccctccggagtactttttacatgacgatatgaaaaactgcggtgtgaattgctctggcgacgtatttaccgctttaattggagaaattgcgtcccccaattaccccaaaccctatcctgaaaactctagatgtgagtatcagatccggcttgaaaagggattccaggtgcacttatctttactcctgaagctggagtgttccggagctatcacagcacactgcagtcttgatctgttaggcagtatcgcaggcgaccggcagtttggcccttactgcggccacgggtttccgggcccccttaatattgagaccaagtccaacgcccttgacatcattttccagacggacttgaccggccagaaaaagggatggaagctaagatatcatggagatccaatgccctgtccaaaggaggacacacccaattccgtgtgggagcctgccaaggctaagtacgtgtttcgcgacgttgttcagattacttgcctggacggctttgaagtggtagagggccgcgttggagccacttcgttctacagcacgtgtcagagcaatggtaaatggagcaatagcaagctgaaatgtcaaccagtagactgcggcataccagaaagtatcgagaacgggaaggtggaggaccccgaatctacactctttgggtctgttatccgatatacctgtgaggaaccttactattatatggagaacgggggcggaggggaagaaagagagagaggagaatatcactgtgccggcaacggcagctgggtcaacgaggtcctgggcccggaacttccaaaatgcgtacccgtgtgtggcgtcccccgtgagcccttcgaggagaagcaacggataattggcggcagtgacgcggacatcaaaaacttcccctggcaggttttttttgacaacccatgggctggaggggcactcattaatgagtattgggtcttgactgccgcccatgttgtggaaggtaacagggaaccgactatgtacgtcggaagcacatccgtccagacctctaggctagccaagtccaagatgttgactcccgagcacgttttcattcacccgggatggaagctgctagaggtgccagagggtcgcacaaattttgataatgacattgctctcgtgaggctcaaggacccagtgaaaatgggacccaccgtgagtcctatttgtctgccgggcacaagctccgattacaacctcatggacggcgatctcggcctaattagtggctgggggcgaactgaaaaacgggatcgggcagtacgcttgaaggccgccaggctccccgtggcccccctgcgcaagtgtaaggaagtgaaggttgaaaaacccaccgccgacgccgaggcctatgtatttacccccaatatgatctgtgctggcggtgaaaaaggtatggattcgtgcaagggagacagtggtggagccttcgccgtgcaggaccctaatgataagactaaattctacgcggctggactggtttcttggggccctcaatgtggtacctacggcctgtacacacgtgtaaagaactatgttgattggataatgaagacaatgcaggagaatagtacaccccgcgaagactag

SEQ ID NO: 112775 - DNA, 507 bp, Artificial Sequence
  Description of Artificial Sequence: Synthetic coding sequence
atgtggtgtatcgtgctgttttcactccttgcttgggtgtacgcagaaccgaccatgtatggcgagatcctgtcccccaattacccacaggcctatccatcagaagtggagaagtcctgggacatagaggtgcccgaggggtatgggatacatctgtacttcacgcatttggatatagagttgagcgaaaactgtgcatacgatagcgtgcagatcatcagtggtgacaccgaggaaggacggctgtgcgggcagcgctcatccaataacccccactccccaattgtggaggagttccaggtgccatacaataaactgcaggtgatctttaagtctgacttttccaatgaggagagatttacaggtttcgctgcgtattacgtcgccaccgacatcaatgaatgcaccgacttcgtcgatgtgccttgttctcacttttgtaacaattttataggaggttacttttgtagttgtccccctgagtattttctgcatgacgatatgtag

SEQ ID NO: 112776 - DNA, 2067 bp, Artificial Sequence
  Description of Artificial Sequence: Synthetic coding sequence
atgtggtgtattgtgcttttcagcctgttggcttgggtctatgcggagcccacgatgtacggcgagatcttgtcccccaactacccacaggcctacccgagcgaggtcgaaaaatcatgggacatcgaggtgccagagggatatggtatccatctctactttacccatctggacatcgagctcagtgaaaattgtgcctacgacagcgtgcagataatatcgggagacacggaggaggggcgcctctgcgggcagcgctcctccaataacccccattcccctatcgtcgaggaatttcaggtgccatataacaaactccaggtgatctttaagtcggatttttcaaatgaggaacggtttaccggattcgccgcgtattacgtcgccaccgatataaacgaatgcaccgatttcgtggacgtgccatgctcacatttctgtaacaattttataggaggctatttctgtagctgcccaccagagtattttctgcatgatgacatgaagaattgcggcgtaaactgctcaggggatgtgttcaccgccctcattggagagattgcctctcccaactatcctaaaccttacccagagaactcccgctgcgagtatcagattcggctggagaagggcttccaggttgtggtgacccttcgcagagaagacttcgacgtggaggctgccgatagtgctggtaactgccttgattccctggtttttgtagccggagatagacagttcgggccgtactgtggccatgggttccctgggcccctgaacattgagactaagtctaacgcactggacattattttccagactgatctgacggggcagaaaaaagggtggaaactgaggtaccacggggatcccatgccttgtcctaaagaggacactcccaactctgtgtgggaacccgcgaaggcaaaatacgtgttcagagacgttgttcagattacctgtttggatggctttgaagtggtggaaggccgggtcggagcgacctcgttctactccacctgtcagagcaatggcaaatggtccaactcgaagttaaagtgtcagcccgtcgactgtggcatccctgagtcaatagaaaatggtaaagtcgaggatcccgaatcgacgctatttgggagcgtaattagatatacctgcgaggagccctattattatatggagaacggcggcgggggagagtatcattgcgcaggaaacggcagttgggtcaatgaagtccttggccccgagctccctaagtgcgttccagtctgcggggttccccgtgaacccttcgaagagaagcagcgcattattggcggctccgacgcggatattaagaactttccctggcaggtcttcttcgacaacccttgggctggcggggcactgatcaacgagtattgggtcctgactgcagcgcatgtggtggagggaaatcgggaaccaacgatgtacgttggcagcacatctgttcaaacgtccaggttggccaagtctaagatgctgaccccggaacatgtgttcatccatcccgggtggaaactcctggaggtccccgaaggaagaacaaattttgataacgatattgctctggtgcggttaaaagaccccgtcaagatggggccaacggtttcccccatctgtttgcccggcacctccagcgactataatttaatggacggggatttgggattgatctcaggttggggacggacagagaagcgcgatcgggccgtgagactgaaagccgcccgacttcccgtggcccctctccgcaagtgcaaagaggttaaggtggagaagccgaccgccgacgcagaggcctatgtctttacccccaacatgatttgcgctggaggagagaagggcatggattcatgtaagggggatagcggcggcgcatttgcggtccaggatccgaatgacaagaccaagttctacgctgcaggcttagtgtcttggggcccacaatgtggtacgtatggactctacacgcgggtaaagaactacgtagactggattatgaaaactatgcaggagaactccacacctcgcgaagattag

SEQ ID NO: 112777 - DNA, 312 bp, Artificial Sequence
  Description of Artificial Sequence: Synthetic coding sequence
atgtggtgtatagtcctgttttctctacttgcctgggtgtacgctgagcctaccatgtatggagagatcctttcgcccaattaccctcaagcttatccaagtgaggtggaaaaaagttgggatattgaggtccctgaaggctatggaatacacctgtatttcacccacctggacattgagctctcggaaaactgcgcctacgactctgtgcaaatcatcagtggcgacacagaggagggaagactgtgcggacagaggtctagcaataatcctcactcgccgattgtcgaggaatttcaggtgccatactag

SEQ ID NO: 112778 - DNA, 306 bp, Artificial Sequence
  Description of Artificial Sequence: Synthetic coding sequence
atgtggtgcatcgtcttgttctcactgctcgcgtgggtgtacgccgaacccactatgtatggggagatcctgtctccgaattacccacaggcttatccttccgaggtcgagaaatcttgggatattgaggtgccagaggggtacggaatccatttatactttacccacttggatatcgaactgtctgagaactgtgcctacgacagcgtacagattattagtggagacaccgaggaggggcggctgtgtgggcaacgaagttccaataacccccattcacccatcgtggaagagttccaggtgtag

SEQ ID NO: 112779 - DNA, 2259 bp, Artificial Sequence
  Description of Artificial Sequence: Synthetic coding sequence
atgggtcctcttatggtgctgttctgcctccttttcttgtatcctggcctggcggattctgcaccatcatgcccccagaacgtgaatatctcgggaggcaccttcaccctgtcacacggatgggcacctggctcactgctgacgtatagctgtccccagggactgtatccaagcccagcttctagattgtgtaagtcctcaggacagtggcagacccccggagccactagaagtctgagcaaggccgtctgtaagccagtccgctgtccagccccagtgtccttcgaaaatggcatttacactccgcgattaggcagttatcctgtgggggggaacgtcagcttcgagtgtgaggacgggttcatcctgcgcggttcaccagtgcggcagtgccgacccaacggaatgtgggacggggagaccgccgtttgtgacaacggagcagggcactgtccaaatccaggaatatccctaggtgctgtgaggaccgggtttaggttcggacacggagataaggtacggtaccgatgtagttccaacctcgttctgaccggctcaagcgagagagagtgccagggaaatggtgtttggtctgggaccgagcctatctgcagacagccatacagttatgatttcccagaagacgtggcccctgcgttgggaacctctttttcccatatgctcggtgcaacgaacccgacccagaaaactaaggaaagtctaggtcgcaaaatccagattcagagatcaggccaccttaacttatacctgctgctggattgctcacaatctgttagcgaaaacgacttcctaatctttaaggaatcagcaagtctaatggtagacagaatattcagctttgagataaacgtgtcagtcgcaatcatcactttcgcttcagaaccaaaagtactgatgtccgtgctcaacgataacagtcgggatatgaccgaagttattagttcgctcgagaatgccaactataaggaccatgaaaacggcactgggaccaacacatacgcggccctaaatagcgtctatctgatgatgaataaccagatgcggcttctgggcatggagaccatggcttggcaggaaatccgccatgccattatcttgctgaccgacggcaaaagtaacatgggcggctcacccaagaccgcggttgaccacatcagggagattctcaacatcaaccagaagcggaatgattaccttgatatatatgccataggcgtggggaagttagatgtcgattggagggagctcaacgagctcgggtccaaaaaggacggcgaacggcacgcctttatcttacaggataccaaagccctgcatcaagtgtttgaacacatgcttgacgtctctaaactgacagacaccatttgtggagtagggaacatgtccgccaatgcttccgaccaggaacggacaccgtggcacgtaaccatcaagccaaaatctcaggagacctgtcggggcgctctcattagcgaccagtgggtccttacagccgcacactgcttcagggacgggaacgaccacagcctgtggagagtaaatgtcggagatcctaagtcccaatggggaaaggagtttctcatcgaaaaggccgtcattagtccaggcttcgacgtgttcgctaaaaagaaccaagggattttggaattctacggtgatgatatcgccttgttgaagctcgcccagaaggtgaaaatgtctacgcatgcccgaccaatttgcctgccctgcaccatggaagcaaacctggctttgaggcgccctcagggctcgacatgccgcgaccatgaaaatgagttgttaaataaacaatcggtgcccgctcactttgtggctctcaatggttctaaactgaacatcaaccttaagatgggagttgagtggacatcctgtgctgaggtggtgtcacaagagaagacaatgtttcccaatctgacggacgtgagagaggtggttacggaccaatttctttgcagtggcacacaggaggatgagtctccttgcaagggggagagtggcggagccgtgtttctggagcggcgcttccggttctttcaggtgggactggtcagctggggcctttataatccctgtctgggaagtgccgataaaaatagcaggaagagagccccgcgcagcaaggtgcctccccccagggactttcacattaacctgttccgcatgcagccatggctgaggcagcacttgggtgatgtgcttaactttctccccctctag

SEQ ID NO: 112780 - DNA, 1134 bp, Artificial Sequence
  Description of Artificial Sequence: Synthetic coding sequence
atgacagaagtgatttcctctctcgaaaacgccaactataaagaccacgaaaatggaaccggcacaaatacttacgccgcactcaatagcgtttacctgatgatgaacaatcagatgcgactgctgggcatggaaactatggcatggcaggagattcgtcacgctatcatcctgctgactgatggaaaatctaacatgggcggatcacccaagacagcagttgatcacatcagagagatccttaatataaatcagaagcgcaatgactacttggacatttacgctatcggggtcggcaaattggacgtggattggcgcgagctgaacgagctgggcagtaaaaaagacggagaaagacatgcgttcattttacaggataccaaagctctccatcaagtgttcgagcacatgctggatgtgagcaaactgacagatacaatatgcggcgtgggcaacatgtcagccaatgcctccgaccaagagcggacaccatggcatgtgacaattaagccgaagtcccaggagacatgcagaggagcactgatttccgaccagtgggttttaaccgctgctcactgctttcgagacggcaacgaccattctctttggcgagttaacgtcggagatccaaaatctcagtgggggaaggagtttttgattgaaaaggcggtcatctcaccagggttcgatgtgtttgctaagaaaaaccagggcatcctggagttctatggggatgacattgctctccttaagcttgcccagaaagtcaaaatgtccacacatgcgcgaccaatttgcttaccatgcaccatggaggctaatctggccctccgtcgacctcagggatcaacctgcagagaccacgagaacgagctgttaaacaaacagtctgtgccagcacactttgtggctctgaatggatcaaagctgaacatcaacctgaagatgggggtggaatggacaagttgtgcagaggtcgtttcccaagagaagactatgttcccaaacctcactgacgttcgagaagtggtaaccgaccagtttttatgctccgggactcaagaagacgaaagtccctgtaagggcggcagtggagagctaggctccctccagccgctcccctggttatgttag

SEQ ID NO: 112781 - DNA, 2259 bp, Artificial Sequence
  Description of Artificial Sequence: Synthetic coding sequence
atgggccccctgatggtgctgttctgcctactttttttatatccagggctcgctgattcagctccatcatgtcctcaaaatgtcaatattagcggaggcacttttacactaagtcacggatgggctcctggaagcttgttgacatatagctgtccgcagggcttgtacccttccccagcctctcggctttgcaaaagctctgggcagtggcagaccccaggcgcaacacgtagcttgagcaaggcggtgtgcaagcctgtgaggtgccccgctcccgtgagcttcgagaatggaatctacacaccacgtttgggctcctatcccgtgggaggcaacgtatcttttgagtgcgaagacggattcatcctgcgaggctctcccgtccggcagtgccggcccaatggcatgtgggacggagagaccgccgtgtgtgataatggcgcaggccattgtcctaatcctggcatctcccttggagcagttcgcactggatttcggttcgggcacggggataaagtgcgatataggtgcagctcgaacctggttctgactggctcatcagagcgagagtgtcagggcaatggagtgtggtcgggcactgagcccatttgtcggcagccctacagttatgattttcccgaggatgttgctcccgcactgggcacttcgttctctcacatgttgggcgccacaaacccaacccagaaaacaaaggaatcgctcggccgaaagattcagatccagcggagcggtcatctcaatctgtacctgctgctcgattgtagccaatccgttagcgagaatgattttctgatcttcaaagagtcagcaagcctcatggtggataggattttctcctttgagattaacgtgagcgtggctattattacattcgctagcgagcctaaggtcttaatgtcagtcctgaatgacaacagcagggacatgaccgaggtcataagttctttggaaaacgcgaattacaaggatcacgaaaacggcactggcaccaacacatacgcagctctgaacagtgtgtacctcatgatgaataaccaaatgagattgttaggcatggaaactatggcatggcaagagatcagacatgccatcattctactcactgacggtaaatcaaatatgggggggagtccgaaaaccgcggtggatcatattagggaaattcttaatattaaccaaaagcggaatgattatctggacatctacgcaataggcgtaggcaaactggatgtggactggagggagctgaatgagctggggtccaagaaagatggggagaggcatgcttttatcctgcaggacacgaaagccctgcaccaagttttcgagcacatgttagatgtatcaaagctgacggacaccatctgtggcgttggcaatatgtctgctaacgcttccgaccaggaaaggaccccctggcacgtgacaataaagccaaagagccaggagacttgtagaggggcactgatctctgatcaatgggtgttaacggcagcgcactgttttcgtgatggaaacgaccatagtttatggagggtgaatgtaggggatcctaagagtcagtggggaaaggaattccttatcgagaaggccgtgatttctcccgggttcgatgtgtttgccaagaagaatcaggggattctagagttctacggtgatgatattgcactgctgaagctcgcccagaaagtcaaaatgtctacacacgctcgacccatctgcctaccttgcaccatggaggctaatcttgccctgcgcaggcctcaaggctccacctgccgggatcatgaaaatgagctattaaacaaacagagtgtgcctgcccatttcgtggccttaaatggcagcaagcttaatataaaccttaagatgggtgtggagtggaccagctgtgctgaggtcgtgtcacaggaaaaaacaatgtttccaaacctgacagacgtccgtgaggtggttactgaccagttcctgtgtagcggcactcaagaagatgagtccccatgtaagggcgaatctgggggagccgttttcctggaacgaagatttaggttttttcaggtggggctcgtaagttggggtctctataacccgtgtttaggttctgcagacaagaattcgcgcaaaagggccccccgcagcaaagtaccccctcccagggacttccacattaatctgttcagaatgcagccatggctgaggcagcacctaggcgatgtcctgaactttcttccactatag

SEQ ID NO: 112782 - DNA, 1578 bp, Artificial Sequence
  Description of Artificial Sequence: Synthetic coding sequence
atggtgctattttgtctgctctttttgtaccccgccggccactgccctaatccaggtattagtctaggggccgttcgcacaggttttaggtttgggcatggggataaagtcagataccggtgctccagcaacctggttttgacaggtagctctgagcgcgaatgtcagggcaatggcgtttggtccgggaccgaacccatttgtcggcagccctactcgtacgacttccccgaggatgttgcccctgcactggggacctccttctcccatatgcttggagccaccaaccctacacaaaagacaaaagatcatgagaacgggactgggaccaatacttatgctgcgctcaactctgtatacttaatgatgaataaccagatgcggctactggggatggaaaccatggcctggcaggagattagacacgctattattctactgacagatgggaagagcaatatgggtggctcccctaagacggcagtggaccatattagggagatcttgaacatcaaccagaaaaggaacgactatctagacatttacgctattggcgtgggaaaactggatgtcgactggcgagagctcaacgaattagggtccaaaaaggatggagagcgtcacgcatttattctgcaagacacaaaggcgttacaccaggtattcgagcacatgctggacgtcagcaagcttacagatacgatctgtggggtcggaaatatgtcggcgaatgcctccgaccaggagaggacgccttggcacgtgacaattaagcccaagtcacaggagacttgcaggggcgcactgatatcagaccaatgggtgcttaccgcagcccattgcttccgagatggtaacgatcactctctgtggagagtgaatgtcggggacccaaaatcccagtgggggaaagaattcctgattgaaaaagccgtcatttctcctggattcgacgtgttcgccaagaagaaccagggtattcttgagttctatggtgacgatattgctctactcaagctggctcagaaggtgaaaatgtctacgcatgcccgacctatttgtttgccttgcacgatggaagccaaccttgctctgcgaagaccccaggggtctacatgccgcgaccatgagaacgaactcctgaacaagcagtccgtgcccgcccatttcgtggcgttaaacggcagcaagctcaacattaatctcaagatgggcgtggagtggactagctgtgcagaggtggtgtctcaggagaagacgatgttccccaacctgaccgacgtcagggaagtcgttacggatcagttcctctgctcaggtactcaagaggatgagagtccatgtaagggagagagcggcggcgccgtattccttgagcgccggttccgtttctttcaagttggcctcgtcagctgggggttatacaatccttgtctgggaagtgctgataagaactcacgcaaacgagccccccgaagtaaagtgcctcctccacgcgatttccacattaacctgttccggatgcaaccttggctgcggcaacacctgggagatgtcctgaattttcttcccctgtag

SEQ ID NO: 112783 - DNA, 2259 bp, Artificial Sequence
  Description of Artificial Sequence: Synthetic coding sequence
atgggccctctaatggtcttgttctgccttctgtttctgtacccagggctcgctgactctgcacccagctgtccccagaacgttaacatctcaggaggcacctttactctatcccacggttgggcacctggatccctcttgacctactcttgcccccaggggctctatccatcccccgctagccggctgtgtaagtctagcggacagtggcagacccctggtgccactaggagtctcagcaaggccgtgtgcaagcctgtgcgctgtcccgcacccgtgtctttcgagaacggcatttatacgcctcgattgggcagttacccagttggaggcaacgtcagctttgaatgcgaggacgggttcatccttcgggggagccccgtccgacagtgcaggcctaacggtatgtgggacggagagacagccgtgtgcgacaacggagctggccattgtccaaaccctggcatttccttaggcgccgtgcggaccggtttccggttcggccacggagataaggtaaggtaccgatgttcttctaatctggtgctgactggaagctctgagagggagtgtcaggggaacggtgtttggagcggtaccgagcccatctgtcggcaaccctactcctacgacttccctgaagatgtcgcccctgccctcggcacatccttctctcatatgttaggagccaccaatcccacacagaagacaaaagagagtctggggcggaagattcaaattcagaggtcaggacatctgaatctttatctgttgttggattgctctcagagtgtctcggagaatgattttttgatctttaaagagagcgcgagcctgatggtggacaggattttctccttcgagattaatgtttcagtggcaattatcacttttgccagtgaacccaaggtcctgatgtctgtccttaacgacaactcccgagatatgacagaggtgatctcctccttagaaaatgctaattacaaggaccatgaaaatggtaccggtaccaacacttacgcagcccttaatagcgtttacctaatgatgaataaccagatgcgattgctcgggatggaaactatggcctggcaagaaatccgccacgccatcattctgctcactgacggaaagagcaatatgggcggctcgcccaaaacggcggtggaccacatccgcgaaatattaaacatcaaccaaaaacgaaatgactacttggatatatacgcgattggggttgggaaactggatgtagactggcgggaactaaacgaattaggctcaaaaaaggatggcgagcggcacgcctttatattgcaggacaccaaggcgctacatcaggtgtttgaacacatgctggacgtttctaagctgaccgatacaatttgtggcgtcggaaacatgtccgcaaatgcttctgaccaggagcgtactccgtggcacgtgaccattaaaccaaaatcccaggagacgtgtaggggtgcgcttatctctgatcaatgggttctaactgccgcacattgttttcgagacgggaacgaccattccctctggcgagtgaatgtaggagatcctaaaagccagtggggtaaagagttcctcatcgaaaaagctgtgatctctccggggttcgatgtgttcgccaagaagaaccaggggatactcgaattctacggggatgacattgctctgcttaagctggcccaaaaagtaaaaatgtctacccacgctaggcctatttgcctgccctgcaccatggaggccaatcttgcattacgtaggccccagggctcaacctgtcgcgaccatgagaacgaactgctaaataagcaaagcgtacctgctcacttcgtggctctgaacggctccaagctcaatataaatttgaagatgggcgtggaatggactagttgcgctgaggtggtatcccaggaaaagacaatgtttccgaacttgacagacgtccgagaggtggtgactgaccagttcctctgctccggaacccaggaggatgagtcaccatgcaaaggagaaagtgggggcgccgttttcctggaaaggcgttttcgtttttttcaagtgggactggttagctggggactttataacccgtgtctcgggagtgccgataaaaattcacggaaacgcgctccacgttccaaggtgcctccgccccgagatttccacatcaacttgtttaggatgcagccttggctgagacagcacctgggggatgtgttgaacttcttacctctgtag

SEQ ID NO: 112784 - DNA, 1578 bp, Artificial Sequence
  Description of Artificial Sequence: Synthetic coding sequence
atggtgttattttgcttgctgtttttgtacccagcaggacattgccccaatccgggcatcagcctgggcgcagtcaggactgggttccgcttcggacatggcgacaaggtgaggtataggtgcagctcgaatctagtgctgacaggcagtagtgaaagagaatgccaaggaaatggcgtgtggtccggaaccgagcctatttgccgacaaccctacagttacgatttcccggaggacgtcgccccagctttgggcacctccttcagccacatgctcggtgccaccaaccctacccagaagaccaaagaccacgagaacggtaccggcactaatacctatgcggctctgaattcagtgtacctcatgatgaacaatcagatgcgcctccttgggatggaaactatggcctggcaggagattaggcatgccatcatcctgcttacggatggcaaaagcaatatgggaggttccccaaagacagccgttgaccatatcagagaaattctgaacattaaccagaagcggaacgactatctagacatctatgcgatcggtgtggggaagctggatgtggattggagagaactgaacgaactaggctctaagaaagacggtgagcggcacgcattcatcctgcaggataccaaagccctgcatcaagttttcgagcacatgttagacgtgtccaagctgacagatactatctgcggcgtaggaaatatgtcagctaatgcgtctgaccaggaaagaacaccatggcatgtgacaatcaaaccaaagagtcaggaaacatgtaggggtgccttgatctcggatcagtgggttctgaccgctgcccactgcttcagggacggaaacgaccacagcctatggagggtgaatgtgggagaccctaagtctcaatggggcaaagagtttctgatcgaaaaagccgttatcagccccggattcgacgtgtttgcaaagaaaaaccaaggtatcctggaattctatggggatgacatcgccctgttaaagctggcccagaaagttaaaatgagtacgcatgcccgcccgatttgtctgccctgtaccatggaggctaatctggctcttagaaggccacaggggagcacatgccgggaccacgaaaacgagctcctgaataaacagtctgtgcccgcccattttgtggcactgaatggatcgaaactgaacattaacctgaagatgggcgtggaatggacatcatgtgccgaagtcgtgagtcaagaaaagacaatgtttccaaacttaacagacgtgagagaagttgtgaccgaccagtttctgtgttccggcactcaggaggatgaatcgccatgtaagggcgaaagtggtggcgccgtgtttctcgaaagacggtttagattctttcaagtcggactcgtgtcatggggactgtacaacccttgcctgggatcagcagacaaaaacagtcgaaagcgcgccccacggagcaaggtgccccctcccagggatttccacattaacttgttcagaatgcagccatggctacgtcaacatctcggcgatgtgctaaacttcctgcctctgtag

SEQ ID NO: 112785 - DNA, 2259 bp, Artificial Sequence
  Description of Artificial Sequence: Synthetic coding sequence
atgggacctctcatggtgctcttttgtcttctgttcctgtacccaggcttagccgattccgcacctagctgtccacagaacgtcaatattagcgggggtaccttcaccctcagccatggctgggcaccaggatctttgctgacttatagctgcccacaaggtctgtatccctcccccgcttctaggctctgcaagtctagcggtcagtggcagactccgggtgcgactcggagtctttccaaggccgtttgcaaaccagttcggtgtcctgcccccgtgagcttcgagaacggcatttacacccctcggctggggagctatccagtgggcgggaacgtctctttcgaatgtgaggacggtttcatcctgaggggcagccctgtgagacagtgcagacccaacggcatgtgggacggagaaaccgctgtgtgtgataacggggccgggcattgcccaaaccccggtattagtttaggagcagttaggacagggttccgcttcggacacggagacaaggtgcgatatcgatgtagctcgaatctcgtgctgacgggctctagtgagagagagtgccaagggaacggtgtgtggagtggcacggagcctatctgccgccagccatattcctacgattttccagaggatgtggcccccgcactaggcaccagctttagccatatgctgggagccaccaatcctacgcagaaaaccaaggagtctttgggcagaaagattcagatccagagaagtgggcatctcaacctctatttactgctggactgctcacagtcagtgtcagaaaacgacttcctgatcttcaaagagtctgctagcttaatggtggacaggattttttcattcgaaatcaacgtgtctgtggctatcatcaccttcgcatctgagcctaaggtcctcatgtctgtgctcaacgacaacagccgtgatatgaccgaggtaattagttccttagagaatgctaattacaaggatcatgagaatggcacaggtacgaatacctatgccgccctcaattctgtctacctcatgatgaacaatcagatgcggctgttgggcatggaaacaatggcctggcaagagatcagacatgctatcatactgctcactgatggaaagtccaatatggggggtagcccaaagactgccgtagatcacatccgtgaaattctgaatattaaccagaagaggaacgactatctggacatctacgccattggcgtgggaaagctcgacgtagattggagagagctaaatgaactaggatctaagaaagacggagagaggcatgcttttattctgcaggacacgaaggccctgcatcaggtctttgaacacatgctcgacgtgtccaaattaactgacaccatctgcggtgttggcaacatgagtgctaacgctagcgaccaggagcgtacaccctggcacgtgactattaaacccaagagtcaggaaacttgtcgtggtgcactcatttcagaccagtgggttcttaccgcggcccattgttttcgcgatggaaatgatcactctttgtggcgggtcaacgtaggagacccaaaatctcaatggggaaaggaattcctcatagagaaagcagtgatatcccccggtttcgatgtgttcgcaaagaaaaaccaggggatccttgaattttatggtgatgacattgctttactgaaacttgcacagaaggtcaagatgagcacccacgcgagacctatctgcctcccatgtactatggaagcgaatctggcgctgaggcgaccacaaggtagtacttgtagggatcacgaaaacgaacttttaaataagcagtctgtgccagcccacttcgtggctcttaatggctccaagctgaacatcaatcttaaaatgggagtggagtggacctcatgcgcagaggtggtcagccaggaaaagacaatgtttccgaatttaactgatgtgagggaagtggttaccgaccagtttctttgttccggcactcaagaggatgaaagcccttgcaagggggagtccgggggggcagtatttcttgagcggcgcttcagattcttccaggttggcttagtgtcctggggtctctacaatccttgtcttggaagcgccgacaagaactccagaaaacgtgcccccaggtctaaagtaccgcctccgagggattttcatatcaatcttttccgaatgcagccatggctacgacagcatttaggcgatgtacttaacttcctgccactttag

SEQ ID NO: 112786 - DNA, 420 bp, Artificial Sequence
  Description of Artificial Sequence: Synthetic coding sequence
atggggcctctgatggtgctgttctgtttgttattcctgtatcccggtcttgcagatagcgcgccgtcttgcccccaaaacgtgaatatttctggcggaacctttaccctttctcacggttgggcaccaggctcattgttaacgtatagctgtcctcaggggctgtacccttcacccgcatcaaggctttgcaaatcatcgggccagtggcagacccccggcgccacaaggagtttgtcaaaggctgtctgtaaacccgtcagatgcccagccccagtttcattcgagaatggaatctacacacctagattaggaagttaccccgtcgggggtaatgtcagcttcgagtgcgaagacggattcatactccgcggtagcccagtgcggcagtgtaggccgaatggaatgtgggatggttag

SEQ ID NO: 112787 - DNA, 510 bp, Artificial Sequence
  Description of Artificial Sequence: Synthetic coding sequence
atgcgagcactttgtattcgagaaacatgctcatcggagctgggctttagccgcaattggtcacgtagaaaagctggacattgccccaatccagggattagcttgggtgcagtgcgaaccggtttcaggtttgggcatggtgataaggtacgttaccgttgcagtagtaatctcgtcctaacaggcagttctgaacgtgagtgtcaagggaatggggtgtggtcgggaacagagcctatatgtaggcagccatactcttatgattttcctgaggacgtggcacctgctctgggcactagtttcagtcacatgctcggtgctacaaatccgacccagaagaccaaagatcatgagaatggaaccggtacgaatacctatgccgctctgaatagcgtttatctgatgatgaacaatcagatgagattgctcggcatggagaccatggcatggcaggagatacgccacgccattattctcctgaccgacggaaagtcgaacatgggtggctag

SEQ ID NO: 112788 - DNA, 420 bp, Artificial Sequence
  Description of Artificial Sequence: Synthetic coding sequence
atgggtcccctgatggtgctcttttgccttttgtttctttaccccgggcttgccgattccgctccctcctgtccacagaacgtaaatatttctggtggcactttcaccttgtctcacgggtgggcacctggatcgctgcttacatacagctgcccacagggactgtacccgtctcctgcctctagattgtgcaaatcctctggtcagtggcagaccccaggagcaaccagatcattgtcgaaagcggtgtgcaagcctgtcagatgtccagcacctgtatcatttgaaaatggcatttacaccccacggttagggtcctatcccgttggaggcaatgtatccttcgaatgcgaggacggctttattttgagggggagcccagtgagacagtgcagaccgaacgggatgtgggacggttag

SEQ ID NO: 112789 - DNA, 2259 bp, Artificial Sequence
  Description of Artificial Sequence: Synthetic coding sequence
atggggcccctgatggtgttgttctgtctcctctttctctatcctgggctggcagattctgcaccttcgtgtccccagaatgtgaacatttccggcggcactttcaccctgagccacggatgggctccaggctccctcctgacctactcatgcccccaaggactgtacccttctccagcttcccgcctgtgcaagtcatccggacaatggcagacgccaggagcaacacgttccttgagcaaggccgtctgtaaacctgtcagatgtccggcccctgtaagcttcgagaatggcatctacacccccaggctggggagttaccctgtggggggtaacgtatcgtttgagtgcgaggatggctttatacttaggggcagcccggtgcggcaatgccgacccaacggaatgtgggacggggaaaccgccgtctgcgataatggcgccggccactgccctaatcctgggatcagcctgggtgccgtgaggacaggcttcaggtttggacacggcgacaaggttcggtatagatgcagttctaacttggtgctgaccggatcaagcgagagagagtgccagggaaatggtgtgtggtctggcactgagccgatatgtcgccagccctattcatacgattttcccgaagatgtagcgcccgctctgggtacctcctttagccatatgctcggggcgaccaatcctacccaaaagaccaaagaaagcctcgggcgcaagattcagatccagagatccggtcacctgaatctttacctgctcctggactgtagccagagtgtctccgaaaacgatttcctgatatttaaggaatccgcgtccctcatggtcgaccgaatcttttccttcgaaatcaatgtgagcgtggccatcattacttttgcatcagaacccaaggttctcatgtccgtgttgaatgacaactcccgggacatgaccgaggtgatttcctccttggagaatgctaactataaagatcacgaaaacgggactggaacaaacacatatgcggccttgaactcagtgtatttaatgatgaacaaccagatgaggttactgggtatggagaccatggcgtggcaggagattcggcatgccattatcctgctgaccgacggaaagtccaacatgggaggctccccaaagactgcagtcgaccatatccgagagattctgaacataaaccagaagagaaacgattacctcgacatctatgctatcggagtagggaagcttgacgttgactggcgtgagctgaatgagctaggctcaaagaaggatggtgagcggcacgcctttattctgcaggatactaaagcgcttcaccaagtgttcgagcacatgctggacgtgagcaagctgacagatactatttgcggagtgggcaatatgtctgcaaatgcatccgaccaggaacgtacaccctggcacgtcaccattaagcctaagagtcaagaaacctgcagaggcgccctcatcagcgatcaatgggtgctgacggccgcacactgctttcgtgacggaaatgaccactctctgtggcgcgtaaacgtgggagaccctaaatcccagtggggaaaggaatttcttattgaaaaagcagtcatctctccaggatttgatgtttttgccaaaaagaatcaggggatcctggagttttacggcgacgatatagctcttctaaaactggctcagaaggtgaagatgagcacgcacgctcgtccgatatgccttccttgtacaatggaggctaatctcgctctgaggaggcctcaaggatctacctgtcgtgaccatgaaaacgaactcctgaataagcagagcgttccagctcacttcgttgccctcaatggctccaagctgaatatcaacttaaagatgggggttgaatggacaagctgcgctgaggtggtttcccaagagaagacaatgttccctaacctcaccgatgtgagggaggttgtgactgaccagttcctctgttctggtacacaagaggatgagagcccttgcaaaggtgagtcaggtggggctgtcttccttgagcgacggtttaggttcttccaggtgggcctagtttcatgggggctatataatccatgccttggatctgctgataagaatagccgaaaacgggccccgcggagtaaagtgcctccacccagggattttcatatcaacctcttcaggatgcagccctggctcaggcagcacctcggagatgtgttgaactttctccctctctag

SEQ ID NO: 112790 - DNA, 378 bp, Artificial Sequence
  Description of Artificial Sequence: Synthetic coding sequence
atgggccctctcatggttctcttctgcctgctgtttttgtatcccggtttagccgattcagccccttcgtgccctcagaacgtgaatatctcaggtgggaccttcactctatctcacggctgggcacctgggtccctacttacgtacagctgtcctcaggggttataccccagtcctgcaagtcgactctgcaagtctagcggtcagtggcagacacctggcgcgaccagatctctttcgaaggccgtctgcaagccagggcattgccctaaccctggtatttcccttggggccgttcgcacaggctttaggttcggccacggagataaagtgcgctaccgctgcagctcaaatctagttttaacgggcagttcttag

SEQ ID NO: 112791 - DNA, 510 bp, Artificial Sequence
  Description of Artificial Sequence: Synthetic coding sequence
atgagagccctgtgtatcagagaaacctgctcttccgaactcggtttctcgcggaactggtcacgcagaaaggctgggcactgccccaatccagggataagcctgggtgctgtacgaactggattcaggttcgggcacggcgacaaagtgcggtacagatgctcctctaatcttgtgctcacaggtagctccgagagggaatgccaaggcaatggagtgtggagcggcactgagcccatctgtcggcaaccgtactcatatgattttcccgaagacgttgcccctgcccttggcacctcctttagccacatgttgggcgcgacaaatccaacccagaagacaaaagaccacgaaaatggcactggcacaaatacgtatgctgccctgaattcggtctacctgatgatgaacaatcagatgcggcttttagggatggaaacaatggcatggcaggagatcagacatgccatcatattgctgacggatggaaagtccaacatgggaggttag

SEQ ID NO: 112792 - DNA, 1062 bp, Artificial Sequence
  Description of Artificial Sequence: Synthetic coding sequence
atgggccccttgatggtgctgttttgtttgttgtttctataccccgcgggacactgtcctaacccaggcatttcattaggtgccgtgcgcaccggcttcagatttggccacggggacaaggttagataccggtgctcttcaaatctagttctaacgggaagctctgagcgggagtgccaaggcaatggcgtctggtctggaactgagccgatttgcaggcagccctacagctacgactttcccgaagatgtggcccctgcactcggtactagctttagccatatgcttggagctaccaatcctacccagaagacaaaggagtcactgggaaggaaaattcagatacagcggagcggacacctcaacttatatctgctgctggattgttcccagtcagtgtcagagaacgactttctgattttcaaagagtcggcctctttgatggtcgacagaatctttagcttcgaaatcaatgtgtctgttgcaatcataacattcgcctctgaaccaaaggtgctgatgtccgtgctgaatgataactcgcgcgacatgactgaagtaatttctagcctggagaatgccaattataaagatcacgaaaatggcacggggaccaacacttacgccgccctgaattcggtttacctgatgatgaacaaccaaatgagattgctcggcatggagaccatggcttggcaggaaattaggcatgctatcattctgctgaccgacggcaagtctaacatgggggggtctccaaagactgccgtcgatcatatccgggagatcttgaacattaatcagaagcgaaacgactacctggatatatatgcgatcggggtcggtaagctcgacgtggactggcgggaactgaatgagcttggatctaaaaaggatggagaacgtcatgcattcattctgcaggatactaaagcactacaccaggtcttcgagcacatgttggatgtcagcaaactcactgacacaatttgcggagttggcaatatgtccgcgaatgcaagcgaccaggagaggactccatggcatgtaactattaaatag

SEQ ID NO: 112793 - DNA, 2259 bp, Artificial Sequence
  Description of Artificial Sequence: Synthetic coding sequence
atgggcccgcttatggtgctgttctgtttactgttcctgtaccctgggttagctgatagcgcccccagctgcccccagaacgttaatatatccggcggaacttttacactgtcccacgggtgggcacctggctcgctgctgacttattcatgtccgcagggactgtatccttctcctgctagccggttatgcaagtcatccgggcagtggcagacccctggggcaacacgcagtctgtcgaaggccgtatgtaagcctgtgaggtgtcccgcacccgttagttttgaaaatggtatttacactcctagattaggtagctatccagtcggtggcaatgtaagctttgagtgcgaggacgggtttattcttagggggagtcctgtgcggcagtgccgcccgaacggaatgtgggatggcgaaaccgcggtgtgtgacaatggcgccggtcactgtcctaatcccggaattagtctgggtgctgtgcggaccgggtttcgctttgggcacggggataaggtgaggtaccgttgctcatccaatctggttcttaccggcagctctgaacgagagtgccaaggtaacggcgtgtggtccggcacagaaccaatctgccgccagccatacagttatgactttcccgaggacgtggctcctgcattagggaccagtttttcccacatgctgggcgcaacgaatcccactcagaagaccaaagagtccttgggccggaagatccagatacaaagatccgggcacctgaacttatacctcctcttggactgtagtcagagcgtgagtgagaacgactttttaatctttaaggagtccgcttcattgatggtcgatcgtatctttagctttgaaattaatgtgagtgtcgcgataatcacatttgcgtcagaaccaaaagtattgatgtcagtccttaacgataattccagagatatgacagaagtaatatcctctctggagaatgccaactataaggaccacgaaaacgggaccgggaccaacacttatgctgctcttaacagtgtatatctcatgatgaacaaccagatgaggctgctcggtatggaaacaatggcttggcaagaaatcagacacgccattatactcctgacggacggaaaatccaacatggggggctctccgaagacagccgttgaccacattcgcgagattctgaatatcaatcagaagcgcaatgattacttggacatctatgcaattggagtaggcaagctagatgtcgattggcgggaattgaatgagctcggaagcaaaaaagacggtgagaggcacgcttttattcttcaagatactaaggccctgcaccaggtgttcgagcatatgctcgatgtttccaagttaacagacaccatttgcggcgtgggaaatatgtcagccaacgcatccgaccaggagaggaccccatggcacgtgaccatcaaacccaaaagtcaagagacatgtcggggagcactcatctcggaccagtgggtcttgacagccgcgcattgtttcagggacggtaacgaccatagcctctggcgcgtgaatgtgggcgatccgaagtcacagtggggcaaggagtttctgatagaaaaagccgtgatctctcccggatttgacgtttttgccaagaagaatcaaggtattttggagttttatggggacgacatcgctcttttgaaactggcccagaaggttaagatgtccacccacgcacgtccgatctgtttaccctgcacgatggaagctaacttggcccttaggaggccccagggcagcacgtgcagagatcatgaaaatgagctcctcaacaagcagagtgtcccagcacactttgtggccctcaacggatccaaacttaatattaatcttaaaatgggagtcgagtggaccagctgtgctgaggtcgtctcgcaggagaaaactatgttccccaatctgaccgatgttagggaagtggtcacggatcagttcctgtgtagcggaacacaggaggacgagagtccctgcaagggggagtctgggggggcagtcttcctcgagcggaggttccggttctttcaagttgggctagttagctgggggttatataacccatgtctgggaagcgccgacaaaaactcccgcaagagggctccacggtcgaaggtgccgcccccacgtgatttccacatcaacctcttccgcatgcagccatggctcagacagcacctaggagacgtcctcaatttcttgcccctttag

SEQ ID NO: 112794 - DNA, 1062 bp, Artificial Sequence
  Description of Artificial Sequence: Synthetic coding sequence
atgggccctctgatggtgcttttttgtttgctcttcctgtatccagccggtcactgtcctaatcctgggatctctctgggggccgtgcgtactggattccgctttggacatggcgacaaagtgcgctatcgctgttccagcaatctcgtgctgaccgggagctctgaaagagaatgtcaagggaacggcgtatggtccggaacagagcctatttgccgccaaccttactcttatgatttcccagaggacgtggcaccagcgctgggaacaagcttcagtcatatgttgggtgccacaaatcccacacagaagaccaaggagtccctggggagaaagatccagatacaaaggtccgggcatctcaatctttacttgctcctagactgctcacagagcgtgtctgaaaatgactttctcatttttaaagagtccgcttctctgatggtcgatcggatttttagtttcgaaatcaatgtgagcgtggcaatcattacattcgccagcgagcctaaagtgttgatgtcagtgttgaatgataactccagggatatgaccgaggttatttcaagcctggagaacgccaactataaagatcacgaaaatgggactggaactaacacttatgccgctctgaattctgtgtatctgatgatgaacaatcagatgcgccttctgggaatggaaacgatggcttggcaggagatccggcatgccataattctgttaaccgacggtaaatcgaatatgggcgggtctcctaagaccgccgtagatcacatcagggaaatcttgaacattaatcagaagaggaacgattaccttgatatatacgccattggtgttggtaagctggatgtagactggagagagttgaacgaactgggtagcaagaaagatggcgaacgtcacgcctttattttgcaagatacaaaagccttgcaccaagtgttcgagcacatgctagacgtctccaaactgacagacacaatttgcggagtagggaacatgtcggccaatgccagcgaccaggagcgtactccctggcatgttaccattaagtag

SEQ ID NO: 112795 - DNA, 1062 bp, Artificial Sequence
  Description of Artificial Sequence: Synthetic coding sequence
atgggacccctcatggtgctcttttgcctcctcttcctatatcctgccggccactgccccaatccaggcatatctctcggtgcagtaagaactgggttcaggttcggacacggcgacaaggtgcgttaccgatgttcatccaatctggtgcttaccggatcttcagaacgggaatgccagggcaacggagtgtggagcggcaccgagccaatttgtcggcaaccgtatagttacgacttccctgaagatgttgccccggccctaggcacctcattcagccacatgttgggcgccaccaatccaactcagaagacaaaagaaagtctggggcggaagatccaaattcaaaggtctggacaccttaacctctacctgctcctggactgcagccagtcagtctccgaaaacgattttttgatattcaaggagagcgcctctctcatggttgatcgcattttttcattcgaaataaatgtaagcgtcgccatcattacatttgctagcgaaccaaaggttctaatgagcgtgcttaatgacaatagtagggacatgaccgaggtgattagcagcttggaaaacgcaaactacaaggaccacgaaaacggcacggggacaaacacttacgctgccctaaatagcgtctacctgatgatgaacaatcagatgagactgcttggtatggaaacaatggcctggcaggagattcgccacgctataattctgctcaccgacggcaagagtaacatgggaggaagtcctaagaccgctgtcgaccatattagagaaatattgaatatcaatcagaagagaaacgattacctagacatatatgctattggcgtcgggaaacttgacgtggattggcgcgagctcaacgagctaggctcgaaaaaagacggcgaacggcatgccttcattctgcaggacactaaggccttacatcaggtattcgaacatatgctggatgtctccaagctgacggataccatctgcggcgtgggaaatatgtccgcgaatgccagcgatcaagaacgaaccccttggcatgttactataaagtag

SEQ ID NO: 112796 - DNA, 510 bp, Artificial Sequence
  Description of Artificial Sequence: Synthetic coding sequence
atgcgcgcactctgcatacgggaaacctgttccagtgagttgggcttcagtagaaattggtcaagaagaaaggccggccattgtccgaatccaggaatcagcctgggtgcagtgcggaccggttttcggtttggacatggggacaaggtgcggtacaggtgcagtagcaatctcgtcttaacaggctcctctgaacgggaatgtcagggcaacggtgtgtggagtggcacagaacccatatgccgtcaaccttactcttacgattttccagaagacgtcgctcccgcccttggaacatccttctcccacatgctcggggctaccaatccgacacagaagactaaggaccacgagaatggcactgggaccaatacatatgccgctttaaactccgtctatcttatgatgaacaaccagatgcgccttttaggaatggagactatggcctggcaggaaatccgccatgctatcatactcctaaccgacgggaaaagtaacatgggaggctag

SEQ ID NO: 112797 - DNA, 1578 bp, Artificial Sequence
  Description of Artificial Sequence: Synthetic coding sequence
atggtattgttttgtctgcttttcctgtatcccgccggacattgccccaacccaggcatcagtcttggcgccgttagaactggttttagatttggccacggcgacaaggttagatatcgatgttcctccaatctggtgttgactggcagttctgaaagggaatgccaaggcaacggagtatggtctggcactgagcctatttgtcgtcagccatactcctacgactttcccgaggacgtcgctccagctctcgggacatccttttcccacatgctgggcgcaacaaatcccactcagaagaccaaagaccacgaaaatggcacgggaactaacacctacgctgccctgaactccgtgtacctgatgatgaacaatcagatgaggttactgggcatggagacgatggcctggcaggaaatcaggcatgccataatactgttgactgacgggaagtcaaatatgggaggaagcccaaagacagcggtggaccatatccgtgagattctgaacattaaccagaagcgcaacgactatctcgacatctacgctatcggtgtggggaagctcgatgtcgactggagagagcttaacgaacttgggtctaagaaagatggtgagcgccatgcttttatcctccaggacactaaagctttgcatcaggtgtttgagcacatgctcgatgtgtcaaaactgaccgacacgatttgtggggttggcaacatgtctgcaaacgccagcgatcaagagaggactccctggcacgttacaattaagccaaagtcccaagagacatgtaggggcgcattaatcagcgaccagtgggtgttgaccgcagcccactgcttccgcgacggtaatgaccactcactgtggcgagtgaatgtgggggaccctaagtctcaatggggcaaggaatttctgattgaaaaggctgtgataagccctggatttgatgtttttgcaaagaagaaccaaggaattttggagttttacggtgatgatatagcactgctgaaattggcccagaaagtgaagatgtccacgcacgcacggcctatttgtcttccgtgtaccatggaggccaatctcgctctgcggcgaccccagggaagcacatgccgggaccatgaaaatgaattgctgaacaaacaatccgtgccagctcactttgttgcactcaacggcagtaagctgaacatcaacctgaagatgggggttgagtggacatcctgcgccgaagttgtgtcccaggagaaaactatgttccctaatctgaccgatgtgagagaggtggtcaccgaccagtttctatgctcgggaactcaggaggatgaaagtccctgcaaaggcgagagtggcggagctgttttcctggagcgacggtttaggttctttcaggttggtctggtgtcatggggactttacaacccatgtttaggctctgctgacaagaatagccgaaagcgggctccccgcagcaaggttcctcctccgagagactttcacataaacctattccgcatgcagccatggctgagacagcatttgggcgatgtgctcaactttctgcccttgtag

SEQ ID NO: 112798 - DNA, 1062 bp, Artificial Sequence
  Description of Artificial Sequence: Synthetic coding sequence
atgggtccattaatggttctgttttgcctgttatttctgtacccagccgggcattgtccaaatcctggcataagtttgggggctgtcaggactggtttccggtttgggcatggcgataaggtgcggtaccgctgttcttcaaatttggttttgaccggcagctcggaaagggaatgccagggtaatggtgtgtggtccgggactgagccaatctgcaggcagccatatagttatgactttccagaggacgtggcccccgcattgggtaccagttttagccatatgctgggtgccacgaacccaacacaaaaaacaaaggagagtttaggcaggaaaattcagatccagaggtcaggacatcttaacctttacctcttactagactgctctcagtctgtctccgagaatgactttctgatttttaaggaatccgccagcttaatggttgatagaatcttttcatttgagatcaacgttagcgtagctatcataacctttgcttctgagccaaaggtcttgatgagtgtgctcaacgacaatagcagagatatgacggaggtgatttcttcgcttgagaatgcaaactacaaggaccacgaaaatgggactggcacaaacacctatgctgctcttaactcagtctacctcatgatgaataaccagatgcgccttctcgggatggagacgatggcatggcaggaaatacgccacgcgataattctgctgacggacggtaagagcaacatgggtggctcccctaaaactgctgttgatcacattagggaaatcctgaacatcaaccagaagaggaatgattacctggacatttatgccattggggtgggaaagctggatgtagactggcgcgaactgaatgagcttggttccaaaaaggacggtgaacgccacgcattcatcctccaggacacaaaagctttgcatcaggtattcgagcacatgctggatgtcagtaagttgactgataccatctgtggagtaggaaatatgagcgctaatgcctcagatcaggagaggaccccctggcatgttactattaaatag

SEQ ID NO: 112799 - DNA, 405 bp, Artificial Sequence
  Description of Artificial Sequence: Synthetic coding sequence
tgaggacactgcccaaacccggggatcagtttgggagctgtgcgaaccggatttcgctttggacacggcgacaaggtacgatacaggtgctcttccaatctagtcctgaccggtagttctgagagagagtgtcagggaaatggcgtgtggtcgggaactgagccaatctgccggcagccatatagctatgacttccctgaagacgtggcgccagctctggggacttctttctctcatatgctaggagcaacaaatcccacgcagaaaacgaaagagagtctcggacggaagattcagattcagagatcagggcatctcaatctctaccttttgctggactgcagtcagtcagtgtcagagaacgacttcctgatctttaaggagtccgcctccctgatggtgtag

SEQ ID NO: 112800 - DNA, 1578 bp, Artificial Sequence
  Description of Artificial Sequence: Synthetic coding sequence
atggtgctgttttgtctgctcttcctgtacccagccggtcactgtcctaatccaggcatatcgttgggagcagtgcgaacaggattcagattcggtcacggcgacaaagttcgctatagatgctccagcaacctggtgcttacgggatcaagtgagcgggaatgtcagggcaatggagtctggtctgggaccgagcctatctgccggcaaccttacagctatgatttccctgaggacgtggcccccgcattgggtacctcctttagccacatgttaggcgctactaacccaacacagaagacaaaggatcacgaaaacggaacagggactaacacttatgcagctctcaacagcgtatatttaatgatgaataaccaaatgcgccttctcgggatggagaccatggcatggcaggagatccgccatgctatcattctgctgacagatgggaagtccaatatgggcggaagtcctaagacagcagtcgaccatattcgcgagattctcaacatcaaccagaaacgcaatgactacttagacatctacgcaatcggtgtggggaagttggacgttgactggcgggagctgaatgagctgggctctaagaaagacggggagcggcacgcattcatcctgcaggatacgaaggctctacaccaagtctttgagcacatgctcgatgtgtctaagctcaccgacaccatctgcggcgtcggtaacatgtctgccaacgcctccgatcaggagcgaacgccctggcacgttacgatcaagccaaagtcccaggaaacttgtaggggagccctcatttccgatcagtgggtccttaccgcggcccattgctttcgggatggcaacgatcatagcctgtggagggttaatgtgggtgacccgaagtcccagtggggcaaagaattcctgatcgagaaagcagtcatatccccaggattcgatgttttcgctaagaagaaccagggcatcctggagttctacggcgatgatatcgcccttctcaaacttgcacagaaagtgaagatgtccactcatgccaggcctatatgtctgccatgtactatggaggctaatctggcattacgtaggccgcagggcagcacatgcagagaccacgagaacgagttgctcaataagcagtcagtgccggcgcactttgtcgcactgaacggatcgaaactcaacattaatttaaagatgggcgttgaatggacctcatgtgctgaagtggtgtctcaggagaaaaccatgttcccaaatctcacagatgtgcgggaagtagtcactgaccagttcctgtgttctggaactcaggaggacgaatccccctgcaagggggagagcgggggggcagtgtttctggaaagacgattcagatttttccaggtcgggttggtgtcgtggggactgtataacccatgcctaggatccgctgacaaaaacagtagaaaaagggctcccaggtcaaaggtccctcctcctcgggattttcacattaatttattccggatgcagccctggttgcggcagcacttgggcgacgttttgaacttcctccccctatag

SEQ ID NO: 112801 - DNA, 1578 bp, Artificial Sequence
  Description of Artificial Sequence: Synthetic coding sequence
atggtcttattttgtctgctgttcctttaccctgctggccattgccccaacccaggtattagtctcggggcggtgcgaacaggatttagattcggacatggcgacaaggtgagatatcggtgctcaagcaacctggtgcttaccggctcctcggaaagagagtgtcagggaaatggcgtgtggagcggcaccgaaccaatttgccgacagccatacagttatgacttccccgaggatgtcgcacctgccttgggaacctccttctcccacatgctgggcgctacgaatcccacacaaaagacaaaggaccacgaaaatggaactgggacaaacacatatgctgccttgaactcggtgtacttaatgatgaacaatcagatgaggctgctgggaatggaaacgatggcctggcaggaaatccggcacgctattattctcctgaccgatggaaaatcgaatatgggtggaagtcccaaaactgccgtcgaccacatccgggagatactgaacataaaccagaaacgtaacgactatctggacatttatgccatcggcgttggcaaactggacgttgactggagagagctcaacgaactaggctcaaagaaagatggcgaaagacacgcttttatacttcaggacaccaaggcccttcatcaagtctttgaacacatgctggatgtgtctaaactaacagacacgatctgtggggtgggcaacatgtcggcaaacgcctccgatcaggagcggactccctggcacgtgaccattaaacccaaaagccaggaaacttgccgtggtgctctcatcagcgatcagtgggtgctcaccgctgctcactgctttagagacgggaatgatcatagcctctggcgtgtgaacgtgggagacccgaaaagtcagtggggcaaggagtttttaatagagaaagcagttatatcgcccgggtttgacgtgttcgctaagaaaaaccaggggatactggaattctacggagatgacatcgccttactgaaactagcccagaaggttaaaatgagtactcacgccagaccaatatgtttgccatgcaccatggaggccaacctcgccctaaggagacctcagggatctacatgtcgggaccacgaaaacgaactgctcaacaagcagtcagtgcccgcccatttcgtagccctcaacggaagcaagcttaatatcaacctgaagatgggcgtcgaatggacatcgtgtgcagaggtggtctcacaggagaagacaatgttcccaaatctgactgatgtccgagaagtcgtgactgaccagttcttgtgttcaggtacccaggaggatgagtctccatgtaagggcgaaagtggtggggccgtattccttgagagaaggtttagattcttccaagtgggactggtttcgtggggcctgtacaacccctgtctgggtagcgcagacaagaactcacgaaaaagagctccacgatccaaggttcccccgcccagggacttccatataaacttgtttagaatgcagccgtggctgaggcaacatttaggggatgtccttaacttcctgcccttatag

SEQ ID NO: 112802 - DNA, 1062 bp, Artificial Sequence
  Description of Artificial Sequence: Synthetic coding sequence
atgggccccctgatggtgctcttttgtctgcttttcctctacccagccgggcattgccccaacccaggaatctctttgggcgccgtgcggactgggtttcgctttggccacggcgataaggtgcgatatcggtgttcaagcaacctcgtcctcacaggcagcagcgaacgggagtgccagggcaacggcgtatggagcggaaccgagccgatctgccggcagccctactcctacgatttcccagaggatgtggcgccggcactgggcacatcattttcacatatgctcggggcaaccaatcccacgcagaagaccaaggaaagtcttggcaggaaaattcagatacagaggtctggccacttgaacctctacctcttgctggactgtagccagagcgtaagtgagaacgattttttgatattcaaggagtccgccagtctcatggttgacaggattttcagttttgaaatcaatgtcagcgttgcgattatcactttcgccagcgaaccaaaagtgctgatgagcgtccttaatgacaattcccgcgatatgacagaggttattagttctcttgaaaacgccaactataaagaccacgagaatggcacagggaccaacacctacgcagctctcaatagcgtctacctgatgatgaacaaccagatgcgcctccttgggatggaaacgatggcctggcaggaaattagacatgctattatcctcttgactgatggaaaatctaacatgggcgggtcacccaagaccgccgttgaccacatcagggagatcctcaatattaaccagaagagaaatgattatttggatatttacgctatcggcgtgggtaaattggatgtggactggcgcgagctgaatgagctgggcagcaagaaggatggtgaaaggcacgcgtttattctccaggacacaaaagccctccaccaggtgttcgagcatatgttagatgtttctaagttaacagacacaatctgtggagtgggcaatatgtcggccaatgcttcagaccaagagcgcacaccctggcacgtcaccatcaagtag

SEQ ID NO: 112803 - DNA, 477 bp, Artificial Sequence
  Description of Artificial Sequence: Synthetic coding sequence
atgagggccttatgcatcagagagacctgttccagcgagctgggctttagcaggaactggtctagaaggaaagccggacactgccctaacccaggcatctccctcggtgccgttaggactggctttagattcggacatggcgataaagtcaggtacagatgctcgagcaatctggtcttaactggtagcagtgagcgtgaatgccaggggaacggggtgtggagcggcacagagcccatttgtaggcaaccctattcctacgacttcccagaggacgtcgcgcctgccctggggacctcattcagccatatgttgggtgccactaacccgacgcagaagacgaaggagagcttggggaggaaaatccagatccagcggagcggtcacttgaacctatacttgctattggattgtagccaaagcgttagcgaaaatgatttcttaatattcaaggaatccgcctcgcttatggtgtag

SEQ ID NO: 112804 - DNA, 477 bp, Artificial Sequence
  Description of Artificial Sequence: Synthetic coding sequence
atgagagctctgtgtatccgagagacctgctcgagtgagctgggcttctccagaaattggagtcggaggaaagccggccactgccctaatcccggtatctccttgggcgccgtcagaaccggctttcgattcgggcatggagacaaagtgaggtaccggtgttcgtcaaatctggtgctgaccggctcttcagaaagagagtgccagggaaatggagtttggagtgggaccgagcctatctgtagacaaccgtactcctacgatttcccagaagatgtcgcccccgcgctggggacatcattttcccatatgttaggggccactaatcctacccagaagacgaaggagtccttaggccgcaagatacagattcagcgtagtggacacctcaacctctaccttctgttggactgttcccaatccgtctccgagaacgacttcctaatcttcaaggaatctgcaagtctaatggtgtag

SEQ ID NO: 112805 - DNA, 978 bp, Artificial Sequence
  Description of Artificial Sequence: Synthetic coding sequence
atggggacccggagcgccattgccgccccacgaatcctgtgtagcagggggctgcggagcggctccgcacgcgctaccggctcaggcgtggagcggtctccatcagccgctaatcctactctgatgaccagtctgagaacctggccccttccatgggctctgcctagtccaacctgtctgggaccaccgataccacccagacgccagagaatatttagcttcgagataaatgtgtccgtggctattatcaccttcgctagtgaaccaaaagtgctgatgtccgtcctaaacgataattctagagacatgaccgaagtcatttctagcctggagaacgccaactataaggatcacgagaatggcactggcactaatacatacgccgctctgaactctgtctatctgatgatgaacaaccagatgcggctgttgggtatggaaaccatggcctggcaggagatcagacacgctattattttactgacagacgggaaatcgaatatgggcggtagccccaaaacggcagtggaccatattcgggagatccttaatataaaccaaaaacggaacgactacctcgacatttatgctattggagtcggtaagctagacgtagactggagagagctcaacgaattgggatctaagaaagacggagagaggcatgctttcatactgcaggatacaaaagcactgcatcaagtatttgagcatatgttggatgtgagcaagctcactgataccatctgtggcgtgggtaatatgtcagctaacgcatcggaccaagaacgtaccccctggcacgtcactattaagcccaaaagccaagaaacctgcaggggagcgctgatctcggaccaatgggtgttaactgccgcccactgtttccgggacggcaatgatcatagtctctggagggttaacgttggggatccaaaatctcaatgggggaaggaattccttatagagaaggcctag

SEQ ID NO: 112806 - DNA, 477 bp, Artificial Sequence
  Description of Artificial Sequence: Synthetic coding sequence
atgcgggcgctgtgtattcgggagacctgctcaagtgagctaggcttctcccgcaactggtcacgtaggaaagccggtcactgccctaacccggggatctccctgggggcagttcgcaccggattccgttttgggcatggcgataaagttaggtaccggtgtagctccaatctagtgcttaccggttcttcagagagagaatgtcagggaaatggtgtctggagtgggaccgaacccatctgcaggcaaccctattcttatgattttccagaggatgtggctcctgcacttgggacatccttcagtcatatgctgggcgcaacaaatcctacccagaaaacaaaggagagtctcgggcgaaagatccagatccagaggagcgggcacttgaacctgtatctcctgcttgactgttcacagagcgtgtctgaaaacgatttcttgatcttcaaagagagtgcctcactgatggtatag

SEQ ID NO: 112807 - DNA, 1062 bp, Artificial Sequence
  Description of Artificial Sequence: Synthetic coding sequence
atggggcccctcatggtattgttttgcctcctctttctctacccggcaggacactgtcccaatcctggtatatctttgggtgctgttcgaacggggtttcggttcggtcatggcgacaaggtgaggtacagatgcagcagtaatcttgtattaactgggtctagcgagagggagtgccagggcaatggggtctggagcggtaccgagcccatctgtcgacagccgtacagctatgactttcccgaggatgtggccccggccctgggtaccagtttctctcacatgctgggcgccacaaatccaactcagaagactaaagagagcctggggcgcaaaattcagatccagcggtcaggccatctgaatctctatctcctgctagactgtagtcagtccgtatctgaaaatgattttctaatatttaaggagtccgcaagtttaatggtagaccgtatttttagttttgagataaatgtctctgtcgctattatcacattcgccagtgagcctaaagtgctgatgtcagtgctgaacgataactccagagacatgaccgaagtcatatcaagtctcgaaaatgcaaactataaagaccacgagaatggcacaggaaccaacacctatgccgcattgaattcagtatacctgatgatgaataaccagatgagactcttgggcatggagacaatggcctggcaagagatccgccacgctattatcctactgacagacggaaaaagcaatatgggcggttctcccaagacagctgtggatcacatccgcgaaatcctgaacataaaccagaagcggaatgattaccttgacatctatgcaatcggcgtcgggaagctggatgtggattggagggaacttaacgagttgggttcaaaaaaggatggggagcggcacgctttcattttgcaagacactaaagcacttcaccaggtgttcgagcatatgctcgatgtatccaagctgacggacactatatgcggagtcggaaacatgtctgccaatgcttctgaccaagagcggactccttggcatgtgacaattaagtag

SEQ ID NO: 112808 - DNA, 420 bp, Artificial Sequence
  Description of Artificial Sequence: Synthetic coding sequence
atgggacctctcatggtgctgttctgtcttctgttcctgtatcccggtctggccgacagtgccccctcatgccctcaaaatgtcaacatctccgggggtacttttaccctatcacacggatgggcacccggcagcttactcacatacagttgcccccagggactataccccagccccgccagtcgtttgtgtaagagttccggacagtggcaaactccaggggctacacgttccttatccaaggcagtttgcaaacctgtgcgctgtccagcccctgtgagcttcgagaatggcatctatactccccggctgggaagttatcccgtgggtggaaatgtgtccttcgagtgcgaggacgggtttattctgcgtggctcccccgtgcgccagtgtcgccctaatggaatgtgggatggatag

SEQ ID NO: 112809 - DNA, 438 bp, Artificial Sequence
  Description of Artificial Sequence: Synthetic coding sequence
tagggtcattgtccaaaccctggtattagtctcggggcagtccgtaccggattccgttttggccatggggataaggtccgatatcggtgcagttccaatctggtgcttaccggttcctccgagagagagtgtcaggggaacggcgtgtggagtgggacggagcctatctgtcggcaaccttatagttacgattttcccgaagacgtcgcacctgccttggggacaagcttctcacacatgctgggggccacgaatcctacccagaaaactaaggatcacgagaatggaaccggaaccaatacgtatgccgcactgaatagcgtctacctgatgatgaataatcagatgagactcttggggatggagacaatggcatggcaggaaattcggcatgctatcattctgttaaccgacggtaaatccaatatgggcgggtag

SEQ ID NO: 112810 - DNA, 378 bp, Artificial Sequence
  Description of Artificial Sequence: Synthetic coding sequence
atgggaccactgatggtgctcttttgtctcctcttcctgtatcctggattggctgactctgccccttcctgcccccagaacgtcaacatctcaggggggacttttactctatcccacggctgggctccaggatcactgttaacttattcttgcccccaaggcttgtacccctccccagcgtccagactctgcaagagcagcggacaatggcaaacaccaggagccaccaggtcactgtctaaagcagtgtgcaagcctgggcactgcccaaaccctgggatttccttgggggccgtcaggacaggattcaggttcggacatggtgacaaggtgcgataccgctgctcttcaaatctggtgctgaccggtagctcctag

SEQ ID NO: 112811 - DNA, 420 bp, Artificial Sequence
  Description of Artificial Sequence: Synthetic coding sequence
atggggcctctcatggtcctattctgtctgttgtttctttatccaggactggccgactctgcccctagctgcccgcagaatgttaatatcagcggcgggaccttcacactgtctcacggatgggcccctggaagtctgctaacttatagttgtccacaaggcttgtatccttctccagcgtccagactgtgcaaaagctcgggtcagtggcaaacacctggagcaacccgttctcttagcaaagcagtgtgcaaacctgtgcggtgcccagcccctgtgtctttcgaaaacgggatctatacaccgcgactggggtcctaccccgtgggaggtaacgtaagttttgagtgtgaagatggattcatactgcggggatcaccagtgcgccaatgtaggccaaatggcatgtgggatggttag

SEQ ID NO: 112812 - DNA, 477 bp, Artificial Sequence
  Description of Artificial Sequence: Synthetic coding sequence
atgcgagctctgtgtattagggagacatgttcgagtgaattgggctttagccgcaattggagtagacggaaggcgggtcattgcccaaaccctgggatatctcttggtgccgtgaggacgggtttccggtttggacacggggataaagttcgctaccgctgctcctcaaacttggtccttacggggagctccgagagagaatgtcaggggaacggagtttggtccggcacagagcctatctgccgtcagccatacagttacgattttcctgaggacgtggccccggctcttggtacgagcttctcacacatgcttggggctaccaatccgacccaaaagacaaaagaaagcctgggcagaaagatccagatccaacgaagcggccacttaaacttatacttgctgctggactgctctcagtctgtgagtgaaaatgactttcttatatttaaagagagcgcatccttaatggtttag

SEQ ID NO: 112813 - DNA, 378 bp, Artificial Sequence
  Description of Artificial Sequence: Synthetic coding sequence
atgggccctctcatggtcctcttttgtctgctgttcttgtatcctgggctggcagattcagccccttcctgcccccaaaacgtgaacatcagtggaggaaccttcaccctcagccacgggtgggctccaggtagtttgctgacatactcctgcccccaaggtctgtatccctcgccggctagcagactctgcaagtcctctggacaatggcagaccccaggagccacacgtagtttgtccaaggcggtgtgcaagcctggccactgccccaaccccggcatttccctgggtgcagttaggacaggattccggtttggacacggggacaaggtgagataccgttgcagttccaatctggtcctgactgggtcttcatag

SEQ ID NO: 112814 - DNA, 1863 bp, Artificial Sequence
  Description of Artificial Sequence: Synthetic coding sequence
atgggaccattgatggtgcttttctgtcttttatttctgtatccagccggacattgtccaaaccctggtatttctttgggcgctgtgagaacgggtttcagatttgggcacggggacaaggttcgttatcgatgctcaagtaaccttgtgctgaccggcagttctgagcgagaatgtcagggtaatggcgtatggtctggaacagaacccatttgtagacaaccctatagctacgattttccagaggatgtcgccccggctctgggaacttctttctctcatatgctgggcgcgacaaacccaactcaaaagacaaaggagagcctggggcggaagattcaaatccaacgcagcgggcacttgaatttgtatcttctgctggattgttcccagtctgtgagcgaaaacgatttccttatttttaaggagtccgcctccctgatggtggatcgaattttttccttcgagattaacgtatccgtcgctatcattacctttgcttccgaacccaaggtgttaatgagcgtgttaaatgataactcacgggatatgactgaagtaattagctccctggagaacgctaactacaaggaccatgagaatggcaccggaaccaatacatacgctgctcttaatagcgtatatctgatgatgaacaaccagatgcgacttctcggcatggaaactatggcctggcaggaaataagacacgccataatcttgctgactgatggaaaaagcaacatgggaggttcgccaaaaacagcagtagaccatattcgggaaatcctgaacataaaccagaaaagaaacgattacctagatatttacgctattggcgtgggcaagcttgatgtggactggcgtgagcttaatgaactagggtccaagaaagacggtgagaggcatgcctttatcctgcaggataccaaggccctgcaccaggtgttcgagcacatgctggatgtgtccaaactgactgacaccatttgtggcgttggtaatatgtccgcgaatgcgtccgaccaggaacgtacaccatggcatgtgactatcaagcctaagtcacaagaaacctgcaggggggctttgatttctgaccagtgggttttgacagccgcccattgctttcgcgatggtaatgatcatagtctgtggcgcgtgaacgtcggcgatcctaaaagtcagtggggcaaggagtttttaatcgagaaagccgtgataagccctggttttgacgtgtttgcaaaaaagaaccaggggatcctcgaattctacggagacgatatcgctctgctgaagctggcacaaaaggtgaagatgagcacccacgctagacccatctgtcttccctgcacaatggaagccaatctggccctgcggcgaccccagggctcaacatgtcgagatcacgaaaatgagctccttaataaacagagcgttcctgctcacttcgtagcccttaacggctccaaactgaacatcaatttgaagatgggtgtagagtggacctcatgcgcggaggtagtatcgcaggagaaaacaatgttcccaaacctgaccgatgtcagggaagttgtcactgaccagtttctgtgctcagggacacaggaagatgagtccccatgtaaaggagagagcggaggggcagtgtttctggagcgccgcttcaggttttttcaggtgggcctcgtgagttgggggctgtacaacccatgcctcggcagcgccgataagaattcgcgcaagcgggcgcctcgcagcaaagtgccccctccccgtgacttccacatcaatctgtttcgcatgcaaccatggcttcggcaacacctcggggacgtcctgaactttcttccactctag

SEQ ID NO: 112815 - DNA, 378 bp, Artificial Sequence
  Description of Artificial Sequence: Synthetic coding sequence
atgggccctttgatggtattattctgtctactgtttctgtatcccggcttggccgactctgccccatcctgcccccagaatgtcaatatctctgggggaaccttcactctcagccacggctgggcccccggaagcctgttgacatactcatgcccccaagggttatacccgtcaccagcctctagactgtgcaagtccagcgggcagtggcaaacgcctggggcaaccaggagcctgagtaaagcggtgtgcaagcctgggcactgccctaaccccggaatcagtctaggcgctgttcgcacaggatttcgctttggtcacggagacaaggtccgatatcggtgctccagtaatcttgtcctcaccggctcctcctag

SEQ ID NO: 112816 - DNA, 420 bp, Artificial Sequence
  Description of Artificial Sequence: Synthetic coding sequence
atgggacctctcatggttctgttttgcttgttgtttctttatcccggactcgccgactccgcgcctagttgcccacagaacgtcaacatctctggaggcacattcaccctgagccacgggtgggcaccaggctctctgctgacttattcttgcccacaggggctgtacccctcaccagcctcaaggctgtgtaaaagttcaggacagtggcagaccccaggcgcgacccgctctctgtcgaaggcagtgtgtaaacccgtccgctgccctgcaccagtcagtttcgagaacggtatctacacccctcgactgggcagctaccccgttggcggcaatgtctccttcgagtgtgaggacggattcattttgcggggcagcccagtcaggcagtgccgaccaaacgggatgtgggacgggtag

SEQ ID NO: 112817 - DNA, 378 bp, Artificial Sequence
  Description of Artificial Sequence: Synthetic coding sequence
atgggccctctgatggttctgttttgcttactctttctgtaccccggactggcagacagcgcgccaagttgtccccaaaacgtaaatatatctggaggtacgttcactctgtcccacgggtgggcaccgggatcattgttgacatattcatgcccccaagggctctatccgtcccctgctagtcgtctctgcaaaagctctggtcaatggcagactcccggcgccacaaggtccctgagcaaggccgtatgcaaacccggccactgccccaatccaggcatctctctcggcgccgtgagaactggattccgattcgggcatggagacaaagtcagatacaggtgttcatctaatcttgtcctgacggggagctcctag

SEQ ID NO: 112818 - DNA, 2259 bp, Artificial Sequence
  Description of Artificial Sequence: Synthetic coding sequence
atgggccccctgatggtcctgttttgtctgctgttcttgtatcctggtcttgccgactccgctcccagctgccctcagaatgtaaacatctcaggtggtactttcactctttcccacgggtgggctcccggcagcctgcttacctattcttgtccccaagggttatatcccagtcctgcaagccgtttgtgcaaatcctcaggccagtggcaaacccctggggccactcgatctctgtccaaggctgtgtgcaagcctgtgaggtgtcccgcacccgtgtcatttgaaaacggcatctataccccgcgactcggctcataccctgtaggcggcaatgtatcctttgagtgtgaagacgggttcatactgcgaggaagcccagtgagacagtgcaggcctaacggtatgtgggacggcgagactgcagtctgtgacaacggagccggccattgcccaaaccctggcattagcttgggagccgtgaggaccggctttcgattcgggcacggtgacaaggtcagatatcgatgtagttctaatctcgtgttaactgggagctcagaaagagagtgccaaggaaacggagtgtggagcgggaccgagcctatctgtcggcagccttatagctacgatttcccagaagacgtggccccagccttaggcacatcattttctcacatgcttggagccactaatcctacccaaaagaccaaggagagccttggtaggaaaattcagatccaacgaagcggccacttgaacttgtatctcttactggattgtagtcaatccgtcagtgaaaacgattttctcatatttaaggagtccgcctccctcatggttgatcgcatctttagttttgagattaatgtctctgttgccattatcacatttgcctctgaaccaaaggttctgatgtccgtgctgaatgataattcaagggacatgacagaagtgatctccagtctggaaaacgctaactataaagatcacgagaacggaactggaacaaatacgtatgccgcattgaatagcgtttacctgatgatgaacaaccagatgcgccttctaggaatggagaccatggcctggcaggaaataaggcacgctattatattgttgaccgacggcaagagtaacatgggcggcagcccgaagactgcagttgaccatatcagagagatcttaaatataaatcagaagagaaacgactacctggacatttacgccattggggtaggcaaactggacgtcgattggcgagagctcaacgaactgggttcaaagaaggacggtgagcgccacgcattcatccttcaggacacaaaagccctccaccaggtctttgaacacatgcttgatgtgagtaaactgacagacactatttgcggtgtgggcaacatgtccgcgaatgccagcgaccaagaacggacgccgtggcatgtcacaattaagcctaaatctcaggagacttgtaggggggctcttattagcgatcaatgggtcctcaccgctgctcactgctttcgcgacgggaacgaccactccttatggagagtgaacgtaggtgatccaaaaagtcagtggggtaaagaattcctgatcgaaaaggccgtgatctcaccaggcttcgacgtgttcgccaagaaaaatcagggtattcttgaattttatggcgatgacattgcacttctgaaactggcccaaaaagtgaaaatgtcgactcatgctcgcccgatctgtctgccttgcactatggaagccaacctggccttacggcgccctcaggggtccacatgccgcgatcacgaaaatgaactgctgaataagcagagcgtccctgcacactttgttgcgctaaacggttcaaaattgaacattaatctcaaaatgggagttgagtggacctcctgtgcagaggtggtgtcccaggagaagactatgttccccaacctcactgatgtcagagaggtagtaacagaccaatttctgtgctcgggcacccaggaagacgagtctccttgcaaaggcgaatcaggaggtgcggtattccttgagaggcgatttcggttttttcaagtaggtctggtcagttggggattgtataatccctgcttaggctctgccgataagaacagccggaaaagagctccccggagcaaagtgccgcctccccgagactttcatataaatttgtttaggatgcagccctggttgaggcagcacctcggagacgtcctcaattttttaccactctag

SEQ ID NO: 112819 - DNA, 378 bp, Artificial Sequence
  Description of Artificial Sequence: Synthetic coding sequence
atggggcctctgatggtcctgttctgccttctatttctttaccccggattggccgactccgccccttcctgcccgcagaatgtgaatattagcggaggaacttttacattgtcccacggttgggcacccggctctctactgacttattcttgcccccaaggcctttacccaagtcctgcctccaggctgtgtaagagctcgggacaatggcagactcctggcgccacacggagcctgagcaaggccgtgtgtaagcccgggcactgccccaacccgggaatctccctgggagctgtcagaaccgggtttcgtttcggacacggggataaagtgcgctatcgatgcagtagcaatctagtgctgaccggctcttcctag

SEQ ID NO: 112820 - DNA, 510 bp, Artificial Sequence
  Description of Artificial Sequence: Synthetic coding sequence
atgcgtgccctgtgtatcagagagacctgctctagcgagctgggtttttcccgcaactggtcgcgtaggaaggccggccactgccccaaccccgggataagcctgggggcagtgcggactgggttcagattcggacatggggacaaggtgcggtaccgttgctcatctaatttagtgcttacagggtccagtgaacgtgagtgccagggcaacggggtgtggtccggtacagagcctatctgtagacaaccctatagttatgactttcctgaagatgtggcccccgcactgggaacttcattctctcatatgctcggagccacaaacccaacacagaaaaccaaagatcacgagaacggcactgggactaacacttacgcagcacttaatagtgtgtatctcatgatgaacaatcagatgagactgctgggaatggagaccatggcctggcaggagatccgtcatgccatcattctcctgaccgatggcaaaagtaacatgggcggttag

SEQ ID NO: 112821 - DNA, 1578 bp, Artificial Sequence
  Description of Artificial Sequence: Synthetic coding sequence
atggtacttttttgtctgttattcttgtatccagccgggcactgccctaacccagggattagcctcggcgccgttaggaccggttttcggttcggccacggggacaaagtccggtaccgctgttcctcaaaccttgtgctgacaggttcttcagagagagagtgccaaggcaatggggtctggagcggaaccgagcctatctgccgtcagccctattcttacgactttcctgaagatgtggctcccgcattggggactagcttttcgcacatgctgggtgcaactaatccaacacaaaagacgaaggatcacgagaatggcaccggaacaaatacttatgcggccctgaacagcgtgtatttgatgatgaataatcagatgcgcctgctgggcatggagactatggcttggcaggagatccggcacgccatcattctgctgactgacggaaagtcaaacatgggtggaagcccaaaaactgctgtggatcacatccgagagatcctcaatattaatcagaagagaaatgattacctggacatttacgcgataggcgtagggaagctggacgtggactggagagagcttaacgagctgggttctaaaaaagatggcgagcggcatgcttttatcctccaggataccaaggccctccatcaggtgttcgagcacatgctggacgtaagcaagctcacagacacgatttgcggagtagggaacatgtccgccaacgcttccgatcaggagcgcacaccttggcacgtaacaatcaaaccaaagtctcaagagacatgccggggtgccttgatttcagatcaatgggtgctgacagccgctcactgcttccgggatggcaatgatcattcactttggagggtgaacgtgggggaccctaaatcgcagtggggcaaagaatttttaattgagaaggccgtgatctctccaggcttcgacgttttcgcaaaaaagaaccagggtattctcgaattctatggggacgatatcgccttgctcaaactggcccaaaaggttaagatgagcacccacgcgcgcccaatctgcctcccatgtacaatggaggccaatcttgcactgcgtaggcctcaggggtcgacttgtagggaccatgagaacgagctgctcaataagcaatctgtgccagcacattttgtggctttaaacggatccaaactcaacatcaacctgaaaatgggcgtggaatggacgagttgtgcagaggtcgttagccaggaaaagacaatgtttcccaacctgacagatgtcagggaagtggtgacagaccagtttctgtgttccggtacgcaggaagacgaaagcccatgtaaaggtgaatcgggcggcgccgtattcctggagcgcaggttccggttctttcaggtgggcttggtttcatgggggttgtataatccttgtctgggttctgccgataagaacagtcggaaaagggcacctagatcaaaagtgccacctcccagagactttcacatcaatttgttcagaatgcagccctggctgcgccagcatctgggcgatgttcttaactttctaccgctgtag

SEQ ID NO: 112822 - DNA, 438 bp, Artificial Sequence
  Description of Artificial Sequence: Synthetic coding sequence
tgagggcactgccctaaccctggcatttctctaggagcagtccgcacaggcttcaggtttggtcatggcgacaaggtccgatataggtgcagcagcaacttggttctcacgggtagtagcgaacgagaatgtcaaggcaatggcgtgtggtccggaaccgaaccaatatgtcgacagccttacagctacgacttccctgaggatgtagccccggctctgggaacgtctttttcccatatgttaggggcaacaaatccaacacagaaaactaaggaccacgagaacggcacagggactaacacctacgctgcgctcaactctgtctatctcatgatgaacaaccaaatgcggttattgggtatggaaaccatggcctggcaggagattagacacgcaatcatcttattgacagatggcaagagtaatatgggcgggtag

SEQ ID NO: 112823 - DNA, 405 bp, Artificial Sequence
  Description of Artificial Sequence: Synthetic coding sequence
tgaggacattgtcccaaccctggtatctccctcggggccgttagaaccgggttccgcttcggacacggtgacaaagtccggtaccgttgtagttctaatctcgtactgaccggtagttcagaacgggagtgtcagggaaacggagtttggagcggtactgaacccatctgccggcaaccttatagctacgactttcccgaggatgtggccccagccctgggaacgagcttttcccatatgttgggtgccactaatccaactcagaaaacaaaggagtctctcggccgcaaaattcagatacagagaagtgggcatttgaacctgtacttgctgctggactgcagtcagagtgtgtctgagaatgattttttaatttttaaagaatccgcctctctcatggtgtag

SEQ ID NO: 112824 - DNA, 420 bp, Artificial Sequence
  Description of Artificial Sequence: Synthetic coding sequence
atgggccccctgatggtgcttttctgcctgctgttcttgtatcctgggctggcagactccgcaccctcctgtccgcaaaacgtgaatatatccgggggtacctttactttgagccatggttgggctcctggttccctgctcacctacagctgccctcagggactctacccttctcctgcctcacgactatgtaagagctcagggcagtggcagacacccggtgccaccagaagcttatccaaagctgtctgtaagccagtgagatgtcctgcccccgtctctttcgaaaacggaatctacacaccgaggctcggctcatatcccgttggcgggaatgtgagctttgagtgcgaggacggtttcatcctgcgtggtagtccagtccgccaatgccggcctaacgggatgtgggacggatag

SEQ ID NO: 112825 - DNA, 420 bp, Artificial Sequence
  Description of Artificial Sequence: Synthetic coding sequence
atgggacccctgatggtactgttctgcctgctctttctgtaccctgggctggccgactccgccccgagctgtccacagaatgtgaatatttcagggggcacgtttaccctctcgcacggatgggctcctggaagcttactgacgtactcgtgcccccagggtctgtacccctcacccgcaagtcgattgtgcaagtctagtggccaatggcagaccccgggggccaccaggtcactgtctaaagccgtctgtaaacccgtgcggtgccctgctccagtttctttcgagaatggaatatatacaccgaggcttgggtcttaccctgtcggagggaatgtttctttcgagtgcgaggacggattcattctgcgaggatctcctgtccgccaatgccgccctaacgggatgtgggatggctag

SEQ ID NO: 112826 - DNA, 1617 bp, Artificial Sequence
  Description of Artificial Sequence: Synthetic coding sequence
atgagggccctgtgtataagagagacatgttcttctgagctgggcttttccaggaactggagtaggagaaaagccggccactgcccgaaccccggaataagtttgggtgcggtacgaactggatttcggtttggtcatggcgataaagttagatacagatgtagcagcaacctagtgctgactggatctagcgaacgcgaatgtcagggaaacggagtgtggtccggcaccgagcctatctgtaggcagccctactcatacgacttccctgaggatgtggcccccgctctggggacgagtttctctcatatgctgggagcaacgaacccaactcaaaagaccaaagatcatgaaaatggcaccgggacaaacacttacgccgcgctgaactccgtttatcttatgatgaacaatcagatgcgcctgttgggcatggagacaatggcctggcaggagatcaggcatgcaatcatcctcctgaccgatgggaagtctaatatgggtggatcacctaagactgccgtggaccacatccgcgagatattgaatataaatcaaaaacgcaacgattatttggatatctatgcaattggcgtcggtaagcttgatgtggattggagagagctgaacgagctgggcagcaagaaagatggcgaacggcacgcctttatcctccaggatacgaaggcgttacaccaggtttttgagcacatgctggatgtcagcaaactgactgataccatctgcggggtgggtaacatgtccgcgaatgcgtctgaccaggaaaggaccccttggcacgtgaccattaagccaaagtctcaggaaacttgccgaggcgcattaattagcgaccaatgggtgctgactgcggctcactgctttcgcgatggcaacgatcatagcctctggcgggtgaatgtaggagacccaaaatctcaatggggcaaagagtttctgatcgaaaaagcagtcatatcccctggcttcgatgttttcgcaaaaaaaaaccaagggatacttgaattctatggcgacgatattgcactccttaagttagcccagaaagttaagatgagcactcacgcccggcctatttgtctgccgtgtactatggaagcgaacctggcactgaggagacctcaagggtctacgtgccgggatcacgaaaacgaactcttaaataagcagtcagttccggcgcattttgttgccctaaatggcagtaagcttaatattaacctgaaaatgggcgttgagtggacctcttgcgcagaagtggtctctcaggaaaagacaatgtttccaaatcttaccgacgtgcgtgaggtagtcacggaccagtttctgtgtagcggaacccaagaggacgagtctccctgtaagggggagtcaggaggcgccgtgtttctggagaggcgctttcggttttttcaggttggcctggtgtcttggggattgtacaacccatgtctcggcagcgccgataagaactcccggaaaagagcgcctcgctccaaagtgccaccgcccagggactttcacataaatcttttcaggatgcaaccgtggctcagacaacacctcggcgatgtgctcaattttctcccactttag

SEQ ID NO: 112827 - DNA, 1521 bp, Artificial Sequence
  Description of Artificial Sequence: Synthetic coding sequence
atggggaccaggtccgccatcgctgctccacgcattctctgcagcagggggttacgttcaggcagcgcacgagcaacaggttccggagtggagcgatctccaagcgctgccatcttttcatttgagatcaacgtctccgttgccataatcaccttcgcatctgagcccaaggtgctcatgtccgttctcaatgacaattctcgcgacatgactgaggtcataagttccctcgaaaacgcgaactataaggaccacgaaaatggcactggaaccaatacatatgctgccctgaacagcgtatatctcatgatgaataatcagatgcgtctgctaggaatggaaacaatggcctggcaggagatcaggcatgccattatattgctgacagacggcaaatcaaacatggggggatctcccaagaccgccgtagaccatattagggaaatactgaacatcaaccagaaacgaaacgattatctggacatctacgctattggcgtaggtaagctggacgtcgactggcgcgagctgaatgagttgggatcaaagaaagacggtgagcggcatgcctttatcctgcaagatactaaggcactgcaccaggtgttcgaacacatgctggacgtgtctaaactcaccgacacaatctgtggtgtgggcaatatgtccgccaacgccagtgaccaggaacggactccttggcacgtgacaatcaagccaaagagccaggagacctgccggggagccctgatctctgaccaatgggtgctcaccgcagcccattgctttcgcgatggcaacgatcactcactctggcgtgtgaacgtaggtgatccaaagtcccagtggggtaaggagtttctcatcgagaaggcagtgatcagtcctggcttcgatgtattcgccaagaagaatcaggggattcttgagttctacggggacgacattgctctgttaaaattagcacagaaagttaaaatgagcacccacgctaggccgatttgtcttccttgcactatggaagcaaacctggcactcagaaggcctcaggggtccacttgtcgcgaccacgaaaacgaactgctgaacaagcagtctgtgcccgcccacttcgtagccctcaatggctctaagctcaatatcaatcttaaaatgggcgtggaatggactagctgcgccgaagtagtgagccaggaaaagacaatgttcccgaatctaactgatgtgagggaggtggtgacagaccagttcctgtgttccggaactcaagaagatgagtcaccttgtaagggggaatccggtggggccgttttcctggagcgtcgttttcgctttttccaggtaggactggtgagctggggcctgtacaacccctgcctcggttcagccgataaaaactcgagaaagcgggctccgcggtccaaagttccacctcccagggattttcatatcaacctctttcgcatgcagccatggttgcggcaacacctgggcgacgtcttaaacttcctgcctctttag

SEQ ID NO: 112828 - DNA, 1521 bp, Artificial Sequence
  Description of Artificial Sequence: Synthetic coding sequence
atggggacacgttcagctatcgccgccccaagaattctgtgttccagggggctcagaagtgggtcagcacgggcaaccggaagcggcgtcgaacggtccccatcagccgccattttctcatttgagatcaacgtgtctgtcgcgattattacttttgcatcagaacctaaggtactgatgagcgttttgaatgacaatagcagagatatgactgaagttatcagctccctcgagaatgccaactataaagaccatgagaacggtacagggaccaacacttatgcggcgctcaacagtgtgtacctaatgatgaataatcagatgcggttattgggtatggaaaccatggcatggcaggagatccggcacgcaatcatcctgctgactgatggcaagtccaatatgggcggatcaccgaagaccgcagtggatcatatacgcgagatcttaaacattaatcagaagcgcaatgactatctggatatctacgcaatcggcgtcggcaaactggatgtcgactggcgcgagcttaatgagctggggagcaaaaaggatggggaaagacatgccttcattctccaggataccaaggcgctccatcaggtgtttgaacacatgctggacgtttcaaagctgaccgacaccatatgtggggttgggaatatgtctgccaacgcaagtgaccaggagagaacaccttggcacgttactatcaaaccaaagtcacaagaaacctgtcggggcgcactgattagcgaccagtgggtacttacagccgctcactgcttccgcgatggaaatgaccactctctttggcgggtcaatgttggcgaccccaagtctcaatgggggaaagagttcctgatcgagaaagcagtgatctcccctggcttcgacgtgttcgccaagaagaaccagggcatactggagttctatggagatgatattgccctgctgaagctagcgcagaaagtaaaaatgtccacccacgcccgcccaatctgtctgccctgtacaatggaagcgaatctggccctgcggcggccccaaggcagtacttgtcgggatcatgaaaatgagctcttgaacaaacagagtgtcccggcccacttcgtcgccctgaatggcagcaaactgaacatcaacctgaagatgggggtggagtggaccagttgcgccgaggttgtcagtcaagaaaaaactatgtttcccaacttaactgatgtgagggaagtcgtaaccgatcagttcctgtgctccggcacccaggaggatgagtcaccatgcaagggagagtccggcggagctgtgtttttggaaagacggttccgcttcttccaggttggtctcgtctcttgggggctctacaatccctgtctgggctcggctgacaaaaacagtcgcaagcgggcgccgagatctaaggtccccccgccacgtgattttcatatcaatctgttccgcatgcaaccctggctgcggcagcatctcggggatgtgctgaacttcctgccactgtag

SEQ ID NO: 112829 - DNA, 1521 bp, Artificial Sequence
  Description of Artificial Sequence: Synthetic coding sequence
atgggtacccggagtgctatcgcggccccccggattctctgtagtcgaggactccggagtggttctgctagagcgacaggttcaggggtggagcgtagcccctcagccgccattttttcatttgaaatcaatgtttccgtggctattataaccttcgcaagcgagcctaaggtcttgatgtctgtgctgaatgataattctcgagatatgaccgaagtgattagtagccttgagaacgctaactacaaggaccacgagaatggaaccggcaccaacacttacgcagccctcaactccgtttatctgatgatgaacaaccaaatgcggcttcttggtatggaaacgatggcttggcaggagattcgccacgccataatcctgttaactgatggaaagtccaatatggggggaagccccaaaactgccgtggaccatattagggagattttgaacataaaccagaagcggaatgattatctcgacatatatgcaattggcgtgggcaagctggacgttgattggcgggagctgaatgagctcggcagtaaaaaagacggagaaagacatgcttttattcttcaagatactaaggccttgcaccaagtctttgagcatatgcttgacgtgtccaagctgacggacacgatctgcggcgttggaaatatgtccgccaatgcgtccgatcaagagcgcacgccatggcacgtgaccatcaaacccaaatcccaggagacatgccgaggcgccctgattagcgaccagtgggtcctgacggctgcgcattgttttagggatgggaacgaccattctctttggagggttaacgttggggacccaaagagtcaatgggggaaagagttcttaattgagaaggctgtcattagccctggctttgacgtcttcgcgaagaagaatcaagggatcctggaattctatggggatgatattgccttactgaagctggcacagaaggtcaaaatgtctacacacgctagaccgatttgcctgccctgcaccatggaggcaaacctcgccttaaggcgacctcaggggtccacatgccgcgaccacgaaaatgagctcctgaacaaacaatccgtgcccgcgcactttgttgctctcaatggcagtaagctgaatattaacttgaaaatgggggttgaatggacctcctgcgctgaggtagtatctcaggagaagaccatgttccctaatcttacagatgtgcgagaagtggtgactgaccaattcctgtgttctggaacacaggaagacgaatccccgtgtaagggggaatcaggcggtgcggtgttcttagagagacggtttagattcttccaggtcgggctggtgagttgggggttatataacccgtgcctgggttccgccgacaaaaactctcggaagagagcacctagatcaaaggtacccccaccccgtgattttcatatcaacctcttccggatgcagccatggctccggcagcatttgggagatgttcttaacttccttccactgtag

SEQ ID NO: 112830 - DNA, 1134 bp, Artificial Sequence
  Description of Artificial Sequence: Synthetic coding sequence
atgacggaggtaattagctcactcgagaacgcaaattataaggatcacgagaacggaacaggtacaaatacttacgctgccctcaactccgtgtacttgatgatgaacaaccagatgcgcttgctcggcatggagacaatggcttggcaagaaattcggcacgctataattctcctaactgacggcaagtcaaacatgggcggaagccccaagaccgccgtcgaccatatcagagagatactaaacataaaccagaagcggaatgattacctggacatttatgccatcggagtcggcaagctggatgtcgattggagggagctgaatgagttaggctctaaaaaggacggcgagaggcacgcctttatccttcaggatactaaggccctgcatcaggtcttcgagcacatgctggatgtatccaagctcacagacactatctgcggcgtgggtaacatgagtgctaacgcttccgatcaggagcgaacaccctggcacgttacaattaaaccaaagagccaggaaacatgcaggggggctctcataagcgaccagtgggttctgacggccgctcactgcttcagggatggcaacgaccactcactgtggagagtgaacgttggcgatcctaaaagccagtgggggaaagaatttcttattgagaaggcagttatttcccccgggtttgacgttttcgccaaaaagaatcaaggcatcctggagttttatggagacgacattgctctcctgaaactggcacagaaggtgaagatgtcgactcacgcaagacctatctgccttccgtgtaccatggaagctaacttagccttgcggcggccacaaggaagcacctgccgcgatcatgaaaatgaactgctgaacaagcaatctgtaccggcccacttcgtggccctgaatggctctaaactgaatattaatctcaaaatgggggtcgaatggacttcctgcgctgaagtggtcagccaggagaagaccatgtttcctaatctgactgacgtcagagaagtggttactgaccagttcctctgcagcggaacccaggaggacgagagcccgtgcaaaggagggagcggcgagctgggatcactccagccgctgccatggctttgttag

SEQ ID NO: 112831 - DNA, 978 bp, Artificial Sequence
  Description of Artificial Sequence: Synthetic coding sequence
atgggaaccaggtctgccatagccgccccacgaatactctgctccagaggactgagatccggcagtgccagggcaaccggatccggagtggaacgttcaccgtccgcggcaaatccgaccctgatgacctccttacgaacgtggccactgccctgggcccttccaagcccaacctgcttgggcccccctatcccccctcggcgccagcggatcttctctttcgagattaacgtgagcgtagccatcatcacctttgcgagcgagcctaaagttctgatgtctgtactaaacgataactcgcgcgatatgacggaggtgatctccagcctggagaatgctaactataaagatcacgagaacgggaccgggaccaacacatacgccgctctgaattccgtttatctgatgatgaataaccagatgaggctactcggcatggagactatggcatggcaggaaattaggcatgccatcatcctcctgaccgacggcaagagcaatatgggtggcagccccaaaaccgcagttgaccatatacgcgaaatcttgaatatcaaccagaaacggaacgactatctggatatatacgcaattggtgtgggtaagttggatgtggactggcgagagctaaacgagctgggtagtaaaaaggatggtgaacggcatgcgttcatcttgcaggatacaaaggctcttcaccaagtgtttgagcacatgctcgatgtatctaaactgacggatactatttgcggtgtggggaatatgagtgcaaatgcaagcgatcaagaaagaactccgtggcacgtaactatcaaacctaagtcccaagagacgtgtcgcggcgcgctcatttccgatcagtgggtgctcactgctgcgcattgcttccgagacggcaatgatcactccctgtggcgggtgaacgttggcgaccccaagagtcagtggggcaaggaattcctgattgaaaaagcttag

SEQ ID NO: 112832 - DNA, 1521 bp, Artificial Sequence
  Description of Artificial Sequence: Synthetic coding sequence
atgggaacaagaagcgccatcgcagcccctcgtattctgtgttctcgcgggttgcggtccggttctgctcgcgcgaccgggtctggcgttgaacgcagccccagcgctgcaatcttctcctttgaaattaatgtgtcagttgccatcatcacattcgctagcgagcctaaggtcctaatgtctgtcctgaatgacaatagtagagacatgaccgaggtcattagcagtcttgaaaacgctaattataaagaccacgaaaatgggacaggtactaacacatacgcagcgctgaatagtgtataccttatgatgaacaatcagatgcggcttctgggtatggagaccatggcctggcaggagatccggcatgcgatcatcttgttgaccgatgggaagtccaatatgggggggtccccaaagacagcagtagatcacatccgcgaaattttaaacatcaaccagaagcggaacgactacctggacatttacgcgattggcgtgggcaagctagacgtcgattggcgtgagttaaacgaactcggatctaaaaaggacggcgagcggcatgccttcatcttacaagataccaaggccttacatcaggtgttcgaacatatgttggacgtgtctaaactgacagacacaatctgtggggtgggaaatatgtccgccaacgctagcgaccaggaaagaaccccctggcacgtgactatcaaacctaagtctcaggagacatgccgaggggctctgatatctgaccagtgggttctgacagccgctcactgctttagagatggtaatgaccattctctgtggagagtgaacgtgggagatccaaagagccagtggggaaaagagttcctaatagagaaggcagtgattagcccagggtttgacgttttcgctaagaagaaccagggaatactcgagttttatggagacgatattgctctgcttaagctggcccaaaaggtgaagatgtcgacccacgcccggcctatttgcttaccctgtacaatggaagccaatctcgctctgaggcggccccagggctcaacatgccgcgaccatgagaacgagctgctgaataaacagagcgtccccgcccactttgtcgcgttgaatggctccaagctgaatatcaatttgaagatgggagtggagtggaccagttgcgctgaggtagtatcccaggaaaagacaatgttcccaaatctgaccgatgtgcgcgaggtagttaccgaccaattcctgtgttctggcacccaggaagacgaaagcccatgcaaaggggagagtggtggcgctgtgttcctggagcgccgattcagattctttcaggtggggctggtgagttgggggctgtacaacccttgtctcggctccgcagacaaaaattctcgaaaacgcgccccccgctctaaggtacccccaccccgcgactttcacatcaacctgttccggatgcagccatggctgcggcaacatcttggtgatgtcctaaatttcctaccgttatag

SEQ ID NO: 112833 - DNA, 1521 bp, Artificial Sequence
  Description of Artificial Sequence: Synthetic coding sequence
atgggcaccagatctgccattgcggctcctaggattctgtgcagtcggggtctaagatccggcagcgctcgggccaccggttccggagtggagagaagcccctccgctgcaatcttctcctttgagataaacgtgagcgtggcaataattacttttgctagtgaacccaaagtactgatgtcagtcttgaacgataactccagagacatgactgaggtgatcagcagcctggagaacgccaattacaaggatcatgaaaacgggactggcaccaatacctatgcagctctgaattctgtatacctgatgatgaacaatcagatgcgcttgctgggtatggaaacaatggcatggcaggaaatcaggcacgctataatcctcctgacagatgggaaatccaacatgggtgggagccccaagactgctgttgatcacattagagaaatcctgaatataaatcaaaaacggaacgactatttggacatttacgcaattggtgtgggtaagctggacgtcgattggcgcgagttgaacgaactagggagcaaaaaagacggtgaacggcacgcatttatactccaggacacaaaggcacttcaccaggtttttgaacacatgctggacgtgtccaagttgacggataccatttgcggcgtcggaaatatgtctgcaaacgccagcgatcaggaacgaacaccctggcatgtgacgatcaagccgaaaagccaggagacatgcagaggcgccctgattagtgaccagtgggtgctgacagctgcgcactgttttcgggatgggaatgaccatagcctttggagggtgaatgttggcgatcccaagtcccagtggggcaaggaattccttattgaaaaggcggttatctctcccggttttgatgttttcgccaaaaaaaaccagggaatcctggagttctatggagacgacattgccctgctgaaactcgcccagaaggtgaaaatgtccacccacgcccgaccgatttgcctcccgtgcaccatggaagccaatctggctctgcggcgccctcaaggatctacctgtagagaccacgaaaacgaattactgaataaacagtctgtcccagcacattttgtggctcttaacggaagtaaacttaatatcaacctcaagatgggcgtagagtggacctcttgtgcagaggtggtgagtcaggagaaaactatgtttccaaatctgacggacgtgcgcgaagtggtcactgaccagttcctttgttccggaacacaggaggacgagagcccttgtaaaggagagtctggcggagcagtgttcctggaacggagattccgcttcttccaggtgggcctcgtttcctgggggctgtacaatccctgtctcgggtcagcagataagaacagccgtaagagagctccgcgttcaaaggttcctcctcccagggacttccacattaacctctttcggatgcagccctggctgcgacagcatctcggcgatgtcctcaatttcttacccctgtag

SEQ ID NO: 112834 - DNA, 1617 bp, Artificial Sequence
  Description of Artificial Sequence: Synthetic coding sequence
atgcgtgctttgtgtatccgggaaacttgcagcagcgagctcggcttcagcagaaactggagtcggcgaaaagccgggcactgtccaaatccagggatctctctgggcgctgttcgtaccggttttcgctttggacatggagataaggtgagatataggtgctcctctaacctcgtgcttaccgggtcgtcagagcgggagtgtcagggaaacggtgtgtggagcggcaccgaaccaatttgccgacaaccgtactcatacgattttccagaggacgttgcccccgcgctgggcacctcattctctcacatgctgggggctacgaatccgacacagaaaaccaaagatcacgaaaatggaaccgggaccaacacatacgccgctctaaactccgtctacctaatgatgaacaaccaaatgcggttactgggtatggaaactatggcttggcaagaaataagacatgctattatcttgcttaccgacggcaaaagtaatatgggggggtcccccaaaaccgcggtggatcacatcagagagatcctgaacatcaatcagaagaggaatgattatctggatatttacgccattggtgtcggcaagctcgacgtggactggagggagctcaacgagctcggttctaagaaagatggcgagaggcatgccttcattcttcaggacaccaaagctctgcaccaagttttcgagcacatgctggatgtgagcaaactgactgacacaatatgcggtgtcggaaacatgagcgctaacgcctctgatcaggagcgaacaccgtggcatgtgaccatcaaaccgaagtcacaggaaacttgtcggggcgcgctaatctccgaccaatgggtactgaccgcggcgcactgcttcagagacggcaacgatcactcactctggagggtgaatgtcggggatccaaaatcacaatggggcaaagagtttttaatcgaaaaagcagtgattagcccagggttcgacgtgttcgcgaaaaagaatcagggaatccttgaattttacggtgatgacattgccctcctcaagctcgctcaaaaggtcaaaatgtcaacccacgcccgtcccatttgtctgccatgcactatggaagctaaccttgccctgaggcggccccaaggatccacctgtagggatcacgaaaatgaattgctcaataagcagtcagtccccgcccacttcgtagctctgaatgggagcaaactgaatatcaacctgaagatgggcgttgaatggactagttgtgctgaggtcgtcagccaggaaaagacgatgtttcctaatctgacagatgttcgcgaggttgtcaccgatcagtttctctgctctggcacgcaggaggacgagtcaccctgtaagggggagtctgggggagcggtcttcttggagcgccggtttcggttcttccaggtggggctggtgtcatggggtctatataacccatgtctgggcagtgctgacaaaaacagccgcaaaagagccccacgctctaaggtccctccaccccgggacttccacatcaatctgttccgcatgcaaccctggctcagacaacacctgggagatgtgcttaattttttgccgttgtag

SEQ ID NO: 112835 - DNA, 1134 bp, Artificial Sequence
  Description of Artificial Sequence: Synthetic coding sequence
atgacagaggtgatatcctcactggaaaatgccaactacaaggatcacgaaaatggcactggtaccaatacctatgccgccctgaacagcgtgtatctgatgatgaataatcaaatgcgccttctcggaatggagaccatggcttggcaagagatccggcacgcaatcattctgttgacagacgggaagtcgaatatgggaggatccccgaagaccgctgttgaccatatcagggagatcttgaacattaaccagaagagaaatgattacttggatatttatgccatcggcgttggcaagttggatgtggactggcgcgagctgaacgaactcggaagcaaaaaggacggcgagagacacgcctttattttgcaagacacgaaagccctgcaccaagtgttcgaacatatgctcgatgtgtctaagctgacagatactatctgcggtgttggaaatatgagcgccaacgcgtccgatcaggagcgaaccccgtggcatgtcacaattaagcccaaaagccaagaaacttgtcggggtgccctcattagcgatcagtgggtcctcacagctgcccattgcttccgcgatgggaatgaccattcactttggcgggtcaacgtcggagaccctaagagccagtggggcaaggagttccttatagaaaaagcagtcatttccccgggatttgatgttttcgctaaaaagaatcaggggattctagagttctacggagacgatatcgcactccttaaactggctcagaaggtgaagatgagcactcacgcccgaccaatctgtctgccgtgtacaatggaggccaatctggcactgcgccggccacagggctccacatgtagggatcatgagaatgaactgctcaacaagcagtccgtccccgcacatttcgtcgctctgaacgggtctaagctgaatataaacttgaagatgggagtcgaatggaccagttgcgcagaggtggtcagccaagaaaaaactatgttccccaacctgaccgatgttagagaggtggtgaccgatcaatttctgtgcagtggaactcaagaggatgaatccccctgcaaaggcggatccggagagttgggaagcctgcagccgctcccctggctgtgctag

SEQ ID NO: 112836 - DNA, 1863 bp, Artificial Sequence
  Description of Artificial Sequence: Synthetic coding sequence
atggggcccctgatggtgctcttctgtctgctgttcctgtacccagccggacactgtcccaaccccggtatcagcttaggtgcggtgaggactggctttagattcggccatggagataaagtacgctatcgatgcagcagcaacctagtgctgacaggctcttccgaaagagagtgccaggggaacggcgtgtggtcaggaacagaacccatttgccggcagccttatagttacgattttcccgaagacgtggcccctgcgctgggtacctccttttctcatatgctgggcgccaccaaccctacccagaagacaaaagagagcctaggccgaaagatccagatccagaggtctgggcacttaaacttatacctattgcttgattgttcccagagcgtgagcgagaatgacttccttattttcaaggagtcagcctccctcatggtggataggatcttttcctttgagatcaatgtctccgtggctataatcacattcgccagcgagcctaaggttctgatgagcgtcctgaacgacaattctcgggacatgaccgaggttatcagtagtctggagaatgcaaactataaagatcacgaaaacggaaccggcactaatacctacgctgccctcaactccgtgtatctgatgatgaacaaccagatgcgactgctgggaatggagacaatggcttggcaggagatcagacacgccatcattctactaactgacggaaaaagtaacatgggagggtccccaaaaaccgcagttgatcacataagagagatcctcaacatcaatcagaagaggaatgattatctggacatttatgccataggggtggggaagctggatgttgactggagagagcttaacgagttgggatccaagaaggatggtgagagacacgcttttatactccaggacacaaaggcgctgcaccaggtgtttgaacacatgctggatgttagcaaactgaccgataccatttgcggtgtggggaatatgtccgctaatgccagcgatcaagagcgaaccccatggcacgtgactattaaacccaaatcccaagagacgtgtagaggggctcttatctccgatcagtgggtcctgactgcggcccattgcttccgtgacggcaatgaccactctctgtggcgggtgaacgttggggatcctaaatctcagtgggggaaagagtttcttatagaaaaggctgtcattagccctggcttcgatgtgttcgctaaaaagaatcaggggatccttgagttttatggcgatgacattgccctgttaaaactcgctcagaaggtgaaaatgagcacacacgccagaccaatttgtcttccctgcactatggaagcgaacctggcactgcgcagacctcagggatccacctgcagggatcacgagaatgaacttcttaacaagcaatcagttcccgctcacttcgtggccttgaacggtagcaaactcaatatcaatttaaagatgggagttgagtggaccagttgtgctgaggtggtgagtcaggagaaaacaatgttcccaaaccttaccgacgtcagggaggtggtgacggaccagttcctctgttccggaacccaagaggacgagtccccgtgcaagggcgagtccggcggcgccgtatttctcgaacgacgattccggttctttcaggtgggattagtcagctggggcctttataacccctgccttggctccgccgataaaaactccagaaaacgagcacctcggtccaaagtgccgccccctcgggatttccatatcaacctcttccgcatgcagccctggttacggcagcatctgggcgatgtgctgaatttcctccccttgtag

SEQ ID NO: 112837 - DNA, 1863 bp, Artificial Sequence
  Description of Artificial Sequence: Synthetic coding sequence
atgggcccccttatggtactgttctgcttactgttcctgtatcccgctggtcactgtcctaaccccggcatttccctgggcgcggtgagaacagggtttaggtttggccatggggacaaggtccggtatcgctgttcatccaatctggtcctaacaggctcatcagaacgggagtgtcaaggcaacggggtctggtcagggaccgagcctatctgtcggcagccttatagctacgactttccagaagatgtggccccagctcttggtaccagcttcagtcacatgcttggggccaccaaccccacccagaagacaaaagaaagtctggggagaaagattcagatccagaggtcagggcacctcaacctttacctcctgctggattgcagccaatccgtgtccgagaatgatttcttgatttttaaggaaagcgcttccctcatggttgaccgtatcttcagttttgaaatcaatgttagcgtagcaatcattacctttgcctctgaaccgaaggtcttgatgagcgtattgaacgacaattcgcgcgacatgacggaggtgatttcatcattagaaaatgcaaactataaagatcacgaaaatgggacagggacaaatacgtatgcagcgttgaattccgtttatctgatgatgaacaaccaaatgcgtctgcttgggatggagacgatggcctggcaggagatccgtcacgccatcatcctgttgacggatggcaagtcaaatatgggcggaagtcctaagacagccgtggatcatatccgggagattcttaacattaaccagaaaaggaacgattatctcgatatttacgcaattggagtgggtaaattagatgtcgattggcgcgaattaaatgagctcggatcaaaaaaagacggtgaacgccatgcgttcatccttcaggatactaaagcgctacaccaggtttttgaacatatgctggacgtttctaaactgacggatacaatttgtggcgtgggcaatatgagtgccaatgcctccgatcaggaacggaccccatggcacgtgaccatcaagcccaaatctcaggaaacctgccgtggagccctaatatccgaccagtgggtcttgaccgctgcccactgcttcagggacgggaacgatcatagcctgtggagggtaaacgtcggggaccccaaatcgcagtggggtaaagagttccttatagagaaagcggtgatttcgccaggctttgacgtatttgcgaaaaagaatcaaggtatcctcgagttttacggcgatgatatcgctttactgaaactggcgcagaaggtgaagatgagcactcacgcgcggccgatatgtttgccgtgcaccatggaagccaacctggcactcaggcggcctcagggctccacctgtcgcgaccacgaaaacgagctgctaaataagcagtccgtacccgcccacttcgtggcactaaatggcagtaaactgaacataaatttgaaaatgggagttgagtggacctcttgcgccgaggtggtcagccaggaaaaaacaatgttccccaaccttaccgatgttagagaggttgtgacagaccagttcttatgctccgggactcaagaagacgagagcccttgtaaaggcgaatccgggggcgccgtattcttggagagaagattcaggttcttccaggtggggttggttagttggggcctttacaacccctgtctcggaagcgctgataaaaactcacgcaagcgcgctccccgttctaaggtaccaccaccaagagattttcacattaatttatttaggatgcagccatggttgcgccaacacctgggggacgttctcaacttcctccctttgtag

SEQ ID NO: 112838 - DNA, 978 bp, Artificial Sequence
  Description of Artificial Sequence: Synthetic coding sequence
atggggactcgcagtgcaattgctgcacctaggattctgtgctccaggggcctgcgctctgggtccgcccgcgccactggctccggtgtcgagcgatctcccagcgcggccaacccgaccttaatgaccagcttgaggacatggcccttaccttgggctctgcccagtcctacctgcctgggaccccccatcccccccagacgccaaagaattttctccttcgaaataaatgtgtcagttgcaattatcacattcgcctcagaacccaaggttctaatgtctgtgctgaatgacaacagtcgcgacatgaccgaagtgatttcctcacttgagaatgcaaactataaggaccatgagaacggcactggtactaacacctatgctgctttgaactcagtttacctgatgatgaataaccagatgcgcctgttaggcatggagaccatggcctggcaagaaatcagacacgcaattattcttctcaccgatggcaagtccaatatgggcggcagtcccaaaacagcggtggaccatattagggagatcctcaacattaaccagaagagaaacgactacttggatatctacgccattggtgtaggcaaactggacgtggattggcgcgaactgaacgagctcggaagcaaaaaagatggcgagcgacacgccttcatcctgcaggacactaaggctctgcatcaggtgtttgagcacatgttagatgtatccaagctgacagacacaatttgtggagtgggcaatatgtccgctaatgcatccgatcaggaacggacaccctggcatgttacaataaagcccaagtcacaggagacatgtcgcggcgcactgattagcgaccaatgggtgttaacggccgctcattgctttagagacggcaatgatcactctctgtggcgggtgaacgttggggaccccaaaagccagtggggaaaggagttcctgatcgagaaagcgtag

SEQ ID NO: 112839 - DNA, 978 bp, Artificial Sequence
  Description of Artificial Sequence: Synthetic coding sequence
atgggcacaaggtccgccatcgccgctccacgcatcctgtgtagccgggggctaagaagcggctccgcccgagctaccgggtccggggtcgagcgaagtcctagcgccgctaaccccaccctcatgacctcactcaggacctggccactgccctgggctctgcctagcccaacttgcctcgggccacctatacctccaagacgccaacggatcttctcttttgagatcaatgtatccgtggcaatcattacattcgccagtgaacccaaagtgttgatgtctgtgctaaacgacaacagccgcgacatgaccgaggtgatctctagtttggaaaacgccaattataaagatcacgaaaacggcacaggaactaatacatatgccgccctgaattctgtgtatctcatgatgaacaatcaaatgcgtctcttaggcatggagacaatggcctggcaggagataagacacgccataattctgctgacagacggaaagtcaaacatgggtgggagcccaaaaacggctgttgatcacatccgggagatcctgaatattaaccagaaaagaaatgattatctggacatttacgctataggcgtaggcaagctcgatgtagactggcgggaactgaatgagctcggatcaaagaaagatggcgaacgacacgctttcatattgcaggatacaaaggccctccaccaggtctttgagcacatgctcgacgtatccaaactcacagatacaatatgcggtgtcggcaatatgtccgcaaatgcttccgaccaggaaaggactccttggcatgtaaccattaagcccaagtctcaggagacttgccgcggcgcacttattagtgaccagtgggtcctcacagccgcacattgtttccgagacgggaatgaccatagcctgtggagggtcaacgtaggtgaccccaagagccagtggggcaaggaattcttgattgaaaaggcttag

SEQ ID NO: 112840 - DNA, 1521 bp, Artificial Sequence
  Description of Artificial Sequence: Synthetic coding sequence
atgggaactagatcggccatagctgctcctagaattctgtgcagcagaggactcaggagcgggagcgcacgagccactgggtccggtgttgaacgatccccgtctgccgccatttttagtttcgaaatcaacgtgagcgttgcaatcatcacattcgcctccgagcctaaggtgcttatgagcgtgcttaacgataattcccgcgacatgaccgaagtaattagctccctggaaaatgctaactataaggaccatgaaaacggcacaggaacaaacacttacgcggcgctaaattctgtttatctcatgatgaataatcagatgcgactcctgggcatggagaccatggcatggcaggagattaggcatgcaatcatactactcacagacggtaagtcaaatatggggggcagcccgaagactgcggttgatcatattagggagattctgaatataaatcagaaacgtaatgactatttggacatttatgccatcggcgttggcaagctggacgtcgattggcgagaactgaatgagctcggcagcaaaaaagacggagagcggcatgcattcatcctccaggataccaaggctctgcatcaggtctttgagcacatgctggacgtatctaaactaaccgacactatatgtggagtgggtaacatgtctgctaatgcctcggaccaggaaagaacaccatggcacgtgacaattaagcctaagtcacaggagacatgtcggggtgccctgatcagcgaccagtgggtgttgaccgctgcacattgttttcgggatggaaatgaccattccctgtggcgggtgaatgtcggagatccaaagagtcaatggggtaaagagttcctgatcgaaaaagctgttatttcgcctggtttcgacgtgttcgcgaaaaagaatcagggcattttggaattctacggagatgacatagccctactgaaattagcgcagaaggtgaagatgagtacccatgctcggcccatctgtctgccctgcacaatggaggcgaatctcgccctgaggaggccccaaggctcaacgtgcagggaccatgagaacgaactcctcaataagcagtccgtgcccgcccatttcgtcgcccttaacgggagtaaactgaacattaacttaaagatgggggttgaatggacatcttgtgctgaagtagtgtctcaggagaagactatgttccctaacttgacagatgtccgcgaagtcgtgaccgatcaattcttatgttccgggacacaggaggacgaatcaccctgcaagggcgaatctgggggagccgtattcttggagagaagatttcggttcttccaggtaggcttggtctcctggggcttatacaacccttgcctgggtagtgccgacaagaactcccgtaagagagccccacgctccaaagtcccgccacctcgcgatttccacattaatcttttccggatgcagccatggttgagacagcacctgggagacgtgcttaactttttgcccctgtag

SEQ ID NO: 112841 - DNA, 978 bp, Artificial Sequence
  Description of Artificial Sequence: Synthetic coding sequence
atggggactagaagtgccatcgccgccccccgcattctgtgcagcagagggcttagaagcggctctgccagggctactggcagcggcgtggagcggagcccttccgctgctaacccgacgttaatgacctcattgcggacgtggcctctgccctgggcactccctagtcccacgtgcctgggccctccaattcccccaaggaggcagaggatattttcattcgagatcaatgtctcagttgccataattacgttcgcgtctgagccaaaagtgctcatgtctgtcttgaacgacaacagccgagacatgacagaagtcatttcgagtcttgaaaacgccaactacaaggatcacgaaaacgggactggcacaaatacctacgcggcattgaattcagtctacttaatgatgaacaatcagatgcgattgctgggaatggaaacgatggcatggcaggagatacggcatgctattattctcctgaccgacggcaagagcaacatgggagggagccccaagacagccgtggaccatatcagagagatcctgaacatcaaccagaaaaggaatgattacctagatatctacgccatcggagtgggcaagttggatgtggactggcgggagctgaacgaactggggagtaagaaggacggggaaaggcacgctttcatactgcaagacaccaaagcactacaccaggtgtttgagcacatgctggacgtgagcaagctgactgacacaatttgcggcgtgggcaacatgagcgccaacgctagcgaccaggagcgaacgccttggcatgttaccattaagccaaaatcccaggaaacctgtagaggcgctctgatatctgaccagtgggtgctaacagctgcacactgtttcagggacgggaatgatcacagcctgtggcgcgtaaatgtcggcgacccaaagtcacaatggggcaaggagttcctgatcgagaaagcctag

SEQ ID NO: 112842 - DNA, 1863 bp, Artificial Sequence
  Description of Artificial Sequence: Synthetic coding sequence
atggggccactgatggttctcttttgcctgctcttcttgtatccagctggccactgcccgaacccaggcatttctctgggggctgtgcgcaccggctttagattcgggcacggggataaggtgagatatcgttgcagcagcaatcttgtgcttaccggaagttccgagcgggaatgccagggtaatggggtttggtccggcacagagccaatatgcagacaaccatacagctacgattttcccgaagatgtggctcccgcccttggtacatcattcagtcacatgttgggcgccacaaatccgacacagaaaactaaggagtcactcggacggaagatccaaattcaacgatccggccacctgaacttgtacctcctgcttgattgcagccagagcgtctccgaaaacgattttctcatctttaaagagagcgctagtcttatggttgatcgcatcttctcattcgagattaacgtttcagtggcgatcattacatttgcctccgaacctaaagtactgatgtccgtgctcaatgacaactcgagggacatgacagaagttatctctagcctggagaatgcgaattacaaagatcatgaaaatggtactgggaccaatacctacgctgccctgaatagtgtgtacctgatgatgaacaatcagatgcgactgcttggaatggagaccatggcttggcaagagatccggcatgctattatcttgttaactgatggaaagtcaaacatgggtggcagccccaaaaccgccgtagaccacattcgggagatcctcaacatcaaccagaagcgtaacgactacctggacatttacgcaatcggtgtcgggaaactggatgtggattggcgagagttgaatgagcttggctctaagaaagatggcgaacggcatgccttcatcctgcaggacaccaaagcactgcaccaggtttttgagcatatgctcgacgtgtccaagcttaccgacacgatatgcggagtgggtaacatgtctgctaatgcctccgatcaagagcgaaccccttggcatgtcacaattaaaccgaagagccaggagacctgccggggagcactgattagcgatcagtgggtcctaaccgccgctcattgcttccgagacggtaatgaccactcactctggagggtcaacgttggagatccgaagtctcaatggggcaaagaatttctcatagagaaggcggtaatttcccccgggttcgatgtgttcgcgaagaagaatcaggggatcctggagttttacggagacgacattgcccttcttaaacttgcacagaaagtgaaaatgagtacacatgcccggcccatttgcctgccatgcactatggaggcaaatctggctctgagaagacctcagggatctacctgccgcgatcacgaaaatgagctgctgaacaagcagtccgtgcctgcacatttcgtcgcactcaatggcagcaagttgaatattaacctgaagatgggcgtggaatggacttcttgcgcagaagttgtctctcaagaaaagaccatgttccccaatttgacagacgttcgcgaggtggttactgaccagtttttgtgcagcggaactcaggaggacgaatcaccatgtaagggagagtctgggggcgctgtgttcctagagcgcagattccgattttttcaggtcggtttggtatcatggggcctgtataacccctgtctggggagtgctgataagaactctcgcaagcgagctccccgcagtaaggtgcctccaccgcgcgacttccacatcaaccttttcagaatgcagccctggctaagacagcacctaggcgacgtgttgaattttctccccctctag

SEQ ID NO: 112843 - DNA, 1134 bp, Artificial Sequence
  Description of Artificial Sequence: Synthetic coding sequence
atgaccgaggtgatctccagcctggagaacgctaactataaggaccacgagaatggaacaggaaccaatacctacgccgcactgaatagcgtgtacctaatgatgaacaatcaaatgcggctcttgggtatggagactatggcgtggcaggaaatccgacacgccatcatcctgctgacagacgggaaaagtaacatgggcggctcacctaagacagccgttgaccacatcagagagatccttaacattaaccagaagaggaacgattatcttgacatctatgccataggcgttggcaagctcgatgttgactggcgggagctgaacgaactcggatcaaaaaaggacggggaacggcacgcgttcatactgcaggatactaaggcgctccaccaggttttcgagcatatgctggacgtgagcaagttaacagacaccatctgtggagtggggaacatgtccgctaatgcgagcgaccaagagcgaaccccctggcacgtgacaatcaaacccaagagccaagagacatgcagaggagctctcattagcgatcagtgggttctgacagcggcacactgtttccgcgacggtaatgaccactccctttggcgggttaatgtgggagatcccaaaagtcagtgggggaaggaatttctcattgaaaaggctgtgattagtcctgggttcgacgtgtttgctaagaagaatcagggtatcttggaattctacggagatgacatcgcactcctgaagctggcccagaaagttaagatgtctacacacgctcgacctatatgcctgccatgtacaatggaagcgaatctggctctcagacgcccacaggggagcacctgccgagatcacgagaatgagctcttaaacaagcaatccgttcctgctcatttcgtggctttaaacgggtccaaactgaacattaatctgaagatgggcgtggaatggactagctgtgctgaggttgtgagccaggagaagaccatgttcccaaatcttacagacgtgagggaagtcgtgacggaccaatttttgtgctccggcacccaggaagatgagtccccttgcaaaggcggtagcggcgagctcggctcgctacagcccctgccctggctatgttag

SEQ ID NO: 112844 - DNA, 1134 bp, Artificial Sequence
  Description of Artificial Sequence: Synthetic coding sequence
atgactgaagttatctcctctcttgaaaacgccaattacaaagaccacgaaaacggaacaggcacaaacacctacgccgctctcaactctgtgtacttaatgatgaataatcaaatgagactgcttggtatggagactatggcttggcaagaaataagacacgcaattattctcttgactgacggtaagagcaacatgggtggctcacccaagactgctgtggaccacattcgtgagattctgaacatcaaccagaaaaggaacgattatctggacatttacgccattggcgttggcaaactggatgtggattggagagagctcaatgagcttggatcgaaaaaagacggagagcgacacgccttcatcctccaggataccaaagcgctgcatcaggtgtttgaacatatgctggatgtttccaagctgaccgacacgatctgtggggtcggcaatatgtccgcaaacgccagcgaccaggaaaggacaccctggcatgtgacaattaaaccaaagtctcaagagacctgtagaggcgccctgattagcgaccagtgggtgctcaccgccgctcactgcttccgcgatgggaacgatcatagtctgtggagagtgaatgtcggggaccctaagagccagtggggaaaagagtttcttatcgagaaggctgtgatctcacctgggtttgatgtgttcgcaaaaaagaatcaaggtattctcgaattctacggagacgatatcgctttgctcaagctggcccagaaagttaagatgagtacccatgccagacctatctgtttgccctgcactatggaggcaaacctagctctgagacgcccacagggctctacttgccgcgaccatgaaaatgagttgctaaacaagcagagtgtaccagcccacttcgtggccttgaacggcagcaagttgaatattaatcttaagatgggcgttgagtggacttcttgcgccgaggtcgtgagtcaagaaaagacaatgttcccgaacctgactgatgttcgcgaggtggttaccgaccaattcctgtgctcaggaacacaggaagatgagagcccctgcaagggggggagcggcgagcttggcagcctccagcctcttccatggctgtgttag

SEQ ID NO: 112845 - DNA, 978 bp, Artificial Sequence
  Description of Artificial Sequence: Synthetic coding sequence
atggggactcgaagcgcgatcgctgctcccaggatattatgttctcggggactgagatcgggctctgcaagagcaaccggctcaggagtggagcgcagtccatctgcagctaacccgacgttgatgacaagcctccggacgtggcccctgccatgggccctgccttcccccacctgtctaggcccacccatcccccctaggagacaaaggattttctcattcgagatcaatgtctctgtggccattattacgtttgccagcgagcccaaggtgctaatgtccgtgctcaatgataactccagggacatgaccgaggtgatatcgtctctagagaatgccaactacaaggaccacgaaaacggtaccggcaccaacacttacgcagctctgaactcagtgtacctgatgatgaacaatcagatgagattactgggaatggagaccatggcttggcaggaaatccgacacgcaattattttgctgactgacgggaagtccaacatggggggatcacctaagaccgccgtagaccacatacgggaaattcttaatattaatcaaaaacgaaatgactatctcgacatctacgcaatcggggtcggcaagctggacgtcgattggcgtgagttgaacgaactagggtctaagaaagatggcgagaggcacgccttcatcctgcaggacacgaaagctctacaccaggtgttcgaacacatgttagatgtttcaaagctgactgacacaatttgcggcgtcggaaatatgagtgctaatgcctctgaccaggagcggacaccatggcacgtgacaataaagccaaagtcgcaggagacatgtaggggagctctcattagtgaccaatgggttcttacagctgcacactgcttcagggacggaaatgaccacagcctgtggagggttaacgttggggacccgaagtcacagtggggcaaagagttcctgattgaaaaggcttag

SEQ ID NO: 112846 - DNA, 1134 bp, Artificial Sequence
  Description of Artificial Sequence: Synthetic coding sequence
atgaccgaagtgatttcttccctcgaaaatgccaattacaaggaccacgagaacggaactgggacaaatacttatgccgccctgaattccgtttacctgatgatgaacaatcagatgaggctgctggggatggagaccatggcctggcaagaaatcagacatgctatcatcctgctgacagacggaaaatccaacatgggaggaagccccaaaaccgccgtcgatcacattagagagatactgaacatcaaccaaaagaggaacgactacttggacatctacgccatcggcgtggggaaattggatgtcgactggcgcgagctaaatgagctcggctccaaaaaagatggagagaggcatgcctttattcttcaagacaccaaggcactccaccaggtctttgagcacatgctggatgtaagtaaattaacagacactatctgcggggtcggaaacatgagcgccaacgcaagcgatcaagaacgcactccctggcatgtgaccattaagccaaaatctcaagaaacctgtaggggcgctctgatctcagatcaatgggtcctgacagcagctcactgtttccgggacgggaatgatcatagcctttggcgtgtgaatgtcggagaccccaaatctcagtggggtaaggaatttctgattgaaaaggctgtgatcagccccggatttgatgtttttgcaaagaagaatcagggaattcttgaattctacggcgatgacattgccctcctaaagttggcccagaaggtgaagatgagcacccatgcaaggcccatttgccttccctgtaccatggaggcaaacctggccttgcgacggcctcaggggtctacctgtcgggatcacgaaaatgagttactgaacaagcaaagtgtacctgcccactttgtggccctcaatggatccaagttaaatattaacctcaagatgggagtggagtggacatcctgtgcagaggtggtttcgcaggagaagaccatgtttcccaatctgaccgacgtcagggaggtcgttaccgaccagttcctgtgctccgggacacaggaggatgagtcgccctgcaagggcggctccggtgagctcggctccctgcagcctctgccgtggctctgctag

SEQ ID NO: 112847 - DNA, 1617 bp, Artificial Sequence
  Description of Artificial Sequence: Synthetic coding sequence
atgagagccctgtgtatccgtgagacttgttcttcggagttggggttttcccggaattggtcccggcgaaaggcgggccattgtccaaaccctggcatctcccttggagcggtacgtacgggatttagattcggccacggcgacaaggtgcgctacagatgttccagtaacctagttctcactggatccagtgagcgcgagtgccagggcaacggcgtctggtcagggaccgaaccgatttgccgccagccatattcgtacgacttcccggaagatgtagcaccggctctaggcacgagtttcagtcacatgttgggagcaacaaatcccacccagaaaaccaaggaccatgagaacgggactggcactaatacctatgccgcattaaacagcgtgtacctcatgatgaataatcagatgcgattactgggaatggagaccatggcttggcaggaaattaggcatgcaatcattctgttgactgatggaaagagcaacatgggcgggtcccctaaaaccgcagtggatcacattcgtgagatcttgaatattaatcagaaaaggaatgactatctggacatatacgctattggcgtgggaaagctcgacgtggattggcgcgagctcaatgagttaggatccaaaaaagacggggagcgacatgcattcatcctgcaggatacgaaagcgctccatcaggtcttcgagcatatgctggacgtcagcaagctcaccgataccatttgtggcgtcggcaatatgtccgcaaatgccagtgaccaggagcggacaccttggcatgtgacgattaagccaaagtcgcaggagacctgtagaggagcccttatctccgaccagtgggtgctcactgctgctcactgtttcagagatggtaacgaccattccctgtggagagtcaatgttggcgatcctaaaagccagtgggggaaagagttcttaattgagaaggctgtgatctcaccaggctttgacgtcttcgccaagaagaatcagggcatattggaattttatggagatgacattgccctactgaagttggctcagaaagtcaagatgtccacgcatgctagacctatttgtttaccctgtacgatggaagcgaaccttgccctcaggcggcctcagggaagcacctgcagggaccatgagaacgagcttctcaataaacagagcgtgcctgcgcacttcgtggctctgaacgggtctaagctgaatataaatttaaagatgggcgtggaatggacgagctgcgccgaagtcgtaagccaggaaaaaacaatgtttcccaatttaacggatgtcagggaagtcgtgactgaccagtttctttgctcaggaacacaggaagatgaatccccatgcaaaggtgagtctggcggggccgtgtttctcgagcgaagatttcgattctttcaagtggggctggtgtcttggggattatacaacccctgcctgggctcggctgataaaaatagtcggaagcgagccccgagaagcaaagtccccccaccccgggactttcacattaatctcttccgaatgcagccgtggctccggcagcacttgggtgacgttctcaactttctacctctgtag

SEQ ID NO: 112848 - DNA, 1863 bp, Artificial Sequence
  Description of Artificial Sequence: Synthetic coding sequence
atgggtcccctcatggtgctgttctgcctcttgttcttgtaccctgcgggccactgtcccaaccctggcataagcctcggggctgtgagaacaggttttaggttcggccatggcgacaaggtgaggtaccggtgctcctctaatcttgtgctcaccggaagcagtgaaagggaatgccagggcaacggagtgtggtcaggaactgagcccatctgtcgccagccctattcctacgatttccccgaggatgtagccccagcactgggtacctctttttcacacatgttgggtgccactaatccgacccaaaagaccaaagagagtcttggacggaagatacagatacagcgaagtggtcatctgaacctgtacctgctgttggactgcagccagtcagttagtgaaaacgatttcctgatctttaaagaatcagcatctctaatggtggatcgcatattctcgtttgagattaatgtcagcgtcgctatcatcacttttgcctctgaacccaaggtgctgatgtcagtcctcaatgataattctagggatatgacagaagtgatttcttctcttgaaaacgcaaactacaaggatcacgagaatgggaccggaacaaatacttatgcagcgctcaactcagtgtatttgatgatgaacaaccaaatgaggctgctggggatggaaaccatggcttggcaggagatccgccatgcgatcatactcctcaccgacgggaagtccaatatggggggctcgcccaagacagcagtcgaccacatacgtgagattctgaacatcaatcagaaacgcaatgactatctggatatctatgcaataggtgtgggtaagctggatgtcgactggagggaattgaatgagctgggctctaaaaaggatggtgaacggcatgcttttatcctccaagatactaaagcgctgcatcaagtgttcgaacacatgctggatgtatccaagttgacagataccatatgcggagtgggaaatatgagtgcgaacgcttccgatcaggagcgcaccccgtggcacgtgactataaaacctaaatcccaagagacctgcaggggcgcccttatcagcgatcagtgggtccttactgcggcccactgttttcgagatggcaacgatcattcgctgtggcgagtaaatgtgggtgaccccaaatcccagtgggggaaggaatttctgattgagaaggcggttatcagtccaggctttgatgtttttgctaaaaagaaccaggggatactggaattctatggcgacgatattgctctgctcaaactcgctcaaaaggttaagatgtccactcatgcccgaccaatctgtctgccttgtacaatggaagcgaatctggctcttcgacgccctcagggctctacctgcagagatcacgaaaatgagttactaaataagcagtccgttcctgctcactttgtcgcgctgaatggtagcaagctgaacatcaatttgaaaatgggggtcgagtggacctcttgtgctgaggtggtctcacaggagaagacaatgttcccaaatttgacggacgtgagagaagtggttactgatcagtttctgtgcagcgggacccaggaggatgagagcccttgcaaaggtgagtccggtggagcggtatttctagagaggcgtttcaggttttttcaagtgggcctggtgtcttggggcctgtacaacccttgtttgggcagcgctgacaaaaacagccgcaaaagggcaccacgatccaaggtgccacccccaagggactttcatatcaatctgttccggatgcagccctggcttcgacagcacctgggcgatgtactgaattttctccccctatag

SEQ ID NO: 112849 - DNA, 1863 bp, Artificial Sequence
  Description of Artificial Sequence: Synthetic coding sequence
atgggtcccctcatggtgttgttttgcttgttattcctgtatcctgcaggccactgccccaatccggggattagcctgggcgctgttcgaaccggattccgcttcggtcacggcgataaagtaagatatcgatgctcatctaatctagtcttgactggcagttccgagcgagagtgccagggtaacggcgtgtggagtggcacagaacctatttgccgccagccttatagttatgatttccccgaggatgtagctccagcacttggaacttccttcagtcatatgctaggtgctacaaacccgacacagaagaccaaagagagtctcggacgaaaaatccaaattcagagatccgggcatttaaacctttatttactactggactgtagtcagtccgtgtctgagaatgacttcttaatatttaaagagagtgcatccctgatggtagatcgcatcttctcctttgagattaacgtgtccgtagccatcatcacgttcgcctctgagccaaaggtgttgatgtcagttctgaatgacaatagtcgcgacatgactgaagttatttcatccttagagaacgcaaactacaaagaccacgagaacgggaccggaacaaacacctatgcagccctcaacagcgtctacctgatgatgaacaaccagatgagactgttgggcatggagacaatggcctggcaggagatccgacatgctatcatacttctgaccgacggaaagtcaaatatggggggaagtcccaagaccgctgttgatcatattagggaaattctgaacatcaaccagaagcgtaatgattatttagatatttacgcgattggggtgggtaagttggacgtcgactggcgggaattgaacgaattgggttccaagaaggacggtgagaggcatgcgttcatacttcaagatacaaaggctttgcatcaggtgttcgaacatatgttggacgtgtctaagttaacagatacaatctgcggagtcggaaacatgtccgctaacgccagcgatcaggagaggacgccatggcatgtgaccataaagccaaagagtcaggaaacctgtcggggcgcgctaatatccgaccagtgggtactgactgctgctcattgcttccgggatgggaatgatcactccctttggcgggtgaatgtgggagacccaaagtctcagtggggcaaggagttcctcatcgagaaggcggtgatttctccaggcttcgacgtttttgctaaaaaaaatcagggaatcctggagttctatggcgacgatattgcgcttctgaaactcgcccagaaagtcaaaatgtctacccacgctagacccatttgtttaccatgtactatggaggctaatctggctcttcgtcgtccacagggatcgacgtgtcgagaccacgaaaacgaactcttgaacaaacaatcagtgccagcgcacttcgtggccctcaacgggagtaagctgaatatcaatctgaaaatgggcgtggagtggacctcttgtgcagaagtcgtcagccaagagaaaacaatgttccctaacctcacggatgtgcgggaagtggtgactgatcaattcctgtgctcaggcacacaggaggacgagagcccttgtaagggggagagtggcggcgccgtgtttctggagcggaggttcagatttttccaggtagggcttgtatcctgggggctttataatccatgtcttggttccgcagataagaattcccgcaagagggctccacggagcaaggtgcctcctcccagagactttcatattaacctgtttagaatgcaaccctggttgcggcagcacctgggggacgtgctcaacttcctccccctctag

SEQ ID NO: 112850 - DNA, 1863 bp, Artificial Sequence
  Description of Artificial Sequence: Synthetic coding sequence
atgggtccattaatggtactgttctgccttcttttcttgtaccctgccggccactgtccaaacccggggatatcccttggggcagttcgcaccggctttagatttggccacggagataaagtaagataccggtgcagctctaatttggtccttaccggatcctctgagagggaatgccagggcaacggcgtttggtccgggacggaacctatctgtaggcagccgtacagctacgacttccctgaggacgtggcaccagcgctcggtacttctttctcccatatgctgggggcaactaaccccacccaaaaaactaaggaatccctgggaagaaaaatacagattcagcggtctggtcacttgaacctttatttactgcttgactgcagtcagagcgtgtcagaaaatgactttttgatttttaaagagagcgcctctctgatggttgaccggatttttagctttgagatcaatgtttctgtggccatcatcactttcgctagcgagcctaaggtgctcatgagcgtgctcaacgacaatagtagagatatgacagaagtgatttcctctctggaaaacgccaattataaagatcatgaaaatgggaccggcactaacacatatgccgctcttaactcagtctatctgatgatgaacaaccagatgcgcttgcttgggatggaaactatggcttggcaggagatccgccatgcaattattctgcttacagatggtaaatccaacatggggggcagtcccaaaaccgccgtagatcacatcagggaaattctgaatattaatcagaagcgtaacgattacttagacatttacgcaatcggggtcggaaaactggatgtggactggagggaactgaacgagctggggtcaaaaaaagacggagaacgacacgctttcattcttcaggataccaaggcacttcatcaagttttcgaacatatgttagatgtgtctaagcttacagatacaatctgcggagtgggtaacatgtccgctaatgcttctgaccaggaaaggacgccgtggcacgtaacaatcaaaccaaagtcacaggagacctgtcggggagctctgattagcgaccagtgggtgctgacagccgcacactgtttcagagacggcaatgaccatagtctttggagggtcaacgttggagatcctaagagtcaatggggcaaagagtttctcatagaaaaggctgtgattagccccgggttcgacgtcttcgcaaaaaaaaaccagggaatcttagaattttatggtgatgatatagccctgctcaagttagcccagaaggttaagatgtccacacacgcccggccaatttgcctgccttgcaccatggaggcaaaccttgccctgcgacgcccacagggcagtacctgtcgcgaccatgaaaatgagttgctgaacaagcagtccgtgccagcccacttcgtagcgcttaacggaagcaagttaaacattaatctcaagatgggcgttgaatggacctcctgtgctgaggtagttagccaagagaaaactatgttccctaatcttactgatgtaagggaggttgttactgatcaatttttgtgttccggaacccaagaggatgaatcaccctgcaagggcgagtcaggaggagccgtttttctggaacgccgttttaggttttttcaggtcgggctcgtatcctggggactgtacaacccatgccttggcagcgccgataaaaactcccggaagagagctccccgcagtaaggtcccacctccccgagactttcacatcaacctgtttagaatgcagccgtggttgcgtcaacacctgggtgacgtgttgaatttcctgcccctctag

SEQ ID NO: 112851 - DNA, 978 bp, Artificial Sequence
  Description of Artificial Sequence: Synthetic coding sequence
atgggcacacggagtgccattgccgctccccgaatactgtgttcacgagggcttagaagcggaagtgcgcgggctacagggtccggggtcgagagatcaccatcggctgccaatccaactttgatgacaagtctccgcacgtggcccctcccatgggcattgccctcacctacctgcctgggacctcccattccgccacgccgccaacgcattttttccttcgaaattaatgttagcgtggctatcatcacctttgccagtgagcccaaggtgctgatgtcagtcttgaatgataactcacgagacatgaccgaggtcattagctctttagaaaacgcaaattacaaagatcatgagaacggcaccggtacaaacacctacgcggcactcaacagcgtctacctcatgatgaacaatcagatgcgcctactgggtatggagactatggcatggcaagaaatacgccacgcaatcattcttctgaccgatggaaagtccaacatggggggctctcctaaaactgccgttgaccacatacgcgagatccttaacattaatcagaaacggaacgactatctcgacatttacgcgatcggtgtgggaaaactggatgtggattggcgggagttgaacgaactcggctcaaagaaggacggtgagaggcacgcatttatactgcaggacaccaaggccctgcaccaggtcttcgaacatatgctcgatgtatccaagctgactgacacgatctgcggcgttggaaatatgtccgctaatgctagtgaccaagagagaacaccgtggcacgttactataaagcctaagagtcaagaaacttgtaggggcgccttaatctcagaccagtgggtcctcaccgctgcacattgttttcgtgacggcaatgaccactctttgtggcgggtgaacgtcggggatcctaagtctcagtggggtaaggaattcctgatagagaaggcttag

SEQ ID NO: 112852 - DNA, 1134 bp, Artificial Sequence
  Description of Artificial Sequence: Synthetic coding sequence
atgaccgaagtaatttccagcctggagaacgctaattataaggaccatgaaaacgggacaggaacgaacacctacgccgcacttaactccgtgtatctgatgatgaacaaccaaatgcgattactggggatggagacaatggcttggcaggagatcagacacgcaatcattttgcttaccgacggaaaaagcaacatggggggatcaccaaaaacagccgttgaccacatccgggaaatcctgaacattaaccagaaaagaaacgactacctggacatctacgctattggggtgggcaaactggacgttgattggcgggaacttaacgaactcgggagcaagaaggacggagaaagacacgcatttatcctccaagacaccaaagctctccaccaggtctttgaacatatgctcgacgtgtctaaattaacagataccatctgtggagtgggcaacatgagtgctaatgccagtgaccaagagaggactccctggcacgtaacaatcaaaccaaagtctcaggagacatgtaggggagctctaatatctgaccagtgggtcttgacggcagcacattgtttccgtgatgggaatgaccactcattgtggagagtcaatgttggcgatcccaaatcacagtgggggaaggaattcctcattgagaaagctgtgatcagccccggtttcgacgtgttcgctaagaagaaccagggaatcctggaattttatggtgatgacatcgccttgttgaagctggcccagaaggtaaaaatgagcactcatgcccgtcctatttgtcttccttgtaccatggaggccaatctggcgctgagaagaccccaggggagcacttgtcgtgatcatgaaaatgagttgctgaataaacagagcgtgcctgctcattttgtggctttgaatggctctaagctcaatataaaccttaagatgggagtggaatggacctcttgcgccgaggtggtgagccaagagaagaccatgttccctaatctcacagatgtgagggaggtggtgactgatcagtttttatgttctggaacgcaggaagatgagtcgccatgcaagggtggctccggtgagctggggtcactgcagcctctgccttggctgtgttag

SEQ ID NO: 112853 - DNA, 1617 bp, Artificial Sequence
  Description of Artificial Sequence: Synthetic coding sequence
atgagagctctatgcatccgggagacctgctcatccgaactgggtttctctaggaactggtcacggcggaaggctggacactgtcccaacccgggcattagcctgggggcagtccggacaggtttccgattcgggcatggcgacaaggtccgttacaggtgctcgagcaacctggtgctgactggctcttcggagagggagtgccaaggaaacggtgtgtggtctgggactgaaccgatttgcagacaaccgtactcttacgacttcccagaagatgtcgcaccggctcttgggacttcattttcccacatgctgggggcaaccaatccaacccagaagactaaggaccacgagaatggaaccggcaccaatacatatgccgccctcaatagtgtttacttaatgatgaacaaccagatgcggctgctcggcatggagacgatggcatggcaagaaataagacacgctatcattctactaactgacgggaagtcaaacatggggggcagtcccaaaaccgcggtggaccacataagggaaatcttgaatataaatcaaaagaggaatgactatctcgatatctatgctataggagttggaaagctggacgtcgactggagggagctcaacgagttgggatcaaagaaggacggagaaaggcatgcattcatccttcaagacacaaaggcattgcatcaggtctttgaacatatgctggacgtgagcaagctgactgacacgatttgtggcgtgggaaatatgagcgccaatgcgtctgatcaggagcgaactccttggcacgttacaatcaaacctaagtcgcaagaaacatgtcgcggagcactgatatcagaccagtgggtgctgactgcggcccactgcttccgcgatggcaatgaccactccctctggagagttaacgtgggtgacccaaagtcacagtggggcaaagagttcctcatcgaaaaggcagtcataagtcccggctttgatgtgttcgccaagaagaaccaagggatcctggagttttacggagacgacatcgcactcctgaagttggcccagaaggtcaaaatgtcaacgcatgcacggccaatatgtttgccttgcaccatggaggccaaccttgcacttcgtcgcccacagggatccacttgccgggatcacgagaatgagctactgaacaagcaaagcgtgcctgcacatttcgtggccttgaatggctctaagctcaatataaatttgaaaatgggagtggagtggacatcttgtgcagaggtggtaagtcaggaaaaaacgatgtttcccaatcttacagacgtgagggaggtggtgaccgatcaattcctgtgctcagggacgcaggaggatgaaagcccatgtaaaggggaatcaggcggtgcagttttcttggagaggaggttccggttcttccaggttggattagtctcctggggtctctacaacccgtgccttggctcggccgacaaaaattcacgcaagcgggcccctagatcaaaagtgcctccacctagagatttccacataaacctgttccggatgcagccttggctccggcagcatctgggagacgttttgaactttttaccgttgtag

SEQ ID NO: 112854 - DNA, 1617 bp, Artificial Sequence
  Description of Artificial Sequence: Synthetic coding sequence
atgagagccctttgcatcagagagacttgctcaagcgagctcggtttttctaggaattggtctcgtcgcaaagctggccactgccctaatccagggatctcattaggcgcagtgcggactggttttaggttcgggcatggagacaaggttaggtataggtgcagttccaacctcgtgctaacaggaagtagcgagagagagtgccagggcaatggagtctggtcaggaactgagcctatctgcaggcagccatattcctatgatttccctgaggacgtggcgcccgccctggggacttcattctctcatatgctaggggctacgaatcccacacaaaagactaaagatcatgagaatggcaccggaacaaatacatacgctgcactgaactcagtgtacctgatgatgaacaatcagatgaggttgctcggcatggaaacaatggcttggcaggaaatccgccacgcgatcatacttctgacggacggtaaatccaatatggggggctcccctaagacggctgtggaccacatccgcgaaatccttaatatcaatcagaagaggaacgattaccttgacatctacgccatcggggttggtaagcttgacgtggattggcgagaactgaatgaattggggtctaagaaggacggagagcgacacgcttttatactacaagatactaaggcacttcatcaagtatttgagcatatgctcgacgtttccaaattgaccgataccatttgcggagttggcaatatgagcgcaaatgcctcagaccaggagcgtacaccatggcatgtgacgattaaacccaagagtcaagagacgtgccgcggcgccctgatctcggatcagtgggtcctaactgcggctcattgcttcagagatggcaatgaccactcattatggcgggttaatgtgggggatcccaagagccagtgggggaaggagtttcttatagagaaagccgttatctcaccaggctttgatgtgttcgccaaaaaaaaccagggaattttagaattttacggagatgatattgccctactgaaactggcacagaaagttaagatgagcacgcacgcgagaccaatctgcttaccatgtaccatggaagccaatctcgctctccggcggcctcagggatccacatgtagagatcatgagaatgaactcttgaacaagcagagtgttccggcccatttcgtggcactaaacgggtccaaactgaacatcaacctgaagatgggagtagagtggacctcctgcgcagaagttgtatcgcaggaaaaaacgatgtttccaaacctgactgatgtgcgagaggttgtgactgatcagtttctctgttcaggcacacaggaggatgagagcccttgcaagggcgagagcggaggcgccgtgtttctagagaggcgctttcgctttttccaggttggcctggtcagttggggactgtacaatccttgtctcggctctgctgataagaatagcaggaaaagggcccctcgctccaaagtgcctcccccaagggattttcacattaatctgttccggatgcagccatggctccgacaacatctgggcgacgtgctgaacttcctgcctttatag

SEQ ID NO: 112855 - DNA, 4992 bp, Artificial Sequence
  Description of Artificial Sequence: Synthetic coding sequence
atggggccgacatctggtcccagcctacttctgttattattgacacacctacccttggcacttggatcccctatgtactcaatcataaccccaaacatcttgagactggaatctgaggagactatggtgctggaagcccatgacgctcagggcgacgtacctgttactgtgacagtgcacgatttccctgggaagaaacttgtgctctcatccgaaaagacagtgctaacccccgccacgaatcatatgggtaatgtcacctttaccattccagcaaacagggaatttaagagtgaaaagggcaggaataagtttgtcaccgtgcaggctacatttgggacccaggtggtggaaaaagttgtattggttagtctgcaatccggctatctgttcatccagaccgacaagacgatttatacccccggatccactgtgctgtatcgtatctttacagtaaatcataagctacttcccgtgggccggacagtcatggtcaacatcgaaaatcctgaaggcattccagttaagcaggatagtttgtcctcacagaaccagttgggggtgctgcccctctcatgggacatcccagagctggtgaacatggggcagtggaagatccgcgcctactacgagaatagtccacagcaggttttcagcacagagttcgaggtcaaagagtatgtacttccctcattcgaggtgatcgtggaacccacagaaaaattctactacatctacaacgagaaaggcttagaggtaacaataaccgctcgcttcctgtatggcaaaaaagtggaaggcacagcctttgtgattttcgggatccaggatggcgagcagaggatctccctcccagagagcctgaagaggataccgatcgaagatggctccggggaagtggtactgagtcgtaaagttttactggacggcgtccagaatccacgggcagaggatctagttggcaagtccctttacgtatccgcaacggtgattctgcatagtgggtctgacatggtacaggctgaaaggtccggaattccaatcgtaacctccccctatcagatacacttcaccaaaacgcccaagtacttcaagccaggcatgccattcgacctaatggtgtttgtcaccaatccagatgggagccctgcttaccgcgttccggtggcagtgcaaggagaagacacggttcagagccttactcaaggcgacggagtcgctaagttgtcaatcaacactcacccttcccagaagcccctgagcatcaccgtgagaaccaaaaagcaggaactatctgaagccgaacaggctacacgcacaatgcaggcattgccgtactccacagtcggcaactctaacaactacctgcatctctccgtcctaagaaccgaactgcgccccggtgagactctgaatgtcaattttctccttcgcatggatcgagcccacgaggctaagataaggtattacacttacctaataatgaataagggccggttgcttaaggccggtaggcaagtgagggagcctgggcaggatctggtagttcttccactaagtattactactgacttcattccatcttttaggctggtggcttattatacactcatcggggcatccggccagcgagaggtggtcgcagattctgtatgggtggacgtcaaagatagctgtgtgggaagtctcgtggtgaagtcgggccagtctgaggacaggcaacctgtgcctggtcagcagatgaccctgaaaatcgaaggggatcatggagcgcgggtcgtcctcgtggccgtggacaagggagtctttgtcctgaacaagaagaacaagttgactcaatctaagatctgggatgtcgtcgaaaaggctgatattggatgcacaccaggcagcggaaaggactacgccggggtgttttctgacgcgggtctgacttttacttcgtcctctggtcaacaaactgcccagcgcgcggaactgcagtgtccgcagcctgccgctcggcgccgtagatccgtgcagttgaccgagaaaaggatggataaagtggggaaataccctaaggaacttcgcaagtgctgtgaagacggcatgagggagaaccctatgaggttttcatgccagcgtcgtacccggttcatttccctaggcgaggcatgtaagaaagtatttctggattgctgcaattacattacagagctaaggcggcagcacgcaagagcctctcatctcggcttagccaggagtaacctcgatgaggacatcatagccgaggaaaacatcgtatccaggtccgaattccccgaatcctggctgtggaacgtggaagatctcaaggagccccctaagaatggcattagtaccaagctcatgaatatcttcctgaaagacagcatcacgacatgggagatcctggcagtcagtatgtccgacaaaaaagggatctgcgtcgccgacccattcgaggtgactgtgatgcaggactttttcatagatctccggctgccttactccgtggtgaggaacgagcaggtcgagattcgggccgttctgtataactacaggcagaaccaggaactgaaggtgcgagttgaactactgcacaatcccgccttttgcagtcttgccaccaccaagcggcgccaccaacaaaccgtgaccatccctccaaagagcagtttgtccgtcccatacgtcatcgtgccgctgaagacgggcctgcaggaagtggaggtgaaggccgctgtttaccatcacttcatctcagatggtgtgaggaaaagcctaaaggtcgttcccgaggggattcgaatgaacaaaacagtagctgtcagaacgcttgatcctgagcggctcggacgagaaggggtgcagaaggaggacatcccccccgccgatctcagcgatcaagtgcctgacaccgaatctgagaccagaattctgctccaaggcacacctgtggcccagatgaccgaggatgcagtagacgctgaaaggctcaagcaccttatcgtgacccctagcgggtgcggcgagcagaatatgattggtatgactccaactgttatagcagtgcactatctggatgagacagagcaatgggaaaagttcggcctagaaaagaggcagggcgctttggaactgatcaagaaagggtacacacaacagctggcctttagacagccgtcctccgcctttgccgcatttgtgaagagggctccctcaacttggcttactgcttacgtggtcaaggtgttttcgttggccgtaaatttgatcgctattgactctcaggtgctatgcggcgcagtgaagtggttgatcctggagaagcagaagccagacggggtgtttcaagaggacgctcccgtcattcatcaggagatgatcggggggctccgcaataataatgaaaaggacatggcactgacagcctttgtcctgatatctctccaggaggcaaaagatatctgcgaggaacaggtgaacagcctcccaggctctattacaaaagcaggcgattttctggaggccaactatatgaacttgcaacgcagctacaccgtggccatcgcgggctacgccctcgcccagatgggcagattgaaaggcccgctgctgaacaagttcctgacaaccgctaaggacaaaaaccgatgggaggatcctgggaagcagctatacaatgtggaagccacaagttacgcgctgctggcacttttgcagctgaaggacttcgacttcgtgccccccgttgtccgatggctcaacgagcagcggtactacggcgggggatacggctccacccaggccacctttatggtgtttcaggccctcgctcagtatcaaaaggatgcacctgatcatcaggagctgaacctggacgttagcctgcagttgccttcccgctcctctaagatcacccataggatccactgggaatcggcttctctcctgcggagtgaagagaccaaagagaatgagggttttaccgtgactgccgagggtaaggggcaggggaccttaagcgtggtgaccatgtatcatgcaaaagccaaggaccagctgacatgtaataagtttgacctgaaagtgaccattaaaccggcccccgaaaccgagaaacgccctcaggatgcaaagaatacaatgatcctggaaatatgtacgcggtaccgcggagatcaagacgccacgatgagtatactggacatcagcatgatgacaggcttcgcaccagacactgatgatttaaagcagctagccaacggggtggaccgttacattagcaagtatgagctagataaggcattctcggaccgcaacacactgataatctacctcgacaaagtgagtcatagcgaggatgactgtctggcattcaaagtgcatcagtatttcaacgtcgaacttatacaaccaggggcggtcaaagtctacgcctattataacctggaggagtcatgtactcgtttctatcatccggagaaagaggatggaaaactgaacaaactgtgtcgcgatgagctgtgcagatgtgccgaggaaaactgctttatacaaaaaagcgatgacaaggtaacgctggaagaaaggctggataaggcctgtgagcccggcgtggactatgtgtacaagactagattggtgaaggtgcagctgtctaacgatttcgacgaatatataatggctatagagcaaaccattaaaagcgggtcggatgaagttcaggtggggcaacagcgcacatttatcagtccaataaagtgcagggaggcattaaagctggaggaaaagaagcattatcttatgtggggtctgagctcagatttttggggcgagaaacccaatcttagctacatcataggcaaagatacttgggtcgagcactggcctgaggaagacgagtgccaggatgaagagaatcagaagcagtgccaggacttgggcgcattcaccgagtcaatggtagtgttcggatgccctaattag

SEQ ID NO: 112856 - DNA, 1794 bp, Artificial Sequence
  Description of Artificial Sequence: Synthetic coding sequence
atgcacccccctaagaccccctctggagctcttcacagaaaacggaagatggccgcttggccgttttctcgactctggaaggttagtgatccgattctttttcagatgaccctgattgctgcgctacttcccgcggtactagggaactgcggcccacccccgacattaagcttcgctgcacctatggatattaccctaaccgagacacggttcaaaacaggcaccactcttaagtatacttgcctgccgggatacgtgcgaagtcacagcacgcagacacttacctgtaatagcgatggggaatgggtttacaataccttttgtatttacaagaggtgtaggcacccaggcgaattacggaatgggcaggttgaaattaagaccgatctttctttcggttctcagatcgaattcagttgctccgaaggcttcttcctgatcgggtccactaccagcagatgtgaagtgcaagaccgcggagttggatggtctcaccccctccctcagtgcgaaatcgtgaagtgcaaaccgccgcccgatatacgtaatggacgccactccggcgaggaaaatttttatgcttatggctttagcgttacatattcctgcgacccaaggttctccctcctgggtcatgcctcaattagttgtaccgtagagaacgaaactatcggcgtgtggaggccctcacctcctacttgcgagaagataacctgccgaaaacccgacgtgtctcacggtgagatggtgtctggtttcggacctatttataattacaaagatacgatcgtgtttaaatgccagaaagggttcgtgctgcgtggctcttccgttatccactgtgacgctgattccaaatggaacccatcaccaccagcatgtgagcctaacagttgcataaacctcccagacattccacatgcgtcctgggaaacataccccagaccaaccaaggaagatgtttatgtggtgggcactgtcctgcgttatagatgtcaccctggatataagcctacgacggacgaaccgaccactgttatctgtcaaaagaatctcaggtggaccccttatcagggctgcgaggcactgtgttgccctgagcccaaactcaacaacggagagatcacacaacatagaaaatcccggcccgctaaccactgtgtttacttttatggagacgagatttctttcagttgtcacgagacgtcccgtttttccgccatttgccagggagatggtacctggagcccaaggacaccaagttgcggagatatttgcaacttcccccccaagatagcccacggacattacaagcagtcctcatcctactcgtttttcaaggaggagattatttatgaatgtgacaaagggtacattctcgttgggcaagctaaattgtcttgttcttactcgcactggagtgccccggccccccagtgtaaagcgctgtgcagaaaacctgaattggtaaatgggcggcttagcgtggacaaagaccagtatgtggagcctgagaacgttactatccagtgtgactcaggctacggagtggtcggcccgcagagcatcacatgtagtggcaatagaacatggtacccggaggtgccaaagtgcgagtgggaaaccccagaaggctgcgaacaggtactcaccggcaagaggctgatgcaatgtctgcctaatccggaggacgtgaagatggctctggaagtgtacaagttatcactcgagatcgaacagctggagctgcagcgggattctgctcggcagagcacactggataaggaactgtag

SEQ ID NO: 112857 - DNA, 459 bp, Artificial Sequence
  Description of Artificial Sequence: Synthetic coding sequence
atgcaccctccaaagacaccatcaggagcgctccaccgaaaaagaaaaatggctgcttggccattttctcggttgtggaaggtgagcgacccaatactctttcagatgaccctgatcgcagcactgttgccagcagtcttagggaattgtggcccacccccaacactgtcttttgccgcccctatggacataacactgactgagacccgattcaagaccggcaccacccttaaatacacatgtctccctggatacgtacgatcacacagtacacaaacactgacatgcaattcggatggtgagtgggtgtacaataccttttgcatatacaaacgatgtcgccatcccggtgagctgcgaaacggccaagttgaaatcaaaaccgatttgtcattcggttcgcagatagagttctcatgtagtgaaggtttcttcttaatcgggtccactactagttag

SEQ ID NO: 112858 - DNA, 759 bp, Artificial Sequence
  Description of Artificial Sequence: Synthetic coding sequence
atgtttttttggtgtgcatgttgcttgatggtggcctggcgagtgagcgccagcgatgctgaacactgccccgagctccccccggtggacaattctattttcgtagccaaggaagtcgagggtcagattttggggacttacgtgtgtataaaagggtatcatctggtgggtaagaaaacattgttttgtaacgcgagcaaagaatgggacaacaccactaccgaatgtcgactggggcactgtccggacccagtgctcgtgaatggagagttttctagttcaggtcccgtgaatgtgtccgataaaatcacatttatgtgtaatgaccattacatactgaagggaagtaaccggtctcaatgccttgaagatcatacgtgggcccctccttttcctatttgtaaatctagggactgtgatccacctggaaacccagtgcacggctatttcgaaggaaacaactttacactaggaagtaccatctcttactattgtgaagaccggtactacctggtaggggtgcaggagcagcaatgtgtggacggggagtggtccagtgctttgccggtgtgcaaactgatccaggaagcaccgaagcctgagtgcgaaaaagccctgctagcttttcaggaaagtaagaatctgtgcgaggctatggaaaactttatgcagcagctcaaggagagcggcatgactatggaggagcttaaatattccctcgaacttaagaaggcagagctgaaagcaaagctgctgtag

SEQ ID NO: 112859 - DNA, 756 bp, Artificial Sequence
  Description of Artificial Sequence: Synthetic coding sequence
atgttcttctggtgcgcgtgctgcctgatggtagcgtggagagtgtcagcatcagacgagcactgcccagaattgcctcctgttgacaactctattttcgttgcgaaggaggttgagggccagattctgggcacatacgtctgtataaagggctatcatctggtgggcaagaaaacactgttttgcaatgctagcaaagaatgggataacacgactacagagtgcagactgggccactgtccagatcccgttctcgtgaatggcgagttttcatcgagcggacccgtcaatgtgtcagacaaaattacattcatgtgtaatgatcactacatactgaaaggttcaaatcgcagtcaatgccttgaggatcatacatgggcacctccgtttcccatctgtaagagccgggattgcgacccccccggtaaccctgttcacggttacttcgagggcaataattttactctggggtctacgatctcatactactgcgaggatagatactacctggtgggcgtccaagagcagcagtgcgtggacggggaatggagctcagcacttccagtgtgcaagcttatacaggaggctcccaaacctgaatgcgagaaagcgcttcttgctttccaggagagcaaaaacctttgtgaagcgatggagaactttatgcaacagctgaaggaaagcggcatgacaatggaggagctgaagtacagcctggagcttaaaaaggccgagctgaaagctaaacttctctag

SEQ ID NO: 112860 - DNA, 759 bp, Artificial Sequence
  Description of Artificial Sequence: Synthetic coding sequence
atgtttttctggtgcgcttgttgtctaatggtagcctggcgagtgagtgcgtcagacgctgaacattgtcccgaattgccccccgtcgacaatagcatctttgtggcaaaggaggtggaaggacagatcctcggaacttatgtctgtatcaaaggctaccacctggtgggaaaaaaaaccctcttctgtaatgcgagtaaggaatgggacaataccactactgagtgccgattgggacattgtccggaccccgtccttgtgaacggggagtttagctcgtccgggccggtaaacgtaagcgataaaatcacgttcatgtgcaacgatcactatattctgaaggggtcaaatagatctcagtgtctcgaggatcacacttgggcacctcccttccccatctgcaagtcgcgggactgtgatccgcctggaaaccctgtacacggctattttgagggcaataacttcactctgggctctacaatatcatattattgtgaagaccggtactacctcgttggagtgcaggagcagcagtgcgtggatggcgagtggtcctccgcattgcccgtgtgtaagctgatccaggaagcacccaaacctgagtgcgaaaaggcattgcttgcttttcaggagtctaaaaatttatgtgaggcaatggagaattttatgcagcagctgaaggagagcggcatgacgatggaggaattaaagtactctctcgagcttaagaaagcagagctgaaagccaaactgttatag

SEQ ID NO: 112861 - DNA, 759 bp, Artificial Sequence
  Description of Artificial Sequence: Synthetic coding sequence
atgtttttttggtgcgcctgttgtttgatggtggcctggcgcgttagcgcttcagacgccgaacactgtcctgagctcccaccagtggataatagtatcttcgtggctaaggaagtggagggccagattctgggaacgtacgtatgcatcaagggataccatttggttggtaaaaagacgctgttctgcaatgccagcaaggagtgggacaatacaacgactgagtgtagattgggacactgtccagaccctgttctcgtcaatggagagttctcctcttcgggacccgttaacgtgtctgataaaatcacatttatgtgcaatgaccactacatattgaagggctccaatcggagccagtgcctggaggaccacacatgggcccctcctttcccaatctgtaagagcagagattgtgatcctccaggaaatcccgttcacggatacttcgagggcaataactttactctggggagtactatttcttactactgcgaggatcgctactacctggttggagttcaggagcagcagtgcgttgatggagagtggagctccgccctgccagtatgcaagctaatccaggaggcacccaagcccgaatgtgaaaaagctcttctggcctttcaggagtctaagaacttatgtgaggccatggaaaactttatgcagcagctcaaagaaagcggaatgactatggaggagctgaagtactccctcgagctgaaaaaagcagagctgaaggccaaactcttatag

SEQ ID NO: 112862 - DNA, 657 bp, Artificial Sequence
  Description of Artificial Sequence: Synthetic coding sequence
atggtcgcttggcgagtcagtgcgtccgatgaacattgtcctgaactcccgcctgtggataattccatatttgtagccaaagaagtcgagggtcagatcctaggcacatatgtatgcataaaaggataccatctcgttgggaagaagacccttttctgcaatgcatcgaaagaatgggacaacaccacaacggaatgccgccttggtcactgtccagaccccgtgttggtcaatggagagttctctagctccggtcctgtaaacgtgagcgacaaaatcacatttatgtgtaacgaccactacatcctgaagggaagcaacaggtcccaatgtctggaagatcatacatgggccccaccttttccaatatgtaagagcataccacagaccagaccattgcccttccagccctgttcgccccttttcctgttcttattacgccagagcctggctctgttcccccgcctcgagtgttctggtcggatcttggcccattgtaacttgcacttgcccggaagttcaagctctcacgccagtgcatcccaggttgccgggatcactggggcgcacccacggtgggcaaatttttgtatattcagcagggactgggtcagtccttgctggccagggtggagtcagatccccgatctgcggtag

SEQ ID NO: 112863 - DNA, 546 bp, Artificial Sequence
  Description of Artificial Sequence: Synthetic coding sequence
atgttcttttggtgtgcttgctgtctcatggttgcgtggcgtgtgtccgcttctgatgccgaacactgcccagaactccctcccgttgataacagtattttcgtggctaaagaagttgaggggcagatactggggacatatgtatgtataaagggataccatttggtgggcaagaagacattgttttgtaatgccagtaaagagtgggacaacacaacaacagagtgcagactggggcactgcccggaccccgtattagtaaatggagagttcagctcatccgggcccgtgaacgtctcagataagatcacatttatgtgtaatgatcattacatcctaaaggggagcaacagatctcagtgtcttgaagatcacacatgggcaccgcccttcccaatctgcaaatccagggattgcgatcctccgggcaacccagtgcatggctatttcgagggcaacaattttacacttgggtcaacaatcagctactactgtgaggatcggtattatctggtgggcgtacaagagcagcagtgcgtcgattag

SEQ ID NO: 112864 - DNA, 5235 bp, Artificial Sequence
  Description of Artificial Sequence: Synthetic coding sequence
atgcgactcttgtggggcctcatttgggctagtagtttctttactcttagcctccagaaaccacgcctgctgctatttagccccagcgtggtgcacctaggagtgccactttctgtgggtgtgcaactgcaggacgtgcccagaggccaggtggtcaaaggctccgtctttttacgtaacccctcccgcaataatgtaccatgtagccccaaggttgattttaccttgagttctgagcgggacttcgcacttctcagtctgcaagtccccctgaaggacgcaaagagctgcggcctgcatcagctgctcagagggccggaggtccaacttgtggcccactccccctggttaaaggattcactgtccaggaccacaaacattcagggcattaacctcttgttttcctcccgcaggggccacctttttcttcagacagaccagcccatctacaatcccggtcagcgcgtaaggtaccgagtattcgcactggatcagaagatgcgtccgtccacagatactatcaccgtcatggtggaaaattcccacggcctcagggttagaaagaaggaggtgtacatgccaagttctattttccaggacgatttcgttatcccagacatcagtgaacctggcacttggaagatcagcgctagattttctgatggattggaatccaacagtagcactcagttcgaggtgaagaaatatgtcctgcctaactttgaagtaaaaataacaccaggcaagccatacattttaaccgttccgggtcacctcgacgagatgcaactggacattcaggccaggtatatttacggaaaacctgtccaaggagtcgcttacgtcaggttcggtttgctcgacgaagacggtaagaaaacatttttcaggggactggagagtcaaactaagctggtgaacgggcaatcccacatctctttgtccaaagccgagtttcaggacgcactggaaaagctgaacatgggtatcacagatctgcagggactgcgcttgtacgtggcagctgccattatcgaatacccaggcggggagatggaggaagcggagctgacttcttggtactttgtgtccagtccgttttcgcttgatttgtcgaagaccaagagacatctcgtgccgggcgctccatttctgttacaagctctggtgagggagatgtctggctctcctgcttcaggcattccggtcaaggtgtccgccaccgtgtcttctccaggttctgtgccagaggttcaggacatccagcagaacacagacggctccggacaggtaagcattccaatcataatccctcagaccatctctgaactgcagctgagtgtgtctgctggctcaccacatcccgcaatagcccgtctgacggtggccgctcccccctccggaggacctggttttctgagcattgagtggcccgactctcgccctccgcgcgttggtgacacacttaacctcaaccttcgcgcggtcggctccggggcaactttttcccactattactatatgatcctgtcccgtggccaaattgtttttatgaacagagagcccaagcggacccttactagcgtatccgtgttcgtagaccaccatcttgccccttctttttacttcgtagctttctattaccacggcgaccaccccgtggctaattcattgcgcgtggatgttcaggccggcgcctgcgagggtaagctcgagctgtcagtggatggcgcgaaacagtaccgaaatggagagagcgtcaagctgcatctagaaactgacagccttgcactggtcgcactgggcgcgctggacactgctctatatgccgcaggatccaagagccacaagcccctgaatatggggaaagtgtttgaagccatgaatagctacgaccttggttgtgggcccggcggaggagactctgctttgcaggtttttcaagctgccggtttggcctttagtgatggcgaccaatggaccctgtcacgcaaaaggctgtcatgcccaaaagagaaaacaactcgtaagaaaagaaatgtaaatttccagaaagccatcaacgagaagctgggccaatacgcttcacccactgctaaacgttgctgtcaagacggcgttacaagactgcctatgatgcgtagctgcgagcagcgcgcagctcgtgtacagcagccagactgtcgcgagccgtttctgagttgttgccaattcgccgagtcccttcgcaaaaagagccgcgataaaggccaagccgggctgcaaagagctctggaaatcctgcaggaagaggacctcatcgatgaggacgacatccccgtcagaagttttttccctgaaaactggttatggagggtggagaccgtggaccggttccagatactgaccctgtggcttccagacagcctcacaacatgggagatccatgggctgtcactgagcaagaccaagggcctttgtgttgccaccccggtacagctgagggtgtttcgcgaatttcatctgcacttacggctgccaatgtcagtgcgccgctttgagcagttagagttaaggccagtgctttataattaccttgataaaaacctcactgtgtctgtccacgtgtcccctgtcgagggactgtgcttagccggcggtggcggcttagctcagcaggtcttagtccccgctggcagcgcaaggcccgtggcattttctgtcgtccccacagccgcagcggccgtttcattaaaagtggtcgcacgaggctccttcgagttccctgtgggggatgccgtatcaaaggtgctccagattgagaaagaaggagcaattcatcgggaggagctggtatatgagcttaaccccttagatcatcggggtcgcacattagagatcccggggaattccgatccaaatatgattcccgacggtgactttaactcatatgtccgggtgaccgcaagtgacccactggatactttaggatccgagggggccctatcccctggtggggtggcatcactgctgcggctcccaagagggtgcggagaacaaaccatgatctatctcgctccaacccttgcagcttcacggtacttagacaaaaccgaacagtggtcaacattaccacctgagactaaggatcacgccgtagatctaattcagaaggggtatatgcgaattcagcagttccggaaagctgatgggtcctacgccgcctggctgagtagggattcatcgacctggctgaccgcttttgtgctgaaagtccttagcctagcacaggagcaagtggggggatcaccagaaaagttgcaggagacgagcaattggctgctgtctcagcagcaggctgacggttccttccaggatccctgtcctgtactggacaggtccatgcagggcggtctcgtcgggaatgatgagaccgtcgctttgaccgcgttcgtaacaattgcactccaccatggactggcagtgttccaagatgagggtgctgaacctttaaagcagagggtggaggcgagcatttcaaaggcaaattctttcctgggggagaaagccagcgccggtttactcggagctcacgccgcagccatcaccgcatacgccctgacgctgaccaaagctcccgtagacctcctgggcgtagcacataacaaccttatggctatggctcaggagactggagacaatctgtattggggttctgtgactgggtcccagtctaacgcggtatctcccaccccggcaccccgcaacccaagcgaccccatgcctcaggctccagccctctggattgagactaccgcgtacgcactgcttcatctgctcctgcacgagggaaaggccgagatggcagatcaggccgccgcctggttaacccgacaaggcagctttcaaggcggatttaggtccacacaggacactgtcattgccctcgatgccctgtccgcctattggatcgcttctcatacaaccgaagaaagaggactgaatgtgaccctgtctagcactggaaggaacgggttcaagtcacacgctttgcagctgaataacaggcagattaggggtttggaggaggaactccagtttagcctcggaagcaaaatcaacgtgaaggtcggaggaaactctaaaggtacacttaaggttctgcggacatacaatgtgttggatatgaagaataccacctgccaggatctccagatcgaggtgaccgtgaagggccatgtggaatacaccatggaggcgaatgaagactatgaagactatgaatatgacgaactccctgccaaagacgacccagacgccccactacaacctgtcactccactccagttattcgaaggccgcaggaacaggcgtcgtcgggaagcaccaaaggtggtcgaagagcaggagtcccgggtacattatactgtgtgcatctggagaaacggcaaggtaggtctgtcaggaatggcgatcgctgacgtgacactcttgtcaggctttcatgctcttcgggccgacctggagaagctcaccagtctgagtgacagatacgtgtcacattttgagactgagggtccacatgtactgctttatttcgattctgtacccacttcccgagaatgcgtgggctttgaagcagtgcaggaggtcccagtgggacttgtccagcccgcatctgccactttatacgactattacaaccctgagagacgttgctccgtgttctacggcgcccctagcaagtccagattgcttgccactctctgttcagctgaagtttgccagtgtgccgagggtaagtgtcctcggcagcgacgggctctggaaaggggacttcaggatgaggacgggtaccggatgaagttcgcatgctattatccgcgggtggagtatggattccaggtgaaggtcttaagagaggacagccgcgctgcatttagactattcgaaaccaaaatcactcaagtactgcacttcaccaaggacgtcaaggcggcagccaatcagatgcgaaatttcctggtgcgggcctcatgtaggctacgactcgagcccggcaaggagtatctgatcatgggcttagacggtgccacctacgatctggaaggccatccccagtacctgctcgattctaactcgtggattgaagagatgccttccgaacggctctgtagatcaaccaggcaacgtgctgcatgtgcccaactcaatgactttctccaagagtatggcactcaaggctgtcaggtgtag

SEQ ID NO: 112865 - DNA, 5235 bp, Artificial Sequence
  Description of Artificial Sequence: Synthetic coding sequence
atgaggttgctctggggactgatttgggcctcatctttctttactctttcgctgcaaaaacccaggttattgctgttctcaccatccgtggtccacctgggggtgcctttatccgtgggagttcaactgcaggacgtgcccaggggtcaggtggtgaagggatctgtcttcctgagaaatccatcgcggaataacgtgccatgcagccccaaagtggatttcactcttagctccgaaagggactttgcgctactgtcactgcaagtgcccctgaaagacgctaagtcctgtggccttcatcaactgcttcggggcccagaggtgcagctggtggcccattccccatggctgaaggactcgttgtcccggaccacaaatatacagggcattaatttactgttcagttcgcggcgcggacacctgttcctgcagaccgaccaaccaatttataatccaggtcagagggttcggtaccgggtgtttgctttggaccagaaaatgcgcccctccaccgacacaataacggtgatggtggagaacagccacggcctacgtgtccgtaaaaaggaagtgtacatgccttcaagtatattccaggacgacttcgtgattcccgacatttccgagcctggaacgtggaaaatatccgctcgtttttctgacgggcttgaaagcaactcctcaactcagttcgaggtcaagaaatatgtcctgcccaatttcgaagttaagattactcccggtaagccatatattctgactgtgcctgggcacttagacgagatgcagctcgacatccaggcccggtacatttatgggaagcctgtccaaggggtcgcgtacgttcgcttcggcctcttggatgaggacggaaaaaaaacattcttcaggggattagagagccagacaaagctcgtcaacggccagtcccatattagtttatcgaaagctgaattccaggacgccctggagaaactcaacatggggattactgacctgcaggggctgagactgtacgtcgctgctgctatcatcgaatcacctgggggggaaatggaagaagcagagctaacatcctggtattttgtctctagccccttctcactcgacttatcgaaaacaaaaagacatcttgtaccaggagcacccttcctgctacaggcgctggtgagagaaatgagtgggagtccagcgagcgggataccagttaaggtgagcgccactgtgtccagcccagggtccgtacccgaagtgcaggacatccagcagaataccgatggctctggccaggtgagcattcccatcattattccacagaccatctcagagctgcagctttctgtcagtgccggctcgccccaccctgcaattgcgcgcctgaccgtggcagcaccaccgtcaggcggacctgggttcctgagtattgagagacccgattcacggcctccaagggttggcgacactcttaatctgaacctgcgggccgtgggtagtggggccacatttagccattattactacatgatactgtcacgaggacagattgttttcatgaatcgggagccaaagaggacactgaccagtgtctcagttttcgtagaccaccacctcgccccttctttctacttcgtggccttttactatcacggagatcaccccgtggccaacagcctccgagtggatgtccaggctggggcttgtgagggaaagctggaactgtccgttgacggagccaagcagtaccgaaacggtgaaagcgtgaagttacacctggaaaccgactcattagcgctggtggccctcggagcactcgatactgcactgtacgcagccggatcgaaatctcacaaacctctaaatatgggaaaggtgtttgaggccatgaatagttacgatctggggtgcgggccgggagggggcgattctgccttacaagtctttcaggcagccggcctggcgttttctgacggcgatcagtggacattgtcacggaaacgcctgtcttgtcccaaggagaagacaacccggaaaaaacgaaacgtgaatttccaaaaagcaattaacgagaaactgggtcaatacgcatcacctacggcgaagcggtgctgccaggatggcgtcacgagacttccaatgatgcgaagctgtgagcagcgcgctgccagggttcagcagccggattgcagagagcccttcctgagctgttgccagttcgccgagtcactgaggaaaaagtctcgcgacaaggggcaggcaggcttgcaacgagctctcgaaatcctgcaggaggaggacttgatagatgaggacgacattcctgtcaggagcttcttccccgagaactggctgtggagagtggaaactgtcgaccgcttccagattttaacactgtggcttcccgattcactgacaacatgggaaatccacggattaagcttaagtaaaaccaagggcctgtgcgttgcaactcccgtgcagcttcgggtcttcagagagtttcatctgcacttgcggctccctatgtccgtgcggcgatttgagcagctggagttgcgccctgtgctgtacaattacctggacaaaaacctgactgtctccgtgcacgtgtctcctgttgagggactctgtctcgctggcggtggaggcctggcacagcaagtgctcgtgcccgctggtagtgcaaggcccgtggcattctctgtggtgcctactgctgccgctgccgtgtcactcaaagttgtcgctaggggatctttcgagtttcccgtcggagacgccgtgtccaaagtgctgcagattgagaaagaaggagctatccacagggaagaattggtctacgagttaaatcctctggaccatcgcgggcgaacactcgagatacccggcaatagcgacccaaatatgataccagatggggacttcaactcctacgtgcgcgtaacagctagcgatcctctggatacactgggctctgagggagcattgtcccctgggggagttgcctctctgctacgccttcccagaggctgcggagaacaaactatgatctacctggctcccactcttgccgctagtagatatctggataaaaccgagcagtggtccaccctaccgcctgaaacaaaagaccacgccgtggacctgatccagaagggatatatgcgcatccaacaattcaggaaagccgatggctcttatgctgcatggctttcccgcgactcttcgacatggctcaccgcattcgtgttaaaagtgctgagcctggcgcaggagcaagtcggaggctcccccgagaagctgcaggaaacttctaattggttgttgtcacaacaacaggcagacggaagttttcaggatccttgtcctgtgctcgaccggtccatgcagggcgggctagttggcaatgacgaaaccgtagccctcacagccttcgtcactatagctctccatcacggcctggccgtgtttcaggacgaaggggccgagcctttaaagcagcgcgttgaagcaagcatctccaaggcctcttcctttttaggtgaaaaagcttctgccggactgctgggcgcacatgctgccgcaataaccgcctacgctctcaccctgacgaaggctcccgtcgacctgcttggagtggcccacaacaacctgatggccatggcacaggaaaccggtgacaacctgtactggggctccgtgaccggcagtcaatcaaacgctgtgtccccaacccctgccccaagaaatcctagcgatcctatgccccaggcaccagccctctggattgagacgaccgcctacgcattgttgcacctactgcttcatgagggtaaagccgaaatggcagaccaagcagcagcctggttaactcggcagggaagctttcagggagggtttagaagtacccaggatacagtcatcgccctggacgctctctcggcttattggattgcctctcatactacggaagagcggggcctgaatgtgaccctcagctcaactgggcgcaatggattcaagtcacatgctctgcagctgaataaccgtcaaatacgaggcttggaggaagaattgcagttctcacttggatcaaaaataaatgtgaaggtgggcgggaattccaagggaactctgaaggtgttaagaacttacaatgtcttggatatgaagaacaccacctgtcaggatctgcaaatagaggtgactgtcaagggccacgttgaatatacaatggaggccaatgaagattacgaggattacgagtatgacgagcttccagccaaggatgacccagacgcccccttacagcccgtcacaccactgcaactgttcgaaggacggcggaaccggcgtcgaagagaggctccaaaagtggtggaagagcaggaatcccgtgtacattacaccgtctgtatctggcgtaacggtaaagtgggcctttccggaatggcaattgccgacgtcacactgttgtccggctttcatgccctgcgggccgatctggaaaaacttacctcgctgtcggacaggtatgtgagtcactttgagacggaaggcccccatgtacttctctatttcgattcggtcccaacttctcgtgaatgcgtaggcttcgaggcagtgcaggaggtccctgtcgggttggtgcagccagcatcggccactttgtacgattattataatccagaaaggaggtgcagtgtcttttacggggcccccagtaagtcacgactgctggctactctctgctcggccgaagtctgtcagtgcgccgagggcaaatgcccgaggcagcgcagggccctggagcgtggcttgcaagacgaagatgggtaccgcatgaaattcgcttgttactatccgagagttgagtacgggttccaggtgaaggttctacgggaagactcgcgcgcggcattcaggttattcgagactaaaattacgcaagtgttgcatttcactaaggacgtgaaagccgctgcaaaccagatgcgaaactttcttgtgagggcctcctgccgccttaggttggagcctggtaaggaatatttgataatgggcttggacggtgccacctatgacttagagggccatcctcagtatcttttagattcaaatagctggatcgaggagatgccgtcagagcgcctttgccggagtactcgacagcgggcggcctgcgctcagttgaacgattttctccaggagtacggtacccagggctgccaggtgtag

SEQ ID NO: 112866 - DNA, 5235 bp, Artificial Sequence
  Description of Artificial Sequence: Synthetic coding sequence
atgagactgctgtgggggctgatatgggccagtagctttttcaccctttccctccagaaacccaggctgctcttatttagcccatcagttgtccatctcggcgtgccattatcagttggggtccagcttcaggacgtcccacgggggcaggtggtgaaggggagtgtattcctgagaaacccgtctagaaataacgtgccctgctcacctaaggtagacttcacactcagcagtgagagggattttgcccttctttccctgcaggtccccctgaaggatgcgaagtcgtgcgggctgcaccagctcctgcgggggcctgaggtgcagctagtcgcccacagtccatggcttaaagactctctctccaggaccactaacattcagggcattaatctcctctttagctcacgaagaggccacctgtttttgcagaccgatcaaccgatttacaacccgggccaacgggtcagatatcgcgtctttgctctggatcagaagatgcggcccagcactgacacaataacagtgatggttgaaaacagtcacggcctgagagtacgcaagaaagaagtttacatgccttcatctatatttcaagacgatttcgtaatccccgatatatcagaaccgggcacatggaaaatttcagccagatttagcgacggactcgagagtaactcttcgactcagttcgaggttaagaagtatgtgcttcccaacttcgaggttaaaatcacaccagggaagccctatatactgacagttcccggacacttggacgaaatgcagttggatatccaagcccgatacatttatggcaaaccagtgcagggcgtggcatacgtccggtttggtctgttagatgaggacggaaaaaaaactttctttaggggcctagagtcccagacaaaactagtgaatggccaaagccacatttctttgtccaaggccgaattccaggatgccctcgagaagttaaacatgggtatcacggacctgcaggggctccggctgtacgtggccgctgcgatcattgagtacccaggaggtgagatggaagaggcggagctgacctcttggtattttgtctcaagtccatttagcttggacctgtccaagactaagcgccacctggtccccggcgcgccgttcctgctccaggccttagtgagagagatgagcggatcccctgcttcgggaatccctgttaaagtgtccgctaccgtctcgagccctggaagcgtgcctgaggttcaagacattcagcagaacaccgatggctctggacaggtcagcattccaatcattatccctcaaaccatcagcgaattgcaactttctgtctccgcaggatcgcctcatccagctatcgctcgcttgacagtagccgctccgccttctggcgggcccggtttcttgtccatcgaacgccccgacagtcggcctccacgcgtgggtgatactctgaatttgaacctgagagccgttggctccggggccacgttttctcactattattacatgattctctcccgcgggcaaatagtgttcatgaatcgagagccaaagaggactctgactagcgtgagtgtgttcgtggatcaccacctcgccccatccttttatttcgtcgccttctattaccatggagatcacccagtggctaatagcctccgggtcgatgtgcaagccggcgcctgtgagggaaagctggagctgtctgtggatggcgctaagcaataccgcaatggggagagcgtgaaactgcacttggagacagactcccttgcactcgtggcattgggggcgctcgacaccgcgctctacgctgctggttcaaaatcccataagcccctgaatatgggaaaggtcttcgaagctatgaactcgtacgacctgggttgcgggcccggcggaggtgactctgccctgcaggtgttccaagctgccggcttggcattcagtgacggagatcagtggaccctgtcacgtaagcggttatcgtgcccaaaagagaagaccacgcgcaaaaagcgcaacgttaacttccaaaaggctatcaatgagaagctcgggcagtacgccagtccaacagcaaaaagatgttgccaagacggcgttaccaggttaccaatgatgaggagttgtgaacaacgcgcagcccgcgtgcagcagccggactgtcgtgaaccctttctctcctgttgtcagtttgcagagagcctccggaagaaatctcgcgacaagggtcaggctggacttcagcgcgccttggagatcttacaggaggaggatctcatcgacgaggacgacatacccgtaaggagcttcttccctgaaaattggctttggcgtgtagagacagtagacagattccagattctgaccctctggctacccgacagcctcactacttgggaaatccatggcctgagcttgagcaagacaaagggactctgtgtagctactcccgtacagctcagggtgtttagggaatttcatttgcatctaagactgccaatgtccgtccgccgcttcgagcagctcgagcttcgcccagttctatacaattacctagataaaaacctgactgtgtcagtgcatgtttcaccggttgaaggcctgtgcttggctggaggtggcggtttggctcagcaggtcctggtgcccgctggctctgcacgccctgtggcatttagcgtcgttcctactgcggccgccgccgtttccctgaaagtagtggcaagagggtcctttgaatttcctgtgggtgatgcggtctctaaggtgctgcagatcgagaaagagggcgctattcatcgtgaagaactggtgtacgagctgaaccctttggaccatagggggcgcacacttgagatcccaggcaattcagacccaaacatgataccagatggcgactttaattcttacgtgcgcgtgactgcctcagatccgttagacaccttaggaagtgaaggggcactgtcaccagggggcgtggctagtttgctcaggctcccgcgggggtgcggggagcagactatgatctatctcgcgcctaccctcgccgcatcacgctacctagacaagaccgagcagtggagcactttgccccctgagaccaaagaccacgctgtggacctgatccaaaagggttatatgagaattcaacagttccggaaggcagacggctcatacgcggcttggctgtccagggacagtagtacttggctcactgccttcgtcctcaaagtactctcgctcgcccaggaacaggtcggcggcagcccggagaaacttcaggaaactagtaactggctgctttcccaacagcaggctgatggctctttccaggatccttgtccagtattggaccggtctatgcagggtggcttagtgggcaatgacgaaacggttgcattgacggcctttgtgacaattgcactgcaccatgggcttgcagtgttccaagatgaaggagcagagcctctcaagcagagagtcgaagcgagtatcagcaaggcaaactcttttctgggtgaaaaggccagtgctggcctcctgggcgctcatgctgcagcaatcactgcctatgccctgaccctgactaaagcaccagtggatttgcttggcgtggcacacaataacttgatggctatggctcaggaaactggcgataacctgtattggggatccgtgacgggctcacagtccaatgcggtgagccccacacccgctccacgcaatcccagcgaccctatgccgcaggcgcccgcactgtggattgaaaccaccgcatacgccctcctgcatctgctcctgcatgaaggtaaggccgagatggcagatcaggctgccgcctggctgacgcgccaaggcagtttccagggtgggttccgtagtacccaggacactgtgatcgctctcgatgcgctctccgcctactggatcgccagtcacactaccgaggaacggggcctaaatgtgacactgagttctacgggccgaaatggattcaaatcacacgctctccagctgaacaataggcaaattagaggcctcgaagaggagctgcagttttcattgggcagcaagatcaatgtgaaggtgggtggtaactcaaaaggtaccctcaaagtattaagaacctataatgtgctggatatgaaaaataccacctgccaggatttacaaattgaggtgaccgttaagggccatgtggaatatacaatggaagctaacgaagactacgaggactacgaatacgacgaactgcctgccaaggacgatccagacgcccctttgcagcctgtaactcctctgcagctgtttgagggcagacgcaaccggcggcgtcgcgaggccccgaaggttgtagaagagcaggagtccagggtgcactataccgtttgtatatggaggaatgggaaagtgggcctgagcgggatggctattgccgacgtcactctgctgagcgggtttcacgctcttcgcgcggatcttgagaaattgactagcctttcagacagatacgtctcccactttgaaactgagggaccccacgttctgctctacttcgattcagtgcctacctcgagggaatgtgtgggtttcgaagccgttcaggaagttccagtcggtctcgtccaaccagcctcagccacactgtatgactattataaccctgagagaagatgctccgtgttctacggcgctccatccaagagccgtttgctggcaacactttgtagtgctgaagtatgtcaatgtgccgaaggaaagtgcccccggcagagacgtgctctggaaaggggcctgcaagacgaagacggatataggatgaagtttgcttgttattacccacgggtggaatatgggtttcaggtaaaggtgcttcgcgaagactcccgggccgcgttcaggctattcgaaacgaagatcactcaggtgctgcatttcaccaaggatgtcaaggccgctgccaatcagatgcgaaacttcttggtaagggccagttgcaggctgaggttggagcctggcaaggagtacttaattatgggtctggatggagctacgtatgatttagagggacaccctcagtaccttctagatagcaattcttggattgaggaaatgcctagtgagcgcctatgccgcagtactaggcaacgcgcagcctgcgcccaactcaatgatttcctgcaggaatacgggactcaaggatgtcaagtatag

SEQ ID NO: 112867 - DNA, 5235 bp, Artificial Sequence
  Description of Artificial Sequence: Synthetic coding sequence
atgcgtctgctttggggtctgatctgggccagctccttcttcacacttagcttgcagaagccgcgcctcctgcttttcagtccctctgtggtccacctgggagtgcctctgtctgtcggcgtccagttgcaagacgtgccaagaggccaggtcgtgaaaggcagcgtattcctgcgcaacccttcccggaataacgtgccttgtagcccaaaagtggactttaccctcagctctgaacgggacttcgccctgctgtccctccaggtacctctgaaagatgctaaaagttgtggactgcatcagctcctgcggggtcccgaggttcagctggttgcccacagcccatggttaaaagacagcttatcaaggacaactaatatacagggcatcaatttactgttctcctctagaaggggacacctcttcctgcagacagatcagcctatctacaaccccgggcaacgcgtgagatacagggtgttcgcacttgaccaaaagatgcggccttccactgatacaattactgtgatggtcgagaactcccatggcctgagagtgcgcaagaaagaggtgtacatgccctcatccatcttccaggacgacttcgttatccctgatataagtgagcccggaacctggaaaatctccgcaagattctccgatggtctggaatccaatagctccacccagttcgaggtgaaaaagtacgtgctcccaaactttgaagtcaaaattacccccggaaaaccctacatcctcaccgtccccggtcacctggacgagatgcaactagacatccaggcccgctatatctatgggaaacctgtccagggtgttgcctatgtccgctttgggctactcgatgaggatggaaaaaaaacctttttcagagggttggagtcccagacgaagctcgtgaacgggcagtcccacatcagcctatcaaaggcagagtttcaggacgctctagagaagctcaatatgggtatcacggacttgcaggggctgcggctctacgttgcagcagccatcatcgagtctcccggaggagagatggaggaggctgaacttacatcctggtactttgtttctagtccatttagcctcgatctcagtaaaactaaacggcacctggtccccggggctcctttcctgctccaagcattggtacgtgagatgtctggctctcctgccagtggcattcctgttaaagttagcgctaccgtgtcgtcacccgggtcagttcccgaagtccaagacatccagcagaatacggacggaagcggccaggtgtcaattccaataatcattccacagaccatcagcgaactgcagctctccgtctctgcgggcagcccccacccagcgatagccagactgactgtcgcggcaccaccatcaggaggccctggtttccttagcatcgagcgcccagacagccgccctccccgtgtgggcgatacgctgaacttaaacctgagggccgtgggttccggtgctactttcagtcactactactatatgatcctttcacgggggcaaatagttttcatgaatagagagcccaaacggacacttacaagtgtgagcgtctttgtcgaccatcacttagcacccagcttctactttgtggctttctactaccacggtgaccacccagtagccaattctctgcgcgttgatgtgcaggcaggggcctgcgaaggaaagctcgagctctctgttgatggggccaaacagtacagaaacggagaaagtgtgaagcttcacctggagacagattcgctcgccctggtggcccttggtgctttggatacggctctgtatgctgccggctccaagagtcacaagccattgaatatgggcaaggtttttgaggcgatgaactcttatgaccttggatgtggcccagggggcggcgattcagccctgcaggtctttcaagccgcaggactcgcctttagtgatggggaccaatggacactgtccaggaagcgtctcagttgtcctaaggaaaagacaactcgcaaaaagaggaacgtgaacttccaaaaggcgatcaatgagaaacttggccagtatgcctcacccaccgctaagcgctgttgccaggacggtgtgacccggctgcctatgatgaggtcctgtgaacaacgtgctgcacgggtgcagcagccagattgtcgggaaccattcctatcctgttgtcagttcgctgaatctctccggaagaaaagcagagataaagggcaggccgggctgcagcgggctcttgagattctccaagaggaagaccttattgacgaggatgacatcccagtgcgatctttttttccagagaactggctatggcgcgtagagacggtagataggttccagattctcacactttggctccccgattcgctgacaacatgggagattcacgggctgagtcttagcaaaacgaaggggttgtgtgtcgcaacccctgttcagctgcgcgtcttccgagaatttcacctgcacctgcggctcccaatgagtgtgcggcggttcgaacagctcgagctgagacctgttctatacaactatctggacaaaaacttgacagttagcgtgcatgtgtcccctgtagaggggctctgcctggccggcggcgggggcttggctcaacaggttctcgtgccagccggttctgcccggcccgtcgcctttagcgtcgtgccgacagccgccgccgccgtgtcacttaaagttgtcgctcgcggatcctttgagttccccgtgggcgatgctgtgagcaaagtacttcaaatcgagaaagagggcgcaatccaccgagaggagcttgtctacgagctgaatcccttagaccaccgcgggcgcaccctggagataccaggtaactccgatcctaacatgatacctgatggcgattttaattcctatgtacgggttactgcctcagatcctctggacactctgggatccgaaggggccctcagtcccggcggcgtggccagtctgctgcggctcccccgaggatgcggcgaacagacaatgatctatctggcccccactctggcggctagtcggtatttggacaagaccgagcaatggtctaccctcccacccgagaccaaggaccatgcagtagacctcatccagaaagggtacatgaggatccagcagtttcggaaggctgatggaagttacgctgcctggctgagccgcgacagtagtacctggctgaccgcctttgtacttaaggtgttatccctggctcaggagcaggtggggggctcccctgagaagctccaagagacatcaaactggttattaagtcagcaacaggcagacggcagcttccaggatccctgtccggtactcgatcgcagtatgcaaggtggcctcgttggcaacgacgagacagtggccctgaccgcctttgtcacaatcgcattacaccatgggctagctgtcttccaagacgaaggtgccgagcctctcaaacagagggtggaagccagtataagtaaggctaactcgtttctgggcgagaaagcctcagctggactgctcggagcccatgccgcggctattacagcctatgcattgactctaacaaaggcaccggtcgacctcctcggtgtggcccataataaccttatggccatggcacaggaaaccggggataacttgtattggggatcggtaactgggtcccagagtaacgcagtctcccctaccccagctccaagaaatccatccgatcccatgccccaggcaccagccctctggattgaaacgacagcttatgcactgttgcacttgctcctccatgaaggcaaagcagagatggccgaccaagcctccgcatggctgactcgccaagggtcctttcagggaggcttccgctcaactcaggatactgtcatcgctcttgacgccctttccgcatattggatagcatcacataccacagaagaacgcggtttaaatgtaacactcagttcgactggccggaacggctttaaatcccacgcactgcagttgaacaatcgccaaatccgcggcttagaagaagagctgcagttttctctcggaagcaagatcaatgttaaggtgggcgggaactcaaagggcacgttgaaggtactgcgaacctataatgtgcttgatatgaagaacaccacttgccaagatctccaaatcgaggtgaccgttaaggggcacgttgaatataccatggaagcaaatgaagactacgaggattacgagtacgacgagcttcccgcgaaggatgatccggacgctcctctccagcccgtgactcctttacagctttttgaggggaggaggaaccgacggcggcgggaggcgccgaaagtggtcgaggagcaggagtcccgggttcactatacagtttgcatatggcgaaacgggaaggtgggcctatccggaatggcaattgccgatgtgactttacttagcgggttccacgccctgcgagccgatctcgagaagctgacctctctgagtgatcgttacgtgtcccactttgaaaccgagggcccccatgtcctgctctactttgatagtgtgcccacctcacgtgaatgcgtcgggttcgaagctgtacaggaggttcctgttggactggttcagccagctagtgccactctctacgattactataacccagaaaggaggtgtagtgtgttttatggagctccatcaaagagccgcctgcttgctacgctttgtagcgccgaggtttgtcaatgcgccgagggcaaatgtccaaggcagcgacgcgcactggaacgcggactacaggacgaggatggatacaggatgaagtttgcctgctactaccctcgtgtcgaatatggcttccaggtgaaggtccttagggaggactcacgcgccgccttcaggctctttgaaactaaaattactcaagtgctgcacttcacgaaagatgtcaaagctgcagctaatcagatgaggaatttcctggtcagagcctcctgtaggctgaggctggagcccggaaaagagtacctgatcatgggccttgacggcgctacttatgatctagaggggcatccgcagtacctactcgactccaatagttggatcgaggagatgccaagtgagcggctgtgtcggagcacacggcagcgggccgcatgtgctcagctgaacgattttctgcaagagtacggcactcaggggtgccaagtctag

SEQ ID NO: 112868 - DNA, 5097 bp, Artificial Sequence
  Description of Artificial Sequence: Synthetic coding sequence
atgagattgctctggggccttatctgggctagtagtttttttaccctgagtctgcaaaagccacgcttgctgttgttctctccctcggtagtgcacctcggagttcccctgagcgtgggagtgcagctccaggatgtgcctagggggcaggttgtaaagggttccgtgttcttgcgaaacccctcacgaaacaacgtaccctgcagcccaaaggtggattttaccctgagctccgagcgggatttcgccttgctgtccttacaggtgccactgaaagatgccaagagctgtgggcttcaccagctcttaagggggccagaggtgcagctcgtggcccacagcccatggttgaaggactctctgtcgagaaccacaaacatccagggaattaacctccttttctccagccgccgcggccacctgtttctccaaaccgatcagcccatctacaatcctggacagagggtgagatatcgagtcttcgccctggaccagaaaatgcggccatccacagataccatcactgtcatggtagaaaattcccatggcctgcgggtccggaaaaaagaagtttacatgccctcctcaatcttccaggacgacttcgtcatcccggacatcagcgaacccgggacgtggaagatttccgcccggttctctgatggacttgagtccaattcatctacacagtttgaggtgaaaaagtacgtgttgcccaatttcgaggtgaaaattacccccggtaagccttatattctgaccgtgcccggccacctggacgaaatgcaattggatatccaggcccgttacatctacgggaaaccagtgcagggcgtcgcgtacgtgcggtttgggctgctagatgaggatggtaaaaagacattcttcaggggccttgagagccagacgaaactcgtgaatggacaatcacacatctccctgagcaaggccgaattccaggacgccctcgaaaagttaaacatgggtatcacagacctgcagggtctgcggctctatgttgcagctgccattattgaaagcccaggaggagagatggaagaagccgagctgaccagttggtactttgtgtcctccccattcagtctagacctcagtaagaccaagcggcatctggtgcctggggcgccttttctcttgcaggctctggttcgtgaaatgagtggtagccccgcctcaggtattccagttaaagtgagcgcaaccgtctcctctcctgggtctgtgcccgaggttcaggacatccagcaaaacacggacgggtccggacaagtgtcgatacctatcattataccacagacgatttccgagctgcagctaagtgttagcgctggctctcctcatccagccatcgcccggctgaccgttgccgccccaccctcagggggcccaggattcctgagtatcgaacgacctgacagccgcccacctcgcgttggcgatacacttaaccttaacctgcgagccgtgggctccggagccaccttcagccactattattatatgattctgagccgaggtcaaatagtctttatgaaccgagaacctaagcgtactcttacatccgtgtcagtctttgttgatcaccatctcgcacctagcttttacttcgtagctttttattaccacggtgatcaccccgtcgccaattcccttcgcgtggacgtccaggcaggcgcctgcgagggcaaactggaactctctgttgacggagctaaacagtatcgtaacggggagtctgtcaaattgcatttagagaccgactccctggctctcgtcgccctcggtgcccttgacaccgccctgtatgcagcaggcagtaaatcccataagcctctcaatatggggaaagtttttgaagctatgaactcttacgatctgggttgcggtccaggaggcggagatagcgccttgcaggtgtttcaggccgcaggactggccttcagtgacggtgatcagtggaccctctctagaaagaggctcagctgccccaaagagaagactacccggaaaaagcggaacgtcaattttcagaaggccattaatgaaaagctcggccagtacgcttctcctaccgccaagcggtgttgtcaggatggagttactagactgcctatgatgcgatcatgcgagcaacgtgcggccagagtccagcagccagactgcagagagccatttctaagttgttgtcagtttgcggagtccctacggaaaaaatctagggacaagggacaagctggtctacagagagcgctcgaaatcctccaggaagaggaccttatcgatgaagatgacatcccagtcagatccttctttccagagaattggttatggcgggtagagactgtagatcgattccagatcttaaccctgtggctgccagacagtctcacaacctgggaaattcacggattgtctctgagcaagaccaaaggactgtgtgtggccactcctgttcagctgagggtgttcagggagttccacctccacctccgcctcccgatgagcgtgaggcgatttgagcagcttgagctgcggcctgtgttgtacaactatctggacaagaacttaaccgtgtccgtgcatgtaagtcccgtagagggattgtgcttggcagggggaggggggctagcacaacaggtgctcgttcctgcaggctccgccaggccggtggccttctctgtggttccaaccgctgcggctgccgtgagtctaaaggtggtggctagaggctcctttgagtttcctgttggtgatgctgtctctaaggtgctgcagatagagaaggagggcgctatccatagagaagagctggtctacgagcttaacccactggatcacagagggaggacactggagataccggggaactccgatccgaatatgatccccgatggcgattttaactcttatgtccgggtcaccgcatcagaccccctcgatacactgggaagtgagggtgctctgtcacccggtggagtggcctcattactgagacttccgcgggggtgcggtgaacagaccatgatttatttggcacctactctcgcagctagccgatatctcgataagactgagcagtggtccaccctccccccggagaccaaggatcacgcagtggatttgatccagaaaggatacatgcggatccagcaattccgaaaagccgacggaagctatgccgcttggttgtcccgggactcatcaacttggctgaccgcctttgtcctgaaggtcctctcactggctcaagagcaagtcgggggcagtcctgagaagctccaagagacttccaactggctgctgtctcaacagcaggcggacggcagctttcaggacccctgtcctgttctggacaggtccatgcagggaggcctcgttggcaatgacgagactgtcgccttgaccgcattcgtcacaattgccctccaccacggacttgctgtgttccaggacgaaggtgctgaaccgctcaagcaaagagtcgaagcctccatctccaaggccaattcatttctaggggaaaaggcgtctgctgggctgttgggcgctcatgctgcagctatcaccgcgtacgctctgacgctgactaaggctcctgtggacctgttgggcgtagcacataataaccttatggccatggcacaggaaaccggggacaatttgtattggggtagtgtaactgggagtcagagtaatgccgtctctcccacccccgctcccagaaatccatccgaccccatgccacaagcccccgcgctgtggatcgaaaccaccgcctacgcattgctgcacttacttttacatgagggtaaagccgagatggctgatcaggcctccgcttggctgactcggcaaggatctttccagggcggcttccgctccacccaggatacggtgatcgctctagacgcgctgtcagcgtattggattgcatctcacacgacagaggagcgcggtctaaatgttacactaagctccaccggcaggaatgggttcaagtcacacgcccttcagcttaacaatcggcagatccgcgggctggaagaagaactacaatttagtctggggagcaagataaatgtcaaagttggagggaactctaagggaacacttaaggtgctccgcacctataacgtcctggatatgaagaataccacttgtcaggatttgcagatcgaagttacggtgaaagggcatgttgagtacacgatggaagcgaacgaagactatgaggactatgagtacgatgagctgcctgccaaggatgacccagacgcacccctccagcccgtgactcctcttcagctgttcgagggacgcaggaatcgtcgacggagggaggcacccaagttgaccagcctctctgaccggtacgtcagccacttcgagactgagggaccgcacgtgttgctgtactttgactccgttccaacttcacgcgagtgcgtggggttcgaggctgttcaagaggtccccgtcgggctcgtgcagccggcctccgccacactgtacgactattacaatccagagcggcgctgctccgtgttttacggagcccccagcaaatcacggctcctggcaacactctgctctgcagaggtttgccagtgcgccgaaggcaaatgtccaaggcagcggcgtgctctggaacgtgggttgcaggacgaggacggctatcgaatgaagtttgcctgctactatccccgggtggaatatggtttccaggtgaaagttctgcgtgaagattcaagagcagcattcaggctgttcgagacaaagatcacacaggtgctacactttacaaaagacgtgaaggccgcggccaaccagatgcggaacttcctggtcagggcttcatgccggctcaggctcgagccaggtaaggagtacctgattatgggcctggacggtgccacctacgatctggaagggcacccccagtacctactggattccaactcatggattgaagagatgcccagtgagcgtctgtgtcgaagcactcgccagcgcgccgcctgcgcccagctaaatgactttctccaggagtacggtacacaggggtgtcaagtctag

SEQ ID NO: 112869 - DNA, 813 bp, Artificial Sequence
  Description of Artificial Sequence: Synthetic coding sequence
atgtgtcccgaggactccctgcaagtgccactgaaagacgctaaatcatgcggattgcaccagctgctccgaggccctgaagtccagctcgtcgctcactcaccatggctaaaggatagcctgtcccgcacaaccaacattcaagggataaatctgctgttttcctcccgaagagggcacctgttcctacaaaccgaccaacctatctataatcccgggcaaagagtccgatacagagtgtttgcactggatcagaaaatgaggccttccacggacactatcacagttatggttgagaactctcatggtctgcgggttaggaagaaagaggtgtacatgccttcctcaatctttcaggacgacttcgtcatcccggacatttccgagcccggaacatggaaaatcagtgcacgcttctcagacgggctggagtccaattcctcaacgcagttcgaagtcaagaaatatgtccttcctaatttcgaagtcaagataacaccgggtaagccctatattttgacagtcccaggccacctggacgaaatgcaactggacatacaggcccggtacatctacgggaaacccgtccagggagtagcatatgttaggtttggcttgctggacgaggatggcaaaaagactttctttcgaggccttgaaagtcagactaaattagttaatggccagtcccatatttctctgtctaaggccgagttccaagatgcactcgaaaaattaaatatgggcatcacagatctccagggcttacgcctttacgttgctgccgccattatagaaagtcctgggggatag

SEQ ID NO: 112870 - DNA, 5097 bp, Artificial Sequence
  Description of Artificial Sequence: Synthetic coding sequence
atgcggttactgtgggggcttatttgggcatcaagcttcttcacgttgagcctgcaaaagcctcgactgttgttgttttcgccaagtgttgtacacctcggcgtcccactgtcagtgggggtccaacttcaggacgtgcctagaggccaagttgttaagggttctgtgttcttgaggaatcccagtcggaacaacgtgccttgctctccgaaggtcgactttacactgagctccgaacgcgacttcgcattgctgagtctgcaggtccctttaaaggatgccaagtcgtgcggcctgcaccagttgcttagaggccccgaagtgcagctcgtagcccattcaccctggctcaaagattccctcagccgcactactaatatacaaggtatcaatctgctgtttagtagtcggaggggacacctgttcttgcagaccgaccagcccatctataatcccggtcagcgtgtgcggtacagagtattcgcgttagaccaaaagatgcgaccatcaactgatactatcaccgtgatggtagagaactctcacggcctgagagtcaggaaaaaagaggtgtacatgcctagtagcatcttccaggacgactttgttatccccgatatcagcgagcccggcacttggaagatcagcgctcgcttcagcgatgggctggagagcaactcttctacccaatttgaagtcaaaaaatatgtattaccgaatttcgaggtgaagatcactccaggtaaaccctatattttgacggtgcccgggcatctggatgaaatgcagctagatattcaggcaagatacatttacgggaagccggtgcaaggcgttgcctatgtccggttcgggctgcttgacgaagatggcaagaagacatttttcagaggcctcgagtcacaaaccaagttggtgaacggacagagccatatttctttatcaaaagctgaatttcaggacgccctggagaagctcaatatgggcattaccgacctgcagggactgcgactgtacgtggccgccgctatcatcgaatacccaggcggcgagatggaagaggctgagctgacctcatggtacttcgtgtcttctccattctctttggacctatccaagaccaagagacaccttgtacccggggcccccttcctgctgcaagcgctcgttcgggaaatgagcggctctccagcctctggcattccagtgaaggtatccgccaccgtgagctcacccggctccgtgcccgaagtgcaggacatccaacaaaacactgatggatctggacaagtttccatccccattatcatcccacaaacaatctctgaactccaacttagcgtcagtgcaggctctccacacccagctatcgcccggctgacggtggcagcacctccttctggagggccaggctttctgagtatagagtggcccgacagtcgccctccgagggtaggagataccctgaacctgaacttacgcgctgtcggttcaggggcaactttcagccactactattatatgatcctgtcacgcgggcagattgtttttatgaatagggagcccaaacgtacacttacaagcgtctccgtgttcgtcgatcatcatctggcaccttcattttacttcgtggctttctactaccacggcgatcatcctgttgccaatagcctaagggtcgacgtccaagcaggagcatgcgagggaaaactggaactctccgtagatggcgcaaagcagtacagaaacggcgagtcagtgaagctccatcttgagaccgacagcttagccctggtcgccttaggcgccttggacactgctctgtacgctgccggcagcaaatcccacaagccactgaatatgggaaaggtgtttgaggctatgaattcttatgatctgggctgtggcccagggggcggagacagcgccctccaggtgtttcaggctgccgggctagccttttcggacggggatcaatggacactttcacgaaaacggctttcctgccctaaagagaaaacgacgaggaagaagagaaacgtcaacttccagaaggcaattaatgagaagcttggtcagtacgcctccccaacagctaagcgctgctgccaggacggggttacccgtctacctatgatgaggtcatgcgagcagagggccgcacgcgtacagcagcctgactgcagggagccgtttttgagctgctgtcaattcgccgagtcactccgcaaaaagtcccgagataaggggcaggccgggctccagcgggccttggagattctgcaggaggaagacctgatcgatgaagacgacatcccagtgcggtctttttttccagaaaactggctgtggcgtgtcgaaacagtcgatcgattccagatcctcactctttggctaccggactccctcacgacttgggagattcacgggttatccctcagtaaaaccaaaggcctctgcgtggctactcctgtacagctcagagtattccgggaattccacctccatttgcgtctgccaatgagcgtccggaggtttgagcagctggaattgcggcctgttctctacaactacctggacaaaaacctcaccgttagcgtgcacgtgagccctgtagagggtctgtgcttggctggaggaggcggcctagcgcagcaggtgctggtaccggccggaagtgcccggcctgtggcattctcagtcgtccccaccgctgcagccgccgtgtcccttaaagttgtagctcggggaagctttgaattccccgtgggcgatgctgtgtccaaagtattgcagatcgagaaggagggggctatccacagagaggaactggtatacgagctgaacccgcttgaccacagagggaggacacttgagatcccagggaattcagatccgaatatgattcccgacggcgacttcaatagctacgtgcgagtcactgcctccgatcctctggacacgctcggttcagagggggccctgagtcctggtggtgtggctagcctgctcagactgcctaggggctgcggagaacagacaatgatatacctggcccctaccctggcagcctcaaggtacctggataagacagagcagtggagtacactgcctcccgagaccaaagaccacgccgtggatctgatccagaagggatacatgaggatacagcagtttcgtaaagctgacggcagttatgccgcgtggctgtctcgggattctagcacttggctgactgcctttgtcttgaaggtccttagtcttgcgcaggagcaggtgggtggaagtcctgagaaactccaggaaacgagtaactggttactgagtcagcagcaggcggatggatcattccaggatccttgcccggtcctggatcggagtatgcaggggggcttagtgggcaacgatgaaacagtggcacttaccgcctttgtgaccatagcacttcatcacgggctggctgtcttccaggacgagggagccgaacccttgaaacagcgagtggaagcctcaatttctaaggccaactcatttctgggcgaaaaggcatctgctgggctgctgggcgcccacgccgctgccattacagcctatgccctcacactgacaaaggctcccgtcgacctgctgggagtggcacataacaacctgatggcaatggctcaggagaccggcgacaacctttactggggtagcgtgacaggatcacagagtaatgctgtcagccctacaccggctccaaggaaccccagcgacccaatgccccaggctccggccctttggattgagacaactgcatacgcgcttttgcacctgctcctgcacgaaggaaaggctgaaatggctgatcaggccgcggcatggctgactcgacagggatcttttcagggagggtttagatctacccaagacaccgtgatcgctctggatgctttatccgcctattggattgcttcacatacaaccgaggaaaggggcctaaacgtaacgcttagttctaccgggcgaaacggttttaaaagccatgccctgcaactgaacaatcggcagattcgcggactggaggaggagctgcaattttctctggggtctaagatcaacgtcaaggtgggagggaattcaaagggcacattaaaggtcctccggacatataatgtgctcgatatgaaaaatacgacatgtcaggaccttcagattgaagtcaccgtcaagggacatgtggaatacactatggaggctaacgaagattacgaagattacgaatacgacgagctaccagccaaagacgatccagacgctccactgcaacccgtcactccgctgcaattgtttgaggggcggcggaaccgcagacggcgcgaggctccgaaattgacctcactctcagacaggtatgtgtcacacttcgagacggaggggccccatgtgttactgtacttcgattccgtccctacgtctcgggagtgcgttggcttcgaagcagttcaggaagtgcctgtcggcctggtgcaaccagcttctgccactctgtacgactattacaatccggaaaggcggtgctccgtcttttatggggcaccttcaaagagtcgcctcttggccacgctgtgcagtgcggaagtgtgtcaatgtgccgagggaaagtgtccacgccaacggcgggcactggagcgggggctgcaggatgaggacggctaccgcatgaaatttgcgtgctattatcctcgcgtggagtacggctttcaagtgaaggtgctacgggaggattcccgagccgcatttcgactcttcgagaccaagattacccaggttcttcacttcactaaagacgttaaagcagctgctaaccagatgcgcaactttctggttcgggcctcgtgtcgacttagactggagccaggtaaagaatatctcatcatgggtttggacggagcaacatacgatttagaaggtcaccctcagtacctccttgacagcaattcctggatcgaggagatgcctagcgagcgcctgtgtcgcagcacgagacaaagagccgcatgcgcccagttgaacgattttctgcaggaatacgggacacagggatgccaggtgtag

SEQ ID NO: 112871 - DNA, 1536 bp, Artificial Sequence
  Description of Artificial Sequence: Synthetic coding sequence
atggctaaggggctgagcgtgcaaaacgacaagcaccccggatatcagcccgcgctcctgctttcccctggggccccactgtttgctgatgggcctgcttatgccttgttacacctactgctgcatgaagggaaagccgagatggccgatcaggcagctgcttggttgactcggcaggggagctttcagggagggttccggtccacacaggatacagtcattgcgcttgacgccctgtccgcctactggattgcgtcacacaccaccgaagagaggggcctcaatgtgactctgtcctccaccggacgcaatgggttcaaatcccatgcactccaacttaacaacaggcaaatacgggggctagaggaagagctgcagtttagcctaggctccaaaatcaatgtgaaggtcggcgggaattctaagggcactctgaaggtactcagaacctacaatgtgcttgacatgaaaaatacgacctgccaggacctccagattgaggtgaccgtgaaaggtcatgtcgaatatacgatggaagctaatgaagactacgaggactacgagtatgacgagcttccggccaaggacgaccctgatgctccactgcaaccagttactcccctccagttgttcgaggggaggcgcaatcgcagacgccgtgaggctcccaaggtggtggaggagcaggaaagtagggttcactacacagtctgcatatggagaaatgggaaggtggggctgagcgggatggctatcgctgacgtgactctgctgtccgggtttcacgcacttagggcggatctggagaagttgacttccctcagcgatcgctacgtaagtcactttgagaccgagggaccccatgtgctattgtacttcgatagcgtcccaacgtcaagggaatgtgtcggcttcgaggccgtccaagaagtgcccgtcgggctagtgcagcctgcatccgcaacactatacgactattacaaccccgaacggagatgttccgtcttctacggcgcccccagtaagtcccggctcctggcaacattgtgctccgccgaagtgtgccagtgcgccgaggggaagtgccctaggcagcgcagagctctcgagcgaggtctccaggacgaggacggctatcggatgaaatttgcgtgttattatccccgggtcgagtacggttttcaggtgaaggtgctgcgagaggatagcagggcagcattcaggctgtttgaaactaagatcacacaggtcctgcattttacaaaagacgtgaaggcagcagcaaaccaaatgcgaaattttctggtccgcgcctcgtgccgcctccggctcgaacctgggaaggaatacctaatcatgggcttggatggcgccacctacgacctcgaggggcatccccaatacctgctggacagtaacagctggatcgaggaaatgccctctgagcggttgtgtcgaagtacacgccagagggccgcctgcgcccaactcaacgacttcctgcaggagtacggcactcaaggctgtcaggtctag

SEQ ID NO: 112872 - DNA, 5097 bp, Artificial Sequence
  Description of Artificial Sequence: Synthetic coding sequence
atgcgtcttctatggggactgatatgggctagcagtttcttcaccctgagcctgcagaaacctcgactcctgctcttttctccgtcagtagtgcacctgggggtcccccttagcgtcggtgtgcaattacaggatgttccccggggacaggtggtcaaggggagcgtgttccttcgcaatccgtcacgtaataatgtcccttgtagtccaaaagtggactttacccttagctccgaaagagacttcgctctgctaagcctacaggtacccctaaaggatgccaaatcatgcggccttcatcagctgttaagggggccagaagttcagctcgtcgcgcactcaccctggctcaaagactccctgtccagaaccaccaacattcagggcattaatttgctcttttcctctcggaggggccacctgtttctgcagacagaccagcctatctataacccaggtcagcgcgtacggtacagggtgtttgctctcgaccagaagatgagaccttctaccgacacaattaccgttatggtggaaaatagtcatggtctccgggtgagaaaaaaggaagtctacatgccgtccagtatctttcaagacgatttcgtgatccccgatatctccgaacctggcacatggaagatcagcgctaggttcagcgatggcctggagagcaactccagcacacagttcgaggtcaaaaagtatgtgcttccaaactttgaagtcaagatcacgccaggaaaaccttacatacttacagttccaggccatctggatgaaatgcagctcgacattcaagccagatatatctatgggaagccagtgcagggagtcgcctacgtcagatttggtctgctggacgaagatggtaagaaaacattctttcgggggctggaaagtcagaccaaactggtgaacggccagtcccatattagcctgagtaaggcagagttccaggatgctctggaaaaactgaacatgggcatcacagacttgcaaggcctgagattgtatgtcgccgctgccattatcgagagtcccggcggtgagatggaggaagccgaactcactagctggtactttgtttctagccccttctccttggatctgagtaaaacgaaacgacacctggtgcccggagccccattcttgctgcaagccctggtccgggaaatgtccggatctcccgcttccggcataccggttaaggtgtccgccacggtctcctcccccggatcagtccctgaggttcaggacatccaacaaaacacagatgggtcgggacaggtgtccattcccattataataccgcagaccatcagtgaactgcagctcagcgtgagtgcaggaagcccacacccagctatagcacggctgacggttgctgctcccccctctggagggcctggcttcctctcgatagagcgaccggacagccgaccacctagggtgggcgatactctgaacttgaatttgagggcagtggggtctggcgcgaccttcagccattattattacatgattttaagtagggggcaaatcgtctttatgaacagggagcctaaaaggaccctcacctccgtgagtgtttttgttgaccatcatctggcgcctagtttctacttcgttgcgttctactaccacggcgatcaccccgtggctaactcattgcgggtggatgtgcaggccggtgcctgcgaaggcaagctagagctctcggtagatggtgccaagcagtataggaatggcgaatcggtaaaactgcacttggagaccgactcacttgcactggtcgcactaggagcgctggatacagctctgtacgccgccggtagcaagagccacaagcccctgaatatgggtaaagtgtttgaggcgatgaattcttatgacctggggtgcggcccaggtggaggtgacagcgcgcttcaggtcttccaggccgctgggcttgcgttttctgatggggaccaatggaccctgagcaggaaacgactgagctgtcccaaagaaaaaacaacgaggaagaagagaaacgtgaactttcaaaaggccatcaatgagaagctgggtcaatacgcctcccccacagccaaacggtgctgccaggacggagtgactcgactccccatgatgagatcctgcgaacagagggcggcacgcgtccagcaaccagactgtagggaaccattcctctcttgttgtcaatttgccgaatctttacggaagaaatccagagacaagggccaagctgggcttcagagagcgctggaaatcctgcaggaagaggatctcatagacgaagatgacattcccgtgcggtcattttttcctgaaaactggctctggagagtggaaactgtcgatcggttccagattctcactttgtggctgcccgattcgctcactacctgggaaattcatggcctgtcgttgtctaagacaaaggggctttgtgttgctactccagtgcagcttcgcgtttttcgggagtttcatcttcatctgagactgccgatgagcgtgcgcagatttgagcagttggaattaagacccgtcctgtataactacctggataaaaacctgactgtctcagtgcatgtgagcccagtggaaggcttgtgcctggccgggggtggcggcctggctcagcaggttttggtaccagcggggtccgcacgtcctgtagcgttcagcgtggtgcccaccgccgccgcagcagttagcctgaaagttgttgctaggggatcattcgaatttcccgtgggggacgccgtttccaaggtgctgcagatcgagaaggagggggcgatacacagagaagagctagtgtatgaacttaatccattggaccatcggggacgtactcttgagatcccgggaaattcagatccgaacatgattccggacggcgactttaacagctatgtgagggtgacagcttcagaccctctggataccttgggatctgaaggggcactgtcgcctggaggagttgcctccctcctccgccttcccaggggctgcggagaacaaaccatgatatacctggctcctactttggcagcaagcagatatctggataagaccgagcagtggagcaccctgccccccgagacgaaagaccacgcagtcgacctgatccaaaaaggatacatgaggattcagcagtttcggaaagctgatggatcatatgcagcatggctctcccgggacagctcaacctggctaacagcctttgtcctcaaggtgctaagtctggcacaggagcaggtcggaggctctcctgagaaattgcaggagacgtcaaactggctgttatcccagcagcaagcggacggctccttccaggacccctgccccgtgcttgaccgatctatgcagggtggcttggtgggtaatgacgagactgtggccttgacagctttcgtaacgattgctctacaccatggtttagctgtgttccaggatgaaggcgctgaacctctgaaacagagagtggaggccagtattagcaaagcgtcaagcttccttggcgaaaaagcttccgctgggctcctgggagcccatgctgcggcaattactgcatacgcgctaactttgaccaaagcccctgtggatctgcttggggttgcgcataacaatctgatggcgatggctcaggaaacaggggataatctgtattgggggtccgtaactggctctcagtcaaatgccgtgagtcccacccccgccccccgcaatccctccgaccctatgccccaggcacccgccctctggatcgagaccaccgcctacgccctgctgcatctgctgctacatgaaggcaaggctgaaatggccgaccaagcagctgcatggttgacaagacaggggagcttccaggggggctttaggagtactcaagatacagttattgcccttgacgcattgtctgcatattggatcgcatcacacacgaccgaagaacggggactgaacgtgacgctatctagcaccggcaggaacggattcaaaagtcatgccctccagctgaataaccgtcagattcgtggccttgaggaggaactccagttctctctggggagcaaaattaacgtgaaggtcggcggaaactcaaaggggacactgaaagtgctcaggacttacaacgtgctggacatgaagaacacaacttgccaggacttgcaaatcgaagtcactgtcaaggggcacgtggagtacaccatggaagcgaatgaagactacgaggactatgagtacgacgagctccctgctaaggacgatccagatgccccactgcaaccagttacccccctgcagttgtttgaaggccggcggaataggcgacgacgggaggcgccaaaattaacttccctgtcagatagatatgtcagccatttcgagactgaggggccacatgtgttgctttattttgacagtgtgcccacctcacgggagtgtgtcgggttcgaggccgtgcaggaagtgcctgtgggcctggtccaaccagcctccgcaacactgtacgactactataatccagaacgcaggtgctctgtcttttacggcgctcccagtaagtcacgccttctcgcgacactgtgttctgcagaagtgtgtcagtgcgctgaaggaaagtgccctcgacagcggcgcgctctcgagcgggggcttcaggacgaagacggttacaggatgaagttcgcatgttattatccgagggtagagtatggcttccaggtgaaggtgttaagagaagactctagagccgcattcagactgtttgagaccaagataacacaggttctgcatttcaccaaggatgtgaaagctgccgccaaccagatgaggaatttcctggttcgggcctcatgtcggttgaggctggaacccggcaaagagtatcttataatggggctcgatggtgccacttatgatcttgagggccacccccagtacctattagatagtaactcttggatcgaggagatgccctctgagaggctgtgtcggtcaacacgacaacgggcggcctgcgcccagctcaatgatttcctgcaagagtacggcactcaggggtgccaggtctag

SEQ ID NO: 112873 - DNA, 5097 bp, Artificial Sequence
  Description of Artificial Sequence: Synthetic coding sequence
atgaggctgctatggggccttatctgggcctctagcttttttactctgtcattgcagaaaccccgtctcttgctgttttctccatctgtggttcacctgggagttccactctctgtcggcgtgcagctgcaggatgtgcctagagggcaagtggtgaagggctcagtgttcctcagaaatccttcccggaataacgtcccctgctccccaaaagtggatttcaccctgagctccgagagggattttgccttgctgtccctgcaggtccctcttaaagatgcgaagtcttgcggcctgcatcagttactccgcggccccgaggtgcagcttgtggcgcactctccatggcttaaggattcactaagccgaactaccaacatccaagggattaatctgctgttttcgagtcggagggggcacttgtttctgcaaacagatcagccgatctataaccccggccagcgcgtccgttatagagtattcgcattggatcagaagatgaggccgagtacagataccatcacggtgatggtggagaacagccatggattacgcgtccgaaagaaggaagtctatatgcctagctctatctttcaggatgatttcgtcatccccgacattagcgaaccggggacttggaagatcagtgctcggttttcggacggcctagaaagcaacagttccacccagttcgaagtaaagaagtacgtgctgccaaatttcgaagtcaaaatcacaccagggaagccgtacatcttgacagttcctgggcatctggatgaaatgcagctcgacatccaggctaggtatatctacgggaaacctgtccaaggggtggcttatgtgcgcttcggactactggacgaggacggcaaaaagactttctttaggggactcgaaagccagacaaaactggtgaacggccaaagccacatctcgctttccaaggccgaattccaggatgcattggagaaattgaatatggggatcactgatctccagggactgcgactgtacgtcgccgcagcaattattgagtacccaggaggcgagatggaggaggcagagttgactagttggtactttgtgagcagtccctttagcctcgatttgagcaagaccaaaaggcatctggtgccaggggccccctttcttctccaagctctcgtgcgagagatgtctggttctccagcctctggaatcccggtcaaagtcagcgcaaccgtgtccagccctggttctgtgccagaagtgcaggatattcagcagaataccgatgggtcaggccaggtatcaatacccatcattatcccccagaccattagtgaactccaactgagcgtcagtgccggatctccccaccccgctatcgcacgcctcactgtcgccgctcctccaagcggcgggccagggtttctctctattgaaaggccagattcccggcctcccagggttggagatactctcaacctgaatcttagagctgtaggctccggggccactttctctcattactactacatgatcctttcccgaggacagatcgtgttcatgaaccgcgagccgaagaggaccttgacgtcagtgagcgtgtttgtggaccaccatctggcaccttcattttattttgtggcattctattatcatggggatcaccccgtggctaattcactgagggtcgacgtccaggctggcgcttgcgaggggaagctcgagcttagtgtagacggcgccaaacaatacagaaatggcgagagtgtgaaactgcatctggaaactgactccctggccctcgtagctcttggcgccctggatactgctctgtacgcggctgggagcaaatcccataagcccctgaacatgggaaaagtgtttgaggccatgaattcatatgatttgggctgcggaccggggggaggagattccgctctgcaggtgttccaggcagcaggtctcgccttcagtgacggggaccagtggacattaagccggaagaggttgagttgccctaaagaaaaaacaacgcgcaaaaaacgtaatgtgaattttcaaaaagctataaacgaaaagttaggacagtacgcttcgcccacagccaaacgttgctgccaggacggcgtcactcggctgccaatgatgaggtcttgcgagcagagagccgcacgcgtccaacaacccgactgtagagagcccttcctgtcgtgttgccagtttgccgagtcactgaggaagaaaagccgagacaaagggcaggcaggcctgcagagggctctggaaatcctgcaggaagaagacctcatcgacgaggatgacattccggttcgtagtttcttccccgaaaactggttgtggcgcgtcgaaactgttgaccgctttcagattctgaccctgtggctaccagacagtcttaccacttgggaaatccacgggttatccctgtctaagacaaaggggctatgcgtggccaccccggtccaactccgagtttttagagaatttcatcttcatttgcggctgccaatgtcagtgcgaagatttgagcaactcgagctgcggccagtcctgtataactaccttgataaaaacttgactgtatctgtgcacgtgtctcctgtcgaggggttgtgtctggctggaggcggcggtctggcccagcaagtactggtacccgccggcagcgcccggccggtggccttttctgtcgtgcccaccgctgcggcggccgtttcgctaaaggtcgttgcccgtggctcttttgagtttccagttggggatgcggtgagtaaggtcctgcagattgagaaagagggggcaattcatcgtgaggaactcgtgtatgaacttaatccgctcgaccatagaggccggacgttagagatcccaggaaactctgatcccaacatgatcccggatggagatttcaattcatatgtccgggtaaccgcaagtgacccactggacacccttggctccgaaggcgcgctgagccctggaggagtggcgtccctgcttagactaccaagagggtgtggagaacagacaatgatatacctcgctcctacgctggctgcatcgcgctacctcgacaagacggagcagtggagtaccttgccccccgaaactaaggaccatgcagtggatcttatacaaaaaggctatatgcgaatccagcaattcaggaaagctgacggttcttacgccgcctggctcagcagggactcctccacctggctgaccgccttcgtactgaaggtcctgtcactcgcacaggagcaggttggcggcagccccgaaaagctgcaggagaccagcaattggctccttagccaacagcaggccgacggaagtttccaagacccctgtcccgtgctggaccgctcaatgcaaggggggttggtggggaacgacgagaccgtcgcactcactgcctttgtcactattgctctccaccacggactcgcagtcttccaggatgaaggcgcagagccactaaagcagagagtcgaagcgtctatctctaaggctaattccttcctgggggaaaaggccagcgcgggcctgctgggtgctcacgctgcagctataaccgcttatgcattgacccttacaaaggctcccgtggatctactgggagttgcccataataatctgatggccatggctcaggagaccggggacaacctatattggggtagcgtgacagggtcacagtccaacgccgtatcacctacacccgctccgcgcaacccttccgaccccatgccccaggcacctgctctgtggatcgagacgaccgcctacgcattgcttcatcttttgttgcacgaaggtaaagcagaaatggcagaccaagccgcagcctggctgaccaggcaagggtccttccagggaggatttcgatctacccaagatacagtcattgcactggacgcattgtctgcctactggatcgccagccacactacggaagaaagggggctgaatgtgacactttctagtacaggcagaaacgggtttaagagtcatgcattgcaactaaacaacaggcagataagaggcctcgaggaggaactacagtttagtttaggatctaagataaacgtaaaggtaggcggcaactccaagggcacactgaaagttctccggacatacaacgttctggatatgaagaatacaacatgtcaagacctgcaaatagaggtgaccgtcaaaggccacgtggagtacacgatggaggccaatgaagattacgaagactacgagtacgacgaactgcctgcaaaggatgacccagatgctcccctccaaccggtgacacccctgcagctgttcgaggggcgccggaacaggcgtagaagagaggcaccaaagcttacaagcctaagcgaccggtatgtcagccacttcgagaccgaggggcctcatgtcctcctttacttcgacagcgtccccacatcacgcgagtgcgtgggtttcgaagcagttcaggaggtgccagtcggcctggttcagcccgcctctgccactctctacgattactacaatcctgaaaggcgatgctcagtgttctatggtgctccgtccaagagccggcttcttgctactctgtgttcagcagaggtctgtcagtgcgccgaaggaaagtgtcctcgacaacgtcgcgccctggaacggggactgcaggatgaggacggttaccgtatgaagttcgcttgttattaccctcgcgtggagtacggtttccaagtcaaggtcctgcgggaagactcgcgggctgcctttcgtctgttcgaaacgaaaattacgcaggtgctacatttcactaaggatgtgaaagccgctgctaatcaaatgcggaacttccttgtccgcgcctcctgtcgcctgagactggaaccaggaaaagagtatctgatcatgggcctcgacggagccacatatgatctggaagggcacccacagtacctgctcgactccaactcttggatcgaagagatgccaagcgagcgcctctgccgctctactcggcaaagggccgcttgcgcccagctcaacgatttccttcaggaatatggcacccaggggtgtcaggtctag

SEQ ID NO: 112874 - DNA, 1536 bp, Artificial Sequence
  Description of Artificial Sequence: Synthetic coding sequence
atggcaaaaggcctgagtgtgcaaaacgataaacaccctggttaccagcctgctctgctgttgtctccaggagcccctctgttcgctgacggaccagcctacgctttgcttcacctgctactgcatgaaggaaaggcggagatggctgatcaggcagccgcttggcttactcgtcagggaagcttccagggtgggttcaggagcacccaggacacggtcatcgctctggacgcactgagcgcttattggatcgcctctcacacaacggaggagcgaggccttaacgtgactcttagtagcaccggtcgcaacggctttaagagccacgcactgcagcttaataatcgccaaatcaggggcctggaggaagaactccagttttccctaggtagtaagatcaatgtcaaggtgggaggaaattccaaaggaacacttaaggtactgaggacctataatgtgctcgacatgaaaaacaccacatgccaggatctgcagatcgaagtgacagttaagggacatgtggaatatactatggaggcaaacgaggattatgaggattatgaatatgacgagctcccagccaaggatgatcccgatgccccccttcaaccagtgaccccactccaacttttcgagggtaggcggaaccgcaggaggagagaggcgcccaaagtcgtcgaggaacaggaaagcagggtgcactacaccgtgtgcatttggagaaacggcaaggtaggattgtccggaatggctattgcagacgttaccttgctcagtggcttccacgcgctacgagctgacctggaaaagctgaccagcctctctgaccggtacgtgagtcacttcgaaacagaaggaccacatgtgctcttatatttcgactcagtccccacctctcgggaatgtgtcggattcgaggcggtgcaagaggtgcccgtcgggctcgtgcagccagctagcgcaacgttgtacgattattacaaccccgagaggcgatgctccgtattctacggcgcgccatctaagtccagattgttggccacactatgtagcgccgaggtgtgccagtgtgccgagggaaagtgtccccggcagagaagggcacttgagcgcggtttgcaggatgaggatgggtaccgcatgaagttcgcatgctactatccgagagttgagtatggcttccaggttaaggtgctgagggaagactcaagagctgccttccgattgtttgaaactaaaattacacaggtgctgcatttcacaaaggacgtaaaggccgcagcaaaccagatgcgaaactttctagtccgagccagctgcaggctgagactggaacccggtaaggaatacctgataatgggcctagatggtgccacgtacgatctggagggccacccacagtatctgttggattcaaattcctggatcgaggaaatgcctagtgaacggttatgcagatctactaggcagagagctgcatgcgcccaactgaatgatttcttgcaagagtacggtactcagggatgccaagtgtag

SEQ ID NO: 112875 - DNA, 813 bp, Artificial Sequence
  Description of Artificial Sequence: Synthetic coding sequence
atgtgtcccgaagacagcctgcaggtgcccctgaaagatgcaaagagttgtggcttgcaccagcttcttcgggggccagaggtgcagctggtggcacacagcccttggttgaaagattcactgtcacgaacaaccaatattcaaggaatcaaccttctgttcagttcccgccgcggccatttgtttctgcaaactgaccagcccatttataatcctggccaaagggttagataccgggtctttgccctagatcagaaaatgcgaccttccaccgacactataaccgtgatggtcgagaactctcacggattacgcgtgcggaagaaggaggtctatatgccctcctctatctttcaggatgactttgtgatcccagatatttccgagcccgggacatggaagatcagcgctcgtttcagcgatggactggagtccaatagctccactcagtttgaggttaagaaatacgttctcccaaacttcgaggtgaagatcacacccggcaagccttacatccttaccgtgcccggacacctcgacgaaatgcagctcgacatccaggccaggtacatctatggtaagcctgttcagggggtggcctacgtacggtttgggctcctcgatgaggatggaaagaaaacgttctttcgcgggctggagtcccagactaagcttgtcaatggacagtcccatatttccctgagcaaagcagagtttcaggacgcgctcgagaagcttaacatgggcatcactgatctccaggggctgcgattatacgtcgccgctgcgattatagagtaccccggggggtag

SEQ ID NO: 112876 - DNA, 5235 bp, Artificial Sequence
  Description of Artificial Sequence: Synthetic coding sequence
atgagactcctgtggggtcttatttgggcatcctccttctttactctgagcctgcagaagccccgtctacttctgttctcccctagcgtggtgcatctcggcgtgcctctatccgtgggtgtgcagctccaggacgtacctagaggtcaggtggtaaagggctcagtatttctcaggaacccaagccggaacaatgtgccttgctccccaaaagtggacttcaccttgagtagtgaaagagatttcgctctgctgagcctgcaggtcccgctgaaggacgctaagtcttgtgggctgcatcaactccttcgcggacctgaagtgcagctggtggcccattcgccatggctgaaggacagcctgagcagaaccaccaatattcaggggatcaacttgctcttctcttcgaggcgcggacatctttttctgcagacagaccaacccatctataaccctggccagagagtcaggtacagagtatttgctctcgaccagaagatgaggccgtccacggacactatcaccgtgatggtggagaattctcatgggctacgggtaagaaagaaggaagtttacatgcctagctctattttccaggatgactttgtcatccccgatatttctgagcccggaacttggaagatcagtgcgcggttcagcgacggcctggagagtaattcctccacccagtttgaagtaaagaagtatgtcctgcctaactttgaggtgaagatcacgcccggaaagccgtatattcttactgtcccaggacatttagacgagatgcagctggatatccaagctaggtatatctatggcaagcccgtgcagggtgtcgcttatgtcaggttcggtctgctggatgaggatggcaagaaaacgttttttcgcggtctggagagtcagactaagttggtcaatgggcagtcccacataagtctgagcaaagctgaattccaggatgccctagagaagctgaatatgggtatcactgacttgcaaggattaagactatatgtggccgccgccatcatagaatctcccggcggtgaaatggaggaggccgagctgaccagctggtacttcgtaagttccccattctccttagacctctccaagacgaaacgccatctggtaccaggtgctccattcctcttgcaggcccttgtccgggaaatgagtggaagcccagcctccgggattcccgtgaaggtttcagctacggtgtccagccccggttccgtgcccgaggtccaggatatccaacaaaatacagacggcagtggacaggtgtcaattcccattatcatacctcaaacaatctctgaacttcaattgtccgtgtctgcaggctcacctcaccctgctatcgcgcgcttgacggtggctgcaccaccctccggaggtcctgggttcctcagtatcgagcggcctgatagccgacctccacgcgtgggcgatacacttaatctaaatcttagagctgtgggatcaggcgccacattctctcactactactacatgatcttgtcccgcggccagatcgtattcatgaatagggaaccgaagcggacacttacaagcgtctcggtctttgtcgaccaccatctggctccttctttttactttgtggcattctattatcacggcgaccacccagttgcaaactccttgcgagtggatgtccaggcaggggcctgcgaggggaaactggagctgtccgtggatggggctaaacagtatagaaacggggagagtgtgaagctgcatttagaaacagactctctggccctggtcgccctgggggcactagacacagccttgtacgctgcaggctccaaaagtcacaagcccctcaatatggggaaagtgttcgaagccatgaattcctatgacctcggatgcgggcccggtggtggggattccgccctccaggtgttccaagccgccggccttgctttctcagatggagaccagtggactttgtctcgaaaaaggctttcctgtccaaaagagaagaccacacgcaaaaaacgtaatgttaacttccaaaaggctatcaacgagaagttggggcagtatgcaagccccacagccaaaagatgttgccaagatggcgtaactagactccccatgatgcgcagttgtgagcagcgtgctgccagggtgcagcagcccgattgtcgcgaaccatttttgtcctgttgtcagtttgccgaatcgctgcgaaagaagtcgagggacaaaggacaagcgggcctccagcgtgcactggagatcttgcaagaggaggatttgatagacgaagacgatatccccgtccggtcattctttcccgaaaactggttgtggcgtgtggagaccgtggatcgctttcagatccttactctgtggctgcctgatagcctaacaacctgggaaatccacggcttgagcctttctaagaccaaaggcctgtgcgttgccacccctgtccagctgagagtgttccgtgaattccacctccacttgcgcctaccaatgtccgtgaggaggttcgaacagctggaattgaggccagtactctacaactacctggataagaatctgacggtgtcggtgcacgtctctccagttgagggactctgcctggctggcggcggcggcctggcccagcaggtgctggtgcccgctggatctgcccgccccgtggccttctccgtggtcccaaccgccgcaactgccgtttcattaaaagtggtagcccgcggtagttttgagttccccgtgggggatgccgtctcgaaagtcctgcagattgagaaggagggagcgatccatagggaggagttggtttatgaattaaatccattggaccaccgcggtagaactctggagatcccaggaaactcagaccctaacatgatcccagatggggactttaatagctatgtgcgcgtgacagcttcagaccctctagacacactcggaagcgagggcgcactttctcccggaggcgtggcatctcttctccgactcccacgcgggtgcggcgaacagacgatgatctacctggcacctactctcgcagcctctagatacctggataagactgaacagtggagcacattgccacctgagactaaggatcacgcggtggacctgatccagaaaggttacatgcgcatacaacagttcaggaaagccgatggatcttatgcggcttggctgtcgcggggaagttccacgtggctaaccgctttcgttctcaaagtgctgtccctggcccaggaacaggtaggaggaagtcccgaaaagttgcaggagacaagcaactggctcctctcccagcaacaggccgatggctccttccaggacttatctcccgtgattcaccgatcaatgcagggggggctggttggaaacgatgagaccgtggcactcacagcctttgtcacaatcgctctgcaccacggccttgcagtgtttcaggacgagggggcagagcctctcaaacagcgcgttgaggcctcgatctctaaggcgtccagtttcctgggcgagaaagcatccgccggactgttgggggcccacgcggcagccatcaccgcgtacgctctgacgttgactaaggcacctgccgatctccgcggcgttgcccataacaacttaatggccatggcccaggagaccggcgataatctgtactgggggtcggtcactggctcccagagcaacgccgtttcccccacacccgctcctagaaatccctctgatcctatgcctcaggccccagccttgtggatagagactaccgcttatgcccttctgcacctactgttacacgaaggcaaggctgaaatggctgatcaagcagctgcatggcttacacgacagggtagttttcagggcgggttccgcagtactcaggataccgtcattgccctggatgccctgtccgcatattggatcgccagccatactacagaggaaaggggactcaatgttactttatcaagcaccgggcgcaacggcttcaagagccacgctctgcagctgaacaatcgacagataagaggattggaggaagagttgcagttctctcttgggagcaaaattaacgtgaaagtgggaggcaatagcaaaggcaccttaaaagtgttgcgtacctacaacgttctcgacatgaagaacacaacgtgtcaggatctgcagattgaggttaccgtcaaaggccatgtcgagtatacaatggaggcaaacgaagattacgaagactacgaatatgatgagttgccagcaaaagacgaccccgacgcgcccctgcaacccgttactccactgcaactttttgaaggcaggcggaatcgccgccggagggaagcacctaaggttgtggaggagcaggaatccagggttcactataccgtgtgcatctggaggaacgggaaagtcggactctcaggcatggccatcgcagatgtgaccctgctgagtgggtttcacgcgcttagggccgatttggaaaagttaacatctctgtcagaccgctacgtctcccattttgagaccgaggggcctcacgttctgctgtacttcgacagcgtaccgacatcccgtgagtgtgtcggtttcgaggccgtgcaggaagtacctgtgggcctcgttcaacccgccagcgccaccttgtatgattattacaaccctgagcgccgatgttcagtcttttatggcgctccttctaagtcccgactgttggccacgctttgttcagcagaggtatgccagtgtgcagaggggaagtgtccccgccaaaggagggcccttgaaaggggccttcaggacgaggacggctaccggatgaagttcgcatgctactacccccgagtggagtacggtttccaagtgaaggtgctccgggaagatagcagagcagcgttccggttgtttgagaccaagatcactcaggtgctccactttactaaggatgttaaagccgccgccaatcagatgagaaattttctcgtgcgcgcatcctgtagactgagattagaaccaggaaaggagtacttgatcatgggactcgacggagctacatacgacctagaaggccatcctcagtatcttctggactccaactcatggatcgaggaaatgccttcggagcgcctgtgccggtcaactagacagcgcgccgcatgcgcacaactaaatgactttttgcaagaatacggcacccaaggatgtcaggtttag

SEQ ID NO: 112877 - DNA, 5097 bp, Artificial Sequence
  Description of Artificial Sequence: Synthetic coding sequence
atgcgtctactgtggggcctgatctgggcgagcagcttctttaccctgtcgctgcagaagcctcggctgctattgttttccccttcggtggtccatctcggagtaccactgtccgtcggggtgcagctacaggacgtgccacgcggccaagtagtgaagggatccgtgtttctgagaaaccctagtcgcaataatgtgccttgctcaccaaaagtagattttactctttcctcagaacgcgacttcgcgctgctttccctccaagtgcctttgaaggatgcgaagagttgcggtttacatcagttgttaaggggcccagaggtgcagctcgtggcccactctccatggttgaaggactcactgtctaggaccaccaacatccagggcatcaacttattgttttcgtctagacgcggacacctgttcctgcagaccgaccagcctatttacaaccccggccagcgcgtgcgatatcgagtcttcgctctggatcaaaagatgcgcccttcaacagacacaatcaccgtcatggtggagaatagtcacgggcttagagtgaggaaaaaggaagtctacatgccctcatccatctttcaagacgactttgttattccagatatctcagaacctggcacctggaagatttccgctagattctctgatggactcgaatcaaatagttcgacacagttcgaggtaaagaagtacgtgttgccaaactttgaagttaagatcacgccaggcaaaccttacatccttacagttccaggacacctggatgaaatgcagttagatatacaggctagatatatttacgggaaaccggtgcagggagttgcatacgttaggttcggccttcttgacgaagacggcaaaaaaaccttctttaggggcctggagtcacagaccaagctagtgaatgggcagtcccacatcagtctgagcaaagcggagtttcaggacgctttggagaaattaaacatgggtatcactgacctgcagggcttacgcttgtacgtagccgccgctattatcgagagcccagggggcgagatggaagaggccgagctgacaagttggtattttgtctcctcccctttttcacttgacctgtctaagaccaagcggcacctggtcccaggggctccttttctgctccaagcactggtaagggagatgtctgggtccccagcatcaggtattcctgtaaaggtttccgccacagtgtcatcaccgggctcagtgcctgaggttcaggatatccagcagaacacggatggaagcggtcaggtgagcatcccgatcataattccccagacaataagcgagctgcagctgtctgtcagcgcagggtctcctcatcccgccatagcccgtctgacggttgccgcaccaccctcaggaggtcctggcttcctatccattgaaagacccgattccagaccacctcgggtgggggatacgctgaatttgaaccttcgagccgtgggaagtggggcaacgtttagtcactactattacatgattctcagcagagggcagatagtgtttatgaaccgcgagccgaagcgaacactgacatccgtgtcagttttcgtggatcaccatctggctccctccttctactttgtggcgttttattaccacggggaccacccggtcgcgaattcactaagggtggacgtgcaggctggagcatgtgaagggaaactcgagctgtccgtcgatggtgcgaagcaataccgcaatggagaaagcgtcaagctacacctcgaaacagactctttagccctagtcgccctcggggccctggatacagctctatatgctgcaggaagcaagtcacataagccacttaatatgggaaaagtgttcgaagcaatgaacagttatgatcttggctgtgggccaggtggcggcgactcggccttacaggtatttcaagctgccggtctggcttttagcgacggcgaccagtggacattgagcagaaagagattgtcctgtcctaaagagaaaacaacgcgcaagaaaagaaacgtgaacttccagaaagccattaatgagaaactaggccaatacgcgtcccccaccgccaagcggtgttgtcaggacggggtcacacgtcttccaatgatgcgcagctgtgaacaacgggcagcacgagtgcagcagcctgattgccgagagccgtttctctcctgctgtcaatttgcggagagcctacgtaaaaagagccgagataagggacaggccggcctccagagggcgcttgagattctgcaggaggaagacttgatcgacgaagatgacatccctgtgcgcagcttttttcctgagaactggctgtggagagtggagaccgtcgatagattccagatactcactttatggctgcctgacagcctcacaacatgggaaattcatggcctcagcctttcgaagaccaagggcctgtgcgtggccacaccagtgcagctgagagtgttccgcgagtttcatcttcatcttcgactgccgatgagtgtccgcagattcgaacagctggagctcaggcccgtgttatataattatctggataagaatctgacggtctccgtccacgtcagcccggtcgaaggtctgtgtctcgctggaggggggggtctagcccagcaggtgctagtgccggcaggctctgcgagacccgtagcctttagtgtcgtacctacggccgccaccgctgtgagcctgaaagtggtggcgcgcggcagctttgagtttcccgttggggatgctgttagtaaggtgctgcagattgagaaggagggagcaatacatcgtgaggagctggtgtacgaactgaaccctctggatcaccgggggaggacattggagattccaggaaactccgatccaaacatgatccccgacggggatttcaactcgtatgtccgggtcacagcttctgatcctcttgatactctgggtagcgaaggcgcactgtcacccggtggtgtagctagcttgctgaggttgccccgcggatgtggcgagcagactatgatttatctggcgcctacactcgctgccagcagatatctggataagacggaacagtggtcaaccttgccgcccgagaccaaggatcacgctgtggacctgatccagaagggatatatgcgcatacagcagtttcgcaaagcggacggaagctacgcggcgtggctatccagaggctcttccacttggctgactgcatttgtgctgaaggtgctgtctctcgcccaggagcaggtaggcggtagtcctgaaaagctgcaggagactagcaactggctcctgtcacagcagcaggctgacggtagctttcaggatttgtcaccagtgatccacagaagtatgcagggagggcttgttggaaacgacgaaacagtagctcttaccgcattcgttaccattgccttgcaccatggtttggccgtttttcaggacgaaggggcggagccgctgaaacagcgtgttgaagcaagtatcagtaaggcatctagttttcttggggagaaggcctcagccggattactgggcgcccacgcagctgctataactgcctacgctcttacactgactaaagctcccgccgatctcaggggcgttgcccacaacaacctcatggccatggcacaagaaactggcgacaacctgtattggggctcagtcaccggctcacagagtaatgcagtttcccctacccccgcccccaggaatccctcagacccaatgccgcaggcccccgctttgtggatagagacaacagcctatgccctcctccacctgctgcttcacgaggggaaggccgagatggcagatcaggctgctgcttggcttactcgacaaggatcatttcagggaggctttcgctcaacccaggatacagttatcgccctggatgctttgtcagcctattggatagcatctcacaccactgaggaaaggggcctcaacgttaccttgtcttctactggtagaaatggctttaaatctcacgcccttcagttaaacaacaggcagataagggggttggaagaggaattgcagttttctctgggcagtaaaattaacgttaaggtaggtggaaatagtaagggcacgctgaaggtgctgcgtacctataacgtcctcgatatgaaaaacactacatgtcaggatctacaaatcgaggtcaccgtaaagggccatgttgaatacactatggaggcaaacgaagactatgaagactacgagtatgacgagctgccggcaaaggatgaccccgacgcacccctccaaccagtgacccctctgcagctcttcgaggggagaagaaatcggcgccggcgcgaggcccctaagttaactagcctctccgacaggtacgtttctcacttcgaaaccgagggcccacacgtgttattgtactttgattccgtgccaactagtagagaatgcgtgggatttgaggcagtgcaagaagtcccagttggtcttgtgcagcccgcgagcgcaacgctttatgactactataacccagagcggagatgttcagtattttacggcgccccctccaagtctaggctcctggcaactctctgcagtgccgaggtctgccaatgtgctgaagggaaatgtcctagacaaagaagggcattagagcgcggactgcaggacgaggacgggtaccgtatgaaattcgcctgctactacccgagggtcgagtatggatttcaggtaaaggtgttaagagaggatagtagagcggccttccgtctgtttgagactaaaataactcaggtgctgcacttcactaaagacgttaaagccgcagccaaccaaatgcgcaacttccttgttcgggcttcctgtaggctgcggctggagcccggcaaggagtacttaatcatgggtctggacggcgcaacctatgacctggaagggcacccacaatacctcctagactccaattcatggattgaagagatgccctctgagaggctctgcagatctactaggcagcgcgcagcttgcgcacaattaaacgatttcctgcaggaatacgggactcaggggtgtcaagtgtag

SEQ ID NO: 112878 - DNA, 5235 bp, Artificial Sequence
  Description of Artificial Sequence: Synthetic coding sequence
atgcggctattatggggcctgatttgggccagttcatttttcacactgagcttacagaagccgaggctgcttttgttctctccatctgtggtgcatctgggggtgccactgagcgtaggggtccagctgcaggatgtaccaagaggccaggtggttaaggggagcgtattcctgaggaacccttctcggaataatgtgccctgcagtcccaaggtggacttcacactgagcagtgaaagggacttcgcgcttctgtcgctgcaggtgcctttaaaagatgccaagagctgcggcctccaccagctcctacgcggtcctgaagttcagctggtggctcacagcccgtggctaaaagatagcctctccaggactaccaacattcagggcatcaacctcttgttcagttctcggagagggcacctctttctgcagaccgatcagcctatatacaaccctggtcagagagtgcgctacagagtgtttgcccttgaccaaaaaatgcgccccagcaccgacacaattaccgtgatggtggaaaacagccacggcctgcgggtgaggaagaaggaagtctacatgcctagttccattttccaagacgactttgtcatccctgatataagcgaaccgggcacttggaagatctcagctcggttctcagatgggctggagagtaactcctcgacccaatttgaagttaagaaatatgtgcttcccaactttgaggtaaagatcactcctggaaagccatacattcttacagtgccgggccatctcgacgaaatgcagctggacatccaagctcgctatatctatggaaaacccgtccagggcgtcgcttatgtgaggtttggattactcgatgaagacggcaaaaaaaccttcttcaggggcctcgagtcgcagacgaaactggtgaatggacagagccacatatccctgtccaaggctgaattccaggatgctttagagaagttgaatatgggtattactgatctccagggtctgaggctttacgtggccgcggctataatcgagtctccaggcggtgaaatggaagaggccgaacttacaagttggtatttcgtcagcagcccttttagcctggacttatccaaaaccaagagacacctggtgcctggtgcaccttttcttctacaggccctcgtgagagagatgtccggttcccccgcttcggggattccagttaaggtgtccgcaactgtaagctcgcccggatctgttcctgaagtgcaggacatacagcagaataccgacgggtcagggcaggtaagtatccccatcatcatcccgcagactatctccgagcttcaactatcagtgtcagcaggcagcccccaccctgctattgcccgccttaccgtggccgcacccccaagtggtggaccaggcttcctgtcaatcgagaggcctgatagcagaccaccccgcgtcggggatacgttaaatctcaacctccgagccgttggatccggggccactttctcccattactactatatgattctatcccggggccagattgtattcatgaaccgggagccaaagagaacacttacgtctgtatcagtgttcgtggaccaccacttagctccttcattctactttgtggcattttactatcatggagatcacccagtagcgaattccttaagggtcgacgtgcaagcaggagcctgtgaagggaagctggagttatctgttgatggagccaagcaataccgtaatggagaatcagtgaagctccacctcgagactgatagcctggctctcgttgctctgggggccctggacaccgccctgtacgccgccggctcaaaatcacacaagcctttgaatatgggaaaggttttcgaagcaatgaatagctacgatctcggctgcggcccaggaggaggtgactcggctcttcaggtgtttcaggccgccggactcgctttcagcgacggagatcagtggaccttgtcccgaaagagattgtcatgtcctaaagagaaaacaaccagaaaaaagaggaacgtgaacttccagaaggcaatcaatgaaaaactgggccagtacgcatcacctaccgctaagcgttgttgccaggacggagttaccagacttccgatgatgaggtcctgtgaacaaagagcagctcgtgtgcagcagcccgattgccgcgagccctttttaagttgctgccagttcgccgagagccttcgaaagaaaagccgagacaagggtcaagctggtttgcagcgggctctggagatcctgcaggaggaggatctaatcgatgaagatgatataccagttcgaagctttttcccagagaattggctgtggcgggtagaaacagttgatcggttccagattctgaccctgtggctgccagattccttgaccacctgggagattcatggactgtccctaagcaagaccaaaggcttgtgcgtggcaacaccggtgcaactgagggtgttccgggaattccatctgcacctgcgactgccaatgagcgtgcggcgattcgagcagctcgaactccgccctgtgctgtataattacctggacaagaatttgactgtcagcgtccatgtatccccagtggaggggttgtgcttggcgggcggaggcgggctggcgcagcaggtcttagtgccagccgggtctgcacgcccagttgctttcagcgtcgtgcctaccgctgctacggcagttagtctgaaggttgtcgctagaggcagctttgaatttcctgtgggtgatgcggttagtaaagtactgcaaattgaaaaggagggagcaatacatagagaggagctcgtttacgagctcaacccactagaccacagggggcgcaccttggagatccccgggaatagcgatcctaatatgatccctgatggagatttcaactcttacgtcagggtgacagcatccgatcctcttgacacactgggatctgaaggcgctctaagccctgggggagttgcttccttactcagactccccaggggctgtggcgaacagacaatgatatacctggccccaaccctggctgcctcccggtacttggataagaccgaacagtggtccacactcccccccgagaccaaggaccatgccgtagatctgatccaaaaaggctatatgaggatacagcagttccgcaaggccgacggctcttatgcagcttggctaagtagaggttcctcaacttggctgacagcttttgtcttgaaagtccttagcctggcccaagagcaagtcgggggctctccagagaagcttcaagaaactagcaactggctgctgtcccagcaacaggccgatggttcttttcaggaccttagccccgtcattcaccggtccatgcaaggcggccttgtcggcaatgacgagacagtcgcgcttacagccttcgtgactattgcgttgcatcatgggctggccgtcttccaggacgagggggccgagccattaaaacaacgcgtcgaagcctcaatcagtaaggcgtcaagtttccttggagagaaagcctcggctggcctgctcggcgctcatgcagcagcgatcactgcctatgccctgaccctgactaaagctcctgcagacttgcgtggggtcgcccacaataatctgatggctatggcccaggagacgggtgacaacctatattggggatcagtgacaggaagtcagtcaaacgcggtgtctccgacgcccgccccgaggaatcccagtgatcccatgccccaagcccccgccctctggatagagaccaccgcatacgccttgcttcacctcctgctccacgaagggaaagccgaaatggcagaccaggccgcggcctggctaacgagacagggaagctttcagggcgggttcagaagcactcaggacaccgtcatcgcgttagatgccctgagcgcctactggatcgccagccacacaactgaagaacgaggcctgaacgttacacttagttcaactggccgtaacggctttaagagccacgctctgcagctcaataaccgacagatccgaggactggaggaagaactgcagttctcactggggtctaagattaacgtgaaggtgggagggaactctaaagggacccttaaagtgcttagaacatacaatgtgcttgacatgaagaacacaacgtgtcaggacctgcagatagaagtaaccgtcaaaggccacgtggaatacacaatggaggctaacgaggattacgaggattacgaatacgatgagttgcccgcgaaggatgaccccgacgcacccctccagcctgtgacacctctgcagctcttcgaaggcagacgcaacaggagaagaagagaagcccccaaggttgtggaagaacaagaatcccgagtacactatacagtgtgcatttggcgcaatggcaaagttggcctctcagggatggccatcgcagacgttacccttctgtccggatttcacgccctcagggccgacctggagaaattaaccagcctcagtgaccggtatgtatcccacttcgaaaccgaaggaccccacgtgttattatactttgactccgtcccgacctctagggaatgcgtaggtttcgaggccgtgcaagaggtacccgtgggcttggtacaaccggctagcgccaccctatatgattattataatcctgagaggcgatgctccgtgttttatggcgctccttccaagtctcggcttctcgctacactgtgctcggctgaagtttgccagtgtgctgagggcaagtgtccgagacagcgcagggccctcgaacgcggactgcaggacgaggatggataccgtatgaagtttgcctgttattatcctagggtggaatacgggtttcaggttaaggtgctgcgggaagactcccgagctgcattccgattgttcgagaccaagatcacacaggtgctccacttcaccaaggacgtgaaagccgctgcgaatcagatgaggaatttcctcgtgcgggcctcctgtaggctccggcttgaaccaggtaaggaatacttgattatgggtcttgacggagctacctatgacctggaagggcacccacagtacctcctcgatagtaacagttggatcgaggagatgccttccgagagactgtgcaggtcaacacgtcagagggccgcctgtgctcagctgaatgattttctccaggagtatggcacccagggctgccaggtgtag

SEQ ID NO: 112879 - DNA, 5235 bp, Artificial Sequence
  Description of Artificial Sequence: Synthetic coding sequence
atgaggttgctgtggggactcatctgggcttcatcatttttcactctgtctcttcagaagcccaggctcttgctcttcagcccatccgtggtgcacctgggcgtccctttgtctgtaggagtacagctgcaggatgtgcccagggggcaggtcgtcaaggggtctgtgtttctgcgcaacccgagccgaaataatgtgccttgctccccaaaggttgattttacgctcagttccgagcgggatttcgctctcctgagcttgcaggtgcccctgaaagacgcaaagtcttgcggtttacaccagctgctgagaggcccggaggtccaactagttgctcattcaccatggttgaaagactcccttagccgcacgacaaacatccaggggatcaatctgctgttcagttcccgcaggggccatctgtttctccagacagatcagcctatctacaacccaggacagagggtgcggtacagggtgttcgctctggaccagaaaatgagaccttccaccgataccataaccgtgatggtggagaattctcatggtctgagagtccgcaaaaaggaagtgtacatgcctagcagcatctttcaagacgacttcgtgatccctgatatatcggaacccgggacatggaaaatatccgccaggttctctgacgggctggagtcaaattcatctacacagtttgaggtcaaaaaatacgttttgcccaattttgaagtgaagatcacgccggggaaaccttacatacttactgtgcctggccatctcgatgagatgcaactggacatacaggcacggtacatctatggtaagccagtgcagggcgttgcctatgtgcgctttggtctacttgatgaagatggtaaaaaaactttcttcaggggcctcgaatcgcagaccaagttggttaacggacagtcccatataagtctgagtaaggccgagttccaggacgcattggagaagctgaacatgggcattacggacttgcagggccttagattgtacgtggcagcagccattatcgagagcccaggcggggagatggaagaggcggaactcacgagttggtactttgtgtcaagtcctttcagcctggatttaagtaagactaagaggcacctggttccaggcgcgcctttcctgctacaagcattggtacgggaaatgagtggatcacctgccagtggcatccccgtcaaagtctccgctacagtctcctcaccaggctctgttcccgaggtccaagacatccaacagaatacggatgggagtgggcaggtgtccattcccattatcatccctcagactatatccgaactgcagctgtcggtgagcgcagggagcccacaccccgcaatagctagactgacagtcgctgcccctccatccggaggacccggcttcctgtccatagaacgacccgattccagaccccccagggtgggcgatactctgaatcttaaccttagggctgtgggctccggagccaccttcagccactattattatatgatcttgagccggggtcagattgtatttatgaatcgtgagccgaagcgaaccctcacctccgtctccgttttcgtcgatcaccacctggccccatctttctatttcgttgctttctattaccatggtgatcaccctgtcgctaatagtttgcgagtggacgtgcaggcaggggcctgtgaaggaaagctggagctctccgtcgatggagctaaacaataccgcaatggcgagtccgtcaaactgcatctagagaccgattctcttgccctcgtcgctcttggggcactggacacagcactgtatgccgctggctctaaaagccacaagcccctcaatatgggtaaggttttcgaagccatgaatagctatgatctaggctgtgggccgggcggcggagactcagctctgcaagtctttcaggcagctggcctggctttcagtgacggggatcagtggacgctgtcaaggaaacgcctgtcgtgtccaaaggagaagacaacccgcaagaagcgaaatgtcaattttcaaaaagccattaatgagaagctaggccagtacgcctcaccaacggcaaagcgctgctgccaggacggggtcacacgattacctatgatgcggtcgtgcgagcaacgagccgctagagttcagcagcccgattgtcgagagcctttcctgtcctgttgccagtttgccgagagcctacgtaaaaagtcgagggataagggacaggccggcctgcagagggctctagagattctccaggaagaagacctgatcgatgaggatgatattccggtacggagctttttcccggaaaattggctgtggcgagtggagacagtggatcgcttccagatcctcaccttatggcttccggacagcctgaccacttgggagatccacgggctgtcactcagcaagaccaaaggcctatgcgtggctacgcccgtgcaactgagagtattcagagagttccatctgcacctaagactaccgatgtccgtcagaaggttcgagcagcttgagttaagaccagtgttgtacaattatctcgacaaaaacctgacagtcagcgtgcacgtgtctcccgtggagggtctgtgtcttgccggaggcggcggtctggcccagcaggtgctggtgcccgctgggtccgctcggccagtggcttttagcgttgtgccaacagctgccgctgccgttagcctgaaggtcgtagcccgtggcagcttcgagttccctgtgggggatgccgtgtccaaggtgctccagattgagaaggagggagcaattcatagagaggagttggtatatgaactgaaccccctggatcacagggggagaactctggagatccccggaaacagtgaccccaacatgattcccgacggcgatttcaattcctacgtgcgggtcacggcatccgatcccctggacactctaggatcagagggcgcgctgtcccccggaggcgtggccagtctgctccgactgcccaggggttgcggcgaacaaaccatgatttatttggctcccacgcttgccgcttcacgctatttggacaagactgagcagtggtccaccctgcctcctgaaaccaaggatcatgctgtggatctgatccagaaggggtacatgcgcattcagcagttccgcaaagctgacgggtcttacgccgcatggctgtcgcgtgggagctcaacttggcttaccgccttcgtgctgaaggtgctatcattggcccaagagcaggtgggtggctcacctgagaagctccaggaaaccagcaactggttattgtctcagcagcaggctgatggatcatttcaagatctctcacctgtcatccacaggagtatgcagggggggctggtgggcaacgacgaaaccgtggcgttgactgccttcgtgactatcgcactgcaccacggcctggctgtgtttcaggatgaaggcgctgagccattgaaacagcgcgttgaggcatccatcagcaaggctaactcattcctgggagaaaaggcttcagccggtctgctcggcgctcacgctgctgctatcaccgcatatgctctgacactcacgaaggcccccgcagatctacggggggtagcccataacaatctgatggctatggcccaggagaccggtgacaatctttactggggatccgtgactgggtcccagagcaatgcggtcagccctactcctgcccctaggaatccgtcggacccaatgccgcaagcccctgcactttggatcgagaccaccgcctatgccctgctccacttattactgcatgaagggaaggccgaaatggcggatcaggccgctgcctggcttaccaggcaggggtcgtttcagggtggatttagatccacgcaggatacagtgatagcactggatgctctgagcgcctattggattgccagccacactacggaggaaagaggcctcaatgtgactctatcttctaccggaaggaacggctttaagagtcacgcactccagctcaacaataggcagatcagaggcttagaagaagagctccagttctcgttaggctcaaagattaatgtaaaagtcggcggtaattccaagggcaccctgaaggtattgagaacctataatgtgttggatatgaagaacacaacgtgccaggaccttcagatcgaggttacagtgaagggccacgtggaatataccatggaggcaaacgaagactatgaggactacgagtacgatgaactccctgccaaagatgacccagacgcccccctacagccggttactccactgcagctgtttgaaggaaggcgaaacaggcgaaggcgggaggctcctaaggtggtggaggagcaagaatctcgcgtccactacactgtgtgcatctggcggaatggtaaggtggggctgagtgggatggcgatcgccgatgttacccttctgagcggtttccacgccctcagagcggaccttgaaaagttgacctctctgagcgaccgctatgtgtcccactttgaaactgaggggccacatgtcttgctctatttcgactctgtccctacatcccgcgagtgtgtcggctttgaggctgttcaggaggtgccggtggggttggtgcagcctgccagcgcaacactgtatgactactacaaccctgagcgccgctgctcggtcttttacggcgcgccttccaagtctagattgctggcaaccctgtgttctgcagaagtttgccaatgcgctgaaggcaaatgtccacgccagcggagggctctcgaaaggggcctgcaagatgaagacggataccgcatgaaattcgcgtgttactacccgcgggtagaatatggtttccaagtcaaagtgctgagagaggattctcgggctgccttccgactctttgagactaagattactcaagttctgcatttcacaaaagacgtgaaagccgccgcgaaccaaatgaggaactttctcgttcgggccagttgccgcctcagactcgaacccggaaaggagtacctcattatgggactggacggcgctacctacgacttggaaggtcatccgcagtacctcttggatagcaactcgtggattgaggaaatgccatcagaacgactatgccggtctacacggcagcgtgcagcatgtgcgcagctgaacgattttctgcaggagtatggcacccaggggtgtcaggtgtag

SEQ ID NO: 112880 - DNA, 807 bp, Artificial Sequence
  Description of Artificial Sequence: Synthetic coding sequence
atgtgccccgaggactcccttcaggtgcccttaaaagatgccaagtcgtgcgggttgcatcagttactcaggggcccagaggtacaactcgtggctcacagcccttggcttaaagactcacttagccgtaccacgaacatccagggcataaatctcctgttttcttctagaagggggcacctcttcctgcagactgatcagcctatatacaatcctggacaaagagtgaggtatcgagtctttgcattggatcagaagatgaggccctctaccgataccattaccgttatggttgagaacagtcacggactgagggtcaggaagaaggaagtatacatgccatcttccattttccaggatgatttcgtcatccctgatatttctgaacctggcacttggaaaatttcagccagattttcagacggcctggaatctaattcctctactcaattcgaggtgaaaaagtatgtacttccaaacttcgaggttaaaattacccctgggaaaccctatattctcacagtgcccggacacctcgatgaaatgcagcttgatatccaggccagatacatatatggcaagcctgtgcagggcgttgcctacgtgaggtttggtctgttagatgaagacggcaaaaagaccttcttcagggggcttgagtcccagactaaattagtgaacgggcagtctcatatttcgctgtcgaaagcagagttccaggacgcactggagaaactgaatatggggattacagacctacaggggctcaggttatatgttgctgccgccattatcgagtcaccttag

SEQ ID NO: 112881 - DNA, 5097 bp, Artificial Sequence
  Description of Artificial Sequence: Synthetic coding sequence
atgagattactgtggggcctaatctgggcatcctccttctttaccctgtccctgcaaaagcctcggctgctgctttttagccctagcgtagtgcaccttggtgttcccctgtctgtgggggtccagctccaagatgtgcctagaggacaagttgtgaagggctcagtctttctgagaaatccgagccgcaataacgtgccatgctcgccaaaggtcgacttcactctttcctctgagcgcgatttcgccctgctgtctctgcaagtgccgctaaaagatgctaagtcctgtggactccaccagcttctgaggggacccgaggtgcagttggtggcccattctccgtggctcaaggattctctgagcaggactaccaacatccagggaatcaacctcctattttcgtctcggcgaggtcaccttttcctgcaaactgaccagccaatctacaatccggggcagcgagtcaggtacagagtttttgcattagaccaaaagatgcggcctagcactgacacaatcaccgtcatggtcgaaaattcccacggcctccgcgttcgaaaaaaagaagtctacatgcctagttcaatttttcaagacgacttcgtgatccccgacattagcgagccgggaacctggaaaatttccgcccgattcagtgacgggctcgaatctaactctagtacacagttcgaggtgaagaaatatgtacttcctaatttcgaggtgaaaatcacaccgggtaagccttacattctgactgttcccgggcacctcgacgagatgcagctggacatacaggcacggtatatttacggcaaaccggttcagggcgtagcctatgtgcgcttcggtttactggatgaggatggaaaaaagacgttctttcgagggctggaatcccagacaaagctagtgaatgggcagagtcatatttctttgagtaaagcagagtttcaggatgcgctcgagaaattgaatatgggaattactgacctgcagggcctccgcttatacgtggccgcagccattatcgaatctccaggtggcgagatggaggaagctgagctcacatcttggtactttgtctctagcccgttttctctggacctcagcaagacaaagcggcatctggttcctggcgcgccctttctgcttcaggccttggtccgggaaatgtctggctctcctgcttccggaatcccggttaaagtgagcgccaccgtctcttccccaggttccgtacctgaggtccaggatatccagcagaatacagatggaagcggccaggtgagcatccccatcatcattccgcaaaccattagcgagttgcagctttccgttagtgctggctcgccccatcccgctattgcccgcctgaccgtcgcagcaccccccagcggcggaccagggttcctgtccattgaacgtcccgacagcaggcctccgagggtgggagataccttaaacctgaaccttagagccgtaggatcaggcgccacattttcacattattattacatgatcttatctcgcggccagatcgtattcatgaatcgtgagcctaaacggactctcacgtctgtgtctgtcttcgtggaccaccaccttgccccctctttctactttgtggccttttactatcatggtgaccacccagtggcaaattctctgcgcgtagatgtccaagcgggggcatgcgagggcaaactggagcttagcgtggacggggcaaagcagtaccggaacggtgagtccgtgaagctccatctggagaccgacagcctggccctagttgccctcggagcccttgacacagcactgtacgcagccgggagcaagagtcacaagccactcaatatgggtaaagtcttcgaggctatgaattcatatgatctaggatgcggaccagggggcggtgactccgccctgcaggtttttcaggccgccggactggctttcagcgatggcgatcagtggaccctttcccggaagcgccttagctgtcctaaagagaaaaccacccgcaaaaaacgtaatgtcaatttccagaaggcaattaacgaaaagctgggacagtatgcgagtcctaccgccaagcgatgttgtcaggacggagtgacccggcttccaatgatgaggagttgcgagcaacgtgcggcaagggtccagcagcctgattgccgagaaccgttcttgtcctgttgccagtttgcagagagcttgcggaaaaaaagccgagataaggggcaagccggcctccagcgagcactggaaattctgcaggaggaagatctgatagacgaagatgacataccagtgcgcagtttctttccagaaaattggctgtggagggttgaaacagtagacaggttccagatacttacattgtggctgcctgacagcctgaccacttgggaaattcacgggcttagtctctctaagactaaggggctatgtgttgcaaccccagtgcagctgcgggtgtttcgagaattccacctccacttgcgactgcctatgtccgtgaggcgttttgaacagttggaactcagacccgttttgtacaactacctggataaaaatttaactgtttccgtacatgtgtcaccggtagaaggactgtgccttgccggcggcggaggattggcacaacaggtcctcgttccagctggcagtgccagacccgttgcttttagcgtagttccaacagccgccgctgcagtgtcactgaaggtggtcgcccgcggcagttttgaatttcctgtcggagacgccgtgtccaaagtgctccagatcgaaaaggaaggcgcaattcaccgggaggagctcgtgtacgagctgaacccgctcgaccatcggggtcggacactcgaaattcctggcaacagtgaccctaatatgattcctgacggagatttcaactcctatgtgagggtcactgcttccgaccctttggataccctgggcagtgaaggggctttatcacccggcggagtggccagtttactgagactcccgaggggctgtggggaacagacaatgatttatctagcccccacattggcggcatcacgctatttggacaagactgagcagtggtcaactctgccgcctgagacaaaagaccatgcagttgacctcatccagaaaggatacatgcgcatccaacagtttagaaaggcggacgggtcttacgccgcatggctgtcccgcggatcaagtacctggctcactgctttcgttctaaaagttttgagtttggcccaggagcaggtggggggaagccctgagaagcttcaggagaccagcaattggctgctgagccagcaacaggcagatggaagtttccaggacttgagccctgtcatacaccggtcgatgcagggtggcttagtggggaatgatgagaccgtggctctcaccgctttcgtgacaatcgcacttcaccatgggctagctgtgttccaggatgaaggcgctgagccgttgaaacaacgcgtggaggctagcatctctaaggcaaacagcttccttggagaaaaggcttctgccgggcttctgggcgcacacgccgctgcaattaccgcctacgccttgaccctcaccaaggcgcctgctgatcttaggggggtggcccataacaatctgatggctatggcgcaggaaactggggacaacctgtactggggctctgttactgggtcccagagtaatgcagtgagccccactcccgccccccgcaacccctccgaccccatgcctcaggctccagctctctggatcgaaaccaccgcatatgcactgctgcacctgctcctgcatgaggggaaggcagagatggccgatcaggctgcagcgtggctgacacggcaggggtcctttcaggggggtttcagaagcacgcaggatacagttatagccctagatgccctgagcgcatactggatcgcctcccacacgactgaggaaagaggcctcaatgtaactctcagtagcacggggagaaatgggtttaagtcacacgccctgcagctgaataaccgccaaattagggggctggaggaggagttgcagttctcactgggcagtaagatcaacgtgaaggtcggcgggaactcaaagggcacattaaaggttctgcgcacctacaacgtgctcgacatgaagaatactacctgccaggatctgcagatcgaagttacagttaaggggcatgtcgagtatactatggaagctaatgaagactacgaggattacgagtatgatgaattaccagcaaaagacgatccggatgcccccctccagcccgtcaccccattgcagctattcgagggccgcaggaacagacgtcggcgggaggcccctaaactgacctcactaagcgatcggtatgtatctcactttgagaccgaaggaccacacgtactgttatactttgactctgttcctacgagccgcgagtgtgtgggcttcgaagcagtgcaggaggttccagtagggcttgtgcaacctgcgagcgccacgctgtacgactactataatccggaaagacgctgcagcgttttttatggagcccccagcaagtcgcgcctgttagcaaccctgtgttctgcggaagtatgtcagtgtgctgagggaaaatgtcccaggcagcgacgagccctcgaaaggggactgcaggatgaggatggctatagaatgaagttcgcttgctactatccacgcgtggaatatggctttcaggtgaaggttctccgcgaggactctagagcggcctttcgcctgtttgagacgaagattacacaggttcttcatttcactaaggacgtgaaggccgcagccaaccagatgaggaatttcctcgtgcgagcctcctgccggctccgtttagaacccggcaaggaatatctcattatggggctggatggtgccacatatgatttggaggggcacccccaatatttgctcgacagcaattcttggatcgaggaaatgccaagtgaacggctttgcaggtccacaaggcaacgcgctgcctgtgcccaactgaatgatttcctccaggagtacgggactcagggatgtcaggtgtag

SEQ ID NO: 112882 - DNA, 813 bp, Artificial Sequence
  Description of Artificial Sequence: Synthetic coding sequence
atgtgccccgaggattccctgcaggtacctctgaaagacgccaagagttgcggcctgcatcagctgttgcgtggccccgaggtccagctggttgctcatagcccttggcttaaagattcccttagtaggacaacaaacatccagggaattaacctacttttctcgtcccggagaggacacctcttcctccaaacagaccagccaatttataatcctggccagagagtgcgatatcgcgttttcgcccttgaccagaagatgagaccttccacagatacaatcacagtgatggttgaaaattcccacggccttcgcgtgagaaagaaagaagtatatatgccaagttccatttttcaggatgattttgttatcccggatatttccgagcccggcacttggaagatctctgcccggttctctgatggtttagagtccaatagctctacacagttcgaagttaagaaatacgtactgcctaactttgaggtgaaaattactcctggcaagccatatatactaacggtgccagggcacctggatgagatgcagctggatatacaagcacggtatatctacggcaaacctgtgcagggtgtggcgtacgtgagatttggactgctcgatgaagatgggaaaaagacttttttccgaggcctcgagagccagacaaagctggtaaacgggcagtcacacattagtctgagcaaagccgagttccaggacgccctggaaaaactcaatatggggataacagatctgcagggcctgaggctttatgtcgcagcagcaatcattgagtctccggggggctag

SEQ ID NO: 112883 - DNA, 5097 bp, Artificial Sequence
  Description of Artificial Sequence: Synthetic coding sequence
atgcgccttttgtggggactgatttgggcatcaagcttcttcacactaagcctccagaaaccgcgcctgctcctcttttcaccaagcgtagttcacctgggggttccgctctccgtgggggtgcagcttcaggacgtccctagagggcaggtggtcaagggaagtgtctttctacgaaacccttcgcgaaataatgtaccatgctctcctaaagtggacttcaccctgagttccgaaagggacttcgctttgctctctctgcaggttccactgaaggatgccaagtcttgcgggctgcaccaacttctgagaggtcctgaagttcagttagtcgcacattcaccctggctgaaggattcgctgtcacgtaccacaaacatccagggaattaacttactcttttcttccagacgaggacaccttttcctacagaccgatcagcctatctacaaccccggtcagagagtcagataccgcgtcttcgctctcgatcagaagatgcggcctagcactgatacgataaccgtgatggtggaaaacagccatggactgagggtgcggaaaaaggaggtttatatgccatcctcaatcttccaagacgatttcgtgatacccgacatctctgagcctgggacttggaaaatctcagcccggtttagtgatggcctggagtccaacagttcaacccagtttgaggtgaagaaatacgtgctgccaaattttgaagtgaagatcacccccggtaagccctacattttgactgtacccggacatttggacgagatgcagctcgacattcaagcacgatatatttacggcaaacctgtccaaggggtggcgtatgttaggttcgggcttctcgacgaagacggcaaaaaaacattcttccggggacttgagtcccagacgaaactagttaacggccagagccacatttctctgagcaaagccgaatttcaagatgcactggaaaagcttaacatgggaataactgatctgcagggactccgcctctatgtagctgctgctatcatagagtcccccggaggtgagatggaggaggctgaactgacatcttggtacttcgttagttcccccttttctctagatctttctaagactaagagacacctggtacctggcgcgccctttctcctgcaagccctggtgagagagatgtctgggtcccccgcttctgggatacccgtcaaggtgtcagctaccgtgtccagtccgggatccgtgcccgaggtccaggatattcaacagaatactgacggcagtgggcaggtgtccattcccatcataattcctcaaaccatctctgaactgcagctttcagtctctgccgggagccctcacccggccatcgcgcgtcttactgtggctgcccccccttctggcggtccgggctttctgagcatagagcggcccgactctcggcccccccgggtcggagacactctcaatctcaatctgcgggctgtgggtagcggggcaacattttcgcactattactacatgatattaagtaggggccagattgtttttatgaatcgagaaccgaagaggacgctcaccagcgtgagtgtgttcgtcgaccatcatctcgcccccagtttttattttgtcgcattctattaccacggtgaccatccggttgcaaactctctccgcgtcgatgtgcaggccggcgcatgtgaaggcaaactggaactttccgtggatggcgccaagcagtacaggaatggcgagagcgtgaaactccacctggagaccgactcccttgctctcgtggcactaggcgctctggatactgcgctgtatgcagcaggttctaaatcgcataaacctctcaatatgggaaaagtgtttgaggctatgaatagctatgatctgggatgtggccctggaggaggtgatagcgctctccaggtgtttcaagctgccggtctggcgttctctgacggagaccagtggacgctgtcacgcaagcggctctcctgtccgaaagagaaaacgacccgcaagaaacgaaatgtcaacttccaaaaggccatcaatgaaaagctgggccagtacgcttcccccaccgcaaagcggtgctgtcaggatggggtgacccggctcccaatgatgcgctcctgtgagcagagggcagcccgggtgcagcagcctgactgccgagagcctttcctgtcttgttgccaattcgcagaaagcctgcgcaagaaatcccgagataaggggcaggctggtctgcagagagccctcgaaatcttgcaggaagaagacctgattgacgaggatgacattcctgtcagatcttttttccctgaaaattggctgtggagggtggagacagtggatcgtttccagatcttaacactgtggctgcctgacagcctgacaacttgggaaattcacggtctgagcctgagcaagactaaaggcctgtgcgttgccacgccggtgcagctaagggtgtttcgtgaatttcacctgcacctgagactgccaatgtccgtcaggaggtttgaacagctggagctgagacccgtgctgtacaactacctcgataagaacctgacagtgtccgtccatgtctcgcctgtggagggactatgcctcgccggcgggggaggtctggcccagcaggtgctggtcccagcagggtcagcgcgtcctgtggcatttagcgttgttcccaccgctgcaacagccgtatctctgaaggtcgtagctcggggaagtttcgagttcccagtgggggacgccgtttccaaggtgctgcagatcgagaaagaaggggctatccatcgcgaagaactcgtgtatgaactgaaccctctggaccaccgggggaggactcttgaaattccgggcaattctgaccccaatatgatccctgatggagatttcaactcttacgtgcgcgttaccgcctctgaccctcttgacaccctgggttccgagggagccttaagcccaggcggagttgcttctcttctgcggctgcctcgcggctgcggcgagcagacaatgatctatctggcgcccacacttgccgcatccaggtacctggataaaaccgaacaatggtccactctgcccccagagaccaaggaccacgctgtggatcttatacagaaggggtatatgagaattcaacaatttcgcaaagctgatggtagctacgccgcttggttgagcagggggagtagcacttggctgactgcatttgtgctgaaagtgctgtccctggcccaagaacaggtgggtggaagccctgagaagctgcaggagactagcaactggttgctctcccagcaacaggccgatggctcgttccaggacctgtcccccgttattcaccgtagcatgcagggagggttggtcggcaacgatgaaaccgttgccctcacagcatttgtgaccattgcgctccatcacggactggctgtgttccaagacgagggagccgaacctctcaaacaaagagttgaagcctcgatctctaaggcgtcttcgttcctgggggaaaaagccagtgccggcctgctgggagcacatgccgcagctattacggcgtatgctctaacgctcaccaaagcaccagccgatcttcgaggcgttgcacataacaacctgatggcaatggcccaagagactggcgataacttatattggggttcagtaaccggctcccaatccaatgccgtatctccaaccccagcaccacggaacccttccgacccgatgccccaggctccagcgctgtggattgaaaccaccgcctacgccctgctgcatctgctcctacacgagggcaaggccgaaatggcagatcaagcagccgcctggctgacaagacagggatcgttccagggtggcttcagatcaacccaggacactgtcatcgctcttgatgctctgagtgcttactggatcgcaagccacaccactgaggagcggggcctcaacgttactctgagttcaacaggacgcaatggcttcaagtcacacgctctacagctgaataacaggcagatccgcggtctggaggaggaactccagttcagccttggctcgaaaataaacgtaaaggtaggcggtaactctaagggaactctgaaggtgcttcgcacctacaatgtcctcgatatgaagaacactacctgtcaggatctacaaattgaggttaccgtgaaggggcatgtggaatacacaatggaggctaacgaggattacgaggactatgagtacgacgaactccctgcaaaagacgatcctgacgctccactgcaaccagtcacccctctgcagttattcgagggcaggagaaacagacggaggcgcgaagcacctaaactcacaagcctgtccgacagatacgtcagccacttcgagaccgaggggccccacgtgttgctgtattttgattccgttcctacctcgcgagaatgcgtcggatttgaggccgtccaggaggttccagtggggctggtgcagcctgcaagtgccacactctatgactactataaccctgaaaggaggtgctctgttttttacggagctccgagtaaaagtagactcctggcgaccctctgttccgcagaagtatgccagtgtgccgagggaaaatgtccaaggcaaaggcgcgctctcgagcggggacttcaggatgaggatggttacagaatgaagttcgcctgctactaccctagggtcgagtatgggttccaggtgaaggtacttcgtgaagattctagagcagcgttccgcctgtttgaaacaaaaatcacccaagttctgcacttcacaaaggacgtgaaagcagctgcaaaccagatgaggaattttctcgtgcgcgcatcctgtagactgcgactcgagcctggaaaggaatatctgattatgggactcgatggggcaacctacgacctggaaggacacccccagtacctcctggattccaattcgtggattgaagagatgccttctgagcggctttgccggagcacacgacagagagccgcgtgtgcacagctaaatgactttctgcaggaatatggaacccagggttgccaggtgtag

SEQ ID NO: 112884 - DNA, 1536 bp, Artificial Sequence
  Description of Artificial Sequence: Synthetic coding sequence
atggccaaagggctctcagtgcaaaacgataagcatccaggctatcaacctgcacttttgctttcgcccggagctcctctctttgctgatggccctgcctacgccctgttacatctgctgctgcacgaaggaaaagccgaaatggccgatcaagctgccgcctggttgaccaggcagggatcattccagggaggcttccgctcaacacaggataccgtcattgcactggacgctctctccgcttactggatcgcaagtcacaccaccgaggaacgtggcctaaacgtgacactgagctctaccggtcgaaatgggttcaagtcccacgcactgcaacttaataataggcagatccggggactcgaggaggagcttcagttctctctgggctcaaaaataaatgtgaaggtcggcggaaattctaaagggaccctgaaagtcttacggacctataatgttctggatatgaaaaatacaacatgtcaggacctgcaaattgaagttaccgtgaagggccatgtggagtatacaatggaggccaacgaggattacgaagattatgagtacgacgagttgccagctaaggatgaccccgatgctccccttcaacccgttacgcccttacaattattcgaagggaggcggaatcgccgtaggcgcgaagcccctaaggtggtggaggagcaggagagtcgagttcattacacagtctgcatctggcggaacggcaaggtagggttgtctgggatggccattgcagacgtgacattgctgtcaggttttcacgccctgcgggccgatctcgagaagctgacttctttatccgacagatacgtgagccacttcgaaaccgagggacctcatgtgctcttatattttgattctgtccctacttctagggagtgtgtaggtttcgaggcggtgcaggaagttcctgttggcctggtccagccggcaagcgcaaccctttatgattattataaccctgaaagaagatgtagtgtcttttatggtgcaccaagtaaaagccggctcctcgcaacgttatgcagtgctgaagtgtgccaatgcgctgagggtaaatgtccgcgacaaagaagagcacttgaaagagggctgcaagacgaggacggctacagaatgaagtttgcatgctactaccctagggtcgagtacgggttccaggttaaagtgctgcgcgaagattctcgcgccgcgttcagactgtttgaaactaagattacacaggttcttcactttaccaaagatgtgaaggccgcagccaaccagatgcgcaatttcctagtccgagcctcctgcaggctgcggttggaacccggcaaggaatatttaattatggggctggatggcgccacatatgatctggaaggtcacccccaatatcttctcgattccaacagttggatcgaagaaatgccatcggaaaggctgtgccgcagtactagacaaagagccgcctgtgcccagctgaacgactttttgcaggagtatgggacacaaggatgtcaagtgtag

SEQ ID NO: 112885 - DNA, 1953 bp, Artificial Sequence
  Description of Artificial Sequence: Synthetic coding sequence
atggggagccaatgcagaggttggcacatgtgtgcccttggaagtcagcaacaggccgatggcagctttcaggacctcagccccgtgatacatagaagcatgcagggcgggttagttggcaatgacgaaacagtggccttgacagcctttgtgaccattgcacttcatcatggcctggctgtgttccaggacgaaggagcagagcctttgaaacagagagttgaggcttcgatctctaaagccagttccttcctgggtgaaaaagcctctgccggtctgcttggggcacacgccgcagcaatcaccgcgtacgctttaaccctgaccaaagctcctgctgatctaaggggagtggctcataacaacttgatggcgatggcacaagagaccggagacaacctttactggggctcagttaccgggtctcagagcaacgctgtgagccctacccccgctcctcgcaatccatccgatcctatgccacaagcgccagctctgtggatcgagacaaccgcctacgcactcttgcatctgttactgcatgagggaaaggcagagatggcagaccaggccgctgcatggctcacccggcagggaagtttccagggaggtttccgctcaacacaagataccgttatcgccttagacgctcttagcgcctactggattgcatctcacacaaccgaagagcgcgggctgaacgtgaccctgtccagcacaggacgtaacggtttcaagtctcacgccttacagttgaacaacagacagatccgtggccttgaggaggagctccaattctcacttggcagcaagattaacgtgaaagtgggaggcaactcaaaaggcaccctgaaggttcttagaacctacaatgttctagacatgaaaaacacgacatgtcaggatctgcagattgaggtgaccgttaaagggcatgtggagtacactatggaggccaacgaggactatgaagactacgaatatgatgagcttcctgctaaagacgaccctgacgccccattgcaaccggtcacaccactgcagctgtttgagggccggaggaaccgtaggcgccgcgaggccccaaaggttgtggaggaacaggagagtcgggtgcattacaccgtgtgtatttggcgaaacggtaaagtgggtctgtctggaatggctatcgcagatgtgactttgttgagtgggtttcatgccctgcgcgcagacctggagaagctgacctccctcagcgatcgatacgtgtctcactttgagaccgagggcccgcatgtgcttctgtattttgacagcgtgccaaccagtcgggagtgtgtggggttcgaagctgttcaggaagtgccggtgggcctggtacaaccagcctccgctactctttacgattactacaaccccgagcgacgctgctccgttttctacggagctccgagcaagtccaggctgctcgcgactctttgttccgctgaagtgtgccaatgtgctgagggtaagtgtcctcggcagagaagagcactggagcgcggactgcaagatgaagatggctaccgtatgaagttcgcatgctattatcccagagtggaatacggattccaggtcaaagtgctaagagaagacagtagggcagcgttcaggttatttgaaacaaaaattacccaggtgttgcactttaccaaggatgtcaaggccgcggcaaaccagatgcgtaatttcctcgtgcgcgcttcctgccgtttgagactagaacctggcaaagagtacctcattatgggtctggacggcgctacatacgatttggaaggtcatcctcagtatctgctagattcaaacagttggatcgaggagatgccatctgaacgattgtgtcgaagtacacggcaacgggcagcatgtgctcaactcaacgatttcttgcaagagtatgggacgcaggggtgtcaggtatag

SEQ ID NO: 112886 - DNA, 291 bp, Artificial Sequence
  Description of Artificial Sequence: Synthetic coding sequence
atgcctgggccaacgccaagtgggactaatgtaggtagctctggccggagcccatcgaaagctgtcgctgccagagcagccggctctacagtgagacagaggaaaaacgcctcgtgtgggacccgcagtgcaggaaggactacctcagcggggaccggaggaatgtggcgtttttacacagaagactcacccggcttgaaagtggggccagtgcctgtgctggtgatgtctcttctattcatcgcatcagtcttcatgcttcacatttggggaaagtacacacggagctag

SEQ ID NO: 112887 - DNA, 3318 bp, Artificial Sequence
  Description of Artificial Sequence: Synthetic coding sequence
gggagagccggggaagtccgggctctgtcttctggggcacagagacggggatcccactttgtggtgctgtgtcggctccctcgtggacgggccagggtcgttggtgcaagtctgtctcatgcgcccctgcccctgcgctactgctggaaaggaagggggggagtgtctagactcttctgttcccagcgagccaggatgccgggatccctagggcgagaagcgtctggccgagccggacctacaggatgtggagcattcgcttttggactcaggtgccgctatgttattagcgctcccaaaatctttagggttggggctagcgagaacatcgtgatacaggtctacggttacaccgaggctttcgatgccaccatctccatcaaatcctaccccgacaaaaaattttcgtatagcagcggtcacgtgcacctgtcctcggagaacaaattccagaatagcgcaatattgaccattcaaccaaaacagttacccggtggacagaaccctgtttcctatgtgtatttggaggtcgtgtccaagcacttttccaagagtaagcggatgcccatcacgtacgataatggattcctgttcatccataccgataagcccgtgtataccccagaccaatccgtgaaagtccgagtttattccctcaatgacgatctcaagccagccaaacgtgagaccgtgctgacttttatcgaccctgagggatcagaggtcgacatggtagaggagatagatcacatcggaatcatatccttccccgactttaagatccctagcaacccccggtatggcatgtggaccatcaaagccaagtacaaggaggatttcagcactacagggacagcttatttcgaagtgaaggagtatgttctgccacatttctctgtcagcatcgagcctgagtataatttcatcggatacaaaaacttcaagaactttgagatcaccattaaggcaaggtacttttataataaggttgtgacagaagcagacgtctacatcaccttcggtatccgggaagatttgaaggacgaccagaaggagatgatgcagaccgctatgcagaacactatgctgattaatggcatcgcccaggtgacttttgacagcgagaccgccgtgaaagagctgtcgtattacagtcttgaggaccttaacaacaaatatctttacatcgccgtcacagtgatagagtcgactggaggcttcagcgaggaggctgagattccaggtatcaagtacgtcctgtccccttacaaactcaacctggtggccacccccctattcctcaagcccggcattccatacccaattaaagtccaggttaaagacagcctagaccaactggtcggaggagtacctgtcacactgaacgcacagacaattgatgtgaaccaagaaacgtcagacctcgacccgtctaaatcagttacccgcgtggacgacggcgtggcatcttttgtcctgaatctgccctcaggcgtcactgtactggagttcaacgtaaaaaccgacgccccagacctgcccgaggagaaccaggctcgtgagggataccgggcaattgcttactcgtccctgagtcagagttatctctatatcgattggactgacaaccacaaggctctgctggtaggcgaacatctcaacatcattgtcacaccaaagagtccttacatcgacaaaattactcattataactatttaatcctgtctaagggaaagatcatccactttggaacgcgtgagaaattcagcgatgcatcctaccagagcattaacatccccgttacgcagaatatggtgccatccagccgcctgctcgtctattacattgttacaggtgagcagaccgctgaactcgtttcggacagcgtgtggcttaatatcgaggagaagtgcggcaaccaactccaagtgcacctctcccctgacgccgacgcctattcccctggccagaccgtaagtctgaatatggctaccggcatggacagttgggtggctctcgctgcggtcgactctgccgtctatggcgttcagcgcggggccaagaagcccctcgagagggtatttcagttcctcgaaaagtcagatctcggatgcggtgccggtggaggcctcaacaatgctaacgtatttcacctggctggcctcacatttctcaccaatgcgaacgcagatgatagtcaagagaatgatgaaccatgtaaagaaattctgcgtccaagacgaaccttgcagaagaagatcgaggaaatagccgccaaatacaagcactccgtagtgaaaaagtgttgttacgatggcgcttgcgtcaataacgacgagacgtgcgaacagcgtgccgctaggatttcactgggtcccagatgtatcaaggcattcacggagtgctgcgttgtggcatcccagttaagggctaacatctcccacaaagacatgcagcttggtcgactgcacatgaagactctcctgccagtctccaagcctgagattcgctcttacttcccggagtcatggttgtgggaggtgcacctagttccccgccgaaaacagctgcagttcgctcttcctgactcactgactacatgggaaatccagggggtcgggatctctaacaccggcatctgcgtggctgacaccgtgaaggccaaagtgttcaaggacgtgtttctggaaatgaatattccatactccgtggttcggggcgagcagatccagttgaaaggcacggtgtacaactaccgcacatcagggatgcagttctgcgtgaagatgtcagccgtcgaaggtatatgtacatccgagtcccctgtgatcgatcaccaggggacgaaaagttcgaagtgcgtccgccagaaagtcgaagggagttccagccatctcgttacatttaccgtacttcccctcgagattggtctccataatatcaacttttcactcgaaacctggttcggaaaagagattttggttaaaacattgagggtggttcctgagggcgttaagagggagagttattcaggcgtcacccttgatcctcggggtatttatggtaccataagtaggcgtaaggagttcccataccgcatccctctggacctagtgcccaaaaccgagatcaaacgcattctgtctgtaaaaggcttgcttgttggagaaatcttgtccgctgttctctcccaagaaggcatcaatattttgacccatctgcctaagggctctgctgaggccgagctgatgagcgtagtccccgtattctatgtctttcccggcaaccgaaaatcgctcgagcacttttctttttag

SEQ ID NO: 112888 - DNA, 2805 bp, Artificial Sequence
  Description of Artificial Sequence: Synthetic coding sequence
atggcccgccgcagtgtgctctactttatcctgctgaatgccttaattaataaaggccaggcgtgcttttgtgatcactacgcctggactcagtggacttcctgctccaaaacttgtaactctgggacgcaatctcggcataggcagatcgtggtggataaatactatcaggaaaatttctgcgaacagatctgcagtaaacaggagacgagagagtgcaattggcaacgctgccccatcaattgtctgctcggcgatttcggcccgtggagtgattgtgatccctgtattgagaagcagagtaaagttcggtccgtacttcggccctcacagttcgggggacagccatgtactgcccctctggtcgctttccagccatgcattccatcgaaactgtgcaaaatcgaagaggctgactgcaagaacaaattcaggtgcgactctgggagatgtatcgccaggaaactagagtgcaacggcgaaaatgactgcggcgacaactcggatgaacgagactgcggacgcacaaaggcagtgtgtaccagaaaatataatccaattcccagcgttcaattgatgggcaatggattccattttctcgcaggagagcctagaggcgaggtgctggacaattcatttactgggggcatatgtaagacagtaaagagttcaagaacatcgaatccatatcgggtcccagctaatctcgagaacgtgggctttgaggtacagactgccgaggatgatctgaagaccgacttttataaagacctgacgagtctcggtcacaacgagaaccagcagggcagcttttcctctcaaggtggatctagtttctctgtccctatcttctactccagcaaacggagcgagaacatcaatcacaattcagcatttaagcaggccatccaggcctcccataaaaaggactcttccttcattagaatacataaggtaatgaaggtgctgaacttcacgactaaggctaaagatttgcacctgagcgacgtctttcttaaggccctaaatcacctcccgttagagtacaacagcgccctttacagtcggatcttcgacgatttcggaacccactactttacatccggttcccttggaggggtttatgacctgctgtatcagtttagctcagaggagctgaagaacagtggtctgaccgaggaagaagccaagcactgtgtgcgaattgaaacgaagaagagagtgctttttgccaagaagacgaaagtcgagcatcgctgcactactaacaaactctctgagaagcatgaaggctccttcatccagggtgccgaaaagtcaatttctctgatccgtggagggcgctccgagtatggtgcggccctagcttgggagaaaggctcctccggattagaagagaagacgttttctgagtggttggagagcgtgaaggagaaccctgcagtgatcgactttgaattggcacccatcgtggacttggtgcggaacatcccctgtgcagtgacaaaaagaaataatctccgtaaagccttgcaggagtacgccgcaaagtttgacccatgccagtgcgctccctgtcccaataatgggcgtcccactttaagcggaacagaatgtctgtgcgtttgccaaagcggcacatacggcgaaaattgtgaaaagcagtctcccgactataagtccaacgcagtcgacggtcaatggggatgctggtcatcttggtcaacatgtgacgccacctataagaggtcgaggacacgggaatgtaataaccccgcgcctcagcggggtggaaagcgctgtgaaggagaaaagcgccaggaggaggattgcactttctccatcatggaaaataacggccagccatgtatcaatgatgacgaagaaatgaaggaggtagatctgcctgagatcgaggcggactcgggttgtccacagcctgttccacccgagaatggatttataaggaatgagaaacagctgtatctagtcggggaagatgtggaaatcagctgccttactggttttgagacggtgggctatcaatacttccggtgtctgcccgacggcacctggcggcagggcgatgtggaatgccagcgtaccgagtgcattaaacccgtcgtgcaggaggtccttacaattactcctttccagcgcctctaccgaatcggggagtctattgaattgacctgtcctaagggtttcgtggtggccggtcccagcagatatacctgtcaaggtaattcctggaccccccccatctccaactccctcacctgcgagaaggacaccctgactaaacttaagggccattgccaactggggcagaaacagtcagggagcgagtgtatttgcatgtcacctgaagaggattgctcccaccactccgaggatctttgtgtgtttgacacagactcaaatgattacttcacgtctccagcctgcaagtttcttgccgaaaagtgtctgaacaaccaacagctacactttctgcatatcggcagctgccaggacgggcgtcagctcgaatggggcctggaaagaacacggctgtcgagcaacagcaccaagaaggagagttgcggatatgacacatgttacgactgggagaagtgttccgcttcaacatcgaagtgcgtgtgtttactgcctcctcaatgttttaaaggtggaaatcagctttattgcgttaaaatgggctcgagcacttcagagaagacattgaacatatgcgaggtgggaaccatcagatgtgccaacaggaagatggagatattgcaccctggcaagtgcctggcctag

SEQ ID NO: 112889 - DNA, 2805 bp, Artificial Sequence
  Description of Artificial Sequence: Synthetic coding sequence
atggcacggcgatccgtactatactttatcctgttaaacgccctgatcaacaaaggccaggcttgcttttgcgaccactatgcctggactcagtggacttcatgtagcaagacatgtaatagtgggacacagagtaggcacagacaaatcgtggttgacaaatattatcaggagaatttctgtgaacaaatttgtagcaagcaggaaacccgcgagtgcaattggcagcgatgccccatcaattgcctgctgggtgactttggcccgtggtctgattgcgatccctgtattgagaagcaatctaaggtgagatccgtgcttcgaccttcccagtttggcgggcagccatgtacagcaccactggtagctttccaaccctgtatcccttcaaagttgtgcaaaatcgaagaagctgactgtaagaacaaatttcgttgtgatagcggacgttgcatagcccggaaactggagtgtaacggagagaacgactgtggtgataacagcgacgagcgcgactgtggtcgcactaaggccgtgtgcacgcgcaagtataatccgataccgtccgtacaactgatgggcaacggctttcatttcttggcgggcgagcccagaggggaggtgctcgacaatagcttcaccgggggtatttgtaagactgtcaagtccagccgtacctctaacccctatcgtgttcccgccaacctggagaacgtggggtttgaagttcagaccgctgaagatgacctgaagaccgacttctacaaggaccttacatctctcggccataatgagaaccagcaaggttccttttcctcccagggggggtcttcatttagcgtgcctattttttatagctctaagcgtagcgaaaatatcaatcataacagcgcttttaaacaagccatccaagcgtctcataagaaggacagctccttcattcggattcataaggtgatgaaagtcctcaactttacaacgaaggccaaagatttgcacctaagcgacgtctttcttaaagcccttaatcaccttccactggaatacaacagcgcactgtacagccgcatctttgatgattttggaacccactactttacatcgggcagtctgggcggcgtctatgatttattgtaccagttctcatccgaggagctgaagaacagtgggctcaccgaggaggaagcaaagcactgtgtgaggatagaaacaaagaaaagggttttgtttgctaagaagaccaaggtggaacatcgatgtactactaataaactgagtgaaaaacatgaaggcagttttattcagggagccgaaaagagcatatcactgatccgaggtgggcggtcagaatatggcgctgcattggcctgggagaaaggctcttccggcctggaggaaaagacattttccgaatggctggagtccgtgaaagagaatccagcagtcatcgactttgaactcgcccctatcgtggatcttgttcgaaatataccatgcgctgtcacaaaacggaacaatctacgtaaagcattgcaggagtatgccgccaaattcgacccctgtcaatgtgctccttgtcccaataacggtagaccgacactgtccggaaccgagtgcctgtgcgtttgtcagtcgggcacctatggggaaaactgcgagaagcagtctcctgactacaagagcaatgccgttgatggccagtggggctgttggtctagctggtcaacgtgtgatgccacctacaagcggtcaagaactcgcgagtgcaataatccagccccccagcgcggtgggaagcgctgtgagggagagaaacggcaggaagaagactgtactttcagcatcatggaaaacaacgggcagccctgcataaacgacgatgaggagatgaaagaggttgacttgccggagattgaagccgactctgggtgtccacagcctgtacctcctgaaaatggcttcatcagaaatgagaaacagctctatctagttggggaagacgttgaaatatcatgcctgacagggttcgagacagtgggataccaatattttagatgccttccagatgggacgtggagacaaggcgatgtcgagtgtcagcgcaccgagtgcattaagcctgtggtgcaagaggtcctcacaataacacctttccagaggctgtacagaatcggcgagtctattgagttgacctgtcctaagggcttcgtcgtggccgggccgtcacggtacacatgtcaaggtaattcttggactcccccgatatctaattcattgacgtgtgaaaaggataccctcacaaaattgaaaggccactgtcaactcgggcagaaacaatccggatcagaatgtatatgcatgtcaccagaggaggattgttcacatcattctgaggatctttgcgtcttcgatacagatagcaacgactatttcaccagcccagcctgtaagtttcttgccgagaaatgtctgaacaatcagcagctgcacttcctacacatcgggtcatgtcaggatggaagacagctcgagtggggactggagcgtacccgcctgtcgagtaatagtactaagaaggagagttgtggatacgatacctgttatgattgggaaaagtgtagcgcttctacttcaaagtgcgtgtgcctcctgccaccccagtgcttcaagggtggaaatcaactgtattgtgtaaagatgggcagtagcacctccgaaaagactctgaatatttgcgaagtgggaacaatccgctgtgcaaatcgtaaaatggaaattctgcatcccggaaagtgcttggcatag

SEQ ID NO: 112890 - DNA, 2532 bp, Artificial Sequence
  Description of Artificial Sequence: Synthetic coding sequence
atgaaggtcattagcctctttattcttgtaggatttattggagagttccagagtttttctagcgcctcctcgcctgtcaattgccaatgggatttttacgccccttggagcgagtgtaatggatgtaccaagacccaaactagacggcgttcggtcgccgtttacggtcagtatggtggccaaccatgtgttgggaatgcctttgagactcagagctgtgaaccaacgagagggtgccccactgaggagggctgtggcgaacggttcaggtgcttttcagggcagtgcattagcaaaagcttggtgtgtaacggcgatagtgactgtgacgaagactcagccgacgaagatcgttgtgaagactctgaacgaaggccaagctgcgatattgacaagccccctcccaatattgaactgaccggcaatgggtataatgagctaaccggccaattccgcaaccgggtcatcaacactaagtcctttggaggccagtgcagaaaggtgttttctggcgacggcaaggacttctatcgcctgtcgggcaatgtgctgagctacactttccaagtgaaaatcaacaatgatttcaactatgaattttataactcgacatggtcgtacgttaagcatacctccacagaacatactagtagtagccgtaagcgctcattctttaggtcttcctcgtcctccagtcggagctacacctcgcacactaacgagattcataaagggaagtcttatcaattgctcgttgttgagaacactgttgaggttgctcagttcattaacaataatcccgagtttctccagctggctgaaccgttttggaaagagctcagtcacttgccgtcactctacgactattccgcataccggcgcctcatagatcagtatggaacacactacctgcaatccggaagtttaggtggtgagtaccgggttttgttttacgtggactcagaaaagttgaagcagaatgacttcaattccgtggaggaaaaaaaatgtaagtcttccgggtggcatttcgttgtcaaattctcaagccatggatgcaaagaactagagaacgcccttaaagctgcatctggaactcagaacaacgttctgaggggggagccatttattcgcggagggggggcgggatttatcagcgggttatcctatctggagctagacaatcctgctggcaacaaaaggcgttacagcgcctgggccgaatccgtcacaaacctgccacaagtgataaagcagaaattaacacctctctatgaactcgtcaaagaggtgccatgcgcatctgtgaaaaaactgtacctcaagtgggccctggaagaatacctggatgagttcgatccatgccattgtcgaccatgccaaaacgggggtctcgctacagtggaggggacgcattgcctttgccactgcaaaccctatacatttggcgccgcatgcgaacagggggttttggtcggcaaccaggccgggggagtggacggaggatggtcctgctggagctcatggtccccatgtgtgcagggcaaaaagacgcggtcacgtgagtgcaacaatccacctccttcagggggcggccggagttgcgtaggggagaccaccgaatcaactcagtgcgaagacgaggagctggaacacctgagacttctggagcctcactgtttcccgttaagcctagtgcccactgaattctgtccttctcctccagctctcaaggatggctttgtgcaggatgaaggaacaatgtttcctgtcgggaaaaacgtcgtctacacctgcaatgagggatactcactcataggtaatccggtggcaaggtgtggggaggacctacggtggctagtgggagagatgcattgtcagaaaatagcctgtgtgctgccagtgctgatggacgggattcagtctcatccacagaagcccttctacaccgtgggcgaaaaagtgacagtttcctgttccggaggcatgagcttggaagggccaagcgcattcctgtgcggcagttccttaaaatggagtcccgaaatgaagaacgctcgttgtgtccagaaagaaaaccccctcactcaggcagtgccaaagtgtcagaggtgggagaaactgcagaactcccggtgcgtgtgcaaaatgccctacgagtgtggaccatctctcgatgtgtgtgcccaagacgagaggtccaagagaattctccccttaaccgtgtgcaagatgcatgtcctacactgtcagggccgcaattatacgttaaccggacgcgattcttgtaccctgcctgcctccgcagaaaaggcttgcggagcctgtccactgtggggaaaatgtgacgccgagagcagcaaatgcgtgtgtagggaagcctccgaatgtgaggaggaggggttctcgatctgcgtcgaagtgaacgggaaagaacagactatgtctgagtgcgaggccggagctctccgctgtaggggtcagagtataagcgtcacttccatccgcccctgcgctgccgagacccagtag

SEQ ID NO: 112891 - DNA, 1461 bp, Artificial Sequence
  Description of Artificial Sequence: Synthetic coding sequence
atgaaggtgatctcgctcttcatcctggttggatttatcggggaatttcaatccttctcttctgcctcttcccccgtgaattgccagtgggacttttacgccccttggtctgaatgcaacgggtgtaccaaaacccaaacacgcaggcgcagtgtggctgtgtatggacagtacggcggtcagccctgtgtgggcaacgcctttgagacccagagttgcgagccaactagaggatgccctacagaggaaggctgcggcgagagatttcgctgcttcagcggacagtgtatctccaaatccctggtgtgtaacggcgactccgactgcgatgaggatagcgccgacgaggataggtgcgaggattctgagaggcgaccctcttgcgacattgataagccaccacccaacatcgagctcaccggcaatggatataacgagctgactgggcaattcagaaacagggtactcttttacgtggatagcgaaaaacttaagcaaaacgactttaactcagtagaggaaaagaagtgcaagtcttccgggtggcattttgtcgtgaagtttagcagtcacgggtgtaaagagcttgaaaatgccctgaaggccgcttcaggcacacagaataatgtgctcagaggtgagccttttattcgcggtgggggtgcaggattcatctccggcctctcttatctcgaactggacaatcccgccggcaataagcggagatattccgcgtgggcagaatcagtcacgaatctgccgcaggtgatcaaacagaagctcacccccctttacgagctcgttaaggaagtaccctgcgcctcggtgaagaaactgtatctgaagtgggcactagaagaatatctggacgagtttgatccatgccattgcaggccatgccagaacggcgggctggccaccgtcgaggggacccactgtctctgccactgtaagccttacaccttcggtgccgcatgcgaacagggagtgttggttggcaatcaagcaggcggtgtagacgggggctggtcttgctggagtagttggagtccctgtgtccaaggcaaaaagactcgcagcagagaatgcaataacccgccacctagcgggggcgggaggtcctgtgtgggcgaaacaactgaatccacccagtgcgaagacgaggaactcgagcatttgagattactcgagccacattgctttccacttagcctggttccaactgaattctgcccctccccaccagctcttaaagatgggttcgtgcaggatgagggaacaatgttccctgtaggcaagaacgtcgtatatacttgtaacgagggttattccctgatcggcaaccccgtggccagatgtggcgaggacctgagatggttagtcggtgaaatgcattgccagaacggcaagataagtaactggatgaaggtgaacgagactctcttggtggaacaccactag

SEQ ID NO: 112892 - DNA, 1032 bp, Artificial Sequence
  Description of Artificial Sequence: Synthetic coding sequence
atgaaagttataagcctgttcatccttgtcggcttcatcggggagttccagagtttttctagtgcatctagcccagtgaactgtcagtgggacttttacgctccttggtcagagtgtaacggttgcactaagactcagacacgcagacggagcgtggcagtgtatggccagtatggtggccaaccctgcgtgggaaatgcttttgagacccagtcgtgtgagccaacccggggctgccccaccgaagaggggtgtggggaacgttttagatgtttcagcggacaatgtatatcaaaaagcctggtgtgtaacggtgattcggattgcgacgaagatagtgcagatgaggataggtgcgaggattcagagaggagaccaagctgcgatatagacaaaccccctccaaatattgagctgaccgggaatggatataatgagctgactggccaattccgaaaccgagtgatcaacaccaaatctttcggaggacagtgccgcaaagtgttttccggcgacgggaaggacttttatcggctgagcgggaatgtgctgtcttacacgtttcaagtgaagatcaacaacgacttcaattatgagttctacaactccacttggagctacgtgaaacatacgtctacagaacacacctcctcgtctcgcaaaaggtctttcttccgaagtagtagctcatcttctagatcgtacacctctcataccaatgagattcataagggcaagagctatcaactgctggtcgttgagaacaccgtagaagtggcacaattcatcaacaataatcctgagtttttgcaactcgccgaaccattttggaaagaactttcccacttgcccagcctttacgactatagtgcttatagaaggcttatcgaccagtacggaacgcattacttgcagagcgggtctctgggaggcgagtaccgagtactgttttacgtagactctgaaaagctgaaacagaatgacttcaactccgtggagaaaaaaaaaaagaaaaagaagaaaaaaaagtag

SEQ ID NO: 112893 - DNA, 1755 bp, Artificial Sequence
  Description of Artificial Sequence: Synthetic coding sequence
atgtttgccgttgtcttcttcatcctcagtctgatgacttgccagccgggcgtcactgcacaggagaaggtcaaccagcgggtgcgccgtgccgccactcccgcagctgtcacatgccaactttccaactggagtgaatggaccgattgttttccctgtcaggacaagaaatacagacatcgatccttgttgcagccaaacaaattcggaggtacaatttgtagcggcgacatctgggatcaagcttcctgttctagttcaacgacgtgtgtccggcaagctcagtgtgggcaggattttcagtgcaaggaaactggcaggtgtctgaagcgccacctggtgtgtaacggcgaccaagactgtctcgacggctctgacgaggacgattgcgaggatgtgcgcgcaattgatgaagattgtagccagtatgagcctattcccggtagccaaaaagctgctttagggtacaacattctcacacaggaggatgcccagtctgtgtacgacgcaagttattacggcggtcaatgtgaaaccgtttacaacggggaatggcgcgagctgaggtacgattctacgtgcgagaggctgtattatggagatgatgaaaaatacttccgcaagccatacaatttcctaaagtatcattttgaggcgctggctgatacgggcatctcctctgagttctatgataatgccaacgacttgctctcaaaagtcaaaaaagataagagtgattcctttggtgtaaccatcggtatcggaccagcaggtagccccctgctagtgggcgtgggtgtgtcccattcccaggacacaagctttctgaacgagttgaataagtacaatgaaaagaagttcatctttacaagaattttcactaaagttcaaacagcgcatttcaaaatgcgaaaagacgacatcatgctcgatgaagggatgttacagtctctcatggagcttccagaccagtataattatggcatgtatgcaaagttcataaatgattacggaactcactatattactagcgggagcatgggcggaatttatgagtacattttggtaatagataaggctaaaatggagtcgcttggtatcacttcccgggatattaccacctgttttggggggagcctaggcatacagtacgaagacaagatcaacgtgggtggagggcttagtggcgaccactgtaagaaattcggcggcggcaagacagagcgagcgaggaaagccatggccgtcgaggacattatttcccgagtgaggggcggcagcagcggctggagtgggggacttgcccagaacagaagtactattacataccgctcctggggccgatccctgaagtacaaccctgtggtaatcgattttgagatgcaaccgatccacgaggtgctcaggcacactagcctgggcccactagaggcaaagagacagaacctgcggcgggccttggaccagtacctcatggagttcaatgcctgccgttgtgggccttgttttaacaacggagtgccaatcctagaggggacctcctgcaggtgccagtgccgcctgggtagtcttggagccgcctgtgaacagacacagactgaaggtgcaaaagccgacggctcttggagttgttggagctcttggtccgtctgtcgcgcggggattcaggagcgccgccgggaatgtgacaatcccgctccccagaatgggggtgcgtcttgtcctggccgcaaagtccaaactcaagcctgttag

SEQ ID NO: 112894 - DNA, 1776 bp, Artificial Sequence
  Description of Artificial Sequence: Synthetic coding sequence
atgaagaatagccgcacttgggcatggagggccccagtggaattgtttttactttgcgctgccctcggttgtcttagcctgcccgggtctagaggtgaaaggccccatagcttcggcagtaacgcagtgaataaatcgtttgccaaatcacggcagatgcgctccgttgatgtgaccctgatgccaatcgactgcgaactctcttcatggagctcctggactacttgtgatccctgccagaaaaagagatatcgctacgcctacttactgcagcctagccagtttcatggggaaccctgtaatttttctgacaaagaagttgaagactgcgtcacaaaccgcccgtgtggcagccaggtaagatgtgaaggtttcgtctgcgctcagaccggcaggtgcgtgaatcgaaggctattgtgcaacggagacaatgattgcggtgatcaaagtgatgaggccaattgtcgccgaatttataaaaaatgtcagcatgagatggatcagtactggggtatcggttccctcgcctccggcatcaatctgtttacaaatagtttcgaaggccccgtgctcgaccatcgatactacgcaggcgggtgttccccacattacattttgaataccagatttcggaagccttataacgtggaatcatacactcctcagacacaggggaaatatgaattcatccttaaagaatatgagtcttactccgactttgagagaaatgtgaccgaaaaaatggcctccaaatccgggttcagctttggattcaagatccctggaattttcgagcttggaatttctagtcagagcgaccgcggcaaacactacattagacggaccaagaggtttagccataccaagtctgtgtttttgcatgcacggtctgacctcgaagttgcccattacaagcttaaacctcgaagcctgatgctgcattacgaatttctccagagggtgaagcggctgcccttggagtactcctacggcgagtatcgggatttattcagagactttgggacccactacatcactgaggctgttctagggggaatttacgagtacaccttggtgatgaacaaggaggccatggaaagaggagattatactctcaataatgtccatgcttgtgccaaaaacgatttcaaaataggaggggctattgaagaggtgtacgtttccctgggggtgtccgtgggaaagtgtcgcggcatactcaatgagataaaggataggaataagcgagatacaatggtggaggaccttgtggtccttgtgaggggtggcgcttcagaacatatcacaaccttggcttatcaagaattgcccaccgctgatctgatgcaggaatggggcgatgccgtacaatacaacccagctatcataaaggtcaaagtggaaccgctctacgagttagttacagccacagactttgcctactcctccaccgtcagacagaacatgaaacaagcactggaggagttccagaaagaagtttcctcttgtcactgcgcaccttgtcagggaaacggcgtgcccgtgctgaagggcagcaggtgtgactgcatctgtccagtcggcagccaggggctcgcatgtgaagtgtcatatagaaaaaacacacccatagacggcaagtggaactgttggtccaactggtcctcttgctctgggaggcgaaaaactagacagcgccagtgcaataaccctcctccgcagaacggcggcagcccatgttccggccccgcgagcgagacactggactgtagttag

SEQ ID NO: 112895 - DNA, 1590 bp, Artificial Sequence
  Description of Artificial Sequence: Synthetic coding sequence
atggacacctgcatgaccctggccttcaccttatcgggcagattttttatgctcctgtcacagtacagatacgcttacttgttacagcctagccagttccacggtgaaccatgcaacttttcagacaaagaagtggaagactgtgttacgaaccgcccctgcggcagccaggtgcggtgtgagggattcgtttgcgcccagacaggccggtgcgttaaccgacggctattgtgcaatggggataacgactgcggggaccagagcgatgaggctaactgcagacgaatttataagaagtgtcagcatgagatggaccagtactggggaattgggtcactagcaagcgggataaacttgttcaccaactctttcgaaggcccagtcttagaccaccgctactacgctgggggctgtagcccacattacatactaaacacgagatttcgaaaaccctataacgttgaatcatatacccctcagacacagggtaagtatgagttcattttgaaggagtacgaatcttactcggatttcgaacggaacgttacagaaaagatggcctctaaatcgggatttagctttggctttaagattcctggaatctttgagctgggtatcagttcgcagagcgaccgtggtaagcactatattaggcgaactaaacgattcagtcatactaagtccgtgtttttgcatgcccgcagcgatctggaggtggcgcactacaaattgaagccaagatcgctgatgctgcactatgagtttttgcaacgagtgaagcgtctaccgcttgagtactcatacggcgagtaccgcgatttgtttcgggattttggaacccattacataaccgaggcggtgctggggggaatttatgaatacacactggtgatgaataaagaggccatggagcgaggcgactacacactcaataatgtccacgcttgtgccaagaacgacttcaagattggcggtgctatcgaagaggtgtacgtatccctgggcgtctccgtggggaagtgccgcgggattctgaacgaaataaaagacaggaataaacgcgatactatggtggaggatctggttgtcctggttcggggtggtgcctctgagcacattacaactcttgcctatcaggaactccccaccgcggacctgatgcaagagtggggcgacgctgtacagtacaaccccgctattattaaggtcaaagttgagcccctctatgagttagtcacggccactgactttgcctacagctccactgttcgacagaacatgaaacaggccctggaagaatttcagaaagaagtttcgagttgtcattgtgccccatgtcagggaaatggggtgcctgtcctgaagggaagtcgctgtgactgcatttgccctgtcggatctcagggtctcgcctgtgaggtgtcctaccgaaaaaataccccgatcgatggaaagtggaactgttggtccaactggagttcatgctctggacgaaggaagacccgtcagagacagtgcaataatccacctcctcagaatggcggaagcccatgtagtgggccagcctctgaaacgctggactgcagctag

SEQ ID NO: 112896 - DNA, 1620 bp, Artificial Sequence
  Description of Artificial Sequence: Synthetic coding sequence
atgaggagcgtggacgtaactctgatgcccatcgactgtgagcttagctcctggtctagctggactacgtgtgatccgtgccaaaaaaaacgctaccgttacgcatacttgctgcagccttcacaattccacggtgagccttgcaacttttctgacaaggaggtagaagattgcgtgaccaacagaccctgcggaagccaggtgcggtgtgagggttttgtgtgtgctcagaccgggagatgtgtgaacagacggctgctgtgtaatggagacaacgactgtggagaccagtcggacgaggccaactgtcgcaggatctacaagaagtgccagcacgagatggaccagtattggggtatcggctccctggcctctggcatcaacctgtttaccaactcctttgagggacctgtacttgatcaccgatattatgccggcggctgctctccccattatatccttaacacccgattcaggaagccgtacaacgttgaaagctatacgccccagacacaaggcaagtatgagttcattctcaaggaatacgaaagctactcagacttcgagcgcaatgtgactgaaaagatggcgtccaagtcaggtttctccttcggctttaagattcctggcatcttcgagttaggcatctccagccagtccgatcgcggaaagcactacattagacgtaccaagcgtttctcccatacaaagtctgtgttcctccacgcaaggtccgacttggaggttgcacactataagctcaagcccaggtcactgatgcttcactatgagtttcttcaaagggtgaaacgcctgccactcgagtattcctatggagagtaccgggatctgttcagggactttggcacgcactatatcaccgaagctgtcctcggcggtatttacgaatacaccttggtgatgaacaaggaggccatggagagaggggattacactctgaacaatgtgcacgcctgcgctaaaaatgattttaagataggcggggcaattgaggaagtgtacgtgtcactgggtgtctcagtgggcaagtgtcggggaatcctcaacgaaattaaagacaggaataagcgggacaccatggtggaagacttggttgttctcgtgagaggcggcgctagcgagcatattacgactctggcttatcaggagcttcccacagccgacctaatgcaggagtggggggatgcggttcagtacaatccagccatcatcaaggtgaaagttgaaccgttgtatgaactggtcacagcgaccgactttgcatatagctccactgtgcgacaaaacatgaaacaagcactcgaagagtttcagaaagaagtgagctcctgccattgcgccccttgtcagggaaatggcgtccctgtcttgaagggctcccgctgcgattgcatttgccccgttggtagccagggactggcctgcgaagtgagttaccggaagaatacacccattgacggcaagtggaattgctggagcaattggtcttcatgctcaggccgccgcaaaaccagacagagacaatgcaataacccaccaccccaaaatggtggcagcccgtgcagtgggccagcttctgaaacgctggactgcagttag

SEQ ID NO: 112897 - DNA, 675 bp, Artificial Sequence
  Description of Artificial Sequence: Synthetic coding sequence
atggcaactcatcatacactctggatgggtctcgctttgctgggcgtgctgggagacctccaagccgcccctgaagctcaggtttcagtccagcctaattttcagcaggacaaatttctggggcgctggttctcagctgggttggcctctaattccagctggttaagagagaagaaggctgcactgtcaatgtgtaaaagcgtggtagctcctgcaactgacggagggcttaatttgacttccacattccttagaaagaaccagtgcgaaacacggaccatgcttcttcagcctgctggctccttgggctcttattcctatcggagcccaagggagtggggtctgcacagacctcccggcccaagcttgggagccactctcgcaggcacgaccctaggacagccgcccgcagccgaaattcacggggtgggcgactgggggtcgacttactcagtttccgtggttgaaacggactatgaccagtacgccctgctgtactcacagggtagcaaggggccaggcgaggacttccggatggcgacgctctacagcaggacccagaccccccgagctgaactgaaagagaaattcaccgccttctgcaaagctcaaggctttacagaagatacaatcgtgttcctgccacagaccgataagtgcatgactgagcagtag

SEQ ID NO: 112898 - DNA, 495 bp, Artificial Sequence
  Description of Artificial Sequence: Synthetic coding sequence
atgctgccacctggaaccgcaacgctcctcacactcttgctcgctgccggctccctcggacaaaagccccagcgccctagacggcctgcgagccccatttccaccatacagccaaaggccaatttcgacgcccagcagttcgctggaacatggttgctagtggctgtcggctccgcctgtcgcttcctgcaggagcaagggcatcgcgctgaggcgacgaccttgcacgtggcaccccagggtactgccatggcagtgtccacatttcggaaattggacggaatctgttggcaggtgaggcaactctatggcgacaccggcgttctgggacgcttcttacttcaggcgagggacgcacggggtgcagttcacgtggtagtggcggaaaccgattatcaatctttcgctgtgctctacttagaacgcgctgggcagctctccgttaagctttatggtgcacagggcgtcgttacggaccgccccggtgtaggttag

SEQ ID NO: 112899 - DNA, 1680 bp, Artificial Sequence
  Description of Artificial Sequence: Synthetic coding sequence
atgagcgcttgtcgttcgtttgccgtcgccatctgcatactggagatttcgatattaactgcgcagtatactacaagctacgatcccgaactgacagagagctcaggaagcgcatcccacatcgactgcaggatgtctccctggtcagagtggtcccagtgcgatccatgcctgcgccagatgttccggtcgagatctatcgaagtgtttgggcagtttaacggtaaaaggtgtaccgacgcggtgggagaccgaaggcagtgcgttcccactgagccctgcgaagacgctgaagacgattgcgggaatgacttccagtgctctacgggtcggtgtattaagatgagactccgatgtaacggggataatgattgcggcgatttttcagatgaggacgattgcgagtccgaaccacggccaccctgcagggatagggtcgtggaggagtcagagctagctcggaccgcaggctacggcattaatattctgggcatggaccccctgagcactcctttcgataatgaattttacaatggactttgtaaccgtgaccgggatggcaacactcttacctactacaggcgaccttggaacgtggcatctctgatctacgaaaccaaaggagaaaaaaactttcgtactgaacattatgaggagcagattgaagccttcaagagtattattcaggaaaagacctccaattttaacgctgccatatccctgaaatttacccctacggaaaccaataaagctgagcagtgctgtgaagaaacggccagcagtatttctcttcatgggaagggcagttttaggttcagctactcaaaaaatgagacatatcagctctttctctcctacagctccaaaaaagaaaagatgtttctccatgtaaaaggtgagatccacctcgggcgatttgtcatgaggaatcgcgacgttgtgttgacgacaacctttgtcgatgacataaaggccttaccaaccacctacgagaaaggagaatacttcgcgtttcttgagacttacggaactcactattcttcatccggaagtttgggtgggttatacgaactgatctatgtactggacaaggccagcatgaaacgcaagggagtcgaattgaaagatattaaacggtgcttggggtaccacctggacgtgagcttggcatttagcgagatctctgtgggagctgagttcaacaaggacgactgtgtgaagcgaggcgaggggcgcgccgtcaatatcacttctgaaaatttgatcgacgatgtggtgtctctcatccgcggaggtactagaaagtatgcctttgaattaaaggagaagctactgcggggcaccgtgatcgatgtcaccgactttgttaattgggccagctccatcaatgatgcccctgtgctgatttcacagaaactatcgcccatatacaacttagtacctgtcaagatgaagaatgcccacctgaagaaacagaatctggaacgcgccatcgaggattatatcaatgagtttagtgtgcgtaagtgccatacctgccagaatggcggcacagtgatactgatggacgggaaatgtctttgtgcctgtccgttcaagtttgaggggatcgcatgtgagatatcaaagcagaaaatcagcgagggcttgcccgcccttgagttccctaacgaaaagtag

SEQ ID NO: 112900 - DNA, 1770 bp, Artificial Sequence
  Description of Artificial Sequence: Synthetic coding sequence
atggggagcaatttgagtcctcaactgtgtctgatgccttttattctagggctgttgagcggcggggtgaccacaactccatggagtcttgcccagcctcaaggaagctgtagtctcgagggcgtggaaatcaaaggtgggagttttcggttgctgcaggagggacaggccctggaatatgtgtgccccagcgggttctacccataccctgtccagactcgcacatgtcgctcaacgggatcctggagtaccctcaagacacaggatcagaagacagttcgaaaggccgagtgtcgcgctatccattgccctcgacctcacgattttgagaacggagaatactggcccagatcaccatattacaatgtatctgatgagataagttttcattgttacgacggttacaccctgagaggcagcgcaaacagaacatgtcaggtgaacggccggtggtccggccagaccgccatctgcgacaatggagctggctactgttcgaacccaggcataccaatcgggaccagaaaggtgggttcccaatatagattagaggattctgtcacttaccattgctcgcgagggttgacactgcgcggtagccagagaaggacctgtcaggaaggggggtcttggagtggtaccgaaccctcctgccaggatagctttatgtacgatacccctcaggaggtggccgaggcattcctcagttccctaactgagactattgaaggcgtcgatgccgaagacgggcacggacctggcgaacaacagaaacgaaagattgtgctggacccctccggtagcatgaatatctacctagttttagacggctccgacagcatcggagcgtccaattttacaggcgccaaaaaatgcctcgtgaacctgatcgagaaggtggccagctatggggtgaaacccaggtacgggttggtgacgtacgctacttacccgaagatctgggtgaaggttagcgaggccgacagctcaaatgccgattgggtgacgaaacagctcaacgagattaactatgaggaccacaagctcaagagtggtaccaacacaaagaaagcgttacaggccgtgtactctatgatgtcatggcccgacgacgtcccacctgagggctggaacagaacccgccatgttattattctaatgaccgacggactgcataatatgggaggggaccctattacagtgatcgatgagattcgggacctattgtatataggaaaggaccggaaaaatccaagggaggattacttggacgtctatgtttttggcgtagggccgctagtgaatcaagtaaatatcaatgcactggcaagtaagaaggataatgagcagcacgtgtttaaagttaaagacatggaaaacctggaggatgtcttctaccaaatgattgatgagtcccaaagtctgtcattatgcggcatggtttgggagcatcggaagggtaccgactatcacaaacaaccatggcaggctaagatctccgtgatcaggcccagcaagggccatgagtcttgtatgggtgcggtggtctccgagtactttgtgctgacggctgcccattgctttacagtggacgacaaggagcattcaataaaagtcagcgtcggtggggaaaagcgtgacctcgagatcgaagtggtgctgtttcatccaaactacaacatcaacggaaaaaaagaagctggcataccagagttctacgactatgatgtggctctgattaagctgaaaaataagcttaaatacggttag

SEQ ID NO: 112901 - DNA, 1770 bp, Artificial Sequence
  Description of Artificial Sequence: Synthetic coding sequence
atgggtagtaatctgagtccacaactgtgtttgatgccctttattctgggcctgcttagcgggggcgttacaacgacgccgtggtctctagcccagccacagggcagctgttcccttgagggtgtagagatcaagggcgggagcttccgcttactacaagagggacaggctttagagtacgtttgtcctagtggattttacccataccccgtgcaaacaagaacatgccgctctacgggatcctggagcaccctgaagacccaggaccaaaagaccgtacgcaaagctgagtgtcgagcaatccactgtccaagaccccacgattttgaaaacggggaatactggccaagaagtccttattataatgtgtccgacgagatctcattccattgctatgacggctacacattgagaggctcagccaaccggacttgccaagttaatggtaggtggagcggccagactgctatttgtgataatggggctggatactgctccaatcctggcattcctatcggcacccgtaaggtgggaagtcagtatcgcctggaggattctgttacataccattgtagtcgagggctgaccctgcgaggaagtcagcggcggacatgccaagagggaggttcttggtcaggcacagagccctcttgccaggattccttcatgtatgatactccccaggaagttgccgaagctttcctgtcaagtctcacagagacaatagagggcgtagacgccgaggatggtcatggccccggcgagcaacagaagcgcaaaatcgttctggatccatctggctctatgaacatttacctggtgctggacggatccgattcaatcggggcttcaaatttcaccggcgctaagaagtgtttggtaaacctgatcgaaaaagtggcttcgtatggagtcaagcctcgctatgggctggtaacttatgccacatatccaaagatttgggtaaaagttagcgaggcggactcttcgaatgctgattgggtaaccaaacagctgaacgaaatcaactacgaagatcacaaactgaaaagtggaaccaacaccaaaaaggccctacaggccgtgtactctatgatgagttggccggatgacgtgccccccgaggggtggaataggacacgccacgtcatcattttgatgacagatggactccacaatatggggggagaccctatcaccgtgattgatgagatccgggatctgctgtacatagggaaggaccggaagaaccctcgagaagactacctggatgtgtacgtcttcggcgtcgggcccctggttaatcaagtgaatattaatgcactagcctccaagaaggacaacgagcagcacgtgttcaaggtgaaggacatggagaacctggaggacgtattttatcagatgattgatgagagccagtccctcagtctgtgcggtatggtctgggagcaccgtaaaggcaccgactaccacaaacaaccatggcaggcaaaaatatctgtcattcgtccttctaaaggacacgaatcttgtatgggggccgtagtatcagagtacttcgtgctgacggcagcccactgcttcactgtggatgataaggagcactcgataaaggtctcggtaggcggcgagaagagagacctcgagattgaagtggtgttattccatccaaactacaacattaacggcaagaaggaggctgggattcctgagttctatgactacgacgtcgctctgattaaactcaaaaacaagttgaagtacggctag

SEQ ID NO: 112902 - DNA, 2295 bp, Artificial Sequence
  Description of Artificial Sequence: Synthetic coding sequence
atggggtccaacttatctccacaactgtgcctgatgccgtttatcctgggactattgtcgggaggtgtaacaaccacaccatggagtttggctcgccctcagggctcctgctccctcgagggtgtggaaatcaaggggggcagtttcaggctacttcaggaaggccaggcccttgagtacgtctgcccttccggattctacccataccctgtgcaaaccaggacttgcagaagtacaggctcttggtctacactcaagacacaggatcagaagacagtcaggaaggcagagtgtagagcgatccactgccccagacctcacgattttgagaacggagaatattggcccagaagcccctactataatgtgagcgatgaaatctcatttcattgctacgacggttataccctgagaggaagtgctaataggacatgtcaggtgaatggtaggtggagtggtcagacagctatctgtgacaatggcgcaggatactgttccaaccctggaattcctataggtaccaggaaagttggttcgcagtaccggctcgaagattcagtcacatatcattgttccagagggctgaccctccggggctcccaaaggaggacctgtcaggaaggtgggtcttggagtggtacagagcccagctgtcaagattcctttatgtacgacactcctcaggaggtagccgaagcctttctgtcgtctctcaccgaaaccattgagggggtcgacgccgaggacggccacgggccaggagaacagcagaagcgtaagatcgtgctcgatccctctggatcaatgaatatatatcttgtgcttgacgggagcgacagcattggcgcatcaaatttcactggcgcaaagaagtgtttagtcaatctaattgagaaagtggcttcgtacggcgtcaaaccaagatatggcctcgttacttatgctacctatccgaaaatatgggtgaaagtctctgaggctgactcatctaatgctgactgggtcactaaacaactgaacgaaatcaactacgaagatcacaagcttaagagtggcacaaatacgaagaaggcccttcaggcagtatacagcatgatgagctggccagatgatgttccaccagagggctggaatcgaactcggcatgtcattattctgatgaccgatggcctccataacatggggggggatcctataacagtcatcgatgagatcagagacttactttacatcggcaaagaccggaaaaacccccgcgaagactaccttgacgtgtatgtgtttggcgtgggcccgcttgttaaccaggtcaacattaatgccctggcttctaaaaaagacaacgaacaacatgtttttaaggttaaggacatggaaaatcttgaggacgtgttctatcagatgatcgacgagtcccaaagcctatctctgtgtggcatggtctgggagcaccggaaagggactgactaccacaagcagccatggcaggccaaaatctcagtgatccgcccttcaaaaggtcacgagtcatgtatgggagccgtggtgtctgaatacttcgtgttaactgctgcacattgttttaccgtggacgataaggaacacagcatcaaggtctccgtgggcggggaaaagagagatctggagatagaggtggtgctctttcatcccaactacaatattaatgggaaagaggaggccggaatccctgagttttatgactacgacgttgccctgattaagctcaaaaataagttaaagtacggacagactatcaggccaatctgcctgccatgcaccgaaggcacaacgagagctctcagactgccacctacgacaacgtgtcaacagcagaaagaggagctgctgcccgcacaagacataaaagccctgtttgtgtcggaggaggagaaaaagcttaccaggaaggaagtctacatcaagaatggagacaaaaaaggctcctgcgagcgggatgcccagtatgctcctggatacgacaaggttaaggatatatccgaagtggtgaccccccgcttcctgtgcacaggtggcgttagtccatacgccgatccgaatacatgccggggcgactcaggagggccccttattgttcacaaacggtcccggtttatccaagtcggcgtgatttcgtggggggtggtcgatgtttgtaagaatcagaagcgacaaaagcaagttccagcccacgcccgtgactttcacatcaacctcttccaagtcctcccttggttgaaagaaaagctgcaggacgaagatctgggctttctttag

SEQ ID NO: 112903 - DNA, 2295 bp, Artificial Sequence
  Description of Artificial Sequence: Synthetic coding sequence
atgggtagcaatctgtccccgcaactttgcctgatgccgtttatcctaggattgctttctggtggagtgacaaccaccccctggtcactcgctcgaccacaaggatcatgttcacttgagggcgtcgaaatcaagggcgggagcttccgtctgctacaggagggccaggctctcgaatatgtctgtccgagcggcttttacccttaccctgttcagacccggacatgtagatcaactggatcctggtctacactgaaaactcaggaccaaaagaccgtgcgaaaggctgagtgtagggccattcactgcccgcgaccacacgacttcgaaaacggagagtattggccgcggtccccttattataatgtgtctgacgagatcagctttcattgctatgatggctatactctgcgcggctctgccaataggacttgtcaggtgaacggaaggtggtctgggcagacggccatctgcgataacggcgctggatactgttccaaccctggcattccaatcggcacccgaaaggtgggaagccagtatagacttgaggacagtgtgacataccattgctcccggggactgaccttgaggggctcgcagaggagaacttgccaggagggtggatcatggtcgggcactgagccgtcatgccaagactcgtttatgtatgacaccccccaggaagtggcggaagcttttctgagttcccttactgagacaatcgaaggggttgacgccgaggatgggcatgggcccggggagcagcaaaagcgaaaaattgtcctagatccttcagggtccatgaacatctacctggtgctcgatggtagcgactccatcggcgcgagcaacttcacaggcgccaaaaagtgtctggtgaacctgatcgaaaaagttgcttcttatggggttaagccaaggtatgggctggtgacatatgctacctatccaaaaatctgggtaaaggtcagcgaggcagacagtagtaatgctgactgggtgaccaaacaactgaatgaaattaattacgaagatcataagttaaagagtggcaccaacaccaagaaggcgctgcaggctgtgtactccatgatgtcctggccagacgacgtgccacccgagggatggaaccgaacaaggcacgtgatcatacttatgaccgacggcttgcataatatgggcggcgatcctatcactgttatcgacgagatcagagatttgctgtatatcggcaaggatcgaaagaaccctcgcgaggactacctcgatgtgtacgtgtttggagttggcccgctagtcaaccaagtcaatatcaatgctttggccagcaaaaaagataacgagcagcacgtgttcaaggtcaaggatatggagaatctagaagatgtattttaccaaatgatcgatgaaagccagagcctttccttatgcgggatggtctgggaacacaggaaaggtaccgactaccacaagcagccttggcaggccaaaatcagtgttataaggccctccaaggggcacgagagctgtatgggtgccgttgtcagtgaatatttcgtgctcacggcagcccactgttttaccgtggatgacaaggaacatagtattaaagtgtcggtcgggggcgagaaacgggacctcgagatcgaagtggtattgtttcatcccaattacaatatcaacggcaaaaaagaagccggcatcccagaattctatgactatgacgtagccctcataaagctgaagaataaactcaagtacggacagactatacgtccaatttgcctgccttgtaccgaaggtactactagagctctgaggctgccacccacaacaacttgtcagcagcagaaagaagagctcttgcccgctcaggatatcaaagccctttttgtgtctgaggaggaaaagaagctgactcgcaaagaagtgtacattaagaatggggacaagaagggatcatgcgagagagatgcccagtacgcaccaggatacgataaagtcaaggacattagtgaagtggtgacccctcgattcctctgcacagggggcgtttccccatacgcagatcctaacacctgtagaggcgacagcggagggccattgatcgtgcataaacgctctcgttttatccaggtcggggtcatatcgtggggggttgtcgatgtgtgtaaaaatcaaaagcgtcaaaaacaagtccctgcccatgctcgggatttccacatcaacctcttccaagtcctaccttggttgaaggagaagctccaggatgaagatctggggttcctgtag

SEQ ID NO: 112904 - DNA, 2295 bp, Artificial Sequence
  Description of Artificial Sequence: Synthetic coding sequence
atggggtcaaatctttcaccccagttgtgtctgatgccattcattcttggattactgagcgggggcgtcacaaccaccccatggagtctggcgcgcccccaaggatcttgtagtctcgaaggcgttgagatcaaaggggggagctttagactcctgcaggagggtcaagcgctggaatacgtttgccctagcgggttctacccttacccggtgcagacaaggacttgcaggtccactgggtcctggtccacactgaagacacaggatcagaagactgtgagaaaggcagaatgtcgggccatccactgcccccgtccccatgactttgagaatggcgaatactggccacgaagcccatattataatgtatctgatgagatcagcttccactgttacgacggctatacactgaggggcagtgccaaccggacatgtcaggtgaacggacggtggagtggccaaacggcgatatgcgacaacggggccgggtactgtagcaaccctggcatccccattggcactagaaaagtaggcagtcagtataggttagaggactccgtgacataccattgctccaggggcctcactttgagaggctcccaacgacggacttgccaggagggcggatcttggagcggaactgagcccagctgtcaggactccttcatgtacgatacaccacaggaggtagcggaagccttcctgtcatccctgacagagactattgaaggagtggacgcagaggacggccacggcccaggtgagcagcagaagaggaagatcgttttggatcctagcggctctatgaacatatacctcgtactcgacggctctgatagcattggagcatccaattttacaggggccaagaaatgcctggttaatttaatcgaaaaggtggcctcctatggagtcaaacccaggtacggactggtgacatacgctacataccccaagatctgggtgaaagtatctgaggcagattcttctaacgctgactgggttaccaaacaattgaatgagatcaactacgaagatcacaagctgaagtcaggaactaatacaaaaaaggctctacaggccgtatattccatgatgtcttggcctgatgacgtcccacccgaaggatggaatcggactaggcacgtcatcatcctcatgaccgatggtttgcacaacatggggggcgaccctattacggtgatagacgagatccgggatctactttacattggtaaggatagaaagaaccctagagaggactatctcgatgtgtatgtcttcggagtggggcctttggtgaaccaggtgaatatcaacgctctggctagcaaaaaggacaacgaacagcacgtgtttaaggtgaaggatatggaaaatctggaagacgtgttttatcagatgatagacgagtctcagtctctcagcttatgcggtatggtttgggaacacagaaaaggaacagactaccataaacagccatggcaagccaagattagtgtgatacgcccgtctaagggccacgagtcctgtatgggggctgtggtctctgagtatttcgtactgacagctgctcactgtttcactgtggatgacaaagaacattctatcaaggtctctgtgggaggcgagaaacgtgacttagaaatcgaagtcgtactgttccacccaaattacaatattaacggcaagaaagaggccggaatcccagagttctacgactacgacgtggctctgatcaagctgaaaaacaaattgaaatatggccagactatacgaccaatttgcctgccttgcacagagggcacaactcgggcattgaggctgcctcccaccacaacctgccaacagcaaaaagaggaactccttccagcccaggacatcaaggccctctttgttagcgaagaggagaaaaaactaactaggaaagaggtatacatcaagaatggcgataagaaagggagctgcgaacgggacgcacagtatgctccagggtatgacaaggtgaaagacatctctgaagttgtgacccctagattcttatgtacagggggagtgtccccctatgctgaccctaatacatgccgtggagattccggcggccccctgatcgtgcacaaacggtcccggttcatccaggtcggtgtcatctcctggggggtagtcgatgtgtgtaagaatcagaagcgacagaaacaggtccctgcccacgctagggactttcacataaacctgttccaagtgctgccctggttgaaggagaagctgcaggacgaagatcttggttttctttag

SEQ ID NO: 112905 - DNA, 2295 bp, Artificial Sequence
  Description of Artificial Sequence: Synthetic coding sequence
atgggctcaaatctgtcacctcagctttgtctgatgccatttattctcggactgctttctggaggcgtaacaaccacaccatggtcgcttgcaaggcctcagggtagttgctccttggagggtgtggagattaagggtgggagtttccgccttctgcaagaggggcaggcactcgagtatgtatgtccctccggtttttatccttacccagtgcagaccagaacttgcagatcaacaggcagttggagcacattaaaaacccaggatcagaagaccgtaaggaaggcagaatgcagagcaattcattgtcccaggccccacgatttcgaaaacggagagtactggcctaggagtccttattataacgtttctgatgaaatctcatttcattgctatgacggatataccctcagagggtctgcgaaccgaacctgtcaggttaatggaaggtggtcaggtcagactgctatctgtgacaacggcgcagggtactgtagcaatccaggaatccctattggcactcggaaagtcggaagccagtaccggttggaagacagtgtgacttaccattgctctagagggttgacgctgcgggggagccaacggcgaacctgtcaggagggcggaagctggagcgggaccgagccttcatgccaggatagcttcatgtacgacaccccacaggaggtggctgaagcgttcctgagttcactgacagaaaccatagagggcgtggacgccgaagacggtcacggccctggtgaacagcagaaaaggaagattgtgcttgatccaagcgggtctatgaacatttacctggtgcttgacgggtccgatagtattggagctagcaactttacaggcgccaaaaagtgtctcgtgaatctaatcgagaaagtcgcttcttacggtgtcaaaccgcgctacggcctggtgacctatgcaacatatcccaaaatctgggtgaaggtgagtgaagccgattctagtaacgccgattgggtgactaagcagctgaatgaaatcaactacgaggaccacaagttgaaatccggcaccaacacgaagaaagcactccaagccgtttactctatgatgagttggcctgacgacgtgccccctgagggctggaatcgcacaagacatgtcataatactcatgactgatggactgcacaatatgggcggagacccgattacagtgattgatgagattcgggacctgctgtacatcggtaaagaccgcaaaaacccacgcgaagactatttggacgtctacgtgttcggcgtgggtcctcttgtgaatcaggtcaacatcaatgctctggccagtaagaaagacaacgaacaacatgtgttcaaggttaaggatatggagaacctagaggatgtgttctaccagatgatagatgaatctcaaagcctgtctctttgtggcatggtttgggagcacagaaaaggcaccgactatcacaaacagccttggcaagccaagatatcagtcatccggccctccaagggtcacgagtcctgcatgggcgcagtcgtatctgaatatttcgtgttgactgccgcccattgtttcacagtggacgacaaggagcactccatcaaagtatccgttgggggcgaaaagagagaccttgagatcgaggttgttcttttccaccccaactacaatatcaatggcaaagaggaagcgggaattcccgagttttacgattacgatgtcgctttgattaagttgaaaaacaagcttaagtatgggcagaccattcggccaatctgtcttccctgcaccgaaggaacaacccgggcgctccggctccctccaacaaccacttgtcaacagcagaaagaagaacttctgcctgctcaggacatcaaggctttatttgtgtctgaagaggagaagaagctgactcgaaaggaagtttacataaagaacggggataagaagggctcctgtgagcgtgacgcacagtatgctccagggtacgataaagtgaaggacatctcagaggtcgtcaccccgaggttcctgtgcaccggtggggtctcaccttacgcggaccccaacacgtgtcgtggcgacagcgggggacccttaatcgtgcacaagcgcagtagatttatccaagtcggcgtgatctcttggggtgtcgtcgatgtgtgcaagaaccagaagcgccagaagcaggtcccggcccacgcacgggattttcatataaacctgtttcaggtattgccctggctgaaggagaagttgcaggacgaggacttgggctttctgtag

SEQ ID NO: 112906 - DNA, 2295 bp, Artificial Sequence
  Description of Artificial Sequence: Synthetic coding sequence
atgggctccaacttgagtcctcagctctgcctcatgccctttatcctgggcctgctgagcgggggagttactacgactccatggtctttggctcggccacaaggctcctgctctctggaaggggttgagattaaaggcggcagtttccgactgctgcaggaaggacaggcactcgagtacgtttgtccttcaggtttctatccataccccgttcagaccaggacctgccgcagcactggcagctggtccactctgaagactcaggaccagaagaccgttagaaaagctgagtgcagagctatacactgtcctaggccacacgactttgagaacggagaatactggcccagatctccttactacaatgtgagcgatgaaatcagttttcactgttacgacggttacaccctgcgggggagtgccaatcggacatgtcaagttaacggccgttggtccggacagaccgcgatttgtgacaatggggccggttactgcagtaatcctggaattccaatcggaacccgtaaggtaggctcccagtaccgcctggaggacagcgtcacgtaccactgctcaagaggactgaccctgcgcggctcgcaacgcagaacgtgccaggagggcggaagttggtcaggcacagaacccagctgccaggattccttcatgtacgatacccctcaggaggtggctgaggctttcctgagtagcctcacagagacaattgagggcgtggacgcagaagatgggcacggacccggagagcagcagaaaaggaaaattgtcctggatccgtcaggcagcatgaacatatacttagtgttggacggatccgacagcattggagcttccaattttacaggcgccaaaaaatgtctcgtaaacctcattgagaaggtggcttcatatggggtgaagcctcgctacggacttgtcacctatgccacgtatcccaagatttgggtcaaggtcagcgaggccgactccagcaacgctgattgggtgacgaaacagttgaacgagattaattatgaagatcacaagctcaagagtggaacgaacactaagaaagctcttcaggcggtgtacagcatgatgtcctggcctgacgatgtgccaccggagggctggaataggacgaggcacgtaatcatcctgatgacagatggactgcacaatatggggggggatccaatcaccgttatcgatgagatccgagatctgctatatatcggaaaagataggaagaatccccgtgaagactatctcgatgtgtacgttttcggtgtgggaccactggttaatcaggtgaacataaacgcactggccagcaaaaaagacaatgagcaacacgtcttcaaagttaaggacatggaaaatctggaggacgtcttctaccagatgatcgacgaatcacaaagcctgagcctgtgtgggatggtatgggagcaccggaagggcactgattaccataaacagccatggcaggcgaaaatttcagtcatccggccgtccaaaggccatgaaagctgtatgggcgcagttgtttcagagtactttgtgttgactgccgcccattgttttacagttgacgataaagaacattccatcaaggtctccgtgggaggcgaaaagcgagatcttgagatcgaggtggttctcttccacccaaactacaatatcaatgggaaaaaggaagccggaatccccgagttctatgactatgatgtggccctgattaagcttaagaataagctaaagtacggccagactatccgacctatctgtttgccctgcacagaggggactacacgcgccctccggctaccccctacgactacatgtcagcaacaaaaagaggagctgctgcccgctcaggacatcaaggccctctttgtgtcagaagaggaaaaaaagctgacccgcaaggaagtgtacataaagaatggcgacaagaaaggaagctgcgagagggacgcacagtacgcccctggatacgacaaggttaaagacatttccgaggtcgtgacgccccggtttctctgtactggcggcgtgtccccctatgccgatccgaacacctgtagaggcgatagtggggggcccctgatcgtacacaaacggagcaggtttatacaagttggggtgatttcttggggcgtggtagatgtgtgtaaaaaccagaagagacagaagcaggtgcccgctcacgctagggactttcatataaacctctttcaggtccttccttggcttaaggaaaagctacaggacgaagatctaggtttcctctag

SEQ ID NO: 112907 - DNA, 2295 bp, Artificial Sequence
  Description of Artificial Sequence: Synthetic coding sequence
atggggtcaaaccttagcccccagctatgtcttatgccttttattttaggcctcctttctggcggtgtgaccacaaccccgtggtcactagccagacctcaaggttcctgctcgctcgaaggcgtcgagatcaaaggggggagcttccggctgttgcaagagggtcaggcattagaatacgtgtgtccctccggcttttatccatatccagttcagacacggacctgccgcagcactgggtcctggagtaccctaaagacgcaggaccaaaaaacagtgaggaaggccgagtgccgagccatccactgccccagacctcatgattttgagaatggagaatattggcctcgcagcccatattataacgtgagtgacgagatctccttccattgttacgacggctatacactacggggctcagcgaaccgtacatgtcaggtgaacggcaggtggagcggtcagactgccatttgcgataatggggccggctactgcagcaacccaggtatccccatcggaacaaggaaggtaggatcccagtacaggttggaggactcagtgacctaccactgttcccgaggcctgaccctgcgggggtcacagcggcggacctgtcaggaaggtggctcttggtcaggaaccgaaccatcatgccaagattcgttcatgtacgatactccccaggaggtcgccgaagcctttctgtcaagcctgaccgagaccattgaaggagttgatgctgaggatggtcacgggcccggggaacagcagaaaagaaaaatcgttcttgatcctagcgggagtatgaacatctacttggtcttggacgggagtgatagcataggcgcctctaattttaccggagccaaaaagtgcttagttaaccttatcgagaaagtggcatcttatggggttaaaccacggtatggcctggttacatacgcaacgtatcctaagatttgggttaaagtgtctgaggccgatagctccaatgccgactgggtgacgaagcaacttaatgaaattaactacgaagatcacaagctgaaatctggaaccaacaccaagaaggccctgcaggcagtatattccatgatgtcatggcccgatgatgttccacctgagggatggaatcgcactcgacatgttattattctaatgaccgatggcctgcataacatgggtggagatccgattacggttatcgacgaaatccgggacctgttgtacatcgggaaagatcggaaaaatcctagggaagactatttggacgtttacgtgtttggggttggccctttggttaatcaggtgaacattaacgccctggccagcaaaaaagataacgagcagcatgtcttcaaagtgaaggatatggagaatctggaggacgtcttctatcaaatgatcgacgaatcccaatctctgtcattatgtgggatggtgtgggagcaccgtaagggaacagactaccacaagcagccatggcaggcaaagatctccgtgatccgccctagcaagggccatgagagctgcatgggcgctgtcgtatccgagtattttgttctgactgcagcgcattgctttactgtagatgataaagaacatagcatcaaggtgtccgtcggtggggaaaagagggatttggagatcgaagtggttttatttcatcccaactataacatcaacggcaaaaaggaagcagggattccagagttctacgattatgatgttgctcttattaagttgaaaaacaagcttaagtatgggcagaccatccggcccatctgcctgccatgcacagaggggacaacacgagctctgaggctgccgcccacaaccacatgtcaacagcagaaggaggagctgctgcctgcccaggatatcaaggctctgttcgtctctgaggaggagaaaaaattgacgaggaaggaagtctatatcaagaacggggacaagaaaggtagctgtgagcgggatgcccaatatgcaccaggatatgataaagtaaaggacatttccgaagtcgttacacctcggttcctatgcacagggggcgtctctccttacgctgacccaaatacatgtcgcggagacagcggtggaccccttatcgttcacaagcgcagcagattcatccaggtgggagtgattagttggggtgtcgtggatgtgtgtaagaaccaaaaaaggcagaagcaggttcccgcccacgcaagagattttcacatcaatctgtttcaagtgttgccatggttaaaagaaaaactccaggatgaggatcttggctttctgtag

SEQ ID NO: 112908 - DNA, 2295 bp, Artificial Sequence
  Description of Artificial Sequence: Synthetic coding sequence
atgggttctaacttaagcccccagctgtgtctcatgccattcatcctgggcttgctgtccggcggagtgacaacaactccttggtctttagctagaccgcagggctcgtgctctctggagggcgtggagatcaagggagggtcctttagacttttacaagaaggacaggcacttgagtatgtatgtccttccggcttttatccctaccctgtacaaacaaggacgtgtcggagcactggcagttggtccactctcaagactcaggatcagaagacagttcgcaaagctgaatgtcgggccatacattgcccaaggcctcatgactttgaaaacggcgaatactggccacgatccccctattataacgttagcgacgagattagctttcattgttacgacggctatacactgcgggggtctgccaataggacttgtcaagtgaatggaaggtggtccggccaaaccgcgatctgtgataatggagcaggatactgctctaacccaggaatcccgataggaactaggaaagtcggctcccagtacagactggaagacagcgtaacttatcactgttcaagaggtctaactctcaggggaagtcaaaggcgaacttgtcaggagggcggcagctggagcggcactgagccaagctgccaggacagcttcatgtacgatacgccacaagaggtggccgaggcattcctgagcagcctcacggaaacaattgagggggttgatgctgaagacggacacggaccaggcgaacagcagaagaggaaaatcgtcctggatccctccggatcaatgaacatatatctggtactcgacgggagcgactccataggagcaagcaactttacaggagccaaaaaatgcctcgtcaatctcatcgagaaggtcgccagctatggcgtgaaacccagatatggacttgtgacttacgccacatatccaaaaatctgggttaaggtatccgaggccgacagctctaatgccgactgggtaaccaagcagcttaacgagatcaattacgaggaccacaaacttaaatccggcacaaataccaagaaagctctccaggccgtgtactcaatgatgtcatggccggacgatgtgcctccagaagggtggaacagaaccagacatgtgattatccttatgactgacggccttcacaatatgggcggagatcccattacagtgatagacgaaatccgcgatctgctgtatataggaaaagacagaaagaacccccgtgaggactatttggacgtgtacgtgttcggagtcggtcctttggtcaatcaagtcaacatcaacgccctggcgtcaaagaaggacaacgagcagcatgtgtttaaagtgaaagacatggagaacctggaggatgtcttttaccagatgattgatgaatcacagtccttatccctttgcggaatggtttgggaacacagaaagggaaccgactatcacaagcagccgtggcaggcgaaaatttctgtgataagaccctcaaagggccatgaaagttgcatgggtgccgtggttagtgaatatttcgtgctcactgctgcacactgcttcaccgtagacgacaaggagcactctatcaaggtgagtgtgggtggcgagaaaagagacctggaaatcgaggtcgttcttttccatcctaactacaatatcaatggaaagaaggaggccggcatccctgagttctatgattacgacgtggctcttatcaagctcaaaaataaactcaagtatggccagaccatcagaccaatttgccttccttgcacggaggggactaccagagccctgcgcctgccacctacaactacttgccaacagcaaaaggaggaattgctaccggcacaggatatcaaggcattgtttgtgagcgaagaagagaaaaagttaacccgtaaagaggtgtacatcaaaaatggcgacaaaaaaggctcgtgcgagcgagacgctcagtatgctccgggctatgacaaggttaaggatataagcgaagtcgtcaccccccgcttcttgtgtaccggaggcgtatctccctatgccgatcccaatacctgtagaggtgacagcggtggacctcttatcgttcataaaaggagcagatttattcaggtgggcgtcatttcttggggcgtggtggacgtatgtaagaaccagaaacgtcagaaacaggttcctgcccacgccagagactttcatatcaatctctttcaggtcctcccctggctgaaggaaaaacttcaggatgaggacctgggctttctgtag

SEQ ID NO: 112909 - DNA, 2295 bp, Artificial Sequence
  Description of Artificial Sequence: Synthetic coding sequence
atgggatccaatctgagcccccaactgtgcttgatgccgtttatccttggactgctgtccggcggcgtgacgacaaccccctggtcactggccagaccacagggaagttgcagcctggagggcgtggaaatcaaaggaggttcgtttagacttctgcaagagggccaggcattggagtatgtgtgccctagcggcttttatccctacccagtacagaccagaacctgtcgctctacgggatcttggagtaccctgaaaacacaggatcagaaaaccgtgagaaaagccgagtgtcgggccatccactgtcctcggccccacgacttcgagaacggggaatattggccaaggagcccttactacaatgttagtgacgagatatcattccattgttatgacgggtatactctgcgcggatctgccaaccgaacctgtcaggtcaacggacgctggtccgggcagaccgccatttgcgacaacggcgctggctactgctctaatcccggaataccgatcgggacaagaaaggtgggcagtcagtaccggttggaagactctgtgacatatcactgctctaggggcctcactctgcgtgggtcccagcggcggacatgtcaggagggagggtcttggtcaggaaccgaacccagctgtcaagactccttcatgtacgacacgccccaggaggtcgcggaggccttcctgtcatctcttacggagacaattgagggggtcgacgctgaggatggtcacggacctggagagcagcagaagcgcaaaatcgttctcgatccctccggaagcatgaacatttacctggtattggatggaagcgactcaattggggccagtaactttaccggcgccaagaagtgcctcgtcaacttaatagagaaggttgcgtcatatggtgttaagccaaggtacggcttggtgacgtacgcaacatatccaaaaatttgggtgaaagtgtccgaggctgattcgtccaacgcagactgggtgaccaagcagctcaatgaaataaactatgaggatcacaaattgaagtcaggcaccaacactaagaaggcccttcaagccgtatactcaatgatgagctggccggacgacgtcccacccgagggctggaatcgcacccgtcatgtgatcatcctgatgaccgatgggcttcataatatgggaggcgatcccataactgtcattgacgaaatccgggatctgctttatatcggcaaggataggaagaaccccagagaggactatctcgacgtatacgttttcggggtcggccctctcgttaatcaggtgaacataaacgctttagcctcaaaaaaggacaacgagcagcacgtgtttaaggttaaggacatggaaaacctggaagatgtattctatcagatgatcgacgaaagtcagagcttgtcactttgtggtatggtttgggagcaccgtaagggaactgattaccataagcaaccttggcaagccaaaatctcggtgattcgccccagtaagggacatgagtcctgcatgggggccgtggttagcgagtattttgttctgacagccgcccactgtttcaccgtagacgataaagagcacagcatcaaggtgagtgtcgggggcgaaaaaagagatcttgagatagaggtggtgctattccaccccaattacaacatcaatgggaaaaaagaggcagggatccccgagttttacgattatgacgttgcgcttataaaattgaaaaacaaactcaagtatggccagaccatccgaccaatctgtctgccttgtactgagggcaccacacgcgcgctgcggctccccccaaccactacatgccagcagcagaaagaggaattgctccctgcacaggatataaaggctctgttcgtgtccgaagaggagaaaaagctaacgagaaaggaggtgtatatcaaaaacggggacaaaaagggttcttgcgagagagatgcgcaatacgctccaggatacgataaggtgaaagacatttccgaggtggtgactcctcggttcctctgcacaggcggggtctcaccatacgctgatccaaatacttgtcgaggggactctgggggccccctgatcgtacataagcgaagtagattcatccaggtgggcgtgatctcctggggggtggttgatgtctgcaaaaatcagaagcgacagaaacaggtccccgcacatgcccgagattttcacatcaatctgttccaggttctgccctggctgaaggagaagctgcaggacgaggaccttggattcttatag

SEQ ID NO: 112910 - DNA, 2295 bp, Artificial Sequence
  Description of Artificial Sequence: Synthetic coding sequence
atgggctctaatctctctcctcagctgtgcttaatgccctttattctcggcctgctgtccggaggagtcacaacaacaccgtggtctctggcacggccgcagggaagttgttccttggagggggtggagataaaagggggctctttcagactgctgcaggaggggcaggcattagagtacgtctgtccttccgggttttatccctacccggtccagacacggacttgcaggtctaccggtagttggagcacccttaagacacaggatcagaagaccgtacggaaagctgagtgtagagccattcattgcccgcgtccacatgactttgaaaacggcgagtactggcctagaagcccttactacaacgtgagcgatgagatttctttccactgctacgacggatacacactccgtggatctgccaacaggacatgccaggttaacgggcgctggtccggtcagacggctatttgtgacaacggcgcaggttattgcagcaacccagggattccgatcgggacacgaaaggtgggatcccagtatagattggaggattccgtcacataccattgctcacgcggcctcaccctcaggggctcgcagcggaggacatgccaagagggggggagctggtctgggaccgaaccttcctgccaggatagctttatgtatgacactcctcaagaagtcgctgaggcgtttctgtctagtttgaccgagacaattgaaggcgttgacgccgaagatgggcacggccccggagaacaacagaagagaaaaatagtgctggatcccagcggatctatgaacatctatttagtcctggacgggtccgacagcattggtgccagcaacttcaccggggccaaaaagtgcctcgtgaacttgatagaaaaggttgcatcctatggggtgaagcctcgttacgggctcgttacatacgccacttacccaaagatctgggtcaaggtatcagaagccgattcctccaacgcagattgggtgactaagcagctgaacgaaatcaattatgaagatcacaagttgaagtcaggcaccaacaccaagaaagccctacaggccgtatatagtatgatgagctggcccgacgacgtccctccagagggttggaatcgcaccaggcacgtgatcattcttatgacagatggtttgcacaatatggggggtgatcccattactgttatcgatgagatccgcgacctcctttatatcggcaaagatcggaagaatccccgagaggattaccttgacgtctatgtcttcggcgtggggccgctcgtgaatcaagtgaacataaatgccttggccagtaaaaaagacaacgagcaacatgtgtttaaagtgaaggacatggaaaacctcgaggatgtcttttatcagatgatcgacgagtcccaatccctgtcactttgcggaatggtgtgggaacacaggaagggtaccgactatcacaaacagccctggcaagccaagatcagtgtcatacggccaagcaaagggcacgagtcgtgcatgggcgcggtggtctcggaatattttgtcctgaccgccgcgcactgcttcacagtagacgataaagagcattccattaaagtctcagtcggtggcgaaaagagagatttggagatagaggttgtcctgttccaccccaactacaacatcaacggaaagaaagaggctgggatcccagagttctatgattacgacgtcgcattgatcaaactgaagaacaagctcaagtatggccagacaatcagacctatctgcctgccgtgcaccgagggcacaaccagggcccttaggctgccgccgaccaccacctgccagcagcagaaggaagagctgcttcccgcacaggacataaaggctctatttgtgagtgaagaggaaaagaagctcacacgaaaagaagtatacatcaagaacggcgacaagaaagggtcctgcgagcgggacgcgcagtatgcccccggttatgataaggttaaagacatttcagaagtggtgaccccccgttttttgtgtaccgggggtgtctccccttacgcagatcccaatacatgccggggggactcaggcggcccattgatcgtacacaaacgctctcgatttatccaggtgggggtcatatcctggggcgtggtcgacgtctgtaagaaccagaagcgccagaagcaagtgcccgcccacgctagggattttcacatcaatctgtttcaggttctcccctggctgaaggaaaaactccaagatgaggatctcgggtttctgtag

SEQ ID NO: 112911 - DNA, 2295 bp, Artificial Sequence
  Description of Artificial Sequence: Synthetic coding sequence
atggggtctaatctcagtccccagctgtgcctgatgccgttcatccttggccttttatccggaggtgtcacaactactccatggtcactcgctcgcccgcaggggtcgtgttcattggagggtgtggaaatcaagggtggatcttttcgcctgttacaggaagggcaagccctggaatatgtttgcccgagcggattttatccctacccagtacagacacgcacttgtcgctcaacaggaagctggtcaacattaaaaacacaagaccaaaaaaccgtgagaaaggcagagtgcagagccatccactgccctagacctcatgacttcgagaatggggaatactggccccggtccccgtactacaatgtgtctgacgagattagcttccactgctatgacggttacacgcttcggggttctgccaaccgcacgtgccaggtcaacggccggtggagcggacagacagcgatctgcgataacggggcgggctattgttctaatccagggattccgatcgggacgcggaaggtgggcagtcaatacagattggaggatagtgttacataccactgctcacgggggttgaccctgagggggagccagcgtaggacctgtcaggagggaggttcatggtccggaacggagccttcgtgccaagatagcttcatgtatgacactcctcaagaagtggccgaggcatttctctcatcactgacagaaacaatcgagggggtcgatgccgaagatggccatggaccaggagagcaacagaagaggaagatcgtgctcgacccaagtggaagcatgaacatatatctggtgctcgatggctccgacagcattggggcctctaacttcacaggggcgaagaagtgtctggttaaccttatcgagaaggtggcaagctatggtgttaagcccaggtatggacttgtgacatatgccacctaccccaaaatctgggtcaaggtttcggaggccgatagttcaaatgccgactgggtcacaaaacagctgaacgaaatcaattatgaagatcacaagctgaagtctggtacaaacacaaaaaaggctctgcaggcagtttattcaatgatgagctggcctgacgacgtgccgccagagggatggaataggacacgccacgtgattatcttgatgacagatgggctgcataacatgggcggcgacccaatcaccgtcatagacgaaattcgggacttactgtatataggtaaagacaggaagaatccacgcgaggattacctcgatgtgtacgtattcggggtgggcccactggtgaatcaggtgaacatcaacgcgctggcctccaaaaaggacaacgagcagcacgtgttcaaggtcaaagacatggaaaacttagaggatgttttctaccagatgattgacgagagtcagtccttgtcattatgtggaatggtctgggagcatagaaaagggacggactaccataagcagccttggcaagccaaaatatccgtcatccggccatcaaagggccatgaaagctgcatgggtgcagtggtctcagagtacttcgtgttgacagctgctcactgctttactgtggatgacaaagagcattctattaaggtatccgtgggtggcgagaaaagagaccttgaaatagaggtcgtgttgtttcaccccaattacaatatcaacgggaagaaagaggctgggatacccgaattctacgattacgatgtggccttgattaaactcaagaacaagctgaagtacggccaaaccatacggcctatttgcttgccatgcacagagggtaccacccgagccctccggctgcctcccacaactacgtgtcagcagcaaaaggaagagctcttaccggcacaagacatcaaggccttgttcgtcagcgaagaggagaagaagttaacacggaaggaagtgtatataaaaaatggtgataagaagggttcctgtgagagggacgctcagtatgcacccgggtatgataaagtcaaagacatatccgaggtcgtaacccccagatttctctgtactggaggagtaagtccatatgcggatcctaatacatgccggggagatagcggcgggcccctcattgtacacaaacgctcccgtttcatccaggtgggcgtgattagttggggggttgtggatgtgtgtaagaatcagaaacgccagaagcaggttcccgcccacgcacgagatttccatatcaaccttttccaagtcttgccatggttgaaagagaaactgcaggatgaggatttaggcttcctctag

SEQ ID NO: 112912 - DNA, 2295 bp, Artificial Sequence
  Description of Artificial Sequence: Synthetic coding sequence
atgggctcgaatcttagtcctcaactgtgcctaatgccattcatcctgggtctgctgtcaggcggggtgaccacaaccccttggtcactggcgagacctcagggtagctgcagcttggagggcgtagaaattaaaggcgggtcctttcgcctgctgcaggagggccaagcactggagtatgtatgcccgtcaggcttctatccatacccagtgcagaccaggacctgtcggagtaccggctcctggagcacgcttaaaacccaggaccagaagacggtccggaaggcagaatgcagggctatccactgtcccagaccacacgacttcgagaacggtgagtactggcctcgttctccatattataatgtgtccgacgagatttctttccactgttacgatggttacacccttaggggatctgcaaatagaacctgtcaagtgaacggcagatggtccggccaaacagcaatctgtgataacggtgccgggtattgttccaatcccggcatccctattggcaccagaaaggtggggtcccagtacaggctcgaggattccgtaacctaccactgttctagaggacttaccttgcgcggcagccagaggcgaacttgccaggaaggcgggtcatggagcggaacagaaccatcttgtcaggactcatttatgtacgacactccccaggaggtcgctgaggcgttcctaagttcattgacagaaaccatcgaaggagtggatgctgaggatggtcacggccctggcgagcagcaaaagagaaaaatcgtgttagacccgtctggctcaatgaacatctatctggttctggacggatctgactcgatcggagcctccaattttacaggggcgaagaagtgcctggtcaacctgatcgagaaggtggcttcttatggcgtgaagcccagatacgggcttgtgacttacgctacataccctaaaatttgggtaaaagtgtctgaggccgacagtagcaacgctgactgggtgacaaaacagctgaacgagattaattacgaggaccacaaactcaaatccggaaccaataccaagaaagctctccaggctgtctattccatgatgtcgtggccggatgacgttccacctgaaggatggaaccggactcgccatgtgattatcctgatgactgacggtctgcacaacatggggggcgacccgattaccgtgatagacgagattcgtgacttgctatacatagggaaagaccggaagaaccctagagaagattacttggacgtctacgtcttcggcgtagggcccctcgttaaccaggttaatatcaatgcgctggcgtccaagaaggacaacgaacagcacgtttttaaagtcaaggatatggagaatttagaagatgtcttctaccagatgatcgacgagtcccaaagtctgagcctgtgtggcatggtgtgggagcatagaaaaggcacagattatcacaagcagccatggcaagcaaagatatcagttatacgacccagcaaagggcatgagagctgcatgggcgccgtagtgtctgaatattttgtgctaactgccgcacactgcttcacagtggacgacaaagagcactctatcaaggtcagtgtaggaggagaaaagcgggatcttgagattgaggtcgtgctttttcacccaaattataacataaacggtaagaaggaagcagggatcccagagttctatgattacgatgtggcactgatcaaactgaagaacaaacttaagtacgggcagacaattcggcctatttgtctaccctgtacagaaggaaccacccgtgcactgaggctccctcctacgactacatgtcaacagcagaaagaggaactgctgccagcccaggacattaaggcactctttgttagtgaagaagaaaagaagttgacccgtaaagaggtttatattaaaaacggcgataagaaggggtcctgtgagcgggacgcccaatatgcacccggctatgataaagttaaagacatctcagaagtcgtgacacctaggtttctgtgtactggcggtgtgagtccctacgccgatcccaacacttgccggggtgactcgggcggccccctgattgttcacaaaaggagtcgatttatccaggtgggagttatatcttggggagtggtggacgtttgtaaaaaccagaaacggcagaagcaggttcctgcccacgctcgggatttccacattaacttgtttcaggtgctcccctggttgaaggaaaagcttcaggatgaggacctcggatttttatag

SEQ ID NO: 112913 - DNA, 435 bp, Artificial Sequence
  Description of Artificial Sequence: Synthetic coding sequence
atggggtcaaatctgagtccccagctatgcttgatgccgttcattctcgggctgttgtctggaggagttactacgacaccatggtccctcgcaaggccgcagggaagctgttcactagaaggtgtggaaatcaagggcggtagtttccgtctgcttcaagaaggccaggcattggagtacgtgtgcccatcaggtttctatccatacccagtccagaccagaacttgccgatctaccggcagttggagtacacttaaaacccaggaccagaaaacggttaggaaagcagagtgtcgtgcaattcactgtccccgcccacatgatttcgagaacggggaatactggcctcgctctccttactacaacgttagcgatgaaatcagttttcactgctatgacgggtacactttacgcggcagcgccaataggacatag

SEQ ID NO: 112914 - DNA, 3801 bp, Artificial Sequence
  Description of Artificial Sequence: Synthetic coding sequence
atgggaccactgatggtgctattctgcttactatttctctatcctgggcttgcagacagcgctccaagctgtcctcagaacgtcaacatttccggcgggacgtttacactcagccacggctgggctcccggaagcctgttgacttactcttgtccacagggactgtatccttcccctgcgtcaaggttgtgcaagtcaagcggtcaatggcagactccgggggcaaccagatcactctctaaagctgtttgtaagcctggtcactgcccaaaccccggcatcagcctgggcgcagtgaggaccggattccgatttggccatggtgataaggtacgctataggtgtagctctaacctggtcctcactggcagcagcgagcgtgagtgccagggaaacggcgtatggtccggtactgagcccatctgcaggcaaccatattcctatgatttccccgaggacgtggcaccagcgctgggaacctctttttcccacatgctcggagctacgaaccctacacagaaaacaaaggatcatgagaacggtacgggaactaacacttacgctgctctgaattctgtgtaccttatgatgaataatcagatgagactcttgggcatggagacaatggcttggcaggagatccggcacgccattattctcttaacagacggcaagtcgaacatggggggcagccccaagactgctgtagatcacatccgtgagatcctgaatatcaaccaaaaaaggaatgactacctggatatttacgctattggcgtcggaaagctagacgtggactggagagaacttaacgaactggggtcgaagaaagatggtgaaagacatgcatttattctccaagacaccaaggctttgcaccaggttttcgaacatatgcttgacgtaagcaagttgacggataccatctgcggggtgggaaatatgtccgctaatgctagtgatcaagagcgcacaccctggcatgtgactatcaagccaaaatcgcaagaaacttgccgaggcgcgttaatctctgaccagtgggtgctgaccgctgcccattgctttagagatggtaatgaccactcattgtggagggttaacgtgggcgaccccaagagtcagtggggaaaagagttcctgatcgaaaaggccgtgatttctccaggttttgacgtcttcgcaaagaaaaatcagggcattctcgaattctacggagatgacatcgctcttttgaagcttgctcaaaaggttaagatgtccactcacgctcggccaatctgtcttccatgtacgatggaggcaaatctggccctgcgaaggcctcagggaagcacctgccgagatcacgagaatgagctgctgaataagcaatctgtacccgcccacttcgtcgcactcaatggtagcaagctgaatatcaatctcaaaatgggtgttgagtggacctcctgtgctgaggtggttagtcaggagaagacaatgttccctaacctgacagacgttagagaagtagttacagatcagtttctttgctccgggacacaggaggatgagtccccttgcaaaggcgtgacaaccactccgtggtcgctggctcgtccccagggttcctgcagtctcgagggtgtggagataaagggcggctcgttccgcttgctgcaggaaggccaagccttagagtatgtgtgtcctagcgggttctatccataccccgttcaaactagaacctgcagaagtaccggatcctggagtacactcaagacccaggatcagaaaacagttcggaaagccgaatgtcgggctatccactgcccccgacctcacgactttgaaaacggagagtactggccccgctcaccttattacaacgtctctgatgaaatttcttttcactgttatgatggatatacgctacgaggcagtgcaaatcgaacatgtcaggtcaacgggagatggagtggccagacagcaatctgcgacaatggtgccggctactgttcaaatcccggaatcccaattggaacccgcaaagtgggatcacagtataggctcgaagactcagtcacgtatcactgtagcagaggcttgaccctgagaggctcccaaaggcgcacttgtcaggaaggaggctcatggtcaggaacggagccatcatgtcaagattcctttatgtacgatacgccgcaggaagtcgccgaggcttttttatcaagcctgactgagacgatcgagggagtggatgctgaggatgggcacggaccaggcgagcaacaaaagaggaaaatagtgcttgacccgtcagggtccatgaatatttacctggtgctggacggcagtgacagcattggcgccagtaatttcaccggcgcgaagaagtgtcttgttaacttaatcgaaaaagtagcatcctacggcgttaaacctcgttacggtttagtaacttatgccacctatccgaagatatgggttaaagttagcgaagccgacagcagcaacgcagactgggtcaccaaacagctgaacgagattaactatgaagatcataagcttaaaagcggtacgaacactaaaaaagctctacaggcagtgtattccatgatgtcctggccagacgacgtgcccccagaagggtggaaccggacccgccacgtgatcatccttatgacagatggattgcacaacatgggtggcgaccccatcaccgtgatcgacgaaatccgggacttgttatacattggtaaagaccgaaaaaacccccgggaggactacctggacgtttatgtgtttggggtcggacctctggttaaccaggttaatatcaacgccctcgcaagcaaaaaagacaacgagcagcatgtcttcaaggtaaaggatatggaaaacctggaggatgttttttaccagatgattgacgagtcccagtcgctgtctctttgcggaatggtgtgggagcatcgaaaggggacggattatcacaaacaaccgtggcaggcaaagatttctgtaattcggccgtcaaaaggccacgaatcttgtatgggggctgtcgtttcagagtactttgtcttgactgccgctcattgcttcacagtcgatgacaaagaacacagtattaaggtgagcgttggcggtgagaagagggacctcgaaattgaagtggtcctgtttcaccccaactataacattaatggcaaaaaggaagctggcattcctgagttctatgattacgatgtggctctgattaaactcaagaataagcttaagtatggccaaaccataaggcccatttgcctgccatgcacagaaggtactacacgcgccttgagactcccaccaaccaccacttgccagcagcagaaagaggaactgctcccagcccaggacatcaaggctctgttcgtctctgaggaagagaagaagttaacacgtaaagaggtttacataaaaaatggggacaaaaaaggctcctgcgaacgggacgcacaatatgcccccggatacgacaaggtgaaagatatcagcgaagtagtgacaccaagatttctatgtacgggcggtgtgtccccatacgctgatcctaacacgtgcagaggcgactccggtgggcccttaatcgttcacaaacgcagtaggtttattcaggtgggcgttatcagctggggcgtggtggacgtgtgtaagaaccaaaagagacagaaacaggtacctgcgcatgcaagggatttccatatcaatctgttccaggtgcttccgtggcttaaagagaagttgcaggacgaggatctgggctttttgtag

SEQ ID NO: 112915 - DNA, 3801 bp, Artificial Sequence
  Description of Artificial Sequence: Synthetic coding sequence
atgggaccactgatggtacttttttgcctgctgttcttgtaccccggcctcgcagattctgcccccagttgtcctcagaatgttaacatttctggaggtaccttcacactgtcccatggttgggcacctggtagcctgctcacctactcttgtcctcagggcttgtacccgtccccggcgtcccgtctctgcaagtcctcagggcaatggcaaacacccggagctacccgctccctcagtaaggccgtatgcaagcctggacactgtcccaacccgggtatatcattaggggccgttagaaccggattccggtttggtcacggggataaggtcagatacagatgcagttcaaacctcgtgttaacgggctcttctgagcgagagtgtcagggcaacggcgtttggtctggcacagagccaatctgtagacagccttattcttatgatttccctgaggacgtggcccccgcactggggacctcattctcccacatgctaggggccaccaaccccactcagaaaacaaaagaccacgaaaatggcaccggtacaaatacatatgctgctttaaattcagtttacttaatgatgaacaaccaaatgcgcctgcttgggatggaaacaatggcctggcaagagatccgacacgccatcatcctgctcacggatggcaagtcaaatatgggcggttctccaaagactgctgtggaccacattcgcgagatcctcaatatcaaccagaaaaggaatgactatcttgatatttacgccatcggcgtcggtaagttggacgttgactggagggagctcaatgaactcggatctaagaaggacggagaacggcacgctttcattctgcaggataccaaagctctgcaccaggtgtttgagcacatgcttgatgtgtcaaagctgaccgacactatatgtggggtggggaatatgagtgctaacgcctccgaccaagaacgcacaccttggcacgtgacgatcaagccgaaatcccaggaaacttgtagaggcgcactgatcagtgatcagtgggttttgaccgcagcacactgctttagagacggcaacgaccattctttgtggcgggttaatgtgggcgaccctaaaagccagtggggcaaggagttcttaatcgaaaaggcggtgatatcccctgggtttgacgtgtttgcaaaaaaaaatcagggcattctcgaattttatggagacgatatcgcgctgctgaagctcgcccaaaaggtcaagatgtccacccacgcgcggccaatatgtttaccatgtacgatggaggctaatctggccctgcggcgtcctcaggggagcacgtgcagagaccatgaaaacgagttgctgaacaagcagagtgtcccagcccactttgtggcattaaacgggagcaaactgaacattaaccttaagatgggtgtggagtggacgagctgcgccgaagtcgtatcccaagaaaagacgatgtttccaaatttgacagatgtgagggaggtggtaaccgatcagtttctgtgtagcggcacccaggaggacgaatccccctgtaagggggtgacaacaaccccttggagcctcgccaggccacagggctcttgtagtttggagggggtcgaaattaaggggggttcttttcggctcctgcaagagggccaggcgctcgaatacgtttgcccatcaggtttctacccgtaccccgtgcagacccgtacctgcagaagtacagggagctggagcactctcaagacacaggaccaaaagaccgtccggaaagccgaatgcagggcaatccactgcccacggccacacgactttgaaaacggcgaatattggccccgcagcccttactataacgtttccgacgagatctcctttcactgctacgatgggtataccctgaggggcagcgccaaccggacctgtcaggtgaatggtcggtggtctggtcagacggctatatgcgataacggcgccgggtattgcagtaacccaggcattcccatcggcactcggaaagttggttcccagtaccgtctggaggattccgtgacttaccattgcagtaggggcctgacacttcgtggatcccagcgacggacgtgccaagaaggaggatcatggtcaggaaccgagccctcttgtcaggattccttcatgtacgacacaccccaggaggtagcggaagcgttcttatccagtttaaccgaaacaattgagggagtggatgctgaagacggacacggccccggagaacaacagaaaagaaaaatcgtgctggacccctccggcagcatgaatatctacttggttttggacggttctgactccattggcgctagcaacttcaccggggcaaagaagtgtctagttaatctgattgagaaggtcgcaagttatggcgttaagccaagatacggcctcgtgacatacgccacgtatcccaagatttgggtgaaagttagcgaagctgattcatctaatgcagattgggtgaccaagcaacttaacgagatcaactacgaggaccacaaactgaaatcaggaaccaatactaagaaagcacttcaggccgtttattcaatgatgtcttggccggatgatgttccaccggaagggtggaaccgcacaaggcatgtgatcattctgatgacagacggactgcacaacatgggaggagatccaatcactgtcatcgatgaaatcagagatctcctgtacataggcaaagaccgcaaaaaccccagggaagactatttggatgtatacgtgttcggggtaggaccgctggtgaatcaagtgaatattaacgccctggcttcgaagaaggacaacgagcaacatgtgttcaaagtcaaagacatggagaatttagaggatgtgttttaccagatgattgatgagagccagagtcttagcttatgcggcatggtgtgggagcaccgcaagggaaccgattatcataagcagccctggcaggcaaaaatctccgtgattaggccaagtaagggccatgagtcctgcatgggcgctgtggtttccgaatactttgtccttaccgccgcccactgttttaccgtcgatgacaaagaacacagcatcaaagtatccgttggtggtgaaaaacgcgatctggagatagaagtggtgctattccaccccaattacaatattaatggaaaagaggaagctgggattcccgagttttacgactatgacgtagccttgattaaactcaagaacaaactcaagtatggacagaccatcagacctatatgtctgccctgcacggagggaactacaagggccttaaggctgccccctactactacatgtcagcagcagaaggaggaactccttccagcacaggatataaaggccctatttgtgagcgaggaggaaaagaaactaacaaggaaagaagtgtacataaaaaacggcgacaagaaaggatcctgtgagcgtgatgcacagtacgcgccaggttacgacaaggtgaaggacatctccgaggtggtcacgccaaggttcctgtgtaccggcggggtctccccttacgccgatccaaacacatgcaggggggattccgggggacccctcatcgttcataaacgcagccgcttcatccaggttggagtgatatcttggggcgtagtcgacgtgtgtaaaaatcagaagcggcagaaacaggttcctgcacacgcccgcgacttccacattaacctcttccaggtgctaccttggctgaaagagaaactccaggatgaggacctcggctttctgtag

SEQ ID NO: 112916 - DNA, 3801 bp, Artificial Sequence
  Description of Artificial Sequence: Synthetic coding sequence
atgggacctctcatggtgttgttttgtctgctgtttctttatcctggtctcgctgactccgcgccatcctgtccacagaatgtcaatattagcggaggaactttcacactgtctcatggatgggctccgggtagtttgctgacatacagttgtccacagggcttgtacccctcacccgcatcgaggctgtgcaagtcctccgggcagtggcagaccccgggggctacaaggtccctctccaaagccgtttgtaaacctgggcactgccccaaccccggaatcagtcttggcgcggtgcggacgggattcaggttcggacatggtgataaggtgcggtaccgttgttcctcaaaccttgtgttaactggatccagtgaacgtgagtgtcagggcaatggcgtgtggtctggtactgagccaatttgccggcaaccttactcatatgatttcccagaggacgtggctcctgctctcggcacctcattctcccacatgctaggcgcgacaaatccgacacagaagaccaaggaccacgagaacggaacaggtaccaatacatacgcagccctcaactctgtatatttaatgatgaacaatcagatgcgtcttctagggatggagacgatggcctggcaggagattcgacatgctatcatcctgctgacggacggaaagagcaacatgggcggttctcccaagacagcagtggaccacattcgcgaaattctcaatataaatcagaagcgcaatgattacctagatatatatgcgattggcgtcggaaaactggatgtagattggagggagctgaacgaactggggagcaagaaggatggggagagacacgcattcattctgcaggatactaaagctttgcatcaggtctttgagcatatgctggatgtgtccaaattgactgacactatatgcggagtaggcaacatgtcggccaacgcaagcgatcaagagcgaaccccctggcacgtgactatcaagccaaagagtcaggagacgtgccgcggggcattgatctcggatcagtgggtgctaacggccgcgcattgctttcgggatggtaacgatcattctctgtggagggtgaatgtcggcgacccaaagagtcagtgggggaaggaatttctcatcgagaaggccgtgatctctcctgggttcgacgtattcgcaaaaaagaaccaagggattcttgagttctatggagatgatatcgccctacttaagctagctcaaaaagtcaaaatgtccacccatgcccggcctatctgccttccttgtacaatggaggctaacctcgcactgcggcgcccccaggggtccacctgtagggaccacgagaacgagctcctcaacaagcagtccgtgcctgcacactttgttgctctgaatgggtcaaagctgaatatcaatctgaagatgggcgtagaatggacctcatgtgctgaggtcgtgagtcaagaaaagaccatgttccccaacttgaccgatgtgagagaagtcgttaccgatcaatttttatgcagtggcacacaggaggatgagagcccctgtaaaggagtgacaactaccccttggtccctggctaggccgcaggggtcctgttccctggagggagtggaaataaaaggaggctccttccggctcctgcaagagggccaggcactggaatacgtgtgtcccagcggcttctatccgtacccagtgcagactaggacttgcagatctactggctcctggtctaccttaaagactcaggaccagaagactgtgcgcaaagcggagtgccgagcaatacattgccctcgtcctcacgacttcgaaaacggcgaatactggccacggagcccctattacaatgtgagcgacgagatatcattccactgctacgacggctacaccctccgggggagcgctaatcgtacctgccaggtcaacggccggtggtctgggcagacagctatatgtgacaacggtgcagggtattgttccaatcccggaatccctataggaacaaggaaagtgggatctcagtatagattggaggattctgtgacctaccattgttccaggggactgactctgaggggttcacagcgcagaacttgccaggagggaggctcttggtctgggacggaaccttcgtgtcaagattcgtttatgtacgacaccccacaggaggtggctgaggctttcctctctagtcttacagaaaccatcgagggagtagacgccgaggatggccatggaccaggggaacagcagaagcggaaaatagtgctggacccttccggtagcatgaacatatatctcgtgcttgatggcagtgactctatcggcgcatcaaattttaccggagccaagaagtgcttggtgaatcttattgagaaagtggctagctacggagttaagcctcggtacgggctcgtgacctacgccacttaccccaaaatttgggtcaaagtatctgaagccgactctagcaatgcagattgggtcactaaacagctcaatgaaattaactatgaggaccacaagctgaagagcgggacaaatacgaagaaggccctgcaggctgtctactccatgatgtcatggccggacgatgtaccacctgagggctggaatagaacaagacatgtcatcatcctgatgacagacggtttgcataacatgggaggcgaccccataactgtaattgacgaaattcgtgacttgttatacatcggtaaggaccgcaaaaacccgcgcgaggactaccttgacgtttatgtctttggagtgggacccctcgtgaaccaggttaacattaacgccctcgcgtccaaaaaagacaatgagcaacatgtctttaaagtcaaagacatggaaaatcttgaagacgttttttaccagatgattgacgaatctcagagtctctccctgtgcggaatggtgtgggagcatagaaaaggaacggactaccacaaacagccctggcaggccaaaatatctgttataaggccatctaaaggtcacgaaagctgcatgggcgcagtggtatctgaatacttcgtgctaacagctgcccactgttttaccgttgacgataaagagcacagcataaaagtatctgtggggggcgaaaagcgcgacctggaaatcgaggttgttctctttcacccgaactacaacataaatggtaagaaagaagcagggattcctgaattctatgactatgacgtagcactgatcaagttgaagaacaagttgaagtacggccaaacaattcgaccaatttgccttccgtgcacggaagggacaacaagggctcttcggctgcccccaactactacttgtcagcagcagaaggaagagttgttgccagcccaggatatcaaggccctttttgtttcagaggaggagaagaaactgacccggaaagaggtttacattaaaaatggagacaaaaaaggtagttgtgagagggacgcccagtatgcccccggctacgacaaggtaaaagacatttcggaggtggttacaccccggttcctttgtaccgggggtgtgagcccatatgccgatccaaacacctgtcgcggcgactccgggggtccattgattgtgcataaaaggtctcgcttcatccaggtaggagtaatatcttggggtgtcgtggatgtgtgcaaaaaccagaaacgtcagaaacaggtgcctgcccacgctcgggatttccacattaatctgtttcaggtgttgccatggctgaaagagaaattacaggatgaggatctgggctttctctag

SEQ ID NO: 112917 - DNA, 3801 bp, Artificial Sequence
  Description of Artificial Sequence: Synthetic coding sequence
atggggcctttaatggttctcttctgcctgctttttctgtaccctggtctggctgactctgcaccctcctgccctcaaaatgtcaatattagtggaggaacattcaccctgagccacggttgggccccgggcagcctcctgacctattcctgcccccagggcctgtatccaagccccgccagtcgtctgtgcaagagctctgggcagtggcaaactccgggagccacccgatccctgtcaaaagccgtgtgcaagcccggtcattgcccaaatcccggtatcagcctgggcgccgtccgcacgggctttcgctttggccacggagacaaagttaggtaccgctgctcttccaatttggtgctgaccggaagcagcgagcgagagtgtcagggcaatggcgtgtggagcggtactgagcccatctgcagacagccttactcatacgactttcctgaagacgtcgccccagcacttggaacgtctttctctcatatgcttggggcgaccaatccaacgcaaaagaccaaggaccatgagaatggcacaggaacaaacacatatgctgcactaaacagcgtgtacttgatgatgaataaccagatgaggctactgggaatggagactatggcgtggcaagagattcggcacgccattatcttgcttaccgacggcaagtctaatatggggggctcccccaagacagccgtggatcacatcagggaaattctcaatatcaaccagaagagaaatgattacttagatatctacgcgatcggagtcgggaagcttgacgttgattggagagagctcaacgaattggggtcaaaaaaggacggggaaagacacgcgttcattttacaagatacaaaagcgctacaccaagtcttcgaacacatgttagacgtttctaagcttacggatactatttgtggagtgggaaacatgtctgctaatgcttctgaccaagagcgaactccatggcacgtgactatcaaacctaaatcccaagagacgtgcaggggagccctgatttcagaccagtgggtattaacagccgctcactgtttccgggatgggaatgaccacagcctttggcgcgtgaatgtgggagatccgaaatctcagtgggggaaggagttcttaatagaaaaggcggtgatcagtcccggcttcgatgtatttgcgaaaaaaaatcaaggaatcctcgagttctacggcgatgatatcgctctcctcaaactcgctcaaaaggtaaagatgagcacccacgcccgccccatatgtctgccttgtacaatggaagccaatctcgccctacggcgtccacagggtagcacttgccgagatcacgaaaatgaactgctgaacaagcagtctgtccccgcgcatttcgtcgccctgaacgggagcaaactaaacataaacctgaaaatgggagtcgagtggactagctgtgcggaagtggtaagccaggaaaagaccatgttcccaaacctaactgatgttagagaggtggtgacggaccagtttctgtgctctgggacacaagaggacgaaagcccttgtaagggcgtaaccaccaccccttggagcctggcccgcccacaggggtcctgtagcctggagggcgtagagatcaaaggcggaagtttccgcctgttgcaggagggacaggctctggagtacgtctgcccaagcggcttttatccctatccagttcagactcgcacatgcagaagcaccgggagctggtcaacccttaaaactcaggatcagaagaccgttcggaaggccgaatgtcgcgccatccactgcccacggcctcacgactttgaaaacggggagtactggccccgcagcccttattataacgtgagtgacgaaatttctttccactgctacgatgggtataccttgcgaggaagtgcaaaccgcacatgccaggtcaacggtaggtggagtggccagactgccatctgtgacaatggggcaggatattgtagtaaccctggcatccccattggaacgcggaaggtggggtctcagtaccggctggaggattcggtaacctatcactgctccaggggcttaaccctgagggggtctcagcgtagaacatgtcaagagggaggtagctggtcaggcactgagccatcatgccaggatagtttcatgtatgatactccacaggaggtggcagaagcttttttgagctctctgacagaaactatcgagggcgtggacgccgaggatggccatggccccggggaacagcagaaaagaaaaatcgtcctagatccgtcggggtccatgaatatttacctggttctcgatgggagcgattccataggcgcctcgaacttcactggcgctaagaagtgccttgtgaacctgattgagaaggtcgcttcctacggggtgaagcctaggtacggactggtaacctacgccacttatcccaagatctgggtcaaagtatccgaagcagactcctccaatgccgattgggttaccaaacagctcaacgagataaattatgaagaccataagctaaaatccgggactaatacgaaaaaggccttgcaggctgtgtactccatgatgtcatggccggacgatgtgcccccagagggctggaacagaacacgccacgtgatcattctgatgacagatggtctgcacaatatgggcggcgaccctatcactgttatcgatgaaatcagagaccttttgtatatcggcaaggatagaaaaaacccgagggaggactacctcgacgtttacgtgttcggcgtgggtcccctggtgaaccaagtgaacatcaacgcccttgctagcaagaaagacaacgaacagcacgtttttaaagtgaaagacatggagaatctggaggatgttttctaccagatgatcgacgagagccagagtctgtccctgtgtgggatggtctgggaacacaggaagggaacagactatcataagcaaccctggcaggctaagatcagcgtgattcgtccaagtaagggtcacgaatcgtgcatgggagcagtcgtcagcgaatacttcgtactaaccgcagcccactgcttcacggttgacgacaaagagcacagcatcaaagtgagcgtcggcggggagaaacgcgacttagagatcgaggtcgtgcttttccacccaaactacaacatcaacggaaaaaaggaggcagggattcccgagttctacgactacgatgtcgctctgattaagcttaaaaacaaactgaaatacgggcaaacaatcagacccatctgcctaccttgtaccgaaggtacaacaagggccctccgcctgccaccaaccaccacctgtcaacagcagaaagaggagttgctcccagcccaggatatcaaagcgttattcgtctcagaagaggagaagaaacttacccgtaaggaggtctatataaaaaacggggacaaaaaaggcagttgcgagagggatgcccagtacgcaccagggtatgataaggtaaaggatatttctgaggttgttacaccacgattcctctgcaccggtggggtgtccccctatgccgaccccaatacttgcagaggcgactctgggggacctctaatagtgcataagagaagtagattcattcaggtgggggtcatcagctggggggtcgtggatgtgtgtaagaaccagaagcggcagaaacaggtgccggcacacgcgagagactttcacatcaatcttttccaggtcctgccatggctgaaagaaaagttacaggatgaggacctggggttcttatag

SEQ ID NO: 112918 - DNA, 3801 bp, Artificial Sequence
  Description of Artificial Sequence: Synthetic coding sequence
atgggacccctgatggtcctcttttgtttgctgtttctctatccaggcctcgccgattcagccccaagttgcccccagaacgtcaacatttctggtggcaccttcacccttagccacggctgggcacctggttctctgctaacctactcttgccctcaggggttatacccctcgccggcctctagactctgtaagtcaagcgggcaatggcagacgcctggcgccacaaggtccctatcaaaggcggtttgcaaacccgggcattgccccaaccctggaattagccttggtgccgtgcggaccggctttcgatttggacatggcgataaagtgcgctacagatgttcctcaaatctcgtgctgactggctcaagcgagagagagtgccagggcaacggggtctggtctggaaccgagcccatctgcagacagccctatagctacgactttccggaggatgtcgcccccgccctgggtacctcattctctcacatgttaggagccactaatccaactcagaagacaaaggaccatgagaatggcactggaactaacacatacgccgcccttaactctgtttatctgatgatgaacaatcagatgcggctgctggggatggagacaatggcttggcaggaaatcagacacgctattattcttctgaccgatggtaaaagcaacatgggtgggagtcccaagaccgcagtagatcacatccgcgagatcctgaatatcaatcagaaacggaacgactacctagatatatatgccattggggttgggaagctggatgtggattggagagaactcaacgagctcggaagcaaaaaggacggggagaggcatgccttcatccttcaggacaccaaagctctgcaccaggtgtttgaacacatgctcgacgtctccaaactcactgataccatctgcggcgtgggaaacatgagtgccaacgccagcgaccaggagcggaccccctggcacgttaccataaagccaaagagtcaagagacctgtaggggcgccctgatctccgatcagtgggtgctaactgctgctcattgcttccgggatggcaatgaccatagcctttggagggttaacgtcggcgaccctaagagtcaatggggtaaggagtttctcatcgagaaagccgtcatttctccagggttcgacgtgttcgctaagaagaaccagggcattctggaattttacggggacgacattgccctcctgaaactggcacaaaaagttaagatgtctacccacgcaagaccaatttgccttccctgcacaatggaggccaatctggctctccggcgcccgcaaggaagcacctgcagagaccacgagaatgagctgctgaataaacaatcagtgcctgcgcattttgttgccttgaatggtagcaagctcaacatcaacctgaagatgggtgtggagtggacatcatgtgccgaggtcgtttctcaggagaaaacaatgttccccaacttaaccgatgtacgggaggtcgtgaccgaccagttcctttgctcggggactcaagaggacgagtcaccttgtaaaggggtcactaccaccccatggtccctggctaggccacagggctcctgttccctggaaggcgtggagattaagggcggcagctttagactcctgcaggagggccaagcccttgagtatgtatgcccatctggcttttacccatatccagtgcaaaccagaacatgtagatccacagggagttggtctactctgaaaacgcaagaccaaaagactgttagaaaagctgaatgccgcgctatacactgcccccgcccccatgatttcgaaaatggggagtattggcctcgatcgccctattataatgtcagcgatgaaatcagcttccactgttacgatggttacaccttgagaggctcagcgaatcgcacctgtcaggtgaacgggcggtggagtggacagaccgctatctgcgacaacggggccggctactgtagcaatcccggaattcctatcgggacccggaaggtgggcagtcaataccggctggaagattctgttacttatcactgttccagaggtctgaccttaagaggtagccagagacgcacctgtcaggaggggggcagctggtctggaacggagccctcgtgtcaggactcctttatgtatgataccccccaggaggtggctgaagcttttctgagtagccttacagaaacaattgaaggcgtggacgccgaagatgggcacggccctggggaacagcagaagaggaagattgtcttggatccctccgggagcatgaacatctacctggtactcgacgggagcgactccattggcgcgagtaacttcaccggtgctaagaagtgtctcgttaacctcattgagaaggttgcatcctatggcgtaaaacccaggtatggactggtgacttatgccacgtatccaaagatctgggtcaaggttagtgaagctgatagctctaatgccgactgggtgacaaaacaacttaacgagataaactatgaggaccacaagttgaagtctggtaccaataccaagaaggccttacaagctgtatacagcatgatgtcttggccagacgacgttccaccagagggatggaacagaacaagacatgtgatcatattgatgactgacggattacacaatatgggcggggatcccattaccgtcattgatgaaatccgggatctcctctacatcgggaaagacaggaagaacccacgagaggattacttggatgtatacgtattcggagtcggccccctggtgaaccaggtgaatattaacgccctggcgtccaaaaaggataatgagcagcacgtcttcaaggttaaagacatggaaaatctcgaagacgtcttttaccagatgattgacgagtcccagagcctgtccctgtgcggcatggtttgggaacacaggaagggcacagattaccacaagcaaccatggcaggcaaagatctctgttatcagaccatcaaagggacacgagtcctgtatgggagcagtagtgagcgagtattttgttctgactgccgcccactgctttacggtggacgacaaggagcatagtattaaagtcagtgttggaggagagaaaagggatctggagatagaggtcgtgctgttccaccctaactataatatcaacggcaagaaagaggcgggcattccagaattttacgactacgacgtggccctcatcaagctgaaaaacaagttgaagtacggccagaccattcggcctatctgcctgccatgtactgagggaactacccgggccttgagactccctccgactactacttgtcaacagcagaaggaggaactcctgccagcgcaggacatcaaggccttgtttgtgtccgaggaagaaaagaagcttactaggaaggaagtctacatcaagaatggcgacaagaagggcagctgcgaacgggacgcccagtacgccccaggctatgataaggtgaaggacatttctgaggtcgtaacccccagattcctttgcaccggtggagtgtctccatatgctgatccgaatacttgtcggggcgatagcggaggtcccttgatcgtacacaaaaggagcaggtttatccaggtgggagtcatttcctggggagttgtcgacgtgtgcaaaaaccaaaagaggcagaaacaggtcccagcccatgctcgggattttcatatcaacctgtttcaagtattaccctggctcaaggagaaattacaggatgaagacctgggttttctctag

SEQ ID NO: 112919 - DNA, 3801 bp, Artificial Sequence
  Description of Artificial Sequence: Synthetic coding sequence
atgggacctctaatggtcctcttctgtctgctgtttctctatcccggcctcgcagattctgccccctcctgtcctcagaacgttaatattagtgggggcacttttacactgtcccacggctgggccccaggctcactcctgacttatagttgtcctcaaggactgtatccttcccccgcctctaggttgtgcaaatcaagtggtcagtggcagactccaggggccactagaagcctgtcgaaagcagtctgtaaaccaggacattgccccaaccctgggatctcgctgggagcggtccgcacaggattccgattcggacatggagacaaggtccggtataggtgtagcagcaatctggtgttaacaggatcgtctgagagggaatgtcaaggaaatggtgtctggagtggcacggagccgatttgccgacaaccttactcgtatgatttcccagaggacgtggcgccagccctgggcacatccttctcacacatgctaggcgctacgaatccaacccagaaaaccaaagaccacgaaaatggcacaggtaccaatacgtatgcggctttgaattccgtgtatttaatgatgaacaaccagatgaggttgttaggcatggagaccatggcatggcaggagatccgccatgctataatcctgcttacagatggcaagtcgaatatgggcggctctccaaagaccgccgtggatcatatcagagaaattctgaacataaatcagaagcgaaacgactacctcgatatatacgcaataggcgtggggaaactcgatgtggactggcgcgagctgaacgaattgggctcaaagaaggacggcgagcgccacgcctttatactgcaagacacaaaagctctgcaccaggtgtttgaacacatgcttgatgtttccaagctgacagatactatctgcggggtgggcaacatgtctgccaacgcgagcgaccaggagaggaccccgtggcatgtgacgataaaacctaaatcacaggaaacctgccggggagcactcatctcagatcagtgggtgctaactgctgcacactgcttcagggacggaaacgaccattcattatggcgcgtcaacgtcggggatcccaagagccagtgggggaaggagttcctgattgagaaagctgtaatctctcccggtttcgacgtcttcgctaaaaagaatcaggggatactcgagttttacggcgacgatatagctttgttgaagctagcccaaaaggtcaagatgtctacacacgccaggccaatttgtctgccttgtactatggaagccaacctggcgcttcgcagaccacagggctctacatgccgggatcacgaaaatgagctacttaacaagcagagcgtaccggcgcattttgtggctctgaatggatctaaactgaacataaacctgaagatgggggttgaatggacaagttgcgcagaggtggtgtcccaggaaaaaactatgtttcccaacttaaccgatgtgagagaggtggtgaccgaccagttcctgtgtagtggcacgcaggaagacgagtccccttgcaagggggtaaccacaacaccttggtcactcgccaggccacagggcagttgctcactcgagggagtggagattaaggggggaagtttccgacttctgcaggagggacaggccctggaatacgtttgccccagtggtttctatccgtaccctgtgcagactcggacatgtcggtcaactggcagctggagcacactcaaaacgcaagatcaaaagaccgttcgcaaggcagaatgcagggctattcattgccccagacctcacgatttcgagaacggcgagtattggcccaggtctccatactacaacgtgtccgacgagatttcattccactgttacgatggctacacccttaggggatctgccaacaggacttgccaggtcaatggaagatggtctggccagacagccatttgtgacaacggcgccggctactgcagcaatcccggaatacccatagggacgaggaaggttgggagtcagtacagattggaagacagcgtgacttaccactgttcaagaggtctgactcttaggggcagccagcgccgtacatgtcaagagggaggatcatggtcaggaacagagccctcatgtcaggactcattcatgtatgatacgccccaagaagtggctgaagccttcctgtcctcactgactgagacgattgagggcgtggacgctgaagacgggcatggccctggagagcagcaaaagcggaagatcgtgctggaccccagtggcagtatgaatatctatctagtactcgacgggagcgacagtatcggggcatcaaatttcactggtgccaagaagtgcttggtgaacctgatagagaaagtggctagctacggagtgaagcctaggtatggattggttacatacgcaacctaccccaagatctgggttaaggtgtctgaggccgactcctcaaacgccgactgggttaccaaacagctgaatgagataaactatgaggaccacaagctcaagtctggcacaaatactaaaaaggctctgcaggcagtgtacagcatgatgtcctggcccgatgacgtccccccagaggggtggaaccggacccgccatgtgatcatcctgatgactgacggcctgcataatatgggcggggatcctatcaccgtcatcgatgagatacgcgatcttctttatatcggaaaggacagaaaaaatcccagggaggattatctggatgtctacgtgtttggagtgggccctctggtcaatcaagtgaacatcaatgccctagccagcaagaaggataacgagcagcacgttttcaaggtaaaagacatggagaatctcgaggacgtgttttaccagatgattgatgaaagccaatcactgtcactctgtggaatggtctgggagcaccggaagggcaccgactatcacaaacagccctggcaagctaaaatctcagtgatccgcccttccaaaggacacgagagctgcatgggcgctgttgtgagcgagtatttcgtgctgacagctgcacactgtttcacagtcgatgataaggaacattccattaaagtatccgtgggaggggagaagcgcgatctcgaaattgaagtcgtgttattccacccaaactataacatcaacggcaaaaaggaagccggcatcccagagttttatgattacgacgttgcactgataaaactgaaaaacaaactcaaatatggacagaccatccggcccatctgcctcccctgcacggagggcactactcgagcacttcgcctaccacccaccactacttgccaacagcaaaaagaggagctcctgcctgctcaggatattaaggccctcttcgtgtcggaggaggaaaaaaagctgacccgtaaagaggtctatataaaaaatggggataaaaagggttcctgcgaacgcgacgctcagtatgctccagggtacgacaaggtcaaggatatctctgaagtagtgacacctaggtttttgtgtaccgggggcgtatccccgtatgccgaccccaatacctgccgaggagacagcggcggccccctcatagtgcataagagatctcggtttatccaagtaggtgtgatttcttggggggtggtcgacgtatgcaagaaccagaaaaggcagaagcaggttcctgctcatgcaagagactttcacatcaatttgtttcaagtgctcccctggctgaaagaaaaactgcaagacgaggacctcgggttcctttag

SEQ ID NO: 112920 - DNA, 762 bp, Artificial Sequence
  Description of Artificial Sequence: Synthetic coding sequence
atgcattcatgggagcggttggcagtgctcgttctattaggcgctgccgcatgcgctgcgccgcctcgggggaggatcttgggagggcgtgaagcagaagcgcacgccagaccctacatggcttctgttcagctgaatggtgcccacctctgtggcggtgttttggtggccgaacagtgggtgttgagcgctgcccattgtctcgaggacgcagccgacggaaaggtgcaggttctgctgggggcgcactctttgagccagcccgaaccatcaaagaggctttacgacgtgctgcgggcagtcccccaccctgactctcagccggacacaatcgaccacgatttgctgctgctgcaactttcagaaaaggccactcttggcccagcagttaggccactgccttggcagagggtggatcgcgatgttgccccaggcactctgtgtgatgtggccgggtgggggatcgtgaaccacgcaggccggagacccgacagtctgcagcacgtcctgctgccagttctcgaccgcgcaacttgcaacagaagaacccaccacgacggtgcaataaccgaaaggctgatgtgtgctgagtccaaccggcgcgacagctgtaagggggacagtggaggcccactggtttgcggaggcgtgctcgagggtgtggtgacaagtggatctcgggtgtgtggaaataggaaaaagcctggcatctacactcgggtggcgagctatgccgcctggatagacagcgtgctagcctag

SEQ ID NO: 112921 - DNA, 993 bp, Artificial Sequence
  Description of Artificial Sequence: Synthetic coding sequence
atgtggctccttgtgtcagtgatactcatatcacggatctcaagcgtgggtggagaagcaaccttctgcgatttccctaagattaaccacgggattctatatgacgaggaaaaatataaaccctttagccaggtgcccacaggcgaggttttctactatagctgtgaatacaacttcgtgagcccttctaaaagtttctggaccagaataacatgtactgaggagggatggtcaccaacgcccaaatgtttaagattgtgcttcttccctttcgtcgagaacggtcactccgagagttccggacaaacacatctggaaggagacactgtacagattatttgtaacacaggatatcggctgcagaataatgagaacaatatctcctgcgtggaacggggctggtctactccacctaagtgccgaagcacagatacgagctgcgtgaaccctcccacggttcagaatgcccatatccttagtagacagatgtcaaagtatccatccggggagcgagtacgctacgagtgccgtagtccttacgaaatgtttggagacgaggaggtaatgtgcctgaacggcaattggacagaacctccacagtgcaaagatagtactggcaaatgtggaccgcctcctcctatcgacaatggcgacataacctcttttcccttatcggtttatgctcctgccagcagtgtggaatatcagtgccagaatctataccaactggagggaaacaagcgcattacctgtaggaacggccagtggagcgagccaccaaaatgtctgcacccctgcgtaatcagcagggaaattatggagaactataacatcgccttgcggtggaccgcgaaacagaagctctatctccgtaccggcgaaagcgctgagtttgtgtgcaaacgtggctaccgcctttctagtcggagtcacactctgcgcactacatgctgggatggtaagcttgaatatccgacgtgtgccaagcgctag

SEQ ID NO: 112922 - DNA, 813 bp, Artificial Sequence
  Description of Artificial Sequence: Synthetic coding sequence
atgtggctactggtgagtgtgattctaataagccggattagctcggtgggcggagaagccatgttctgtgacttccccaaaatcaaccatggaattctgtatgatgaggaaaaatacaaacctttcagccaagtgcccactggagaggtgttttactacagttgtgagtacaactttgttagcccctctaagagtttttggacccgcattacttgcgctgaggaaggatggtcacccacccccaaatgcctgcgcctttgcttttttcccttcgttgaaaacggccactcggagtccagtgggcagacacatctggagggcgacactgtgcagatcatttgcaatacaggctataggctgcagaataacgagaacaacatttcctgtgtggagcgcggatggtccacccctcctaagtgtcggtccacaatatcagctgagaaatgtggccccccgccacctattgacaatggtgacattaccagctttctcctcagtgtctacgcaccgggctccagcgttgaataccaatgtcaaaatctctaccagctggagggcaataatcaaatcacatgtaggaacggacaatggtcagaaccacccaagtgtctcgatccttgtgtgatttcccaggaaatcatggagaagtacaacatcaaactgaagtggactaatcagcagaagctctacagtcgcacaggcgatatagtggaattcgtttgcaagagtggctaccacccaacaaagtcccattctttcagagctatgtgccagaatgggaaactggtttatccttcttgtgaggagaagtag

SEQ ID NO: 112923 - DNA, 813 bp, Artificial Sequence
  Description of Artificial Sequence: Synthetic coding sequence
atgtggctgctggtcagcgtaatcctgattagcagaataagcagcgtggggggcgaggccatgttctgcgattttcctaagattaatcacgggatcctgtacgacgaagaaaaatacaagcctttctcacaggtccctactggtgaggtgttctattacagctgcgagtataacttcgtatccccttctaagagcttttggacacgtattacatgtgccgaagaaggctggtcccccactccaaagtgcctcaggctctgtttctttccctttgtggagaacggtcactcagagtcgtcaggccagactcacctcgaaggtgatacggtgcagattatatgtaacacagggtacagacttcaaaataacgaaaacaacatatcctgcgtggagcggggatggagcacaccccctaagtgccggtctacaatttcggctgagaagtgtggaccccccccaccaatcgacaacggtgatattacatctttcctgctgagcgtgtacgcaccaggaagttcagtagagtatcaatgccagaacctgtaccaactggaaggtaacaatcaaattacatgcaggaacggccagtggtcggagcctccaaaatgtttggacccatgcgtgatatcccaggagattatggaaaaatataatatcaaactcaagtggacaaatcaacagaaactatatagtagaacaggtgacatcgtggaatttgtgtgtaagagcggataccaccccaccaaatctcactcctttcgtgccatgtgccaaaacgggaaactcgtttacccctcctgtgaagaaaagtag

SEQ ID NO: 112924 - DNA, 993 bp, Artificial Sequence
  Description of Artificial Sequence: Synthetic coding sequence
atgctgctattgataaatgtcattcttacactctgggttagctgcgctaatggtcaggtaaaaccctgcgactttcctgacatcaaacacggagggctgttccacgagaacatgaggcgcccctacttcccagtcgccgtcggcaagtattattcatattattgtgatgagcatttcgagacaccaagcggatcctactgggactatattcactgcacgcagaacggttggtcaccggccgtgccatgcttgcggaagtgttatttcccatacctggagaatggatacaatcagaattatggaaggaagttcgtgcaaggaaatagcaccgaggtggcctgtcaccctggctatggcttaccaaaggcgcaaacaacggtaacatgtacggaaaagggatggagcccgacaccgcgctgtataagggtgaggacgtgctccaagtccgatattgagatcgagaacggcttcatttctgagagctcttccatttacatcctgaacaaggagatacagtacaagtgtaagccaggatatgccacggcagacgggaacagttccgggagtataacttgcctccagaacggctggtctgcccagcctatctgcatcaactccagtgaaaaatgcggcccccctcctcctatctctaacggcgatactacttcttttctgctcaaagtctacgtgccacagagccgggttgagtaccagtgtcagccatattatgagctgcaaggctccaactacgtcacctgttctaacggcgagtggtccgagcctccacgctgtatccatccctgcattatcaccgaagaaaatatgaataaaaacaatatcaaactcaaggggcgcagtgaccggaagtactacgccaagacgggtgatacgattgagttcatgtgcaagctgggctacaacgctaacaccagcatcctttcctttcaggcagtctgcagggaagggatcgtggagtacccaagatgcgagtag

SEQ ID NO: 112925 - DNA, 588 bp, Artificial Sequence
  Description of Artificial Sequence: Synthetic coding sequence
atgttgctgttgattaatgtaattctgaccctgtgggtgtcctgcgccaatgggcaagtgaagccgtgcgactttccagacattaaacatggggggctcttccacgagaatatgaggcggccttactttcctgtggcagtgggtaagtattatagctactactgcgatgaacactttgaaactcctagtggttcttactgggactacatccactgcactcagaatggctggtcgcccgccgttccctgcctccgcaagtgttatttcccctacctcgaaaatggatataatcagaattacggtcggaagttcgtccagggtaactccactgaggtggcttgtcaccccggttacggcttgccaaaagcccagaccaccgtgacctgcaccgaaaaggggtggtcccccaccccaaggtgtatacgggtgcggacatgttccaaaagcgacatcgagattgaaaacggatttattagtgagagttctagtatttacatcctgaataaagagattcaatataagtgcaagcccggatatgccacagctgacgggaatagcagcgatatggtattctgtatttcttattag

SEQ ID NO: 112926 - DNA, 810 bp, Artificial Sequence
  Description of Artificial Sequence: Synthetic coding sequence
atgcttcttctgataaacgtaatcctcactctgtgggtatcgtgtgctaatgggcaggtaaagccttgcgatttccccgatataaaacacggtggcttgtttcacgagaacatgcgtcgtccttacttccccgtcgcagtggggaagtactactcatactattgcgacgagcacttcgagacgccgtcaggctcttactgggactatattcactgcacacaaaacggatggagtccagccgtgccttgtctacgcaagtgttattttccatatctagagaatggctataatcaaaactacggccggaaatttgttcaaggtaactccacagaggtggcctgtcaccctggatatggattgccaaaagctcagacaacagtgacctgtaccgaaaaaggctggagtcctaccccccgttgcatccgagtgaatagcagcgaaaagtgtggccctccaccccctatatctaatggcgacaccacttcattcctgctgaaggtgtacgttccccagtctagagtggagtatcagtgtcagccatactacgagctgcaaggatcgaattatgtgacatgctcgaatggtgagtggtctgagccgcctaggtgcattcatccttgcatcattactgaggaaaatatgaataagaacaatatcaagctcaaaggccgctcagataggaaatactatgctaagaccggggatacaattgaattcatgtgcaagctggggtacaacgcaaacacttccattctctcatttcaggcagtgtgtcgggaaggaatcgtggagtaccccaggtgcgagtag

SEQ ID NO: 112927 - DNA, 996 bp, Artificial Sequence
  Description of Artificial Sequence: Synthetic coding sequence
atgttgctgctgatcaatgtcatcctcaccttgtgggtatcatgcgctaatggtcaggaagtaaagccctgtgactttcccgagattcaacacggcggcctgtactacaagtccctgaggcgcctgtacttcccggcggctgccggccagagctacagttattattgcgaccaaaacttcgttacaccttcgggttcatattgggactatatccattgtacacaggacggttggagtcctacggtgccttgcctgcgaacatgttccaagtcagatatagagatagaaaacggcttcatatccgaatcctcttcaatctacatccttaataaagagatccagtataagtgcaagccgggctacgcaaccgccgacggaaactcaagcggatcaatcacttgcctgcagaatggctggtctgcccagcccatctgtattaagttctgtgatatgccggtgttcgaaaatagtagagccaagtctaacggcatgaggttcaagctccatgatacactagactacgaatgctatgacgggtatgagattagctatggcaacacaacgggctcgattgtatgcggagaagacggctggtcccacttccccacgtgttacaactcgtctgagaagtgcgggcctcctcctccgatctccaatggcgatacaactagctttcttctgaaggtctacgtcccacagtctcgggtcgagtaccagtgccaatcttactacgaattgcagggatccaactacgtgacttgttctaatggggagtggtcagaaccaccaagatgtattcacccttgcatcatcaccgaggaaaatatgaataagaacaacatccagctaaagggcaagtccgacatcaagtattacgcaaaaactggagacaccatcgaatttatgtgcaagctgggatataatgccaacacttctgtgttaagctttcaggccgtttgtcgggaaggaatcgttgagtatcctcggtgcgaatag

SEQ ID NO: 112928 - DNA, 1734 bp, Artificial Sequence
  Description of Artificial Sequence: Synthetic coding sequence
atgttgttgcttatcaacgtaatccttactctctgggtctcctgtgcaaacggacaggtaaagccctgcgatttccctgagattcaacacggggggttatattacaagagcctgcggcggttatacttccccgccgcagccggacagtcctatagctattactgtgatcagaactttgtgaccccatcaggctcatactgggactatatccattgcactcaagatggttggtcccccacagtaccttgccttcgtacatgtagtaaaagcgatgtggagatcgaaaacggctttatctctgaaagttcaagcatttacatcttgaatgaggaaacccagtacaactgtaaacctgggtatgctaccgccgagggcaacagcagcggtagcattacttgcctgcagaatggttggtctacacagcccatctgcataaaattctgtgatatgccagtcttcgaaaactctagagctaagagcaacggcatgtggttcaagctccacgatactctggattacgagtgctacgacggctatgagtccagctatggaaacactaccgacagcatcgtgtgtggggaagacggctggtcccaccttccaacctgttacaatagctccgaaaactgtgggcctccacctcccatttccaacggcgacacgacatccttcccccaaaaagtgtacctgccttggagccgtgtagaatatcagtgtcagtcttattacgaattgcaggggagtaagtatgttacgtgctctaacggcgattggtccgaaccacctaggtgtataagcatgaagccctgcgaattccctgaaatccagcatggacatctgtactatgagaacactaggaggccctattttccagtcgccacaggtcaatcatactcttactattgcgatcagaacttcgttacgccgtcaggatcatattgggattacatccactgcacccaggacggatggcttcccacggtaccttgccttcggacatgcagcaagagcgatatcgaaatagagaatggcttcatttccgagtcttcaagtatctatattctgaataaagaaattcagtataagtgcaagccaggctacgccactgccgatggaaattcctccggctcaatcacatgtctgcagaacggatggtctgcacaacccatatgtattaagttttgcgatatgcccgtgtttgagaatagtagggccaagtccaacggaatgcgtttcaaactccacgacacactggactacgaatgctatgatgggtatgagatctcttacggcaatacaactgggtccatagtatgtggcgaggatggttggtctcacttccccacttgttacaatagtagcgagaaatgcggccccccgcctccaataagcaacggggatactacctctttcctgctgaaagtctacgtgccccagtcaagggtggaatatcagtgccaatcttattatgaactgcagggctccaactatgtgacctgttctaacggcgagtggtcagaaccccctaggtgcatccacccatgtatcatcaccgaggagaatatgaacaagaacaatatacagctcaaaggcaagtcagacattaagtactacgctaaaactggtgatacgatcgagttcatgtgcaagctcgggtataacgccaacaccagtgtcctatcttttcaagctgtctgcagagaaggtattgtggaatacccacgctgtgaatag

SEQ ID NO: 112929 - DNA, 996 bp, Artificial Sequence
  Description of Artificial Sequence: Synthetic coding sequence
atgctactgctgattaacgtgatcctaacactgtgggtcagctgcgcgaatgggcaagcaatgaagccctgcgaatttccggaaatccaacacggacacctctactatgaaaatacacgtagaccttattttccggtggccacaggacagagttacagttattattgcgaccagaactttgtgacaccctccgggtcatattgggattacatccactgcacccaagacggttggctcccaacagtgccctgcttgcggacttgttctaagtcggatatcgagatcgaaaacgggttcatttctgaaagctccagtatctatatccttaacaaagagatccagtataaatgcaagcccggatatgctaccgccgatggcaatagctcaggttctattacatgcttgcagaatgggtggagtgcccaacctatctgcatcaagttctgtgatatgccagtgttcgagaattctcgcgccaagagcaacggcatgcgcttcaaattgcacgatactcttgattatgagtgctatgacggttatgaaatctcttacggcaatacaaccggctccatagtctgcggcgaagatgggtggagtcacttccccacctgctacaattccagtgagaaatgcgggccaccccccccgatatccaatggagacaccacaagttttctgttgaaagtgtacgttcctcaaagccgagtggagtatcagtgtcagtcctattacgaattgcaaggaagcaactatgtaacctgttctaatggggagtggagtgaaccaccccgctgcattcacccatgtatcataacagaggagaacatgaataagaataatatacagctcaaaggcaaatctgacattaaatattacgcaaaaacgggcgacactatcgaatttatgtgtaagctggggtataatgcgaacacttccgtgctgtcattccaggcagtttgtcgggagggcatcgtcgaatatcccaggtgcgagtag

SEQ ID NO: 112930 - DNA, 996 bp, Artificial Sequence
  Description of Artificial Sequence: Synthetic coding sequence
atgctgctcctgattaacgtcattctcacactctgggtcagctgcgctaacgggcaggaagttaagccgtgtgacttccctgaaatccagcatgggggcctatactataaaagtctgagaagactctacttcccagctgccgctgggcagagctattcatattactgtgatcagaatttcgtgacgccctccgggagttactgggattacatccattgtacccaggatggctggctccctacagttccgtgtctccgtacttgctcgaagtccgacatagaaatagaaaatggcttcatttctgaatcaagttccatttacatcctgaataaggaaattcagtataagtgcaaacctggatacgctacagccgacggcaactcaagtggatctattacctgccttcagaacgggtggagtgcgcaaccgatctgtatcaaattctgtgacatgccggtattcgagaattctagggcgaaaagcaatggaatgagattcaaattacatgacacattagattacgagtgttacgatggctatgagatcagctatggcaatacaacggggtccattgtctgcggggaggacggatggtcacactttcccacttgttataactctagcgaaaagtgtggccctccaccacccatctcaaacggagatacaacgtcctttctcctcaaggtatacgtgccacaatctcgggttgaatatcagtgccagagttattatgagctgcaaggttcaaattatgtcacatgttcaaatggggagtggtccgagcctccacggtgcattcacccttgtatcattactgaagaaaatatgaataagaacaacatccagctgaaaggaaaatccgacattaagtactatgctaagacaggcgatactatcgaattcatgtgcaaactgggctacaatgcaaacacctctgtattatcatttcaagccgtctgccgggagggcatcgtggaatacccccgctgcgagtag

SEQ ID NO: 112931 - DNA, 1752 bp, Artificial Sequence
  Description of Artificial Sequence: Synthetic coding sequence
atgaaacttctccacgtgttcctgttgtttctctgtttccacctccggttctgtaaagtgacatacacctctcaggaagatcttgtcgaaaagaaatgcctggccaagaaatatactcacctgagctgtgacaaggtcttctgtcagccatggcagcgttgcatcgaggggacctgtgtgtgtaaactcccttatcaatgccccaaaaacggcacagctgtgtgcgccactaaccgccgcagttttcccacatactgtcaacagaaatctttggagtgtctgcaccccggcacaaagtttctgaataatggcacttgtacagccgaagggaagttcagcgtgtccttaaaacatgggaatacggatagcgaagggatagtggaggtgaagctggtcgaccaggacaagaccatgttcatatgcaagagttcttggagtatgagagaggccaatgtcgcatgcctggatctgggtttccagcagggggctgacacgcagcggaggtttaagctcagcgaccttagcattaactctaccgagtgtctccacgtacactgtaggggcctggagacctccctggccgaatgcacgtttactaaaagaagaaccatgggttaccaggacttcgccgatgtggtatgctatactcagaaagccgattcaccaatggatgacttcttccagtgcgtgaatggcaagtatatctcccagatgaaagcctgcgacggtatcaatgattgtggcgatcagagtgatgagttatgttgcaaggcttgtcagggtaaaggcttccattgcaaatccggcgtgtgcataccttcacagtaccagtgtaatggcgaagtcgactgcattactggtgaagatgaggtgggatgcgccgggttcgcgtccgtcacgcaggaggaaactgagatcctgactgcagacatggacgctgaaaggcgccgtattaagtctcttctacccaagctgtcctgcggggtgaagaataggatgcacatccggaggaaacgcatcgtgggtggaaaaagggcccagctgggcgaccttccttggcaggtggccatcaaagatgccagcggaattacatgtggtggcatctatatcggcgggtgttggattttaacagcagcccactgcctgagggcttctaaaactcataggtaccagatctggaccacagtcgtggattggatccacccagacctgaagcgaatcgttattgagtacgtagaccggattatctttcatgaaaactacaacgccggcacgtaccagaatgatatcgccctaatcgagatgaagaaagacgggaataaaaaggactgcgaactcccacgctcaatacccgcctgcgtcccttggagtccatatctgttccagcccaatgatacttgcatcgtgtctggttggggtcgagagaaagataacgaaagagtgttctccctccagtggggagaagtgaaactgatcagcaactgttccaagttttatgggaaccggttttacgaaaaggaaatggagtgcgccggcacttatgacgggtcaatcgacgcgtgtaaaggtgatagcggcggccccctggtgtgcatggatgcaaacaacgtgacatatgtgtggggcgtggtgagctggggagaaaattgtgggaagccggaattccctggagtgtatactaaggtggcaaactatttcgactggatttcttatcatgtggggagaccatttatcagtcagtacaacgtgtag

SEQ ID NO: 112932 - DNA, 1776 bp, Artificial Sequence
  Description of Artificial Sequence: Synthetic coding sequence
atgaagcttctgcacgtgttccttttgttcttatgtttccatctgagattttgtaaagtgacatataccagccaggaagacctagtcgaaaagaagtgcctggctaaaaagtacactcatttgagttgcgataaggtgttctgtcaaccatggcagagatgtatcgaggggacatgtgtttgcaaactcccctatcagtgtcctaagaatggcacagcagtctgcgccacaaacaggcgctctttcccgacttactgccagcaaaaatctctagagtgtctccaccccggtaccaaattcctgaataacggcacgtgtacagccgagggcaagttctcagtcagcctaaaacatggaaacacagatagcgagggaatcgtggaggtcaaactagtggaccaagataagacaatgttcatctgcaagtcctcttggagcatgagggaagcaaatgtagcctgcctcgacctcggcttccagcaaggagctgatactcagaggagatttaaacttagtgatctgagtatcaacagtaccgagtgcttacacgtgcactgtagaggactcgagacttctctcgctgagtgcaccttcactaagagacggaccatggggtaccaagactttgccgacgttgtgtgttacacccaaaaagctgactctcccatggacgatttctttcagtgtgtaaatgggaagtacatctcccagatgaaggcatgcgatgggatcaacgactgtggcgatcagtccgacgagctgtgttgtaaggcttgtcagggcaagggcttccattgtaaatcgggagtttgcatcccatctcaataccagtgcaacggagaagtggattgtattaccggcgaggacgaggtgggttgtgccgcagccagacacccaactattcaggggtttgcttccgtgacacaggaggaaacagagatcctgacagctgatatggatgccgagagaaggcggattaaatctctgctaccaaagctgagctgtggcgtaaagaatcgcatgcacatccggcgtaagcgtattgtgggtgggaaacgggcacagctcggggacctcccctggcaggttgccatcaaggacgcatctgggatcacatgtgggggaatttacatcgggggttgttggatcctgacagctgcccactgcctccgggctagcaagactcaccgttatcagatatggaccaccgtggtggattggatccatcccgatctgaagaggattgttattgaatacgtcgatcgcatcattttccatgaaaattataatgcaggcacttaccagaacgatattgctctcattgaaatgaagaaggatggaaacaagaaggattgtgagttgccaagatcaatacctgcctgcgtcccttggtccccatatctgtttcagcctaatgatacttgcatcgtatccggctggggtagggagaaagataatgagcgtgttttttctcttcagtggggtgaagtcaagctgatatctaactgttctaaattttacgggaatcgtttttatgaaaaggagatggaatgcgctgggacttatgacggatccatcgacgcctgcaagggagacagcggggggcctctggtctgcatggacgccaacaacgtgacatacgtgtggggcgtagtctcttggggtgaaaactgcggcaagcccgaattcccaggagtgtacactaaggtggccaactatttcgactggatctcatatcatgtgggcagaccctttattagccaatataatgtctag

SEQ ID NO: 112933 - DNA, 1731 bp, Artificial Sequence
  Description of Artificial Sequence: Synthetic coding sequence
atgaagctattgcatgttttccttttgttcctctgcttccacctgcgtttctgtaaagtgacttacactagccaagaggacttagttgagaaaaaatgtctggcaaaaaagtatacccacctgtcgtgcgataaagtcttttgccagccctggcagaggtgcatcgaaggcacatgtgtatgcaagctgccttatcagtgccccaaaaacggtaccgccgtctgtgcgactaataggcggtcctttcccacttattgtcaacaaaaatccctggaatgtcttcaccccggaacaaagtttcttaataatgggacctgtactgccgagggcaaattctctgtttctcttaaacacggcaacactgattctgagggcatcgtagaagtcaaactggtggaccaagataaaaccatgttcatatgtaaatcatcgtggtcaatgcgggaagccaacgtcgcatgcctcgacctcggttttcagcagggggccgacactcagagacgttttaagttaagcgacctgagcataaactccactgaatgtctgcatgtgcactgtcgtggcctggagacctccctggctgagtgcactttcacaaaacgacgcacaatgggttatcaagattttgccgacgtcgtgtgttatacacagaaagcggatagccctatggacgacttcttccagtgcgtgaatggcaagtacatctctcaaatgaaagcctgcgacggaattaatgactgtggcgaccagtccgatgaactgtgctgcaaagcctgtcagggcaaagggtttcattgtaaaagcggtgtgtgcatcccctcacagtaccagtgtaacggcgaggtggactgcatcacaggggaagacgaagtagggtgtgctgaagaaacggaaatactgaccgctgacatggacgccgagcggagacgcataaagtccctgctgccaaagttgagctgtggggtgaagaacagaatgcatattcgaaggaaaaggatagtcgggggtaagagggcacagctgggggatttgccctggcaggtcgcaatcaaggacgcatccggcatcacttgcgggggaatctacattggcggctgttggatattgaccgccgcacactgcctgcgcgcctccaaaacacaccgctaccagatttggactaccgtggttgactggattcacccggacctgaaacgaatagtgatcgaatacgttgatagaataatctttcatgagaactacaatgccgggacctaccagaacgatattgcactgatagaaatgaaaaaagatggtaataaaaaggactgcgaactaccgaggtccatccccgcatgcgttccatggagcccctatttgtttcaaccgaacgatacatgtatcgtatcaggttgggggagggaaaaagacaacgagagagtgtttagcttacaatggggcgaggtcaagctgatctctaattgttcaaaattttatgggaatcgtttttatgagaaagagatggaatgtgcagggacttatgacggctccatagacgcatgtaagggagattcgggcggccccctggtctgcatggatgctaataatgttacttacgtctggggcgtagtgagctggggtgagaattgtggcaaacctgaatttcccggagtctataccaaggtcgccaactattttgactggattagttaccacgtagggagaccctttatctcccagtataacgtgtag

SEQ ID NO: 112934 - DNA, 966 bp, Artificial Sequence
  Description of Artificial Sequence: Synthetic coding sequence
caggttacctatacttctcaggaagaccttgttgaaaagaagtgtctggcgaaaaagtacacacacctgtcctgcgacaaggttttctgtcaaccttggcaaaggtgtattgaaggaacgtgcgtatgtaaactgccctatcaatgccctaaaaacgggaccgcggtatgcgcgactaatcgtagaagtttccctacctattgccagcagaaaagcctggagtgcctgcaccctggaaccaaattccttaataacggcacttgcacagccgaaggaaagtttagcgtaagtcttaagcacggtaacaccgatagtgaaggaattgtggaggttaagcttgtggaccaggacaaaacaatgttcatatgtaagtctagctggtcaatgagagaggccaacgtggcctgcctggatttggggttccaacagggtgctgatactcagcgacggttcaagctttccgacctgagtataaactcaaccgagtgcttacatgtgcactgccgggggttggagacgtccttggcagaatgtacattcactaaacggcgcacaatgggttatcaagatttcgctgacgtggtgtgctatacacagaaggcagattcccccatggacgattttttccagtgcgttaacgggaaatacattagccagatgaaggcctgtgatggtataaacgactgcggagaccagagcgacgagctctgctgtaaagcctgccagggcaaaggatttcactgcaagtctggggtgtgcattcctagtcagtaccaatgcaatggagaagtggattgcatcaccggagaagatgaggtcggttgcgctgcatttgctgagctgtgcattgaggagacagagatcctaacagctgacatggacgctgagcggcggcggataaagagccttctgcccaagctttcttgcggggtcaagaataggatgcatataaggcgcaagcgttag

SEQ ID NO: 112935 - DNA, 1134 bp, Artificial Sequence
  Description of Artificial Sequence: Synthetic coding sequence
atgaagctactgcacgtctttctcttattcctgtgctttcatttgcggttctgcaaggttacgtatacctcccaggaagacctggtcgagaagaagtgcctggctaagaaatacacacacctgtcctgcgataaagtcttttgtcagccttggcaaagatgcatcgaaggcacctgtgtgtgcaaactgccataccagtgtccaaaaaatgggacagccgtgtgtgcaaccaatcgacgctcattcccaacttactgtcaacagaagtccctcgagtgtctacatcccggcaccaagttcctaaacaacggcacttgcaccgccgaaggaaaattctctgtctcgctgaaacacggcaacaccgactcagagggaatcgtggaggtcaagcttgtagaccaagacaaaaccatgttcatttgcaagtcaagctggtccatgcgggaagctaacgttgcatgtttggatttgggattccaacagggcgccgatacgcagcgccgctttaagttgtccgatctttctattaatagcaccgagtgtctgcacgtgcattgtagggggttggagacatcactcgctgaatgcacattcaccaaacggagaacaatggggtatcaggactttgccgatgttgtttgttatacccagaaggctgactctcccatggatgactttttccaatgcgttaacggcaaatatatcagccagatgaaagcctgcgacggtataaacgactgcggagaccaatctgacgaactctgctgcaaagcttgccaaggaaaggggtttcattgcaagtcgggagtgtgtataccctcccagtaccaatgtaacggtgaggtggattgcatcacaggtgaagatgaggtagggtgtgcgggcttcgcatctgtcacccaggaggagaccgaaatcctgaccgctgatatggatgcagagcgcagacggatcaagtccttgttgcccaaactgtcatgcggggtcaagaaccgaatgcacatccgcaggaagcggattgtgggaggaaagcgggcgcaattagggaaaatgaagcagatctctctggatatctttaaggggcttcaccgtgtctatgctatcctggaattctgttgcatcatcctgaagtag

SEQ ID NO: 112936 - DNA, 405 bp, Artificial Sequence
  Description of Artificial Sequence: Synthetic coding sequence
atggagttcgtgatgaagcaggccctgggcggagcaaccaaagacatggggaagatgctcggtggggacgaggagaaggacccagacgcagccaaaaaggaggaggagcgacaggaggctttgcgtcaggccgaagaggaacgcaaggccaagtacgcaaaaatggaggctgagcgtgaggccgttcggcagggtattagagataagtacggtatcaagaagaaagaggaacgagaggccgaggcccaggctgcaatggaagccaattccgaaggaagtcttacacggccaaagaaggccattcctccggggtgtggggacgaggtggaggaggaagatgagtctatcctggatacagtgatcaaatacttgcctggcccgctgcaagacatgctgaaaaaatag

SEQ ID NO: 112937 - DNA, 405 bp, Artificial Sequence
  Description of Artificial Sequence: Synthetic coding sequence
atggacttcgtaatgaagcaggctctgggaggtgctaccaaggatatgggaaaaatgctcggaggggaggaagaaaaggatccagatgcacagaagaaggaggaagagaggcaagaagcccttcggcagcaggaggaagagcgaaaagcaaaacatgcaaggatggaggcagaacgcgaaaaagtacgccagcagattagagataagtacggcctcaagaaaaaggaggagaaggaagcagaggaaaaagcggcactggaacagccctgtgaaggaagcctcacacggcccaaaaaggccattcctgccgggtgcggcgacgaggaggaagaagaagaagagagcatactggacaccgttttgaaatatcttcctggccctctgcaggacatgtttaagaaatag

SEQ ID NO: 112938 - DNA, 405 bp, Artificial Sequence
  Description of Artificial Sequence: Synthetic coding sequence
atggattttgtgatgaagcaggccctaggcggggccaccaaagacatggggaagatgctgggcggagaagaggagaaggatcccgacgcgcaaaagaaggaggaggaaagacaagaagccttacgacagcaagaagaagagagaaaagctaaacatgcgcgaatggaggcagagagggagaaagtaagacagcagatccgtgataagtacggtttgaaaaagaaagaggagaaagaagcggaggagaaggccgctctggagcagccatgcgagggctccttaactaggcccaaaaaagcaattcctgcagggtgtggcgacgaagaagaggaggaagaagagagcatcctcgataccgtcttaaagtatctgcccggaccactgcaagatatgttcaaaaagtag

SEQ ID NO: 112939 - DNA, 555 bp, Artificial Sequence
  Description of Artificial Sequence: Synthetic coding sequence
atggacttcgtgatgaaacaggccctgggcggggccaccaaggatatgggcaagatgctcggtggtgaggaggaaaaggatccagacgcacagaagaaggaagaggaaaggcaggaggcattaagacagcaggaggaggagcgcaaagccaagcacgcccgtatggaagctgaaagagagaaggtgagacagcagatccgagataagtatggactcaagaagaaggaagaaaaagaggccgaagaaaaggcagctctgagaggcaggggcggcggaggtcggggagagcaccctggtcacggtgcccagattccggcccgggccgccgccgggcatgtgcaagaggtgacacgcccccctgcaccagcctactctacctgttactatttcttcctcgttttgtcttttttattcatccgcttatcactgaattctgagggagagaacttaagttggcctctgccgctattccccggccagggtctgcttcccctatcctccccgtcccacctgcctagcagccaggggatacacctacaccccacacctaagtag

SEQ ID NO: 112940 - DNA, 234 bp, Artificial Sequence
  Description of Artificial Sequence: Synthetic coding sequence
atggacttcgttatgaagcaagctttagggggggctactaaagatatgggcaaaatgctcggcggggaggaggagaaggatcctgatgcacaaaagaaggaagaagagcgtcaggaagccctccggcagcaggaagaggaacgaaaggcaaagcatgctcgaatggaggcagagagagagaaggtaaggcagcagatccgggataagtacggactgaaaaaaaaggaagagtag

SEQ ID NO: 112941 - DNA, 336 bp, Artificial Sequence
  Description of Artificial Sequence: Synthetic coding sequence
atggactttgtgatgaagcaagccctgggcggggcaaccaaggatatgggaaagatgctgggtggcgaggaagaaaaagaccccgacgctcagaagaaagaggaggaaaggcaggaggcactgaggcaacaggaggaggaaaggaaagccaagcacgctaggatggaggccgaacgggagaaggttcgccagcagatccgtgacaaatatggcttgaagaaaaaggaggagaaggaagccgaagaaaaggcagcattggagcagccttgcgaggggtctctcactagaccaaaaaaagccattcccgccgggtgtggggatgaggaagaggaatag

SEQ ID NO: 112942 - DNA, 360 bp, Artificial Sequence
  Description of Artificial Sequence: Synthetic coding sequence
atggatttcgtaatgaagcaggccttgggcggagcaaccaaagacatgggcaaaatgcttggaggagaagaggagaaggacccggacgcacagaaaaaagaagaagagcgccaggaagccctgcggcagcaggaagaggaacggaaggctaagcacgctcgtatggaagccgaacgcgaaaaagtccggcagcagattcgagataaatatggtctgaagaagaaggaagagaaggaggccgaagagaaggctgcactggagcaaccctgtgagggtagcctgaccaggcctaaaaaagccattcccgcgggctgcggagatgaggaggaggaagaggaggagagcattctcgacacatag

SEQ ID NO: 112943 - DNA, 114 bp, Artificial Sequence
  Description of Artificial Sequence: Synthetic coding sequence
atggatttcgtcatgaaacaggcactgggaggcgccacaaaagacatgggcaagatgttgggaggagaggaagagaaagaccccgatgcccaaaaaaaggaggaggaacgctag

SEQ ID NO: 112944 - DNA, 405 bp, Artificial Sequence
  Description of Artificial Sequence: Synthetic coding sequence
atggattttgtcatgaaacaggctctcgggggtgctacaaaagatatgggaaaaatgctcggtggagaagaggaaaaggaccccgatgcccagaagaaggaagaggagcggcaagaggctctccgccagcaagaggaagagaggaaggcaaagcacgctagaatggaagccgagagagaaaaggtgaggcagcaaatccgtgacaagtacggcttgaagaagaaagaagagaaggaggctgaggaaaaagccgctctcgagcagccatgcgaaggaagcttgactagacctaagaaggcaatccctgcaggctgcggagacgaagaggaggaggaggaggagtcgatacttgacacagtgttgaagtatctgcccggccctctgcaggacatgttcaagaaatag

SEQ ID NO: 112945 - DNA, 21 bp, Artificial Sequence
  Description of Artificial Sequence: Synthetic coding sequence
atggactttgttatgaaatag

SEQ ID NO: 112946 - DNA, 2943 bp, Artificial Sequence
  Description of Artificial Sequence: Synthetic coding sequence
atggctactgccgccacttcaccagccctgaagcggctggacttaagagaccctgctgcgctttttgaaacacatggagcagaagaaatccgtggacttgaacgccaggtgagggctgagattgagcacaagaaggaggagctaagacagatggttggggaacggtacagggacttgatcgaagcagccgatactatcggccagatgcggcgctgcgctgtcgggctggtcgatgctgtgaaggctactgatcagtattgcgcccgattgagacaggcaggttctgccgccccaaggccaccacgggcacagcagcctcagcagcccagccaggaaaagttctattccatggcggcccagataaagcttctacttgaaatccctgagaagatctggtcctccatggaagcaagccagtgtctgcatgccactcaactgtacctgctgtgttgccaccttcacagtctccttcagctggactcctccagtagccgatacagcccagtgctgtccagattccctattctcatacgacaggttgctgccgctagtcactttagatcaactattcttcatgaaagcaaaatgttgctgaagtgtcaaggagtgtctgatcaggctgtcgcagaagcactgtgtagtatcatgctgctggaggagtccagcccaagacaggctttaacagatttcttgctggccaggaaagcgaccatccagaagctgctgaaccagccccatcacggcgccggcattaaggcacaaatctgctctctcgtggagctcctggccaccacactgaagcaggcccatgcactcttttataccctgcctgaagggctgttacctgatcctgcactgccgtgtggactgttattttccacgctggaaacaataacagggcagcaccctgcgggtaaggggacgggcgtgctgcaagaggagatgaaactgtgcagctggttcaaacacttaccggcatccatagtcgaattccagccgacattgaggaccctggcacaccctatctctcaagagtacctaaaagatacgctccaaaaatggattcacatgtgcaacgaggacattaaaaacggtatcaccaatctgctgatgtatgttaaatctatgaaggggcttgccggaatccgcgacgctatgtgggaactgttgaccaacgaatcaaccaaccatagttgggatgtgctgtgtcggcggctgctagaaaagcctctgttgttctgggaggacatgatgcaacagctgttcctcgacaggctccaaacattaacaaaagagggatttgatagtatttcttctagctcaaaggagctactggttagcgccctgcaagaactggagtcttcaaccagcaatagtccctccaacaagcatatccacttcgagtataacatgtccctgttcctgtggagcgagtcccctaacgatcttccctcggatgccgcatgggtctccgttgctaatcggggccagtttgctagctccggactcagcatgaaggcccaggccatctccccttgtgtgcagaacttttgttcagctcttgactcaaagcttaaggtcaagttagatgacctgctggcttaccttccttccgacgatagctctttacctaaggacgtgagcccaactcaagcaaaaagtagcgcctttgaccgctatgccgacgcaggcaccgtgcaagaaatgctaagaacccaatctgtggcgtgtattaagcacatcgtggactgcatccgggccgagctccagtccatcgaagaaggcgtgcaggggcagcaggatgctctgaactctgccaagcttcacagcgttcttttcatggcacgactatgtcagtccctgggcgaattgtgtcctcatttaaagcaatgcattttgggaaagagtgagagttccgaaaaacccgctcgtgaatttcgtgccttaaggaagcaggggaaagtgaaaacacaggaaatcatccctacgcaggctaaatggcaggaggtgaaagaggttcttttacaacaaagtgtgatggggtaccaggtctggagtagcgctgtagttaaggtgctgatccatggcttcacacagtcactgctgctggatgatgccggatccgtgctggccacggccacgagctgggacgagctcgaaatccaggaagaggccgaatccggatcgtccgttactagcaagatcaggttaccggcccagccaagctggtacgtgcagtcttttctgttttccttgtgccaagagatcaatcgggtcggcggtcatgccttgcctaaagttacattacaggaaatgctgaagagctgcatggttcaagttgtggctgcttatgagaaattgagcgaggagaagcaaatcaagaaggaaggcgccttccctgtgacccaaaatcgcgcactccagctcctgtatgacctgcgatacctgaacattgtgttgacagccaaaggggacgaagtcaagtccggacggtccaaaccagactcacgcatcgagaaggtcacagaccatctagaagccctaatagatccatttgatctggatgttttcacccctcacctaaatagcaatctgcaccgactcgtgcagaggacctctgtgttgtttgggctggtgacaggaactgagaaccaattggcacctcgctcttccaccttcaatagtcaggaaccgcacaacatccttccgctcgcatccagccagattcgctttggacttctgcccttaagcatgacgtcaacccggaaggcaaagtccacacggaatattgaaacaaaggcccaagtggttcctcccgccagatctaccgctggggaccctactgtaccaggcagtctgtttagacaactggtgtctgaagaagacaacacgtctgccccatctctgtttaagttgggttggctgtcttcaatgactaaatag

SEQ ID NO: 112947 - DNA, 2823 bp, Artificial Sequence
  Description of Artificial Sequence: Synthetic coding sequence
atggcaacggcagccacaagccccgccctgaagaggctggatttacgcgaccctgccgctctgtttgaaactcacggagccgaagagatacgcggacttgagagacaggtgcgagcggagattgaacacaagaaggaggagctgaggcagatggtaggcgagcggtaccgtgacctgatcgaagcagcggacacaattggccaaatgaggagatgcgccgtggggctcgtggacgcagttaaagccacagatcaatattgcgcgcgactgcgtcaggcaggtagcgccgcaccgcggccaccaagagcacagcagccccagcagcccagtcaggagaagttctactcgatggcagcgcagataaaactacttttggagatcccagagaaaatttggagctccatggaagcctcccagtgcctccatgctacacagttatacctattatgttgccatttacactccctgctgcagttggacagttctagctcccgctatagccctgtgctgtcccggttcccaatcctcataagacaggtagccgctgcatcacacttcagatccacgatcttacacgaaagtaaaatgctcctgaagtgccagggggtgagcgaccaggcagtcgcagaggcgctttgcagcatcatgctgcttgaagaaagttcaccaaggcaggcactgacagactttcttttggcgcggaaggcgactatccagaagctccttaatcagccgcaccacggggccggaattaaggctcaaatatgtagcctagtagagctgcttgccactacgttaaaacaggcacacgccctgttttacactctaccagagggcctgctgccagatccagccctgccttgcggactactgttcagtacgttggagacaatcactggacagcatcccgctggcaaaggcactggcgtcttgcaagaagagatgaaactgtgcagttggttcaagcatttgcctgcctccatagtggagttccagcctacattgaggacgctggcacatcccatctcccaagagtatctgaaggacacgctgcagaagtggattcatatgtgcaacgaggatattaagaacggcattacaaacttgctgatgtatgtgaaaagcatgaagggacttgcgggtatcagggacgctatgtgggagctcctgacaaatgaatctacaaaccacagctgggacgtgctgtgccgacgacttctagagaagccactcctgttctgggaagatatgatgcagcagctctttctggatcgactgcagacgctgactaaagagggctttgacagcattagctcatccagtaaggaacttctggtctccgctctccaggaattggaatccagtacaagtaattccccttctaacaagcacattcactttgaatataacatgtctctcttcttatggtcagagtctcctaacgacctgccctcggacgctgcttgggtgtccgtggcaaacagaggacagttcgcttcctcaggcctttctatgaaagcccaggccatcagcccatgcgtccagaatttttgcagcgctcttgatagtaaactaaaagtgaagctggacgacctgttggcttacctgccttccgatgactcaagcctcccgaaggatgtgtctcccacccaggccaaatccagcgcctttgataggtacgccgacgccggcactgtccaggaaatgttaaggacacagagcgtggcctgcatcaagcatatagtggactgcatcagggcagagctacaaagtatcgaggagggtgtacagggtcagcaggatgcactgaacagtgctaagttgcatagtgtcctcttcatggcccgcctgtgtcagtccctcggcgaactgtgcccccacctgaaacagtgcatcctgggcaagtctgagagctccgaaaaacccgccagggaattcagggccctgagaaagcaagggaaagtcaaaacacaagagattatacccactcaggccaagtggcaggaggtcaaagaggtgctattacaacagtccgtcatgggctaccaggtctggtccagtgccgtcgtgaaagtcctaatccacgggtttactcaaagcctcctgctggatgacgcgggtagcgttctggccacggctacaagttgggatgaactcgaaatccaggaagaggccgaaagtgggagtagtgtaacatcaaaaatcaggctccccgctcagccttcttggtacgtgcaaagctttcttttttcactatgccaggaaatcaatcgggttggcggccacgcactccctaaggtaaccctgcaggagatgttaaagtcctgtatggtccaggtggtcgcagcatacgagaagctgtccgaggaaaagcaaatcaaaaaggaaggcgccttcccagtcacacagaaccgggccttgcagttgctgtacgatctgagatatctgaacattgttctcacagcaaaaggcgacgaggtcaagtctggccgatctaagcccgattcacggatagagaaagtaaccgaccacctggaggccttgatcgacccgtttgatctggacgttttcacccctcatctgaatagcaatttacaccggctggtacagcgaacctctgttctgttcggactggttacaggcactgagaatcagctggctccgcgtagctcgacatttaactcccaggaacctcataatattctccccctggctagttcacaaataaggtttggcctgctgccactgtcgatgacttctacccgaaaagcaaaatctacaaggaacatcgagaccaaggcccaatacgacgccaactgctag

SEQ ID NO: 112948 - DNA, 2214 bp, Artificial Sequence
  Description of Artificial Sequence: Synthetic coding sequence
atggagaagagtaggatgaatctacctaagggccccgatactctgtgttttgacaaggacgaatttatgaaagaagatttcgatgtggaccattttgtctctgactgccgtaaacgcgtgcagctggaagaactgcgcgacgatttagagctgtattacaagttgctgaaaactgcgatggtagaactgattaacaaagactacgcagattttgtgaatctctccaccaatctcgtgggaatggacaaagccctcaatcagttgtctgtgccactggggcagctccgggaagaagtgctctcactgcggagctccgtaagcgaggggatccgcgcagtagatgagcgcatgtccaaacaagaggacattaggaagaaaaagatgtgtgtgctacgcctcatccaagtgatccgttcagtggaaaaaattgagaaaatactgaacagccaaagttccaaggagaccagtgctctggaggccagctctcctttactgaccgggcagattctggagcggatagcaaccgagttcaaccagctgcaattccacgccgtgcaatctaagggaatgcctttactcgacaaagtgaggcctagaatcgcaggcataactgccatgctgcagcagagccttgagggtctgcttctggaaggtctccaaacgagtgatgttgacattatacgccattgcctccggacatacgcaacgatcgataagactagggatgcggaggcccttgttgggcaggtccttgtcaagccctacatagatgaagtaatcattgagcagttcgtggaatcccacccaaatggactgcaagtgatgtacaacaaactgctggagtttgtcccgcaccactgccgcctgctgcgggaggttaccggaggagctatcagctccgagaaaggcaatacagtgcctggatatgactttctagttaattccgtgtggccccagatagtgcagggattggaggagaaactgccgtccctgtttaatcccggcaacccggatgcctttcacgaaaaatacactattagcatggacttcgtgcgtagacttgaaaggcagtgtggtagccaggcatctgtcaagaggctgcgggctcatcccgcctaccattctttcaacaaaaaatggaatctacctgtgtacttccaaatcagattccgggagatagccggtagcctggaggctgccctgaccgacgtattggaagatgcgccagcagagtcgccctactgcctcctcgccagtcatcggacctggagctctctcagacggtgctggagcgacgaaatgtttctccccctacttgtccacaggctctggcgccttacactccaaatcctggctaggtattccgtgttcgtcaatgagctctcacttcgaccaatctcaaacgaatcacccaaggagattaaaaaacccctggtcacagggtctaaagagccttcaatcactcagggaaatacggaggatcaagggtcgggtcctagcgaaaccaaaccagttgtgagtatctctcggacccagctggtttacgtggtggccgaccttgataaattgcaagaacagctgccggaattactggagatcattaagcctaagcttgaaatgatcgggttcaaaaacttcagcagtatctctgccctagaagattctcaaagcagcttctccgcctgtgtccctagtctgagcagcaaaataatacaggatctgagcgatagttgcttcgggttccttaagagcgctctggaagtgccacgcctgtaccgccgcacaaacaaagaggtgcctactacggcatcttcctacgtggacagcgctttaaagcccctgttccagttgcagagtggccataaagataagctcaaacaggcaatcatacaacagtggcttgaaggcaccctcagcgagagtacccacaaatattatgagaccgtttctgatgttttgaactcagttaaaaagatggaggagtctttgaagagactgaaacaggccaggaagaccacacctgctaatccagtagggccatccggcggcatgagtgatgacgataaaataagactacaactcgctctggacgtggagtacctgggagaacagatccagaaactaggtctgcaggcatcggacatcaaaagcttctctgctctagcggaactggtggcggcggccaaggatcaggcgaccgccgaacagccttag

SEQ ID NO: 112949 - DNA, 2217 bp, Artificial Sequence
  Description of Artificial Sequence: Synthetic coding sequence
atggaaaagtcgaggatgaaccttccgaaaggtcccgacactctgtgtttcgacaaagacgaattcatgaaggaagacttcgacgtcgaccacttcgtgtccgattgtcggaaaagggttcagttggaggaactccgagatgacctcgagctgtattacaagctgctaaaaactgccatggttgaattaattaataaagactatgctgactttgtgaatttgagcacgaatctcgttgggatggacaaagccctcaatcagctctcagtgccactgggacagctaagagaggaagtactctcactcaggtcaagtgtgtccgagggaattagagccgtcgatgagagaatgagcaaacaggaggacattcgaaaaaagaaaatgtgtgttttgagactcattcaagtgattaggtccgttgaaaagatcgaaaaaatcctgaattctcagagcagtaaggagacaagtgcactggaggcaagctcccccctgctgacaggtcaaatcctggaaagaatcgccacggaatttaaccagctccaattccacgccgtgcagtcaaaaggaatgcctctgctcgacaaggttcgcccacgcattgctggtatcactgctatgctgcagcagagcctggagggcctgcttctggagggattgcagacttctgatgtcgatatcattaggcattgtctcaggacctacgccacaatcgacaagactcgagatgccgaagcccttgtggggcaggtgctggtgaaaccttatatagacgaggtcatcattgagcaattcgtggaatcgcacccaaacggcttgcaggttatgtataacaagctgctggagtttgtaccccatcattgccgccttttgcgcgaggtgaccgggggagcaatctccagcgagaaagggaacacagtgcctggatacgattttctggtgaattccgtctggccacaaattgtccaggggttggaggagaagctgccaagcctctttaatcccggtaaccctgacgcttttcacgagaagtatactatctccatggatttcgttcggaggctggagcggcagtgtggctctcaggcctctgtgaagcggctgcgggcccatcctgcctaccactcattcaacaagaaatggaaccttccggtgtactttcagatcagattcagggaaattgcagggagcctcgaagccgcccttaccgacgttcttgaagatgcgcccgccgaatcaccatattgcctgctagcctcccatcgcacatggagcagcctgagacggtgttggagtgacgaaatgtttcttccactcctagtccataggctgtggaggctaacgttacaaatcctggctcggtattccgtctttgtgaacgagctgtccctcaggcccatcagcaacgagagtcccaaggagattaaaaagccactagtaactggcagcaaggagcccagcattacacagggtaatacagaagaccagggctctgggccctccgaaaccaaaccagtggtgtccatatctaggacccagctggtctatgttgtggctgatttggataagctccaagaacaactcccagagctactcgaaatcattaaaccgaagctggagatgatcggcttcaaaaacttttccagtatatctgcggccttagaagattctcagagcagcttcagcgcttgtgtgcctagcctcagcagtaaaattattcaggatctgtctgactcctgttttggcttcctcaagtctgccctggaagtgccacgcttataccgaaggaccaataaggaggttcccacgacagctagttcctacgttgacagcgctctgaagccgctatttcaacttcagtcagggcataaagataaactgaaacaagccatcatccaacaatggttggaaggtactctctctgagtcgactcacaagtactacgaaacagttagcgacgtgcttaattcagtcaagaaaatggaagagtctctcaagcggctgaagcaggcacggaaaaccactcctgccaatccggtggggccgtccggggggatgagcgatgacgataagatcaggttacagctggccctagatgttgagtatttgggcgagcagatccagaagctggggctccaggcgtcagatatcaaatctttctccgctctcgccgagttagttgcagcagccaaggatcaggctacagctgagcagccctag

SEQ ID NO: 112950 - DNA, 2040 bp, Artificial Sequence
  Description of Artificial Sequence: Synthetic coding sequence
atggtcgagcttatcaacaaggactatgcagactttgtcaacctgtctactaatctcgtaggaatggacaaggcactaaatcagctcagcgtgcccctgggccaactgagagaagaggttctgtccttgagaagtagcgtatccgagggcattcgtgcagtggatgagcggatgagtaaacaggaagatatcagaaagaaaaagatgtgtgtgctgaggttgatacaggtcatacgcagcgtagagaagatcgaaaaaatcttgaattctcagtcatctaaagagacgtccgctctagaggctagctcaccactgctcactggacaaattctcgaacgaattgccaccgaattcaatcagctccagtttcatgccgtgcagtccaagggaatgcctttgctcgataaggtgcgcccgaggatcgcgggcatcacggctatgcttcagcaatcactcgagggactgcttctggaaggtctgcagacctcggacgtcgacattattcgccactgtctccggacgtacgccaccatagacaagacacgtgatgctgaggccctcgtcggacaggtcctggtgaagccatatattgacgaggtgattatcgaacaatttgtggaaagccatcccaacggactgcaggtaatgtacaacaaacttctggagtttgtcccgcaccactgtagacttctacgtgaagtgacaggaggggcgatcagctccgagaagggaaacaccgtccctggatatgatttccttgtcaactcagtctggcctcaaatcgtgcagggactcgaggaaaaacttcctagtctcttcaatcccggcaatcctgacgccttccacgagaaatacaccatctcgatggattttgtgcggcggcttgagcgtcagtgcggctcgcaggcttccgtgaagcgattacgggcacacccggcctaccactccttcaataaaaaatggaaccttcctgtttactttcagatccggtttcgggaaatcgcagggagtctggaggcagctcttaccgacgtgctcgaggatgccccggcggagtcaccatattgcttattggccagccacagaacatggagctctcttagaaggtgctggagtgacgagatgtttctccctttgttggtgcacagactgtggagacttaccctgcagattctggctcgttattcagttttcgtgaacgagctgtcattacggccgatcagcaatgagtcccccaaggagatcaagaaacctctggtcactggctccaaggagcccagtatcacacaggggaatacagaggatcaaggcagcggccccagcgaaaccaaaccagttgtctcaattagcagaacccagcttgtgtatgtggtggctgatctcgataagctacaggagcagcttccagaactgctggagattataaaaccaaaacttgagatgatcgggttcaaaaacttttcgtcaatatccgccgctcttgaagacagtcaatccagttttagcgcttgtgtacccagcctgagctctaagatcatccaagatttgtctgactcttgtttcgggtttctgaaaagcgctctagaggtcccacggctgtataggaggacgaataaggaggtacctaccacagcctcttcatacgtcgactcagctctgaaaccactgttccaacttcaatctggacacaaggacaaactgaaacaagcaattattcagcagtggctggagggaactctttctgagagtactcataaatactatgagaccgtgtccgatgtgttgaacagtgtcaagaaaatggaagagtccctgaagcgtctgaaacaggcaaggaaaactacccccgcgaaccctgtgggaccgtctggcggcatgtctgatgacgataaaatcagattacagttggccctggacgtcgaatacttgggagaacaaatccagaagcttggccttcaggccagcgatataaagtctttctcggctctggcggagctcgtggccgctgccaaagatcaagctactgcggaacaaccatag

SEQ ID NO: 112951 - DNA, 1869 bp, Artificial Sequence
  Description of Artificial Sequence: Synthetic coding sequence
atgtctaagcaggaagatatcagaaaaaagaagatgtgcgtgctcaggctgatccaggtcattaggagcgttgagaagattgaaaagatcctcaacagccagagctccaaagagacaagtgcactggaggccagctcaccgcttctgacagggcagatattggagcgcatcgcaaccgaatttaaccagttacagttccatgctgtgcaaagtaaggggatgccactccttgacaaggtcagacccaggatcgctggtattacagctatgctacagcagtccctagaagggctcctgctcgagggtttgcagacatctgacgttgacatcattcggcactgtctacgtacctacgcgactatcgacaagactagggacgccgaggccctggttggacaggtgctcgttaagccttacatcgacgaggtgataatcgaacagtttgttgagtcgcacccaaatgggctccaggtgatgtacaataagctactggagttcgtacctcatcactgccgcctcctgcgggaagttacaggtggggccatttcttccgagaagggaaacactgtgcctggctatgactttttggtgaattctgtgtggccccagattgttcagggccttgaagaaaaactgcctagtctcttcaatccaggtaatccagatgccttccacgagaagtatactatttccatggacttcgtgcgccggttagagcgtcagtgtggatctcaagcctccgtgaagaggttgcgcgctcaccccgcatatcattcttttaacaagaagtggaatctcccagtgtacttccagataaggttccgagaaattgcaggcagccttgaagcagctttgacagatgtgctggaggatgctcctgctgagagtccctattgccttctcgcctcccataggacatggtctagcctccgaaggtgctggtcagacgagatgttcctgcccctcctggtacataggctctggaggctcaccctccagattttggctaggtactctgttttcgtcaatgaattatccttgaggccaatttctaatgagtctcccaaggaaatcaaaaaaccccttgtcacgggctccaaagagccttctatcacacagggcaatactgaggatcagggtagcggtccttctgagacgaaaccagtagtgagcatctcaagaacgcagctggtgtatgtcgttgcagatctggataaactccaggagcagctgcccgaactgctcgagattattaaacctaagctggaaatgatcggcttcaagaacttttccagtattagcgccgcattggaggatagccagtcatcctttagcgcatgcgttccttctctgtcgagcaagattatacaggatctgtccgactcctgcttcgggttcttaaagagtgctctcgaggtgccaagactgtatagacgaactaataaggaggtgccaaccacagccagttcctatgtggatagcgccttgaagcctctatttcagctgcagtctggacacaaagacaagctgaaacaggctattatccagcaatggttggaaggaaccctatccgagtctactcacaagtattacgaaacagtgtctgatgtcctgaattctgtcaagaaaatggaagagagtcttaagcggctcaagcaggcccggaaaaccaccccagccaaccccgttgggccctccggtggcatgagcgacgatgacaagatcaggctgcagctggctctggacgtggagtatttgggcgagcagatccaaaagctggggcttcaggcttccgatatcaagtcattctctgctctcgccgagttggtcgctgctgctaaggatcaggccacggcagagcagccgtag

SEQ ID NO: 112952 - DNA, 1284 bp, Artificial Sequence
  Description of Artificial Sequence: Synthetic coding sequence
atgggcttcgccatggaggatacagaagacatcagtcaaaaccattttgggcatttatgcatctttaagtgggggcattggaagaaagacttgaagtacacgatctcgatggacttcgtacgacgtctagagcgacaatgcgggagtcaagccagcgtcaagcgcctgcgggcacacccggcctatcactcatttaataaaaagtggaacttgcccgtgtacttccagattaggtttagagagatcgcagggtcactggaagccgcgctcactgacgtactggaggatgcacctgcggagtcgccctactgcctgctggcgtcccatcggacctggtccagcctgcgacgatgttggtccgacgagatgtttttgccactgctggtccacaggctgtggcggctcactttgcagattttggctcggtactcggtgttcgtgaacgagctcagcctgaggcccattagtaatgaatctcccaaggagattaaaaaaccactagttactggatcaaaggaacctagcataacgcagggaaatacagaggatcagggatctgggccttccgaaaccaagccggtcgtctccatatctcgtacgcagttagtctacgtggtggctgacctggacaaactccaggagcagctacccgagctgcttgaaattatcaaaccaaagctggagatgatcggttttaagaatttcagctctatctccgctgccctggaggatagtcaatcaagcttttcggcctgcgttcctagcttgtccagtaaaattatccaggatctgtcagactcttgctttggcttcctgaagagtgcactagaggtccctcgcctatatagacgaactaataaggaggtgccgaccacggcctccagttacgtggactccgcgctgaagccacttttccagctgcagagtggccataaggacaagctcaaacaggcaatcatccagcagtggctggagggaactctatctgaatctacgcataagtactatgaaacagtgtctgacgtccttaattcagtcaaaaaaatggaagagtctttaaagcggttaaagcaagcacgtaagacaactccagcaaatccagtaggcccttcaggagggatgagcgatgacgataaaattagactccaacttgccttggacgttgagtaccttggcgagcaaattcagaaactggggctgcaggccagtgatataaaatcattttctgctctcgcggaactcgttgctgctgccaaggatcaagccactgctgaacagccatag

SEQ ID NO: 112953 - DNA, 2487 bp, Artificial Sequence
  Description of Artificial Sequence: Synthetic coding sequence
atggccgaagctgccctgctcttattgccagaggctgccgctgagcgtgatgcccgggagaagcttgctctatgggaccggcgccctgatactactgcacctttgactgatcgccaaacagacagcgtactagagctaaaagccgccgcggagaatctacctgtcccagcagagctccctattgaggatttgtgctccctgacttcccagtccttgccgatagagctaacttccgtggtgcccgagtccactgaggatattctgctcaagggtttcacatctctcggtatggaggaagagcgcatcgaaacagctcagcagttcttcagttggtttgcaaagctgcagacgcagatggatcaggacgagggaaccaagtatcgtcagatgcgtgactacctctccggtttccaggaacagtgcgatgccatcctcaatgatgtgaattcagccttacaacatctagagtccctccagaaacaatatctgttcgtgtcgaataaaacaggaactctgcatgaggcatgcgaacagctgttgaaggaacagagtgagctggtagatcttgccgaaaatattcagcagaagctgtcttactttaacgagcttgagaccattaatactaagttaaattctccaaccctctccgtgaacagtgatggattcatccctatgcttgccaagcttgatgactgtattacctacattagttctcatcccaacttcaaggactaccctatttacctgctgaagttcaagcagtgcctgtccaaggctctgcatttgatgaagacttatactgtgaatactctgcagacccttacctcccaattgcttaaacgcgaccccagcagtgtgccgaacgcagataacgcctttacactgttctacgtaaagttcagggcggcggccccgaaagtgcggaccctgatagaacaaatcgagctgcgcagcgaaaaaattcctgaataccagcagctgctgaacgacatacaccagtgttatctggaccagagggagctcctgctgggaccttccatagcctgtacggtggccgaattaaccagtcagaataacagagaccattgcgcgctggtgcgaagcgggtgcgccttcatggtgcacgtgtgtcaggatgagcatcagctctataatgagttttttacaaaacccaccagcaaattggacgaacttctagagaagttgtgtgtgagcttgtacgacgtcttccggccccttatcattcacgtgatacaccttgaaacccttagcgagctttgtggcatcctcaagaatgaggtgctggaggatcacgtccaaaacaatgccgaacagctcggcgctttcgcagcaggtgtgaagcaaatgcttgaagacgttcaagaacgattggtctatcgaacccatatctacatccaaacagatattacgggctacaaaccagctcccggggatctggcataccctgacaagctcgtcatgatggaacagatcgcccaatccctcaaagacgagcaaaaaaaggttccttctgaggcaagcttctccgacgtccatctcgaggagggagaatcaaactcgcttaccaaatctggatcgacagagtcactgaacccaagaccacaaactacaataagtcccgctgatctacatgggatgtggtacccgacagtgcggcggactctcgtttgcctgagtaaactatataggtgtattgatcgcgccgtgtttcaggggcttagtcaggaggccctgagtgcctgcattcagagcctgttgggagcaagcgagtcaatctcaaagaataaaacccaaattgatggacagctgttcttaattaaacatctccttatcctccgggaacagatcgctccctttcacacggagtttactatcaaggagatctccctggatctcaaaaaaactcgggacgcggccttcaagattctcaaccctatgacagttccgcgcttttttcggctgaacagcaataatgcacttatagaatttctattggagggaaccccagagatcagagagcactacttggacagcaaaaaggacgtcgataggcatctgaagtccgcttgcgaacagttcatccagcagcaaacaaaactgtttgtcgagcagttggaggagtttatgaccaaggtttccgccttaaaaacaatggcgagtcagggaggcccaaaatatactctgtcacagcagccatgggcccagccagctaaggtgaacgatcttgccgcaaccgcctataagaccattaagacaaagctccctgttaccttgcgctccatgtctctctatctgagcaacaaggatacagagttcatcctgtttaagcctgttcgaaataacatccagcaggtgtttcagaaattccacgcgctacttaaggaggagtttagtcccgaggatatccagattattgcctgcccttcgatggagcagctgagccttctgctcctggtgtcaaagtag

SEQ ID NO: 112954 - DNA, 2370 bp, Artificial Sequence
  Description of Artificial Sequence: Synthetic coding sequence
atgggcacaaaaatggcggatttggacagcccaccaaagctgtccggagtccagcaaccaagcgagggggtagggggcggccgatgcagcgagatttccgcggagttgattaggagcctcacagaactgcaggaactagaagcggtctatgagcgcctatgcggagaagaaaaagtcgtcgagagagaactcgatgcactgctggagcagcagaatactatcgaatcaaaaatggtgacgctccaccggatgggccccaacttgcagttgatcgagggcgacgctaaacagctcgcgggaatgatcacctttacttgtaaccttgccgaaaacgttagctcaaaagtgagacaacttgatcttgctaagaatagactgtaccaggctattcagcgcgccgacgacatactggatctgaaattttgcatggacggcgtgcagacagccctgcgatcagaggactacgagcaggcagccgcccacacgcatcggtacctgtgcctcgacaagagtgtgatagagttgtctcgtcagggcaaggaggggtctatgattgacgccaatctcaagttactgcaggaggccgagcagaggcttaaagccatcgtggccgagaaattcgccatcgctactaaagagggggatctcccccaggtggagaggttcttcaagatcttccccctcctagggttacacgaggagggattgaggaaattctctgaatacttgtgtaagcaggtggccagcaaggctgaggagaatctgctgatggtcctgggaacagacatgagtgacaggcgagcagctgttatctttgccgatacgctgacactactcttcgaaggcattgctcgaatcgtcgagacgcaccagccaatcgtggaaacctattatggacctggacgactgtatacactcatcaaatatctccaggtcgagtgtgataggcaagtggaaaaagtagtggataagttcattaagcagcgcgactaccatcagcaatttcggcacgtccaaaacaacctgatgaggaattctaccacagagaagatcgagccgcgagagctggaccctattctgacagaggtgactttaatgaatgccagatcggagctctacctccgatttcttaagaagagaatttctagcgactttgaagttggggactctatggcttcggaggaggtcaagcaggaacaccagaagtgtctcgacaaattgctgaacaactgcctcctcagttgtacaatgcaagagctgataggattatatgtgaccatggaggagtattttatgcgggagaccgtcaacaaagcagtggctctcgacacttacgagaaaggacagctcacaagcagcatggtggatgacgttttttacatcgtgaagaagtgcatcggcagggcgctcagcagtagtagtattgactgtctctgtgcaatgatcaacctcgcaactaccgagctggagtccgattttagagatgttctgtgcaacaagctcaggatgggcttcccagcaaccactttccaggacatccagagaggtgtgacctccgcggtaaatatcatgcattcatctctgcaacaggggaagtttgacaccaaaggtattgagagtaccgacgaggctaagatgtcattcctggttacgttgaataacgttgaggtttgctccgagaacatttctacattgaagaaaacactggagagtgattgcaccaagctgttctctcaagggatcggcggagagcaggcgcaagctaagttcgattcatgtctgtccgacttggccgccgtaagcaataaatttcgcgatctgctgcaggaggggctgacagagttgaattcaaccgccatcaaaccccaagtgcagccttggattaacagttttttctccgtaagccataacattgaggaagaggaattcaacgactatgaggccaatgatccatgggtgcagcagttcatcctaaacctagagcagcagatggcggagtttaaagccagtctgtctccagtaatttatgatagcctcaccggtctgatgaccagtctggtggcggttgaactggagaaggtggtcctaaaaagcaccttcaacagattgggagggctgcaatttgacaaagagctgcgaagccttatcgcctacctcaccaccgtcacaacctggacaattcgtgataaatttgcccgactgagtcagatggctacaattttgaatctggaacgtgtgacagagattctggactattggggccctaactctggccccctgacctggcggcttacgcccgcagaggtacgacaggttctggcccttcggattgacttccgctccgaggacatcaagaggctgcgcctgtag

SEQ ID NO: 112955 - DNA, 2295 bp, Artificial Sequence
  Description of Artificial Sequence: Synthetic coding sequence
atggctgacctagacagcccccccaagctgagcggtgtgcagcaaccatccgagggggtaggtggaggccgctgttccgaaatttccgccgagctgatcaggtcgctgacagagttacaggagctggaagcagtgtacgagagactgtgtggcgaagagaaggttgtggagcgtgaactggatgctctactggagcagcagaacacaatcgaatcaaagatggttactttgcatcgcatgggacctaacctccagctaatagaaggggatgccaagcaacttgccggcatgatcacatttacctgcaatcttgccgagaatgtgtcttctaaggtgcgccagctcgacctggccaaaaatcgtctgtaccaagccattcaaagggctgatgatattctagacctgaaattttgcatggacggggttcagaccgctctccgatctgaggattatgagcaggccgctgcacacactcatcgttacttgtgtctggacaagtctgtgatcgagttgagcaggcaaggcaaggaggggagcatgatagatgccaatctcaaactactccaggaggcggagcagagactcaaagccatcgttgccgagaaatttgctattgcaactaaagagggagaccttcctcaggtcgaacggtttttcaagattttcccactcttgggtcttcacgaggagggactgaggaagttcagcgaatatctgtgcaaacaagtggcctctaaggcggaggagaatctcctgatggtgttaggcacagacatgtccgatagaagagccgcagtgattttcgccgacaccctgaccctcctgttcgaggggatagccaggatcgttgaaacgcaccagcccattgtcgaaacgtactatgggcccggacgtctttatacactcattaagtatcttcaggtggaatgtgaccggcaggtggagaaggtggtggataagtttattaagcagagggattatcaccaacaattccgacacgtacagaacaaccttatgcggaattctactaccgagaaaatcgagccacgcgaactggaccctatcctgactgaggtgaccctgatgaacgctaggtctgaactttatttgcggtttttgaagaagcgcatatccagcgatttcgaggtgggcgatagtatggcgtcggaggaggtgaagcaggagcaccagaaatgcctcgataaactcctgaataactgcctgttgtcttgtaccatgcaggaactcattggactttatgtgacaatggaagaatatttcatgcgggagacagtgaacaaagccgtggctcttgatacttatgagaaaggccaactgacaagttctatggtcgacgatgtgttctatatagtgaaaaaatgtatcggccgcgccctctcttcttcctctatcgattgcctatgcgcaatgataaacctggctaccacagagctggaaagtgatttccgtgatgtgctgtgtaacaagctcaggatgggcttcccggccacgacatttcaggacattcagcgtggggtgacctctgcggtgaatataatgcacagcagtctccaacaggggaagttcgacaccaagggcatagagagcacagatgaggccaagatgtctttccttagtgactgcaccaaactcttctcccagggcataggaggtgagcaggcccaggccaagtttgactcttgcctcagcgacctggcggcagtttccaataagtttcgcgaccttcttcaggaaggcctgaccgaactcaatagcactgctattaagccacaagttcagccttggattaattcattttttagcgttagccataacattgaagaggaggagtttaatgattacgaagccaatgacccatgggtacagcagttcatactaaacttagaacagcagatggcggaattcaaggccagtttatcgccagttatctatgatagcctaaccggactaatgacatcactcgtggccgtggagctggaaaaggtagtgctgaagtctacttttaataggctaggcggtttgcaatttgacaaagagttgcgatctctgattgcctaccttaccaccgtcactacctggacaatcagggacaaatttgcacgactaagccaaatggccaccatccttaatctggaaagagtcaccgaaattttagactattggggccccaactccgggccactgacctggaggcttaccccagctgaggttcggcaagtgctggctctcagaatcgatttcaggtccgaggacatcaagagacttaggctctag

SEQ ID NO: 112956 - DNA, 1014 bp, Artificial Sequence
  Description of Artificial Sequence: Synthetic coding sequence
atggctgatttggattcgccccctaagctctcaggcgtgcagcaaccaagtgagggggttgggggcggtaggtgctcagagatctctgccgagctgattaggtcgctgaccgagttgcaggagcttgaggctgtgtacgaaagactttgtggcgaagagaaggtcgtggagcgagagttggacgcgctgctggagcagcagaacacaattgagagtaaaatggtgacgctgcatcgcatggggccaaatctgcagctgatagaaggggacgcaaagcagctcgccggcatgataactttcacttgtaatctcgccgagaacgtatcctctaaggtccgccagctagatctcgccaagaacaggctgtaccaagccattcagcgtgctgatgatatcttagacttaaagttctgtatggacggagtgcagactgcgctccgcagtgaggattatgagcaggctgcagctcatacccacagatatctgtgcctagataagagtgtgattgaactgtcacgccaagggaaggaaggcagcatgatagacgcaaatctcaagctgctccaagaagctgaacagcggctgaaagctatagtggcagagaaattcgcaatcgcgactaaagagggggatctgccacaagtggagcggttcttcaagatcttcccccttctgggcctccatgaagagggcttgcggaagttctccgagtacctatgcaagcaggtggccagcaaggccgaggagaacttactcatggttctggggaccgatatgtccgataggagagccgcggtaatcttcgccgatactttaactctcctgtttgaagggattgctagaatagtcgaaactcatcagcccatagtggaaacatattatggccctggccgcttatacacactgatcaagtacctccaagttgagtgtgatcgccaagtggagaaagtcgtcgacaaattcataaaacagcgcgattaccatcagcagaacttcgtgttcagcttcttttag

SEQ ID NO: 112957 - DNA, 1344 bp, Artificial Sequence
  Description of Artificial Sequence: Synthetic coding sequence
atgcgcaattccaccacagaaaagatagaaccgagggaactggatcccatccttaccgaggtaaccttaatgaacgccagatccgagctgtacttacgatttttaaaaaaacgcatctccagcgactttgaggtgggagatagtatggcaagcgaggaggtgaagcaggaacaccagaagtgcctggacaagttgcttaacaattgtctgcttagctgtaccatgcaggaattgatcgggctctatgttaccatggaggagtactttatgagggagaccgtgaataaagctgttgctctggatacttacgagaaaggacagcttacttcctccatggtggacgacgtattctacattgtcaaaaagtgtattgggagagctctttcttcaagtagcattgactgtctgtgcgcgatgatcaacctcgccactactgagctggaatccgatttcagggacgtactgtgcaacaaacttcggatgggttttccggctactacattccaagatatccagcgtggggtgacaagcgctgtgaacatcatgcattcatccctccagcaagggaagttcgacaccaagggaatcgagtccacagatgaagcaaagatgtccttccttgttaccctgaataatgtggaggtctgttcggaaaatatcagcactctgaaaaagacccttgaaagcgattgtaccaagttgttcagccagggcattggcggcgagcaggcccaagctaagttcgacagctgtctgtcagacctagccgctgtctcgaacaaattccgggatctgttgcaagaggggctgacagaactgaacagcaccgctattaaaccacaggtccagccgtggatcaactctttcttttcagtgtcgcacaatatcgaggaggaagagtttaacgactatgaagccaacgatccctgggttcagcagttcatcctgaatctggaacagcagatggccgagttcaaggcgagcctgagtccagtgatttatgacagcctcaccggccttatgacctctctcgtcgcagttgagcttgagaaggtggtactgaaatccacatttaacagattgggcggcctgcagtttgacaaggagctccgcagcctgatagcttatttaacaaccgtgaccacatggacaatcagggataaatttgcacgcttgtcccagatggccaccatactcaatctagagcgcgtcaccgagatattggactattgggggccgaactctgggcccctcacatggcgcttgactccagccgaagtgcggcaggtgttagccctgcgtatcgactttaggtctgaggacatcaagaggctcaggctgtag

SEQ ID NO: 112958 - DNA, 2583 bp, Artificial Sequence
  Description of Artificial Sequence: Synthetic coding sequence
atggggtgggtaggggggcgccgcagagattctgcaagtccaccgggccgtagtcgctcagcagcagacgacattaatcctgcaccagccaatatggaaggaggaggcggcagcgtagccgttgccggtctcggagccagaggctcaggcgctgctgctgccacagtccgcgagctgttgcaggatgggtgctattctgactttctgaacgaggacttcgacgtgaaaacctacacttcccagtctattcatcaggcagtcattgccgaacaactggcaaaacttgcccaagggatatcccaacttgatcgagagctccatttgcaggtagttgctcgtcatgaagatctcctcgcgcaggccacagggatcgagtcgctggagggggtccttcagatgatgcagacccggattggagcgctgcagggggccgtggatcgtattaaagccaaaatcgttgagccttacaacaagatagttgcacggacagcgcagctggcccgattacaggtggcttgtgatcttctgcgcagaatcataaggatactgaatctgagtaagcgcctccaagggcaactgcagggcgggagtcgcgagatcaccaaggcagcacaatctctaaatgaactggactacttgtctcagggcatcgacttaagtggaattgaggtcatcgagaacgacctattgttcatcgctagagcccggttagaggtcgaaaaccaggcaaagcgcctccttgaacaagggctcgagactcagaatccaacacaggtgggcacagccctacaggtgttctacaatctggggactttgaaggataccattacttcagtggtggacggttactgcgcaacgttggaggagaatatcaattccgcactcgacatcaaggtcctcactcagccttcccagtccgctgtgcgaggggggcctggacgatcgacaatgcccacccctggcaatactgccgccttgcgcgcttctttttggacaaatatggaaaaattaatggaccacatctacgctgtttgcggccaagtgcaacatctccagaaggtgcttgctaaaaaaagagatccagtgagccacatctgttttatagaagaaattgtgaaggacggacaacccgaaatcttttacacattctggaactccgtaacacaggctcttagctctcagtttcacatggccaccaatagttccatgtttctgaagcaggcattcgagggggaatacccaaaactccttcggctgtacaatgatctatggaagcggctgcagcagtattctcaacatatacagggcaattttaacgcttctggaaccacggatctctatgtcgacctccagcatatggaagacgacgctcaggatattttcataccaaagaagcctgactatgaccctgaaaaggctctaaaggattctctgcaaccttacgaggccgcctacctctccaagtcactatcacggctcttcgacccaatcaatctggtgttcccccccgggggccgcaacccccccagcagcgatgaactcgacggcattattaaaacaatcgctagcgaacttaatgttgccgcagtggataccaatctgaccctggctgtgagtaaaaatgtggccaaaacgatccagctgtatagcgttaaatctgagcagctcctctccacccagggcgatgccagtcaggtgattggcccactgaccgaaggtcaacgcaggaatgtagccgtggtgaactcactttataaacttcatcagagtgtgacaaaagtggtctcctcccagtctagctttcccctggcggccgaacagaccatcatctctgctcttaaggccattcacgctctcatggagaacgcagtgcagcctctgctcacatctgtgggggacgccatcgaggccattataatcacaatgcatcaggaagattttagtggtagtctgagttcctctggaaagccggacgtgccatgtagtctttacatgaaggagctgcaaggcttcatcgccagggtgatgtctgactattttaagcactttgaatgcctcgattttgttttcgacaataccgaggcgatcgctcagagggccgtggagctattcatcaggcacgcatccttgatccgccccctgggcgagggggggaaaatgagacttgcggccgatttcgcccagatggagctcgctgtagggcctttttgtaggagagtatctgatctgggtaagagttatcggatgttgaggagcttcagaccactgctttttcaggcaagtgaacatgttgcttccagtcctgcactcggtgatgttattccttttagtataattattcagtttctgttcaccagagctcctgctgagcttaagtcgcctttccaacgggctgagtggtcacatacaagattttcacagtggcttgatgatcatccttctgagaaggatcgactcttactaattagaggcgcgttggaagcatatgtccagtcggtgcgcagccgcgaggggaaggagttcgcaccagtttatccaatcatggtgcaactcttacagaaagcaatgtccgcgcttcagtag

SEQ ID NO: 112959 - DNA, 2520 bp, Artificial Sequence
  Description of Artificial Sequence: Synthetic coding sequence
atgggctgggtcggaggccgtagacgcgatagtgcctctcctccaggacgtagccgttccgctgccgacgatatcaatcccgcccccgctaatatggaaggaggcggcggttccgtggctgtggcaggtctgggagctaggggtagcggggccgcagccgccaccgtgagggaactgctgcaggacggatgctacagcgacttcttgaacgaggacttcgacgtgaaaacttacacaagccagagcattcatcaggcagttatcgcggagcagttagctaagctagctcagggcatctctcagctagatcgagagctacacctacaggtagtggccaggcacgaagacctgcttgcccaggccacgggcatcgagagcctggagggagtgctccagatgatgcagactaggattggagcccttcaaggggcggtggaccgaattaaagccaagatagtggagccatataacaaaatcgtggctcgcacagcccagttggctcgtttgcaggttgcatgtgatcttctcagacgcatcattcggatcctgaatctgtccaagcgtttgcagggacagctgcaggggggtagtagagaaataacaaaagccgcccaatccttaaacgaactcgactatctgtcccagggtattgacctgtccggtattgaggtgatcgagaacgatttactgttcattgctagagctcgactggaagtcgagaatcaggccaagagactgttggaacagggtcttgaaacacaaaatccaacccaggtgggcaccgcactccaggtgttctacaatctggggacattgaaggacacaattacaagcgtagtggacggctattgcgccacgctggaggagaatatcaactccgctctggacattaaggtattgacacagccctcccaatctgccgtccggggcggcccaggtcgctctacgatgccaacacctggaaataccgcggccctgagagcctccttctggactaacatggagaaattgatggatcatatttacgccgtgtgcggacaggtccaacaccttcagaaagtgcttgccaagaaacgggacccggtctctcacatctgttttatcgaggagatagtgaaagatggacaacccgaaattttctatactttctggaatagcgtgacccaagctctgtcctcccaatttcatatggccaccaacagctccatgtttctgaaacaagcctttgagggtgaataccccaagctgctcaggttatataacgatctctggaagcggttgcaacagtatagccagcacatccaggggaattttaacgcaagtggtacgactgacttgtacgtcgacttgcagcacatggaggacgacgcccaggatatattcatccctaagaaacccgattacgacccggagaaagccctgaaggattctcttcaaccctacgaagccgcatacctctctaaatcattatctcgcttgtttgaccctattaatctcgtgttcccccctggcgggagaaacccccccagttctgatgagctggacgggatcatcaaaaccattgcttctgagctaaatgttgcagccgtggatacaaacttaacactagccgttagtaagaatgttgcaaaaactatccagctatactctgttaaatccgaacagctgctatcaacccaaggggacgcgtcccaggtcattgggcccctcaccgaaggtcaaagaagaaacgtggcggtggtgaatagcctgtataaactgcaccaaagcgtgactaaggccatacacgcactcatggaaaatgcagtgcagcccttgcttacctcagttggtgacgccatcgaggcgatcataattaccatgcatcaagaagatttctccgggtccctgtccagctccggcaagcccgatgtgccctgttcactttacatgaaagaactgcaggggtttattgctagggtcatgagcgactatttcaagcatttcgaatgccttgatttcgtgtttgacaacacagaggccatcgcacaacgagctgtcgagcttttcatcagacatgcctcgttaatcagacctctgggcgagggagggaagatgaggctggcagctgacttcgcccagatggagctagcagtaggccctttctgccgccgagtatcagacctggggaaaagctaccggatgctccgctcctttagaccgttgctgttccaggcctccgaacacgttgctagctctcctgccctcggcgacgtgatccctttctccataattatacagttcctgttcacacgggccccagccgaacttaagtccccatttcaacgcgcagagtggtcccatactcgcttctcccagtggttggacgaccacccaagcgagaaggatagacttcttttgatccgaggtgcattggaagcgtacgtgcagtcagtcagaagccgcgagggcaaagaattcgcgcccgtgtatcctatcatggtgcagctgctgcaaaaggctatgagtgctctgcagtag

SEQ ID NO: 112960 - DNA, 2472 bp, Artificial Sequence
  Description of Artificial Sequence: Synthetic coding sequence
atgggatgggttgggggacgtcggagggactcagcctcccctccagggcgctcaaggagcgctgctgatgacatcaatccggccccagctaacatggaggggggcggaggatcagtggctgtagccggcttgggagcaaggggatctggggccgccgctgccacagtcagggagttgctgcaggacggatgctatagcgactttctgaacgaggattttgatgtgaaaacctatacgtcacaatccattcaccaggccgtgatagccgagcaactagccaaacttgcccagggcatttcccagctagacagggagttgcacctgcaggtcgtagctcgtcatgaagatctcctggctcaagcaacaggtattgaaagtctggagggagttctgcagatgatgcagacccgcattggggctttgcagggagccgtagaccggataaaagctaagatcgttgagccctacaataagatcgtggccagaaccgctcagcttgcgagattgcaggtagcatgtgacctccttcggagaattatccggatactcaatctgtcaaagaggctgcaggggcagctgcagggtggttccagagaaattacaaaagctgcccagtctctaaacgagctcgactatttaagccagggaattgatctttccggcattgaggttatcgaaaacgacctgctgttcattgctcgcgctagactagaggtggagaaccaggcaaagcgcctccttgagcagggactagagacacagaacccgacccaggttggtacggccctgcaggtcttctataatctgggaaccctcaaggacaccatcacatcggtggtcgacggctactgtgcgactctggaggagaacatcaacagcgctctggatatcaaagttctgacccagccctctcagagtgccgtgagaggggggcccgggagaagtacaatgcccacgccgggcaacaccgcagcccttagagcttcgttctggaccaacatggagaaacttatggatcatatctacgcggtgtgcgggcaggttcagcacctgcagaaagtcctcgcaaagaaacgggaccctgtgtcccacatatgctttatcgaggagatcgtcaaggatggccaaccagagattttctacaccttttggaacagcgtgactcaggcacttagcagtcagttccatatggcaactaactcttcaatgttccttaagcaagctttcgaaggagagtacccgaaactcctaagactgtacaacgacctctggaagcgtctgcagcaatacagtcaacacatccaaggaaacttcaacgcctcaggaaccaccgatctgtatgtagatctccagcatatggaagacgacgctcaagatatcttcatcccaaagaaacccgactatgacccagaaaaggctctgaaagatagcttacaaccatatgaggctgcttatcttagtaaatccctgagccgcttgttcgaccccataaatctcgtcttccctcccgggggccggaaccccccctcttcagacgagctggacgggatcattaaaacaatagcatcagaactgaacgtggctgcggtggatacgaacctaactctggccgtgtctaagaatgtggcaaaaacgatccagttgtattctgtaaaatctgaacagctgcttagtacccaaggtgacgcatcacaggtcattggccctttgaccgaaggccagcgccgcaacgtagctgtcgtgaacagcttatataaacttcatcagagcgtgaccaaagtggtcagctcccagagttcattcccattggccgccgagcagaccatcatctccgctctaaaagctatccatgccctgatggagaatgcagtgcagcctctcctgacgtccgtgggtgacgctatcgaggcaatcattatcaccatgcatcaggaggatttttcagggtccctgagctcttcgggcaaaccagacgtgccatgttcgttgtacatgaaagagctccaaggctttatcgccagggttatgtccgattattttaagcatttcgaatgcttagacttcgtctttgataataccgaagccatcgcccaacgcgctgtcgagctgttcattaggcacgcatcactcataaggcccctaggagagggtggtaaaatgcgcttggcagccgactttgctcaaatggagctggcagtgggccctttttgtcgccgggtttcagatctggggaagtcttacagaatgctgcgctccttccgccccctgttatttcaagcgtcagagcacgtagccagttcccctgcccttggcgacgtgattcccttctccatcattatccaattccttttcacaagggctccggctgaacttaagtcaccgttccagagagcagagtggtcgcacactcggttcagtcaatggctcgatgaccaccccagcgagaaagacaggctgctgcttatacgatag

SEQ ID NO: 112961 - DNA, 2067 bp, Artificial Sequence
  Description of Artificial Sequence: Synthetic coding sequence
atgaggggtcgattcgcccacgcacaatacagtcgttgtctccggggaccttgtctagccgaggtggctgctgggggcggaacaaggtcagcaatggcggagggaagcggtgaggtcgtggcagtcagcgcgaccggcgccgccaatggactaaacaatggcgccgggggcacatccgctacaacttgcaacccattgagtagaaaattgcacaaaatcctggaaacccgtttggacaacgacaaagaaatgctcgaagcactgaaggccctgagcacctttttcgtcgaaaattccctgagaactaggaggaatctgcgaggagacattgaacgcaaatcgctggcgatcaacgaggagtttgtctccatttttaaagaagtgaaggaagagctcgagtcaatcagcgaagacgttcaggcgatgtccaactgctgtcaagatatgacctctcgcctgcaggctgctaaggagcaaacccaggatttaattgtgaaaacaaccaagctccaatcggagagtcagaagcttgagattcgagcgcaggtagctgatgcgtttctgagcaagttccagctcacgagtgacgaaatgagcctgttgagagggactagggagggccctattactgaggacttcttcaaggctctgggtagggttaaacagatacataacgacgttaaagtattactacggacaaaccagcagacagccggcctggagatcatggagcagatggctctgttgcaggaaaccgcctacgagagactgtataggtgggcccagagcgaatgccggacactgacccaggagagttgtgatgtctcgcctgtgctcacgcaagcaatggaggccctgcaggacagacctgtgctgtacaagtatactctggacgagttcggaaccgcgagacgctccacagtggttcgtgggtttattgatgctctcaccaggggtgggcctggcggcacacctagacctatcgagatgcatagtcacgacccactcaggtacgtgggggatatgctggcctggctacatcaagccactgcatctgagaaagagcacttggaggctctactgaagcatgtgacgacccaaggcgtggaggaaaacatccaggaggtcgttggccatatcaccgaaggggtttgccggccactgaaggttcgcattgagcaggttatcgttgccgagccaggcgctgtgctcttgtacaagatctcaaatctattaaagttctaccatcacacgatctctggcattgtcggcaacagcgccacggccttgctcaccacgatcgaggaaatgcacctgctcagtaagaagatcttttttaattcactttcactgcatgccagcaagttgatggacaaggtagaattgccgccccccgacctaggtccctcgtctgctctcaatcagactctaatgttactccgcgaggttctcgcttctcacgattctagcgtcgtgcccctggatgcacgtcaagccgacttcgtgcaggtcctctcctgtgtcctcgatcctctactgcaaatgtgcacggtgagcgcgtcaaaccttggaaccgcggacatggccaccttcatggtgaactcattatacatgatgaaaacgaccctagctctgttcgaattcaccgacagaagactcgagatgctccagtttcagatcgaggcacacctggacacactgattaacgaacaggccagttacgtgctaacccgcgtcgggctgtcgtacatatacaacaccgtgcagcagcacaaaccagagcaagggagcctcgccaacatgcccaacctggactccgttacccttaaggccgccatggtgcagttcgatagatacctgtccgcgccagacaacctcttgattcctcaactgaattttctgttgagcgccacagtaaaagaacagatcgtaaaacagagcactgaacttgtttgcagagcctacggagaggtatacgcagccgtcatgaacccgattaatgagtacaaagacccggagaacatccttcatcggtctccccaacaggtccagacattactcagctag

SEQ ID NO: 112962 - DNA, 1848 bp, Artificial Sequence
  Description of Artificial Sequence: Synthetic coding sequence
atggccgaaggcagcggcgaggtcgtggcggtgtctgccactggggccgctaacggcctcaacaatggagcgggcggcacgagcgcaactacatgcaatcccctttcacgcaagctgcataaaattctagaaacccggttggataatgacaaggagatgcttgaggctcttaaagctctttctactttttttgtagagaactcgctgcggacacgtcggaatctgcggggcgatatcgaaagaaagtcactggcaatcaacgaagaattcgtatctatttttaaagaggtcaaggaggaactggagtccatttcggaagatgtgcaggccatgagcaattgctgtcaggatatgacatcgcgcctccaggccgcaaaagagcagacgcaggacctgattgtaaaaaccactaagctgcagagcgaatctcaaaagctcgagatccgggcacaagtggcagacgcattcctgagtaaatttcaactgacaagcgatgaaatgagtctgctccggggaacgagggagggacccattaccgaggacttttttaaagcactgggcagggtcaaacagattcacaacgacgttaaagtgctgcttagaacaaaccaacagaccgcaggcctagaaatcatggagcaaatggcgcttctgcaggagactgcatacgagagattgtatagatgggcccagtcggagtgccggaccctgacccaggagtcctgcgatgtgagccctgtgctgacacaagccatggaggccctgcaagacagaccggtcttgtacaagtatacactggatgagttcggtacagcccggagaagcaccgtcgttcgaggcttcatcgatgcactcacccgagggggccctggcgggacacctaggcccattgaaatgcatagccatgacccactgcgatatgtgggagatatgctagcatggctgcaccaggctaccgccagcgagaaagaacacttggaagctctcctaaagcatgtgacaactcaaggcgtggaggagaatatccaagaggtggtcggacacatcacagagggcgtatgtcggcctctgaaggtccgcatcgaacaggtgattgtggcagaaccaggagccgtgctgctgtacaagattagtaatctgctgaagttttaccatcatacaatcagtggaatagtaggcaattctgcaaccgcgctgctgactaccattgaagagatgcacctgctttccaaaaagatcttcttcaattccctctctttgcacgcctctaagctcatggacaaggtggaactcccccctcctgatttaggcccctcctccgccctcaatcagaccctgatgctcctgagagaagtactggcttcacacgatagttctgtggtgcccctcgacgcaagacaagccgatttcgtccaggtgctgagctgcgtgctagacccgcttctgcagatgtgcaccgtgagtgcaagtaatcttggtactgcagatatggccactttcatggtgaatagcctgtatatgatgaaaactacactggccctgttcgagttcacagacagacgcctggagatgctccagttccagatagaggcccacctcgataccttaatcaacgaacaggcgtcatacgtcctgactagggtcggcctctcatacatttataatactgtccagcagcacaagcctgagcaggggtccctcgccaacatgcccaacctcgacagtgttaccctgaaggctgcaatggtccaattcgaccgctatctgagtgctcctgataatcttttgattccacaactgaactttctgttaagcgccacagtcaaacggccacctaacggaccttag

SEQ ID NO: 112963 - DNA, 1974 bp, Artificial Sequence
  Description of Artificial Sequence: Synthetic coding sequence
atggcagaaggctccggagaggtggttgcagtaagtgctacaggggccgccaacggccttaacaacggggctggcgggacctcagccacaacttgtaacccactgagccgaaagctccacaagatcttggagacacggctcgacaacgataaggagatgctggaagccctaaaagcactttctacgttcttcgtcgaaaactccttgaggacaagacggaacctccggggcgacatagagcgaaagagccttgccattaatgaagaattcgtgagcatctttaaggaagtaaaggaagaactggaaagtatcagtgaagatgtgcaggccatgtcaaattgttgccaagatatgacttcccggctgcaggccgcaaaggagcagacccaggacttgattgtgaagactaccaagttgcagtctgagtctcaaaagctggaaatcagagcccaagtcgccgacgctttcctctctaagttccaactcacatctgatgaaatgagcctgctgcggggcactcgggagggacccatcacggaggactttttcaaggcgctcggccgagttaaacagatccacaacgacgtgaaagttcttcttagaacaaaccaacagacggcgggacttgaaataatggaacagatggcgttacttcaggaaaccgcatatgagaggctatatcgctgggcccagtctgaatgcagaacactaactcaggagtcatgcgatgtgtccccggtcctcactcaagccatggaggcactgcaggaccgaccagttctgtataagtacacgcttgacgagttcggaactgctcgccgatctactgtggtgaggggattcattgatgcactgactcggggaggacccggcgggacgccgaggcctatcgagatgcacagccacgaccccctacggtacgtgggcgacatgcttgcctggctgcaccaggctaccgcatctgagaaggaacaccttgaggcactccttaagcacgttacgacgcaaggcgtcgaagagaatattcaagaggtggttggccatattaccgaaggcgtatgcaggccactcaaggttcggattgaacaggttatagtagcagagccgggagccgtgctcctctacaagatatctaacttactaaagttttaccaccacactatttctggaattgtgggcaattccgctacagccctcttaacgacgatagaggagatgcaccttctgagtaaaaagatcttcttcaattccctgtctttgcatgcctccaaactgatggacaaggtggagttaccgccccctgacttaggcccaagtagtgcattaaaccagacactgatgctgctgcgtgaagttctggcgtcccatgattcatcggtcgtccccctggatgctaggcaggcagattttgtgcaagtgctctcttgtgtcctcgacccactgctgcagatgtgtacagtttccgcctcaaacttgggaactgccgacatggctactttcatggtcaacagtctatatatgatgaagacaacactcgcgttatttgagttcaccgacagaaggttggaaatgttgcagttccaaatagaggctcatctggacacactgattaacgaacaggcctcctatgtgctcacccgagtaggactgtcatacatctataacaccgtccagcagcataaacccgagcagggatccttggctaacatgccaaatctcgacagcgtgaccctgaaagctgctatggttcagtttgatcgctacttatctgcacctgacaacctcctcataccccagctcaatttcttattgtcagccaccgtgaaagagcagattgtaaaacagtctacggagttggtgtgccgagcatacggggaagtgtacgctgctgtaatgaaccctatcaacgaatataaggatcctgaaaacatcctccatcgaagtcctcagcaagttcagaccttgctgtcctag

SEQ ID NO: 112964 - DNA, 2313 bp, Artificial Sequence
  Description of Artificial Sequence: Synthetic coding sequence
atggacttttccaagttccttgcagacgacttcgacgtcaaagagtggatcaacgccgcattcagggccgggtccaaggaggcagccagcggcaaagctgatggccatgcagccacactggtgatgaagctacagctgtttatccaggaagtgaatcatgctgtggaggagacatcccaccaggcactccagaacatgcctaaggtgctgcgggacgtggaagccctgaagcaggaggcaagtttcctaaaggaacagatgattctggtgaaggaggatatcaaaaaatttgagcaagacaccagccaatcaatgcaggttctagtggagattgatcaggtgaagtcacgcatgcagctagccgccgaatcactacaggaggcggataagtggtcaacactatctgcagatatcgaggaaacattcaaaacgcaggatattgcagtgataagtgctaaactgaccggtatgcaaaattctctcatgatgctggttgatacacctgactactcagagaaatgtgtgcacctcgaggccctaaaaaacaggctggaggcgctagcatcccctcaaatagtcgcggcctttacttcacaggccgtggaccagtccaaggtgttcgttaaggtatttacagagatcgatcgaatgcctcaacttcttgcctattactataaatgccacaaggtgcagttgctcgccgcatggcaggagctgtgccagtcagatctgtctcttgatcggcagctgacaggcctgtatgacgcactcttgggggcttggcatactcagatccagtgggctactcaggtgttccagaaaccccacgaggttgtcatggtgctactgattcaaactctgggcgctctcatgccgagcttgcccagctgtttgtcaaatggggtggaaagagctgggccggagcaggagctaaccagactgctggagttctatgatgccacagcccattttgccaaagggctggaaatggctctgctgccccacctccacgagcataatctggttaaggttacagagctcgtagacgcggtttacgacccttataagccatatcagctgaaatatggcgatatggaagagtctaatctgctaatacagatgtcagcggtaccacttgagcacggagaagtgattgactgtgtccaggaactgagtcactcagtgaacaagctcttcggactggcaagcgctgccgtcgataggtgcgtccggtttactaatggattaggcacttgcggactgcttagcgcactcaaatcattgtttgctaagtacgtgagtgattttacttctacccttcagtcaattaggaagaagtgtaaattggatcacattcctccaaactcactgttccaggaggactggaccgccttccagaattccatcagaataatcgccacctgcggcgaactgcttagacattgtggagactttgaacagcagctcgcgaatcgcatactgagcactgccggcaagtacctgagcgactcttgcagtcctcggtctctggctggcttccaggaaagtatcctcaccgacaaaaagaattccgcaaaaaacccctggcaagaatataattacctacaaaaggacaatcctgccgaatacgcctccctgatggaaattctgtataccttgaaagaaaaaggtagcagcaatcataacctgctggccgctccgcgagcagctctcacacggctgaaccagcaagctcatcagcttgctttcgattcggtattcttgcgcatcaagcagcaattgctgctcatctccaaaatggactcatggaataccgctggaattggggagacactgacggacgagctcccagcctttagcctgacaccactggagtacatctctaatatcggccaatacatcatgagcttgcctttaaaccttgagcccttcgtcacgcaagaggactctgctctcgaactggccctgcatgctggtaaactgcccttcccacctgaacaaggtgatgaactgcccgaacttgataatatggcagataattggcttgggtccattgcgagagccacaatgcagacatactgcgatgctattctgcagattcctgagctctctccccacagcgccaagcagctggcaacggacattgactatctcatcaacgtgatggatgccctgggtcttcagccatcgagaaccctgcagcacattgttacactgctgaagacaaggcctgaggattaccgacaggtgtcaaagggactaccacgccgactagccacaactgtggcgaccatgcggtctgtcaattattag

SEQ ID NO: 112965 - DNA, 1839 bp, Artificial Sequence
  Description of Artificial Sequence: Synthetic coding sequence
atggcaactgctgctacgattcctagcgtggctactgccaccgctgcggcactgggggaggtcgaggacgaggggctcttagctagtctgttcagggataggtttcccgaggcacaatggcgagaacgacccgatgtgggccggtacttacgcgagctttctggcagcgggctcgaaaggcttagacgtgaaccggaacggctggcggaggagagggcccaactgcttcagcaaacccgggatctggctttcgcaaattataaaacatttattaggggtgccgaatgcaccgaacggattcataggctgtttggcgatgtggaagccagtctggggaggctgctcgacagactgccttcttttcagcagtcctgcagaaatttcgtcaaggaggctgaggagatttcatccaatcgccgcatgaacagcctgacactgaatcgtcatacagaaatcctcgagatcctggaaattccccagctgatggatacctgtgtgcgcaatagctattacgaagaggccctcgaactagcagcctatgttcgaaggcttgaacggaaatattcttccattcctgtaattcagggaattgtaaatgaagtgaggcaatctatgcagcttatgttgtcacagctcatacaacaactacgaacgaatatccagctacccgcttgcctgcgggtgattggctatctgcggcgtatggatgtgttcactgaggccgagctgcgggtgaagtttctgcaggcaagagatgcatggctgcggagcatcctcacagccattccgaatgacgacccatattttcatattaccaagactatagaggcctctagagtgcacctcttcgatattattacgcagtatagggccattttctcagatgaggaccccctgcttccacctgcgatgggagagcacactgtgaatgagtctgccatttttcacggatgggtcctacagaaagtatcccagtttcttcaggtgctggaaaccgatctctatcgcggaattgggggccacctggacagcttattagggcaatgcatgtactttggactgtccttctcacgagtcggggctgacttccgtgggcagctggctccagtctttcaaagagtggccatttcaacattccagaaagccatacaagagaccgtggagaagtttcaagaagagatgaactcttatatgctgatctctgcacctgccattcttggcacttctaacatgccggcagccgtgccagccactcaaccaggtaccctacagcctccgatggtgctcctggattttccgcccctggcttgcttcctgaataatattctggtggccttcaatgatcttcggctatgttgtccagtggccctggcccaagacgtgactggtgctctggaggacgccctcgctaaagtgacaaagatcatattggctttccaccgcgctgaggaggccgccttctcttctggtgagcaggaattgtttgttcagttttgtactgtgttcctggaagatctggttccctatcttaacagatgcctgcaagtcctgtttcctccagcccagatcgcacagactctgggcatcccccctacgcagctcagcaagtatgggaacctaggccacgtaaacatcggagcgatccaagagcctctcgcattcattctgcccaaaagggagaccctcttcaccttggatgaccaggctttgggtcctgaattaactgctcctgccccagaaccacccgccgaggaacctcggcttgaaccagcaggacctgcctgccccgagggcggtcgtgccgagactcaggctgaacctcccagtgtaggcccctag

SEQ ID NO: 112966 - DNA, 2109 bp, Artificial Sequence
  Description of Artificial Sequence: Synthetic coding sequence
atggagagcccatccgccccccctcatcggtggtgcatcccttggcaacgtctgcttctcaccgcgtcccttctgaccttctggaatccaccgactacagctaagctcacaatcgagtctacacccttcaacgtggccgagggtaaagaagtgttattgctggttcacaatctgcctcagcatttatttggctactcttggtataaaggggagcgggtcgacgggaacaggcagattattggatacgtaatcggaactcaacaggccacacctgggcccgcgtattcaggtcgagaaattatttaccccaatgcgtctctgcttattcagaacattattcagaacgataccggattctacactctgcacgtaatcaaatctgatctggtgaacgaggaagcgacgggacaattcagagtgtacccagagctaccgaaaccatcaatctcttccaataacagtaagcctgttgaagataaggacgcggtggcatttacctgtgaacctgagacccaagacgccacctatctgtggtgggtgaataatcagagcctgccggttagtccacggctgcagctctccaacggaaaccgcactcttacactttttaacgtcacgaggaatgatactgcctcctacaagtgcgagacccagaacccagtgtccgctcgtaggtccgacagtgtgattctaaacgtactctatggccccgacgcacccacaatcagtcctttgaatacatcctatcgttccggtgagaacctgaacctctcatgtcatgctgcaagcaatcctccagctcagtactcctggttcgtcaacggcacgttccagcagtctactcaggagttgttcatcccaaatatcacggttaacaattcgggctcttatacctgtcaagcccacaattcagatacgggccttaatcgcaccactgtgactactataacagtgtatgcagagccaccaaaaccgttcataacgagcaataattccaaccccgttgaagacgaagatgccgtagctctgacctgcgagcccgagatccaaaacacaacatacctatggtgggtgaacaaccagtcactacctgtttcaccccgcctgcaactctcgaacgacaatagaacattaactttgctgtcagtgacccgaaatgacgttgggccgtacgaatgtgggatccagaacaagctatctgtggatcactcagaccccgtaattcttaatgtcctttacggtcctgatgaccccacaatcagccctagttacacttattaccggccaggggtgaatctcagtttatcttgccatgcggctagcaatcctcctgcccagtactcatggttaattgacggcaacatccagcagcacactcaagagctgttcatcagcaatattaccgagaagaactcaggcttgtatacctgccaggccaataacagtgctagcggacactctaggaccaccgtgaaaaccatcacggttagtgctgagcttccaaagccatcaatcagtagcaacaatagcaagcccgtggaggacaaagatgcggtcgcctttacctgcgaacccgaggcccagaacaccacctatctgtggtgggtcaacggacaatccctaccggtgtccccgcgattgcaactgtcaaatgggaaccgcactttaactttgtttaatgtgaccagaaatgatgccagagcttatgtgtgtggcatacaaaatagcgttagcgcaaacaggtctgatcctgtgacacttgacgtcctttacggcccagatactcccatcatctctccacctgactcgtcatatctgtccggagccaacctgaacttgagctgtcattccgcatcgaatcccagtccacaatatagctggaggattaatgggatccctcagcagcacactcaagtgctctttatcgctaagataacccctaacaataatggaacctacgcctgtttcgtgtcaaatctcgctacaggacgtaataactcaatagtcaaaagtatcactgtcagcgccagtggaacctcccccggtctgagcgctggggctacggtggggattatgatcggagttctcgtcggagtggccctgatctag

SEQ ID NO: 112967 - DNA, 981 bp, Artificial Sequence
  Description of Artificial Sequence: Synthetic coding sequence
atgatggcctacatgaacccgggcccacactattcagtgaatgccctggctctgagcggtcctagcgtggatctgatgcaccaggcagtgccttacccctcaccgcccttggcacttgaccctccaaggcgacagagacaggaacgcacagtatataccgagtcccagcaaaaggtcctggagttctactttcagaaggaccagtatcccaactacgaccaaagattaaacctggctgaaatgcttagcctgcgtgaacaacaactgcaggtttggttcaagaatcgcagagctaagttggctcgagaacgtaggctgcagcagcaaccccagcgcgtcccgggccagcgcggtcggggtgcccgcgcagcgcctctggtgcccgtggcagccgcctctttccccggcggaccggaattcccgcagggtcggggcagttggatctccccacagccaggcccctggggagtgcttcccgcagcagaaccaaagatttattcactgccgcgtacatggggtgggccagagtgcgggactcaggaggggcttaaggccgtgccagctcctggtccagggccaattccggcccctataccgggacctgctcagattccaggccccgtgccgggccctgcccctaacctgggccccatgtcagggccccttagcgtgagcattcctgggcctatcccggcaccaatctcatgtccaggaccaatccctgaccctgttctcggaaggactctgatgcccgggcccggatctctgccaactcccgcacctggcgctctgtggcctcagtccccctatgccagcaatctgtctcccgacacccagctgtacccagatttcacaaaactgcttccattgttggaccgatttgaggaatccagtctgagtaccacaacttcacagtacaaagaggaggatggctttgtggacaagaatcactcggtaccacgctctctcctggacctatag

SEQ ID NO: 112968 - DNA, 900 bp, Artificial Sequence
  Description of Artificial Sequence: Synthetic coding sequence
atgatggcgtatatgaacccaggcccccactacagtgtgaatgccctcgccctttccgggccgtcagtcgacctcatgcaccaggcagttccctacccttccgctccacgcaagcaacgtcgagagcgcacaacctttactagatcacaactagaggagctggaagcactgttcgcaaagacacagtaccctgacgtctacgccagagaggaagtggctctcaaaatcaatttaccggaatctagggttcaagtgtggtttaagaatagaagggccaagtgcagacagcagcggcaacagcagaagcagcagcagcagccaccaggcggccaggcaaaggctaggcccgctaagcggaaagctgggactagccctcgcccctctactgacgtctgtcccgacccgctggggatttctgattcttatagtccaccactgcctggcccatcaggtagtcctacgactgctgtggccacggtttccatatggtcacccgctagtgagtcaccccttccagaagctcagagggccggcctggtagcctccggtccttcactgacatctgccccgtatgccatgacatacgctcccgctagcgcattctgttcttccccatctgcatatggctccccttcctcatacttttctggcctcgatccttacctcagccctatggttccccaactgggaggccccgccctcagtccgctgagcggcccttcagtaggaccctccctggcccagtcgccaacgtctctcagtggccaatcctacggggcatacagccccgtggacagtctcgaattcaaggatccgactggtacttggaagtttacatacaatcctatggatcccctagattacaaagaccagtccgcgtggaagttccagattctttag

SEQ ID NO: 112969 - DNA, 900 bp, Artificial Sequence
  Description of Artificial Sequence: Synthetic coding sequence
atgatggcatatatgaacccagggccccactacagcgtgaatgcactggcgctgagcggccccagcgtcgacctgatgcaccaggccgtaccttatccttcagcccctcgcaaacagaggcgggagcggacgacatttacccggagccaactagaagaattggaggcgctgtttgcaaaaacacaataccctgacgtttatgctcgcgaggaagtggctctcaaaattaatctgcctgagtcgcgcgtacaggtgtggttcaagaatcggagagccaagtgtcgtcagcagaggcaacagcaaaaacagcagcaacaaccacccgggggccaggctaaggctcgccccgctaagaggaaggccgggacctctcctcggccttcaacagacgtgtgtccagacccactggggatttcggattcatacagtccccccctgcctggcccctcaggcagccctaccacagcagtggctacggtctcgatatggtcaccagcttccgagtcgcctctccccgaggcgcagagggcagggctcgtggcctcaggtccatccctcacatccgccccctacgcaatgacgtatgccccagccagcgctttctgttcctccccaagtgcctatgggtctcctagctcttatttctccggactggacccctacttgtcacctatggttccacagctgggcggacccgccctgtcacccctcagcggtccctctgtcggtccttctctagctcagagccctactagcctgtctgggcagagttacggggcatattcacccgtggactctctcgagttcaaggatcctacgggcacttggaagttcacatacaatcccatggaccctctggactacaaagaccaatcagcatggaaattccagatcctatag

SEQ ID NO: 112970 - DNA, 900 bp, Artificial Sequence
  Description of Artificial Sequence: Synthetic coding sequence
atgatggcctatatgaaccctggcccccactattccgtgaacgcgcttgcgctatcggggccctccgtggatctgatgcatcaagccgtgccttaccctagcgccccccgcaagcagcgaagagaaagaacaacattcacacggtctcagctggaggagctcgaggctctctttgccaaaactcagtaccctgatgtgtacgctagggaggaagttgctttgaaaatcaaccttccggaatcccgggtgcaggtatggtttaagaatcgccgggcaaagtgcagacaacaacgccagcagcagaaacagcagcagcagccaccgggcggacaagccaaggctcgaccggctaaaagaaaggctggcacttccccaaggccttccacggacgtttgtcccgatcccttaggaatttctgacagttactcaccaccattaccaggtcctagcggcagccccactaccgctgtggcaacagtgtccatatggtctcctgcctctgaaagccctcttcccgaggcccaaagagcagggcttgtggcttctgggcctagcttaacttccgccccatatgctatgacatacgctcccgcaagtgcgttttgttcatccccatccgcatacggatctccctctagctatttttctgggttggacccttatttgtcacccatggtcccacagctgggggggcccgcactgtctcccctgagtgggcctagtgtgggtccttcgctagcccagtcaccaacctccctttcaggccagagctacggggcctactctcccgtggacagtctggagttcaaggatcctacaggaacatggaagtttacgtacaatcctatggatcctctcgactacaaggaccagtctgcatggaagtttcaaatactctag

SEQ ID NO: 112971 - DNA, 3678 bp, Artificial Sequence
  Description of Artificial Sequence: Synthetic coding sequence
atggcagctgtgctggagtctttgctgagagaggaagtcagtgtggccgctgtggtccggtggatagcaagaagtactcaaggatccgaggacaatgctggtgaggcagctgccctctcaagccttcgtgctctccgtaaagagttcgttccatttctgttaaattttctcagagaacagagcagcagagttctgccccaggggcccccaacacccgcaaagacacccggcgcctccgccgccctgccaggcagaccagggggtccccccagggggagccgcggagcgcggagccaactgttccctccaaccgaagcccagtccaccgccgccgaagcacctcttgctagaagagggggacggaggcgaggccccggtccagcacgggagagaggtggacgcgggctagaggagggggtctccggagagagtctgccaggcgcaggcggaaggcggttacggggttccgggtctccaagtcggccgagcctcaccctttcagatccacccaacctgagcaacctcgaggagttcccacctgtaggctccgtgccaccaggcccaacagagacacagctgtcctgccgtcgatgggtgccgagaagactgtggggggtcagtcactcctcttcagctttacgctcaggcgcgcctgggtgtaggaccaaaccctctcggcggataaatcccactccggtttcggaagaacggagcctgtccaagcctaaaacctgtttcaccagccccccaatatcttgcgtgcccagcagtaaacaactgcagcagtctcctaccccgacttgtcccacccctgaactgggaagtcccctgccatccagaacaggaagcctgacagacgaaccggcagaccctgcccgggtgagcagcaggcagagactggaactcgtggctttggtctattccagttgcatcgccgagaacctcgttcccaatcttttcttagagcttttctttgtgtttcagctcctcaccgctagaagaatggtcactgccaaggacagtgaccctgaattgtccccggccgtgctggactccctggaatctcccttgtttcagtccatccatgactgtgtgttcttcgctgtgcaggtgctggaatgtcactttcaggtgctgagcaacttggataagggaactctgaagctcctggctgagaacgagcgcctgctttgcttttcacctgctctccaaggtcgcctgagagcggcatatgaaggcagcgtggccaaagtgtcactggtcatgccaccgtccacccaggccgtgtccttccagcctgaaacagacaatagagcgaacttttcatccgaccgagcctttcatacctttaagaaacagagggacgtcttctatgaagtcctgcgggaatgggaggaccaccatgaggagcccggttgggacttcgaaaaggggttgggatctcggattagggccatgatgggacagctctctgccgcctgtagccacagccatttcgtacgattattccagaagcaattattgcagatgtgtcagtcccccgggggagcagggggcacagtgcttggcgaagctcctgacgtgctttccatgttgggtgccgacaaacttggacgcctttggagattgcaggagcggctgatggctcctcagtctagtggcggaccctgccccccaccaacttttccagggtgccagggcttcttcagggatttcattttgtctgcaagctctttccaattcaaccagcacctgatggactccctctccctgaagatccaagaactgaacggactggcactgccccagcatgaaccgaacgatgaagatggggaaagcgacgtagattggcagggggagcgaaagcagtttgctgtggttcttctttcactccgactgctggccaagtttctcggcttcgtggccttcctgccgtacaggggacctgagccacccccgacaggcgaattgcaagattctatcctggccctgagaagccaagtgccgcctgttctcgacgtgcgaacactactgcagagggggctgcaggcacggagggccgtgctcactgtgccctggttagttgagtttctgagtttcgcagaccacgtcgtgcctctgctcgagtactatcgcgacatctttaccctattactgcgcctccatcgcagcttggtattgtcgcaggagagcgagggaaagatgtgttttctgaacaagctgttactgctagctgttctgggatggttgttccagattcctactgtgcccgaggatctgttcttcctcgaggagggaccttcttacgcatttgaggtggacacagtggcacctgaacacgggctagacaacgccccagtggtggaccagcagctgctatacacatgctgtccatacataggagagctgcggaagctactggcctcatgggtctctggtagtagtggacgcagtggtggatttatgcgcaaaataaccccaaccacgacaacctcactgggcgctcaaccaagccagacttcccaggggctgcaggctcagcttgcacaggcatttttccataaccaacctccatccttgcgccgcacggttgagtttgtagcagagcgcatcggttcaaattgcgtgaagcacataaaagcaacacttgtcgctgatctcgtgcgccaggctgaaagcctacttcaagagcagctggtcacccagggtgaggaaggcggagaccccgcccagttgttggaaatcttgtgctctcagctgtgtccccatggggcacaagccctagctttaggacgggaattttgccagcgcaagtcacccggggccgttagggccctgttgccagaggagacgccagcggctgtgctcagctctgccgaaaatattgcagtggggctggcaacagagaaagcctgtgcttggttgtcggctaatatcacagccctgattcggcgagaagttaaggcagctgtgagtcgtactttgcgagcacagggtcccgagcctgcagctagaggagaacggcgcgggtgctcacgggcttgtgagcaccatgctcccttaccaagccacctcatcagcgagattaaggacgttttgtccctggcagtcggaccacgcgacccggatgaaggcgtgagtcctgagcacttggagcagttactgggacagctgggacaaacgctgcgttgtcggcaatttctgtgtccacccgccgaacagcacctggccaagtgttccgtggagctcgcctcgctgcttgtggccgatcagattccgatcctgggccctcctgctcaataccggctggagcggggccaggcccgacggctcctgcatatgcttctttcactgtggaaagaagacttccagggtcccgtgccactccaacttctgctgagccccaggaacgtgggtctcctggcagacacaagaccgcgcgagtgggatcttctactgtttttactcagggaactcgttgagaaggggctgatgggccgtatggaaattgaggcctgcctcggatccctccaccaagctcaatggcctggggattttgccgaggaactggccactctctcaaatttgtttctcgctgaaccacaccttcccgagcctcagctccgcgcgtgcgagctggttcagccaaacagaggtacggtcctggcccagtcatag

SEQ ID NO: 112972 - DNA, 3684 bp, Artificial Sequence
  Description of Artificial Sequence: Synthetic coding sequence
atggcggccgtactggagagcctgctccgtgaggaagtcagcgtcgctgctgtggtcagatggatagctcggagtacgcagggttccgaagataacgctggagaggcggcggcattaagttctttaagggctctcaggaaggagtttgtaccttttctgctcaacttccttcgcgagcaatcctccagagttttaccgcagggaccaccaactccggccaaaacgcctggggcttccgccgcactcccaggcaggccaggtgggccgcctcgcggatccaggggcgccagatcccagttgtttcctcccactgaggctcagagtacagccgccgaggctcctctggctcgccggggaggacggcgtcggggtcccggccctgctcgtgagaggggcggccgaggactggaggaaggggtgtccggagagtccctacccggggcaggcggacggagactccgcggctctgggtccccttctaggccttctctgactctcagcgatcctccaaatctttcaaacctggaggaattcccaccagtgggcagcgttccccccggacccacaggtaccaagccctcccgccgaatcaatcctacacctgtgtctgaggagagatcactgtccaaacctaagacatgctttactagtccacctataagctgtgtgcctagctcacagccatctgccctcgacacatccccttggggtcttgggctgcctcctggatgtcgatctctgcaggaggagagagagatgctgaggaaagaacggtcaaagcaactgcagcaaagtccaaccccgacatgtccgacccccgagctgggctctccactgccctcgcgaacaggctccctgactgatgaaccagctgatcccgctcgcgttagtagcagacagcggttagagctcgtcgctcttgtatatagctcttgcatcgcggagaacctggtgcccaacctcttcctggagctgttcttcgtctttcaactattgaccgctcggagaatggttacagccaaggactcagaccccgagctcagtcccgctgtccttgatagtttggagtcccccctgttccagagcatccacgattgcgtcttttttgccgtgcaggtcttggagtgtcacttccaagtcctgtcaaacctggacaagggaacactgaagttactggctgagaacgaaagactgctgtgtttcagtcccgcgctccagggccggttacgggctgcttatgagggctccgtagccaaggtgtcattggtcatgccccctagtacccaggctgtgtccttccaacccgaaaccgataatcgagccaacttctcaagtgatagagcttttcacacttttaagaagcagcgcgatgtgttctacgaggtgctcagggaatgggaggatcatcacgaagagccaggctgggacttcgaaaagggcctgggctcacggattagagccatgatgggacaacttagcgccgcatgctcccactcccatttcgttagactatttcagaaacagctactccagatgtgtcagtcaccaggaggcgccggcggaactgtcttgggcgaagctccggatgtcctttccatgctgggagccgacaagctcgggaggctgtggcgtcttcaagagcgcttgatggcccctcagagcagcggcggcccctgtcccccacccacattcccaggatgccaagggtttttcagagattttatcctgtcagcttcatcttttcagtttaaccagcatctgatggattcgctcagcctgaagatccaagagctcaatggattggccctgccacagcatgagcctaacgatgaggacggggagtccgacgtcgactggcagggggagcgaaagcaatttgctgttgtgctgctcagcctcaggctcctcgccaagtttctgggcttcgtcgcctttttgccttatagaggccccgagcctcccccaaccggagagctccaggatagcatccttgctttgcgatcacaggtgccacccgtgctggacgttagaactctcctgcagcgcggacttcaagcacgacgagcagtgttaaccgtgccatggctagtcgagtttctgagtttcgccgaccacgtggtgcctctcctcgaatattatcgcgatatctttacgctgctccttaggctgcaccgatccctcgtgctgtctcaagagagtgaaggcaagatgtgcttcctgaacaaactcctgctattggctgtgttaggatggctcttccaaattccgaccgtgcccgaggacttgttttttctggaggaggggccaagttacgcgttcgaggtagatactgtggctcctgaacatggcctcgacaatgcccctgttgtggatcagcagctgctgtacacctgctgcccctacattggtgagctgagaaagttgctcgcatcttgggtgtccggatcctccggtcgctcaggtgggttcatgcggaaaataaccccaaccacgacaacatccctcggggcccagccttcacaaacgtcccagggcttacaagcccagcttgctcaagccttttttcacaatcagccaccaagtctccgccggacggtggagtttgtcgcggagagaatcggttctaactgtgttaagcacatcaaagccacactggtggcagacctagtgcgacaagctgaaagcctactacaggagcagctggtgacacagggcgaagaaggaggcgatccagcccagctgctcgagatactgtgttctcagctgtgtccacacggggcacaagcactggctttgggccgcgagttttgtcagaggaagtctcctggggccgttcgtgcgttgcttccagaagaaacccccgctgcggtcctctcctcagctgagaatatcgcggtgggacttgcaaccgaaaaagcttgcgcttggctgagcgctaacataactgcattaatccgacgcgaggtgaaagccgccgtttctcggactctgcgcgcacaggggccggaacctgccgctcgaggagagagacgcgggtgctctcgtgcttgcgagcaccatgctccactgccctctcatcttatatctgaaattaaggatgtgctgtctcttgcagtgggcccccgcgacccagacgagggagtgagtccagaacatctcgagcagctcctgggccagctgggccagacccttcgctgtcgtcaattcttatgtccaccggccgagcagcacctggctaagtgcagcgtcgagctggctagcctcttggtggcagatcagatacccatactgggcccacccgcccaatacaggcttgagcgcgggcaagcaagacgactgctccatatgctgctctcattgtggaaggaggacttccaaggacccgtgccccttcagttgttactttctcctcgcaacgtcggactgttggccgacacccgtccaagggaatgggatctgctgctgtttctgcttcgggagctggtcgagaaggggctaatgggccggatggaaattgaagcctgtttgggatctttgcaccaagcccaatggcccggtgacttcgcagaggagcttgctacactgagtaaccttttcctggctgagcctcatctgcctgagccgcagctccgggcctgcgaactcgtccagcccaaccggggtacggtactggcccagtcttag

SEQ ID NO: 112973 - DNA, 2697 bp, Artificial Sequence
  Description of Artificial Sequence: Synthetic coding sequence
atggcactcatcatggagcctgtgtctaaatggagcccatcacaagtcgttgactggatgaaggggctggatgattgtctgcagcagtacataaagaactttgaaagagaaaaaatttctggcgaccagctgctgaggattacccaccaggaactagaagacttaggcgtgtccagaattggacaccaggaattgatcctcgaggccgtggacctcctgtgcgcccttaactacggcctcgaaacggaaaatttgaaaaccttgtcacacaagcttaacgcttcagccaagaatctccagaactttattacaggccgcagacgatcgggtcactatgacggtaggacctcaagaaagttacctaacgacttcttgacctcagtggtagacctcatcggagctgccaaatcattacttgcttggctggaccgctcaccttttgcggcggtaaccgattattcggtcacaagaaacaacgttatccagctgtgtttggaactcacaaccatcgtgcagcaggattgcactgtgtatgagaccgaaaataaaatcctgcatgtctgtaagaccctcagcggcgtctgcgaccatataatcagcctgagtagcgatccacttgtgtctcagtccgcccatttagaggtgatccagctggccaacatcaaacctagtgaagggttaggcatgtacattaagtctacctacgacgggttgcacgtgatcacgggtaccacggaaaacagcccggccgaccgctgcaagaagattcacgctggggacgaagtgatacaggtgaaccaccagacggttgtgggttggcaactcaaaaacctggtgaatgccctgagagaggatccctcgggtgtcatcttgacattaaagaaacgaccgcagtccatgctgacaagtgcacctgcacttttaaagaacatgaggtggaagccgttggcactccagcctctcatacccaggagtcctaccagtagcgtagccactcctagctccaccatcagcactcctaccaaacgcgacagtagcgccctgcaggatctgtatatccctcccccgcctgctgaaccctatatcccccgtgacgagaagggtaacctcccatgtgaggatttacgcggacatatggtaggtaaacctgtgcacaaaggcagcgaatctcctaactcttttctcgaccaggagtaccgaaagcggtttaacatagtggaggaggacaccgtgctctattgctacgaatacgagaagggccggtcatcaagtcagggccgcagagaatcaacaccaacttatggcaaactgcgccccatctctatgcctgtggaatataattgggtgggcgattacgaagatccgaataagatgaaacgtgacagccggcgcgagaacagccttctacgctacatgtctaacgaaaagatcgcacaagaagaatatatgttccagcggaattctaagaaagacactgggaagaaatctaaaaaaaagggagataagtctaattctccgacccactacagcctcctcccttccctgcaaatggacgccttgcgccaggatatcatggggactcctgtacctgaaaccacactgtaccacaccttccagcaaagttctctgcagcacaagagtaaaaaaaagaacaagggacccattgccggcaagtcaaagcgcaggatctcttgcaaagacctggggaggggcgattgtgagggttggctgtggaagaagaaggatgctaagtcatacttttcacagaaatggaagaagtactggtttgtcctcaaggatgctagcctgtattggtacatcaatgaagaagacgaaaaagcggaagggtttatttccttacctgagttcaagatagaccgcgcgagcgaatgtcgcaaaaaatatgcgttcaaagcctgtcaccctaaaattaaatcattctactttgcggccgaacatctggacgatatgaataggtggctaaacagaattaacatgcttacagccgggtacgcggagcgggaacgaataaaacaggagcaggactactggtccgagagcgacaaagaggaggccgatacgccttccacacccaagcaggattctccccccccaccatacgacacatacccgagacccccatctatgtcgtgtgcttccccgtatgtagaagccaaacattcacgactaagctctaccgagacctcacagtcacagagttcgcacgaggagttccggcaggaggtcaccggctctagcgcggtcagccctatcagaaagaccgctagtcagcgccgtagttggcaggacctgattgagactcccttaacaagtagtgggttgcactatctgcagacgctacccctcgaggatagcgtgtttagcgacagtgctgctatctctccagagcacaggaggcaatctaccttaccaacgcaaaagtgccacctgcaggatcattatggcccctatccccttgccgaatcagagcgcatgcaggttctgaacggtaacgggggcaaacctagatcttttaccctccctcgcgactccggcttcaaccattgttgtctgaatgctcctgtctctgcctgtgatccacaagacgatgtgcagccgccggaagtcgaagaggaggaggaggaagaggaggaggagggggaggccgcaggagaaaacattggagagaagagttag

SEQ ID NO: 112974 - DNA, 3105 bp, Artificial Sequence
  Description of Artificial Sequence: Synthetic coding sequence
atggccctgatcatggagcccgtgtccaaatggtctcctagtcaggtggtggactggatgaaaggcttagacgactgcctgcaacagtatataaagaactttgagagggaaaaaatcagcggcgaccagttactgcgaatcacccatcaggagcttgaggatctgggggtgtcccgcatcggtcaccaggagcttatccttgaagccgttgatctgctttgcgccttgaattacggcctggagaccgagaacttaaagactttgtcccataagcttaacgccagcgccaagaatctgcagaacttcataacgggcagacgacggagcggccactacgatggaagaacaagccgaaaattacccaatgattttctcacgtcggtggtagacttgatcggagcagcgaaatccctcctcgcctggttagaccgctcgccatttgcagctgtgaccgactattctgtcacgaggaataatgtgatacagctttgcctggaactgactactattgtgcagcaggattgcaccgtgtacgagaccgagaataagatcttacacgtctgcaaaacgcttagcggggtctgcgatcatattatctccctctcttccgacccattggtgtcacagagcgcccatctggaggtgattcagctggcaaatatcaagccctccgaagggctcggtatgtatataaagtctacatatgatggactacacgtcatcacaggcaccacagagaacagtcccgccgatagatgcaaaaagatacacgccggggacgaagtgatacaagtgaatcatcagacagtggtcggctggcagctgaagaatctcgtgaatgccctccgagaggatccatccggggtcatcctgacactgaaaaagcgcccacagagtatgctaacaagcgcccccgcgcttctcaaaaacatgagatggaagcctttggccttacagccgcttattccaaggagcccaacttccagcgtcgcaactccatcctctacgatcagcacgcctacaaaaagggattcatccgcgctgcaggacctgtacatccccccacctcccgccgagccgtatattccacgcgatgagaaagggaacctgccgtgtgaggatctgcgaggacacatggtgggcaaaccagtgcacaaaggaagcgaatcacctaacagtttcctggaccaggagtacagaaagagattcaatattgtggaggaagatacagtgctgtattgctacgagtatgagaaaggacgctcttcctcgcagggcaggcgcgaatcaactccaacatacgggaaactgagacccatttctatgccggtggagtacaattgggtaggcgattacgaggaccctaacaagatgaaacgcgactcgaggagagaaaacagccttctccggtacatgtcaaatgaaaagattgcacaggaagagtacatgtttcagaggaattctaagaaggacacaggcaaaaagtctaaaaagaagggcgataagagcaacagcccaacacattactcactcctgccatcattgcagatggacgcactgaggcaggatatcatgggcacccccgttcctgagacaaccttgtaccacaccttccagcaatcctctctacagcacaaaagcaagaagaaaaataagggaccgatagccggcaaaagcaaaagaaggatctcttgcaaagatcttggtagaggagattgcgaaggctggctctggaaaaagaaggacgctaagagctatttttctcagaagtggaaaaaatattggtttgtgttgaaagatgcgagtttgtactggtacataaacgaggaagatgagaaagccgagggtttcattagcttaccagagttcaaaattgacagagcatctgaatgtcgaaaaaagtacgcctttaaggcctgtcatccgaaaataaagtctttctatttcgcagccgaacacctcgacgatatgaatcgatggcttaataggatcaacatgctgaccgcagggtatgcagaaagagaacggatcaagcaagagcaagattactggtcggaatcagacaaggaagaagctgacactcctagtactccaaaacaagactctccaccccctccatacgatacttacccaaggcctccctccatgtcctgcgcatcgccctatgtagaggctaagcattctcgcctctcctctacagagacctcccaatcgcaaagtagccacgaggagttcagacaggaggtcacaggctcttccgcagtttctccaattcgtaaaactgcttcacagcgacggtcatggcaggacctgattgaaacccccttgacttcgagcgggctgcattatctgcagacactgccactagaggattcggttttttcagattcagctgcaatttcacccgaacaccgacgccagtctacactgcccacgcagaagtgtcatcttcaggaccactacggtccttaccctctggccgaatctgagcggatgcaggtgctgaatggaaacggcggaaagccccggagctttacccttcctcgggactccggctttaatcactgttgcctcaatgcaccagtgagcgcctgcgatcctcaggatgatgtgcagccacccgaggtggaggaagaggaggaagaagaagaagaggagggcgaagctgctggcgagaacatcggtgagaagtcagagtcgcgcgaggaaaaactgggcgactccctgcaggacctttatagagcactggagcaggccagcttgagtcccctgggagagcaccgtatttccacgaagatggagtacaagctgagcttcatcaagcgctgcaatgatccggtcatgaacgagaaactgcataggttgaggattctgaaatccactttgaaagctagagagggggaagtggctattatcgataaggtgctggacaaccctgatctcaccagcaaggagttccagcagtggaagcaaatgtatctcgacctgttcctggacatttgtcaaaacaccacatcgaacgacccactgagcatttcatcggaagtggacgtaatcacgagtagtctggctcacacccacagctatatcgagactcacgtgtag

SEQ ID NO: 112975 - DNA, 3015 bp, Artificial Sequence
  Description of Artificial Sequence: Synthetic coding sequence
atggctttaattatggaacccgtttccaagtggtctccatcacaggtcgttgattggatgaaagggctcgacgattgcctgcagcagtacattaagaacttcgagcgggagaaaattagcggagaccagctcctccgcattacacaccaggaattggaagatctgggtgtgtcaaggattggccatcaggagctgatactggaagcagtggacctgctttgcgccctgaactatggactggaaaccgagaacctcaaaactctgtcacacaagcttaatgctagtgcaaagaatttgcagaatttcatcacagggcgccgccggtcaggccactatgatggacggacaagccgcaaattgccaaacgacttcttaacttccgtggttgatctcatcggtgctgccaagagcctattggcatggttagatcgctccccatttgccgccgtgactgattacagtgtgactcgcaataacgtaatccagctctgtctcgagctgactacgatcgtccagcaagactgcaccgtgtacgaaacagaaaataagatacttcacgtgtgcaaaacattgagcggcgtatgcgaccacataatatctctgtcttcagaccctctcgtttcccaaagtgcgcacctggaggttattcaattagcaaacattaagccgagtgagggccttgggatgtatattaagtccacatacgacggccttcacgtgattacaggcaccaccgagaatagccccgcagatcggtgtaaaaagatccacgcgggagatgaagtgatccaggtaaaccatcagactgtggttggctggcagctgaaaaaccttgtcaatgccctgagggaagatcctagcggcgtaatcctgactctgaagaagagacctcagagcatgctaacatcagctccagctttacttaagaatatgagatggaagccactcgctttgcagcccctgattcccagaagccccacctcttctgttgcaacccctagcagtactatttccactccaacaaagcgggatagctccgccctgcaggacctttacataccgcctcctcctgctgagccctacatcccaagagatgagaaaggaaacctcccgtgtgaggacttgcgagggcatatggtgggaaagccagtccacaaaggttcagaatcccccaacagcttccttgatcaagagtacaggaagagattcaatattgtagaagaagatacagtgctctactgctacgagtacgagaaagggcgttcttccagtcagggccgccgagaatccaccccgacttacgagaacagcctgctacgctatatgtctaacgaaaaaatcgcgcaggaggaatacatgtttcagcggaattctaagaaagacaccggcaaaaagtctaagaagaagggtgacaagtctaatagtcccacccactactccctgctgccttctttgcagatggatgccctcaggcaggatattatgggcacgcctgttcccgagactacactgtatcacacctttcagcagtcatctctgcagcacaaatccaaaaaaaagaacaagggtcccattgccgggaagagcaagcggcgaatctcatgtaaggacctgggtaggggcgactgtgaaggctggctctggaaaaaaaaagatgccaagtcctatttctcacagaaatggaaaaaatactggttcgtactgaaagacgctagtctgtactggtatattaacgaggaggacgagaaggcggaggggttcattagcctgcccgaattcaaaattgaccgtgcgtccgaatgccggaagaaatacgcatttaaagcttgccaccccaaaataaagagcttttattttgccgctgaacacttagatgacatgaatagatggctgaaccgaatcaacatgcttacagctgggtacgccgaacgggagcgaattaagcaggaacaagactactggagcgagtctgacaaagaggaggcagatacaccaagcacacctaagcaggactctccaccgccaccgtatgatacataccctagaccaccatctatgtcctgcgccagtccctacgtagaagctaaacacagtcgacttagttcgactgagactagccagagtcaaagttcccatgaggaatttcgacaggaggtgaccggcagttcagccgtctcacctatcaggaagactgcctcacagaggcggtcctggcaggacttgatagagacccctctgacctcaagcggcctccactaccttcaaacactgcccttggaagattctgtctttagcgactccgctgcaatctctcccgaacacagacgacagtccactctgccgacccagaagtgtcacctgcaggaccactatggcccatatcctctggccgagagcgaaaggatgcaagtgttaaatgggaacgggggcaagccgcgttccttcacgctaccaagagactctggcttcaatcactgctgcctcaatgccccagtgagcgcgtgtgacccccaggacgacgtgcagccgcccgaagtggaggaagaggaagaagaggaggaagaggaaggagaagccgccggagagaacataggcgagaagtcagaatcccgggaggagaaacttggcgactcacttcaggatctttatagagcgcttgagcaggcttcgctttctccactgggagagcacaggatcagcacaaagatggaatacaagttgtcttttatcaaaaggtgtaacgaccctgtcatgaacgaaaagctccacagactcagaattcttaagtccacactgaaagccagagaaggggaagtggctattattgacaaagtcttagataatccggacctcaccagtaaagagtttcagcagtggaagcaaatgtatttagacctgtttttggatatctgtcagaatacaacatcaaacgatcctttatccatcagctccgaagtcgacgtgatcacatcctccttggcacacacacattcttacattgagacgcacgtatag

SEQ ID NO: 112976 - DNA, 2550 bp, Artificial Sequence
  Description of Artificial Sequence: Synthetic coding sequence
atggcactgatcatggagcctgtgtcaaagtggtcacccagccaggtcgtggattggatgaagggcctcgacgactgtcttcagcaatatattaaaaacttcgagcgggagaagatcagcggcgatcaacttctccgaatcacccatcaggagcttgaagatcttggcgtgtcgcggatcggtcaccaggaactcatcttggaagccgtcgacctcctctgcgccctgaactacggcctcgagaccgaaaatctgaagactctgagccataaacttaatgcttccgcaaagaacctgcagaacttcatcaccggcagaagacggagcggacactatgatgggcgcacttcaagaaagttgcctaatgattttttgacctctgtcgtggacttgataggtgccgccaagtctttgctggcctggttggaccgttcgccattcgccgcggtcaccgattatagcgtcacacgcaacaatgtgatccaactgtgtttagaactaaccactatagtacagcaagactgtaccgtgtacgagaccgagaataagatccttcacgtctgcaaaacactcagcggcgtgtgtgatcacatcatcagtctatcttctgaccccctggtctctcaatcggcccacttggaggtgatccagctagccaatattaaaccgtcagaaggcctaggaatgtatatcaagtcgacttacgatggtctgcacgttattaccggcactaccgagaacagtcccgcggatcgctgcaagaagattcatgccggggacgaggttattcaagtgaatcatcagacagtgccgttgattccgaggagccctacatcaagcgtggctacaccatcctcgactatatctacccccaccaaacgagattcctcagcactgcaagatctgtacattccccctccccccgctgagccatatatcccgagggacgagaagggcaacctgccgtgcgaagaccttcgtggccacatggtcggtaagcccgtgcacaagggctccgaaagtcccaatagtttcttggaccaggaataccgcaaacggttcaatattgtcgaggaggacactgtgctctattgttacgagtacgagaagggacgcagcagctcgcagggtcggagggagagcaccccgacgtatggaaagttgcgtcctatctcaatgcctgtcgagtataactgggtaggcgactatgaggatcctaataagatgaagcgtgattccagacgcgagaattctctgctgagatatatgtccaatgagaaaatcgcgcaagaggagtacatgtttcagcgtaacagtaaaaaagataccggcaagaaatccaaaaagaaaggagacaagtctaatagtcctactcattacagtctactgcccagtctgcagatggatgctctgagacaagacataatgggcaccccagttcctgaaacgacgctgtatcacacatttcagcagagtagcctgcagcataagtccaagaaaaaaaataaaggacctatcgctggtaaaagcaaaagacgaatttcttgcaaggacctgggacgaggggactgcgagggttggctgtggaagaaaaaagacgcaaaaagctatttcagtcagaaatggaaaaaatactggtttgtgttgaaagacgctagtctgtactggtatatcaatgaggaagatgaaaaagcagagggctttatctccctgcccgaatttaagatagatcgcgctagcgaatgtcgcaaaaagtatgctttcaaggcctgccatcctaaaatcaagagcttctatttcgccgctgagcacctcgatgacatgaacaggtggctgaacaggattaacatgctcaccgcaggctacgctgaaagggaacgaataaaacaagaacaggattactggtctgagagcgataaagaagaggcagacacaccatccactcctaaacaggactctccacccccaccatatgatacttatcctcggcctccctctatgtcatgtgcgagcccttacgtcgaagcgaaacattctcggctgtcctcaaccgaaactagccaatctcagtcttcccatgaggagtttcgccaagaggtgaccggttcttcagccgtgtctcccattcgcaagaccgccagccagaggagaagctggcaggatctgatcgaaaccccactcactagcagtggcctgcactatttacagaccctgccattggaagattcagtgttctcagattccgcagcaatctcaccagagcatcggcgccagagtacactcccaacgcaaaagtgccacctgcaggaccactatggcccttatccactagcagaatcggaaaggatgcaggtgctgaatggtaacggcggaaaaccccggtcatttactctccctcgtgactcagggtttaaccactgctgcctcaacgcccccgttagcgcatgcgaccctcaagacgacgtccagccgccagaggtggaagaggaagaggaagaagaagaagaggagggcgaggccgccggagaaaacatcggggagaaatcctag

SEQ ID NO: 112977 - DNA, 414 bp, Artificial Sequence
  Description of Artificial Sequence: Synthetic coding sequence
atggatgattctgacacgccaacatattacttgcaaattgaaccccaagacggatgccatcctggagattccgtggagaggagtgttacttgcttgccgagcgcctctgacgagaatgagaaccagttagatggagacgggcacgagcacctgacctcctccgatagtgccatggggaaaccacaggtgtccgagcaggactctttgaataacaacgaatcttgcaccttgtcctgcgaggtagctgcaggcgagaaccttcagaatactctatgcgaggcctcccgcgatgaacaagctttcctcggcaaggacaaaaagattcctggcaagcgcagtcccagaagcaagaaaggtactgccaagaaaattcctccagactcgcgcattctattcccgggcggcgggctgtag

SEQ ID NO: 112978 - DNA, 1851 bp, Artificial Sequence
  Description of Artificial Sequence: Synthetic coding sequence
atggacgattctgacactccaacctactatcttcagattgagccacaggatgggtgtcatccaggtgactctgttgaaagatccgtgacttgccttccaagcgcttcagacgaaaacgaaaaccagctggatggagacggccatgagcacttaacgagtagcgatagtgcaatgggcaaacctcaagtctccgagcaagactcgctcaacaacaatgaaagttgcaccttaagttgtgaagttgccgctggggaaaatctccagaacactctgtgcgaagcctctagggatgagcaagcctttctgggtaaggataagaaaatacccggcaagcgctctcctcgatctaaaaagggaacggccaaaaagattcccccgggactgttcagcggagacatcgcacccctgatgcaagaaaaggttctgagcgctgtcacatacgccgttgatgatgaagaagctgctgaggttaacgccaatgagcaaccggaggctccaaagttggtgctgcagagtctcttctctctgatcagaggcgaggtggagcagctggactcaagagccctgccgctgtgcctgcaccagattgccgagtcctactttcaagaggaggattatgaaaaggcaatgaagttcattcagctcgagaggttgtaccacgaacaactgctggccaatctcagtgccattcaggagcagtgggagaccaagtggaagacagtgcagccccacaccgttaccgcgcttcgcaactcagagaaaggattcaacggcgaagattttgagcgcctgactaagatctgcgctactcaccaagacccccttctcagtaaacacaaaatcgccgccgtggaaaagtctcaagagaggaagtgttcaacacagttgcttgtctcagaggacccgaaggagggaggcgctaccacaaaggagtccgagagtaagacttgcctagggacagagagttccaaagagtcgcaacataccgtggagcccctgggttccagcccatgctgccaccagatggatgtgcagaccgactcgccaagtttatccgtgacagccggtaaggatcatatggaagaattgctttgctccgctgaagctaccctagccctgcacacccaatcgtctgagacggcaggctctccgagcggacctgatagtagcgaggacgcctgcgaggatgactctaggctgcagctcgcacaaacagaggcctgccaagacgtggcccgtatcgaagggattgccgaggaccctaaagtgttcctcagtagtaagagtaaaacggaaccactgatctctccaggatgcgatcggatcccaccagcattaatctccgaggggaaatatagccaggctcaacggaaagaattaagactgccattgcgcgatgcctccgaagctctgcctacggatcagttggagaacaatgaactgaacgagttacagcaacccgacttgaccgactccgatggcaagagccctcaagcacaggctgactccgacggttccgaaaacgtcctttgtggtaacaatcagattagcgacttaggcattttacttccggaagtgtgtatggcaccagaggagaaaggggacaaggacgaccagctcaataaggaaacagaagattatctgaactctctgctggaggggtgtctgaaagataccgaagactccctatcctatgaggacaatcaggacgacgattcagaccttctgcaagacctgtccccggaggaggccagctactctctgcaagagaacctccctagcgacgagtcctgtctgtccctggatgacctcgccaaaagaattgaaatcgctgaagtcaaccaacgatag

SEQ ID NO: 112979 - DNA, 2178 bp, Artificial Sequence
  Description of Artificial Sequence: Synthetic coding sequence
atggacgactctgacacccccacatactatctgcagattgaaccccaagatggctgtcatcccggggattcagtcgaaaggtccgtcacatgtctgccaagcgcctccgacgagaatgaaaatcagttagacggtgatgggcatgagcacctgaccagctctgactccgcgatgggtaagccacaggtttcagagcaggacagcctgaacaataatgaaagctgtacactgtcttgtgaggtcgccgccggagaaaacctgcagaataccctttgcgaggcatccagggacgagcaggcattcctcggaaaagacaaaaagattcccggcaagagaagtccacgatctaagaagggaaccgccaagaagattccaccggggttattctccggagatatcgcccccctgatgcaagagaaagtcctatcggctgtcacatatgccgtggacgacgaagaggcagctgaggttaacgctaatgagcagccagaagcaccgaagctagttctgcaatcactgttctcgctcattcgaggtgaggtcgagcagctggattcccgggccctaccgctttgcctgcaccaaattgccgagtcttattttcaggaagaggactacgagaaggccatgaagtttatacagctggagagactgtaccacgagcagttactcgcgaatctcagcgcaattcaggagcagtgggagactaaatggaagactgtacagcctcacaccgttaccgcattgaggaactccgaaaaggggttcaatggagaagatttcgagagactcaccaaaatttgcgctacacaccaggatccactcctaagtaagcacaagatcgctgccgtggaaaaatcacaggagaggaagtgctctacgcagttattagtatctgaggatcccaaagaaggcggggctaccacaaaggagtcagagtctaagacctgtcttggtaccgagagctccaaagagagtcagcatacagttgaacccctcgggtcatccccatgctgtcaccaaatggatgtgcagaccgattccccatctcttagcgtcacagcaggcaaggatcacatggaggagctgctctgctccgccgaagcaacactcgccctgcacacccaaagctcggaaacggctgggtccccttcgggccccgacagctcagaagacgcctgtgaggacgattcacgcctccagttggcacagacagaagcttgtcaggacgtggctagaatcgaggggatagccgaggatccaaaagtctttttgagcagtaaaagcaagacagaaccacttatatcacccggttgtgaccgtattccacccgcacttatctccgaaggcaagtacagtcaggcccagcggaaggagctcagactccctctgagagatgcctctgaagcgctcccaaccgaccagctggaaaataacgaattaaatgaactgcagcaacccgacctgacagatagcgatgggaagtccccgcaggctcaagcagactcagacggatctgagaacgtcctctgcggtaataatcaaataagtgatttggggatacttctgccagaagtgtgcatggcaccagaggagaagggggataaggatgaccagctgaacaaggaaacagaggattatcttaacagcctcctggagggttgtctcaaggataccgaggattcattgagctatgaggacaaccaggatgacgactcggatctgctgcaggacctcagcccggaggaagcgagctattcgctgcaggaaaaccttccttcagacgagagttgcctaagcctcgacgatctggcaaaacggattgagatcgctgaggtggtccctactgaaggcctggtgtcaattttgaagaagcggaatgacactgttggcgaccatcccgcacagatgcagcataaaccttctaaacgcagagtgagatttcaggagatcgacgatagccttgatcaagacgaggtaggcggaggcagttgtatcctactcgtgctcttgtgcattgccaccgtgtttctcagtgttggtggaaccgcactctactgcaccttcggcgatatggaatctcccgtctgcacagacttcgcagacaatatggacttttactacacaaagctcctacaaggagtggctgaactcaaacattggatctatctctcatag

SEQ ID NO: 112980 - DNA, 3057 bp, Artificial Sequence
  Description of Artificial Sequence: Synthetic coding sequence
atgaagatgtggctgctggtatctcaccttgtcatcatttctatcacaacctgcctcgctgaattcacatggtacagaaggtacggacatggggtcagtgaagaagataaaggatttggtccgatattcgaagagcaacctattaatacgatctaccccgaagagtctcttgagggaaaagtgagtctgaattgcagggctagagccagtccttttccagtgtataagtggcgaatgaacaacggcgacgtagacctcacgtccgacaggtattctatggtgggaggaaatctggtgatcaataatccagacaagcagaaggacgctggcatttattactgcctagctagcaacaactacggcatggttcgcagcaccgaggctacactctcctttgggtatctggaccccttcccaccagaggagagaccagaagttcgggtgaaggaaggcaaaggcatggtgttgctctgtgaccctccgtatcattttcccgacgatctgtcgtataggtggctgctcaacgaattcccagtttttattacaatggacaaacgacggttcgtatcgcaaactaacggcaatctatatatcgccaacgtggaagcgagtgacaaaggcaattatagctgtttcgtgagtagccccagtatcaccaagagcgtgttcagcaaattcataccattgattccaatcccggagaggaccaccaaaccgtaccctgccgatatcgtcgtgcagttcaaggacgtctacgcacttatgggacagaacgtgactcttgagtgctttgcattagggaatcctgtacccgacatccgctggaggaaggtgcttgagcccatgccgagtacagcagagatctccacttcaggagccgtgctgaaaatctttaacatccaactcgaggacgaagggatatatgagtgtgaggcagagaatataagaggcaaggataaacaccaggcccgtatctacgtccaggccttccccgaatgggtcgaacatataaacgacactgaggtcgatattggttctgatttatattggccctgtgtggccactggcaagcccattccaaccatccgatggctaaaaaatggctatgcctaccacaagggcgagcttagactttacgatgtgacctttgaaaacgccggaatgtatcaatgcatcgccgagaacacctatggcgctatttatgccaacgctgagctgaagatactggctctggccccaactttcgaaatgaacccaatgaagaaaaagatcctggccgcaaaaggtggtagggtgatcattgagtgtaagcctaaagcagctcccaagccgaagttttcatggtccaagggcacagagtggctggtcaactcctcgaggatactgatttgggaggacggtagtctcgagattaataatatcacaaggaatgatgggggaatctacacctgctttgccgaaaataatagaggcaaggcaaatagcacgggcaccctggttatcacagaccccacaaggattattctcgctccgattaatgccgacattaccgtcggcgagaacgccactatgcagtgcgccgcttccttcgacccggccctggacctaacttttgtctggagtttcaatggttacgttattgatttcaataaggaaaatatccattatcagagaaacttcatgctcgactcaaatggagaactgctgatcaggaacgcccagttgaaacacgcggggagatacacttgcaccgcacaaaccattgtagacaactcctctgcgtccgctgaccttgtagtgagaggtcctcctggacctcccggcggcctgaggattgaagacattcgcgcaacttctgtggcactgacctggagcagaggctccgataatcactcaccgatatctaagtacaccatacagactaaaaccatcttgagcgatgactggaaagatgcgaagacagacccacctattattgagggcaatatggaggcagcacgggcggtcgatctcatcccatggatggagtatgagttccgtgtcgtggcaaccaacactctcgggagaggcgagcctagtatccccagtaaccggatcaagacagacggtgccgccccaaacgtcgccccaagtgatgtaggcggcggtggcgggcggaaccgtgagctaacaatcacctgggcccccctctcccgagaataccactacggaaataactttggatatatcgtcgcatttaaacccttcgacggagaggagtggaagaaagttacagtcacaaatcctgatacagggaggtatgtgcacaaggacgagactatgtctccttccacggcctttcaggtaaaggtaaaggcttttaacaacaagggtgacgggccgtattcgctggtcgccgtgatcaatagcgctcaggatgcaccgagtgaggcacccacagaggtcggggtgaaggttctgtcttcttcggaaatctcggtccactgggagcatgtcctggaaaagatagtagagtcctaccaaataaggtattgggcagcacacgacaaagaagaagctgcaaatcgcgtccaagtgaccagccaggagtattcagcaaggcttgagaacctccttcctgacacccaatacttcatcgaggttggagcctgcaactcggccggttgcggccctccgtctgacatgatcgaagccttcacaaagaaggcaccaccctctcagccccccaggatcatatccagtgtgcgttcggggagcagatatattatcacatgggaccacgtggtcgccctctcgaatgagtctactgtgacaggatataaggtcctctaccggccggatggacagcacgacggtaaattatatagtactcacaaacacagtatcgaggtgcccatccctcgtgacggcgagtacgtggtggaggtgagggcccactcagatgggggggatggggtagtttcgcaggtcaagattagtggagctcccacgctgtccccaagcctgctaggtctcctgttaccggcctttggcatacttgtctacctggaattctag

SEQ ID NO: 112981 - DNA, 3024 bp, Artificial Sequence
  Description of Artificial Sequence: Synthetic coding sequence
atgaagatgtggctattagtgagtcacctggtgatcatttccataactacttgtctggctgtgtccgaggaagataagggttttggtcctattttcgaagaacagccgattaacactatctaccctgaagaatctctggaagggaaagtgagcctcaattgccgagctcgcgcaagccccttcccagtgtacaaatggaggatgaataacggcgatgtggatttaacttccgatagatactctatggtcggtggcaacctggtaattaacaaccccgacaaacagaaggatgcaggaatctattactgcctggcaagcaacaattacggtatggtcaggtctaccgaagcaaccctcagctttgggtatctggatcccttccctccggaagaaagacctgaggtgagggtgaaagagggcaaaggaatggtgctgttgtgcgacccaccctatcacttcccagacgacctctcctatagatggttgctgaatgagtttccagtgtttataacgatggacaagaggcggttcgtgagtcagaccaatggaaacctgtatattgcaaacgtagaggcaagcgacaagggtaactattcatgctttgtttccagtccctcaataactaagtcagtgtttagcaaattcatcccattgatacctatacctgagcggactactaaaccataccctgctgacatcgtggtccagttcaaggacgtatacgctttgatggggcagaatgtaactctcgaatgctttgctctcggcaatcccgtgccagacatcagatggcgtaaagtgttggagcccatgccctccacggccgagatttcgaccagcggggcagtcctcaaaatatttaacatccaactcgaagatgaggggatatacgagtgtgaagcagagaacatccgggggaaggacaagcaccaggctaggatctacgtgcaggcatttcccgagtgggtcgaacatatcaacgacacggaagtggatatcggatctgatctgtattggccttgtgtcgcaacaggaaaaccaattcccactattcgctggttaaagaacggttatgcctaccacaagggcgagctgcgcctctatgatgtgacatttgagaacgctggcatgtaccaatgcatcgccgaaaatacttatggcgctatctacgccaacgcagaactgaagatactggcgttggctccgacattcgagatgaaccccatgaagaagaagattcttgcagcaaaggggggacgggttattattgaatgcaaaccaaaggcagcacctaagccaaagtttagctggtccaagggaactgaatggctggtcaacagttccaggatcctcatttgggaggacggatcgctagagatcaataatataactagaaacgatggcggcatctatacatgttttgctgagaataatcgcggaaaagccaacagtacagggaccctggtgattaccgaccccacccgcatcatcctcgcccctattaacgcagacattaccgtaggagaaaatgccaccatgcagtgcgccgcctcattcgaccccgctttggacctgacatttgtgtggtcttttaacgggtacgttattgactttaacaaagagaacatccattatcaacgcaacttcatgttggacagtaacggagaactcctgatcaggaacgcccagctcaagcatgctgggcgatacacttgtaccgcacagactatcgtagataacagttcagcatctgccgatttggtcgtgcgtggacctccaggaccacctggggggctgagaattgaggacattcgagccaccagcgtggctctgacctggtctcggggcagtgataatcattcgcccatcagcaaatacaccattcagactaaaacaatcctctcggatgactggaaggacgcaaagacggaccctcccattattgagggcaatatggaggccgcacgtgccgtggatctcatcccctggatggaatatgaatttcgggtagtcgcaaccaacacactgggaagaggcgagccgagtatccctagcaatcgcatcaagaccgatggggcagctcctaatgtggccccttctgatgtcggtggggggggaggcagaaaccgggagcttacaattacgtgggctcctttgagtagagaatatcactacggtaataacttcgggtatatcgtagcctttaagccgttcgatggggaagaatggaaaaaggtgaccgtgacgaaccccgacacaggaagatacgtccataaggatgagacaatgagcccaagtactgcatttcaagttaaagtgaaggcttttaataataagggagatggaccttactccttggtggcggtgatcaattctgcccaggacgccccaagtgaggccccaactgaggtgggtgttaaagtgctcagttcttctgagatctcagtccactgggagcacgtgctcgaaaaaatcgtggagtcataccagatccggtactgggctgctcatgacaaggaagaggctgccaatcgtgtccaggtgacctcacaagaatactcagctagacttgaaaatctcctaccagacactcagtatttcattgaggtgggagcctgcaattctgcgggctgcggccccccatctgatatgattgaagccttcaccaaaaaggcaccgccaagtcaacctcctcggattatctcttccgtgagatccggatcccgctatattatcacctgggatcacgtggtggcattgtccaacgagtccaccgtcacaggctataaggtgctgtatcgcccagatgggcagcatgatggcaagttgtactctactcataagcattctattgaggtaccaatacccagagatggggagtacgtcgtagaggtgcgggcccattccgatgggggagacggagtcgttagtcaagtaaagattagcggtgcacctaccctgtccccatccctccttgggttacttcttccagcttttggaattcttgtttatctcgagttctag

SEQ ID NO: 112982 - DNA, 1884 bp, Artificial Sequence
  Description of Artificial Sequence: Synthetic coding sequence
atgaaaatgtggcttctggtcagtcacttggtgataattagcattaccacctgtctggccgagttcacatggtatcgaagatacggtcatggagtgtcggaggaagataagggcttcggacccatcttcgaagagcagccgataaataccatctacccggaggaaagcctggaagggaaggtgagcctgaactgcagagccagagcctctccattccctgtgtacaaatggcggatgaacaacggtgacgtcgacctcacaagtgatcggtactctatggtgggcggtaacctggtcattaataatcccgacaaacagaaagacgcgggcatttactattgccttgcaagcaataattatggcatggtgaggtccactgaggcgactctgtcttttggctatttggatcctttcccacccgaagaaagacccgaagtgcgggtgaaggagggcaaggggatggttctgctttgtgaccctccttaccactttcctgacgatttgagttatcggtggctgctgaacgagttccccgttttcattacgatggacaagcgccggttcgtgtctcagactaatgggaatctttacattgcaaatgttgaggcttcagataaggggaactacagttgttttgtctctagtccctctattactaagagtgtgtttagcaaatttatacccctcatccctatacctgagagaacaactaaaccataccctgccgacatcgtggtgcaattcaaggacgtctacgctctcatggggcagaacgtgacactggagtgtttcgcattaggcaatcccgtccccgacataagatggcgaaaagtgttagaacccatgcccagtaccgccgagatctctacgagtggcgcagtgttgaagatatttaatatccagctcgaggatgagggcatttatgagtgcgaagcggaaaacatcaggggcaaggataaacaccaggctcgcatctacgttcaggcattccccgagtgggttgaacatattaacgatacagaagtcgacataggttcagacttgtactggccctgcgtggcaaccggtaagcctatcccgactattagatggttgaaaaacggctacgcctaccataagggggagctgcgattatacgacgttacatttgagaacgcgggcatgtatcagtgcatcgccgagaacacatatggggctatctacgccaatgccgagctgaagattctcgccctcgctccaacatttgaaatgaaccccatgaagaagaaaattctcgcggctaaaggggggagagtgatcatagaatgtaagcccaaagccgcccctaaacctaaatttagctggagtaaaggcaccgagtggcttgtgaacagtagccggattctcatttgggaagatggaagcctggaaattaacaacatcactagaaacgatgggggaatatacacctgtttcgcagaaaataaccgcgggaaggcaaactcaactggtacactggtgattaccgaccccacaagaataatacttgctccgattaacgccgatatcacagtcggtgaaaacgcaacgatgcagtgcgccgcctcatttgacccagccctggacttgaccttcgtatggtcatttaacgggtacgtcatcgacttcaacaaagaaaatattcattatcagaggaactttatgcttgacagtaacggagaattactcatccggaatgcacagctgaaacatgccggcaggtacacttgtaccgctcagaccatcgtggataatagttccgcaagcgctgacctggttgtacggggaaagaaccgaaaaggcggggaaaagaacatggtagattcgttcctgcctgtttgtgcttcgctgccgccaacctggtag

SEQ ID NO: 112983 - DNA, 1884 bp, Artificial Sequence
  Description of Artificial Sequence: Synthetic coding sequence
atgaaaatgtggctgttagtgtctcatctggtaatcattagcatcactacgtgtctggcagaattcacgtggtataggagatatggccatggggtatcggaggaagacaaggggtttggccccattttcgaagaacagccaattaatactatctatcctgaggaaagcttagagggcaaggtgagcttaaattgcagggcccgagcttcccctttccctgtttataaatggaggatgaataacggagacgtcgatctcactagtgacaggtacagtatggtgggtggcaacttggtaattaataaccctgacaaacagaaggatgctggcatctactactgcctcgcgtccaacaattatgggatggtgcggtcaaccgaggctacattatcttttggttacttggaccctttcccgccagaggagagacctgaagttagagtgaaggagggaaagggaatggtgttgttatgcgatcctccttatcactttccagacgatctctcgtatcgttggctcctcaatgagttccctgttttcatcacaatggataagcggcggtttgtaagccagaccaacggaaacttatacatcgcaaacgtggaggcctcagataaggggaattattcttgtttcgtcagtagcccttctattaccaagtctgtgttctctaagttcattccacttattcccatacctgaacgtaccacaaaaccgtatcccgccgatatagtggttcagtttaaggacgtttacgctttaatgggacagaacgtaaccctggaatgcttcgccctaggtaaccctgtccccgatatcagatggaggaaagtcctggagccaatgcctagcacagctgaaatcagtacaagtggagcagtgctgaagatatttaacatccagctggaggatgaggggatatacgagtgtgaggccgaaaatatcagaggcaaagataagcatcaggcccggatttacgtgcaggcctttcctgagtgggtcgagcatataaatgatactgaggtggatatcggtagcgacctctactggccttgcgtggcaacaggcaagcccattccaactatccgatggttgaagaacggctacgcttatcacaaaggcgaactgcggctgtatgacgtgacgtttgagaatgccggcatgtatcagtgtattgcggaaaatacctatggtgccatttacgctaatgcggagctgaagatccttgctttggccccaacatttgagatgaatccaatgaaaaagaagatcttggccgcgaaaggggggagggtaatcattgagtgcaagcccaaggccgcacccaaacccaagttttcctggtccaagggcacagaatggctggtgaatagttctcgcatactaatctgggaggacggctctctggaaattaataatattacccgaaacgatggaggaatatatacatgttttgctgagaacaatcgtgggaaggccaattccacaggtacgttggtgattaccgacccgacgagaattattttggcccccattaatgcagacattacagtgggggaaaatgcaaccatgcaatgtgccgctagctttgaccctgcactagacctgaccttcgtgtggtctttcaacggatacgtaattgatttcaataaagaaaatatacactatcagaggaatttcatgctcgactccaacggggagctgttgataaggaatgcccagctgaagcatgcggggcgatatacgtgcaccgcacagactatcgttgacaatagctcagcctctgccgacctcgttgtcagaggtaagaacaggaaggggggagagaaaaatatggtagactcctttctgcctgtttgtgccagtctgcctcccacatggtag

SEQ ID NO: 112984 - DNA, 1884 bp, Artificial Sequence
  Description of Artificial Sequence: Synthetic coding sequence
atgaagatgtggctcctggttagccatctggtgattataagtataaccacatgtctggccgagttcacctggtaccggaggtatggtcatggcgtgtctgaagaagataagggattcggacctatctttgaagaacagcccatcaacactatatatccagaagagagccttgagggtaaggtgtcactgaattgcagggctcgagctagtccctttccagtgtacaaatggcgtatgaacaacggcgacgtcgacctgacaagcgacaggtattcaatggtgggaggtaatcttgtcatcaacaaccccgacaagcaaaaggacgctggtatctattattgtctggcgagcaataattacggaatggtcaggtctaccgaagcgaccctgtcattcggatacctggatccattccccccggaagaaagacctgaggtcagggttaaggagggcaaaggtatggtcctcctctgtgatcccccttatcatttccccgatgatttgtcttatcggtggctcctgaatgagttcccagtgttcatcactatggacaagcgcaggtttgtcagtcagactaatggcaatctgtatatcgcaaacgtggaggcgagcgacaaaggtaattactcatgcttcgtaagttcccccagtattaccaaaagcgtgttttcaaagttcatccccctcatacctatccccgagaggacgacaaagccctatccagcagacatcgtagtgcaattcaaggacgtatatgcacttatgggacagaatgtgaccctggaatgcttcgcgctggggaaccccgtgcctgatatccggtggcgcaaggtgctggagcccatgccaagtaccgctgaaatatccacttctggcgctgtgctgaaaatctttaacatccaactggaggacgaggggatttacgagtgtgaagctgagaacattcgtggcaaagataagcaccaagctcgcatctatgtgcaagcttttccagaatgggtagaacatatcaacgatacagaggttgatatcggcagcgacctttattggccttgcgtggctacaggaaagccaattccaacgattcgctggctgaagaacggttacgcttaccacaaaggcgaacttagactttatgatgtgacctttgagaatgccgggatgtaccagtgcatagcagagaatacctatggagctatttacgcaaacgctgagttgaaaattttagccctggccccgaccttcgaaatgaaccccatgaagaagaaaattctggcagccaaaggagggagggtgataatagagtgcaaacctaaggccgctccgaaacctaagttttcctggagcaaaggcacagagtggctcgtcaactcaagcaggattctgatttgggaggatggctctctggagataaataacattacccgtaatgatggaggaatttacacttgtttcgccgagaataacaggggtaaagccaactcgacgggcactctggttattactgatcccaccaggataattctggcaccaattaatgccgatatcaccgtgggagagaacgccacgatgcagtgtgccgcttcattcgatccagcactggatctcacatttgtgtggagcttcaacgggtacgtgattgacttcaacaaagagaacattcattatcagcggaactttatgctggactccaacggcgagctcctcattcggaatgcacagctaaagcacgcaggcagatatacctgtacagctcagactatcgttgacaactcttccgcctcagctgatttggtggtgaggggtaaaaaccggaagggcggggaaaaaaatatggtggactccttccttcccgtatgtgcctcgctgcctcccacatggtag

SEQ ID NO: 112985 - DNA, 258 bp, Artificial Sequence
  Description of Artificial Sequence: Synthetic coding sequence
atgaagatgtggctactggtctcccacctggtgataatctccatcacgacctgtctggctgagttcacctggtacagaagatatggtcacggagtcagcgaggaagacaaaggttttggcccgatatttgaggagcagccaattaacacaatttatcccgaagagagcttggaagggaaggttagcctcaattgccgagcgagagcctctccattccccgtgtacaagtggcgaatgaacaacggggatgttgactag

SEQ ID NO: 112986 - DNA, 3057 bp, Artificial Sequence
  Description of Artificial Sequence: Synthetic coding sequence
atgaagatgtggctgctggtcagtcacctggttatcatatccatcacaacctgtctcgccgaatttacttggtaccgccgctacggccatggcgtgagcgaggaggataagggctttgggcccatttttgaagagcagccaattaatactatctaccctgaagaaagcctcgagggcaaagtgagtttaaactgtagagcaagagcaagcccctttccggtatacaaatggagaatgaataatggagatgtcgacctgaccagtgatcgctatagcatggtgggcggaaacttggtgattaataatcctgataagcagaaagacgctggaatctactactgcctggcctctaacaattatggtatggtgcgctccacagaagcgacccttagcttcggctatctcgatccatttccaccagaggaacggcccgaggtgcgagtaaaggagggtaaaggcatggtcctgctttgtgacccaccatatcacttccccgatgacctatcatataggtggttattgaacgaattcccggtttttataacaatggacaaaaggcggtttgtgagccaaacgaatggaaacctgtacatagccaacgtagaggccagtgacaagggaaactatagctgctttgtaagcagcccaagcatcaccaagtctgtgttctctaagttcatcccacttatacccattcctgagagaaccactaaaccttatccagcagacattgtcgttcaatttaaagatgtctatgctctgatgggacagaatgtcacgctggagtgttttgccctcgggaatccagtgcccgacatacgctggcggaaggtcttggaaccaatgcctagcaccgccgagatatcaacaagtggggccgtgcttaagatcttcaacattcaattagaagacgaggggatatatgagtgtgaggctgaaaatatcagaggaaaagataagcaccaagcccgaatctacgtgcaagcatttcccgagtgggtagaacacattaatgacaccgaagtggacatcggaagtgatctctactggccctgcgtggcaacagggaaacccattccaacaattcggtggttaaaaaatggctatgcatatcacaaaggggagctcagactctatgatgtgaccttcgagaacgctggtatgtaccaatgcatagcggaaaacacttacggagcaatttatgcaaatgccgaactgaaaatcctggcgctggcgcctacatttgagatgaaccctatgaaaaagaagattctggccgccaagggcgggcgtgttataatcgaatgcaagccgaaagctgcaccaaagcccaaattcagctggagtaaaggcacagagtggcttgtgaacagctcccgcatactcatctgggaggacggatctctcgagatcaataacatcaccagaaatgatggaggaatctacacttgttttgctgaaaataaccggggcaaggctaactccaccgggactctggtgatcactgaccccactaggattattctggcaccaattaacgctgatattaccgttggcgaaaacgcaacgatgcagtgtgcagcctcattcgatcccgccctggacttaacattcgtgtggagcttcaatggctatgtcatcgactttaataaggaaaatattcattatcaacgtaattttatgcttgactccaatggggagctgttgatcaggaatgcacaactcaagcatgccggaagatatacctgtaccgcacagaccattgtcgataattcttctgcttccgctgatctggtggttagggggcctcccggaccccctggcggcctgcgaatcgaagacatcagggctacctctgtcgctttgacgtggagccgagggagtgataaccattcccccatcagcaaatacacaattcagactaagactatcttgtcagacgattggaaagatgccaaaacggacccccccattatcgagggcaatatggaggcggctagggccgtagacctaatcccatggatggaatatgaatttagggtagtcgctaccaacacactgggccggggcgaaccttctattccctcgaaccggatcaagacggacggggccgccccaaacgtggctccgtctgacgtgggtggcggaggaggaaggaaccgcgaactcactattacatgggcccccttgtcacgtgagtaccattacgggaataatttcggatatattgtcgccttcaagccctttgatggcgaggagtggaaaaaggtgactgtgacgaatcccgataccggccgctacgtccacaaggacgagaccatgtctcctagcactgcatttcaggtaaaggttaaagcctttaacaataagggggacggcccctacagcttggtggccgtgataaactccgcccaggatgctccgagtgaggctcccaccgaggtgggggtgaaggtcctttcctcctcagagatcagcgttcactgggagcacgttctggagaagattgtggagtcctaccaaattagatactgggccgcacacgacaaggaagaggccgccaatagggtgcaggtcacctctcaggagtactctgctcgcctcgagaacctgcttcctgacacgcagtacttcattgaggtgggagcatgcaactcagctggctgcggcccacccagcgatatgatcgaagcatttacaaagaaagctccccctagccagccaccccggattatttcctcagtaaggtcaggtagcagatatatcatcacttgggaccacgtcgtggccctaagcaatgaaagtaccgtgacgggctacaaggtgctgtaccgccctgatggacaacatgacggcaagctatactccactcacaagcattctatcgaggtccctatccccagagacggcgaatacgtggtcgaggttagagcacatagcgacggaggggatggcgtagtaagccaagtgaaaatttctggggcgccaactctgagtcctagcttgctggggcttctcctgcctgcctttggtattctcgtgtatctggaattttag

SEQ ID NO: 112987 - DNA, 192 bp, Artificial Sequence
  Description of Artificial Sequence: Synthetic coding sequence
atgaagatgtggctgctcgtatcacatcttgttataattagtatcacaacttgcctcgcagagttcacctggtatcgcagatacgggcatggggtgagtgaggaggataaggggttcggacccatttttgaggagcagccgattaatacgatctaccctgaagagagtcttgagggcaaggttagtctgtag

SEQ ID NO: 112988 - DNA, 273 bp, Artificial Sequence
  Description of Artificial Sequence: Synthetic coding sequence
atgaagatgtggctgctcgtttcgcacttggtgatcattagcattaccacctgtctggcagaattcacgtggtaccggcggtatggtcatggggtctctgaggaagacaaagggttcgggcctatctttgaggaacagccaattaatactatctaccccgaggagtctctcgagggcaaagtctcactgaactgccgagctcgagcctcacctttcccagtgtataagtggcgaatgaataatggagatgtcgatttaactagtgaccgttag

SEQ ID NO: 112989 - DNA, 222 bp, Artificial Sequence
  Description of Artificial Sequence: Synthetic coding sequence
atgaaaatgtggttgttagtgtctcatttggtgatcatctccataaccacctgcctggcagaattcacatggtaccgacggtatggccatggggttagcgaagaagataaaggattcggcccaatctttgaggaacagcccattaacacaatataccccgaggaatcactagaagggaaggtctccctcaactgcagagcccgtgcctccccttttccatag

SEQ ID NO: 112990 - DNA, 3123 bp, Artificial Sequence
  Description of Artificial Sequence: Synthetic coding sequence
atggggactgcaacgcgccggaaaccccatctgctgctggttgccgcggttgccctggtatctagcagcgcatggtcttctgccctggggtcccagactacctttggccccgtatttgaggaccagcccctgagcgtcctgttcccagaggagtctaccgaagaacaggtgctcctggcgtgtcgcgcgcgggccagccctccagccacatacagatggaaaatgaacggcaccgaaatgaagctggaacccgggagcagacatcagctcgttgggggaaacttggtcatcatgaatccgaccaaggcccaagacgctggcgtgtaccaatgcctcgcctcaaatcccgtcggcacggtcgtctcccgtgaagctatccttcggtttggctttctgcaggaattttccaaagaggagcgggatcctgtcaaagcccacgaagggtggggcgtgatgctgccttgtaacccccctgcacattaccctggcctgagctatagatggctgttgaatgaatttccaaatttcatccccacggacgggaggcatttcgtgtcgcagacgacagggaatttgtacattgcacgcacgaacgcttctgacttgggaaattattcctgcctggccactagccatatggatttctccaccaaatccgtattcagcaagtttgcacagcttaacttggccgccgaagacacccgactcttcgctccatccataaaggctcggtttccggccgaaacctatgctctggtaggccaacaggtgacccttgaatgtttcgcattcggcaaccccgtccctagaatcaaatggagaaaagtagatgggtctctgagtccacaatggacaacggcagagcccactctccagataccctccgtgagctttgaggacgaaggaacttatgaatgtgaggcagaaaactccaaggggagggacactgtacagggccgcatcatcgtgcaggcccagcccgagtggctgaaggtgatatcagacacagaagcggacatcggatcaaacctgcggtggggatgtgccgccgccgggaagcctagacctaccgttcgttggctccgcaacggagagcctctggctagccagaatagggtggaagtacttgctggcgaccttcggttcagtaaactcagcctggaagatagcgggatgtatcaatgcgttgcagagaacaaacacgggacaatctacgcctccgcagagctggcggttcaggcgctggcccccgacttcaggctgaatccggttcgccgtctgattcctgctgcaagaggaggagagatcctcattccctgccaaccgagggccgcccccaaagctgtggttttatggtcaaagggaaccgagatcttggttaactcctctcgcgttaccgtgactcctgacggaacgctcattattaggaacatttcaaggtcggacgaagggaaatacacgtgctttgccgaaaattttatgggaaaagcaaatagcacgggcatcttgtctgtccgcgatgccaccaagatcactctcgccccatctagcgccgatatcaacctgggtgacaacctgacactgcagtgccacgcgagccatgatcccacgatggacctgactttcacctggacactggacgactttccgatagattttgacaaaccgggggggcactaccggcgcacaaacgtgaaagagacaattggggacttgacaatactgaacgcgcagctgaggcacgggggaaaatacacgtgcatggcccagactgtggtggactccgccagtaaagaggctactgtgctggtgaggggcccgccgggcccacctgggggtgtggttgtgcgggacatcggcgacaccacaatccagttgagctggagcagaggatttgacaaccattccccgattgctaagtacacgcttcaggcgagaaccccaccagctggcaagtggaagcaggtgaggacaaatcctgcaaatatcgaggggaatgccgaaactgctcaggttctggggttgactccgtggatggattatgagttccgagttattgccagtaacatcctggggactggagaacctagcggtccatcaagtaagatccgcactagggaagccgcccccagtgtggcaccgagtggactgagcgggggcggtggcgccccaggcgagctcatcgtgaactggacccctatgtcaagggagtaccagaatggagatgggttcggatatctgctgagctttcgccggcagggtagcacccactggcagacagctagggtgcccggggctgacgctcagtactttgtgtatagtaatgaatcagtgcgcccatacactccgtttgaagtgaagatcagatcatataaccgtcggggggatggacctgagagcctgaccgccctcgtgtattctgccgaagaggagcctcgcgtggctcccacaaaagtctgggccaagggagtgtcatcttcggagatgaacgtcacctgggaaccagtgcagcaggacatgaacggaattctgctgggttacgagatccggtattggaaggcaggcgataaggaggccgccgcagaccgggtaaggacagccggtctcgataccagtgcgcgcgtttcaggtctgcaccctaacactaaataccacgtgactgttagagcatacaaccgggcaggcacaggcccagcttcgccatctgctaatgcaacaactatgaagccgccacctagacggcctcctgggaatatttcttggaccttctcctcatcttcattatccatcaaatgggaccccgttgtcccattccgcaatgagtctgccgtaactggctataaaatgctctaccagaacgacttgcatcttactccgacactgcacctgaccggaaaaaactggattgaaatccctgtccccgaggatataggccacgcccttgttcagataagaactacgggcccgggaggggacggaatcccggctgaggtgcacatcgtgagaaacggcggcacttcaatgatggtagagaatatggcagtaaggcctgccccccaccccggcactgtaataagccacagcgtggcaatgctgatccttatcggttcactcgagttgtag

SEQ ID NO: 112991 - DNA, 3087 bp, Artificial Sequence
  Description of Artificial Sequence: Synthetic coding sequence
atgatgttcccttggaagcagttgattctgctaagttttattggctgtctggggggcgaactcttgcttcaggggccagtgttcataaaggaaccgtctaactccatctttccagtcggtagtgaggacaaaaagataacccttcactgtgaggcccgagggaatcccagccctcactaccgctggcagctgaacggaagcgacattgacatgtctatggagcataggtataagctcaacggaggtaacctggtcgtaatcaaccccaataggaactgggataccggtacatatcagtgctttgccaccaactcgctgggtacgattgtgagccgtgaggctaagctccagttcgcatatctggagaatttcaaaaccaaaatgaggtcgacagtgtcagtgagagaaggccagggtgttgtccttctctgcggcccacccccacatagcggggaattgtcatacgcatggatttttaatgaatacccatcgttcgtggaagaggactctcgcaggttcgttagccaggagacaggacatctctacatcagcaaggttgagccatcagacgtgggtaactacacctgcgtggtgaccagtatggtcaccaatgcccgcgtgcttgggtcgcccacccccttggtgctgagatccgacggcgtgatgggcgaatatgagccaaagatcgaagtgcagttcccagagacactgcctgcggccaaaggttcaaccgtcaagctggaatgcttcgctctcggaaaccccatcccccagattaactggcgccgctcggatggccttcctttctcttccaagatcaagctcagaaaattctcaggcgtgctggaaatacccaattttcagcaagaggacgccggtagttatgagtgcatcgccgaaaacagccgtggcaagaatgttgccagaggtaggctaacctactatgcaaagcctcattgggttcagctcatcaaagacgtggaaatcgctgtggaggactcgttgtactgggagtgtagggcttcaggcaagcctaaaccatcctatcgctggctaaaaaacggtgcagctctggtgctggaggagcgcacccagatcgaaaacggcgctttgactataagcaatctgtccgtcaccgactcggggatgttccagtgcatcgccgagaacaaacacggcttggtgtattctagcgccgagcttaaagtggtggcctcggctcccgacttcagcaagaatccgatgaaaaagctcgttcaagtgcaagtggggtcgttggtgtccctggactgcaagcccagggcctctccccgggccctgtcatcttggaagaagggcgacgtgtcagtgcaggagcacgaacgtatcagtctgctgaatgacggcgggctcaagatcgctaacgtgacaaaggcggatgcaggaacttacacctgtatggctgagaatcaatttggaaaggctaacggtactacacacctcgttgtgaccgaaccaacacggatcaccctcgctcccagtaacatggacgtgagtgtgggggaatccgtaattttaccatgtcaggtgcagcatgacccactgcttgacatcatttttacctggtacttcaatggagccttggcagactttaaaaaggatggatcccactttgagaaggttggcggcagtagcagcggtgatctgatgatccggaatatccagctgaaacacagcgggaagtacgtgtgtatggttcagacgggcgtagacagtgtgtccagcgctgccgaccttatcgtgagaggaagccccgggcctccagaaaacgtgaaggttgatgagatcaccgatactactgctcagctctcctggaaagaaggtaaggataatcatagccctgttatttcttattccatccaggcaagaactccgttcagtgtcgggtggcagacagtgactacagtaccagaggttattgacggaaagacgcataccgcaacagtggtggagctgaacccatgggtggagtacgaattcagggtcgtggctagcaataaaattggcggaggggagccctctttgccatcagagaaggtaaggacagaggaggccgtgcctgaggtgcctccgtcagaagtaaatgggggcggagggtcacggagtgaattggtgatcacatgggaccccgtccctgaggagcttcagaacggagaaggcttcgggtacgtagttgcctttaggccactcggcgtgaccacgtggatacagaccgtggttacctctcccgacacaccccgttacgtgtttcggaacgagagcattgtaccatattccccatatgaagttaaagtgggcgtttataacaacaagggggaaggaccatttagccctgttaccaccgtgtttagcgccgaggaagagcctaccgtggctccatcacaggtgtctgccaattccctctctagcagcgagattgaggtgagctggaatacaattccctggaagctttctaacggccatcttctgggctacgaggtccgctactggaacggcgggggaaaggaggaatcctcaagcaaaatgaaggtggccggtaatgagactagcgccagactccgcggattgaagagcaatctggcatactacaccgctgtcagggcctataactctgctggcgccggtcccttcagcgctacagtgaacgtgaccaccaaaaagactccaccatcacagccccctggcaatgttgtgtggaatgctaccgatactaaggttttattaaactgggaacaggttaaagctatggagaacgaaagcgaggtgacaggttacaaggtcttttaccgtaccagttctcaaaataatgtccaggttctcaacactaataagacttctgccgaactggtgctgcctattaaagaggattacatcattgaggtcaaggccaccaccgacggaggggatgggacatctagcgagcagattcgcattccaaggatcaccagtatggatgcccgcgggagcacaagtgccatcagtaacgtccacccaatgtcctcatacatgcctattgtcctattccttattgtttacgttctgtggtag

SEQ ID NO: 112992 - DNA, 2424 bp, Artificial Sequence
  Description of Artificial Sequence: Synthetic coding sequence
atgggagagtacgagccaaaaatagaagtccagttccctgagaccgtccccactgctaagggagccacagtgaagttggagtgtttcgcactaggtaaccctgtcccaacaataatatggcgaagagccgacggcaaacctattgccagaaaggcccggaggcacaagtcaaatggcatactggagatccccaactttcaacaggaggatgccggcctttacgagtgcgttgctgaaaactcaagaggtaagaatgtggctagaggccagctcaccttttatgcgcagcctaactggattcagaaaataaatgatattcatgtggcgatggaagagaacgttttctgggagtgtaaggccaacggccggccaaagccgacctacaaatggttgaagaatggcgaacccctcctgacccgggaccggatccaaatcgaacagggtacactgaatatcacaatcgtcaacctttctgatgccgggatgtaccagtgcttagccgaaaataagcacggagttatatttagcaacgcggagttatccgtgattgctgtgggcccagattttagcagaaccctgctgaagagagtgaccctggtgaaagtggggggggaggttgtgatcgagtgcaagccaaaggcttctccaaaacctgtgtatacctggaaaaagggtagggacatcctcaaggagaatgaacgaattaccatttcagaggacgggaacctcaggattatcaatgtgactaaatctgacgctgggtcttacacttgcatcgcgaccaatcattttggcactgcgtccagtaccggcaatctcgtggtgaaagaccccacaagagttatggtcccccccagctctatggacgtgactgtgggggaatcaattgtcctgccttgtcaggtgacacacgaccactccctggacatagttttcacctggtcatttaacggccatcttattgactttgatcgcgatggtgatcatttcgaacgagtgggaggtcaggacagcgccggggacttgatgatccggaatatccagctcaaacatgcgggcaaatatgtctgcatggtgcagaccagcgtggataggctgtcagctgcggctgatctcattgtaaggggaccgcccggaccccctgaagctgttactatcgacgagatcaccgatactacggcccaactgtcatggagacccggtccggataaccactcaccgattaccatgtatgtgatccaggcacgtactccattttccgtgggctggcaagcagtgagtactgtccctgagctgatcgatggcaaaacattcacagcaaccgtggtgggcctgaatccgtgggttgaatacgaattcagaacagtggcggccaacgtgattggcatcggagaacccagccgcccatccgagaaaaggaggaccgaagaggcactgccggaagttaccccagctaatgtctccggcggtgggggttctaagagcgaactggtgatcacttgggaaacagtcccagaggagctgcagaacggcaggggttttgggtatgtcgtggcctttcgcccttatggtaaaatgatatggatgctcaccgtgctcgcctccgctgatgctagtagatacgtcttcagaaacgaatctgtgcaccccttctcgccttttgaagtaaaggttggcgtttttaataacaaaggtgaggggccattttcgcctaccactgtagtttattccgcagaggaagaacccacgaagccccccgctagcatcttcgctagatcactgtctgcaacggatattgaggtcttctgggcaagccccctcgagaaaaatcgggggaggattcaaggttacgaggttaaatactggcgccatgaggataaggaagagaatgcaagaaagatcagaacagtgggcaatcagacaagcacaaagatcactaaccttaaaggatctgtcctctatcatttagctgtgaaagcatataatagtgccggtactggtccaagcagtgccactgtcaacgtaaccacacgcaagcctcctccatcccagcctcctggcaatatcatatggaatagcagcgactcaaagatcatcctcaactgggatcaggtgaaagccttggacaatgagtctgaagtcaaagggtataaggtgctctacaggtggaatcgccagagttccacttctgtgatcgaaaccaacaaaacctcggtggaactgtcactacccttcgacgaagattatataatagagatcaagcccttctctgatggaggggatggctcttcatcagagcaaatcaggattcccaaaatcagcaacgcatatgccaggggttcaggcgccagtacaagtaatgcatgtaccctgagtgcaatttctacaatcatgatctccttgacggcccgctcttccctatag

SEQ ID NO: 112993 - DNA, 2097 bp, Artificial Sequence
  Description of Artificial Sequence: Synthetic coding sequence
atggaggagaacgtattctgggaatgcaaagccaacggaagaccaaaacctacatataagtggctgaagaatggtgaacctctcctgacccgggacagaatccagatagaacagggcacccttaatattacgattgtgaatctctccgacgccgggatgtatcagtgtctcgccgaaaacaagcatggggtaatcttcagcaacgctgaactctccgttatcgcggtggggccagacttttcacggacgctcctgaaacgggtgacccttgtgaaggtggggggcgaggtcgtaatcgagtgcaagcccaaagcttccccaaaacctgtgtatacctggaagaaaggtcgtgacatcctaaaggaaaatgagagaatcactatttccgaagacggtaaccttcgtatcatcaacgtgaccaagtccgatgctggctcatacacgtgtattgcaacgaaccacttcggcactgcctcttcaactggcaaccttgtagtgaaagaccctacaagggtgatggtgccaccaagctccatggacgtgacagtcggagagtctattgtgttgccctgtcaggtaacccatgatcatagtctcgatatcgtgttcacatggtctttcaatggacacctgatcgactttgatcgggatggcgatcacttcgagagggtcggggggcaggattccgcaggagacctgatgatccgtaatatccagttgaagcacgcaggcaaatacgtgtgtatggtgcagacaagcgtggaccgcctgtccgccgccgccgatcttatagtcagaggcccacccggaccgccggaagccgttaccattgacgagattacagacacaactgcgcagctgtcctggcggccgggccctgacaatcatagtcctatcacaatgtacgtcatacaggcccgtactcctttctccgtgggttggcaggccgtttcgacagtgcccgagttgatcgatggaaagacattcactgcaacagtggtcggcctgaatccttgggtcgaatatgagtttaggaccgtagcagctaatgtaatcggcatcggtgaaccaagcaggccatcggagaagcggcgaactgaggaggctcttcctgaggtcacgccagctaacgttagtggcggcggcgggagcaagtccgaacttgtcatcacatgggagacagtgcccgaagagctacagaatggacggggcttcggttacgtcgtcgcctttagaccctatggaaaaatgatctggatgcttacggtgctggcgtcagccgacgcatcacgatatgtattcagaaatgagtcagtccaccctttttcccccttcgaggttaaagtgggggttttcaacaataaaggtgaaggaccatttagccctactacggtggtctacagcgctgaggaagaaccgacaaaaccaccagcctccatatttgcccggagcctgtcggctaccgacatcgaggtcttctgggcttctccacttgagaagaacagaggacgaatccaggggtatgaagtgaagtactggcgacacgaggacaaggaggagaatgctcggaaaattagaactgtagggaatcagacctcaacgaagattaccaaccttaagggatctgttttgtaccacttggccgtgaaagcctataacagcgccggtaccgggccctcgtctgccaccgtcaacgtgacaaccaggaaacccccgccctcgcagcctcctgggaatattatttggaactcttctgattctaaaatcatcttaaattgggaccaggtgaaggccctcgataacgaaagcgaagtcaaagggtacaaagttctgtatagatggaatagacagagctccaccagcgttatcgaaactaacaagacatcggtcgagctctcgcttcccttcgatgaggattacatcattgaaattaaacctttcagcgatggtggggacggttcgtccagcgagcaaattagaatccctaaaatcagtaacgcctacgcccgcggctcaggtgctagcacctccaacgcctgcaccttgtctgccattagcacaatcatgatatctctgactgcccgttcttccttgtag

SEQ ID NO: 112994 - DNA, 3081 bp, Artificial Sequence
  Description of Artificial Sequence: Synthetic coding sequence
atgcgcctgccctgggaactcctggttttgcagagctttattctgtgcctggccgacgacagcaccttgcacggccctatctttatacaagagcccagccccgtcatgttccccttggatagcgaggaaaagaaggttaagcttaattgcgaagtgaagggaaatccgaagccacatattagatggaaactaaatggaacggatgtggacacaggcatggactttcgttatagcgtggtggagggctcactcctcattaacaatcctaataaaacacaggacgcaggcacctaccagtgtaccgccaccaatagcttcggtactatcgtttcccgagaggccaaactgcagtttgcctacttggacaacttcaagacacgcaccaggtcaaccgtaagcgtacgccgaggacagggtatggtcctcctgtgcggcccacccccacactccggcgaactgtcatacgcatggatcttcaatgaataccccagctaccaggacaatcggaggtttgtctcccaggagacaggaaacctgtacatcgcaaaagttgaaaaatccgacgtagggaactatacctgcgtggtcaccaacacagtaaccaatcacaaggtcctagggccacccactccactgatcctgagaaatgatggagtgatgggagagtacgagcccaagatcgaggttcagttcccagagacagtccccacagcaaaaggcgccaccgtaaagttggaatgtttcgccctggggaatcctgttcccactattatttggaggcgagccgatgggaagccgatcgcgcgcaaagcccgtcggcataagtcaaacgggattctggagatccccaattttcagcaggaagatgcaggtctgtacgaatgcgtggcagaaaatagccgaggaaaaaatgtggctaggggacagctcacattctacgcccagccgaattggatacagaagatcaatgatatccatgtggccatggaggaaaatgtgttctgggaatgcaaagcaaacgggcggccaaaacccacctataagtggttaaagaatggtgagcccttgttgactcgtgatcggatccagattgaacaagggacactcaacattacaatcgtcaacttgtctgacgcaggcatgtatcagtgcctggctgaaaacaagcacggagttatcttcagtaacgcggagctgagtgtgatcgccgtaggccctgactttagcaggacgttactcaaacgggtgaccctggtgaaggtgggaggcgaagtagttatcgagtgtaaacccaaagcatctccaaagccagtgtatacctggaaaaaaggaagggatatcctcaaggagaatgagaggataaccatctccgaggacggaaatctgagaatcataaacgtcaccaagtctgatgcgggatcttatacctgcattgctaccaatcattttggcaccgcctctagcacaggtaatctagtcgtgaaggatccgacaagggttatggtaccaccaagctcaatggatgtgactgtcggcgagtccattgtcctaccttgccaagtgacccatgaccatagcctggatatcgtcttcacctggtcattcaatggtcatctcattgatttcgatagggacggtgatcactttgaacgagttgggggacaggatagcgcaggggacctgatgatcagaaacattcagctcaagcatgctggaaaatacgtgtgcatggtccagacatctgtagaccgattatctgcagcagcagacctgatcgttaggggcccccccggacccccagaggcagtgaccatagacgagattaccgacacgactgcacagcttagctggaggccagggccagataatcattcccccattacaatgtatgtgattcaggcacgcacccccttctcggtggggtggcaggctgtatccaccgtgcctgaacttatcgacggcaagactttcacagctaccgtggtgggcctgaatccctgggtggaatacgagtttaggactgtggccgccaacgtcatcggcattggcgagccctctagacctagcgagaagaggagaaccgaggaagccctccccgaggttaccccagctaacgtcagtggcggcggaggcagcaaaagcgagctggtgataacctgggaaaccgtcccagaggagttgcaaaacgggagaggctttggctacgtggtggcttttcgcccgtatggcaaaatgatttggatgctgacagtgctcgcctctgcagatgcatctcggtacgtgttcaggaatgaaagtgtgcatccttttagccctttcgaagtaaaggtgggagttttcaacaacaaaggcgagggaccattctcccccactaccgtggtgtactcagctgaagaggagccaaccaaaccccccgcctcgattttcgctcggagccttagtgccaccgatattgaggttttttgggcttcaccccttgagaagaatcgcggtaggattcagggatatgaggtgaagtattggcggcacgaagacaaggaggaaaatgccaggaagataaggactgtcggaaatcagacctctacaaagataacaaatctaaaggggtccgttttatatcatttagccgtgaaagcatacaactctgccggcacagggccatcttcagcaaccgtgaatgtgacaacccggaagcctcccccgtcacaacctcccggaaacattatttggaatagtagtgattcaaaaatcattttgaattgggaccaggttaaagctcttgataacgagtctgaggtgaaggggtacaaagtcctgtaccgctggaacagacaaagtagtaccagtgtgatcgaaactaacaagacctctgtggagttgagcctcccctttgatgaggattacattattgagattaaacctttttcggatggtggagatggctccagcagcgaacaaatcagaatccccaagatctccaatgcctacgctcggggatccggcgcctcaacctccaacgcctgtacactcagcgcaatcagcaccattatgatctccctgacagcgcgtagctcactttag

SEQ ID NO: 112995 - DNA, 3081 bp, Artificial Sequence
  Description of Artificial Sequence: Synthetic coding sequence
atgcgtttgccttgggagctgctagtgttgcagagctttatcctgtgtctagccgacgatagcaccttacacggcccaatctttatccaggaaccaagtcccgttatgttccctctggatagtgaagagaagaaagtgaagctgaattgtgaggtaaagggcaaccccaagccccatattcgctggaagcttaatggcaccgatgtcgatactggaatggacttccgctactcagttgtggagggttcgctgctaattaacaacccaaacaaaacccaagacgcgggaacataccagtgtactgcaaccaactcctttggtacaatcgtatcgcgggaagctaaacttcagttcgcttatctggacaatttcaaaactcgaacaaggtctacggtgagcgttcgaaggggccaaggtatggtgttactctgcggcccgcctccacactccggagagctttcatatgcctggatcttcaatgagtacccatcgtatcaggacaatcgtcgctttgtgtcccaggagaccggaaatctgtatatcgccaaggtcgagaagtctgacgtagggaactacacctgtgtggtgaccaatactgtgactaaccacaaggtcctgggaccgcccacccctcttatacttcgcaatgacggcgttatgggagaatacgagccaaagattgaagtgcagttccctgagactgttcccaccgctaaaggcgccacagttaagcttgaatgttttgctctgggcaacccagtgcccactataatctggaggagagccgatggcaagcctatcgcaaggaaagctaggagacataaaagcaatggcatcctggagatacccaatttccagcaggaagacgccgggctctacgagtgcgtggccgagaattctagggggaaaaatgttgcacgtggtcagctgacattttatgctcagcctaattggatccagaagatcaacgatattcacgttgctatggaggaaaatgtgttctgggagtgtaaggctaatgggcgccccaaacctacttataagtggctcaagaacggcgagcctttgctcacgcgtgatcgaattcagattgagcagggaacattgaatatcacgattgtgaacttaagcgacgccggcatgtaccagtgtttggccgaaaataaacacggcgttattttctccaacgctgaactcagcgttatagccgtgggccctgacttctcccgcaccctgttgaagcgggtgaccctggtcaaggtgggtggggaagtagtcattgagtgcaagcccaaagcctcacctaagccagtgtatacatggaagaaaggccgggacattttgaaagagaacgaaaggatcacaattagcgaggacggcaacttacggataataaatgtcaccaaatcagacgccggtagttacacttgtatcgccacaaatcatttcggcacagcctcttcaactgggaacctcgtggtgaaggatcccactcgcgtcatggtgccgccgtcatcaatggatgtcacggtcggcgagagcatcgtgctaccttgtcaggtgacccatgaccacagtctggatattgtgttcacatggtctttcaatggccacctgattgatttcgaccgtgacggggatcatttcgaaagggtgggcggacaggacagcgctggcgacctcatgatcagaaacatccagctgaaacacgctggtaagtacgtgtgcatggttcagacctctgtcgaccgtttatctgcggcagcagacctcattgtgcgtggcccgcctggcccccctgaagctgtcactattgacgaaatcaccgataccaccgcccagttaagctggcgccccgggcctgataaccactccccgatcacaatgtacgtaatccaggctagaactcctttcagtgtgggatggcaggctgtttcgaccgtgccagagctgattgatgggaagacatttaccgccacagtagtagggctgaatccttgggtcgagtatgagttccgaaccgtggccgcgaatgtcatcggaattggggaacccagcagaccgtctgaaaagaggagaacagaggaagccttacctgaggtcacaccggccaacgtcagtggaggggggggatcaaaaagcgagctggtgattacctgggagacagtgccagaagagttgcaaaacggtaggggattcggctatgttgtggcattccgcccatatgggaagatgatatggatgttgaccgtccttgcctctgccgacgcgagcaggtatgtgtttaggaacgagtcagtgcatcccttctcaccatttgaggtgaaagtgggggtgttcaacaacaagggggaaggcccattctcacctacaactgtcgtctactctgccgaagaagagcctaccaagcctcctgcatctatatttgctcggagccttagcgccactgacatcgaagtgttttgggcatcacctcttgagaagaaccgcggaagaatccaaggatacgaggtaaagtattggcggcacgaggacaaagaagaaaacgcacgcaaaatccgaaccgtaggtaaccagacttcgacaaaaatcacaaaccttaagggtagtgttctctatcatctggctgtgaaggcctacaactcagccggaaccggcccgagctctgccactgtcaacgtgacgacccggaaaccaccgcctagtcaaccacccggaaatatcatttggaatagtagtgactctaaaatcatcctgaattgggaccaggttaaggcactcgacaatgagagcgaggtgaagggctacaaggtgctgtacagatggaatcggcagtctagcacttcagtcattgaaacaaacaaaacttctgtcgaactgtctctaccttttgatgaagattatatcatcgagataaaacctttcagcgatgggggagatgggtcctccagtgagcaaataagaattcccaagattagtaatgcttacgctcgaggcagtggcgcatccacctccaacgcctgtactctgtcggcaattagtactataatgattagtctcaccgctagatcgagtctctag

SEQ ID NO: 112996 - DNA, 351 bp, Artificial Sequence
  Description of Artificial Sequence: Synthetic coding sequence
atgagactgccctgggaactgctggttctgcagtccttcatcctgtgccttgctgacgacagtacgctgcacggcccaatttttatccaggagcctagtccagtgatgttccctcttgactccgaggagaagaaagtcaaactcaactgcgaggtgaaaggaaatcctaaaccacatatcaggtggaaactcaatggcacagacgtggacactggaatggacttcagatactctgtggtggagggtagcctgctcatcaataatcctaacaagactcaggatgctggcacgtaccagtgtacagctaccaatagttttggcacaatcgtctccagggaagccaagctatag

SEQ ID NO: 112997 - DNA, 3081 bp, Artificial Sequence
  Description of Artificial Sequence: Synthetic coding sequence
atgcgtctgccttgggagctgctggtgctccagtctttcatcctatgccttgccgatgactccacattacatgggccaatctttatacaggagcccagcccagtcatgttccctctggactcggaagagaagaaggttaagctaaactgtgaggtgaaaggcaaccctaaacctcacatcagatggaaactaaacggtacagatgtggatacagggatggatttccggtactccgtcgtggagggcagtctgctgattaataacccaaataaaactcaggacgctggcacttaccaatgtacagccaccaatagcttcggcactattgtgtcaagagaggccaaactgcagttcgcttatctggacaattttaaaaccaggactcggtctaccgtgtcagtgaggcgcggccaggggatggtactattgtgcggacctcctccacattccggcgagctgtcttacgcctggatattcaatgagtacccttcctatcaggataacagacgctttgtttcccaggagacggggaacctgtatattgccaaagttgaaaagtctgatgtgggcaactatacctgcgtcgtaactaatacagtgaccaaccataaagttttgggccccccaacacctctgatcttaaggaacgacggcgtcatgggagagtacgagcctaaaatagaagtccagtttccggagacggttcccacagctaaaggcgccaccgttaagttggagtgttttgcactcggtaatcccgtccccacgattatctggcgtagagcagatgggaagcccatagccaggaaggcaagaagacataagtcaaacggaattctggaaatacccaacttccagcaagaagatgcaggtctctacgagtgtgtggcagagaatagccgtggcaagaacgttgcccgaggacagctgacattctacgcccaacccaactggatacaaaagatcaacgacatacatgtggctatggaggagaacgtgttctgggagtgcaaggctaacgggaggccgaaacccacatacaagtggctgaagaacggcgagccactcctgaccagggaccggattcagatcgaacaggggaccctgaatattacaatcgttaatttatcagatgctggtatgtatcagtgcctggctgaaaacaagcatggcgtgatctttagcaatgccgagttgagtgtgatagccgtgggacctgacttctctaggaccttactaaaacgggtgactctcgtgaaagtcggcggtgaggtggttatcgagtgcaagccaaaggcgagtcccaagccggtgtacacctggaagaagggcagggatattcttaaggagaacgaaaggatcacgatttccgaagacggcaacttgaggattatcaatgtcactaagagcgacgcagggagttatacgtgtattgctacaaatcattttggtacagctagctctaccgggaacctggtggtaaaggaccctacccgggtgatggtcccccccagctccatggacgtaaccgtgggagagtccatcgtcttaccatgtcaagtgacccacgaccactccttagacattgtatttacctggagcttcaatggccatctgattgacttcgatagggacggggatcatttcgagagggtgggcggccaggatagcgctggcgatctgatgatccgcaatattcagctcaagcatgccggaaaatacgtatgcatggttcaaacttcagtggaccgcctgagcgctgccgctgaccttattgtcagaggccccccaggtcccccagaggctgtgaccatcgacgagatcacagataccaccgcccagttgtcatggcgcccagggcccgataaccacagccccattaccatgtacgtgattcaggctagaactccattctctgtcgggtggcaggccgtcagcaccgtgcccgagcttattgatgggaaaacttttaccgcaactgtcgtgggtctgaacccatgggtggaatacgagtttagaaccgtcgcggctaatgtaatcggcatcggcgaaccctctcgaccatcagaaaagcgcaggaccgaagaggccctccccgaagtgaccccggcgaacgtgtcaggcggtggaggaagcaaatccgagttggttatcacctgggagacagttcctgaggaattgcagaacggacgcggttttgggtacgttgtggccttcagaccctacggtaaaatgatctggatgctgacagtgttggcttcagccgacgcaagtagatacgttttccgcaatgagtccgttcatccattttctccattcgaggtgaaggtgggcgtttttaacaataagggggaaggccctttttctccaacaacggtagtgtacagtgccgaagaggagcccacgaagccccctgcatccatcttcgcccggtcactctcagctacagacatcgaggttttttgggcctcaccactggaaaagaaccggggcaggatccagggctatgaggtcaagtactggaggcatgaggataaggaggagaatgcccgcaagattagaaccgtagggaaccagacaagtaccaagattaccaatctgaagggcagcgtcctgtaccacttggcagtaaaagcctacaatagtgcagggactggaccgagctccgcaactgtcaatgttaccacccgaaaacccccaccctcccaaccccctggcaacatcatttggaattcgagtgattcaaagattatcttgaattgggaccaggtgaaggcgctcgataacgaatctgaagtgaagggctataaggtcctgtacaggtggaatcggcagagcagcacaagtgtgattgaaaccaataaaaccagtgtggagcttagcctgccatttgatgaagattacattatcgagataaaaccattcagcgatggtggcgacggatcatccagtgaacagattcgcattcctaaaatctctaatgcctacgctagaggatcgggcgcctcaacatccaatgcctgcactctctctgctataagcacaatcatgatttcactcacagctcggtcaagcttgtag

SEQ ID NO: 112998 - DNA, 2097 bp, Artificial Sequence
  Description of Artificial Sequence: Synthetic coding sequence
atggaggagaatgtcttctgggaatgcaaagcgaatggccgccctaagccgacttataaatggctcaagaatggagagccattacttactagggaccgtattcaaatagagcagggcaccctcaatatcacaatcgtgaacttatcagacgccgggatgtaccagtgtcttgcagagaacaaacacggagtcatcttctctaacgccgaactgtccgtgatcgctgtggggcctgatttttcaagaacattgctcaaacgggtgacactagtcaaagttggcggtgaggtggttatcgaatgcaagccaaaggcctcccccaagccagtgtatacgtggaagaagggaagggacattttaaaggaaaatgagagaataacaatcagtgaggatgggaacttacgtattattaatgtgactaagtcagacgctggctcatatacttgtatagctacgaatcatttcggcacggcgagttctaccggaaacctggtggttaaggatccaacccgtgtaatggtgccgccttcatcaatggatgtgaccgtgggggaatcgattgtgcttccatgccaggtgacacacgatcactccctggatattgtgttcacatggagcttcaacggacatctgattgacttcgatagagatggagatcattttgaaagagtcgggggtcaagactccgcaggagacctaatgataagaaacatccagctaaagcatgcgggcaaatacgtttgtatggtgcagaccagtgtcgaccgtcttagtgccgcagctgacctcattgtgcgcggccccccaggcccgcctgaggccgtcacaatcgatgagataactgataccactgcacagctttcctggcgaccaggccccgacaatcactctcctatcactatgtacgtcatccaggcccgcacaccatttagtgtcggctggcaggctgtatccacagtcccagaactgattgatggtaaaacatttacagcaaccgttgtgggactgaacccatgggtcgagtatgagtttcgcacagtcgctgctaatgtgattgggataggcgaaccctcccggccatctgagaaacgccggacggaagaggcactgcccgaggtcactccggccaacgtatccgggggcggcggttctaaaagcgagctagtcatcacctgggagactgtaccagaagaactgcagaacgggagaggcttcggatatgtggttgcctttaggccctacggtaagatgatttggatgctgactgtccttgccagcgccgatgccagccggtatgtgttcagaaacgagtcagtacacccattctcacccttcgaggtcaaggtgggggtgtttaacaacaaaggggaaggccccttttctccaactaccgtggtctactccgcggaagaggagcctactaagccaccggccagcatatttgcacggtccctgtcggctactgatatcgaagtattttgggcaagcccactcgagaagaatagaggaagaatacaaggctatgaggtgaaatattggcgacatgaggacaaggaagaaaacgctcgcaaaatccgaacagtgggaaatcagacttcaactaagattactaatctgaaagggtcagtactctaccatttggccgtgaaggcgtacaattcggccgggacaggccctagcagcgcaaccgttaacgtgactactcgaaaaccaccccctagtcagcctccaggaaacatcatatggaactcctctgatagcaaaatcattttgaattgggaccaagttaaagcacttgacaatgaatccgaggtcaaaggctacaaggtgctgtatcgttggaacagacaatccagcactagcgtcatcgaaactaataagacaagtgtggaactgtccttacctttcgacgaggactacatcatcgaaatcaaacctttctcagacgggggcgatggtagcagttcagaacagatccgcatccctaagatcagcaacgcctatgcccggggtagcggtgctagcacttcgaacgcatgcacactctcggctatctcaaccattatgatcagtctcaccgctcgctccagcctgtag

SEQ ID NO: 112999 - DNA, 165 bp, Artificial Sequence
  Description of Artificial Sequence: Synthetic coding sequence
atgcgcctcccctgggaactgttagtactgcaatcgttcatactctgccttgctgatgattccactctccacggaccgatttttatccaagaaccaagccctgtaatgttccccttagatagtgaggagaaaaaagtgaagttgaattgcgaagttaagggctag

SEQ ID NO: 113000 - DNA, 3303 bp, Artificial Sequence
  Description of Artificial Sequence: Synthetic coding sequence
atggccagtagttggaaactcatgctcttcctgagcgtaacgatgtgcctgagtgagtattccaagtccctcccgggactcagtacttcttatgcagccttgcttcgaatcaaaaagtcgtcttcctcaagcctgtttggctccaagacccgcccccgttactcctcaccctccctgggaaccctgtcagcatccagcccttcatggcttggagcagcacaaaattactactctccaatcaacctttatcacagctccgacgcctttaaacaggacgagagcgttgactacggccccgtcttcgtgcaggagcctgacgacatcatatttcctactgacagtgatgaaaagaaagtcgccttgaattgtgaagtccgcggaaatcccgttccgtcttatcggtggttgcggaacgggaccgaaattgacctggagtccgactaccgttacagccttatcgatggcacgtttattatttctaatccgtctgaggcaaaggattccggacactaccaatgccttgctactaacacagtgggttccattttgagcagagaagctactctgcagtttgcctatctgggaaatttctccggacgtacaaggtctgcagtctcagtgagggaaggccaaggggtggtcctgatgtgttccccacccccccactctcctgagatcatctattcctgggtattcaacgaattccctagctttgttgcagaggacagccgacggtttattagtcaagaaacagggaacctctacattagtaaggttcagacctctgatgtcgggtcctatatctgtttggtgaagaacaccgttacgaatgctagagtgctgagtccaccaactcctctgaccctcagaaatgacggcgtcatgggcgaatatgaaccgaagattgaagtgcattttccattcacagtgacagctgcaaagggcactacagtgaaaatggaatgttttgccctgggcaaccctgtgccaaccattacatggatgaaggtcaatggttacataccctcaaaagcccgcctcagaaaatcccaggctgtgctggagatcccaaacgtccagctcgacgatgctgggatctacgaatgtagggctgaaaactcgcggggcaaaaacagctttcgtggacagttgcaggtctacacatacccacattgggtggagaaactgaacgacactcaacttgactcgggatcccccctcagatgggagtgcaaggcgactggcaaacccagacccacatacaggtggttgaagaacggcgtgcccttatcaccacagagccgggttgagatggttaatggtgtccttatgatacataatgtaaaccagtctgatgcaggaatgtatcagtgcctggccgaaaataaatatggggccatctatgcatccgccgagctcaagatcctcgcctcagcaccaaccttcgcactcaatcagcttaagaagactatcatcgtgacgaaagaccaggaagtggtaatcgagtgcaaaccccagggaagcccaaagccaaccattagttggaagaaaggagatcgggcagtcagagagaacaagcggatagctattctcccggacggcagcctcaggatcctcaatgcaagtaagtctgatgaagggaaatacgtttgccggggcgagaacgtgtttggctccgccgagatcatagcatctctgagtgtgaaggaacccacaagaattgagttaactcctaagagaactgaactgaccgtgggtgagagtattgttctgaattgcaaggcgatccacgatgctagtctagatgtgacattttactggacccttaaagggcagccgatcgatttcgaggaagaaggaggccattttgaatctatcagagcgcaagccagcagcgctgatcttatgattagaaacattctcctcatgcacgctggcagatatggttgtcgggtgcagaccacggcagactccgtctccgacgaagcagaacttctggttaggggccctcccggtcctcctggtatagtcatcgtggaggagataacggagtccaccgctaccctgagttggagtcccgccgccgacaaccacagcccaatctcctcttataacctccaggcacgctctccgttctctctcggctggcagacggtcaagacagtccctgagattatcactggagacatggagtcagctatggccgtcgatttaaatccatgggtggaatatgaattccgcgtcgtagcgactaatcctatcggcactggggatccaagcactccttcccgtatgatcagaaccaacgaggccgtgcctaaaactgcccccaccaatgttagtgggaggagcggccgcagacacgagttggtgattgcctgggagcctgtgagtgaagagttccagaacggcgaaggcttcggatatattgtggcctttcggcccaatgggacacgtggttggaaggaaaaaatggtgacttcctccgaggccagcaagttcatttaccgagatgagtctgtcccccctcttacccccttcgaggtgaaggtcggcgtctataacaataagggcgacggcccctttagtcagatcgtggtaatctgctccgccgaaggagagccatctgccgcccccacggacgttaaagccacttcagtttccgttagcgagatcctagttgcctggaaacacatcaaggagagtttgggccggccacagggattcgaagtggggtattggaaagacatggagcaggaagacaccgccgaaacggtgaagactagaggcaatgaatccttcgtaatccttaccggcctggagggtaatacactttaccattttacagtgcgggcatacaatggcgcagggtatgggcccccttcatcagaagtcagtgccaccacgaaaaagagcccaccctctcaagctccctccaacctccgctgggaacagcaggggtcccaggtgtcactgggctgggaacccgtgataccactggccaacgagtccgaagtcgtcggctacaaggtgttttaccggcaggaagggcattccaatagtcaggtgatcgagacacagaagcttcaggctgtggtgcctctcccagatgccggtgtttatatcattgaagtgagagcctactccgaaggcggcgacggaacagcaagctcccagattagggttccttcatactcaggcggcaagatcacatcagctcagagtactttacacagcttgagcacatcttcctcaagcgtgactctcctactcgccctcatgataccatcgacttcatggtag

SEQ ID NO: 113001 - DNA, 3081 bp, Artificial Sequence
  Description of Artificial Sequence: Synthetic coding sequence
atggcatctagttggaaactcatgttatttctctcagtgacaatgtgtctttccgaatccgtggattatggccccgtttttgttcaggagcctgatgacattatcttcccaaccgatagcgacgagaaaaaggttgcattgaattgcgaggtgagggggaaccctgtaccaagctatcgttggctgcgaaacggtaccgagatcgatctggagtcggactatagatattccctcatcgatggaacatttatcatctccaacccaagcgaagccaaagactccggccattatcaatgcctcgcaacaaacaccgtgggaagcatcctgagtagagaagccacattgcagtttgcatacctgggcaacttcagtggacggacgaggagcgcagtttcagttcgagagggacagggggtcgtgttaatgtgttcccccccgccacacagccccgaaattatctattcctgggtttttaatgaattcccgtctttcgtcgccgaagacagccgtcgattcatctcccaggagactgggaacctgtacatctcaaaggtacagacttcagacgtgggcagctatatatgcctggtgaagaatacagtgacgaacgcccgcgtgctatcacccccaaccccgttaacactgcgcaacgacggggttatgggagaatatgaacccaagattgaggttcattttccatttactgtaactgcagcaaagggcacaacagttaagatggagtgctttgccctgggcaaccctgtgccgacaatcacctggatgaaagtgaacggctatatcccctcaaaggcccggctgaggaaaagccaagccgtgctcgaaatccctaacgtccagttagatgatgctggaatctacgagtgccgggcggaaaattcccgagggaagaattccttccgaggccagctgcaagtctacacctacccacactgggtagagaaattgaatgatacacagctagatagcggctctcctttgagatgggaatgtaaggcaaccggaaaacccagaccaacctatcgatggctcaagaatggagtgcctttgtcccctcagagcagagttgaaatggtgaatggtgttctcatgatccacaacgtcaatcagtccgacgctggtatgtaccagtgtctggcagagaacaaatatggtgcaatctacgcttcagcggagctcaaaatcctggcctctgccccgaccttcgcgcttaatcaactgaagaagactatcatcgttacgaaggatcaggaggtagttatcgagtgtaaaccgcagggttccccaaagccaactataagctggaagaagggcgatcgggcagtccgcgagaacaagaggatagccattctgcctgatggcagcctcagaatactgaacgccagtaagtcggacgagggtaagtatgtgtgcaggggcgaaaatgtgttcggaagtgctgaaataattgcatctctgagtgtgaaagagccaacccgaatcgagcttacacccaagcgaaccgagctgacagtaggggaatccatcgtgctgaactgcaaggcaatacacgacgcctcactggacgtcacattctattggacgctgaaaggtcagcctatcgattttgaggaagaagggggccactttgagtccatccgtgcccaggcctctagtgccgatctcatgattcggaatatattactgatgcacgccgggagatatggctgtcgtgtacagactaccgccgactccgtatctgatgaggccgagctcctcgtcagagggcctccaggtccccccggcatcgtgatcgttgaagaaatcacagaatctactgcaaccctttcatggtcacctgctgctgataaccacagtccaattagcagctataacctccaggccagatcacctttctcgcttggatggcagaccgtcaagaccgttcctgagatcatcacaggagacatggagtcagccatggcggtcgacctcaatccgtgggtggagtatgaattccgcgtcgttgctactaacccgataggaaccggcgacccttccaccccctcacgcatgattagaaccaatgaagccgtccccaaaacggctcccaccaatgtatccggacgctccgggcgccgacacgagctggttatcgcttgggagccagtatccgaggagtttcagaatggggagggtttcggctacattgtcgccttcaggcccaacggtacgcggggatggaaagaaaagatggtcacatcttcagaggcctccaaatttatttatcgtgatgagtctgttccccctctgactcctttcgaagtaaaagtcggcgtgtacaacaataagggcgatggccctttctcacagatcgtggttatttgctctgcggaaggagaaccttccgcagccccgaccgatgtgaaagcaacctcagtgagtgtaagtgaaattctggttgcctggaaacacatcaaagagagtctggggaggcctcagggtttcgaagtgggctactggaaggatatggagcaggaagatactgccgagaccgtgaagacacggggaaatgaaagctttgtgatcctgacaggtttggaggggaacaccctctatcatttcactgttcgggcatataacggggccggctacgggccaccctcctctgaagttagcgcgactaccaaaaaatcccctccatcccaggctccgtctaacctccggtgggaacagcaagggtctcaggtgtcgctaggctgggagccagtgataccactggctaacgagtccgaagtggtgggttataaagtgttttatcgccaggaaggccactctaactcccaggttatagaaacccagaaactgcaggcagtagtccctctgcctgacgctggagtatatatcatcgaggtgcgggcgtacagcgagggcggcgacggcaccgcaagtagccaaatccgcgtgccaagttattcaggcgggaaaattacaagcgctcagagcacactccacagcttatccacttccagttccagcgtgacattattattggccttaatgatcccctcgacgtcatggtag

SEQ ID NO: 113002 - DNA, 3303 bp, Artificial Sequence
  Description of Artificial Sequence: Synthetic coding sequence
atggcctcatcctggaaactgatgctcttccttagcgttactatgtgtctgtccgaatatagcaagagcctgcctggtctgagcacttcctacgcagccctgctcaggatcaagaaatcgtctagctccagtctgtttgggagtaagacgcgaccccggtacagcagcccatctctggggaccctgagcgcctcctccccctcttggctgggagccgcacaaaactactattcccccatcaacctttatcattcatctgacgcttttaagcaagatgagtcggtggattatggacctgtgttcgtgcaagaaccggacgacataatatttcccacagacagtgacgagaaaaaagttgcactgaactgcgaggtgaggggcaatcccgtgccatcatacaggtggttgcgtaacggcacggaaatcgacttggagagtgactaccgatatagcctgatcgatggtacgtttataatctcaaatccctcagaggccaaagattcaggacattatcagtgtctagccaccaatacagttgggtccatactgagccgagaggctaccttacagttcgcttacctgggaaatttcagtgggcgcactcgcagtgcggtaagcgtgcgggagggtcagggagtcgtcctcatgtgctcacctcctccccactctcccgaaataatctacagttgggtgtttaacgaattcccttcatttgtggctgaggattcccggcgcttcattagccaggaaactggaaacctgtatatttctaaggtacagacctcagacgtgggcagctacatctgtcttgtgaagaacaccgtcactaatgcccgcgtcctgtctccgcccacgcccctcactttaagaaatgacggagttatgggcgagtacgaacccaagatcgaggtacactttcctttcaccgtgacggccgccaagggcaccaccgtgaaaatggagtgctttgccctcgggaatccggttccaactataacctggatgaaagtgaatggatatattccttccaaggcgaggctacggaagagccaggcagttctggaaattccaaacgtgcagttggatgacgctggcatctacgagtgccgggccgagaactccagaggcaaaaacagtttccgcggccagcttcaggtatatacatacccccattgggttgaaaagctgaatgatactcagctcgactccggcagccccctgaggtgggagtgcaaagctacaggaaaaccccgaccaacatatcgctggctcaagaatggggttcctctgtcaccacagtcacgggtggaaatggttaatggcgtcctaatgattcacaatgtgaaccaatccgacgctggtatgtaccagtgcctagcagaaaataagtatggagctatctacgccagcgccgaattgaagatcctggcttcagctcccacttttgctcttaatcagcttaagaaaaccatcattgtcacgaaagaccaggaggttgttattgaatgtaaaccccagggctctcctaagcccaccatcagttggaagaaaggcgatagagccgtacgcgaaaacaaacgcattgcaatcctgccagacggaagcctccgtatcctcaacgcctccaaaagcgacgaggggaaatacgtttgtcggggggagaatgtctttggaagcgccgagataattgcatctttatcagtgaaggaacccacccgaatcgaactcaccccaaaaaggaccgagcttaccgtgggcgagtcaatcgtgttgaattgtaaagcgatacacgacgccagcctagatgtcaccttctattggactctcaagggccaacccatagacttcgaagaagaaggtggtcactttgaatcgattcgggctcaggcctcttccgctgacctcatgatccgaaacatcctgctgatgcacgctgggcgatatggctgccgggtgcagaccacagcggatagcgtcagtgacgaagccgagctactagtaaggggaccccccggcccgcctggcattgtgattgttgaagagatcactgagtccactgctactctttcctggtcccccgccgcggacaaccattccccaatttcttcctataatttgcaggcccggagccccttttctctgggatggcagacagtgaaaaccgtcccagaaatcatcactggtgatatggagtcggcgatggctgtagacctaaacccatgggtggagtatgagtttcgagtggtggctacaaacccaatcggtactggtgacccgtcgaccccatcaagaatgatacgtacgaatgaagcggtgcccaagaccgccccgaccaacgtctctggaagatccggtaggaggcatgagttagtcatagcctgggagccagtgtccgaggaattccagaacggggagggcttcggctatatagtggccttccgccctaacggaactcgggggtggaaagagaaaatggtgacttcttccgaagcgtcaaaatttatctacagggatgaatccgtgccacccctgaccccatttgaagtcaaagtgggcgtgtataataataaaggcgacggcccattcagccagattgttgtcatctgctccgctgagggtgagcctagcgctgcacccactgatgttaaagctaccagtgtgtcagtcagtgaaattctggtggcctggaagcatatcaaggagtctctggggaggcctcagggcttcgaggttggatattggaaggatatggagcaggaagacaccgcagagactgtgaagacccgtgggaatgagtccttcgtgatactgacggggttggaaggcaacactctgtaccatttcactgtcagagcatacaacggtgctggctacggaccacccagttccgaggtctccgcaactactaaaaagagcccaccctcacaggcacctagcaatctccgttgggaacaacagggctcccaagtgagtctcggatgggaaccagtgatacctctcgctaatgaatctgaagtggtaggatataaagtgttttacagacaggagggtcactcaaactcacaggtgatcgaaacgcagaaattgcaggctgtagtccctcttcccgatgccggcgtgtacattattgaagtgagagcttatagcgagggcggagacgggaccgcaagctcacagatccgggtgccatcgtatagcgggggaaagattacttccgcacagtctaccttacactctctgtcaacctcaagctccagtgtgaccctgttactggctctgatgatcccttcgacaagctggtag

SEQ ID NO: 113003 - DNA, 3303 bp, Artificial Sequence
  Description of Artificial Sequence: Synthetic coding sequence
atggcctcatcgtggaaactgatgctttttctctccgtaaccatgtgcctgagtgaatactctaagtctctgccaggcctctcaactagctacgcggcgttactgaggattaaaaaatctagttcttccagtctgttcggaagcaagacccgcccccggtactcctccccctcattggggacactgtcagcaagctccccttcttggctgggtgccgcccagaactattatagcccaatcaacttgtaccattccagcgatgctttcaagcaagatgaatccgtggattacggtcccgtttttgtgcaggagcctgatgacatcatctttccaactgatagcgacgaaaagaaagtggcactcaactgcgaagtgcggggaaaccccgtgcccagctatcgctggttacggaatggcaccgagatcgaccttgagtccgactacagatatagtctgattgacggcacttttatcatttccaaccccagcgaagcgaaggattccggacactaccaatgtttggctaccaataccgtcggctctatcctgtctcgggaggcaaccctccagttcgcctatctcggaaactttagtgggcgcacacgctccgctgttagcgtgcgcgaaggccagggagtagtgctgatgtgttctcctcccccgcattctcccgagatcatctactcatgggtttttaatgagttcccttcttttgtcgctgaagacagccgccgctttatttcccaagagaccggaaatctttatatcagcaaagtgcagacttcagatgtggggtcctacatctgtctcgtaaagaacactgtaacaaacgcaagagttttgagccctccaactccgctcaccctgcgaaacgacggcgtgatgggcgagtatgagcccaagatagaggtccacttcccatttaccgtcacagcagccaagggtaccaccgtgaagatggagtgcttcgcactcgggaacccggtgcccactatcacctggatgaaggtgaacggatatatcccgtccaaagcccggctgagaaagagtcaggccgtgctggaaattccgaatgttcagcttgatgacgctggcatatacgaatgtagggccgagaactcacgggggaagaattcatttagaggccaactgcaagtgtatacctacccacactgggtggagaagctcaacgatactcagctggatagcggatcgcccctgcgctgggaatgtaaggctactggtaaaccaagacccacatataggtggctgaagaacggggtgcctctgtctcctcagtcccgggtggaaatggtgaatggcgtccttatgatccacaacgtgaatcagtctgatgccgggatgtaccaatgtcttgcggagaacaaatacggcgcaatatacgcgtccgctgagctgaaaattcttgcctccgccccaacctttgctctgaaccaactgaagaagaccattattgttacgaaagaccaggaggtggtaattgagtgcaagccacagggtagtcctaaacccaccatttcttggaaaaaaggcgaccgggctgttagagagaacaagcgtatcgccattctgcctgatggctccctgaggatattgaatgcctccaagtctgatgagggcaaatatgtgtgcaggggcgagaacgtgttcgggagcgctgaaatcattgcctcactgtccgttaaggagccaacccgcatcgagctgacacccaaaagaactgagctgactgtgggggaatctatagtgctgaattgtaaagccatccacgatgcctcgctggacgtgacgttttactggaccctgaaaggccagccgatcgactttgaggaggaagggggccacttcgagtccatccgcgctcaggcatcaagtgccgatctcatgatccgtaacattcttctgatgcatgccggtagatacggatgcagggtccagaccacagccgattcggtcagcgacgaggccgaactgctggtccgcggccctcctggcccccctgggatagtgatcgtagaagagattaccgagtccacagctacgctttcatggtccccggccgcagacaatcatagtccaatatcttcctacaatctgcaggccaggtcccctttctctctgggttggcagacggtgaaaacagtgccagagattatcacaggggatatggaatctgccatggctgtcgacctgaacccttgggtggaatatgagtttagagttgtggccaccaacccaatcggtacaggcgacccgtctaccccatctcggatgattcgaactaacgaggcagtccccaagactgcgcctacaaacgtgtccggcaggtcagggcggaggcatgagctggtgattgcgtgggagcctgtctccgaggagttccagaatggcgaggggttcggatacatagtggcctttaggccgaacggtaccaggggctggaaagagaagatggtgaccagttccgaggcgagcaaatttatatacagggacgagagcgtccctcctctgaccccttttgaggtgaaagtgggggtttacaataacaaaggtgacggccccttttcccagatcgtcgtgatctgttccgcagagggtgagccatccgcagcccccaccgacgtgaaagccaccagcgtgtcagtgagtgagattctggtggcttggaagcatattaaagaaagtctggggcggcctcaggggttcgaggtgggctactggaaggacatggagcaagaagatactgccgaaaccgttaaaactcgcggcaatgagagctttgtgattctgaccggcttggagggcaacaccctgtatcactttacagttagggcctacaacggtgcaggttacggccctcccagcagtgaggtaagtgcgacaactaagaaatcaccaccatcccaagcgccgtccaatctgcgctgggagcagcagggttcacaggtttcactcggatgggagcccgtgatcccactcgctaatgaaagcgaagtcgtcggctataaggtgttctatcggcaagaggggcatagtaactcccaggtcattgagacccaaaagctgcaagcagtggtacccctgcccgacgctggcgtgtacattatcgaagtaagagcgtactccgaaggaggggatgggacagcctcatctcaaatcagagtgccatcctacagcggagggaagatcacatctgcccagtctaccttgcactctctttctacatctagttcgtctgtaacactcctgttggccctgatgatcccgtccacatcttggtag

SEQ ID NO: 113004 - DNA, 2736 bp, Artificial Sequence
  Description of Artificial Sequence: Synthetic coding sequence
atggcgtcctcctggaagctgatgctctttttatctgtcaccatgtgcctgagtgagtacagcaagtctttgcctggcctatccacatcatacgccgcgctgctgaggattaagaagtcaagcagcagctctctgtttggatcaaaaactaggcctaggtactcatctccatccctgggcaccctgtccgcctcttctccctcctggctcggtgccgcccagaactactactcccctatcaacctctaccacagttccgatgctttcaaacaggacgagagcgtagattacggacctgttttcgtccaggagccggacgatattatattcccaacggacagcgatgagaaaaaagtcgccctcaactgtgaggtgcgcggtaaccctgttcccagctataggtggctcagaaacggcaccgagatagatctggaatctgactaccgttactccttaatcgacggcacctttatcattagtaacccttcagaagcaaaagactccggtcattatcagtgtttggcaaccaacacagttgggtcgattctctcgagggaggcgaccctccaatttgcctacctcggcaatttcagtggccggaccaggtcagctgtgagtgttagggaggggcagggggtggtgctgatgtgtagcccacctcctcatagcccagaaattatctactcatgggtcttcaacgaatttccaagcttcgtcgccgaggactctcgccggtttatttcacaagagaccgggaatctctatatctccaaggtccaaacaagcgacgtgggttcatatatctgcctcgtcaaaaatacagtcaccaatgccagggtcttaagccccccaacccctttgacactgcgcaacgacggtgtcatgggcgagtacgagcctaaaatcgaagtccattttcctttcacggtgacggctgctaaagggacgacggtgaagatggagtgttttgccctggggaacccagtgcctacaataacctggatgaaagttaatggttacataccgtccaaggcaagacttagaaagagtcaggccgtccttgagatacccaacgtccaactggacgacgctgggatttacgaatgtcgtgccgagaatagccggggcaagaactcgttccgcgggcagctgcaagtctatacctacccacattgggtcgagaaactgaacgatacccaactggattccggcagcccgctccgttgggaatgtaaggcaaccggtaagccaaggccaacgtacaggtggctaaagaacggcgtgcctctctccccacagtctcgtgtggagatggtcaatggagtactgatgatccacaatgtaaaccagagcgacgcaggtatgtaccagtgcctggcagagaacaagtatggagccatctatgcatctgcagagctgaagatcttggctagcgcgcccactttcgcactgaaccagctgaagaaaacaataattgtcactaaggaccaggaagtggtgatcgagtgcaaaccccagggcagtcctaagcccacaatctcctggaagaaaggagaccgcgcagtgagagaaaataaaagaatcgccatactacctgacggctctttgaggatcttgaacgctagcaagtccgatgagggtaagtatgtctgtcgaggcgaaaatgtttttgggtcagcagagattatcgcttcactgtccgtcaaggaaccaacacgcatagagctcacacctaaacgcacggagctgactgttggagagagtatagtcctgaactgcaaagcaattcatgacgcttccctggacgtgacattttactggacactgaaaggccagccaattgactttgaagaggagggagggcatttcgagagtattcgggcccaggcatcgtcagccgacctaatgatccggaatatcctgctgatgcacgctggacggtacgggtgtcgagttcaaacaacagctgatagcgtctctgatgaggccgaactgctggtacgaggccctcccggaccaccaggcatagtgatcgtggaggagatcactgagagtacagctacactgagctggagccctgcggcggacaaccacagccctatctcatcttacaatttgcaggctcggagtccattctctcttggctggcaaacagtaaagaccgtgcccgagattatcacgggtgacatggaaagcgcgatggctgtcgatctgaatccctgggtggagtacgagtttcgggttgtggccacaaaccccattggaacgggtgatccaagtactccttcgcggatgatccgcaccaacgaggcagttcccaagaccgctccgacaaacgtgtctgggcggagcggtcgacggcatgaattggttatcgcctgggagcccgtcagcgaagaattccagaatggtgagggcttcggatacatcgtcgcgttccgccctaacgggacccgcggctggaaagagaaaatggtaacttcttccgaggccagtaaattcatctatcgtgatgaaagcgtaccgccccttacaccttttgaggtcaaggtcggtgtttataataacaagggagacggccctttttcccagatcgtcgttatctgctccgcagagggtgagccttcagccgccccgaccgacgtcaaagcaacttccgtcagtgtgtccgaaattcttgtcgcctggaaacacatcaaggaatctctgggcaggccacagggatttgaagtttag

SEQ ID NO: 113005 - DNA, 3087 bp, Artificial Sequence
  Description of Artificial Sequence: Synthetic coding sequence
atgcgtctcctgtggaaactggtgattctgctacccttgattaactccagtgctggtgatggcctcctgagccggcccattttcacacaggaaccccacgatgtcatttttcccctcgatctgtctaagtcggaggtgatactcaactgtgctgctaatggatatccttcccctcattatcggtggaaacagaatggcacagacatcgatttcaccatgtcctatcattaccgcctggacggaggcagtctggcaatcaatagccctcatacagatcaagatatcggtatgtatcaatgtctagcgactaacctacttgggacaatcctttctcggaaggccaagctgcagttcgcatatatcgaagacttcgaaacaaagaccaggtccactgtgtccgttcgcgaaggtcaaggggtagtgctgctgtgcggccctcccccacattttggcgacctgagctatgcctggaccttcaacgataaccccctttacgtccaagaggacaataggcgcttcgtgagccaggaaaccggcaacttgtatattgccaaggtggaaccttccgatgtcggcaactatacatgctttattactaataaggaggcccagcgatctgtgcagggtccacctacacccttggtgcaaaggacggatggcgtgatgggagagtatgagccaaaaatcgaagtcagattccccgaaaccatacaggccgccaaagattcctccgtaaagctggaatgtttcgcgctggggaaccccgtgccggatataagctggcggagactcgacgggagcccactgcctggtaaggtgaagtatagtaagtctcaggccattctggagatcccaaactttcagcaagaggacgagggattctatgagtgcattgcttccaatctaagaggcaggaacctggctaagggccaattgatcttctatgcacctccggagtgggagcaaaagatccaaaatactcatctgagcatttacgataacctgctgtgggagtgcaaagcctcgggtaaacctaatccttggtacacctggctaaagaatggcgaacggctgaaccctgaggagcgaatccaaattgagaacgggacactcatcattaccatgttgaacgtgagtgacagtggagtttaccaatgcgccgccgaaaataagtaccagatcatctacgcaaatgcggagttgagggtactggcttcggcccctgatttctcaaaatcccccgtcaaaaaaaagtctttcgtgcaggtcggtggcgatatcgttatcggatgcaagcctaatgctttcccccgggctgccatttcctggaagagaggaacagagacgctccgacaaagcaagcgcattttcctcttggaggatggcagtctgaaaatttataacattacacgcagtgacgctggctcctatacttgcatcgcaaccaaccagttcgggactgctaagaacacaggaagcctgatcgtgaaagagagaactgtcattaccgtgccccccagcaaaatggacgtgaccgttggcgaaagtattgtgttgccgtgtcaggtaagccatgatccctctattgaggttgtattcgtatggttctttaatggggacgttatcgacctgaagaagggggtcgcgcatttcgagagaatcgggggggagtcagttggagaccttatgatcaggaacatccagctgcatcattcaggcaaatacttatgtacggttcagactacgctggagtccctctcagccgtggctgatataattgtacgcgggcccccggggccccctgaagatgtacaggtggaggatatttccagcaccacaagtcagctgtcatggcgggctgggcccgacaataactctcctattcaaattttcacaatacagaccagaacaccttttagcgtcgggtggcaagccgtggcaaccgtccctgaaatactgaacggcaagacatataacgccacagtagtgggcctgagcccctgggttgagtatgagtttcgggtggtggctgggaatagcataggcatcggagaaccgtcagagccctcggaactgttgagaaccaaggcctccgtgcccgtggtggctcctgttaacatccacggtggcggagggtcccgcagcgaactggttattacatgggagagcattcccgaagagcttcaaaatggggagggtttcgggtatatcattatgttcaggcccgtggggagtacaacgtggtccaaagagaaggtgtcctctgtggaaagttctcggtttgtataccgaaatgaatcgatcatccccctgtcaccctttgaggtgaaagtgggcgtgtacaacaacgagggcgaggggagccttagtacggtgactatcgtgtactctggagaagacgaaccacaattggcgccccgcgggaccagcttacagagcttttccgcttccgagatggaggtgtcctggaacgccattgcgtggaatcgaaacacaggtcgtgtgttaggatacgaggtgctctactggaccgacgactccaaggagagcatgatcgggaagattcgggtgagcgggaatgtgacgactaagaatatcaccggcttgaaagcaaacactatctactttgcctcagtgcgcgcttacaatacggccggtactggcccctcatctccacccgtcaatgttacgacaaagaagtcccctcccagccagccacctgctaatatagcatggaaattaaccaactctaaactctgtctgaactgggagcatgttaagaccatggagaacgagtccgaagtgctgggttataagattctgtatcgtcaaaatcgacagtcaaagactcacatccttgagacaaataatacatccgctgaactgctggttccttttgaggaagattacctgattgagatcagaacagtgtcggatggcggggatggctcatcatccgaagaaattcggattcctaaaatgtcctcactctctagtagagggatccagtttttggagcctagcacccacttcctctcaattgtcattgtcatttttcattgctttgctatccaaccactaatttag

SEQ ID NO: 113006 - DNA, 3087 bp, Artificial Sequence
  Description of Artificial Sequence: Synthetic coding sequence
atgaggctgctatggaaattggtcattctcctacccctcattaatagcagcgctggtgatggtttgttgtctaggccgatattcacgcaagagccgcacgacgtcatttttcctttagatttatccaagtccgaagtcatcctgaattgtgctgctaacggatatccatcaccccactatcgttggaagcaaaatggaacagatatcgactttactatgagttaccactaccggctggacggtggctcacttgcaataaactctccccatacggatcaagacatcgggatgtaccagtgtttagccactaacctcctgggtaccatcctgagccgcaaggccaagttacaattcgcctatatcgaagatttcgaaacaaagacaaggtccaccgtctcagtcagggagggtcaaggcgtcgtgctgttgtgcggcccccccccacacttcggggatctgagttacgcctggacctttaatgacaatccactgtacgttcaagaagataaccggagatttgtgtcccaagagactgggaatctgtatattgctaaagttgagccatcagacgtcggtaattacacttgcttcataaccaacaaagaggcacaacgcagcgttcagggaccccccacccccctggttcagcgcactgacggggtgatgggagagtacgagccaaaaatcgaggtccgctttcctgagaccatccaggccgcgaaagattctagcgtgaagctggaatgctttgccctgggtaatcctgtgccagacatatcgtggcgacgtctggatggctctcccttgcctggaaaggtcaaatattcaaagtctcaggcaatattggaaattcccaattttcagcaggaagacgaagggttttacgagtgcatcgcctccaatcttcggggccgaaacctggctaagggacagctgattttttacgcaccccctgagtgggagcagaagatacagaacacgcatctttccatttacgacaacttgctctgggaatgcaaagcttccggaaagcctaacccctggtatacttggctcaagaacggcgagaggctgaacccggaagagcgcattcaaattgagaacgggactctgattatcaccatgttgaacgtgagcgacagcggcgtatatcagtgcgccgcagagaataaataccagatcatatacgccaatgccgagctgagggtgctagcctctgcacctgacttttctaaaagtccagtgaaaaaaaagagttttgtgcaggtgggcggagacattgtaatcggttgcaaacccaacgccttccctagagcggctatcagctggaagcggggaaccgaaacactgcggcagagcaagagaatttttctccttgaagacggctccttgaagatatataacattacgcggtccgacgcaggctcatacacctgcatcgccacaaaccagttcgggacggccaaaaacactggatccctgatcgtcaaggaacggacagtgatcactgttccgcccagcaagatggatgtgaccgttggggaaagcatcgtgctgccttgccaggtatcccacgatccaagcattgaggtagtttttgtgtggttttttaatggcgacgttattgacctgaagaaaggtgtagctcattttgaacgcatcggaggcgagagcgtgggggatttaatgatcaggaacattcagctgcaccactctggcaagtatctatgtacagtgcaaaccacactagaaagtctgagcgccgtcgctgacatcatagtgagagggcctcccggcccccctgaggacgttcaagtcgaagacattagctctacgaccagccagttgtcctggagagctggtcccgataacaatagtcctattcaaattttcacaatccagacgcgcacaccattttctgtgggctggcaggccgtggcaaccgtgccagaaatcctgaatggcaagacatataacgctaccgttgtcggactgtcaccttgggtggagtatgaattccgggtggtggccggcaactcaattggcatcggggagccctccgagccctccgaattattgagaaccaaggcttccgtgcccgtcgtagctccggttaacattcatggagggggcgggtccaggagcgaactcgtgataacttgggaatccattcctgaagagcttcagaatggcgaggggttcggctacatcatcatgtttaggcctgtgggatctacgacatggagcaaagagaaggtgtccagtgtcgaaagctcaagattcgtgtaccgcaacgagtctatcattccactgagccctttcgaggtgaaggtgggcgtgtacaacaacgagggtgaaggttctctctccaccgtgacaatcgtgtatagcggcgaggatgagccccaactggccccacggggcacttcgctgcagagcttttcagcttcagagatggaagtctcatggaatgccattgcttggaaccgaaacactggcagggtcttagggtacgaggttctgtattggaccgatgactccaaggagtccatgattggaaagattcgggtgagcggtaatgtgaccacgaagaacatcaccggactgaaagcaaacaccatctatttcgccagcgtaagggcttataataccgccgggacaggcccatctagtcccccggtgaacgtgacaactaagaagtcccctccttcacagcccccggccaacatagcctggaaattaactaacagcaagctgtgtttgaattgggagcacgtcaagactatggaaaatgaatctgaggtcttggggtacaagatactgtaccgccagaacaggcagagtaaaacccatatactggagactaacaacacaagcgcagaactgctggtgcctttcgaagaggactacctcatcgaaataaggactgtgtctgacgggggggatggcagtagcagcgaggagataaggatccccaagatgagctcattgtcttccaggggcatccaattccttgagcccagcacacatttcctgagcatcgtcatcgttattttccattgttttgcaatccagcctctgatttag

SEQ ID NO: 113007 - DNA, 2871 bp, Artificial Sequence
  Description of Artificial Sequence: Synthetic coding sequence
atgtcctatcactacagactggatggtggttcgttagcaatcaatagcccgcatacagaccaagacattggaatgtaccagtgcctggccaccaacctactgggaacgatcttgtcacgaaaagctaaattacagttcgcatatatcgaagatttcgagactaagacgcggtctacagtgtcagtcagagaaggtcagggggtagtactcctttgtggccccccaccccattttggagatttatcctacgcctggaccttcaacgacaaccccttatacgttcaggaagacaaccgtcgattcgtttcacaggaaacaggtaatctgtacattgccaaggtagagcccagcgacgttggcaattacacctgctttattacgaacaaagaagcgcagcgaagcgttcaaggaccgcccacccctctggtgcagaggaccgatggtgtcatgggggagtatgaacccaagatcgaagtgaggtttcccgagactatacaggcagcgaaagactcatctgtgaagctcgagtgttttgccttgggtaaccccgtccccgacatttcctggagacgccttgatggatctccactcccgggtaaagttaagtactctaagagccaagcaattctggaaatcccaaatttccagcaggaggatgagggattctatgaatgcatcgccagtaatctccgtggccgaaatttggcgaaagggcagttaattttctatgcccccccagaatgggaacaaaaaattcagaatacacatttgtccatctatgacaatctcttgtgggagtgcaaagcatccggtaagcccaacccatggtacacctggttgaagaacggggaaagactcaatccagaggagaggatacagatagagaacggtaccctcatcattactatgttaaacgtgtcagactcaggtgtataccaatgcgctgcagagaataaatatcagattatctacgccaacgccgaactgcgggtcctggcctctgctccagacttcagtaagtcccctgtgaaaaagaagagtttcgtgcaggtggggggtgatatcgtgatcggatgtaaacctaatgccttcccacgagccgctatctcatggaagaggggtaccgaaactcttaggcaatccaaacgcatcttcttgcttgaggatggatccctcaaaatctataatataacacgcagcgacgcagggtcctacacctgtatcgcaaccaaccaattcggcaccgccaaaaacacagggtctctcatcgtgaaggagaggaccgtcatcaccgttccaccatccaagatggacgtcacagtcggggaaagcatcgtactaccttgtcaggttagccacgaccccagcatcgaggtagttttcgtatggttcttcaatggggacgttattgacctgaaaaaaggtgtcgcccattttgaacggattgggggtgaatcggtgggcgacttgatgatcagaaatattcagctccaccactctggcaaatatctgtgtaccgtgcagactactctggaatccttgtcagccgtggccgacattatagttcgcggcccacctggacctcctgaggacgtgcaggtggaagatatctccagtactactagccaactatcttggcgggcaggccccgataacaattccccaatacagatcttcaccatccagacacgaactcccttcagtgtgggctggcaggcggtcgccacagtgcccgagatcttaaacgggaagacctacaatgctacggtagtggggctttccccctgggtggaatacgaattccgtgttgttgctggcaactcaatcggcataggtgagccgtctgaaccctctgagctactgcgaaccaaagcctccgtgcccgtggtggcgcctgtaaacattcacggtggaggcggcagccggtctgaactggttatcacatgggagtccatcccagaagagctgcagaacggagaaggattcggctatattattatgtttcgtcccgttggttccacgacttggtcgaaagagaaggtatcctctgtcgagtcatcgcggtttgtgtaccgcaacgagtctatcatccccctctctcccttcgaagttaaggtgggcgtgtataataacgaaggtgaaggctcactgagcactgttactattgtgtacagcggagaagacgaaccccagctggcaccccggggaacatccttgcagtccttcagcgcatccgagatggaagtgtcgtggaatgcgatcgcttggaatcggaacacaggaagagtcctcggatatgaggttttatattggacagacgattctaaggagtctatgattggcaagataagagtgagtgggaatgtgactacgaagaatatcaccggcttgaaagccaacacaatatatttcgcctccgtgagagcatataataccgccggcactgggcccagcagtccccccgtcaacgtgacaaccaagaaaagtccaccaagtcaaccacccgcgaatatcgcttggaaattgacaaacagtaagttatgcctgaactgggagcatgtcaaaacaatggaaaatgagagcgaggttctggggtacaagattttgtaccgtcaaaacaggcagtcaaagactcacatccttgagacaaataacacctccgcggaactgctggtgcctttcgaggaggattacctcatcgaaatccggactgtaagtgacggcggcgatgggagtagctctgaagagattcgtatccccaaaatgtcatccttgtccagccgggggattcaatttctggagccctccactcacttcctgtcaatcgttatcgttatctttcactgcttcgctatccagccattgatctag

SEQ ID NO: 113008 - DNA, 3996 bp, Artificial Sequence
  Description of Artificial Sequence: Synthetic coding sequence
atgcaggcagcgccaagagcggggtgcggagcagccttactgctgtggattgttagttcctgcctatgccgcgcctggacagccccaagtacatcccaaaaatgcgatgagcctctggtgagcgggctgccacacgtggcattctccagtagttcgtccataagtggatcatattctcccggctatgccaaaatcaacaagcgcgggggtgcaggtggatggtctccatctgactctgatcactaccagtggcttcaggtcgacttcggaaacagaaagcaaatctccgccatcgccacacagggacgctactccagtagcgattgggtaacccagtatagaatgctctattctgacacagggcggaactggaaaccttatcaccaagacggtaacatttgggcctttcccggcaatatcaattccgatggcgttgtgcgccacgagcttcagcaccctattatagctagatatgtgcgcattgttcccctagattggaacggggagggacggataggcctccggatcgaggtctacggttgttcttattgggcggatgttataaattttgacggacatgttgttctcccttatcgctttaggaataagaagatgaaaacccttaaagacgtcatcgctctcaactttaaaacctccgaatctgaaggagttatcctgcacggcgagggacaacaaggcgactacatcacactcgagttaaagaaggcaaagctggtgctcagcctgaaccttggcagcaatcagctcgggccgatctatgggcatacctcagttatgactggctcattgcttgacgatcaccattggcacagcgttgtgatcgaacgccagggacgatcgattaacctgacgcttgaccgctccatgcaacacttcagaactaatggtgaatttgactatttagacttggactacgaaatcacttttggaggcattccattcagcggcaagccttcttcctcatcaaggaagaactttaaggggtgtatggagtctattaactacaacggcgttaatattaccgacctcgcccgcaggaagaagctcgaacccagcaatgtgggtaacctgtccttctcttgcgttgaaccctacactgttccagtattctttaatgccacttcttacctggaggtgccagggagactgaaccaggatctattctccgtgtcatttcaattccgcacatggaaccctaacggcttactggtattttctcatttcgctgacaatctagggaatgtcgaaattgacttgacagaatccaaggtaggcgtccacataaatatcactcagacgaagatgtctcagattgatatttcctcgggatctggtctgaacgacggtcagtggcatgaggtccggttcctggcaaaggagaattttgccatccttaccatcgacggtgacgaggcctccgcagtacgcaccaattcacctctgcaagtcaagacaggtgaaaagtacttctttggagggttcctcaaccagatgaacaacagtagccattctgtcctgcaacctagctttcaaggctgcatgcagttaatccaagtagatgaccaactcgtaaatctgtatgaagtggcgcagagaaagcctgggagctttgctaatgtgtctattgatatgtgtgccattatcgaccggtgcgttcccaaccactgcgaacacggagggaaatgctcccagacatgggacagctttaaatgtacttgtgacgaaacaggctactccggagccacttgtcacaactcaatctacgaaccaagctgcgaggcgtacaagcacctcggacagacatccaactattactggatcgatcctgatgggtccggcccgctgggccccctcaaggtctattgcaatatgaccgaggataaagtgtggaccattgtcagccacgacctgcaaatgcaaacacctgtggtgggctacaaccccgagaagtacagcgtcacacagctcgtgtatagcgcgagtatggatcaaatttccgcaataactgacagtgccgagtactgtgaacagtacgtatcttacttttgtaagatgtcccgcctcttgaacaccccagacggttccccatacacgtggtgggtcggaaaagccaacgaaaagcactactactggggaggatcaggccccggcatacagaagtgcgcctgcggcattgagcgcaactgtactgatcctaagtactattgtaactgcgacgcggattacaaacagtggcggaaagacgcaggctttctctcttataaagaccatctgccagttagtcaagtggtcgtcggtgacaccgacagacaaggtagcgaagccaagctgtctgtggggcccttgaggtgtcaaggcgataggaactactggaatgcggcctcttttcccaacccttcaagctatctgcatttctctacatttcagggggaaaccagcgctgacatttcgttttatttcaagaccctgaccccttggggtgtgttcctggagaacatgggcaaagaagacttcattaagctggaactcaagtccgctacggaagtgtcgttctcgttcgatgtcggaaatgggcctgttgagattgttgtccgcagtcccacgcctttgaacgatgaccagtggcatagagttaccgcagagcggaacgtcaaacaggccagcttgcaggtagaccggctgccccagcagattagaaaagcaccaacagaaggccacaccagactggaactctatagccaactctttgttggcggggccggaggtcagcagggcttcctagggtgtattaggtccctgagaatgaatggggtgacactggacctcgaagaacgggctaaggtcacctctggattcatttcgggatgttccggccactgtacatcttacggcaccaactgtgagaacggtgggaaatgtctggaacggtatcacggctattcttgtgactgcagcaacacagcatacgacggtacgttttgtaataaagacgtcggagcgttttttgaagagggcatgtggttaagatacaattttcaagcccctgccacgaacgcaagggatagctcttcccgtgtcgataacgcccccgaccagcagaatagccaccctgatcttgcccaggaagaaatcagattcagtttcagtaccactaaggccccatgtatcctgttatatatcagctcttttaccactgactttctagcggtgctcgtcaaaccaaccgggtcacttcagattagatataatctgggtggaaccagggagccgtacaacattgatgtagatcacagaaacatggcaaacgggcagccacattcggtgaatatcaccaggcacgagaaaactatttttctgaagctggatcattatccgagcgtgagctatcatctgcccagttcaagcgacactctttttaatagtcccaagtccctcttcctcgggaaggtcatcgaaacaggcaagatcgatcaggaaatccacaaatataatactcccggtttcacagggtgcctttctcgggttcaatttaaccaaattgcaccccttaaggccgcacttcgacagactaatgcctcagctcacgttcacattcagggagagctcgttgagagcaactgtggagccagtccgctcaccttgtcaccgatgagctcagcaaccgacccatggcacctcgatcacttggactccgcaagcgcggactttccttataacccgggccaggggcaggccatccgaaatggcgtgaaccgcaacagtgccatcataggcggtgtgatcgctgtggttattttcaccattctgtgcactctggtgtttctgatacggtacatgtttcgtcacaagggaacctaccatactaacgaagccaagggcgcagagtctgcagagtccgcagacgctgcaatcatgaataacgaccctaatttcaccgagaccatcgatgaaagtaaaaaagagtggctcatctag

SEQ ID NO: 113009 - DNA, 1173 bp, Artificial Sequence
  Description of Artificial Sequence: Synthetic coding sequence
atgaacggggtcaccctggaccttgaggagcgagcgaaggtaacaagcgggtttatatccggttgtagtggccattgcacttcttatggcactaattgcgaaaatggcgggaagtgcctcgaacggtaccacggttattcctgtgactgctcaaatactgcgtacgatggaaccttctgcaacaaagatgtcggagcattcttcgaagagggaatgtggctgcggtacaattttcaggcccctgccactaacgcgagggatagtagttcaagggtcgataacgcccccgatcagcagaactctcaccccgatctggcacaagaagaaatccgttttagcttctccacgactaaagccccctgtatcctgctgtatatctccagctttaccacggacttcctcgcggtgttagtgaaacctaccggaagtctgcagattcgttacaaccttggggggactcgcgagccctacaatattgacgtggaccacagaaatatggctaatgggcagcctcatagcgtaaatatcactagacacgaaaagaccatttttctgaaattggaccactacccgagcgtctcttaccacctgccgtctagttctgacacactctttaactcacccaaatccctgttcttggggaaagtcatcgaaacagggaaaattgaccaagagatacataaatacaacacaccagggtttaccggatgcctttctcgcgtacaattcaatcaaattgccccgctgaaagccgccctcagacaaactaatgccagtgcacatgttcacattcagggagagctggtggagagtaactgtggggcatcaccactgacattaagtcccatgagctcagcaaccgacccatggcacttggaccacctggacagtgctagcgcagatttcccatacaaccccggtcaggggcaggctatccggaatggcgtgaatcggaatagtgccatcattggaggggttattgctgtagtcatctttacaatcttatgtacacttgtcttcttaatccgttacatgttccggcataagggaacataccacacaaatgaagccaaaggcgcagagtccgcagaaagcgccgacgcggccattatgaacaatgatccaaactttactgagactatcgacgagagcaaaaaggaatggctaatttag

SEQ ID NO: 113010 - DNA, 1353 bp, Artificial Sequence
  Description of Artificial Sequence: Synthetic coding sequence
atgtctgatatggaggacgattttatgtgtgatgacgaagaagattacgacctcgagtactcagaagattccaactctgagcctaacgttgatttggaaaatcagtattataattcaaaggccctgaaagaagacgatcctaaggctgccctgtcttctttccaaaaagtattggagctcgagggcgaaaaaggggaatgggggttcaaagcactgaagcaaatgatcaagattaacttcaagctcacaaatttccctgaaatgatgaaccgctataagcagctattaacctacatccgctctgctgtgacgcgcaactattccgaaaaaagcatcaactccatcctcgattacatatcgacgagtaaacagaactcagactttctgtgccaaatggatctcctgcaagaattctacgaaaccacgctcgaggccctaaaagatgcgaagaacgaccggttgtggttcaagaccaacaccaaactgggcaagttatatctcgagcgtgaagaatatgggaagctccagaagattctccgccagcttcaccaaagctgtcagactgacgatggcgaggatgatctcaagaagggcacacagctgctggagatttacgcactggagatacaaatgtatacagctcaaaagaataacaaaaaactgaaggcactctatgaacagagtctgcatattaagagcgctattccgcaccctctgatcatgggagtgatccgagagtgtggcggcaaaatgcacttgcgcgagggcgagtttgagaaggcacacacagacttctttgaagctttcaagaattacgatgagagcggttcgcctaggagaaccacatgtcttaagtatctggtgttagctaacatgcttatgaagagtggtatcaaccctttcgattctcaagaggccaagccttacaaaaacgatccagaaattctcgctatgaccaatcttgtttccgcttaccagaacaacgatatcaccgagttcgagaagattcttaaaactaaccattcaaacattatggacgacccattcatcagggagcatattgaggagctcctcaggaacatacgcactcaagttttgataaaactgattaaaccctacaccagaatacacatcccctttatatcaaaggaactaaacatagatgttgcagacgtggagagcctgctcgttcagtgcatattagacaatacaatccacggacggattgaccaggtgaaccagctgctggaactcgatcatcagaaacggggtggtgctcgctacactgcgctggataagtggacaaaccagctcaacagcttgaatcaggcggttgtgtccaagcttgcatag

SEQ ID NO: 113011 - DNA, 1332 bp, Artificial Sequence
  Description of Artificial Sequence: Synthetic coding sequence
atgtccgatatggaggatgatttcatgtgtgatgatgaagaagactatgatcttgagtatagcgaggattcaaattcagaacctaacgtagacctggaaaaccagtactacaactccaaggccctgaaggaggatgacccaaaggccgccctgtcttctttccagaaggttctcgagctggaaggcgaaaagggtgaatggggattcaaggctctgaaacagatgatcaaaattaactttaagctcacaaactttccggaaatgatgaaccgctataagcagctgctgacttacatccgcagtgccgtcacgagaaactactctgagaagagcattaatagcatcctcgactacatctccacttcaaagcagatggacttgctgcaggaattctatgaaaccaccctcgaagccctgaaggatgccaagaatgacaggctctggttcaagacgaacacgaagctcgggaagctgtacctggagcgagaggaatatggcaagttgcagaaaattttgcggcagttgcaccagtcatgtcaaacagacgatggagaggacgacctgaagaagggcacccaactcctggagatctacgctctggagattcagatgtacaccgcacagaagaataataaaaagctcaaagctctttacgaacaaagtttgcatatcaagagtgccatccctcaccctctgatcatgggggttattagggagtgtggcggaaaaatgcatctaagggaaggggagtttgagaaggcgcacacggatttcttcgaggcattcaagaactacgatgagagtgggagtcctaggagaaccacttgcctgaagtacctggtcttagctaacatgctgatgaagagtggtattaaccccttcgatagtcaagaagccaagccgtataaaaacgatcccgagattctcgcaatgaccaacctagtttctgcataccagaacaacgatattacagaattcgagaagattcttaagacaaaccacagcaatatcatggacgaccccttcatccgagagcatatcgaagaattgcttaggaatatccgcactcaggtgctcattaagcttatcaagccctatacacgaattcacatcccatttatttcaaaggagctcaatatcgacgtggcagacgtggagtccctacttgtacagtgcattcttgacaataccatacacggcaggattgaccaggttaatcagctgctcgaattagatcaccaaaaaagaggaggggcaaggtataccgctcttgataagtggaccaatcagcttaattcacttaaccaagcagtcgtgagcaagctcgcctag

SEQ ID NO: 113012 - DNA, 1272 bp, Artificial Sequence
  Description of Artificial Sequence: Synthetic coding sequence
atggcgtctgcgcttgaacagttcgttaatagcgtgcgtcagctttctgcccagggacaaatgacgcagctctgcgagctcataaacaagtccggagagcttttggcaaaaaacctgagccatctcgacacagtcctgggagccctggacgtgcaggaacactccctgggtgtcctggcggttctcttcgtgaagttctcaatgcctagcgtccctgactttgagaccttattttcccaagtgcaactgtttatctctacctgcaacggcgagcacatccgttacgcaacagacacctttgctggattgtgccaccagctgactaacgcactcgtggagcgtaaacagccgttaagaggtattggtatcctaaagcaggctattgataaaatgcagatgaatacaaaccaactcacatccatacatgctgatctctgtcagctgtgtttactggctaagtgtttcaagccagcactgccctacctggatgtcgacatgatggacatctgcaaggagaacggagcctatgacgccaagcacttcctgtgttactattattatggggggatgatttatacagggctcaagaattttgaaagagccctatatttctatgaacaggccatcaccactccagccatggcagtgagccatattatgttagaatcttataaaaagtacattctggtgtcactcatcctcttgggaaaagtgcagcagctccctaagtatacctctcagatagtgggtagatttatcaaaccacttagtaacgcgtaccacgaactcgcacaggtttattccacaaataatccatctgagctaagaaacttagtgaacaagcacagcgagaccttcacaagagataacaacatggggctggtaaaacaatgcctgagctcgttatacaaaaagaatatccagcggttgactaaaacgtttctgacactctcactccaagatatggctagtcgggtgcagctctccggcccgcaggaagccgaaaagtatgtgcttcatatgatagaagacggcgaaatctttgcaagcattaaccagaaagacgggatggtgtcatttcatgacaatccagaaaagtataataacccagcaatgcttcataatatagaccaggagatgctgaaatgcatcgagttggatgagcgactaaaagcaatggatcaggagatcactgtaaatccccagtttgtacagaaatcaatggggtcacaggaggatgactctggaaacaagcctagttcctatagctag

SEQ ID NO: 113013 - DNA, 960 bp, Artificial Sequence
  Description of Artificial Sequence: Synthetic coding sequence
atggcctctgcgctcgagcaatttgtcaactctgttcgccagttaagcgcacaggggcaaatgacgcagttgtgcgaattaatcaataaaagtggtgaactgctggcaaaaaacctctcacacctcgacaccgtactcggcgcactggatgtgcaagaacattcccttggtgtacttgcagtcctgttcgtgaaattctcaatgccttcggtccccgatttcgaaacactcttctctcaagtccagctttttatttcaacttgtaacggggaacatattcgctacgcgaccgacacgttcgccggcctttgccaccaattgactaacgccctggttgagcgcaagcaacctctacgggggattggaattttgaaacaggccattgataagatgcagatgaacaccaaccaattaacctccatccacgccgacttgtgtcaactctgcctcttggcgaaatgcttcaagccagccctgccttatctggacgtggacatgatggatatctgtaaggaaaacggggcctacgacgcaaaacacttcctgtgctattactactatggggggatgatctacaccgggctaaagaatttcgagcgggctctctatttctatgagcaggctattaccactcctgccatggctgtatctcacataatgctcgaatcttacaagaaatacattctggtgagcctgatcctactcggaaaggtgcaacaactgcctaaatacacatctcagattgttggcaggttcattaaacgccagagcctcgccatgttggctcgattagtccttaattcgtggcctcaagctgttttgttgcgtctccctcccagggttcttgggttacaacccctctcaaatgcttaccacgagctggcacaggtctactcaacaaataatccttccgagctgcggaatctggtgaacaagcacagtgaaacttttactcgatag

SEQ ID NO: 113014 - DNA, 834 bp, Artificial Sequence
  Description of Artificial Sequence: Synthetic coding sequence
gcttcgcccttttgggttagctggctctacggctctcctctcccggccccccctctgccaggcggtgcccgttccggaacatgtgccccaattctcgttcttcagaacgcagctgaagctcttgcccgccagatgacacagctctgcgaactcattaacaaaagtggcgagctcctggcgaagaacctctcgcacctggacactgtccttggggccttggatgtacaagagcactcactcggcgtactggcagtcctgtttgttaagttctctatgccctccgtgccagacttcgagacactcttttcacaggtgcagctgtttatatcgacatgcaacggcgagcacattagatacgctactgacacttttgctgggctgtgccatcagctgacaaatgccttggttgaacgcaaacagcccctgagaggcattgggatcttaaagcaagccatcgataagatgcagatgaataccaaccagttgacatccatacatgcagacttgtgccagctgtgtttattggcaaaatgttttaagccggccttaccttacctggacgtggacatgatggatatctgtaaagagaacggcgcttacgatgctaagcacttcttgtgctactattactatggaggcatgatctataccgggctcaagaacttcgagcgcgcgctatacttttatgaacaggccatcaccaccccagccatggcagtgagtcacatcatgttagaaagttacaaaaaatatattctggtgtcgttaatcctactgggcaaagtgcaacaactgcccaaatacaccagccaaatcgttgggagattcatttag

SEQ ID NO: 113015 - DNA, 1212 bp, Artificial Sequence
  Description of Artificial Sequence: Synthetic coding sequence
atgacccaactctgcgagctcatcaacaaatctggggagctattggcgaaaaacctgtcacatttagacaccgttctcggcgcactggatgtgcaggagcattctttgggcgttctcgccgtattgtttgtgaaattctccatgccctccgtgcccgactttgaaactctcttttcacaggtgcagctcttcatctctacatgcaacggcgagcacatcaggtacgcgactgacacgttcgcagggctctgtcatcagctgaccaatgccctcgtggaacggaagcaacctctgagaggaatcggtattctgaaacaagctatcgacaaaatgcagatgaatacaaaccagctgaccagcatccatgctgacctatgccagctgtgtctactggcgaagtgtttcaaaccggctcttccctatctggacgtggatatgatggatatttgcaaagagaacggcgcatatgatgcgaaacatttcctatgttattactattatggcggcatgatctataccgggttaaagaatttcgaacgggccttatacttctacgagcaggccatcactactcccgccatggccgtgagccacattatgcttgagagctacaagaagtatatcctcgtttccttgatccttttgggcaaggtacagcagttaccaaagtatacaagccagattgttggacggttcataaagccgttgagcaacgcctaccacgagctggctcaggtatatagcacaaataacccttctgagctaaggaacttagttaataaacactctgagactttcaccagagacaataacatgggccttgtgaagcaatgcctgagcagcctgtataagaaaaatatccaaaggctgacgaaaacattcctgaccctgtcattacaagacatggcatcacgagtgcagctgtctggaccacaggaagcggagaaatacgttcttcacatgatagaggacggcgagatctttgccagcattaatcagaaagacgggatggtgagctttcatgataaccctgaaaaatataataacccggctatgctccacaacatagaccaggagatgctgaaatgcattgaactggatgaacggctgaaggccatggatcaggaaatcacagtgaatcctcagttcgttcagaagagtatggggtcccaggaggatgactccggcaataagccctcgtcctatagctag

SEQ ID NO: 113016 - DNA, 1614 bp, Artificial Sequence
  Description of Artificial Sequence: Synthetic coding sequence
atggctgctcagtgcgtgacaaaagttgctctcaacgtgtcgtgcgccaacctgctcgataaggatatcgggtccaagtcagaccctctttgtgtgctgttcttgaatacctccggccagcagtggtacgaggtcgagaggacagagcgaattaagaactgcctgaacccgcagttctcaaaaacattcatcattgattactacttcgaggtggtccagaaattaaaattcggggtttatgatattgacaataagacgatcgagctatcagacgatgacttccttggcgagtgtgagtgcaccttggggcagattgtgagctccaaaaaactgactagaccactggtcatgaaaacaggaagacctgcaggtaagggcagtatcaccatatcagccgaggagatcaaagataacagagtcgtgctgtttgagatggaggcccgcaaactggataataaagacctctttggcaaaagcgatccctacctggaatttcacaagcagacaagcgacggtaattggctgatggtacataggaccgaagtggtgaagaacaatttaaacccagtgtggcgaccctttaaaatttccttgaactctctgtgctacggggacatggacaagactatcaaagtcgagtgttatgattacgataatgatggcagccatgatcttatcggaacctttcagactaccatgacaaagttaaaggaggcctcacggagcagcccggtagaattcgagtgcatcaacgagaaaaagcgtcaaaaaaaaaaaagttacaagaacagcggcgtcatttccgttaaacagtgtgagataacagtagagtgcacatttttagattacattatgggcgggtgccaactgaactttacagtaggagtcgattttactggaagtaatggagatcctaggtccccagattctctgcactacatatccccgaatggtgtgaatgagtatctgaccgcactgtggagtgtaggtctggtgattcaagactacgatgcagacaagatgtttccagcctttggattcggggcccagatcccaccgcagtggcaggtctctcatgagttccctatgaacttcaacccgagcaatccctactgtaatggcatccagggtatagtggaagcttatagatcctgcctgccccagatcaagctttacgggcccaccaattttagtcctatcatcaaccacgtcgccaggtttgccgccgcagccactcagcagcagaccgctagtcagtactttgttctgttgattataactgacggagtgataacagaccttgacgagacccgtcaggcaatcgtgaacgcctctcgtctgcccatgtctatcatcattgtgggggtggggggggctgacttttcggcaatggaatttctggatggggatggcggctccctgagatcccccctgggagaggtagcgattcgagatatagttcagttcgtgcccttcagacagttccagaatgcgcctaaagaggcccttgcccagtgcgtgttggctgagatcccccagcaggtcgtgggctacttcaatacgtataagcttttacccccgaaaaacccagcaactaagcagcagaagcaatag

SEQ ID NO: 113017 - DNA, 420 bp, Artificial Sequence
  Description of Artificial Sequence: Synthetic coding sequence
atggcagcccaatgcgtcaccaaggttgcactaaatgtatcctgcgcaaatcttttggacaaggacatcgggtccaagtcagacccactatgtgtactcttcctgaacacaagcggccaacagtggtatgaggttgagaggactgaacgcattaaaaactgtctgaaccctcagtttagtaaaacgttcattattgactactactttgaagtggtgcaaaagcttaaattcggcgtttacgacattgataacaaaactatcgaactctccgacgatgatttcttaggggagtgcgagtgcactcttgggcagattgtgtcctctaaaaaactcacacgtccccttgtcatgaagaccggccgacccgccggaaaggggtccatcacaattagcgccgaggagattaaggataacaggtag

SEQ ID NO: 113018 - DNA, 30 bp, Artificial Sequence
  Description of Artificial Sequence: Synthetic coding sequence
atggcagcccaatgtgttaccaaggtgtag

SEQ ID NO: 113019 - DNA, 1614 bp, Artificial Sequence
  Description of Artificial Sequence: Synthetic coding sequence
atggccgctcagtgcgtcactaaggtcgctctgaacgtttcctgcgcgaacctgttagataaagacattggtagcaagtccgatcccctgtgtgtgttgttcctgaacacatcggggcagcaatggtatgaagtcgagcgcaccgaacgtattaagaattgcctgaatccgcagttttcaaaaaccttcatcattgactattattttgaagtcgtccagaaactgaagtttggggtctacgacattgataacaagacaatagagctctccgacgacgacttcctcggcgaatgtgagtgtaccctgggtcagatcgtgtctagtaagaaactgacaagaccgctggtgatgaagacaggcaggcccgcaggaaaaggttccattacaatctcagcggaagagattaaggacaatcgtgttgttctgttcgaaatggaggcacgaaaactggacaacaaagacctatttgggaagagcgatccctatttggaattccacaagcagacttccgacggcaattggcttatggtacaccggaccgaggttgttaaaaacaatttaaatcccgtgtggcggccatttaagatcagtctcaactcactctgctacggcgacatggacaagaccataaaggtcgagtgctatgattatgataacgatggttcacatgatctaatcggcacatttcagacgaccatgactaagttaaaggaggcttcccgcagcagccccgtcgaattcgaatgtatcaatgagaaaaagcgacagaagaaaaagagttacaagaatagcggcgttatttcagtcaaacagtgcgaaatcacagtggaatgtaccttcctggattatatcatggggggttgtcagctaaacttcaccgttggtgtggatttcaccgggagtaatggggacccacgcagtccagactcgctgcactacatttcaccaaatggtgtcaacgagtaccttacagccctgtggtcagtgggtctcgttattcaggattatgatgctgacaagatgttccccgcctttggattcggagcccagatcccccctcagtggcaagtctcgcatgagttcccaatgaattttaacccctctaacccatattgcaacggcatccaggggatcgtcgaggcttatcgttcctgcctgcctcagataaaactgtacgggccaacgaatttcagtcctattatcaaccacgttgcaaggttcgccgccgccgccactcagcagcaaactgctagtcaatactttgtcctactcattataactgatggggtcattacagacttagatgaaactcgccaggcgattgtgaatgcttctcgacttccaatgtccattataattgtgggtgtcggaggtgcagacttttctgccatggagtttttggacggagatggtggtagcctgagatctcccctaggtgaggttgctatcagagacatcgttcagtttgtgcccttccggcagttccagaacgcacccaaagaggctctcgcccagtgtgtgcttgcagaaatccctcagcaggttgtagggtattttaacacctacaaactgctcccccctaagaatccagccacaaagcaacagaagcagtag

SEQ ID NO: 113020 - DNA, 240 bp, Artificial Sequence
  Description of Artificial Sequence: Synthetic coding sequence
atggcagctcagtgtgtgaccaaagtggctctcaatgtctcttgtgctaatttactcgacaaggatataggctctaaatccgatcccctatgtgtgctctttctcaacacctccggccaacagtggtacgaagtggaaagaacggagaggatcaaaaattgcctgaacccacagttttctaagacctttataattgactactactttgaggtggtacagaagctcaaattcggggtctag

SEQ ID NO: 113021 - DNA, 408 bp, Artificial Sequence
  Description of Artificial Sequence: Synthetic coding sequence
atggccgcccaatgtgttactaaggtggcattgaacgtttcatgtgctaacctcctagacaaggacattgggtctaaatccgaccccttgtgcgtcctcttcctgaatacatccggacagcagtggtacgaggtggagcgaactgagaggatcaagaactgcctgaatccccagttctccaaaacattcatcatcgattactatttcgaagttgtacagaagttgaagttcggtgtatatgacatagataacaagaccattgagctatctgatgacgacttcctgggtgagtgtgagtgtactttgggccaaatcgtgtcttccaagaaactgacaagacccctcgtgatgaaaacaggacgcccagctggtaaaggttccatcaccatcagcgccgaagagatatag

SEQ ID NO: 113022 - DNA, 705 bp, Artificial Sequence
  Description of Artificial Sequence: Synthetic coding sequence
atggcggcccagtgcgtaaccaaagtagcgctaaatgtgtcttgcgctaacctgttagataaagacatcggtagtaaatcagatcccctgtgcgtgttgttcttgaatacctccgggcagcagtggtatgaggtggaacgaacagaacggatcaagaattgcctgaacccccagtttagcaaaactttcattattgactattacttcgaagtagtccaaaagctgaagtttggcgtttacgatattgacaacaagaccatagagctgtccgacgatgacttcctgggggaatgtgagtgtaccctggggcaaatcgtttcatctaaaaagctgaccagaccgctcgtgatgaagactggccgccctgccggcaagggcagcatcacaatctcagccgaggagattaaagataaccgcgtcgtactgttcgagatggaggctcggaagctggataacaaggatttattcggaaaatccgacccgtacctggagttccacaagcagacatcagacggcaattggctgatggtgcataggaccgaagtggtcaagaacaacctcaatcccgtctggcgtcctttcaagatcagcctaaactccctgtgctatggggacatggataaaactataaaggtggaatgctacgattatgataacgacggatcccacgatctgatcggcacctttcagacgacaatgacctag

SEQ ID NO: 113023 - DNA, 462 bp, Artificial Sequence
  Description of Artificial Sequence: Synthetic coding sequence
atggccgctcagtgcgtgaccaaggtcgcacttaatgtctcttgtgccaatctactggacaaggacataggatcaaagagcgatcctctttgtgttctgttcctgaatacctctggccagcaatggtacgaagtcgaacggacggagaggatcaagaattgtttgaacccgcaattttctaaaactttcatcatagattactattttgaagtggtgcaaaagttaaagtttggcgtctacgacattgataataagaccatcgagctatccgacgatgattttttgggtgagtgtgagtgcactctgggccagattgtgagttccaaaaaactcacccggcccctggtcatgaaaaccgggcgcccggccgggaaggggtctatcactatcagtgcagaggaaataaaagataacagggtagtcttatttgagatggaagcaagaaagctggataacaagtag

SEQ ID NO: 113024 - DNA, 1782 bp, Artificial Sequence
  Description of Artificial Sequence: Synthetic coding sequence
atggagcagccggaagacatggcttctctgtcggaattcgattcgttggctggcagtattcctgcgactaaagtagagatcacagtgtcatgccgaaacctgttggataaggacatgttcagcaaatcagaccccctctgcgtgatgtatacacaaggaatggagaacaagcaatggagagaattcgggcggactgaggtgatcgacaacaccctgaatccagacttcgtgaggaaattcattgtggactatttttttgaggaaaagcaaaacctgagattcgacttatacgatgtggactccaagtcccccgacctgagtaagcacgactttctgggccaggccttctgcacgctgggagagatcgttggaagtccaggtagccgcctggagaagccgctgacaattggcgcatttagcctgaattcccgcaccggcaaaccaatgccagctgtgtccaatggaggggtccccggtaagaagtgtggaaccattattctcagcgccgaggaattgtctaattgtcgcgatgttgccaccatgcagttctgtgctaataaattagacaaaaaggacttttttgggaagagtgatcctttcctagtcttctacaggagcaatgaggacggaacgtttacaatctgtcacaagacagaggttatgaaaaataccttaaacccagtttggcagactttttcaattcccgtgagggcattgtgtaatggggactatgatagaacaatcaaagtcgaggtttacgactgggacagagacggctcacacgacttcatcggcgagtttaccaccagctatagagaactggctcgagggcagtcccagtttaatatttatgaggtggttaaccccaagaaaaagatgaagaagaagaagtatgtcaatagcgggacggtgactctcctttcttttgccgtcgagagtgagtgcaccttcctcgattacattaagggtgggacacagatcaactttactgtggctattgacttcactgcaagtaatgggaacccaagtcaatcaacctctctccactacatgtctccatatcaactcaatgcctatgccctggctctgacagctgtgggggaaatcatccagcattacgatagtgataagatgtttcccgccctgggttttggagccaaactgcccccagatggacgtgtttcccatgagtttcctctgaacggcaatcaggagaatccatcatgttgtggaatcgatgggatcctggaggcctatcatcgctccctcagaactgtccagctgtatggccccacaaatttcgcacctgtggttacacatgtcgctcgaaacgccgccgccgtccaagatggttcccagtactcagttttgctgattatcaccgatggggtgatatcagatatggcacagaccaaggaagccattgtcaacgcagctaaattacccatgagcattataatcgtgggagtgggtcaagctgaatttgacgctatggttgaacttgacggggacgacgtgcgcatctcgtctagaggcaagttagctgagagggatatcgtccaatttgtcccttttagggactatgtggataggacgggcaaccatgtactgtcaatggctcgcctggcacgggacgtccttgcggaaatacctgaccagttggtttcttatatgaaagcacagggtatccggcccaggcccccccctgcagccccaacgcactctccgagccagtcccccgccaggaccccccccgcttcccctctccatacacatatctag

SEQ ID NO: 113025 - DNA, 906 bp, Artificial Sequence
  Description of Artificial Sequence: Synthetic coding sequence
atgaagaagaagaaatacgtcaactcaggaaccgttacgttactctccttcgccgtggagtcggagtgcacatttctggactacatcaaaggcggcacacaaattaatttcaccgttgccatcgattttaccgctagcaacggcaatcctagccagtccaccagcctgcactacatgtcaccttatcagttgaatgcatatgccctggccctcaccgccgtaggcgagattatacagcattatgatagcgacaaaatgttccctgctcttggctttggcgccaaactcccaccagacggcagagtgagccacgaatttcccctgaatggtaaccaggagaacccctcatgctgcggaatcgatggaatcttagaagcgtaccaccgaagcctccggacagtacagttgtacggacccaccaattttgccccggtcgtaactcacgtggcgcggaacgccgccgcggtgcaggacggatcccagtattcagttctgttgataatcaccgacggagtgatcagcgatatggctcagactaaggaggccatagtaaatgccgctaaactgcctatgtctattatcattgtgggcgtgggccaagctgagtttgacgccatggtggaactggatggcgatgacgtgagaatcagcagtcgtggtaagctcgctgaacgcgatattgtgcagtttgtacccttcagagattatgtggaccgtacaggcaaccacgtcctctctatggctcgcctggctagagacgttctcgccgagattccagaccaacttgtaagctatatgaaagcacaggggattaggccaaggccgcctcctgctgcacctacccattcaccatcccaaagtccagccaggacccccccggcaagtcccttacatacccacatctag

SEQ ID NO: 113026 - DNA, 1515 bp, Artificial Sequence
  Description of Artificial Sequence: Synthetic coding sequence
atggtgctcgccgacttgggccgcaaaattaccagtgctctgcgaagtctgagtaatgccaccataattaatgaggaagtgctgaacgcgatgctgaaggaagtatgtaccgctctgctggaagccgacgtgaatattaagttggttaagcagcttagagaaaacgtaaaatcggctattgaccttgaggagatggcttctggtctcaacaaacggaagatgattcagcatgccgtctttaaggagctcgttaaattggtggaccccggtgtgaaggcctggacacccaccaagggaaagcagaatgtcataatgtttgttggcctgcagggctccggcaaaaccactacctgtagtaagctcgcctattattatcagcggaaaggatggaaaacttgtctgatatgtgccgacacctttagggccggggctttcgaccagttaaaacagaatgctaccaaagcccgcatccccttctacggttcctacacggaaatggatccagtcattatcgccagtgagggcgttgaaaagtttaagaatgagaattttgagatcataatcgtggacacctctggccgacataagcaggaggacagcctgtttgaagaaatgcttcaggtggccaatgcaattcagcctgataacatcgtctatgtgatggacgcgagcattggacaggcgtgtgaagcccaggccaaggcattcaaggacaaagtcgacgtcgctagcgtcattgtgactaagttggacggtcatgctaagggaggaggcgccttgagcgcggtggctgcaacaaagtcgcccatcatttttattgggaccggtgagcatattgatgacttcgaaccttttaagacacaaccttttattagcaagcttctcggaatgggtgacattgaaggcttgattgacaaagtcaacgaactgaaattggatgacaatgaagcattgattgaaaaactgaaacatggccagttcaccctgcgcgatatgtacgagcagttccagaacatcatgaagatgggaccttttagccagattctgggcatgataccgggattcggaacggatttcatgagcaagggcaatgaacaagagtctatggccaggctcaaaaagcttatgaccatcatggactctatgaacgaccaggagcttgatagtacagacggtgccaaggtgtttagtaaacagccaggacggatccagcgggtcgcacgggggtccggcgtgagcaccagggacgtacaggaacttctcactcagtataccaagtttgctcagatggtgaaaaaaatgggcggtattaaaggactctttaaaggaggcgatatgagcaagaacgtcagccagagtcaaatggccaagctgaatcagcagatggccaaaatgatggatccgcgcgtactacaccatatgggcggaatggccggcctgcaatctatgatgcgacagttccagcaaggtgcagcaggtaacatgaaaggtatgatgggattcaataatatgtag

SEQ ID NO: 113027 - DNA, 1674 bp, Artificial Sequence
  Description of Artificial Sequence: Synthetic coding sequence
atgagcgaccccgagatgggctgggttccagagccgcctactatgactctcggggccagtagggtcgagttgagggtttcctgtcacgggctgctcgaccgcgacacccttacaaaaccacatccttgcgtgttgctcaagttatattctgacgagcagtgggtcgaggttgagcggaccgaagtactgcggtcatgctccagtccagtgttctcccgcgtgctggctctcgaatacttctttgaggaaaaacagcctctccagtttcacgtattcgatgcagaggacggcgccacatcgccaagaaatgacacatttctgggctcaacagagtgcaccctcggacagatcgtatcgcagaccaaggtgactaagccactgctgctgaagaatggaaagactgcaggaaagtccactatcaccattgttgccgaagaggtgtcgggaactaacgactacgtccagctcacattccgggcttataagctggacaataaagacctgttctcaaaaagcgacccattcatggagatctacaaaacgaacgaggaccaatccgaccaactggtctggagaacggaagtagttaagaataatctgaatccatcctgggagccttttaggctttcactccactccctctgctcctgcgacgtacataggcccctgaagttcctagtttatgactatgactccagcggaaaacatgatttcatcggtgaattcacatccacttttcaagagatgcaggaagggaccgccaacccgggacaggagatgcagtgggactgtatcaatcctaaatatcgggacaagaagaagaactacaaatctagcggaaccgtggtgttggcacaatgcactgtcgagaaagtgcatacctttttggattacatcatgggcggatgtcaaatttcctttaccgtcgccatagactttaccgcatcaaacggagatccgcggtccagccagtcattgcattgcctatcccctcggcaaccgaaccattacctgcaggcactgcgcgccgtgggtggaatatgccaagattatgatagtgacaaacggtttcccgcctttggctttggagcacgaatccctccgaatttcgaagtctcccacgattttgctatcaatttcgaccctgaaaacccggaatgcgaggagatcagtggggtgatcgcttcctacagacgctgcttgccccagatccagttgtatgggcctacaaatgtggcacccatcatcaaccgggtggcagaacccgcccagagggaacagtctaccggacaggcaaccaagtacagcgttttgctcgtgctgaccgatggcgttgtgagtgacatggcagagacgcgcactgctattgttcgagcctctcgcttgcctatgtccatcatcattgtaggcgttgggaacgcagacttctccgacatgcggctgctcgatggcgatgatggccctttgagatgtcccaggggggtgccggccgctagagatatagtgcaatttgtgcccttcagggatttcaaagacgccgcaccatcagctctcgcaaaatgtgtcttggcggaggtcccgagacaggtcgtcgagtattatgcaagccaagggatcagcccaggagcaccccgcccttgcacattggccaccacacctagcccatccccctag

SEQ ID NO: 113028 - DNA, 1839 bp, Artificial Sequence
  Description of Artificial Sequence: Synthetic coding sequence
atggcgtttaaagagcatggtaagatcactagttgctgtatccccggaccgattaattcctccagagcgggcgctggggctggcgcctccgggtggtcttcgaagggtgttagagctcgagcaagagagcccgagcgaggtgcgcccgaccgtgaaccgagcgatatgagcgaccctgaaatggggtgggtgccagaaccacccacaatgaccctgggggctagcagggtggagctgcgggttagttgtcatggattgctggatagagacaccctgacgaagcctcatccgtgcgttctgttgaaactgtattctgatgaacaatgggtggaagttgagagaacagaggtgctacggtcttgcagctcccccgtcttcagcagagtgctggccttagaatacttttttgaggagaaacagcctctacaattccacgtatttgacgctgaggacggggccacctcccccagaaacgacacgttcctgggatctacagaatgtactctggggcagattgtgagccagacaaaggtgacaaagccattactgctgaagaacggaaaaacagccgggaagtccaccatcacaatcgtagctgaagaagtgtctggcaccaacgactatgtgcaactcacattccgagcctacaaactagataacaaggacctgtttagcaaatctgacccatttatggagatatacaaaaccaacgaagatcagagcgatcagctcgtctggagaacagaagtagttaagaacaacttgaatccaagttgggaaccttttcgcctctcactgcacagcctgtgtagttgcgatgtgcacaggccactgaagtttcttgtttatgattatgactcttctggaaagcacgatttcatcggagagtttaccagtacattccaggagatgcaagaaggtaccgctaatccggggcaggaaatgcagtgggactgtattaatccaaagtaccgcgacaagaagaagaattataaaagttcaggcaccgttgtcctggctcagtgtactgtcgagaaggtgcacaccttcctagactatattatgggaggttgccagattagcttcacagtggcaatagacttcactgcttccaacggcgacccaaggtcctcccagtctttacactgcctttctccacggcagcctaaccattacctccaggccttacgggccgtaggaggtatttgccaagactatgattctgataagcggttccccgcgttcgggtttggtgctagaatcccgcccaactttgaggtgagccatgattttgcaatcaatttcgatcctgagaaccccgagtgtgaggagatatccggagtcatagcctcttacagaaggtgtttaccccagatccaattatatggcccgaccaacgtggccccaattataaaccgagtcgccgagccagcacaacgggagcagtctaccggacaggctaccaagtactccgtgctcctcgtccttacagacggcgtggtgtcagatatggccgaaacccgaacggccatcgtcagagcctcacgactccccatgtctatcatcatcgtgggagtcgggaatgctgactttagcgacatgcggcttctcgatggagatgatggccctctcaggtgcccaaggggggtcccggctgctagagacatcgttcagtttgtccccttcagggattttaaggacgcggcgccatctgcactggctaagtgcgtgctagctgaggtaccaaggcaagtggttgaatactacgccagtcaagggatctcccccggggctcctaggccgtgcacacttgccacaactccttccccgagcccgtag

SEQ ID NO: 113029 - DNA, 159 bp, Artificial Sequence
  Description of Artificial Sequence: Synthetic coding sequence
atgagcgatcctgagatggggtgggtgcctgagccccccaccatgacattgggagcaagccgtgttgaactacgggtcagctgccatggcctgttagaccgcgataccctgacaaaacctcatccttgcgttcttctgaagctctatagtgacgagtag

SEQ ID NO: 113030 - DNA, 396 bp, Artificial Sequence
  Description of Artificial Sequence: Synthetic coding sequence
atgtccgaccccgaaatgggttgggtccctgagccgcctacgatgaccttgggcgcaagtcgggttgagctgcgggtatcttgccacgggcttctggacagagacacactcactaaacctcacccatgcgtattgttgaaactgtacagcgacgaacagtgggtggaagtggagaggactgaagtgttgcggagttgcagttctccggtcttcagtcgggtgttggcattggagtattttttcgaggaaaaacagccattacagttccacgtcttcgacgctgaagatggagccacatcgccccgcaacgacacatttttggggagcaccgagtgcacccttggtcaaatcgtttcacaaaccaaagtgaccaaacctctactgctaaaaaattag

SEQ ID NO: 113031 - DNA, 681 bp, Artificial Sequence
  Description of Artificial Sequence: Synthetic coding sequence
atgtccgatccggaaatgggctgggtgccagagcctcctactatgaccctgggcgccagtagggttgaactccgggtgagttgtcacggccttctggatcgggataccctgacgaagccacacccatgcgtattgctgaagctctatagcgacgagcagtgggtagaggtggaacgcaccgaggtgctgagaagctgcagctctcctgtgttcagtcgggtgctagcccttgaatacttctttgaggagaaacagcctctccaattccacgtgttcgatgctgaggacggggcgacctcccctcgtaatgatactttcttagggtcaaccgagtgtactctgggccaaattgtaagccagaccaaggtgactaaaccgttgctgctgaaaaacggcaaaacagcaggaaagtccaccatcacaatagtggccgaagaggtctcagggaccaatgactacgtccagttgaccttcagggcctacaagctcgacaacaaggacctctttagtaaatctgaccccttcatggagatttataagacgaacgaggatcagagcgatcaactcgtatggcggacagaagtagtgaagaacaatttaaacccatcttgggagccgtttagattaagcttgcactctttatgctcctgtgacgttcaccgacccttgaagtttctgtag

SEQ ID NO: 113032 - DNA, 318 bp, Artificial Sequence
  Description of Artificial Sequence: Synthetic coding sequence
atgagcgatccagagatgggatgggttccagaaccaccaaccatgacattgggggcatctagagttgagctgcgagtttcctgccacggcctgctggaccgagacacattgacaaagccccacccttgcgtactgctgaaactgtacagcgatgaacagtgggttgaagtggagcggactgaagtactacgctcttgtagtagccccgtgttctcccgcgttcttgcactagagtacttttttgaggaaaagcaacctctgcaatttcacgtcttcgacgcagaagatggtgctacatccccacggaatgacacatag

SEQ ID NO: 113033 - DNA, 426 bp, Artificial Sequence
  Description of Artificial Sequence: Synthetic coding sequence
atgagtgatcccgagatgggttgggtgcctgagcctccaacaatgactctgggggcttcacgggttgagctgcgcgtgagctgccacggtctgttggatagggacacgcttactaagccccatccttgcgtgctgcttaaactctactcagacgaacagtgggtggaagtcgagaggaccgaggtgctaaggtcttgcagtagtcccgtcttcagcagagtgctcgccctggagtacttttttgaagaaaagcagccattgcaatttcatgtttttgacgcagaggacggtgcgacttctccccgtaatgacacctttctcggcagcactgaatgcacactgggccagatcgtgtcacagaccaaagtgactaaaccactgctgttaaaaaacggcaagaccgccgggaaatcgacaataacatag

SEQ ID NO: 113034 - DNA, 450 bp, Artificial Sequence
  Description of Artificial Sequence: Synthetic coding sequence
atgtctgatccagaaatggggtgggtccctgaacctcccacaatgaccctcggtgcctccagagtcgagctgagagtcagctgtcacggcctgctggacagagacaccttgactaagccccacccctgcgtgcttttgaaactctattccgatgaacaatgggtggaggtggaacggaccgaagtgctgcgctcatgttcatctcccgttttctcacgggtgctggcccttgagtactttttcgaagaaaagcagccgctgcaattccacgttttcgacgctgaagacggagctacttctccacgaaacgatacctttcttgggagcaccgagtgcaccctgggtcagatagtgtcccaaaccaaggttactaaaccgctgctgctgaagaatggcaagaccgccggcaagtctaccatcacaattgtggccgaggaggtgtctggttag

SEQ ID NO: 113035 - DNA, 1902 bp, Artificial Sequence
  Description of Artificial Sequence: Synthetic coding sequence
atgtcggcaggaagtgagaggggagccgcagccaccccaggagggctgcccgcaccgtgcgcatccaaagtcgagcttagactgagctgccggcacctgctggacagagaccccctgaccaaatccgacccatctgtggctttgctgcaacaggcccagggacagtgggtccaagtcggaaggaccgaagttgtgcggagtagcctccaccccgtttttagcaaggtgttcacagttgattattactttgaggaggtgcagagacttcggtttgaagtgtacgatacccacggaccaagtgggtttagctgccaagaggatgactttctgggaggaatggaatgtacgttgggccaacctgcgcagaagtggctactgcaggtggtaatgcgcgtatctgtggacgttctaggccctgcaggccattgtgctaagcacttcctatgttgtaccgagagttcacaccttgcccggactggtccatcctttctgcttaggtacgatgacttgtgccttccttgggctacagcgggagctgttcgctggtggacctgccgaggaggccacacccaaggttggcagattgtggcccagaagaaggtaacacgccccctgctgttaaagtttggtcgcaatgccgggaagtcaaccatcactgtgatagcagaggatatttcagggaacaacggatacgtggagctgagttttcgggcaaggaaactggatgataaggacttattttccaaatccgaccctttcttggaactgtatcgagttaacgatgatcagggcctccagctcgtttacaggactgaggtggtcaagaataacctcaatcccgtttgggaggccttcaaagtctcattgagtagcctgtgcagctgtgaggaaacacgtcctttgaaatgcttagtttgggactacgactctcggggcaaacatgactttattggcgaattcagcaccaccttcgaagaaatgcaaaaggcctttgaagagggacaggcccagtgggactgcgtgaacccgaaatacaaacagaaaaggagaagctacaagaacagcggcgtggtggttctggccgatttaaagtttcatcgcgtgtattcttttctggactacattatgggtgggtgccagatccacttcactgtggcaatcgatttcactgcctcgaatggcgaccccagaaacagttgctcgttacattacatcaacccataccagccaaatgagtatctcaaagcactagtatctgtgggtgagatttgccaagactacgattctgacaagaggttctcggcattgggattcggggctcggattccaccgaaatatgaggtgtcccacgactttgccatcaattttaatcctgaggatgacgagtgcgagggaatacagggcgtcgttgaagcataccagaattgtctgcccagagttcagctgtatgggccgaccaatgtagccccaatcatttccaaggtagcaagggtggccgctgcagaggagagcacggggaaggccagtcagtattacatcctacttatcctgacagatggcgtggtcacagatatggcagatacccgtgaggcaatcgtgcgcgcttctcgactcccaatgagtattattatcgtcggagttggaaacgccgattttacagacatgcaagtgcttgacggagacgacggggtgttgagatcccccagaggggagcccgcgctgcgcgacattgtccaatttgtgcccttcagggaattaaaaaatgctagtccggcagcgctggccaaatgtgttctggccgaggttccaaaacaggtggtcgaatactatagtcatcgggggttgcccccaagaagcctgggtgtccccgcaggagaggcatctccgggatgtacaccttag

SEQ ID NO: 113036 - DNA, 1677 bp, Artificial Sequence
  Description of Artificial Sequence: Synthetic coding sequence
atgtctgctggatcagagcgaggcgcagccgccacacctggaggtcttcccgctccttgtgcctccaaagtagagctcagattaagctgccgccacttattagaccgggaccctctgactaagagtgaccctagtgtggcattgcttcagcaggcccaggggcaatgggtgcaggtgggccgaaccgaagtagtaagaagcagcctacatcctgtgttttctaaagtattcaccgtggattattacttcgaggaggttcagcgccttaggtttgaggtgtatgacacacatgggccttcaggcttttcttgccaggaggatgacttcttgggtgggatggagtgcacactcgggcagatcgttgctcagaagaaagtgactcgacctcttctgctgaaattcggacggaacgccggcaaatcgacaattacggtgatcgcagaagacatatctggaaataatggttacgtggagctttcttttagggccagaaaacttgatgacaaggatttattcagcaaatcagaccctttcctcgaactttacagggtaaatgacgaccagggattgcagctggtatacagaactgaagtggtgaagaacaacctgaaccccgtttgggaggcctttaaggtatcactctcctccttgtgctcatgcgaagagacacgacctctaaagtgcttagtgtgggattacgattcccgtggaaaacacgatttcattggagagttcagtactaccttcgaagagatgcagaaagcgttcgaagagggacaggcccagtgggactgtgtgaacccaaagtacaagcagaaacgaaggtcctacaagaatagtggggtggtggtactggcagatctcaaatttcacagagtgtattcttttctggattacatcatgggtgggtgtcagattcatttcaccgtagctattgactttacagcctccaatggggatccccgtaacagctgttcactgcattacattaacccctatcaaccgaacgaatatttgaaggcattggttagtgtaggcgaaatctgccaggattacgactccgacaaaagattcagtgcattaggctttggagcgcggatacctcccaagtacgaggtgagccatgatttcgcgattaactttaacccggaggatgacgagtgcgagggaattcagggggtggtagaagcataccaaaactgtctccctcgagtgcagctgtacggaccaaccaacgtagccccgatcattagcaaagtcgcccgtgtggccgctgccgaggagagcaccgggaaggctagccagtattatatacttctgatcctgactgatggggttgttaccgacatggccgacactagggaagcaattgttcgcgcaagtcggttacccatgtcgatcattatcgtcggcgtggggaacgcagacttcacagatatgcaggtcctggacggcgacgatggagtgctgagatctcccagaggcgagccagcactgcgagatatcgtccagtttgtgccatttagagagctcaagaacgccagcccagcggctctggccaagtgcgtgctggcggaggtcccgaaacaagttgtcgagtattacagccaccgtggacttccgccaagatcgctcggcgtcccggcaggggaagccagtccagggtgcaccccttag

SEQ ID NO: 113037 - DNA, 825 bp, Artificial Sequence
  Description of Artificial Sequence: Synthetic coding sequence
atggccagtgattccggaaaccaggggacactgtgcaccctcgaatttgccgttcagatgacatgtcaaagttgcgtcgatgctgtgcgtaaatctctgcagggcgtggccggcgtgcaagatgttgaggtacatctggaggaccagatggtgctcgtacacactactctcccttcccaggaggtgcaggccctgctggaaggcaccgggcgacaagcggtgctcaagggcatgggctccgggcagcttcagaacctaggagccgccgtcgccatcctgggaggccctggaaccgtccaaggcgtcgtacggttcctccagctgacgccagaacgctgcttaatcgaagggacaattgatggccttgaaccaggtctgcatggtctccatgttcaccagtacggtgatctcacaaacaactgcaattcttgcggaaatcactttaatccagacggagcgagccatggcgggccccaggacagtgatagacacagaggtgatttaggcaacgtaagagccgatgctgacggaagggccatattccgtatggaggatgagcaattaaaggtctgggacgtgatcggacggtcccttattatcgacgaaggcgaggatgacttagggcgcggcggccatccgttgtccaaaatcaccggaaattctggagagcggttggcgtgtggtattattgcgcggtctgccggtctttttcaaaatcccaaacagatctgcagttgcgatggactcactatatgggaagagaggggaaggcctatcgctggcaaaggccgtaaagagtccgcacagccacccgcgcacctgtag

SEQ ID NO: 113038 - DNA, 1365 bp, Artificial Sequence
  Description of Artificial Sequence: Synthetic coding sequence
atggccctgcagctcggacgcttaagttccggtccttgttggctggtggcccgcggtgggtgtggggggcctcgtgcgtggtcacaatgcggggggggcggtttgcgcgcgtggagccagcgctcggcagctggtagggtttgtaggccaccgggtcctgccggcacagagcagtcacgcggtctggggcacgggagcacctcccggggagggccgtgggtcggaacaggcctggcagctgcactcgccggactcgtcggacttgccactgctgcattcggacacgtccagagagccgagatgctcccaaagactagtgggaccagagcaacctctctcggacggcctgaggaggaagaggatgaattggcccacaggtgttcttccttcatggctccccccgtgacggacttaggtgagctaaggaggcgtcctggggacatgaaaaccaagatggagctactgatcctcgagacccaagcccaggtatgtcaggccttggcccaagtggatggtggcgctaatttcagtgtagatcggtgggagcgtaaagaagggggaggcgggatttcctgtgtcttgcaggacggttgcgtgtttgagaaggccggagtgtcaatcagcgttgtacatgggaatctttcagaagaggccgccaaacaaatgcggtccagaggaaaggttctcaaaactaaagacggcaagctgcctttttgcgcaatgggtgtgtcctccgtgatccaccccaagaatccccacgctcccaccatccattttaactaccggtattttgaggtggaggaggcggacgggaacaagcagtggtggtttgggggagggtgcgacttgactcccacatacctcaaccaggaggatgccgtgcacttccacagaacattaaaggaagcatgtgatcagcacgggcctgacctctatccaaagtttaagaaatggtgcgacgattacttcttcatcgctcatagaggcgagagaagagggataggggggatattcttcgacgatctggattcgcccagcaaggaggaggtctttcgtttcgtgcaaagctgcgcccgcgcggttgtgccctcttatatccccctggtaaagaaacattgtgacgacagcttcaccccccaagaaaagttgtggcagcaactgaggcgtggccgctatgtggagttcaatctgctctacgaccgcgggaccaagttcggcctcttcactccaggcagccgcatagaaagtattctgatgtcactccccctaactgctcgttgggagtatatgcattcaccttccgaaaatagtaaagaggctgagattttggaggtgttacgccaccctcgggactgggtgcgttag

SEQ ID NO: 113039 - DNA, 1026 bp, Artificial Sequence
  Description of Artificial Sequence: Synthetic coding sequence
atgggcgtggcaactaccttgcaacctcccacgacctctaagaccttgcaaaagcaacacctagaggctgtgggagcttaccagtacgttttaaccttcctgtttatgggaccttttttctctttgctcgtttttgtgctgctgttcacaagcctctggcctttcagcgtgttttacctcgtgtggttatatgtggattgggatacccctaatcaaggtggccgccgcagcgagtggattaggaatcgcgccatctggagacagctccgcgactattaccccgtgaagctcgtgaaaaccgcggagctccctccggatagaaactatgtcctgggtgcacacccccatggtatcatgtgcactgggttcctctgtaactttagcaccgagagtaacggtttctcccagctcttccccggcctgcgaccctggctggccgtcttggccggattattctatcttccggtgtaccgcgattacattatgagctttggactgtgtccggtgtccaggcagtctttggactttatcctcagccagccacagttgggacaagcggtggtcattatggtaggcggcgctcacgaggccctgtattctgtgccaggagaacactgtctaaccctacagaagcgcaaggggtttgtccggcttgctctgcgccacggtgcatccctggttccagtttattcctttggtgagaatgatatcttcaggctaaaggcgtttgccactggctcctggcaacactggtgtcagctgacatttaagaaattgatgggcttcagcccctgcatattttggggacggggtctgtttagtgcaacctcctggggactgctgcctttcgctgtacccatcaccaccgttgtggggcggcccatccccgttccacagcggttgcaccctactgaagaagaggtcaatcattatcatgccctatatatgactgctctggaacagctgtttgaagaacacaaggaaagttgtggcgtaccagcttctacatgtcttacctttatctag

SEQ ID NO: 113040 - DNA, 930 bp, Artificial Sequence
  Description of Artificial Sequence: Synthetic coding sequence
atggctagcaaatcctggctcaatttcctgacattcctgtgtgggagtgctattggatttctgctatgctcgcagctctttagcatcctgctgggtgagaaggtggacacccagcccaacgtgctgcacaacgatccccacgcaagacactcggacgataacggtcagaaccatttagagggacaaatgaactttaatgcagacagtagtcagcacaaggacgagaacacagatattgctgaaaatctgtatcagaaagtgaggatcctctgttgggtgatgactggaccacaaaacctggagaagaaagccaaacacgttaaagccacatgggcccagagatgcaacaaagtactgttcatgagcagcgaggagaataaagattttccggccgttggactgaagaccaaagaggggcgggaccagttgtactggaagaccatcaaggcgttccagtacgttcatgaacactatctcgaggatgccgattggtttctcaaggccgatgacgatacctatgtcattctcgacaacctgcgatggctactgtctaagtatgaccccgaagagcctatatactttggccgacgctttaagccctatgtcaagcaagggtacatgagtggcggcgcgggctacgtcctctccaaagaggccctcaagaggttcgttgacgccttcaaaacagataaatgtactcactccagttcgattgaggatcttgcattggggcgatgtatggagatcatgaacgttgaagctggggatagtcgagacaccatcgggaaggagactttccacccctttgttcccgagcatcatctgatcaagggatatctgcctcgaactttctggtattggaattacaattattatccaccagttgaagtctcattagagattctactgttatgccaatacttagattag

SEQ ID NO: 113041 - DNA, 303 bp, Artificial Sequence
  Description of Artificial Sequence: Synthetic coding sequence
atggcatctaagagctggttaaatttcctcacattcctgtgtgggtccgccatcgggtttctgctatgttcacagctcttctctatattactgggagaaaaggtcgatactcagcccaatgttctgcataatgacccacacgctcggcactccgatgataatggccaaaaccacctggagggtcagatgaatttcaatgctgacagttcccagcacaaggacgaaaacactgacatcgcagagaacctgtatcagaaagtgaggattctgtgctgggtgatgaccgggccccagaatctctag

SEQ ID NO: 113042 - DNA, 396 bp, Artificial Sequence
  Description of Artificial Sequence: Synthetic coding sequence
atggctagcaagtcttggcttaatttcctgacgtttctgtgcggcagcgctattggctttctgttgtgcagtcagctcttcagcatcctgctgggggaaaaagtggacacccagcctaacgttctccacaacgatccgcacgcccgacattccgacgataacgggcaaaaccatctggagggtcagatgaactttaatgccgattcttcccaacacaaggacgaaaatacagatatagccgagaatttatatcagaaggttcgaatcttatgctgggtgatgaccggtccacagaatcttgaaaaaaaggctaagcatgtaaaagctacttgggcccagagatgtaacaaggtgctttttatgtccagtgaagagaataaggattttcctgcctag

SEQ ID NO: 113043 - DNA, 1092 bp, Artificial Sequence
  Description of Artificial Sequence: Synthetic coding sequence
atggcgagtaagagctggctgaactttttgaccttcctctgcggttccgcaatcggattccttctctgttctcagctgtttagcatcctccttggcgaaaaggtcgacacacagccaaatgtgctgcacaatgatcctcacgcacggcactctgatgataacgggcagaatcacctcgaaggacagatgaactttaatgcagatagcagccagcacaaggacgagaataccgatattgccgaaaacctgtaccagaaggtgaggattctgtgttgggtgatgacaggtcctcagaatctcgaaaagaaggccaagcacgtgaaggcgacctgggcccaacgatgtaataaagttcttttcatgtcctccgaggagaataaggactttccagctgtcgggctgaaaacgaaggaaggcagggaccagctctattggaaaactattaaagcctttcaatatgttcatgagcattacctggaagatgcggattggtttttaaaggccgacgatgatacatatgtcatcctcgacaacctgcgctggttactaagcaaatacgacccggaagaacccatctacttcggaagacgttttaaaccctatgtcaagcagggctatatgagcggcggtgcggggtacgtgctcagcaaagaggccctcaaacgcttcgtggacgcattcaagactgataagtgtactcactcctcgtctatagaagatctggcattaggccggtgcatggaaataatgaatgtggaggcgggcgattcaagagacacgatcggaaaggaaaccttccacccatttgtgccagagcaccatctgataaaagggtacctacctagaacattctggtactggaactataactattatccccccgtggaaggccctggctgttgttccgacctcgcggtgtctttccactacgtggatagtaccactatgtacgagctcgagtatctggtttaccatcttaggccgtacgggtacctctaccgctaccaaccaacccttcccgagcggattttgaaagagataagccaggcgaacaaaaatgaggacaccaaagtcaaattaggaaacccgtag

SEQ ID NO: 113044 - DNA, 549 bp, Artificial Sequence
  Description of Artificial Sequence: Synthetic coding sequence
atgccacgggtcgtgccagaccaaaggagcaaattcgagaacgaagaattttttcggaaattgtcacgcgagtgtgagattaaatatacgggattcagagaccggccccatgaggagagacaagccagattccagaacgcatgtagggatggccgtagcgagatcgcattcgtggctaccggaacaaacctgagcttgcagttctttcctgctagttggcagggagagcagagacagaccccatcacgcgaatacgttgatctggagagagaagctggcaaggtctatcttaaagcacctatgatcctcaacggcgtctgtgttatatggaaaggctggattgatctgcaacggctcgatggtatggggtgcttggagtttgatgaagagcgggcacagcaggaggacgctctggcgcaacaagcctttgaagaagcacgaaggcggactcgggaattcgaagatagggacagaagccacagagaggagatggaagtcagagtctcacagttgctcgcggttaccggcaagaaaactactagaccttag

SEQ ID NO: 113045 - DNA, 564 bp, Artificial Sequence
  Description of Artificial Sequence: Synthetic coding sequence
atgccccgggtggtgcccgaccaacgctcaaagttcgagaatgaagaatttttccgcaaacttagcagggagtgcgagattaagtacacaggattccgagatagaccacacgaggaaaggcaggccaggttccagaatgcctgccgggacggaaggtctgaaattgcttttgtagcgactggtacgaatttatctttgcagttctttccggcctcgtggcagggagaacaacgtcagacaccatccagagagtacgtggatctcgagcgagaggccggcaaagtgtatctgaaggcacccatgatcttgaatggcgtgtgcgtgatttggaaaggatggatcgatttgcagcggctcgacggaatggggtgtctggagttcgacgaggagcgcgcacagcaggaagatgcgctcgcccagcaagcctttgaggaggcccgccgaagaacacgggagttcgaggaccgcgacaggagtcaccgcgaggagatggaggccagacgccagcaagatccatctccgggctccaaccttgggggcggggacgacctgaagttgcgatag

SEQ ID NO: 113046 - DNA, 1788 bp, Artificial Sequence
  Description of Artificial Sequence: Synthetic coding sequence
atggtcggggtgccaggcgccgcagccttccagctgggccctgagaagagagtgccagctatgcccggctctcctgtagaggtgaaaatccaaagtcgcagtagccccccgaccatgccaccccttccccccatcaaccctggtggcccccgacccgtgtccttcacgcccaccgccctgtccaatggtatcaaccatagccctcctactctgaacggcgctccttctccaccacaacggttcagcaatggacctgctagctccacctcctcagctcttacaaaccagcagttgcccgctacatgcggtgcgcgccagttgtctaaactgaaaagatttcttaccacactgcaacagtttgggaatgatatctctcctgagataggcgaaaaggtccgcacactagttctcgctcttgtcaactcaaccgtgacaatagaggagtttcattgcaaactacaagaggccacgaactttccccttaggccctttgtgatccctttcctcaaagctaacctgccccttctacaacgtgaacttttgcattgcgctagggctgccaagcagaccccatcacagtatcttgctcaacatgaacacttgctgttaaatactagcattgcatctccagctgatagctcagagctgctaatggaggtgcatgggaatggcaagaggccctcacccgaaaggcgggaggagaattctttcgaccgggacaccatagctcccgagcctcccgcaaagcgagtctgcaccatcagcccagcccctcgccactcccctgcactgacagtgccattaatgaaccccggtgggcagttccaccctacacccccacctctgcagcactacacactggaagatatagccacctcacacctgtatagggagcctaataaaatgctcgaacaccgagaggtgagagatagacaccattccttaggtttgaatggcggataccaggacgagcttgtcgaccacagacttacagagagagagtgggcagacgaatggaagcatttggatcatgcactgaactgtattatggaaatggtggagaagaccaggagatccatggccgtcttacgaagatgtcaagagagcgaccgagaggagcttaactactggaagcgacgatataacgagaacaccgaactccggaaaacgggtactgaactagtgtcgcggcaacattcgccaggcagcgcagactccttatccaacgatagtcaaagggagtttaatagcagaccagggaccggatacgtaccagtggagttctggaagaaaaccgaggaggctgtcaacaaagttaagatccaagctatgagtgaggtgcagaaagcggttgccgaggccgagcagaaggccttcgaggtcatagccaccgaacgtgcccgcatggaacagacgatagctgacgtcaaacggcaggccgccgaagacgcgtttctggtgatcaacgaacaagaggaaagcacagagaactgctggaattgtgggcggaaggcctccgagacttgttcagggtgcaatattgcaaggtattgcgggtccttctgtcaacacaaagattgggagaggcatcataggctgtgcggacagaaccttcatggacagagccctcacggccagggtaggcccctgttgcctgtcggacgaggcagctcggcccgaagtgcagattgttcagtgccttcaccggccctggataagacgagcgccaccacctctcgttcatccactcccgcctcagtgaccgccatcgataccaatggcctgtag

SEQ ID NO: 113047 - DNA, 1815 bp, Artificial Sequence
  Description of Artificial Sequence: Synthetic coding sequence
atggccaaggagtccgggatatccttaaaggagatccaagtcttagctcggcagtggaaggttgggccagaaaaacgagtgcctgctatgccaggtagccccgttgaggtcaagattcagtctagatccagtcccccaaccatgcctcctctgcctccaattaatccaggggggccccggcctgtgagttttactcccaccgcgctgtccaacggcattaaccactctccgcccaccctcaatggggcgccatccccccctcagaggttcagcaatggccccgcatcttccacgagtagtgcactcacaaaccaacagctgcccgcaacgtgcggagctcgccaactgagcaagttaaagcgctttctgactaccctgcaacaatttggtaatgatatctcccctgagattggggagaaagtgcgcactctggtgctcgctttggtgaatagcacggtgacaatcgaagagtttcactgcaagctgcaggaagctaccaacttcccactgaggccctttgtaattccatttttgaaggcgaaccttcccttgttacagcgggagctacttcactgcgctagggccgcgaaacagacgccttcacagtacctggcacaacatgaacacctgttactgaacacatcaattgcctctcccgccgactcctccgaattactgatggaagtccatggaaacggcaagcgtcccagtccagagcgaagagaggaaaattccttcgacagggataccattgccccagagcccccagccaagcgcgtatgtacaatatctccagcccccagacattctcctgccttgacagtacccttaatgaatccgggagggcagttccatccaactcctccaccattacagcactacacattggaggacattgccacttctcacctctatagggaaccaaacaagatgctcgaacaccgcgaggtgcgggaccgccaccattctctgggcctaaacggcggttatcaagacgaattggtggaccaccggctgaccgaaagggaatgggcagacgagtggaagcacttggaccatgcattgaactgcattatggaaatggttgagaagactcgacgaagcatggccgtgctgaggaggtgccaggagtctgaccgggaggagcttaactactggaaaagaaggtacaacgagaataccgagctgcgtaagacgggaactgagcttgtttcccggcaacacagtcccggttcagcagacagcctgtctaacgatagtcaaagggaattcaactcacgacccgggactggctacgttcctgtcgagttctggaagaagaccgaagaagcagtgaacaaggtaaaaattcaagccatgagcgaagtccagaaggcagtggccgaagccgagcaaaaagcgtttgaagtgattgcgaccgagcgggctaggatggagcaaaccatagcggatgttaagagacaggcggccgaagacgcgttcctcgtcattaacgagcaggaggaatcaactgagaattgttggaattgtgggcggaaggccagtgaaacttgtagcggatgcaacatcgctagatattgcggtagcttttgtcagcataaggattgggaacggcaccacagattatgcggacaaaaccttcacgggcaatctcctcatggccagggacgccccctacttcccgtggggcgcggctcatccgcaaggtctgctgattgcagcgtgccttcacctgccctcgataagacgtcagcaacaacgagccgatcaagcacgccggcttctgtgactgcgatcgacaccaatggcctgtag

SEQ ID NO: 113048 - DNA, 1815 bp, Artificial Sequence
  Description of Artificial Sequence: Synthetic coding sequence
atggccaaagagtctggaatttcactaaaagaaatccaggtccttgctcgtcagtggaaagtagggcctgagaaaagggtcccagccatgccggggagtcctgtcgaggtcaaaattcagtctcggtcatcccccccgacgatgcctccgctcccaccaataaatcctggaggcccaagacccgtgagtttcacacccaccgccttatctaatgggattaatcactctccacctaccttaaacggggcgccatcgcccccccagcggtttagcaatggccccgcgagttccacaagtagcgcactgactaatcaacagctgcccgcgacgtgtggcgcccggcaattgagtaagttaaagaggtttctgactactctgcagcagttcggcaacgacatttcccctgagattggcgaaaaagtgcgaaccctggttctggcactggtaaattccacggtcacgattgaggagtttcattgtaaactgcaagaagcaaccaacttccctctgagaccctttgtcattccattcctgaaggcaaatctcccattgttgcagagagaactgctccactgcgctagagcagcgaagcagaccccatctcagtatctagcccaacatgaacacctgttactcaacacctccatagcaagccctgcggactcctccgagctgctgatggaagtccacggcaacggtaaaaggccaagtcctgagaggagagaggagaacagctttgatagggatacgattgctcccgagcctcccgctaaaagagtttgtaccattagtccagcgcctcggcattccccagctcttacagtcccactgatgaacccaggaggccagttccatcctaccccacccccactgcagcattataccctggaagatatcgcaacttcgcatctatatcgggaaccgaacaagatgttggagcaccgcgaagtgagagaccgacaccatagcctgggtctcaacggtgggtaccaggacgagttagtcgatcaccgcctgacggagcgagaatgggccgacgaatggaagcatctggaccacgcgctgaactgcatcatggagatggtagaaaaaacccgccggtccatggccgtcttgaggagatgccaggaatccgaccgagaagaactgaattattggaagcggcggtacaatgagaacactgagttgcggaagaccgggacggagctggtatcaaggcaacactcacctggctccgcagatagcctttccaacgactctcagagggagttcaatagccggccggggacgggttacgtgcccgtggagttctggaaaaaaacagaagaagcagtgaataaagtcaagatccaggccatgtccgaggtccagaaggcagtcgccgaggctgagcaaaaggctttcgaggtgatcgcaacggaacgtgcccggatggagcagacaatagccgatgtaaagaggcaggctgcggaggatgctttcttggttattaacgagcaggaggaatctaccgaaaattgctggaattgcggacgtaaggccagcgaaacttgctcaggctgtaacatagctagatactgcggctctttctgtcagcacaaggactgggaacgccaccatcgcctctgcggtcaaaatctgcatggccaatctcctcacgggcaagggcggcccctcctaccagtcgggcggggctcctccgcccgttccgctgactgttcggtgccatctccagcacttgacaaaacgtctgcaacaacgtctagaagctctacccctgcatcggtgactgccattgacacaaatggtttgtag

SEQ ID NO: 113049 - DNA, 792 bp, Artificial Sequence
  Description of Artificial Sequence: Synthetic coding sequence
atgccgggcagtcccgtagaggtgaagatccagagtagaagcagtccccccactatgcctccactgccacccattaatccaggcggcccacggccagtgtcttttacccccactgccttgtccaacgggattaatcatagtcctcccactttgaacggcgcaccctcacccccccaacgcttcagcaacggacctgccagttccacctcttctgctctaactaaccagcagttgccggctacttgtggcgcccggcaattgagcaagctcaagcggtttctgacaacacttcagcaattcggtaacgacattagccccgaaattggcgagaaagtgcgtacccttgtccttgcgcttgtgaatagcaccgtgaccatcgaggagtttcactgcaagttgcaggaagcaactaactttccactgaggccctttgtgatcccattcctaaaggcaaacctcccgttgctgcagcgagagctgttgcactgcgcgagagctgccaagcaaactcctagccagtatctcgcgcagcacgagcacctgctgttgaataccagtatcgcgtccccagccgatagtagcgaactcctgatggaggtccatggcaatgggaaaaggccaagcccggagagttgcatcattcacctcaaaagtatgggcgtagcatccagacacgagtacttttccgggacccttcagatgccggcccaccctgttagaaattctactcttgaaaatttgtgggttgactgttcccgatccctgcggtcaactgtgcttccgttcccttag

SEQ ID NO: 113050 - DNA, 1728 bp, Artificial Sequence
  Description of Artificial Sequence: Synthetic coding sequence
atgccaggctcccctgttgaggtcaagatccagtctagaagttccccaccaacaatgcctcctcttcctccaattaaccccggcgggccacgtccagtgtccttcactcctaccgctctgagcaacgggatcaaccacagcccccccaccttgaatggggccccctctcctcctcagcgatttagcaacggacctgcaagctctacatcttccgcattaactaatcagcagctgccagccacctgcggcgccaggcagctctctaagctaaagcggtttctcacaactctgcagcagttcggaaatgacatctcgcccgaaataggcgaaaaagttcggacactggtcctggctctcgtgaactctactgtgaccatagaggaatttcactgcaagctgcaagaggcaaccaattttcctctccgcccctttgtgatcccattccttaaggccaacctccctctattacagagagagctcctacattgcgcgagagccgccaagcagaccccctctcagtatttggcccagcacgaacacctgttgcttaatacttcaatcgcttccccagcagattcttcagaactattgatggaggtgcacggcaatggaaaaaggccgtcccccgagaggagagaagaaaatagtttcgatagagataccatagcaccagagcctccagccaaaagagtgtgtacgatcagtccagcccctaggcactcaccggctctaaccgtaccattgatgaaccccggaggacagtttcaccctaccccaccacccctgcaacactataccctggaggacattgcaacaagtcatctctatagggaacctaataagatgttagaacaccgcgaggtaagagatcggcaccacagcctaggactgaatggaggctaccaggacgaactggtggatcatagattaactgaacgggaatgggctgatgaatggaaacatttagaccacgcactgaactgcattatggagatggtggaaaagacccgcagatctatggcagtattgaggaggtgtcaagagtctgacagggaggagctgaactactggaagagaaggtataacgaaaatactgagttaaggaaaacaggcacggaattggtctctcgacagcactccccaggttccgccgattctctcagtaatgactcacagcgcgagttcaactctaggccaggtacaggctacgtaccagttgaattctggaaaaaaactgaagaggcggtgaataaggtcaaaattcaagctatgagcgaggttcagaaggctgtcgccgaagccgaacagaaggcctttgaagtgatcgcgactgagcgggcccgtatggaacaaactatcgctgacgttaagaggcaagcagcagaagacgctttcttggtgataaacgaacaagaggagtcaactgagaactgctggaattgcggtcgcaaagcatccgaaacttgctctggctgcaacattgcccggtattgtgggagtttttgccagcataaggactgggaacggcatcatcgtctttgcggacaaaatcttcacggacagagtccacacgggcagggacgccccttgctccccgtgggaagaggctccagtgcccggtcagcagactgttcagtgccaagcccggctctggacaagaccagcgccactacatcacgttcgagcactcccgccagcgtaaccgccattgatactaacggcctgtag

SEQ ID NO: 113051 - DNA, 1137 bp, Artificial Sequence
  Description of Artificial Sequence: Synthetic coding sequence
atggaggtacacggcaacggcaagcgaccgtccccggaaagacgtgaggaaaattccttcgaccgggataccatcgccccggaaccacctgccaaaagagtgtgcactatcagtccagcaccgcgccactccccagcactgaccgtccccctgatgaaccctggcggccagtttcacccaaccccacccccactccagcattacacacttgaagatattgctacctcacacctttaccgcgaacccaataagatgctggagcaccgcgaggtgcgtgaccgacaccactctctggggcttaacggagggtatcaggatgagttggtggaccatagactgactgaacgcgagtgggcagacgaatggaagcatctggatcatgccctgaattgcataatggaaatggtggagaaaacacgcagaagcatggctgtgctgagacgctgccaggagagcgatagggaggagttgaattactggaagcggcgctacaacgagaatacggaattaagaaaaactgggactgagcttgtgagtcggcagcatagtcctggctcagcagatagtctgtcaaatgattctcaacgagaatttaatagccggcctggaacaggttacgtccccgtggaattctggaagaagaccgaggaggccgtgaataaggtgaaaattcaagctatgagcgaggtacagaaggctgttgctgaagcagaacagaaagcctttgaagtcatcgctaccgagcgtgcaaggatggaacagaccattgctgatgtcaaacgacaggcggctgaggacgcctttctggtaatcaacgagcaggaagaatcaaccgagaactgctggaactgcggaagaaaggcgtcagagacgtgtagtggctgcaatattgcacggtattgtggctctttctgtcaacataaggactgggagcgacatcaccgcctctgtggacagaatctccatggccaaagcccccatggacaggggcgccctctgctgcctgtaggacggggctcttccgctaggtcagcagattgctccgtgccatctccggcactcgacaagaccagcgccactacgtctaggtctagcacaccagcatcggtgactgcaatcgacaccaatgggctgtag

SEQ ID NO: 113052 - DNA, 546 bp, Artificial Sequence
  Description of Artificial Sequence: Synthetic coding sequence
atggtgggggtgcccggtgcagcagcgttccagctggggcctgagaagcgagttccggccatgcctgggagccctgtagaagtaaaaatacagagtagatcatctcctcccacaatgcctcctttgccaccgataaaccccggtggcccacggcccgtttcttttacgcccaccgcgcttagcaatggcatcaatcactctccccctacgctgaatggcgcgccgagtccgccccaacgctttagcaatggtccagctagctccactagcagcgccttaaccaaccaacagctgcctgctacatgcggagcacggcagctttcaaaactcaagcgttttttaacgaccctccaacagttcggaaacgacattagccctgagattggagaaaaggtaaggaccctggttctggctctggtgaatagcaccgtcaccattgaggagtttcactgtaaattgcaagaagctacgaacttccctcttcgccctttcgtcattccattcctgaaagctaacctcccacttctgcaacgcgagctactctag

SEQ ID NO: 113053 - DNA, 243 bp, Artificial Sequence
  Description of Artificial Sequence: Synthetic coding sequence
atggccaaagagtccggcatatcactcaaggagatacaggtcctggcaagacagtggaaggtcggccctgagaaaagggtgcccgcaatgccaggaagcccggtggaggttaagattcaatctcgatccagccctcctaccatgccaccgctgcctcccattaacccaggtggcccgcgacctgtcagcttcaccccgaccgccctcagcaacggtataaatcattcacctcctacactctag

SEQ ID NO: 113054 - DNA, 459 bp, Artificial Sequence
  Description of Artificial Sequence: Synthetic coding sequence
atgagcgaggtgcagaaggctgtcgccgaagcggagcagaaggcttttgaggtgattgccactgagcgagccaggatggagcaaactatcgctgacgttaagcggcaagccgcagaggacgcatttttagtcataaacgaacaggaggagagcactgagaactgttggaactgcggtcgcaaggccagcgaaacgtgtagcggctgtaatattgcacggtattgcggcagtttctgtcaacacaaggactgggagagacatcatagactgtgcggtcagaacctgcacggccagtctccacatggccaagggcgcccgcttctgccggtggggagggggagtagcgctcgatcggctgactgctcggtcccttcacccgccctcgacaagacatcagccactacgtcaaggagttccactccagcatccgtaaccgctatcgatacaaacgggttatag

SEQ ID NO: 113055 - DNA, 1962 bp, Artificial Sequence
  Description of Artificial Sequence: Synthetic coding sequence
atgcctgcctctcggctgcgagatagagctgcttcctctgcttccgggagcacatgcgggagcatgtctcagactcaccctgtgctcgagtctggcttgttagcatcggcaggctgctccgccccaaggggtccccggaaaggaggccctgcacccgtcgacaggaaagcaaaagcatctgcgatgcccgactctccagctgaggtgaaaacacagccccgaagcaccccaccatccatgccccctcccccccccgcggcgtcccaaggcgctacacgacctccctccttcacccctcacacacaccgggaggatgggccggccactctcccacatggtcggttccatggatgtttgaaatggtcaatggtgtgtctgctcatgaacggaagtagccattctcccacagctataaatggtgccccttgcacgccaaacggcttttctaacggccctgcaacatctagcaccgcatccctaagtactcagcacctgccgcctgcgtgcggtgccagacaactgtcaaaactgaagcgctttctgacaacccttcagcagtttgggagtgacatttcacctgaaataggggaacgtgtccggacgctcgtcctgggccttgtcaatagcaccttaacaattgaggaatttcacagcaagctccaggaggcaaccaatttcccgcttcgcccatttgtcatccccttcctaaaggccaatctgcccttgcttcagagggaactgcttcactgcgcgcgcctggccaagcagacaccagctcaatacctggcccagcacgaacagctgttgttggacgcctccgcctcctctcccatcgacagcagtgagttgctccttgaggttaacgaaaatggaaagagacgcacgcccgacagaacaaaagaaaatgggagcgacagagaccctttgcaccccgagcacttgtctaagagaccttgtacgctgaacccagcacagcggtactccccctctaatggaccaccccagccgaccccccccccccactaccggctcgaggatattgctatggcacaccacttccgcgacgcatatcgacaccctgacccgcgggaactgcgtgagcgtcaccgaccgctagtggtgcctggatctcgccaggaggaggttatcgatcacaaactgaccgaacgcgagtgggctgaggagtggaagcatctgaataacttattgaactgcataatggatatggtggaaaagacacgccgaagcttgacagtgctccgccgctgtcaggaggcagacagagaagaactaaaccattgggcccgccgatatagcgatgctgaagacacaaaaaaaggacctgcccccgcagccgcccggcctaggtcatcctcagcaggcccagaaggcccacaactggacgtgcctagagaattcctgccccgaaccctgacaggctatgtgcccgaggacatctggcggaaggccgaagaagccgttaatgaggtgaaaaggcaggcaatgtctgagcttcagaaagctgtgtctgatgcagagcggaaagcccacgagctgatcacaacggaacgcgccaagatggaacgggccctggctgaggccaaacgccaggcttcagaagatgcactgacggtgattaatcagcaggaggatagcagcgagtcgtgttggaactgtggacggaaagcaagtgagacctgttccggctgcaacgccgccaggtactgtggttctttttgtcagcaccgggactgggagaagcaccatcacgtgtgcggccaatccctgcagggcccaaccgcagtcgtggcagacccagtcccagggccgccggaagcagctcactctctggggccttctctgccagtgggagctgccagtccatctgaggccggctccgctgggccttctcggccggggagtccctccccgccggggccccttgacacagtgcctcggtag

SEQ ID NO: 113056 - DNA, 1704 bp, Artificial Sequence
  Description of Artificial Sequence: Synthetic coding sequence
atgccagattcgccagctgaagtcaagactcagcccaggagtactccgccctccatgccacccccaccgcccgccgcgtcccagggtgctactaggcccccctccttcacaccccacaccctgatgaacgggagctctcactcacctaccgcaattaacggggcgccttgcaccccaaacggattctccaatggtccagcgacctcttccacagcctccctttcaacccagcatcttccacctgcctgtggcgccagacagctgtcgaaactcaagaggttccttacgactctgcagcagttcgggtccgatatcagccccgagatcggcgaaagggtgaggacactggttctgggcctcgtgaacagtacccttactattgaagaattccattcaaagttgcaggaagctaccaatttcccactcagaccattcgtcatcccctttctgaaagcgaatctaccactgttgcagcgtgagctgctacactgcgcccgtttggctaaacagactcctgcccagtatttggctcagcatgagcagttactgttagatgcatcagccagctccccaatcgacagttccgagcttttgctggaagtgaacgagaacgggaagcgtagaaccccggaccgcactaaggagaatggttctgatcgcgatccattgcatccagagcacctgtccaagcgcccgtgcaccctaaacccagcacagcggtatagtccttctaacggcccaccgcagcctaccccaccgccgcattaccggctggaggacatagccatggctcaccattttagagatgcttaccgccacccagaccctcgcgagcttagagagcgccacagacccttggtggtacccggcagtcgccaggaggaggtgatcgaccataagctgaccgagagagagtgggctgaagaatggaaacacttaaacaacttgctaaattgcatcatggatatggtggaaaaaactcgccgctccctcaccgtacttaggaggtgccaggaagccgaccgggaagaactgaaccactgggcacgccggtacagcgacgctgaggatacaaagaagggacctgcccctgctgccgctagaccacgaagtagtagcgccggtcccgaaggaccccaactggacgttccaagggagttcctgcctaggactctcaccggctatgtgcctgaagacatttggaggaaagctgaggaggcggtgaacgaagtgaagaggcaggcgatgtctgaactacagaaggctgtgagcgacgcggagcggaaggctcacgagttgatcacgacagagcgggcgaaaatggaaagagctcttgccgaggctaagaggcaagcctccgaagacgcactcaccgttattaatcaacaggaggactcctctgaaagctgctggaactgcggccgtaaggcttccgaaacgtgtagtggctgcaacgccgcccgatactgtggctctttctgtcagcatcgggattgggaaaaacatcaccacgtctgtgggcagagtctccagggccccacagctgttgtcgcagatcctgttccaggtccccccgaggctgcgcatagcctgggtccgagcttgccggtgggcgcggcgtcgccgagcgaggcaggatcagccggcccctcccgaccagggtctcccagtccgcctggaccgttagataccgtgccaaggtag

SEQ ID NO: 113057 - DNA, 1704 bp, Artificial Sequence
  Description of Artificial Sequence: Synthetic coding sequence
atgcccgactcccccgccgaggtcaagacacagccaagatcaacccctccgtcaatgccccccccacctccagccgcttcccagggagcgaccagaccaccatcttttaccccgcatacgctgatgaacggttcatcccattctcctaccgccataaatggggccccctgcaccccaaacgggtttagcaacggccccgccacatctagcacagcaagcttaagtacacaacatctgcctcccgcctgcggcgcgagacaattgagtaaactcaagaggtttctgacaaccctgcagcagttcggctctgacattagcccagagatcggagaaagagtgagaacactggtcttaggcctggtgaatagcactttgaccatcgaggagtttcacagtaagcttcaggaggctacaaactttccactgcgccccttcgtaataccctttctcaaagccaacttgcctttactgcagcgtgagctgctccactgcgcaaggctcgctaagcaaactcctgcccaatatttggcccagcatgagcaattgctcctcgacgcctcagcctcatcaccaattgatagtagtgaacttctgctagaggtgaacgagaacggcaaacggcggaccccggacagaactaaggagaatggatccgaccgggaccccctgcatcccgaacatctgagtaaacgaccctgtaccctgaaccctgcacagagatatagtcctagcaacgggccccctcagcctaccccaccaccgcattacagattagaggatatcgccatggcacaccatttcagggatgcatatcggcacccagatccaagggagctcagggagagacaccgacctcttgtggtgccgggcagcagacaggaagaggttatagatcacaaactaaccgagagagaatgggccgaggaatggaagcacctgaataatttgttaaactgcatcatggatatggttgagaagacaagacgctcactcactgttctgagacggtgccaggaagccgacagggaggagctcaaccattgggctaggcggtatagtgatgcagaagacactaagaagggccccgcgccagcagccgctagaccaagatctagtagtgcggggccggagggaccacagctcgatgtccctagagagttcctgcctcgtaccctgacgggatacgttcctgaagatatctggagaaaagcagaggaggccgtgaacgaggttaaaagacaggcaatgtccgagctgcagaaagctgtctccgatgctgagcgaaaagctcacgaattgatcacaaccgagcgagctaaaatggagcgagcccttgctgaggccaaaagacaggcctccgaggacgcccttaccgtgattaaccagcaggaagattcatcagagtcctgttggaactgcggccgaaaggctagcgagacttgttcaggctgtaacgccgcccggtactgcggctcattttgccagcatagggactgggagaagcatcaccacgtctgcggccaatcactgcagggtccgacagcagtcgtggccgacccagtgcctggtcctcccgaggctgcccattctctaggaccatctcttcctgtgggtgccgcaagtccatccgaggccgggtctgcaggacccagccgaccggggagtccaagtccgcccggaccactagacaccgtcccccggtag

SEQ ID NO: 113058 - DNA, 1848 bp, Artificial Sequence
  Description of Artificial Sequence: Synthetic coding sequence
atgccagccagccgtttgagggacagagccgccagctctgcaagcggctctacatgcggctctatgtctcagactcaccccgtgctggagagtggcctactcgcctctgcagggtgctcggctccaaggggcccaaggaaggggggcccagccccagtcgaccggaaggccaaggcgtctgcaatgccagatagtcccgctgaggtcaagactcagccaagatctacccctccgtcgatgcctcccccaccaccagctgccagccagggcgctactcgcccaccaagctttaccccccacaccttaatgaacggcagctcacactccccgacagccattaatggggcaccgtgcacccccaatggattttcaaacggcccggccaccagtagtaccgcgagtttatccacacagcacctgcctccggcctgcggggccagacagctgtccaagctgaaacgattcttaacgacgctccagcagttcggcagcgatatttccccagagattggggaacgggtacgtacactggtgcttggcctggtgaattctacactgactatcgaggaattccattctaagctgcaggaagcgactaactttccgcttaggcccttcgtgatccccttcctcaaggccaatttgcctcttctccagagagagctgctgcattgcgcaagactcgcaaagcagactccagcccagtatttggctcagcacgagcagcttctgttggacgccagcgcatctagtccaatcgactcttccgaattgctactcgaggtcaatgagaacggcaaaaggcggaccccggatagaacaaaggagaacggatccgatcgggaccccctgcaccccgaaaggtactccccaagtaacggcccccctcagccaacccctcccccgcactataggttggaagacattgcgatggcacaccactttcgggacgcctatcggcaccctgatccgagagaattgcgggagcgccaccgaccactggtagttcccggatccaggcaagaggaggtgattgatcacaagctgacagaacgcgagtgggcagaagaatggaagcatttgaataacctcctaaactgtattatggatatggtggagaagaccaggcggagcctgaccgttctacggcggtgtcaggaagccgaccgcgaagagctgaaccattgggcaagacggtacagcgatgccgaggataccaaaaagggccccgctccggccgccgcacggccaagatcaagctccgcaggccccgaagggcctcagctggatgtgccccgagagtttctcccccggactctgactggctatgtgcccgaagacatctggcggaaagctgaggaggcggttaacgaagtaaagcgccaggccatgtcagagttgcagaaagcggtgagcgatgcggagcgaaaagctcatgagcttattacgacagaacgtgccaagatggagcgagcactggcagaagcgaagcggcaggcttcggaggacgccctcacagtaataaaccagcaggaagattcttctgagagctgttggaactgcggcagaaaagcttcagaaacctgctcaggctgcaatgctgcgaggtactgtggctccttctgtcagcacagggattgggagaaacaccaccatgtgtgcggccaatccctacaaggacctaccgcggttgtggcagaccccgtgcctggccccccggaggcagctcacagtctgggaccttctcttccagtgggtgctgctagtccttcggaggctggaagcgctggcccttccagacccggatctccttcccctccaggtccactggacaccgtaccccgatag

SEQ ID NO: 113059 - DNA, 1734 bp, Artificial Sequence
  Description of Artificial Sequence: Synthetic coding sequence
atgcccgcctctcgccttagggacagggcagcttccagcgctagtggtagtacatgcgggtcaatgtcacaaacacacccagtgctggaatccgggttgctagcctcagcgggctgctcagcacctagagggcctaggaaaggcggaccagtgatgaatggttcatcgcattccccaactgccattaacggcgctccctgcacgcctaacggcttttctaacggccctgccacatcctcaaccgccagcctcagcactcaacacttgccgcccgcctgcggcgccagacagctcagcaagctcaaaaggttcttaaccaccctgcaacagtttggctcggatatctccccagagattggcgagagggttcgcacgctagtcctgggtctcgtcaactctaccctcacaatagaggaattccattccaagctgcaggaggccaccaatttccctttgcgccccttcgtcataccctttctaaaggcaaatctgcccctactccaacgagagcttctgcattgcgcccggcttgccaagcaaacccccgcccagtatctagcacagcacgagcagctgctgttggacgcttcggccagcagcccaattgattccagtgagctgttactggaagtgaacgagaacggcaaaagacggacccctgacagaaccaaagaaaacggttccgaccgagacccactgcatccagagcacctttccaagcgcccatgcaccctcaaccctgctcagcgctactctcctagcaacggaccaccccagcccaccccacccccccactaccgactagaggacattgctatggctcaccactttcgggatgcataccgacaccctgatcctagagagctgagggagagacataggccattagttgtacccgggagcagacaagaagaggtcattgatcataagctcaccgagagggagtgggccgaggagtggaagcacctgaataaccttttgaactgtatcatggatatggtagagaaaaccaggcgttcgctgaccgtcctccggcgctgtcaggaagcagaccgtgaggagcttaatcactgggcgaggaggtactctgacgcagaggataccaaaaagggccccgccccagccgctgctaggccccggagctcgtcggctgggccagaagggccccagctggacgtgcccagggaattcctgccacggactctcacaggctacgtgccagaagacatctggagaaaagccgaagaggcagttaatgaagtcaagcggcaggccatgtcagaactgcaaaaggccgtcagcgacgccgaacgcaaagctcacgagctcatcactactgagcgtgctaaaatggagagagccctggccgaggcgaagcgtcaggcctctgaagacgccctgaccgtgatcaaccagcaggaggattcctccgaatcgtgttggaactgcggtcgtaaggctagtgagacctgctccggatgcaatgccgccagatattgcggctcgttttgtcagcatcgggactgggaaaagcaccatcatgtgtgcggccagtccctccaaggtcccaccgccgtagtcgctgaccccgtgcctggcccgccagaggctgcacactcgctgggtccctccttgccagtgggggccgcctcccccagcgaggcgggctcagcaggcccttctagaccaggttctcctagcccaccaggacccttagacaccgtgcctaggtag

SEQ ID NO: 113060 - DNA, 558 bp, Artificial Sequence
  Description of Artificial Sequence: Synthetic coding sequence
atggcagctcagaaagaccagcagaaagacgcagaggccgagggcctttcaggtaccaccctgttgcctaagctgatcccttccggagcaggtcgcgagtggctggagcggaggagagctaccatcaggccatggagcactttcgtggaccagcagagattcagccgacctcgcaatctgggggagctgtgtcagcgcctggtgcgtaatgtggagtattaccagtcaaactacgtgttcgtctttcttggtctgatcttgtactgtgtggttacttctcctatgttgttagtcgccctcgccgtgttctttggcgcctgctacatcctttacctgcgcaccttggaatcaaaattggtgctgttcgggagggaggtgtctccggcccaccagtacgctttagccggagggatctccttcccctttttttggttagctggggctggatccgcagttttttgggttttaggagccactctcgtggttataggctcacacgctgcattccaccagattgaggccgttgatggtgaggagttgcagatggagccggtgtag

SEQ ID NO: 113061 - DNA, 3147 bp, Artificial Sequence
  Description of Artificial Sequence: Synthetic coding sequence
atgaaccgattccgcgtttctaagttccggcacactgaggcacgtccccccagacgggagtcatggatatctgacatcagggccggcaccgcccctagttgtagaaaccacataaagagctcttgtagtctgattgccttcaacagcgataggccaggtgtgttgggcatcgtgcccctgcagggacagggcgaggataagcgccgcgtggcgcacctcggatgtcattccgaccttgtgacagatttggatttctccccttttgacgactttttgctggctacaggctcagccgacaggaccgtgaaactttggcgtcttcctggccccggacaagccttgccctcggcacccggagtggtgctcggaccggaagacttgccggttgaggttctccagttccatcccaccagtgacggtatactggtgtccgcggctggaaccaccgttaaggtctgggacgcagctaagcagcaacccctgacagagctggctgcgcatggtgatctcgttcagagtgccgtgtggtccagagatggcgccctagttggcacagcctgcaaggacaagcagcttcggatttttgaccccagaactaagccacgagccagccagagcacacaagctcatgaaaattcccgagactctagactcgcgtggatgggtacatgggaacacctggtatccaccggcttcaaccaaatgagggaaagagaagtcaagctctgggataccaggtttttttcctccgcacttgcctccctcaccctcgacacgtcacttggctgtctcgtgccactcctggatccagactccggactcttagtactggccgggaagggagaacggcagctctattgctacgaggtggtcccacaacaaccagccctttctcctgttactcagtgcgtcttggagtcagtattgcgtggggcagcactcgtaccacggcaagccctagcagtcatgtcttgcgaggtcttgcgagtcctgcagctctccgatacagccatcgtcccgattgggtaccacgtgccccgaaaggccgttgaatttcatgaagacctcttcccggataccgccgggtgcgttcccgctactgatccacactcctggtgggctggagataatcagcaggtgcagaaggtgtccctgaatccagcctgcaggcctcatcctagcttcacctcgtgcctcgtgccccctgctgaacctctccccgacaccgctcagcctgccgtgatggagaccccagtgggggacgcagatgctagtgaggggttctcttctcctcctagcagcctaacaagcccttcaacaccatctagtctaggacctagtctgagcagcacctctggcattggaacaagtccatcactgcggtcactgcagagtctgttaggaccatctagcaaatttagacacgcccagggaacggtgctgcaccgggactctcacataactaacctcaagggcctcaatctgacgacgcccggagaatccgacggattttgcgccaacaagttgcgggtggccgtacccctgctgtcttccggcggacaggtggccgtacttgagctcagaaaacctggccggctgccggacaccgctcttccaactctgcagaacggagcagcggtgaccgacctcgcatgggatccattcgatccacacagactcgctgtggccggcgaagatgcacgcatccgcctgtggcgggtgccagctgaagggctcgaggaagtgctaactactcccgaaaccgtcctgactggacacaccgagaagatttgcagcttgcgattccaccctctagccgccaatgtgctggcttcgtcttcatatgatctcaccgtaaggatttgggacctacaagcaggcgcggatcgtctgaagctccagggacaccaggatcaaatcttcagcctagcctggtcacccgacggacagcagctggctactgtgtgcaaggatggcagagtcagggtgtaccgacctcgctccggacccgagccgctgcaggagggaccaggccccaaaggcgggcgcggcgcccggattgtgtgggtgtgcgacgggagatgccttctcgtttctggcttcgactcccaatccgaaaggcaactgcttctgtacgaggccgaagcccttgctggtggaccactggctgttctagggctggatgtcgcgccatcaacattgttgccttcgtatgacccggacaccggtcttgtcttgctgacaggaaaaggagacacgagggttttcctgtatgagttgctgcccgagagccccttcttcttggagtgtaactcattcacctcccctgatccacataaagggctagtgctccttccaaaaaccgagtgtgacgtgagagaggtcgagctcatgaggtgtttacgattaaggcaatcaagcctggagcccgttgccttccgcctccctagggttcgcaaggaatttttccaagacgacgtcttccccgatacagccgtgatttgggaacctgtcctcagcgcagaggcctggctgcagggcgcaaatggtcagccatggctgttgtccctgcagcccccagacatgagccccgtgtcccaggccccaagagaggcgccagctcgccgggcccccagtagcgcgcagtaccttgaggaaaagagtgatcagcagaagaaggaggagctgctcaacgctatggtggccaagctgggaaatagggaggaccctctgccacaggatagcttcgagggcgtcgacgaagacgagtgggccaaatacctcgcacaaattattgtgatgggagtgcaagtcgtaggccgcgcctttgctagggcattaaggcaggaattcgccgcaagcagagccgctgccgatgctaggggtcgggcaggacatcgtagcgccgccgccagcaatctgagcgggctatccctgcaggaggcccagcagattcttaatgtctccaagctcagtcccgaggaggtgcagaagaactacgagcacttgtttaaagtgaacgataaatcagtcggtggatctttctacttgcaaagcaaagtagtccgggccaaggagcggttggatgaggagctgaaaattcaggcacaagaggacagggagaagggccagatgcctcacacctag

SEQ ID NO: 113062 - DNA, 2778 bp, Artificial Sequence
  Description of Artificial Sequence: Synthetic coding sequence
atgaatagattccgtgtgtcgaaatttcgccacaccgaagctagacctcctcgacgagagtcttggatcagcgacattagggcagggaccgctccatcctgccggaatcatatcaagagctcctgttctctgatagcgtttaattccgaccggccaggagtgctaggaattgtccccctgcaggggcaaggcgaagacaagcggagggtcgcacatctgggctgccactcggacctggtcaccgacctggatttctccccgtttgatgattttctgctggctacaggctccgccgatagaaccgtgaagttgtggcggcttcccggccctggccaagcactcccaagtgcccctggggtggttttaggccccgaggatttaccggtcgaggtgctgcagtttcaccccacctctgacggaattctagtcagtgctgccggtaccacagtgaaggtttgggatgccgctaagcagcaacccctcaccgaactggccgcgcatggagacttggtgcagtctgcagtgtggtcaagagacggggccctggtgggcacagcttgtaaggacaaacagctccgcatcttcgatccaagaacaaaaccgagggctagccagtccacccaggcacacgagaattcacgcgactcacggctggcgtggatgggtacttgggagcatctcgtcagcactggattcaaccagatgcgggagcgagaagtgaagctgtgggatactcgttttttttcctccgctctcgcaagtcttactctggatacctccctggggtgtctcgtgccccttctcgacccagactccggcctgctggtgctcgccggaaagggggaaaggcagctgtactgttatgaagtagtaccccagcaacctgccttgagccctgtgacccagtgcgtgctggagagtgtcctgaggggagccgccctggtgccaagacaggccctggctgtgatgtcatgtgaagtgctaagagtactgcagctctccgacaccgctattgtgcccataggctatcatgtccccagaaaggccgtggagttccacgaggatttatttccagacactgctggttgcgtccccgcgactgatccgcattcatggtgggctggggacaaccaacaggtccagaaagtctctttgaaccccgcgtgcaggccacaccccagctttacatcctgcctagttcctccagcagaaccacttcccgacacggcccagccagccgtgatggagacaccggtgggagatgcagatgctagtgaggggttctcttcccccccctcctccttaacctcacccagcactcccagcagcctcggccccagcctttcctccacctctggtatcggaacaagccctagcctccggtccctgcagtccctgctggggccctcttccaaattcagacacgcacagggtacagtgctgcatcgagactcacacatcaccaacttaaaggggctgaatctaaccacccccggagagtctgatggattttgcgcaaataagctcagagtggccgtccctttgttatccagcggggggcaggtggcggtgcttgaactgagaaagcctggacggctgcccgacactgcgttaccaacattacagaacggagcagcagtgactgatctcgcttgggaccccttcgacccacatcgcctcgcggtggcgggtgaggacgccagaatcaggttgtggagagtccctgccgagggactggaggaggttctcaccacaccagagacagtacttaccggacacaccgagaaaatttgcagtctgagattccaccctctcgccgcgaatgtccttgccagttcctcttacgatttgactgtgcgcatttgggacctgcaggccggggcggatagactgaagctgcaggggcaccaggaccagatcttctccctcgcttggtcccccgacgggcagcaattggccactgtatgtaaggacggaagggtcagagtctatagaccccggtccggccctgaacctctccaggaaggacctgggccaaagggtggccgtggagccaggatcgtatgggtgtgcgacggtcggtgtctactggttagtggctttgattcccagtctgaaagacagctgctgctgtacgaggctgaggcactggctggcgggcctctcgcagtcctgggtctggatgtggctcccagcacgttactgccttcctatgatccggatacaggattggtgctactgaccggtaaaggcgacacacgagtgttcctctatgagctgctgccagaatccccttttttcctcgagtgtaatagcttcactagtcctgatccccataaggggctggtgctcttgcccaagaccgaatgtgatgtacgggaggtggagctcatgcgatgtctgcgactccgacagtcgtctctggagcccgtggctttcagactgccacgcgtgcgcaaggaattctttcaggacgatgtatttcctgacaccgccgttatatgggaacctgttctgtctgctgaagcctggttacaaggcgcgaacggccagccctggttgctgtcgctccagccgccagacatgagccccgtctcccaggctcccagggaagctccagcgagaagagcccccagcagcgctcagtatctagaggagaaatccgaccaacaaaagaaggaagaactgctcaatgccatggtggccaaactgggcaaccgggaggaccccttgccgcaggattcctttgagggtgttgacgaagacgaatgggactag

SEQ ID NO: 113063 - DNA, 1104 bp, Artificial Sequence
  Description of Artificial Sequence: Synthetic coding sequence
atgaaccggttcagggtgtctaaatttaggcacactgaggcccgaccaccaagacgggaggacaagcagctccgaatttttgatccgcgtacaaaacctagggcctcccaatcgacccaggctcacgaaaacagcagggattctcggctggcttggatgggcacatgggaacatttggtctccactggattcaatcagatgagggagcgggaagtcaagctttgggacactcgcttctttagtagcgccctggcatccctgacactagatacctcattgggctgtctggttcctctgctggacccggatagcgggctgctcgttttggccggaaagggcgagagacagctttattgctatgaggtggtcccccagcagcccgctctgagccccgtgacacagtgtgtcctggaaagcgtgctacggggcgccgccctggtaccaaggcaagctctggcggttatgtcgtgtgaggttttgcgtgtcctccagctgagcgatacagcaatcgtccccatcggttatcatgtgcctcggaaggccgtagagtttcatgaagatctgttccccgatacggctgggtgtgtgcctgccaccgacccacatagctggtgggcgggcgacaatcagcaggtgcagaaggtgtcactcaacccagcttgccggcctcatccatccttcacttcttgtcttgtgcctccggccgagccactgccagacaccgctcagcccgccgtgatggagaccccggtcggagatgctgatgctagcgaaggattctcatctcctcccagcagccttacatcaccaagcacaccttcatccttgggaccgtctttgtcctctacaagtgggattggcacctcacctagcttgcgctcactccagtccttgctgggcccttctagcaaattccgccatgctcaggggaccgtgcttcaccgtgattcacacatcacaaacctgaaagggctgaacctgaccacaccaggggagagcgatgggttctgtgctaataagctccgcgtggctgtgcctcttctctcttccgggggccaagttgcagtgcttgaaatgagggagaaaagacaccgagaagtgtag

SEQ ID NO: 113064 - DNA, 2523 bp, Artificial Sequence
  Description of Artificial Sequence: Synthetic coding sequence
atgaatagattcagagtgagtaaatttaggcacaccgaagcgcggccgccaaggcgcgaaagctggattagtgacatcagagccggcactgctccaagttgtcggaaccatattaaatcgagctgttcattgattgcttttaattcagacagaccaggcgtgctcggcattgttcctcttcaagggcagggggaagataaaagacgcgtagcccacttgggatgccactccgagctcgcagctcatggagacctggtccaatcagccgtgtggtccagggatggagctctcgtgggcaccgcttgcaaggacaagcagttacggatatttgatcctcggaccaaaccccgcgcctctcagtccacccaggcccatgaaaactcaagagattccagacttgcctggatgggaacctgggaacatttggtgtccacaggctttaaccagatgagagagagagaagtaaagttatgggatacaagattctttagttcggcactcgcctccctgactctggacaccagtctggggtgcctggtgcccttattagacccagattccggcctactggtcctagctggaaagggggagaggcaactgtactgctacgaagtcgtcccacagcaacctgctctgagtccagtgacgcagtgtgtactggaatccgtcctgaggggtgcagcactagtgcccaggcaagccttggccgtgatgtcatgcgaggtgctgcgagtgctgcagctgagtgacacagctattgtacctataggttaccatgttccccggaaagccgtggagttccatgaagatctttttcccgacactgccgggtgtgtccctgcaacagatcctcactcgtggtgggccggtgataaccagcaggtacagaaagtgtcacttaacccagcgtgccgccctcaccctagcttcacttcctgtctagtgccccctgcagagcctcttcccgatactgcccaacccgccgtcatggagacccctgttggagatgcagacgcaagtgagggtttctccagcccaccaagtagcctcacgtcccctagcactcccagcagcctggggccatcactcagctccactagtggcattggaacgtccccgagcctgaggtccctgcagtcactgctgggcccgagcagcaaattccgccacgcgcaaggaacggtgttacacagggatagccatatcacaaacctgaagggcttgaatctgaccactcctggtgaatctgacgggttctgcgccaacaaactccgcgtggccgtgccgctactgagcagcggaggccaggtcgccgtactcgaactgcgcaaacccggtagactgcctgatacagctctgccaacccttcagaacggagctgcagtgactgacctcgcctgggaccccttcgatccccatcggctggccgtggcgggcgaggatgcccgaattcgactttggagagtcccagcagagggcctggaggaagtgcttaccactcctgaaactgtgctgacaggccatactgaaaagatctgctccctgcggtttcatcctctggccgccaacgttttagcctcgtctagctatgacttgaccgtgcgtatctgggacctgcaggctggggcagacagacttaaactgcagggccaccaggaccaaatcttctctttggcttggtccccggatggtcagcagttggctacagtgtgcaaagatggcagagtacgggtgtaccgcccgcgctctgggcccgaacccttgcaggaaggcccagggcccaagggggggaggggagctcgtatagtctgggtgtgtgatggtcggtgcctgctggtcagcggatttgactcccagtctgagaggcagcttctgttatacgaggccgaggcactggcaggaggacccttagcggtcctcggattggacgtcgcccccagtacccttttaccaagctatgaccccgatacagggctggtgctcttgacaggaaagggggacacccgtgtgtttctgtacgagctgctgcccgagtctcccttttttctcgagtgcaactcattcacaagccctgatcctcataagggcctcgtcctcctgcccaagacagagtgtgatgtccgggaggtagaactgatgcgatgccttcgtctccggcagtcaagcctggagccagtggccttccggttgccgagggtgaggaaagaattttttcaagatgatgtgttccccgacacagcagtgatctgggaacctgtgttgtctgctgaagcctggctgcagggcgctaacgggcagccatggctcctgagcctgcagccaccagacatgtcgcccgtgtcacaggcacctcgggaagctcccgccaggagggcaccttccagcgctcaatacctggaggagaaatccgaccaacagaaaaaggaggaactgctaaacgccatggtggccaagttgggtaacagggaggaccctctgccccaagatagtttcgaaggcgtggatgaagatgaatgggattag

SEQ ID NO: 113065 - DNA, 2118 bp, Artificial Sequence
  Description of Artificial Sequence: Synthetic coding sequence
atgggcacctgggagcacctggtttctaccggcttcaaccaaatgcgggagcgtgaagttaaactgtgggatacccgattcttttcgtcggccctggcgagcttgaccctggatacctccctgggctgcctagttcctctactggaccctgatagcggcctcctggttctcgccggcaagggtgaaagacagctgtactgttacgaagtggtcccacaacagcctgcgctgagtcccgtgacccagtgtgtgctcgaaagcgtgctacggggagcggccctggtaccgcgccaggcattagctgttatgtcttgtgaagttctccgagttttgcagctgtccgacaccgccatcgtgcccattggttatcacgtaccccggaaggcagtggaattccacgaagatctgtttcccgatactgccggttgtgtcccggccacagatccacactcatggtgggctggtgataaccagcaggtgcagaaagtaagtctcaaccccgcctgcagaccacacccttcttttacaagctgcctggtgccacccgctgagccattaccagacaccgctcagcccgccgtgatggaaacgcctgttggcgatgccgatgctagcgaagggttttccagcccgcctagcagtcttacgagcccatcaacaccatcctcactgggcccatctctttcttcgaccagcggtattggtacaagtccttcactgcgatcccttcagagcctgttgggaccctccagcaagttccgacatgcccaggggaccgtcctgcacagagactcacatatcactaacttgaaaggtctaaaccttaccacccccggtgagtctgacggattctgcgccaacaagctgcgcgtggctgtacctttactcagtagtggagggcaagtggcagttcttgaactacggaaaccaggccgactgcccgatacagccctccctaccctccaaaacggcgccgccgtgactgaccttgcgtgggatccatttgacccacatcgcctggccgttgcgggagaggacgccagaatccggctgtggcgggtccctgctgagggccttgaagaggtgctcactacccccgagacagttttaactggccacaccgagaaaatttgtagcctgcgcttccatcccttggccgctaatgtcttagcatcttcatcttacgatctaacggtcagaatttgggaccttcaggccggcgccgatcggctcaagctgcagggtcatcaggaccagattttcagccttgcctggtcaccagatggccaacagcttgccacagtctgtaaagacggaagggtaagagtttatagacctcgctcagggcccgagcccctgcaagaaggtcctggtccaaaggggggccggggggccagaattgtgtgggtatgcgacgggcggtgtcttttggtgtccggatttgattctcagagcgagcggcaactgctgctatacgaagctgaggcgctggccggaggaccattggccgtccttggattagatgtagcgccaagcacgctacttccttcttacgaccccgacactggactggtgcttcttactggaaaaggagatactcgggttttcctgtacgaattgcttcccgaaagtccttttttcttggagtgcaattcattcacctcaccagatccacacaaaggtctggtcctcctaccaaaaaccgagtgcgatgtccgagaggtcgagctaatgagatgcctgaggctccgccagtcgagcctggaacccgtcgcttttagacttcctcgcgtccgtaaagaattcttccaggatgatgtgtttcccgataccgctgtgatctgggaaccggttctaagcgccgaagcctggttgcagggggctaacggtcagccgtggctgctcagcctgcaacccccagatatgagccctgtgagtcaggctccacgcgaggctcccgctagacgagcccccagcagtgcccagtacctcgaggagaaatctgatcagcagaagaaggaggaactgctcaacgccatggttgccaagctgggaaatagggaagatcccctgccccaagactcattcgagggtgtggatgaagatgaatgggattag

SEQ ID NO: 113066 - DNA, 1386 bp, Artificial Sequence
  Description of Artificial Sequence: Synthetic coding sequence
atgagcagacaggtcgtcaggagctccaagttcaggcatgttttcggtcagcccgccaaggctgatcaatgctacgaagatgtgcgcgtgagccagacaacgtgggattcagggttctgcgcggtgaaccccaaatttgttgccttgatttgcgaggctagcggaggcggagcatttctcgtgctgcccttaggaaaaacaggccgtgtggataagaatgctccgacagtctgcggtcataccgctcccgtgcttgacatagcctggtgcccacacaatgataatgtgatcgccagtgggtctgaggattgcaccgttatggtgtgggagattcccgacggcggtctaatgttacccctgcgggaacccgtcgtgacgttagaagggcacacgaaaagagtggggattgttgcatggcacaccaccgctcagaacgtgctgctgtccgcaggttgtgataatgtgataatggtctgggatgtcggaaccggggccgcaatgttgaccctgggtcctgaggttcatcccgataccatttactccgtggattggagtagggatggcggccttatttgcacaagctgccgagacaaacgagtcaggatcatcgaacccaggaaggggaccgttgtggctgaaaaggacaggccacacgaaggcactagaccagtaagggcggtgttcgtatctgaaggtaagattctcaccaccggcttctctaggatgagcgagcgtcaagtggcattgtgggataccaagcatctggaggaacctctttcactacaggaactggatacttcaagtggcgtcctcctaccattttttgacccagatacaaacatcgtgtatctgtgcggaaaaggcgattcttccattcgatatttcgaaattacatccgaagcaccctttctgcattatctgtcaatgttcagtagtaaggagtcacagagggggatgggttacatgcctaagcggggcctcgaagtgaataagtgtgaaatcgcaaggttttataagttgcacgagcgccggtgcgaacccatagccatgactgtaccacggaagtcagacctatttcaggaagacctgtaccctcctacagctggcccagaccctgctctgaccgctgaagagtggctagggggtagggatgctggacctctgctgatttccctgaaggacggatacgtgcctcccaagtctcgcgaactgcgtgtgaaccgcggcctggacaccgggcggcgcagagcggctcctgaggcctctgggacccccagcagcgatgccgtttcaagactggaggaagagatgagaaaacttcaggccactgtccaggaattgcaaaagcgacttgataggctggaggagaccgtgcaagcaaaatag

SEQ ID NO: 113067 - DNA, 1443 bp, Artificial Sequence
  Description of Artificial Sequence: Synthetic coding sequence
atgactgtgaccaagatgtcctggcgcccccagtatcgcagttcaaaattcaggaacgtgtatggcaaggtagcaaacagagagcactgttttgacgggatccctatcacaaagaacgtccacgacaatcacttttgtgctgttaacaccagattcctggcgatcgttacagagtcagcaggcggaggcagttttctagtgatacctctggagcaaacaggtagaatcgaaccaaattatcctaaagtgtgtggacaccagggaaatgttttagacattaagtggaatccctttatagacaacattatcgcgtcatgtagcgaggacaccagcgtaaggatttgggaaatccccgaaggcggcctgaagaggaatatgactgaagctctattggagctccatggtcattccaggcgagtgggattagtggaatggcatcccacaactaacaacatcttgtttagtgccggatatgattataaagttctcatctggaatctggatgtgggggagcccgttaagatgatagactgccacaccgatgtgatcctgtgcatgtctttcaacaccgatggcagtctccttacaaccacgtgtaaagacaaaaaactgagagttatcgagcctcgcagcggcagggtgctgcaggaggccaattgcaaaaaccaccgggttaaccgggtggtattcctcggcaatatgaagaggctcttaactacaggggtaagccgctggaatacgcgacaaattgcactgtgggatcaggaggacctgagcatgcccctgatcgaagaagagatcgatgggctgtccggtctgctttttccattttacgacgccgatacacacatgctgtatctcgccggcaagggcgacggcaatattcgctactatgaaatctctacagaaaaaccttatcttagctacctcatggagttcaggtcccccgcgccccagaaaggtttaggcgtgatgccaaaacacggtctggacgtctccgcttgcgaagtgttccggttctataagctggtgacactgaaaggcttgatcgagcctattagtatgatcgtaccacgaagatccgactcctaccaggaggatatctatcctatgaccccgggaaccgaaccagcactgaccccagacgaatggctcggtgggatcaaccgggatcccgtcctcatgtcactgaaagagggatataaaaagagttctaagatggtgtttaaggctccgatcaaggaaaagaaaagcgtcgtggtcaacgggattgatttgctggagaacgtgccgccaaggaccgaaaacgagctcttgagaatgttctttcgtcagcaggatgagatcaggagactgaaagaggagttggctcagaaggacattaggatccgccagctgcaactcgaactgaaaaacctccggaactcccccaagaactgctag

SEQ ID NO: 113068 - DNA, 1269 bp, Artificial Sequence
  Description of Artificial Sequence: Synthetic coding sequence
atgttggatctggaggtggtgccggagagaagcctcgggaatgagcaatgggaatttaccctgggaatgcccctcgcccaggcagtagctatcctccagaagcattgtcggattataaagaacgtgcaggtgctttacagcgaacagagtcctctttcacacgacctcattctaaatctcactcaagacgggattaagctgatgtttgatgccttcaatcaacgcctcaaggtgattgaggtgtgtgatctgaccaaagtgaagcttaaatactgtggagtccacttcaactcccaggccatcgctccgacaattgagcagatcgaccagagcttcggagccacacacccaggcgtatacaactcggcggagcagctctttcatttaaactttcgcggtctgtcttttagcttccagctggactcttggactgaagctcctaaatacgagccaaacttcgcgcatggtctggcctcattgcagatccctcatggcgctaccgtgaaaaggatgtatatttatagcggaaactcgctacaggacacgaaggctcctatgatgcccctgtcctgctttcttggaaacgtctacgccgaatccgtagacgtactgcgggatggcacaggccccgcgggactaaggctccgactgctggccgctgggtgcggacccggcctcttggctgacgctaagatgcgtgtcttcgaacggtccgtctacttcggggactcatgtcaggatgtcttatctatgttagggtcgccgcacaaggtgttctacaagtccgaggacaagatgaagatccactccccgagtccgcataagcaggtgccgtctaagtgtaatgattacttctttaactattttacacttggagtcgacattctttttgacgccaacacccacaaggtgaaaaagttcgtgttgcacacgaattatccaggacattacaactttaatatctatcataggtgtgaatttaagatcccactggccattaagaaagagaatgcagacggccagacagaaacatgcactacttattctaaatgggataacatccaggagctgttaggtcatcctgtagaaaagcccgtggtgctacatcggagctccagcccaaacaatactaacccatttggatcgaccttctgctttggtttgcagcggatgatttttgaggttatgcagaacaaccatatagcttcagtcacgctctacggaccaccccgaccaggaagtcatctccggacagccgagctgccctag

SEQ ID NO: 113069 - DNA, 1470 bp, Artificial Sequence
  Description of Artificial Sequence: Synthetic coding sequence
atgtctttcaggaaggtggttcgacaatcaaagtttcgacacgtcttcgggcaacccgtcaagaacgatcaatgttatgaggacatacgcgtttcaagggtgacgtgggacagtactttttgcgctgtgaaccccaagttcttggccgttatcgtggaagcatccggcgggggcgcattcctggttctcccactgtcaaaaacggggcggatcgacaaagcctatcccactgtctgtggacatacaggaccggtcctagatatcgactggtgtccccataatgatgaggttatagcatccggcagcgaggattgtaccgtgatggtttggcaaattcctgagaatggactgacctcgccactgacagaacctgtggtggtgcttgagggccataccaagagggtcggaattattgcctggcacccaactgcaaggaacgttctgttgtccgccgggtgcgataacgtcgttctcatctggaatgtcggaaccgccgaggaactctacagactggatagtctgcatcccgaccttatctacaatgtgagttggaatcataatggttccctattttgctccgcatgcaaagacaaaagcgtaaggattatcgacccacgccggggaaccctagtcgcagaacgagagaaggcacacgagggtgcccggcctatgcgggcgatatttcttgcagatgggaaagtgtttacgactggcttttccaggatgtctgaaaggcagctcgccctgtgggaccctgagaacctggaagaaccaatggcgcttcaagagctggactccagcaacggggcacttctgccgttttacgatcccgacacatcagtcgtttacgtgtgtgggaagggcgacagttctataaggtactttgagatcactgaagagccaccctatattcactttttgaatacgttcacatctaaggaaccacagaggggtatggggagtatgcccaagcgagggctggaggtgagcaaatgtgagattgctcgattttacaaattgcatgagcgcaaatgtgaacccattgtcatgaccgtacctcggaagtctgatctctttcaagatgatttgtatccggacaccgctggtcccgaggcggctttggaagctgaggaatgggtgtctgggcgggatgcagaccccatcctcatttctctgcgcgaggcctacgtgccatccaagcagcgagatctgaagatctctcgcagaaacgtcctcagcgattcacgtccggccatggcccctggaagctctcacctgggagcacctgcgagtaccaccactgccgccgatgcgacaccttcgggctccctcgctcgtgccggcgaggccgggaaactcgaggaggtgatgcaggagttgcgggcattgcgggcactagtcaaagagcagggggacaggatatgtcgcctcgaagagcagttgggccgcatggaaaacggagatgcgtag

SEQ ID NO: 113070 - DNA, 864 bp, Artificial Sequence
  Description of Artificial Sequence: Synthetic coding sequence
tgcttcctcctcccccggggacgagacccagagccccctgaagctggagccgccgctccctgtgccccaggcgcaccggatatgagcttcagaaaggtggttaggcagagcaaatttagacatgtattcgggcaaccagttaaaaacgatcagtgttacgaggacatcagggttagtagagttacctgggatagtactttctgtgccgtgaaccctaaatttctcgctgtgattgtggaagccagcggaggtggcgcctttcttgtgcttcctctttctaagacaggcaggatcgacaaggcgtaccctactgtgtgtggtcacactgggcccgtgctagacatagactggtgcccccacaacgacgaggttatcgcttctggcagcgaggactgcaccgtaatggtatggcagatacccgaaaatgggctcacttctccactaacggaacccgtggtggtgttggagggacataccaagcgagtcggaatcatcgcatggcatccaactgcccgtaacgtgctgctatccgcaggttgtgacaacgtggtgttgatatggaatgttggtaccgctgaggagctgtaccgactcgattccttgcatcctgacctcatctacaatgtgtcttggaatcacaatggcagcctgttctgttccgcatgtaaagataagagtgtgagaataattgacccccgccgcggtacactagtggctgaaagagaaaaagctcatgagggagcgcgcccgatgcgggccatcttcttggccgatggaaaagttttcactaccggattctctaggatgagtgagagacagctcgctttatgggatcctggcgtcagaagattttgccttgcctag

SEQ ID NO: 113071 - DNA, 1470 bp, Artificial Sequence
  Description of Artificial Sequence: Synthetic coding sequence
atgagctttcggaaggttgtgaggcagtccaagttcaggcatgtgtttgggcagcctgtgaagaatgatcaatgttacgaggacattcgggtcagtagggtgacatgggattctacattctgtgcagtgaaccccaagtttctagctgtaatcgtggaagcatccggaggtggggcgttcctggtcctgccattgtctaaaaccgggagaatcgacaaggcttatcccaccgtctgcggccacacaggcccagtactagacattgactggtgtccgcataatgacgaggttattgcgagcggaagcgaagactgtacggttatggtgtggcagatccccgaaaatggcctaacctcccccctaacggagcccgtggtggtgctggagggccacactaaaagggtggggataattgcgtggcacccgacagctcggaatgtcctactgagtgccggctgcgacaacgtggtgttgatatggaacgtgggcactgccgaggagctatatagattagactcactccaccccgacctgatctacaacgtaagttggaaccataacgggtctctgttttgttcggcatgtaaggacaagtctgtcagaattattgatcctcgacgcggcactctggtggccgaacgcgagaaggcgcatgaaggagccagacctatgcgggctattttcctggcagacggtaaggtctttacaacagggtttagccgcatgagtgagaggcagcttgcgctgtgggaccctgagaatctggaggagccgatggccctccaggaattggactcatcaaacggggctctccttcccttctacgatcctgacacctcagtagtgtatgtttgcggtaaaggcgactccagtataaggtactttgagattacggaagagcccccatatattcacttcctcaataccttcacatccaaagagcctcagcgcggcatgggatccatgccaaagcgcgggctggaggtgtctaaatgcgagatcgctcgcttttataagctccacgagaggaaatgtgagccaatcgttatgaccgtccctcgaaaatcagacttgtttcaggacgatctgtacccggataccgcaggaccggaagctgctttggaggcagaagagtgggtgtccggtagagacgctgaccctatactgatttcgttacgtgaagcatacgtaccatctaagcagcgtgatctcaagatttcgcgcagaaacgtgctgtccgatagcaggcccgctatggccccaggttccagtcatctgggcgctcctgcttccaccactactgcagcggatgccacaccatccgggtcactggccagggcaggcgaggctggtaaactcgaggaggttatgcaggagcttcgagctcttagggcactggttaaggagcagggggaccgcatttgcaggctggaagaacagctggggcggatggagaacggggacgcttag

SEQ ID NO: 113072 - DNA, 870 bp, Artificial Sequence
  Description of Artificial Sequence: Synthetic coding sequence
atgagtttcagaaaggttgtcaggcagtcaaagttcagacacgtttttggacagcctgtcaaaaacgatcaatgttatgaggatatcagggtgagtcgcgtgacctgggattcaacattttgtgctgtcaatcctaagttcctggccgttattgtggaagcttcaggcggcggcgcctttctggtgctacctttatccaaaaccggccggatagacaaggcgtatcccaccgtatgcggccataccggaccagttctggacatcgactggtgtccgcacaatgacgaggtgatcgcaagtggtagtgaggattgcacagtaatggtgtggcagatccccgaaaacggcctcacaagcccgctaactgaacccgtagtcgtgctggaaggtcacaccaagagagtgggaatcatcgcatggcacccaactgcgaggaatgtactgcttagcgccggatgcgacaacgtggtgctgatttggaatgtgggaaccgcggaggagttataccggctagactccctccacccagatcttatttacaatgtatcttggaaccataacggcagtctattttgctccgcctgcaaggataagtccgtccgcatcatagaccctcggcggggcacactcgtggccgagcgcgaaaaagcgcacgaaggcgcccgcccaatgagggccatatttctagccgatggaaaggtgttcactaccgggtttagccgcatgagcgaaagacaactcgcgctgtgggaccccgtatccggacagcctgagggagcaaatcttcgcctaggaccacacccggggcccggccggcaagggtctccttggggcggactctggtttttagcctccctgcctgggacctag

SEQ ID NO: 113073 - DNA, 552 bp, Artificial Sequence
  Description of Artificial Sequence: Synthetic coding sequence
atgtcttttagaaaggtggtcagacaaagcaagttcagacatgtatttgggcaacccgtcaagaacgatcaatgctatgaggatatcagagtcagtcgggtgacctgggatagcaccttctgtgccgttaacccgaagtttctggccgtgatcgtcgaagcctccggagggggcgcattcttagtgctgccgctttctaaaacgggccgcattgataaggcatacccgacagtctgtgggcatactgggccggtgttagacatcgactggtgccctcacaacgatgaggttattgcatcggggagcgaagactgtactgtcatggtgtggcagatcccagaaaacggtctgacctccccgctcaccgagccggtggtagttctcgaggggcatacaaaacgtgtaggcataatcgcttggcatcctacagctcggaatgtccttctctcagcgggcctgcacaggccccccttttgcgcgccccctccacacggacccttacacacttctcagcaaccactccagggaccgcatgacaagtgggagtcttag

SEQ ID NO: 113074 - DNA, 1425 bp, Artificial Sequence
  Description of Artificial Sequence: Synthetic coding sequence
atgaggagggtcgtccgccagagcaaatttcggcacgttttcggccaggctgtaaagaatgaccagtgctatgatgatatcagagtctctcgtgtgacctgggactcaagtttctgtgcagtgaacccacggttcgtcgccatcattattgaggcatcgggaggaggcgccttcctggtcctgccactgcacaagaccggaagaattgacaagagttaccctaccgtgtgcgggcacactggtcccgttctggacattgactggtgcccacataacgatcaagttatcgcctctggaagtgaagattgtactgttatggtctggcagatccctgaaaatggactcacactctctctcacagagcctgtagtgattctggaagggcactctaaacgcgtgggcatcgtcgcctggcacccaaccgctcggaacgttctgctcagcgctggatgcgacaatgccattattatttggaatgttggaactggggaggccctgataaacctggatgacatgcatagtgatatgatctacaatgtttcatggaacaggaacggatccctcatttgcacagcaagcaaggacaaaaaggtgagggtgatcgatcctaggaagcaggaaatagtcgccgagaaggagaaggcgcacgagggcgctaggcctatgagggccatattccttgccgacggcaatgtttttacaaccgggttcagccgcatgtctgagagacagctggccctttggaaccccaagaatatgcaggagccaattgcacttcacgagatggatacttccaacggtgttcttttgccgttttatgatcctgatactagcatcatatacctctgtggaaagggagattcgagtatccgttacttcgaaattaccgatgagagcccatacgtgcactacctgaatacgttctccagtaaagagccacagcgtgggatgggctatatgccaaaacggggcctagacgtaaacaaatgcgagatagctcgtttctttaaattacacgaaaggaaatgcgaacccatcatcatgactgtccctcgaaaaagtgacctgttccaggacgacctctaccccgacacagccgggccggaagccgccctagaggccgaagagtggttcgaggggaaaaacgcggatccaatcctgatcagtctgaagcacggctacattcccggcaagaatcgtgatcttaaggtggtaaagaagaatattctcgattctaaacctaccgctaacaagaagtgtgatttgatcagtatccccaagaagaccactgatacagcctcagtgcagaatgaagccaagctggatgaaatcctaaaagagattaaaagtatcaaagataccatatgcaatcaggatgaaaggatctcaaagttagagcagcagatggccaagattgccgcttag

SEQ ID NO: 113075 - DNA, 1584 bp, Artificial Sequence
  Description of Artificial Sequence: Synthetic coding sequence
atgtacggccccgggtcccagctggggaagtccggaaataactcctgggccaaggagcgtggttgctctatcgcctgtcaaggatctctcacctctgcaaggctacatgcgccatcgatcggcgaacggcctctgtcacacatgagatggaaggataccatgcgtcgggtcgttcggcagtccaagttccgacacgtgtttggccaagcagtcaaaaacgaccagtgctacgacgatattcgcgtgagccgcgtgacctgggatagcagtttttgcgccgtgaaccccaggttcgttgccatcattattgaagcatccggaggcggcgccttcttggtgctgcccctgcacaagaccggcaggattgataaatcctatcctactgtatgcggacatactgggcccgtgttggatatcgattggtgcccccataatgaccaagtgattgcatctggttcagaagattgtaccgttatggtttggcaaataccggagaacggcctaactctgagcctgaccgagccagttgtgatcctagaggggcattcaaagcgagtggggatcgtcgcctggcaccctaccgcgaggaatgtgctgctgagcgccggatgtgataatgccatcattatttggaatgttggcacaggcgaggctctgattaacctggacgacatgcactccgatatgatttataatgtatcctggaacagaaatggctctcttatatgtaccgccagcaaagataagaaagtgagagtgatcgaccctagaaagcaggaaatcgtggccgagaaggaaaaggcccacgagggagcgcgccctatgcgcgccatatttctggccgacggcaacgtttttactacggggttctcccggatgtccgaacggcagttagccctctggaaccccaagaatatgcaggagcccatcgcactccatgaaatggacacaagcaatggcgtcttgctcccgttttacgaccctgacacttctatcatttatttgtgcggcaagggcgactccagcatccgctacttcgaaatcacagatgagtctccatacgttcattatctgaacacattcagtagcaaggaaccacagcgagggatggggtacatgccaaagcggggcctcgatgttaataaatgcgaaatcgctagattcttcaagttgcacgaacggaaatgtgagcccatcatcatgacagtgcccagaaaatctgacctatttcaggatgacctgtatccagacaccgccgggcccgaagctgcactggaggctgaagaatggtttgaaggcaaaaacgccgatcccatcctgatttcactgaaacatgggtacattcccggtaaaaatagggacttgaaagttgtgaaaaagaacatactggatagtaaacctaccgccaataagaaatgtgacttgatctctataccgaagaaaaccaccgatacagcatcagtccagaacgaagctaagctcgacgagatcctgaaggagatcaaaagcatcaaggacacaatctgcaaccaggatgagcggatatctaagctcgaacaacagatggccaaaatcgctgcttag

SEQ ID NO: 113076 - DNA, 1425 bp, Artificial Sequence
  Description of Artificial Sequence: Synthetic coding sequence
atgaggagggtggtgcgccaatcgaagttccgtcacgtctttggccaggctgtcaaaaacgaccagtgctacgatgatatccgggtcagtcgtgttacgtgggattcctcattttgcgctgtgaatccaaggttcgtcgctatcataattgaagcttctggcggcggcgctttcctggtgttgccactacacaagaccggccgtatcgacaaatcatacccaactgtgtgtggccatacaggtccagttctggatattgattggtgtccacacaacgaccaggttattgcttccggcagcgaagactgcacggtcatggtgtggcagattccagagaacggcctgacactttccttgaccgagccagtcgtaatcctcgaaggccactcaaaaagggtcggtatagtcgcttggcaccccacagcaaggaatgtcctcctgagcgcagggtgcgacaatgcgatcatcatttggaacgtggggactggggaagcactcatcaacctcgatgatatgcacagtgacatgatatacaacgtgagttggaaccggaatggctctctaatatgcaccgcaagcaaggacaagaaagtgcgggtgatagaccctcggaagcaggaaatcgtggccgagaaggagaaggctcatgagggcgcgagaccaatgcgtgccatctttctcgccgacggaaacgtcttcaccactggattctccagaatgagtgagcgacaacttgcgttgtggaaccctaagaatatgcaggaacccattgcattgcatgaaatggacaccagcaacggcgtccttctgccattctatgatcccgatacatcaatcatatacctgtgcggcaaaggcgacagtagtatacggtactttgagatcacagacgaatctccttacgtccattatttaaatactttctctagtaaagaacctcagcgcggcatgggctacatgcctaagagggggctcgatgtcaacaaatgcgagattgctcgcttcttcaaactgcatgagaggaagtgcgagccaattattatgacagtcccacgcaagtctgatctgttccaggacgatctctaccccgatactgcagggccagaggctgcgttggaagccgaagagtggttcgagggtaagaacgccgaccctatccttatctccctgaagcacggatacattcctgggaagaaccgggacctgaaagtggtcaagaagaacattttggacagcaaacccaccgccaataaaaaatgcgacctaatcagcattccgaagaagaccacagatacggccagcgttcagaatgaggcaaaactggacgaaatactgaaggagattaaaagcatcaaagacaccatatgcaatcaggacgagagaatcagcaaacttgagcagcaaatggcaaagatcgcagcctag

SEQ ID NO: 113077 - DNA, 489 bp, Artificial Sequence
  Description of Artificial Sequence: Synthetic coding sequence
atgaggcgtgtcgtacgccagtctaaattccgacatgtgtttggccaagctgtaaagaatgatcagtgctacgacgatattagggttagccgagtcacctgggacagtagcttttgcgctgtgaatcccagatttgtggctattatcatcgaagcgagcggcggcggcgccttccttgttctacccctccacaaaaccgggcgcatagataaaagctaccctactgtctgtggccacacaggccctgtattggacatagattggtgcccgcacaatgatcaggttatcgcatcaggcagcgaagactgcaccgtgatggtgtggcagattcccgaaaatgggctcactttgagtcttacagaacccgtcgtgatcttagagggacacagcaaacgggtgggaatcgttgcttggcacccaaccgcccgcaatgttcttctgtccgccgggtgcgacaatgcaattattatatggaatgtagggacctag

SEQ ID NO: 113078 - DNA, 498 bp, Artificial Sequence
  Description of Artificial Sequence: Synthetic coding sequence
tcgaaagagccacagcgtggtatgggatacatgccaaaaaggggccttgatgtcaacaagtgcgaaattgcacgcttctttaaactgcatgaacgcaagtgtgaaccaatcattatgacagttccaaggaagagtgacttgttccaggatgacctgtatccagatacagccggaccggaggccgcccttgaggcggaagaatggttcgaaggcaagaacgcagatcctattttgatttctctaaagcatggttacattccaggcaaaaatcgggatctgaaggtcgtaaagaagaatattctggatagcaaacctacagcaaataagaaatgcgacctcattagcattccgaaaaagaccactgataccgcatcagtccaaaacgaggctaagctggacgaaatcctgaaagagatcaaatccattaaagacaccatctgcaatcaggatgagaggatatccaagctggagcagcagatggcaaagatcgctgcttag

SEQ ID NO: 113079 - DNA, 546 bp, Artificial Sequence
  Description of Artificial Sequence: Synthetic coding sequence
atgcgacgggtggtgcggcaatccaaatttcgtcatgtgttcggacaagccgtgaagaacgaccaatgttacgacgatatcagagtctctagggtgacctgggatagctccttttgtgctgttaatccgcgttttgtcgctatcataattgaggctagcgggggaggcgcattcctggtccttccactacacaagacaggaagaattgacaagtcctacccaactgtatgtgggcataccgggccagtattggacattgattggtgcccccataacgatcaggtgatcgccagcggatcggaagactgcactgtgatggtctggcagatccccgagaatggcctcactctgtcgcttacagagcccgtggtgatcctggaaggacattccaagagagtggggatcgtagcatggcatcccactgcgagaaacgtacttctctcagctggttgcgataatgcaatcattatttggaatgtgggaactggtgaagcactgatcaaccttgacgatatgcatagtgatatgatctacaacgtgagttag

SEQ ID NO: 113080 - DNA, 1443 bp, Artificial Sequence
  Description of Artificial Sequence: Synthetic coding sequence
atgaggtggaaagatactatgcgcagagtcgtgcgacagagtaaattccgccacgtatttggacaggcagttaagaatgaccagtgttacgacgatattagggtgagccgggtgacatgggacagcagcttctgcgcggtcaaccctaggtttgtcgcgatcataatcgaagcctcaggcggcggcgcctttttagtgctaccattgcacaagactggaagaattgacaagtcttatccaactgtgtgtggccacactgggcccgttttggacatcgactggtgcccgcataacgatcaagtcattgcatctggatccgaggattgtaccgttatggtgtggcagatcccggaaaatggtttgacccttagtttgactgaacctgtcgtcatcctggaaggtcacagcaagcgggtgggaattgtggcgtggcaccctacagcaagaaacgtattgcttagcgcaggttgtgataacgcaatcatcatttggaacgtgggaaccggagaagcgctgataaaccttgatgatatgcacagcgatatgatctacaatgtcagctggaacaggaacggcagcctgatttgcacagcctctaaagacaaaaaagttagggtcatcgatccaagaaaacaggagatcgtggctgagaaggagaaagctcacgagggtgccaggccaatgcgcgcaatcttcctggctgacggcaatgtatttacaaccggattcagtagaatgtcagagcgccaactggctttatggaaccccaagaacatgcaggagccgatagccctgcatgaaatggatactagtaatggcgtcttgttgcccttttatgatccagacacatccatcatctacctgtgtggcaagggtgactcttccattaggtatttcgaaatcactgacgagtcaccctacgtgcactacctgaataccttcagctccaaggagccgcagaggggcatgggctacatgccgaagcgcggcctcgatgtaaataaatgcgaaattgccagattcttcaagctgcacgaaagaaagtgcgagcccataattatgacagttcccagaaaatcggacttgtttcaggacgatctgtaccccgatacagcagggcctgaggcagctttggaagcagaggagtggttcgagggcaaaaatgctgacccaatcctcatctctttgaagcatggttacattcccggcaaaaaccgagaccttaaagtggttaagaaaaacatattggatagtaaacccactgctaacaagaaatgtgatctcatcagcatacccaagaagaccacagatacagcaagcgtgcagaatgaagcaaagcttgacgaaatcttaaaagagattaaaagcatcaaggacacgatctgcaatcaagatgaacgcattagtaagctggaacagcagatggccaagattgccgcctag

SEQ ID NO: 113081 - DNA, 510 bp, Artificial Sequence
  Description of Artificial Sequence: Synthetic coding sequence
atgcggagggtagttaggcagagcaagtttcgccatgtctttggtcaagctgtgaagaatgatcagtgttatgacgatattagggtctcgagagtgacttgggactcatctttttgcgcagtgaaccctaggttcgtggctattatcatcgaggcctccggaggaggagcgtttctggtactgcctttgcacaagaccggccgcattgataagtcctatcctactgtctgcggccacaccggtcccgtattagacatagattggtgcccacataacgaccaggtgatcgcctccggatccgaagactgtaccgtaatggtgtggcagatcccggagaatggcctgactctctctttgactgaaccggtggtcatcctggaaggtcactccaagagggtgggcatcgtggcttggcatcccaccgcgaggaatgtgttgctttcagctgggtgtgataatgcaatcatcatttggaatgtcggcacgggagaagccctgataaacctgtag

SEQ ID NO: 113082 - DNA, 456 bp, Artificial Sequence
  Description of Artificial Sequence: Synthetic coding sequence
atgcgcagagtcgttcggcagagtaagtttaggcacgtcttcggtcaagccgttaagaatgaccagtgctacgatgacatcagagtgtcgcgtgtgacctgggactcatctttctgcgctgtgaacccgcggttcgtggccattataattgaggcaagcggcggcggcgcgttcctcgtgttaccccttcataagaccggcaggatagataagtcttatcccactgtgtgcgggcacacgggtcccgtgctggatattgattggtgcccacataatgaccaggtgatcgcctcaggtagcgaggattgtactgttatggtttggcagatccccgaaaacggcctgacattatcacttacggaaccagtggtgatccttgaaggccatagcaaaagagtgggtatagtggcatggcaccccacggcacggaatgttctactgtctgcaggggggtag

SEQ ID NO: 113083 - DNA, 492 bp, Artificial Sequence
  Description of Artificial Sequence: Synthetic coding sequence
atgcgacgcgtcgtgcggcagtctaagtttaggcatgtgtttggacaggccgtgaagaatgatcagtgctacgatgacattagagtgagccgggtcacctgggactcctccttttgcgcggtgaatccacggttcgtggccattattatcgaggccagcggtggcggcgccttcctggtgctgcccctgcataagacaggcagaattgacaaaagctatcccaccgtctgtggccataccggaccagtacttgatatagattggtgtccgcataacgaccaggtgattgcctctggctccgaagactgcactgttatggtctggcagattccagaaaatgggctcaccctgagccttacagagcctgtggttatattggaaggccactccaaacgcgtgggaattgtggcctggcaccccacggcccgaaacgtgcttctgagcgcgggttgcgacaacgcaatcatcatctggaacgtgggcactggatag

SEQ ID NO: 113084 - DNA, 1578 bp, Artificial Sequence
  Description of Artificial Sequence: Synthetic coding sequence
atgtcatggcacccccaatataggtcatctaagtttagacacgtgttcgggaaacccgcttccaaagagaattgttatgacagcgtccctataaccagaagtgtgcacgataaccatttttgtgccgttaatccccactttatcgcagtggtgactgagtgcgctggcggtggcgcttttcttgtgatcccacttcaccagactggaaaactggacccccattaccctaaagtctgcggccaccgcgggaacgtcctggatgtgaagtggaacccgttcgatgacttcgagatcgcatcttgttcagaagatgcgactattaagatctggtccatcccaaaacaactactgacacgcaacctgactgcctaccggaaggaattggttggccacgcgagacgcgtgggccttgtggagtggcatcccaccgctgcaaacatcctcttcagtgccggttatgactataaagtcatgatatggaatcttgacaccaaagagtcagttatcacttcaccaatgagcaccatttcctgtcatcaggatgtgatcctctcaatgagtttcaatacaaacgggtctctattggccaccacctgtaaggatcgaaagatccgcgtgatcgacccccgggccggaactgtgctgcaggaggcatcctataaaggacacagagcctctaaagtgttgtttctggggaatttaaaaaaacttatgagcacgggcacatcccgatggaacaacagacaggttgccctctgggatcaggataatctgtccgtgcccttaatggaggaggacctggacggcagttccggcgtgctgttccccttctatgacgctgatacgtctatgctgtatgtcgttgggaaaggcgacggaaacatccgctattatgaggtttccgcagataagccgcacctgtcttatcttaccgaatatcggagctataatcctcagaaaggtattggtgttatgcccaagagggggttggacgtcagctcctgcgagattttccgcttctacaagctgattactacaaagtcactgattgagcctatatccatgattgtgcctaggcggtctgagtcctatcaggaagatatctatcccccaaccgcgggtgctcagcccagcctgaccgcgcaagagtggttgtctggtatgaatagggatcctatcctggtgtccctcagaccagggtcagaattgcttcggccccatcctttacccgccgagagaccaatttttaactccatggctccagccagcccacgcctgctgaaccagactgagaaattggccgctgaggacggctggcgttcctcgtcactccttgaggaaaagatgccccgatgggcagccgaacaccgcctcgaagagaagaaaacctggctgactaacggatttgatgtattcgagtgtcctccacccaaaaccgaaaatgagctgcttcaaatgttctacaggcagcaagaagagatccgaagactgagagaactattaacgcagcgggaggtccaggccaaacagctcgagctcgaaatcaagaatcttcgaatggggtccgagcagttatag

SEQ ID NO: 113085 - DNA, 1578 bp, Artificial Sequence
  Description of Artificial Sequence: Synthetic coding sequence
atgtcatggcatcctcagtaccgatccagtaaattcaggcacgtatttggaaagcccgcatcgaaagagaattgctacgattccgtgccaatcacacgctcagtccatgataaccacttttgcgcagtgaatccgcactttatcgcagtggtgaccgagtgcgcagggggcggcgccttcttagttataccactccaccaaacaggaaaattggatcctcactacccaaaggtctgcggccacaggggtaacgtcctagatgtcaaatggaacccgttcgacgactttgagatcgcaagctgttccgaagatgcaactatcaagatttggagcattcccaagcaacttctcacacgtaatcttacagcctatagaaaagagctggtaggtcacgcccggagagtggggctggtggagtggcatcctactgctgctaacatactattcagcgccggctacgattataaggtgatgatatggaacctggacaccaaagagagcgtgatcactagtcccatgtcaacgatctcatgccaccaagacgtcatcctgtctatgtcattcaataccaatggctccctgctggctacaacatgcaaagaccgtaaaatccgcgtcattgacccgagagcaggtactgttctccaggaggctagttacaagggtcaccgggcttctaaggtcctgttcctcgggaacctgaaaaagctcatgtcaactggtacttcccgctggaacaatagacaggttgccttgtgggatcaggataatctgtccgtgcccctgatggaggaggacctggacggctcctctggcgtattgttccctttctacgatgcagatacttccatgctttacgtggtcggaaagggggatggcaatattagatactatgaagtgtccgctgataagccgcatctctcgtatctcactgaataccgaagttacaacccacagaagggcataggcgtaatgcctaaacgcggcttggatgttagctcgtgtgaaatttttagattctataaactgatcactactaaaagcctaattgagcccatttctatgattgtgccccggaggtcagagagctatcaggaggacatctacccaccaacagctggagctcaaccctccttgaccgcacaggaatggctatccggcatgaaccgggatcccatcctggtctctttgcggccaggaagtgaacttctaagacctcaccctctccccgctgagaggcccatattcaacagcatggctcccgcatcacctcgactgctgaatcaaactgaaaagttggccgccgaggatggatggcgttcaagctcgttactcgaggagaaaatgcctaggtgggccgctgaacaccgtttggaggagaaaaagacttggcttacaaatgggttcgacgtgttcgaatgccccccgcccaagacagagaacgagcttttgcagatgttctataggcagcaagaggaaattcggcgtttaagagagttgctcacccaacgcgaagtgcaggccaaacagctcgagctcgaaattaagaacctcaggatggggagcgagcagctctag

SEQ ID NO: 113086 - DNA, 1443 bp, Artificial Sequence
  Description of Artificial Sequence: Synthetic coding sequence
atgactgtcactaaaatgtcttggcgcccacagtacagatcaagtaagttcagaaatgtgtatgggaaggtcgccaaccgagaacactgtttcgacggcatacccataacgaaaaatgtccatgacaaccacttctgcgcagttaataccaggttcctggccatagtgaccgagagtgccggtggaggatcgtttctggtcatcccacttgagcagaccggaagaattgaaccgaactatcccaaagtctgcggacaccaaggcaacgtgctggacatcaagtggaaccctttcatcgataatataatagcttcctgtagcgaagatacctccgtcaggatctgggagatcccagaggggggcctgaagcggaatatgacagaggcattgctggaactgcatggtcatagccggagagtgggcctggtagaatggcaccctacaaccaataacattctcttctctgcagggtacgactataaggtcctcatatggaatctcgacgtgggcgaacccgtcaaaatgatcgactgccacaccgacgtgattctgtgcatgtcatttaataccgatggaagcctgctgactactacatgcaaggacaagaagttaagggtgatagaacctaggagtggacgggtactacaagaagccaattgcaagaatcatcgcgtgaaccgcgtggtgttcctggggaacatgaaaagactgctcaccactggagtgtccaggtggaacaccagacagattgcactgtgggatcaggaagacctgtcaatgcccctgatcgaagaggaaatcgacggacttagtgggctgctttttcccttttacgatgccgatactcatatgctctatctggctgggaaaggtgatggcaacattagatactatgagattagtaccgaaaagccttacctgtcatacctgatggagttccgatcccccgcgccccagaaggggctcggagttatgccaaaacatgggctcgacgttagtgcgtgcgaggtctttagattctacaagttagttactctaaaaggcttgatcgagccaatctccatgatcgtccctcggaggagtgacagctatcaggaggacatttaccccatgacgcccggtactgaacctgcattgacaccagatgagtggcttgggggcattaaccgggaccccgtattgatgagtctgaaggagggttacaaaaagtcctcaaagatggtctttaaagcccctattaaagaaaagaaaagtgtggtagtcaatggaatcgatctgcttgaaaacgtaccccctcgaaccgaaaacgaattattgagaatgttcttccggcagcaggatgagattcgcaggctgaaggaggagctggcgcagaaagatattcggatccgccagctgcaactggagcttaaaaatctcaggaacagcccaaagaactgctag

SEQ ID NO: 113087 - DNA, 1428 bp, Artificial Sequence
  Description of Artificial Sequence: Synthetic coding sequence
atgtcttggcgtcctcagtatcgaagctcaaagttcagaaatgtgtacggcaaggttgccaacagagaacattgcttcgacggaatccccatcacgaaaaacgtgcacgacaatcacttctgtgcagtcaacactaggttcctcgcgatcgtcaccgaatccgcagggggggggagtttcctcgtcataccccttgagcagaccggacggatagagcctaattatcctaaggtttgtggacatcaggggaatgtccttgacatcaagtggaatccctttatcgataatattatcgcctcctgtagtgaggatacaagtgtccgaatctgggaaattcctgagggcggacttaagcgaaacatgaccgaagccctgttggaattgcacggccactcaagacgagtcgggttggtcgagtggcaccctactactaataatatcctgttctctgctggatacgactacaaggtcctgatttggaatctggatgttggagaacctgtaaaaatgatagactgccatacagacgtcattctatgcatgtcctttaataccgatgggtccctcttgacaaccacctgcaaggacaaaaagttgcgggtgatcgagccccgatcaggcagagtgcttcaggaggcgaattgtaaaaatcatagagttaacagagtggtgttcctgggcaacatgaaaaggctgctgacaacgggcgtctccaggtggaacacgagacagatagccctttgggaccaggaggacctgtccatgccattgatcgaagaggagatagacggacttagtgggctgctcttccctttctatgatgctgacacacacatgttatatcttgcaggtaagggcgatgggaacatacgttattacgagatatccaccgagaagccttatctatcctatttgatggaattcagatccccagctccacagaaagggctgggagttatgcctaagcacgggttagacgtgtcggcttgtgaggtgtttcgtttctataagctcgtcactctgaagggactcattgagccaatatcaatgatcgtcccacggcggtctgactcctatcaggaggacatttatccaatgacaccaggtaccgaacctgcgcttacacctgacgagtggctcggagggattaatagggaccccgtcttaatgtcactgaaggaagggtacaagaagtccagcaagatggtctttaaggctcccattaaggagaaaaaatccgtggtggtgaacgggattgatctcctagaaaacgtgcccccaaggaccgaaaacgagctgctgagaatgttcttcagacagcaggacgaaatacggcgactgaaggaagaattggcccaaaaggacatcagaatcagacagttacaactggagttgaagaacctgcgaaattcccctaagaactgctag

SEQ ID NO: 113088 - DNA, 1428 bp, Artificial Sequence
  Description of Artificial Sequence: Synthetic coding sequence
atgagctggcgtccacaatatcggtctagcaagtttcgcaatgtatacgggaaggtggccaacagggagcattgtttcgacgggatccccattacaaaaaacgtgcatgataaccatttctgtgctgttaatactcggttcctcgccatagtgaccgagtctgccggaggcggatcttttcttgtgattcccctggaacagacaggcagaattgaacctaactaccccaaagtctgcggccatcagggtaatgtgctggatataaaatggaatccctttattgacaatatcattgcatcatgctcagaggacacatctgtaagaatctgggagatacctgaaggcggattgaaacgaaacatgacagaggccctcctggagcttcatgggcatagcaggcgcgtcggattagtggagtggcacccaactacaaacaacattcttttcagcgccggttatgactataaagtattgatttggaaccttgatgtgggggagcccgtgaagatgatcgattgtcacacggacgtgatactctgcatgtcttttaatacggacgggtctttgttaaccactacctgtaaagacaaaaaattgcgggtgatcgaacctagatccggccgcgtactgcaagaagccaattgcaaaaaccatcgggtgaatcgcgtcgtgtttctgggaaatatgaagcgcctccttaccacgggagtctcaaggtggaacaccaggcaaatagccctgtgggaccaggaagatctcagcatgcctctgattgaggaagaaatcgacggactgtccggccttctctttccattttacgatgccgacactcatatgttatacctggccggtaaaggagatgggaacattaggtactacgaaatctctacagaaaaaccttacctgtcctacctgatggagtttaggtcacccgccccacagaagggacttggggttatgcctaagcacggcctggacgtgtcggcctgtgaggtgttcagattctacaagctcgtaacactgaaagggctgattgaacctattagcatgatagtacctagacgctcagattcttaccaggaagatatatatccaatgacgcctggaaccgaaccagcgctgacacctgacgaatggctgggcggaattaaccgtgacccagtcttgatgagccttaaagaagggtataagaaatccagtaaaatggtgtttaaggcccctattaaagaaaagaaatcagtagtagtgaatggtattgaccttctggagaacgtccccccaaggacagagaatgagttgctcaggatgttctttcggcaacaggacgagattagaaggctaaaggaagagttagcgcagaaggatattcgcatccgccaactacagctcgaacttaaaaacctgcgtaatagtcccaagaactgctag

SEQ ID NO: 113089 - DNA, 4992 bp, Artificial Sequence
  Description of Artificial Sequence: Synthetic coding sequence
atggccacagacggggccagctgcgagcccgatctgagccgcgcacccgaagatgcagcaggcgctgctgccgaagcagctaaaaaagagtttgatgtcgatactctttcaaagtccgaactgcgcatgttactgagcgtcatggagggcgaactcgaagctcgcgacctagtgatcgaggccctgagggcccggaggaaagaagtttttattcaggagagatatggaaggttcaatctgaatgatccttttctggcccttcaacgggactatgaggcaggagcaggggataaagaaaaaaaacccgtgtgcactaacccgctgtccatcctggaggcagtcatggcacactgcaaaaaaatgcaggagcggatgtccgcccagctcgcagctgctgaaagtcggcaaaaaaaactggaaatggaaaaactgcagctccaggccctggagcaagagcacaagaagctggcagcacgattagaggaggagcgagggaagaacaagcaggtggtgttgatgcttgtgaaggaatgcaaacagttatccgggaaagttattgaagaagcccagaaattagaagacgtcatggcgaaacttgaagaggaaaagaaaaaaaccaacgaacttgaggaggagctttctgccgaaaaacggaggtcaactgagatggaggcccagatggagaagcaattatccgaattcgatacagaaagagagcagctgcgggcaaagctgaaccgcgaggaagctcatacaactgacctcaaggaagaaattgacaagatgcggaagatgattgagcagctcaagcgcggctcagacagcaagccatcgctctctctgccccggaagacaaaggaccggcgcctggtctcaattagtgtaggcaccgaggggacagtgacaagaagtgtggcctgccagactgatctggtcacagagaatgctgaccatatgaaaaaacttccattgaccatgccagtgaagccttccaccggatcacccctggtgtcagctaacgctaaagggagtgtgtgcactagcgccacaatggctcgacctgggattgaccgacaggcgtcatatggggacttaattggagcctctgtccctgctttcccaccgccttccgcaaataaaatcgaagaaaacggcccatctactggcagcacccccgatccaactagttccacccctcctctcccatccaatgccgcccccccaacagcccagacccctgggatagcgccccagaattcccaggccccccccatgcactccctgcactccccatgcgccaacacctcacttcaccctggcctcaacccacggatccaggctgccaggtttcgatttcagggaaacgctaatgacccagaccagaatggtaatacaacccagtctcccccctcgagggatgtttctccaacgagccgagataatctcgtagccaagcagcttgccaggaatactgtgacacaggccctgagcaggtttacctctccccaagccggagccccctctcgccctggcgtaccgcctacaggggacgtcggcacacacccaccggttggacgtacatctctcaagacgcacggtgtagccagggtggaccgcggcaaccctcctccgatccctcccaaaaagccagggctgtcccaaaccccctcaccacctcatcctcaattaaaggtcattattgattccagcagagccagcaacactggtgctaaggtggataacaagaccgttgccagcactccttcttctctgccccagggcaatagagtcataaatgaagagaacttgcccaagtcgagcagcccacagctcccaccgaagccttctattgacctgacggtggcgcccgctggctgcgctgtctctgccctggccaccagtcaggtgggggcctggccggccgccacacccggactcaaccagccggcttgttccgactcatccttagtgataccaacaacaattgcattttgtagtagtatcaaccccgtctctgcttcctcctgccgcccgggggccagcgactcactcctggtgaccgcctccgggtggtccccgtctcttaccccacttctgatgagtggggggcccgctccactggccgggcgtccaacacttctccagcaggctgctgcccagggtaatgtgaccctgctgtctatgttactcaatgaagagggccttgacataaactatagttgcgaagacggccacagcgcactctacagcgccgccaaaaacggacataccgattgtgtgcgcctgctcctgtcagcagaggcccaggttaacgccgcagataaaaatgggtttaccccgctctgcgcggcagccgcacaggggcacttcgagtgcgtcgagctcctcatctcctacgatgccaacattaaccacgccgccgatggtggccagactccactgtatctggcctgcaagaacggcaataaagagtgtattaaactactgctggaggcaggtaccaacagatccgtgaaaaccaccgacggttggacacccgtgcacgccgccgtcgataccggaaatgtagacagccttaagctccttatgtatcaccgaatccctgctcatggaaactctttcaatgaggaggaatccgagagcagtgtgttcgacctcgatggcggtgaggagtccccagagggcattagcaagccagttgtccccgccgatctgattaatcatgccaaccgggaaggctggaccgctgcccatatagccgcctctaagggctttaaaaattgtctggagattctctgccggcatggtggcctggaacctgagaggcgagacaaatgcaataggaccgtgcatgatgtggccacagatgattgcaagcacctccttgagaaccttaatgccctgaagatcccgctgagaatctcagttggcgaaattgagccatcaaactatggtagcgacgacctggagtgcgagaacacaatttgtgctctgaacatccgtaagcagacatcatgggatgacttttctaaagccgtgtcccaggcactgactaaccactttcaagctattagttcggacggatggtggtctctagaagatgtcacgtgcaacaatacaacagactcgaatattggtctgagcgctcgaagcatccgcagcatcaccctgggcaacgtgccttggtctgtggggcagagcttcgcccagagcccctgggattttatgcgtaaaaacaaggccgaacacatcacagtgctgctgagtggtcctcaggaaggatgcctgtctagtgtcacctatgccagtatgatccccctgcaaatgatgcagaattacttgagactggtggagcagtatcataacgttattttccatggaccagagggcagcttgcaggactacattgtccaccagctcgctctgtgtttgaagcatagacagatggcggctggattctcttgcgaaattgtacgggctgaggtggatgccgggttttcaaaagagcagttactggaccttttcatctcttcagcttgtctcatacctgtaaagcagtcaccatctaagaagaaaattataatcattctggagaatcttgagaagtcaagcctttccgagttgctgagggactttctggctccactcgagaatcggtccaccgagtcaccttgtactttccagaaagggaacgggttgagtgagtgttactactttcatgagaactgctttcttatgggcaccatcgccaaagcctgtctccagggctcagatctgctcgtgcagcagcactttcgctgggtccagctcaggtgggatggcgagcccatgcaaggcctcttgcagcgattcttgagaaggaaggtggtgaacaaattcaaaggtcaggctcctagcccatgtgacccagtatgtaaaatcgttgattgggcactgagtgtttggcgacagctgaacagctgtctagcacgcctcgggactcccgaggcgctgctaggcccgaagtacttcctgagctgccctgttgtccccggccatgctcaggtaacggtgaagtggatgtcaaaattgtggaatggagttattgccccacgagtgcaggaggccatcctgtcccgcgctagtgtcaagaggcagcctggatttgggcagactacggcaaagaggcatcccagccaagggcagcaagccgtagtaaaagcggcactctcgatcctgctcaacaaagcggtgctccacggctgtcctttaccaagagctgagcttgaccagcacaccgctgacttcaagggcggttccttcccgctttcgatagtttcgtcctataatacctgtaacaagaagaagggagagtccggcgcgtggcgcaaggtaaacacatcaccacggagaaaaagtgggagattctccctcccaacatggaacaagcccgacctttccaccgagggtatgaagaacaagacaatctctcagcttaactgtaatcggaacgccagcctaagcaaacaaaaatccctcgagaacgacttatccttgactctcaatctggatcagaggctatctttgggatccgatgacgaagcggacttggtgaaggagctgcaatcgatgtgctctagcaaaagcgaaagcgacataagcaaaatcgccgattcccgagatgacctgcggatgtttgacagcagtgggaataaccccgttctgagcgccacaatcaacaatttgcgcatgcccgtgagtcaaaaggaggtctccccactctcttcccaccagacaactgagtgctcaaatagcaagagcaagacagaacttggtgtgtccagagtcaagagcttcttgcctgtgccacggagtaaagtcactcaatgctcacaaaacacaaagcgcagctcctcatcttccaatacgagacaaattgagatcaataataatagcaaggaggtaaactggaacctgcataagaatgaacatttggagaagcctaataaatag

SEQ ID NO: 113090 - DNA, 249 bp, Artificial Sequence
  Description of Artificial Sequence: Synthetic coding sequence
atgtcggctacatggacacttagccctgaaccactcccaccaagcaccgggcctcccgtcggcgccggcctggatgccgagcagaggaccgtatttgctttcgtactgtgtctgctagtggtcctggtgttgctcatggtcagatgcgttcgcatcctcctcgatccttacagtaggatgcctgcctcaagctggactgatcacaaggaagctttggagagaggccagtttgattacgccctggtgtag

SEQ ID NO: 113091 - DNA, 969 bp, Artificial Sequence
  Description of Artificial Sequence: Synthetic coding sequence
atgtcgccaaatttcaagctgcagtgtcattttatacttatctttctgactgcccttaggggggaatcgcgatatctcgagttacgggaggcggccgattacgatcccttcttactgtttagtgcaaatcttaaaagggagctagctggggagcagccatacaggagggccctgcggtgtttggatatgctgtctctacaagggcaatttacatttactgctgatcgacctcagttgcactgtgccgccttctttataagcgaacccgaggaatttatcaccattcattacgatcaggtgagtatcgactgtcaggggggagattttctgaaggtgttcgacggctggatactgaagggtgagaaattcccaagcagccaggaccacccactgcccagtgccgaacgttacatcgacttttgtgagagtggactgagtagaagatccattaggagcagtcagaacgtggctatgatcttcttccgagtgcacgagccaggcaatggattcaccctcactatcaagaccgacccaaatctgttcccttgtaatgtaatatctcagactccaaacggcaaattcactttggtcgtcccccaccagcacagaaattgctcattttctattatctatcctgttgtaattaagatcagcgatttaacattaggacatgtgaacggcctgcagctgaagaagtcttccgcagggtgtgaaggtatcggagatttcgtagaactgctggggggaaccggcttggaccccagcaaaatgaccccgctagccgatttgtgttatcccttccatggaccagcccaaatgaaggtgggctgcgacaacactgtcgtcaggatggtgtcttctgggaagcacgtcaatcgcgttaccttcgaatacagacagttggaaccatacgaactggaaaatcccaacggcaattcaattggagagttctgtcttagtggcctgtag

SEQ ID NO: 113092 - DNA, 723 bp, Artificial Sequence
  Description of Artificial Sequence: Synthetic coding sequence
atgagtcccgaagtccaccagagcaacgttggctggtgtcgacttgttacagctgcctacaactactttcacgtgacaaatttcttttggatgtttggcgagggttgctatttgcataccgctattgttctcacgtattcgacagaccgacttcgaaaatggatgttcatttgtattggatggggcgtcccatttcccattatcgttgcatgggcaatcggaaagttgtactacgacaatgaaaagtgttggtttggcaaaaggccaggggtctatacagattacatatatcaaggaccaatgattctagtgttgttgatcaatttcattttcctgtttaatattgtccgcatacttatgactaaactccgggccagcaccacttctgaaaccatccagtaccggaaagctgtgaaagccacactcgtcctgctcccactgctggggatcacctatatgctttttttcgtcaatcccggcgaggatgaagtgtcacgggttgttttcatctattttaactcctttctagaatctttccaaggattttttgtgagtgtgttttattgcttcctgaatagcgaggtgcgcagcgctattagaaagcgatggcacagatggcaagataaacattcgatccgggccagggtggcgcgcgccatgtctatacccacatctccaacacgagtcagcttccactcaattaaacagagcaccgctgtctag

SEQ ID NO: 113093 - DNA, 1248 bp, Artificial Sequence
  Description of Artificial Sequence: Synthetic coding sequence
atgggtggacacccccaactgaggctggtcaaggctctcctgctcctgggcctcaaccctgtgtccgcatctctccaggatcagcattgtgaatccctctctctggcctctaacatctctgggctccagtgtaatgccagcgtggacctgatcgggacttgttggccacggtccccagccgggcagctggttgtaaggccctgtcccgccttcttctatggggttagatacaacacaacaaataatggataccgagagtgtctggcgaatggcagttgggctgcccgagtgaactattctgaatgtcaggaaatcctgaacgaagagaagaagtcaaaagtgcattatcacgtggccgtgatcatcaactacctcggccactgcatcagtcttgtggccttgcttgtggcttttgtcctgtttttgcgtctgaggtctattagatgtctaagaaacattattcactggaatcttatttcagccttcatccttcgcaacgccacatggttcgtggtgcagctgactatgtcgccagaagtacaccaatctaacgtggggtggtgccgcttagttaccgccgcatacaactattttcacgttacaaacttcttttggatgttcggagaaggctgctacctacacactgccattgtgctcacttactcaaccgatcggcttagaaaatggatgtttatttgcattggctggggtgtgcctttccccatcatcgtagcttgggcgatcggcaaactgtattatgacaacgagaagtgttggttcggcaagcgccctggcgtgtatactgattacatttaccaaggacctatgatcttggtgctcctgattaactttatctttttgtttaatatcgtccggattctcatgaccaaactgagggccagcaccaccagcgagacgattcagtaccggaaggccgtcaaggccacactggttctgctgcctttgttgggaataacctacatgcttttttttgttaaccccggcgaggacgaggttagcagggtggtgttcatctactttaactctttcctggagtctttccaaggattcttcgtaagcgttttttattgttttttgaattccgaagtgcgatccgccattaggaaaaggtggcacaggtggcaagacaagcattccattagggcaagagttgcgcgtgcaatgagcatccctacctcccctacgagggtgagtttccacagcatcaagcagagcacagccgtgtag

SEQ ID NO: 113094 - DNA, 858 bp, Artificial Sequence
  Description of Artificial Sequence: Synthetic coding sequence
atggtgagcgccacgattcctcagaaaaaatccaaggtccattatcatgtggccgttatcatcaactatttagggcattgcatatctttggtcgcgctgctggtggctttcgttctgttcctgcggctcagatcaatccggtgcctaagaaatataatacactggaatctgatctctgcttttatccttcgaaatgctacatggtttgtcgtccaattgaccatgtccccagaggtccaccagtctaatgtggggtggtgtcgattggtgactgcagcctacaactactttcacgttacaaacttcttttggatgttcggtgaaggatgctatctgcacacggccatcgtcctgacatactctacagacagactgagaaagtggatgtttatttgcatcggatggggcgtgccgtttccgattattgtggcctgggcgattggaaagctatactatgataacgagaagtgttggtttgggaagcgacctggcgtgtataccgactacatctaccaggggccaatgatcctggtcttattgatcaatttcatcttcctctttaacattgtgcgcatcttgatgacaaagctccgtgcctctaccactagcgagaccatccaatacagggccagcctgtgcctgtgttccacggtatctagcatcgtgagatctgtactaccctctggccgaggcggcactggcggaaggacctcaacaagaagtgtgcctgaatggccagtgccctgtccgtcaccacctccgcagcctgtctctgcctttaccgcttcctcctctccacaacagtcagagctggccggccatggggcagcacccaaagaactgtggctgggtggatag

SEQ ID NO: 113095 - DNA, 1206 bp, Artificial Sequence
  Description of Artificial Sequence: Synthetic coding sequence
atggggggccatcctcagctgagactcgttaaagcgcttctcctgctggggttgaaccccgtgtctgcatctctgcaggatcaacattgtgaaagcctgagtttggcaagtaacatatctgggttgcagtgtaacgcctcagtcgatctgattggcacttgctggccccgctctcctgctggacaattggtggtaaggccatgtccagcctttttctacggagtccgctataacactaccaacaatggttatcgggagtgtttagccaacggctcttgggcggctagagtgaattattctgagtgccaggaaatattaaatgaagaaaaaaagagcaaagtccactatcacgtagctgtgatcattaactatctgggccattgtatatctctcgtagctttattggtggccttcgtgctattcctccgactccgctccatccgctgcctcagaaatatcatccactggaacttgataagcgccttcattctaaggaacgccacctggtttgttgttcagctgaccatgagtcctgaggtgcaccagtccaatgttggatggtgccgactggtgaccgcagcctataactattttcacgtgactaactttttctggatgttcggtgaagggtgctatctgcacacagccatcgtactgacctatagcaccgatcgtctgagaaagtggatgttcatctgcattggatggggtgtgcccttccccattattgtggcatgggcaatcggcaagctatactacgataatgaaaagtgttggtttggaaagaggcctggcgtttatactgattacatctaccaggggccgatgatacttgtgctcttaataaatttcatcttcctttttaatattgtgagaatcctcatgacgaaactgcgcgcttccactaccagtgagactattcagtatcgcaaagcagtgaaggcaaccctggtcctcttaccgttacttggcatcacatacatgctgttcttcgttaatcctggcgaagatgaagtaagtcgagtagtcttcatctacttcaattctttcctggaatctttccaggtacgttccgctatccggaagaggtggcaccgatggcaagataagcattccattcgagctagggtggcaagggcaatgagcattccaacatcccccacacgggtctcgtttcactccattaaacagagtaccgcggtgtag

SEQ ID NO: 113096 - DNA, 1128 bp, Artificial Sequence
  Description of Artificial Sequence: Synthetic coding sequence
atgggggggcacccccagctcaggcttgtcaaggccctcttattgcttggtctaaacccagtgagcgccagcttacaggaccaacactgcgagagcctttccctggcatccaacatctccgacaacggatacagagagtgtttggctaatggttcctgggccgcgcgcgtgaactactcagagtgtcaggaaattctcaatgaagagaagaaatccaaagtccactaccatgtggcggtgatcattaactatctgggacattgtatttcacttgttgcccttttggttgcttttgtccttttcctgcgcctgaggtctatccggtgcttgcgaaatatcattcactggaatctgatatctgcttttattctgcggaacgcaacttggttcgtcgtacagttaaccatgtccccagaagtacaccaatctaatgtgggctggtgccgactggtgaccgctgcttacaattactttcacgttaccaactttttttggatgtttggggaaggctgctatcttcacactgctatcgttctgacctatagcacagatcgcctgagaaaatggatgtttatctgcattgggtggggcgtgccctttccgattatcgtggcctgggcaatcgggaagctctactatgataacgaaaagtgttggtttggcaagcgccctggcgtgtacactgattacatttaccaggggcctatgattttggttctgctgattaatttcatttttctgttcaatattgtgaggatcctgatgacaaaactgagagctagtaccaccagcgaaacgatccagtatagaaaggcagtgaaagccacacttgtactgctcccactgcttggaattacatacatgttatttttcgtcaaccccggcgaagatgaagtgagccgggtggttttcatctacttcaacagtttcttagaaagcttccaaggcttttttgtatccgtcttctattgcttcctgaactccgaggtgcgctccgccatcaggaaacgatggcatagatggcaagacaaacatagtatccgcgctcgggttgctcgggccatgtctattcccactagccctacccgggtgtcgttccattcaataaagcaatccaccgctgtgtag

SEQ ID NO: 113097 - DNA, 1335 bp, Artificial Sequence
  Description of Artificial Sequence: Synthetic coding sequence
atgggtggacaccctcagctgagactcgtgaaggcccttctgctcctgggtcttaacccagtctctgcatcactccaggatcagcactgcgaatcgctctctcttgctagtaatatttccggcttacagtgcaacgcctcagttgacctcatcggcacctgttggccccgctcccctgctggtcagttggtcgtgaggccttgccctgctttcttctacggcgtgagatacaacacgactaataacggctaccgagagtgtctcgcgaacggtagctgggccgcacgcgttaactactccgagtgtcaggagatcctaaatgaggagaaaaaatctaaggtgcactaccacgtagccgttatcataaattacttgggccactgcatctccttggtggccctgctcgtggctttcgttctattcctcagactccgcccagggtgtactcattggggggatcaggccgatggcgcattggaggtgggtgcaccgtggtctggcgcaccttttcaagtgaggcgctcgattcggtgcttaagaaatattattcactggaatctcatatcggcgtttatactgcgcaacgccacatggttcgtcgttcaattgacaatgtctcccgaggtacaccagtccaatgtcggctggtgtcggctcgtgacagccgcgtataattattttcacgtcactaacttcttttggatgttcggtgaaggatgctaccttcataccgccatcgtgttgacctattctacagaccgtttacgcaaatggatgtttatctgcatcggatggggcgttccctttcctattattgtagcctgggccatcggtaagttgtactatgataacgagaagtgttggttcggcaagaggccgggagtatatacagactatatctatcagggacccatgatactggtgctgctgattaactttatctttcttttcaatatcgtgcgtattttgatgaccaagctacgcgcaagcactacctcagaaaccatccagtatcgcaaggctgttaaggcaaccctcgtgctcttacccctgctcggtatcacctatatgcttttttttgttaaccctggcgaggatgaggtcagccgtgtcgtcttcatttacttcaatagctttctagagagcttccaggggttttttgttagcgtcttttactgtttcctgaactccgaggtccgaagcgcaattaggaaacggtggcataggtggcaggacaaacacagcattagagctcgtgtcgccagggccatgagcataccaacttcccccacaagagtgtcttttcatagcatcaagcagagcacagccgtctag

SEQ ID NO: 113098 - DNA, 114 bp, Artificial Sequence
  Description of Artificial Sequence: Synthetic coding sequence
gtctatacagactatatctacttcaattcatttcttgagtcatttcagggcttctttgtctctgtgttttattgttttctgaatagtgaggtccgttctgccatccgcaagtag

SEQ ID NO: 113099 - DNA, 1206 bp, Artificial Sequence
  Description of Artificial Sequence: Synthetic coding sequence
atgggcggacatccccagcttaggctggtcaaagccctgctgctcctgggcctcaaccctgtgtctgcttccttacaggatcagcactgtgaatcactctcgctggcatccaatatcagcgggctgcagtgcaatgcttccgttgatttgatcggaacctgctggcccagaagcccagccgggcaactggtggtgcgaccctgccctgccttcttctatggcgttcggtataacactacaaacaacggatacagagagtgtctggccaatgggtcttgggctgcacgcgtaaattactcagagtgccaggagattttgaacgaggagaagaaaagtaaagtgcactatcatgtggctgtcattatcaactacctgggacactgtatctctctggtagccttgctagtagcattcgtccttttcctccggctgcgatcgatccgctgtttgcgaaacatcattcactggaatcttatttccgcctttatactgcgcaacgctacctggtttgtcgtacagctaaccatgtcacctgaggtgcatcagagcaatgttggctggtgccgcttagtcaccgctgcctacaactatttccatgtgaccaacttcttttggatgtttggggagggctgttacctgcacacagccatcgtcttaacctacagcacagatagactgcgcaagtggatgtttatctgtatcggatggggcgtgcccttccctatcatcgtagcctgggctattgggaaactgtactatgacaatgagaagtgttggtttggtaaacgtccaggggtctacactgattacatttatcagggacctatgattctggtgctcctaataaactttatattcctctttaatattgtgcgaatccttatgactaagcttagggcgagcaccactagcgaaacgattcagtatcggaaggctgtcaaagcaactttagtcctgctgccactcctgggcattacttacatgctctttttcgtcaaccccggggaggacgaagtttctcgggtggtctttatatattttaattctttcctggaaagtttccaggtacgttccgccatccgcaaaagatggcacagatggcaggacaagcacagcatcagggctagggtggcacgggccatgagcataccgacatctccaacacgggtcagcttccattccattaaacagtctactgccgtttag

SEQ ID NO: 113100 - DNA, 1194 bp, Artificial Sequence
  Description of Artificial Sequence: Synthetic coding sequence
atgggccgcgaaccttggccagaagatagggatctaggctttccccaattgttttgccaggggccctattcctactgtaacacgacccttgatcagatcggaacctgttggccgaggagtgcagctggagcactcgtggaaaggccttgtcccgaatactttaacggagtgaaatacaatacaacgcgtaacgcctatcgggagtgcctggaaaatggaacctgggcctctaagataaattattctcagtgcgaacctattctggatgacaagcaacgcaagtatgacctccattaccgaattgcactcgtcgtgaactatcttggccactgcgtgagtgtggccgccctcgtcgccgcctttctgcttttcttggccttacgctcaatccgctgtctacgaaatgtaatccactggaatctcatcactaccttcatcctgagaaacgtcatgtggttccttctccagctggtggaccatgaagttcatgagtctaatgaagtatggtgccgctgcattaccaccatcttcaactactttgtggtgacgaattttttttggatgttcgtcgaaggatgctatctgcacacagccatagtgatgacctactccacagaacgcctgaggaaatgcttattcctgttcatcgggtggtgcatcccattccccataatcgtagcgtgggctatcgggaaactgtactacgaaaacgagcagtgttggtttggcaaggagcccggggatctcgtggattacatttaccagggaccgattattctggttttattgattaactttgtgtttctcttcaatatcgtacggatcctgatgacaaaactacgagcctctacgactagtgaaaccattcagtatagaaaagccgttaaggcaactctcgtactgctgcctctgttggggataacctacatgctgttctttgtcaacccaggggaggacgacctgtcccaaattatgtttatctatttcaactccttcctacagtccttccagggcttctttgtgtcagtattttactgtttcttcaacggcgaagtgagatctgctgttcggaaacgctggcacagatggcaggatcaccactccctgagagttccaatggcaagggccatgtcgatacctactagtcctacacgcatctcttttcactccatcaaacagacagctgcagtatag

SEQ ID NO: 113101 - DNA, 1317 bp, Artificial Sequence
  Description of Artificial Sequence: Synthetic coding sequence
atgcggggccccagtggccctccagggctgctgtatgtgccgcacttgctcctgtgtttactttgtctcttgcctccccctctgcagtatgcagcaggtcaaagtcaaatgccaaaggatcagccactttgggcactgctcgaacagtactgccatacgattatgacgcttacgaacctcagcggaccctacagctattgtaatactaccctggaccagattggaacgtgctggccgcgcagcgcagctggcgcacttgtggagaggccctgtcctgaatatttcaatggcgtgaagtataatacaacacgcaatgcgtaccgtgaatgccttgagaatggtacctgggcctccaaaatcaattattcccagtgcgagcccatcctcgatgataagcagagaaaatatgacttgcattaccgcatcgcccttgtcgtgaattatctgggtcactgcgtgtccgtcgctgcgctggtggctgcattcctgctctttctggccctaagatcaatacggtgcttgcggaacgtcatccactggaatctgatcacgacattcatcctgaggaacgtaatgtggttcctcctccagcttgtggatcatgaggtccatgaaagcaacgaggtctggtgtcgatgtattacaaccatttttaattatttcgtggtgaccaattttttttggatgttcgtggaagggtgctatttacacaccgctatcgtgatgacctactcaaccgaaaggctacggaaatgccttttcctgtttataggctggtgcattcctttccccatcattgtggcctgggcgattggaaagctgtactatgagaacgaacaatgctggtttggcaaggagcctggcgacctagtagactatatctaccagggacctattatcctggtacttctcattaacttcgtttttctgttcaacatcgtaaggattttgatgacaaagcttcgcgcctctacaacttccgaaactatccaatataggaaggctgtaaaggccaccttagtgttgctgccactgctgggaatcacatatatgctgttcttcgtaaatcctggcgaagacgacctgtcccagataatgttcatttatttcaactctttcctacagtcttttcagggattcttcgtttctgtattttattgtttttttaacggcgaggttagatctgctgtcaggaagaggtggcaccgttggcaggatcatcattctctgcgagttcctatggctagggccatgagtatcccaacatcgcccacaaggatttcattccatagtataaaacaaacagccgccgtttag

SEQ ID NO: 113102 - DNA, 1236 bp, Artificial Sequence
  Description of Artificial Sequence: Synthetic coding sequence
atggacgccgccttgctccattcattacttgaggccaactgctcattggccctagccgaggagctgttactcgatggctggggaccaccgctggacccagaaggaccatatagctattgcaatactactttagatcagatcggaacgtgttggccaagaagcgctgcaggggcgcttgttgagcgtccttgtcccgagtacttcaacggggtgaagtacaacactacccgcaatgcctaccgggagtgcctcgagaatggcacctgggcttcgaagataaactattcccagtgtgagccgatccttgatgacaagcagaggaagtacgatctgcactatcggatcgccttggtagtgaattaccttgggcattgcgtctctgtcgccgctttggttgccgcctttctgctgtttctggccctccgatcgatcaggtgtctccggaacgtgatccactggaatctgattacaactttcattctcaggaacgtcatgtggtttctgctgcagttggtggatcacgaagttcatgagtccaacgaagtgtggtgtagatgcattaccacaatcttcaattatttcgtggtgaccaatttcttttggatgtttgtcgaaggctgctacttgcatactgcgatagtaatgacttatagtacagaacgccttcggaaatgcctcttcctgtttatcgggtggtgcatccctttccccatcatcgtggcttgggctataggcaagctctattatgagaacgagcaatgttggttcggcaaggagccgggcgatctggtagactacatctaccagggccctattattctcgtgctgcttatcaattttgtcttcctcttcaacatagtgagaattttaatgaccaaactcagggcttccacaacctctgaaacaatccagtaccgtaaggcagtgaaggcaactctcgtcctcttaccactgcttggcatcacttacatgttgttctttgtcaaccctggcgaagacgacctgagtcagattatgttcatatattttaattcctttcttcaatcctttcagggcttcttcgtttccgtattctactgcttctttaatggagaggtgcgctccgcagtgcggaagcgttggcatagatggcaggatcaccactctctccgggtgcccatggcgagagccatgagcatacctactagccccacccggatctctttccacagcattaagcagacggccgctgtgtag

SEQ ID NO: 113103 - DNA, 1113 bp, Artificial Sequence
  Description of Artificial Sequence: Synthetic coding sequence
atggatgcagcgcttctgcatagcctgctggaggctaattgtagcctggccctggcagaagagctattgctggatggttggggccccccactcgacccggaaggaccttatagttattgtaataccacactggaccagatcggcacttgctggccaagatccgctgccggcgctttagtggaacggccatgtcccgagtacttcaacggggtaaaatataacaccacacgtaacgcttaccgcgagtgtctggagaacgggacctgggcaagcaaaatcaactattctcagtgcgaacccattctggacgacaaacaacgcaaatatgatctgcattacaggatcgccctggtggtgaattacttggggcattgcgtctctgtggcagctctggtcgctgcctttttactgttccttgctctgcggtcgatcagatgcctgcggaacgtcatccactggaacttgatcaccacgtttattctccgaaatgtgatgtggtttctactgcagctggttgatcacgaagtccatgaatccaacgaggtgtggtgtaggtgtatcaccaccatcttcaactactttgtggtcacgaattttttctggatgtttgtagaggggtgctatctacacaccgcgatcgttatgacctactctaccgagagactgcgcaagtgtctattcctgttcatcggctggtgtatcccatttcctatcattgtggcctgggccatcggtaaactctattacgaaaacgaacagtgttggttcggaaaagaaccaggagacctagttgactatatttaccagggcccaatcattctggttctattaatcaacttcgtgtttctcttcaacattgtccggatcctcatgacaaaactgagagccagtacgacctctgaaactatccagtatcgcaaagccgtgaaggccactctggtgttactccccttgctggggatcacatacatgctgttcttcgtaaaccccggggaggatgatctgtcccagattatgtttatctatttcaatagtttcctacagtcgtttcagggatttttcgtatccgttttttactgtttctttaatggagaaggactggagccagtatag

SEQ ID NO: 113104 - DNA, 468 bp, Artificial Sequence
  Description of Artificial Sequence: Synthetic coding sequence
atgtatcgacataagaactcctggagactgggactgaaataccccccttcctccaaggaggaaacacaggtccctaagaccctgatctctggactgcctggacggaaatcatccagtcgtgtaggtgagaagttgcagtcagcccacaagatgccgctgagtcccggacttctcctgctgttgttgtccggcgccacagcaacggccgctctgcctctagaaggagggcctaccggaagagacagcgaacacatgcaggaagccgcagggataagaaagtcctcactgttaacgttcttggcatggtggttcgagtggacaagccaggcctccgcaggaccgttgattggcgaagaagcacgcgaagttgcccggcgccaggaaggcgctcctccccagcaatccgcaaggcgggaccgaatgccgtgccggaacttcttttggaagaccttttcatcatgcaagtag

SEQ ID NO: 113105 - DNA, 318 bp, Artificial Sequence
  Description of Artificial Sequence: Synthetic coding sequence
atgcctctgagtccaggcctgcttttgctgctcctcagtggcgccacagcgaccgccgccctgcctctcgaaggtgggcctactggcagggattcagagcatatgcaggaggcagccggcattagaaaatccagcctgttgacgtttttagcctggtggttcgaatggacctcacaggcaagcgccggacctctcatcggcgaagaggctcgcgaagtcgcccggcggcaggagggagctccaccacagcagagcgctagacgcgacaggatgccttgtagaaactttttttggaaaactttctcttcatgcaagtag

SEQ ID NO: 113106 - DNA, 1332 bp, Artificial Sequence
  Description of Artificial Sequence: Synthetic coding sequence
atggcggcttcacctcacacactatctagtaggcttcttaccggctgcgttggaggatccgtgtggtaccttgaacgccgaaccatacaggatagcccccacaaattccttcatctgctgaggaatgtaaacaagcaatggatcactttccagcactttagtttcctgaagaggatgtatgtgacccaactcaatcgatcccacaatcaacaagtgcgtcccaaaccggagcccgtggcatccccatttctggaaaaaacaagcagtgggcaggcaaaggcggagatctatgaaatgaggccattgtcacccccttcccttagcctgtcacgaaaacccaacgaaaaagaacttatagaactggagcccgattcagtcatagaagattccatcgacgtgggcaaggagaccaaggaggagaaacgttggaaggaaatgaaactccaggtgtatgacctaccagggatattagcacgcctgtctaagatcaagctcacagcccttgtggtgagtaccacagcagctggctttgcactggcacccggtcccttcgactggccatgttttctgctcacaagcgttgggaccgggctcgctagctgcgccgcaaatagtatcaaccaattcttcgaagtgccattcgactctaatatgaatagaacaaaaaaccggccactagttcgcggccagattagtcccttgctggccgtttcctttgcgacctgttgtgccgtcccgggggtcgcaatcctaactctgggtgtcaatcccctgacaggagccctgggtcttttcaatattttcctgtatacatgctgctataccccactgaagcgtattagcatcgcaaacacgtgggttggggcagtggttggcgccattccgccagtgatgggctggactgcagccactgggagtttagatgcaggggccttcttgctgggaggcatcctgtattcatggcagtttccacactttaacgccctgagttggggcttacgggaggattattcccgtggcggatactgtatgatgtccgtgactcacccaggtctgtgcaggagggtcgccttgcgccactgtttagccctgcttgttctgtccgctgccgcccccgtcctggacatcactacttggacatttcccatcatggcgctgcctatcaatgcatatatcagctatctgggcttccggttttacgtcgacgcagatcggcggagctctagacgattatttttttgtagtctgtggcacttgccactgctactgctgcttatgcttacctgcaagaggccttccggggggggggacgcaggcccgccacctagctag

SEQ ID NO: 113107 - DNA, 399 bp, Artificial Sequence
  Description of Artificial Sequence: Synthetic coding sequence
taacgcaatgtcaataagcagtggatcacctttcagcacttttcctttctgaagagaatgtacgtcactcagctcaatcgtagccataaccagcaggtccggcctaagccggaaccagtagcgagccccttccttgagaagacctcttctggtcaagctaaggctgaaatctacgagatgcggccactgagccctccttccttgtctttgagtaggaaacctaatgaaaaagaactaattgagctggaaccagactcagtgatcgaggattctattgacgttggcaaagagacaaaagaggaaaagcgttggaaggaaatgaaactgcaggtgtatgatctgcccggaatccttgctaggttatctaagattaaactcacaggaacattgttcttctag

SEQ ID NO: 113108 - DNA, 756 bp, Artificial Sequence
  Description of Artificial Sequence: Synthetic coding sequence
atgatatgtcaggagttttggcttgattaccccaagtcaaatagtcaattttttgaggtgcctttcgattcaaacatgaatcgaaccaagaatcgcccactggtcagaggacagatctcacctctcctcgcagtgagcttcgcaacctgctgcgccgtccccggcgtcgccattcttacattaggcgttaatccacttaccggggccctgggcctttttaacatcttcttatatacctgctgctataccccattaaaaagaattagtattgccaatacttgggtcggcgcagtggtgggcgctatcccccccgtgatgggatggactgccgccactggctctttggacgcaggcgccttcctgctgggtgggatcctatattcttggcagttccctcacttcaatgctttgtcttggggcctccgggaagactacagccgcggaggctattgcatgatgtccgtgacgcacccggggttgtgtcgccgggtggcgctgaggcattgcctcgctctgctggtcctgtccgccgccgcccctgtgctagatataacaacctggacatttcctattatggctctgcctattaacgcctacataagttacctagggtttaggttttatgtggacgccgatcgccggagcagcagaagactcttcttttgcagcctttggcacctgcccttgctgctactgctaatgttgacctgtaaacgcccatccggcggaggggacgccggtccccccccctcttag

SEQ ID NO: 113109 - DNA, 681 bp, Artificial Sequence
  Description of Artificial Sequence: Synthetic coding sequence
atgaataggaccaaaaatcgaccccttgtaagaggccagatatcaccattactggccgtgagcttcgcaacctgctgcgccgtacccggagtcgccatcttgaccttaggggtgaaccccttgacgggcgctctcgggctctttaacatttttctgtacacctgctgctacactcctctaaaacgcatctccattgccaatacatgggtaggagccgttgtgggagctatcccccctgtgatgggctggacggccgcaaccggcagcctggacgcaggcgcctttttgctgggcggtatcttgtattcttggcagttcccacatttcaatgcactctcttgggggttgagagaagactacagccgcgggggctactgtatgatgagcgttactcacccaggattatgcaggagggtggcattgcgtcactgcttagccttgttggtgctgtccgccgctgcaccggtcctcgacattaccacttggacctttccgatcatggctcttcctattaatgcgtacatctcttacttggggtttcgcttctatgtggacgccgaccgacgctccagcagaaggcttttcttttgttcactgtggcacctaccgttgctgctgctcttgatgctgacttgcaagcgcccaagtggcgggggcgacgctggcccgccgccaagctag

SEQ ID NO: 113110 - DNA, 831 bp, Artificial Sequence
  Description of Artificial Sequence: Synthetic coding sequence
atggggggactctggcgacctgggtggcgatgcgtgcccttttgcgggtggaggtggattcatcccggaagtccaacccgggctgcggagcgcgttgaaccatttctaagacctgagtggagcgggactggtggcgccgagcgaggcctcaggtggttgggaacatggaagcgttgctcactgagagcaagacatccagccctgcagccccctagaaggcccaagtccagcaaccctttcactcgggcgcaggaggaggaaaggcgccggcagaataagacaacattgacttacgtggcggcagtcgccgtagggatgctgggcgcgtcttatgctgccgtcccactgtaccggctttactgtcagactacagggcttggcggctccgccgtcgcgggccacgcatccgacaagattgagaacatggtcccagtcaaagaccgaattatcaaaatctctttcaacgcagacgtgcacgcctccctacagtggaacttccggcctcagcaaaccgagatttatgttgtgcccggcgagaccgctctggccttctatagagcaaagaaccctacagacaagcctgtgatcgggattagcacatacaatattgtgcccttcgaggcgggtcaatatttcaataagatccagtgtttttgctttgaggaacagcggctcaatcctcaggaagaggtggacatgccagtctttttctatattgatcccgagtttgctgaggatcctaggatgatcaaggtggacctgattacactgtcgtataccttcttcgaggcaaaagaaggccacaaactccccgttcccggctacaattag

SEQ ID NO: 113111 - DNA, 1233 bp, Artificial Sequence
  Description of Artificial Sequence: Synthetic coding sequence
atgcaacggctcctattcccaccgctgagggcactgaagggtcgacaatacctgcccctcctcgcaccacgggccgctccacgggcacagtgcgattgtatcagaaggccacttagacctggacagtactccactatctcagaggttgctctgcagtcgggcaggggcactgtatccctgccttcaaaagccgccgaacgcgtggtggggcgctggctgctcgtctgtagtggcaccgtggccggcgccgtgatcctgggcggggttactagactgaccgagtccggtttgagcatggttgactggcatctcatcaaggaaatgaagccccctacctcccaggaggaatgggaagccgagttccaaagataccagcagttcccagagttcaagatcctgaatcatgacatgactctcacagagtttaagtttatctggtacatggaatactctcaccggatgtggggacggcttgtgggtctcgtgtatatcctcccagccgcttatttctggagaaaaggctggttgagcagggggatgaaggggcgagtcttggctctctgcggactggtctgtttccagggcctactggggtggtatatggtaaagtccggactggaggaaaaatctgattctcatgacattccccgcgtgagtcagtaccgtcttgcagcgcatctcggcagcgccttagtgctgtactgcgcaagcctttggactagcctttccctgctgctgccacctcacaagctgccggagacgcatcagttgttgcagctgaggcgcttcgcacacggcacagcagggctcgtgtttctcactgccctttccggcgcttttgtggccggcctggacgcaggactggtttacaatagttttccgaagatgggcgagtcatggatcccagaggacctgtttaccttctcccccatcctcaggaatgtcttcgaaaatcccactatggttcagtttgaccaccgcatcctcgggatcacgtcagtgactgcaatcacagtattatactttttgtctaggagaataccactgcctagacggacaaaaatggcggccgtcaccctactagcactagcctacacgcaggtcggactcggaatttctaccctgctcatgtacgtgccaacaccgcttgcggctacacatcagtctggtagtctcgcactgctgaccggcgcactttggcttatgaacgaactacggagagtccctaagtag

SEQ ID NO: 113112 - DNA, 1167 bp, Artificial Sequence
  Description of Artificial Sequence: Synthetic coding sequence
atgcagcggctgctgtttcctcccctgcgggccctgaaaggaaggcagtatctgcccctgttggctccgcgcgctgcacctagagcgcagtgtgattgtattcgccggcccctacgcccaggacagtactccacaatctctgaagtggcattacagagtggcaggggcacggtctctctgccatctaaagcagctgagcgcgtcgtcgggcgttggcttctggtctgttcaggcactgtcgctggcgctgtgatccttggcggcgtcactcgattaactgagtccgggctgagcatggtggactggcacctgatcaaagaaatgaagccgcccacctcacaagaagaatgggaggccgaattccagagataccagcagttccccgagtttaaaattctgaaccatgatatgacgcttactgaatttaagtttatttggtatatggaatattcccacagaatgtggggccgactggtaggcttggtgtatattcttcctgctgcttacttctggcgtaagggctggctctcccgggggatgaaggggagagtcctagccctctgtgggcttgtgtgtttccaaggcctcctcggttggtatatggtgaagtctgggctagaggaaaagtctgactctcacgacattccccgcgtgagccagtaccggctggcagcccatctcggttcggcacttgtcctctattgtgcttcactgtggacctctctgtctctgctcctgccccctcataaattaccagagactcaccagctcctgcaactccggcgtttcgcacatggtaccgccggccttgtgttcctcaccgctctgagcggggcattcgtagctggtctagacgccgggctagtttacaacagctttccgaagatgggcgaatcgtggatccctgaggacttattcaccttctcaccgatcttgcggaacgtgtttgagaaccctacgatggtccagttcgaccataggatcttgggcatcacttcggtgaccgcaattacagtgctgtatttcctgagcaggaggatccccctacctcgcagaacaaagatggctgccgtgactctgctggctctggcctacacccaaggcccagttctgtttaatttcactttcaaaatatctgacttggacgaaggtattcggaatatctag

SEQ ID NO: 113113 - DNA, 192 bp, Artificial Sequence
  Description of Artificial Sequence: Synthetic coding sequence
atgcccggcctggtggacagcaatcctgccccccctgaatcacaggaaaagaagcctttaaagccctgttgtgcctgccccgaaaccaagaaagcccgagatgcctgcattattgagaagggagaagagcattgtggccaccttattgaagcacacaaggagtgcatgagggcgctgggattcaagatttag

SEQ ID NO: 113114 - DNA, 192 bp, Artificial Sequence
  Description of Artificial Sequence: Synthetic coding sequence
atgccaggccttgtggactctaatcctgccccccctgaaagtcaagaaaagaagcctttgaagccgtgttgcgcctgtccggagactaaaaaagcaagggacgcttgcattatcgagaaaggggaagagcactgtggacatcttatcgaggctcacaaagaatgtatgcgagcgctgggttttaaaatatag

SEQ ID NO: 113115 - DNA, 297 bp, Artificial Sequence
  Description of Artificial Sequence: Synthetic coding sequence
atgcctgggttggtggattccaatcctgccccacccgagtctcaggagaagaagcctctgaaaccctgctgtgcatgtcctgaaactaagaaggcccgtgacgcctggttccggggacgggtgtcggtggacctgtcaagatccctggtgcctggtaatgatggggagagaggggagcgccaagctagcactacccactcctttttacagataataattgagaagggggaagagcactgtggacatctcatagaggcccacaaggaatgtatgcgcgctttgggatttaagatttag

SEQ ID NO: 113116 - DNA, 192 bp, Artificial Sequence
  Description of Artificial Sequence: Synthetic coding sequence
atgcccggtctggtggactcaaatccggctccacctgagagccaggaaaaaaagcccctgaagccctgctgcgcttgccctgaaaccaagaaggcccgcgacgcttgcataattgagaagggtgaggaacactgcggccacctgatcgaggcgcataaggagtgtatgagagctttgggattcaaaatctag

SEQ ID NO: 113117 - DNA, 1098 bp, Artificial Sequence
  Description of Artificial Sequence: Synthetic coding sequence
atggcacttcttctgtgcttcgttctcctttgtggcgtggtggatttcgcgaggtccctcagcatcacgactcctgaagagatgatagagaaggccaagggagagaccgcttatctgccttgtaagtttaccttgagccccgaggaccaaggaccccttgatatagagtggctgattagtcccgcagataaccagaaagtggatcaggttatcatactttacagtggcgacaagatctacgacgactattatcccgatctgaaaggtcgcgttcacttcacgtccaatgatttgaagtccggggacgcgagcatcaatgtgaccaatttgcaactgtctgatatcggaacgtatcagtgtaaagtgaagaaggcgcccggtgttgccaacaagaaaatccatctcgtggtcctggtgaagccttctggcgccagatgttacgttgacggctctgaagaaatcggaagcgactttaaaattaaatgcgaaccgaaggagggaagcctgcctctacagtacgagtggcagaagttgtcagacagccagaagatgcctacctcctggctggctgagatgaccagctcagtgattagcgtcaagaacgccagctctgagtactccggaacatactcttgtaccgtccgaaatcgggttggaagcgaccagtgcctgctccggcttaatgtcgtcccccccagcaacaaagctggtctgatcgccggggctatcatcgggacgcttttggccctggctctaatcgggttaattattttctgctgccggaagaaaaggagggaggaaaagtacgaaaaagaggtgcatcacgacatcagggaggatgtgcctcctccgaaatcacggacttcgaccgccagatcctatatcggatcaaaccattcaagcctcggatcgatgtcccctagcaacatggagggatactcaaaaacacaatataaccaggtcccatctgaagattttgagagaaccccacagagcccaacactgccccctgcaaaagttgccgcccccaacttaagcagaatgggcgccatccccgtgatgattccagctcagtccaaggacgggtcaatcgtgtag

SEQ ID NO: 113118 - DNA, 975 bp, Artificial Sequence
  Description of Artificial Sequence: Synthetic coding sequence
atggcgctccttctgtgttttgtgctcctatgcggggtggtcgacttcgctaggtccctatccatcactactcctgaggaaatgatcgagaaagccaagggcgaaacagcttacctcccttgcaaatttacgctgagtccagaagaccaggggccattggatattgaatggctcatatcacctgccgataatcaaaaagtcgatcaggtgataatactgtactccggagacaaaatatacgacgactactaccccgacctcaaggggcgtgtgcactttacgtctaatgacctgaagtctggagacgccagcatcaacgtgacaaatcttcaattgagcgatattggtacatatcaatgcaaagtgaaaaaggcccccggggtcgccaacaaaaaaatacacctggtcgtcctggtcaagcccagcggggctcgctgctatgtggacggtagcgaggaaataggctcagactttaagattaaatgtgaacccaaagaaggctccttgcctctccagtacgagtggcagaaactttcagactctcagaagatgcccaccagctggttagctgcctctaacaaggctgggctgatcgcaggagccataatcggaacacttctcgccctcgccttaattggcttaatcattttttgttgcaggaagaaaaggagagaggagaagtacgaaaaggaagttcaccacgatatacgggaggatgttcctccccctaaatccaggacctccactgccaggtcgtacatcggctcgaatcattcaagccttggaagcatgtctccgtccaacatggaaggctactcaaaaacacagtataatcaagtcccatcagaggactttgaacggactccgcagtccccaaccctaccgccagctaaggtggccgcacctaatctctctcggatgggagcaattcctgtcatgattccggcgcaatccaaggacgggagtatcgtctag

SEQ ID NO: 113119 - DNA, 603 bp, Artificial Sequence
  Description of Artificial Sequence: Synthetic coding sequence
atggccttgctgctctgcttcgtactgctgtgtggcgttgtggattttgcccggagtctctccatcacaactcccgaagagatgatcgagaaagctaagggtgagacagcctacctgccatgcaaatttaccctgagtcccgaggaccagggtcctctggatattgaatggcttatctctccagccgacaatcaaaaagtggaccaggttatcatcttgtactcaggagataagatctatgatgactattatcccgatttgaaggggagggtgcatttcacctctaacgatctgaaatcgggagacgctagcatcaacgtgaccaacctccagctgtctgacattggcacctaccagtgcaaggtgaagaaggcaccaggagtcgccaataagaagattcatttggtcgttttgggtaaaatgtgtcatttgcagcgggccgtacgacctctgccggaagccaccagtgccgtaattatccatccttggggtccctgcctgttgccgacttggaaagacattccccgcttatccatcacaaagtatcaggtgaaaaccctgaacgccctgctgagggtccgcctgtcccaccttttgaggtag

SEQ ID NO: 113120 - DNA, 759 bp, Artificial Sequence
  Description of Artificial Sequence: Synthetic coding sequence
atggccctacttttatgtttcgtcctgctttgtggggttgttgactttgctcgctccctctccattaccactccggaggagatgatagagaaggcgaagggtgagacagcctacctgccctgtaaattcaccctttctccagaagatcaaggtcctctggacatcgaatggttgataagtcccgccgacaaccagaaggtggatcaagtgataatcctgtacagtggggacaagatttacgatgattactatcccgatttgaaagggagagttcactttacctcaaatgaccttaagtctggtgatgcttctattaatgtcactaatctgcagctctcggatatcggcacctaccaatgcaaggtaaagaaggcgcccggggtagcaaataaaaaaatccacctcgtggtcctggtcaaaccctctggcgctaggtgctatgtcgatggctcagaagagatcggctccgatttcaaaattaagtgtgagcctaaggaagggagtctccctctccagtatgagtggcaaaagctttcagacagccaaaagatgccaacctcttggctggccggcaaaatgtgccacctccagcgagcagtgcggcctttgccagaagcaacctctgccgtgatcatccatccttggggcccttgtctcttgcctacctggaaagatatcccacgcttgagtattactaagtaccaggtgaagacactcaacgccctgctgagagtccgactgagccatcttcttcgctag
